United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 47

SEQ ID NO: 1681965 - RNA, 14 nt, Salmonella enterica enterica serovar Typhi
ugcuguaaccccug

SEQ ID NO: 1681966 - RNA, 13 nt, Salmonella enterica enterica serovar Typhi
ugcuguaaaauau

SEQ ID NO: 1681967 - RNA, 20 nt, Salmonella enterica enterica serovar Typhi
ugcuggucagcaacgccucc

SEQ ID NO: 1681968 - RNA, 19 nt, Salmonella enterica enterica serovar Typhi
ugcuggugaagacgcugca

SEQ ID NO: 1681969 - RNA, 16 nt, Salmonella enterica enterica serovar Typhi
aaaugucuguuuguuc

SEQ ID NO: 1681970 - RNA, 20 nt, Salmonella enterica enterica serovar Typhi
ugcugugccaguaccgccgc

SEQ ID NO: 1681971 - RNA, 23 nt, Salmonella enterica enterica serovar Typhi
ugcuguuaccguaagcgggaugg

SEQ ID NO: 1681972 - RNA, 21 nt, Salmonella enterica enterica serovar Typhi
ugcugugcagacugcacuucc

SEQ ID NO: 1681973 - RNA, 14 nt, Salmonella enterica enterica serovar Typhi
ugcugugcauaucu

SEQ ID NO: 1681974 - RNA, 23 nt, Salmonella enterica enterica serovar Typhi
ugcugucgcaauuuaccuauuuc

SEQ ID NO: 1681975 - RNA, 17 nt, Salmonella enterica enterica serovar Typhi
ugcuguuuauggcgcuu

SEQ ID NO: 1681976 - RNA, 21 nt, Salmonella enterica enterica serovar Typhi
ugcuguuucaguaaaucccgc

SEQ ID NO: 1681977 - RNA, 21 nt, Salmonella enterica enterica serovar Typhi
ugcuguuuuuuguugauuuua

SEQ ID NO: 1681978 - RNA, 15 nt, Salmonella enterica enterica serovar Typhi
ugcuuaaaggcggca

SEQ ID NO: 1681979 - RNA, 17 nt, Salmonella enterica enterica serovar Typhi
ugcuuaaugcucugcug

SEQ ID NO: 1681980 - RNA, 19 nt, Salmonella enterica enterica serovar Typhi
ugcuuaccguuuaccucau

SEQ ID NO: 1681981 - RNA, 19 nt, Salmonella enterica enterica serovar Typhi
ugcuuacggcaaacugaaa

SEQ ID NO: 1681982 - RNA, 22 nt, Salmonella enterica enterica serovar Typhi
ugcuuagcuggccaaucagcgg

SEQ ID NO: 1681983 - RNA, 18 nt, Salmonella enterica enterica serovar Typhi
ugcuuauugucgccgccg

SEQ ID NO: 1681984 - RNA, 17 nt, Salmonella enterica enterica serovar Typhi
ugcuuaugaucgcccag

SEQ ID NO: 1681985 - RNA, 18 nt, Salmonella enterica enterica serovar Typhi
ugcuucagguuaagugac

SEQ ID NO: 1681986 - RNA, 22 nt, Salmonella enterica enterica serovar Typhi
ugcuucacguuuuccaggugcu

SEQ ID NO: 1681987 - RNA, 18 nt, Salmonella enterica enterica serovar Typhi
ugcuucacggaaggggcc

SEQ ID NO: 1681988 - RNA, 21 nt, Salmonella enterica enterica serovar Typhi
ugcuucacgggguugaaguag

SEQ ID NO: 1681989 - RNA, 13 nt, Salmonella enterica enterica serovar Typhi
ugcuucagccaga

SEQ ID NO: 1681990 - RNA, 20 nt, Salmonella enterica enterica serovar Typhi
ugcuucagacaacgccgccu

SEQ ID NO: 1681991 - RNA, 16 nt, Salmonella enterica enterica serovar Typhi
ugcuucgucccugcau

SEQ ID NO: 1681992 - RNA, 13 nt, Salmonella enterica enterica serovar Typhi
ugcuuccagcucc

SEQ ID NO: 1681993 - RNA, 14 nt, Salmonella enterica enterica serovar Typhi
ugcuuccagcucca

SEQ ID NO: 1681994 - RNA, 19 nt, Salmonella enterica enterica serovar Typhi
ugcuuccagcuccauccac

SEQ ID NO: 1681995 - RNA, 14 nt, Salmonella enterica enterica serovar Typhi
ugcuuuaaaugccu

SEQ ID NO: 1681996 - RNA, 12 nt, Salmonella enterica enterica serovar Typhi
ugcuuuaauauu

SEQ ID NO: 1681997 - RNA, 16 nt, Salmonella enterica enterica serovar Typhi
ugcuuucaauaaauca

SEQ ID NO: 1681998 - RNA, 13 nt, Salmonella enterica enterica serovar Typhi
ugcuuuauaaaaa

SEQ ID NO: 1681999 - RNA, 14 nt, Salmonella enterica enterica serovar Typhi
ugcuuuaauauuca

SEQ ID NO: 1682000 - RNA, 15 nt, Salmonella enterica enterica serovar Typhi
ugcuuucuggaugau

SEQ ID NO: 1682001 - RNA, 22 nt, Salmonella enterica enterica serovar Typhi
ugcuuugaucacccacaccaca

SEQ ID NO: 1682002 - RNA, 21 nt, Salmonella enterica enterica serovar Typhi
ugcuuuuaauagcguagccug

SEQ ID NO: 1682003 - RNA, 21 nt, Salmonella enterica enterica serovar Typhi
ugcuuuuucagcgaggaaaac

SEQ ID NO: 1682004 - RNA, 20 nt, Salmonella enterica enterica serovar Typhi
ugcuuuuuauuuuucuggcu

SEQ ID NO: 1682005 - RNA, 18 nt, Salmonella enterica enterica serovar Typhi
ugcuuuuggcaacggcag

SEQ ID NO: 1682006 - RNA, 17 nt, Salmonella enterica enterica serovar Typhi
ugcuuuuuuucucuguc

SEQ ID NO: 1682007 - RNA, 12 nt, Salmonella enterica enterica serovar Typhi
uggaaaaaaaga

SEQ ID NO: 1682008 - RNA, 13 nt, Salmonella enterica enterica serovar Typhi
uggaaaaaaagaa

SEQ ID NO: 1682009 - RNA, 22 nt, Salmonella enterica enterica serovar Typhi
uggaaaaaucuguaggcccggu

SEQ ID NO: 1682010 - RNA, 22 nt, Salmonella enterica enterica serovar Typhi
uggaaaaccccaucccggcaac

SEQ ID NO: 1682011 - RNA, 15 nt, Salmonella enterica enterica serovar Typhi
uggaaaauaauaauc

SEQ ID NO: 1682012 - RNA, 17 nt, Salmonella enterica enterica serovar Typhi
uggaaaaagaccaauac

SEQ ID NO: 1682013 - RNA, 14 nt, Salmonella enterica enterica serovar Typhi
uggaaaauuucagu

SEQ ID NO: 1682014 - RNA, 21 nt, Salmonella enterica enterica serovar Typhi
uggaaacagccaaucauaaac

SEQ ID NO: 1682015 - RNA, 19 nt, Salmonella enterica enterica serovar Typhi
uggaaaugcguggcauuaa

SEQ ID NO: 1682016 - RNA, 19 nt, Salmonella enterica enterica serovar Typhi
uggaaauaaucuguagauu

SEQ ID NO: 1682017 - RNA, 21 nt, Salmonella enterica enterica serovar Typhi
uggaaauaccgguaaucaagc

SEQ ID NO: 1682018 - RNA, 15 nt, Salmonella enterica enterica serovar Typhi
uggaaauauucucag

SEQ ID NO: 1682019 - RNA, 18 nt, Salmonella enterica enterica serovar Typhi
uggaaauauucucagcca

SEQ ID NO: 1682020 - RNA, 15 nt, Salmonella enterica enterica serovar Typhi
uggaaccgccggaga

SEQ ID NO: 1682021 - RNA, 18 nt, Salmonella enterica enterica serovar Typhi
uggaaccaaacaccagau

SEQ ID NO: 1682022 - RNA, 15 nt, Salmonella enterica enterica serovar Typhi
uggaaauucagggug

SEQ ID NO: 1682023 - RNA, 19 nt, Salmonella enterica enterica serovar Typhi
uggaagaacuuccccauca

SEQ ID NO: 1682024 - RNA, 17 nt, Salmonella enterica enterica serovar Typhi
uggaagcgaucaagaca

SEQ ID NO: 1682025 - RNA, 19 nt, Salmonella enterica enterica serovar Typhi
uggaaggaagggcgcugcc

SEQ ID NO: 1682026 - RNA, 15 nt, Salmonella enterica enterica serovar Typhi
uggaccgcagcuuau

SEQ ID NO: 1682027 - RNA, 14 nt, Salmonella enterica enterica serovar Typhi
uggaccagccaggc

SEQ ID NO: 1682028 - RNA, 13 nt, Salmonella enterica enterica serovar Typhi
uggacaaggcacc

SEQ ID NO: 1682029 - RNA, 19 nt, Salmonella enterica enterica serovar Typhi
uggacaaaauuuuuuauca

SEQ ID NO: 1682030 - RNA, 19 nt, Salmonella enterica enterica serovar Typhi
uggacagguaaaccgguca

SEQ ID NO: 1682031 - RNA, 14 nt, Salmonella enterica enterica serovar Typhi
uggaaguacuggau

SEQ ID NO: 1682032 - RNA, 23 nt, Salmonella enterica enterica serovar Typhi
uggaaguagucgcgaaugcgcaa

SEQ ID NO: 1682033 - RNA, 20 nt, Salmonella enterica enterica serovar Typhi
uggaaguugaagaaaaaccc

SEQ ID NO: 1682034 - RNA, 18 nt, Salmonella enterica enterica serovar Typhi
uggaauaaacgguaagag

SEQ ID NO: 1682035 - RNA, 22 nt, Salmonella enterica enterica serovar Typhi
uggaaguaugccucgcgcacca

SEQ ID NO: 1682036 - RNA, 15 nt, Salmonella enterica enterica serovar Typhi
uggaaugcccacucc

SEQ ID NO: 1682037 - RNA, 15 nt, Salmonella enterica enterica serovar Typhi
uggacaaaaaaggaa

SEQ ID NO: 1682038 - RNA, 22 nt, Salmonella enterica enterica serovar Typhi
uggacaaaaaaggaaaaugacg

SEQ ID NO: 1682039 - RNA, 14 nt, Salmonella enterica enterica serovar Typhi
uggaauuuuuccag

SEQ ID NO: 1682040 - RNA, 19 nt, Salmonella enterica enterica serovar Typhi
ugcgucgcgcuuucaaucg

SEQ ID NO: 1682041 - RNA, 23 nt, Salmonella enterica enterica serovar Typhi
ugcgucaugauuaacgucacgau

SEQ ID NO: 1682042 - RNA, 14 nt, Salmonella enterica enterica serovar Typhi
ugcguccgccgcua

SEQ ID NO: 1682043 - RNA, 21 nt, Salmonella enterica enterica serovar Typhi
ugcguuuaaagagaugacugg

SEQ ID NO: 1682044 - RNA, 15 nt, Salmonella enterica enterica serovar Typhi
ugcggucuccugaac

SEQ ID NO: 1682045 - RNA, 18 nt, Salmonella enterica enterica serovar Typhi
ugcgggaacagauaaaug

SEQ ID NO: 1682046 - RNA, 15 nt, Salmonella enterica enterica serovar Typhi
ugcgucaccgggcug

SEQ ID NO: 1682047 - RNA, 23 nt, Salmonella enterica enterica serovar Typhi
ugcgucaaucaggaaagagccgc

SEQ ID NO: 1682048 - RNA, 18 nt, Salmonella enterica enterica serovar Typhi
ugcgguuacguccggcau

SEQ ID NO: 1682049 - RNA, 22 nt, Salmonella enterica enterica serovar Typhi
ugcgccggcugcgcugccagcu

SEQ ID NO: 1682050 - RNA, 16 nt, Salmonella enterica enterica serovar Typhi
ugcgcugucaccagca

SEQ ID NO: 1682051 - RNA, 21 nt, Salmonella enterica enterica serovar Typhi
ugcggaacaccagcgccgcgg

SEQ ID NO: 1682052 - RNA, 14 nt, Salmonella enterica enterica serovar Typhi
ugcggcaagcgcgc

SEQ ID NO: 1682053 - RNA, 17 nt, Salmonella enterica enterica serovar Typhi
ugcggaauacacgaaca

SEQ ID NO: 1682054 - RNA, 21 nt, Salmonella enterica enterica serovar Typhi
ugcgcuuuccgccaugaaaaa

SEQ ID NO: 1682055 - RNA, 16 nt, Salmonella enterica enterica serovar Typhi
ugcgcuuuacuguucc

SEQ ID NO: 1682056 - RNA, 17 nt, Salmonella enterica enterica serovar Typhi
ugcggcuauauaaaauc

SEQ ID NO: 1682057 - RNA, 13 nt, Salmonella enterica enterica serovar Typhi
ugcggcaucagau

SEQ ID NO: 1682058 - RNA, 23 nt, Salmonella enterica enterica serovar Typhi
ugcggcaauggccgcagcgccau

SEQ ID NO: 1682059 - RNA, 22 nt, Salmonella enterica enterica serovar Typhi
ugcuaccguuuucgccuuugcg

SEQ ID NO: 1682060 - RNA, 18 nt, Salmonella enterica enterica serovar Typhi
ugcguuuugugcggccua

SEQ ID NO: 1682061 - RNA, 14 nt, Salmonella enterica enterica serovar Typhi
ugcuaucccaggcg

SEQ ID NO: 1682062 - RNA, 12 nt, Salmonella enterica enterica serovar Typhi
ugcuaucaggau

SEQ ID NO: 1682063 - RNA, 14 nt, Salmonella enterica enterica serovar Typhi
ugcuaucaaacuga

SEQ ID NO: 1682064 - RNA, 18 nt, Salmonella enterica enterica serovar Typhi
ugcuaugauaagccugac

SEQ ID NO: 1682065 - RNA, 16 nt, Salmonella enterica enterica serovar Typhi
ugcuauccgccgccag

SEQ ID NO: 1682066 - RNA, 21 nt, Salmonella enterica enterica serovar Typhi
ugcucaaccaguaccgggccu

SEQ ID NO: 1682067 - RNA, 22 nt, Salmonella enterica enterica serovar Typhi
ugcucaaccaguaccgggccuc

SEQ ID NO: 1682068 - RNA, 16 nt, Salmonella enterica enterica serovar Typhi
ugcucaggaucaauuc

SEQ ID NO: 1682069 - RNA, 18 nt, Salmonella enterica enterica serovar Typhi
ugcucaauaagccaugug

SEQ ID NO: 1682070 - RNA, 17 nt, Salmonella enterica enterica serovar Typhi
ugcucaaucacuuuugc

SEQ ID NO: 1682071 - RNA, 22 nt, Salmonella enterica enterica serovar Typhi
ugcucacccauuuuauccucuu

SEQ ID NO: 1682072 - RNA, 12 nt, Salmonella enterica enterica serovar Typhi
ugcucagccccu

SEQ ID NO: 1682073 - RNA, 19 nt, Salmonella enterica enterica serovar Typhi
ugcucgaaauccucacggu

SEQ ID NO: 1682074 - RNA, 14 nt, Salmonella enterica enterica serovar Typhi
ugcucgacaauaaa

SEQ ID NO: 1682075 - RNA, 13 nt, Salmonella enterica enterica serovar Typhi
ugcucccacagcu

SEQ ID NO: 1682076 - RNA, 20 nt, Salmonella enterica enterica serovar Typhi
ugcuccaguuguuccagcag

SEQ ID NO: 1682077 - RNA, 15 nt, Salmonella enterica enterica serovar Typhi
ugcgcacgccagcgg

SEQ ID NO: 1682078 - RNA, 19 nt, Salmonella enterica enterica serovar Typhi
ugcgccaacugcauuucau

SEQ ID NO: 1682079 - RNA, 20 nt, Salmonella enterica enterica serovar Typhi
ugcgccaacgaagagaccug

SEQ ID NO: 1682080 - RNA, 13 nt, Salmonella enterica enterica serovar Typhi
ugcgccaacguca

SEQ ID NO: 1682081 - RNA, 16 nt, Salmonella enterica enterica serovar Typhi
ugcgauggccgcugac

SEQ ID NO: 1682082 - RNA, 19 nt, Salmonella enterica enterica serovar Typhi
ugcgaucugugucguccag

SEQ ID NO: 1682083 - RNA, 21 nt, Salmonella enterica enterica serovar Typhi
ugcgaucugugucguccaggc

SEQ ID NO: 1682084 - RNA, 19 nt, Salmonella enterica enterica serovar Typhi
ugcgaucuccuuuaaugaa

SEQ ID NO: 1682085 - RNA, 19 nt, Salmonella enterica enterica serovar Typhi
ugcgaucucauaccaggug

SEQ ID NO: 1682086 - RNA, 23 nt, Salmonella enterica enterica serovar Typhi
ugcgaucguaaucacccgcuucc

SEQ ID NO: 1682087 - RNA, 23 nt, Salmonella enterica enterica serovar Typhi
ugcgccauugccguaucagcaag

SEQ ID NO: 1682088 - RNA, 22 nt, Salmonella enterica enterica serovar Typhi
ugcgccauccaccaggcaugca

SEQ ID NO: 1682089 - RNA, 21 nt, Salmonella enterica enterica serovar Typhi
ugcgccaucggcgcugauugc

SEQ ID NO: 1682090 - RNA, 20 nt, Salmonella enterica enterica serovar Typhi
ugcgccagccagcucaccag

SEQ ID NO: 1682091 - RNA, 23 nt, Salmonella enterica enterica serovar Typhi
ugcgccagccagucgccaggcaa

SEQ ID NO: 1682092 - RNA, 17 nt, Salmonella enterica enterica serovar Typhi
ugcgccaggcagcaccu

SEQ ID NO: 1682093 - RNA, 18 nt, Salmonella enterica enterica serovar Typhi
ugcgccagcgugcuaagc

SEQ ID NO: 1682094 - RNA, 23 nt, Salmonella enterica enterica serovar Typhi
ugcgccgacaucgccaccgcaug

SEQ ID NO: 1682095 - RNA, 16 nt, Salmonella enterica enterica serovar Typhi
ugccuugcgaauggag

SEQ ID NO: 1682096 - RNA, 17 nt, Salmonella enterica enterica serovar Typhi
ugccuuguaggccugau

SEQ ID NO: 1682097 - RNA, 18 nt, Salmonella enterica enterica serovar Typhi
ugccuuuaacaaauuaaa

SEQ ID NO: 1682098 - RNA, 19 nt, Salmonella enterica enterica serovar Typhi
ugccuuuaacaaauuaaau

SEQ ID NO: 1682099 - RNA, 23 nt, Salmonella enterica enterica serovar Typhi
ugccuuuaacaaauuaaauccug

SEQ ID NO: 1682100 - RNA, 22 nt, Salmonella enterica enterica serovar Typhi
ugccuuuuacaauaaccggcag

SEQ ID NO: 1682101 - RNA, 16 nt, Salmonella enterica enterica serovar Typhi
ugccuuuauuucaagc

SEQ ID NO: 1682102 - RNA, 18 nt, Salmonella enterica enterica serovar Typhi
ugcgaaaauacucccggc

SEQ ID NO: 1682103 - RNA, 16 nt, Salmonella enterica enterica serovar Typhi
ugcgaauaacaucauc

SEQ ID NO: 1682104 - RNA, 14 nt, Salmonella enterica enterica serovar Typhi
ugcgacaagcucau

SEQ ID NO: 1682105 - RNA, 22 nt, Salmonella enterica enterica serovar Typhi
ugcgacaacaaguccaaguaug

SEQ ID NO: 1682106 - RNA, 16 nt, Salmonella enterica enterica serovar Typhi
ugcgauagcccggcau

SEQ ID NO: 1682107 - RNA, 17 nt, Salmonella enterica enterica serovar Typhi
ugcgagcuuuccaccag

SEQ ID NO: 1682108 - RNA, 17 nt, Salmonella enterica enterica serovar Typhi
ugcgaguagcaaauccc

SEQ ID NO: 1682109 - RNA, 11 nt, Salmonella enterica enterica serovar Typhi
ugcgaggcgcg

SEQ ID NO: 1682110 - RNA, 15 nt, Salmonella enterica enterica serovar Typhi
ugcgaggucugguca

SEQ ID NO: 1682111 - RNA, 16 nt, Salmonella enterica enterica serovar Typhi
ugccgggugcggcgcu

SEQ ID NO: 1682112 - RNA, 23 nt, Salmonella enterica enterica serovar Typhi
ugccggguucguuaacccggcau

SEQ ID NO: 1682113 - RNA, 17 nt, Salmonella enterica enterica serovar Typhi
ugccggugcgagaaaaa

SEQ ID NO: 1682114 - RNA, 13 nt, Salmonella enterica enterica serovar Typhi
ugccggucggcgu

SEQ ID NO: 1682115 - RNA, 18 nt, Salmonella enterica enterica serovar Typhi
ugccggugcgagaaaaag

SEQ ID NO: 1682116 - RNA, 15 nt, Salmonella enterica enterica serovar Typhi
ugccgguuaacucuu

SEQ ID NO: 1682117 - RNA, 13 nt, Salmonella enterica enterica serovar Typhi
ugccgucguacuc

SEQ ID NO: 1682118 - RNA, 21 nt, Salmonella enterica enterica serovar Typhi
ugccguccggucuacaaguga

SEQ ID NO: 1682119 - RNA, 19 nt, Salmonella enterica enterica serovar Typhi
ugccgguuuuagcaaugau

SEQ ID NO: 1682120 - RNA, 23 nt, Salmonella enterica enterica serovar Typhi
ugccgguuuuagcaaugaugaug

SEQ ID NO: 1682121 - RNA, 11 nt, Salmonella enterica enterica serovar Typhi
ugccagagaga

SEQ ID NO: 1682122 - RNA, 17 nt, Salmonella enterica enterica serovar Typhi
ugccagacgggccaggc

SEQ ID NO: 1682123 - RNA, 18 nt, Salmonella enterica enterica serovar Typhi
ugccuucaaauauauuga

SEQ ID NO: 1682124 - RNA, 14 nt, Salmonella enterica enterica serovar Typhi
ugccuuauccggcc

SEQ ID NO: 1682125 - RNA, 23 nt, Salmonella enterica enterica serovar Typhi
ugccuuccgggcggcugucccag

SEQ ID NO: 1682126 - RNA, 14 nt, Salmonella enterica enterica serovar Typhi
ugccuucgccgccg

SEQ ID NO: 1682127 - RNA, 15 nt, Salmonella enterica enterica serovar Typhi
ugccuucugaaaguu

SEQ ID NO: 1682128 - RNA, 18 nt, Salmonella enterica enterica serovar Typhi
ugccuguugcgggccagc

SEQ ID NO: 1682129 - RNA, 18 nt, Salmonella enterica enterica serovar Typhi
ugccuguguaucgcccug

SEQ ID NO: 1682130 - RNA, 18 nt, Salmonella enterica enterica serovar Typhi
ugccugucgucaccugua

SEQ ID NO: 1682131 - RNA, 17 nt, Salmonella enterica enterica serovar Typhi
ugccugacagcaaugag

SEQ ID NO: 1682132 - RNA, 22 nt, Salmonella enterica enterica serovar Typhi
ugccugccgucgcggcuuucag

SEQ ID NO: 1682133 - RNA, 14 nt, Salmonella enterica enterica serovar Typhi
ugccugccgccucc

SEQ ID NO: 1682134 - RNA, 20 nt, Salmonella enterica enterica serovar Typhi
ugccucggguggcaucugau

SEQ ID NO: 1682135 - RNA, 17 nt, Salmonella enterica enterica serovar Typhi
ugccucguuucccucau

SEQ ID NO: 1682136 - RNA, 18 nt, Salmonella enterica enterica serovar Typhi
ugccgugaauauucagau

SEQ ID NO: 1682137 - RNA, 20 nt, Salmonella enterica enterica serovar Typhi
ugccgugaauauucagaucg

SEQ ID NO: 1682138 - RNA, 23 nt, Salmonella enterica enterica serovar Typhi
uguaaagaaugaaaaaaaaauua

SEQ ID NO: 1682139 - RNA, 16 nt, Salmonella enterica enterica serovar Typhi
uguaaacguuccugcc

SEQ ID NO: 1682140 - RNA, 16 nt, Salmonella enterica enterica serovar Typhi
ugguugagauccauaa

SEQ ID NO: 1682141 - RNA, 18 nt, Salmonella enterica enterica serovar Typhi
ugguugaaccgacggugc

SEQ ID NO: 1682142 - RNA, 22 nt, Salmonella enterica enterica serovar Typhi
ugguucauagaguguuggucuu

SEQ ID NO: 1682143 - RNA, 23 nt, Salmonella enterica enterica serovar Typhi
ugguucccugaccuuccauccac

SEQ ID NO: 1682144 - RNA, 21 nt, Salmonella enterica enterica serovar Typhi
ugguugccgcaaaugaccaga

SEQ ID NO: 1682145 - RNA, 12 nt, Salmonella enterica enterica serovar Typhi
ugguuucuuuua

SEQ ID NO: 1682146 - RNA, 23 nt, Salmonella enterica enterica serovar Typhi
ugguugugccaguaaucccgguc

SEQ ID NO: 1682147 - RNA, 15 nt, Salmonella enterica enterica serovar Typhi
ugguuguagcacagc

SEQ ID NO: 1682148 - RNA, 22 nt, Salmonella enterica enterica serovar Typhi
uguacaucacauugccccagcc

SEQ ID NO: 1682149 - RNA, 19 nt, Salmonella enterica enterica serovar Typhi
uguacagcaauaaaaggaa

SEQ ID NO: 1682150 - RNA, 17 nt, Salmonella enterica enterica serovar Typhi
uguaauuucauaauauu

SEQ ID NO: 1682151 - RNA, 21 nt, Salmonella enterica enterica serovar Typhi
uguaauucucccaaauuuuuu

SEQ ID NO: 1682152 - RNA, 15 nt, Salmonella enterica enterica serovar Typhi
uguaauugcgccagg

SEQ ID NO: 1682153 - RNA, 22 nt, Salmonella enterica enterica serovar Typhi
uguaauucucacagaaucauca

SEQ ID NO: 1682154 - RNA, 14 nt, Salmonella enterica enterica serovar Typhi
uguaauugacaugg

SEQ ID NO: 1682155 - RNA, 14 nt, Salmonella enterica enterica serovar Typhi
uguaauuuauaaag

SEQ ID NO: 1682156 - RNA, 16 nt, Salmonella enterica enterica serovar Typhi
uguacgugaagggaau

SEQ ID NO: 1682157 - RNA, 15 nt, Salmonella enterica enterica serovar Typhi
uguacuccugauagg

SEQ ID NO: 1682158 - RNA, 13 nt, Salmonella enterica enterica serovar Typhi
uguacgcccagcc

SEQ ID NO: 1682159 - RNA, 22 nt, Salmonella enterica enterica serovar Typhi
uguaagggaggugcucucccag

SEQ ID NO: 1682160 - RNA, 20 nt, Salmonella enterica enterica serovar Typhi
uguaagcaauuaauauuuaa

SEQ ID NO: 1682161 - RNA, 18 nt, Salmonella enterica enterica serovar Typhi
uguaagagguauccugaa

SEQ ID NO: 1682162 - RNA, 23 nt, Salmonella enterica enterica serovar Typhi
uguaagaggcauaaaaaaaagcc

SEQ ID NO: 1682163 - RNA, 20 nt, Salmonella enterica enterica serovar Typhi
uguaauguuuucugccagca

SEQ ID NO: 1682164 - RNA, 20 nt, Salmonella enterica enterica serovar Typhi
uguaauggcgcucuuuucca

SEQ ID NO: 1682165 - RNA, 18 nt, Salmonella enterica enterica serovar Typhi
ugguucaacaucagcgcu

SEQ ID NO: 1682166 - RNA, 18 nt, Salmonella enterica enterica serovar Typhi
ugguuagaauaccugccu

SEQ ID NO: 1682167 - RNA, 14 nt, Salmonella enterica enterica serovar Typhi
ugguuauccagcaa

SEQ ID NO: 1682168 - RNA, 19 nt, Salmonella enterica enterica serovar Typhi
ugguuauacgguaauaacu

SEQ ID NO: 1682169 - RNA, 16 nt, Salmonella enterica enterica serovar Typhi
ugguguuaguuucuau

SEQ ID NO: 1682170 - RNA, 20 nt, Salmonella enterica enterica serovar Typhi
ugguuaaauuaaauaacaaa

SEQ ID NO: 1682171 - RNA, 22 nt, Salmonella enterica enterica serovar Typhi
ugguuaaauucauauuuaaaua

SEQ ID NO: 1682172 - RNA, 14 nt, Salmonella enterica enterica serovar Typhi
ugguuaauucaaaa

SEQ ID NO: 1682173 - RNA, 21 nt, Salmonella enterica enterica serovar Typhi
ugguuaacgccguuaccagca

SEQ ID NO: 1682174 - RNA, 21 nt, Salmonella enterica enterica serovar Typhi
ugguuaacaauauugcgcuua

SEQ ID NO: 1682175 - RNA, 15 nt, Salmonella enterica enterica serovar Typhi
uggugugaacaucac

SEQ ID NO: 1682176 - RNA, 18 nt, Salmonella enterica enterica serovar Typhi
uggugucucgucgccagg

SEQ ID NO: 1682177 - RNA, 15 nt, Salmonella enterica enterica serovar Typhi
uggugugcauggugu

SEQ ID NO: 1682178 - RNA, 22 nt, Salmonella enterica enterica serovar Typhi
ugguggugccguuacuguuuua

SEQ ID NO: 1682179 - RNA, 14 nt, Salmonella enterica enterica serovar Typhi
ugguggucuauggu

SEQ ID NO: 1682180 - RNA, 23 nt, Salmonella enterica enterica serovar Typhi
ugguggauauccagcauaauaug

SEQ ID NO: 1682181 - RNA, 21 nt, Salmonella enterica enterica serovar Typhi
uggugcugugccugccugugg

SEQ ID NO: 1682182 - RNA, 21 nt, Salmonella enterica enterica serovar Typhi
uggugggacuguucagcugac

SEQ ID NO: 1682183 - RNA, 22 nt, Salmonella enterica enterica serovar Typhi
uggugcucaggaucaauucuga

SEQ ID NO: 1682184 - RNA, 23 nt, Salmonella enterica enterica serovar Typhi
uggugcggcgcacugccugaugg

SEQ ID NO: 1682185 - RNA, 12 nt, Salmonella enterica enterica serovar Typhi
uggugcaucugg

SEQ ID NO: 1682186 - RNA, 12 nt, Salmonella enterica enterica serovar Typhi
uggugcauuuuu

SEQ ID NO: 1682187 - RNA, 15 nt, Salmonella enterica enterica serovar Typhi
uggugcagccgccau

SEQ ID NO: 1682188 - RNA, 23 nt, Salmonella enterica enterica serovar Typhi
uggugaucuggccaauuuuucac

SEQ ID NO: 1682189 - RNA, 19 nt, Salmonella enterica enterica serovar Typhi
uggugagguugagauccug

SEQ ID NO: 1682190 - RNA, 19 nt, Salmonella enterica enterica serovar Typhi
ugggucacgauaaccaggu

SEQ ID NO: 1682191 - RNA, 14 nt, Salmonella enterica enterica serovar Typhi
uggguaucuucauc

SEQ ID NO: 1682192 - RNA, 18 nt, Salmonella enterica enterica serovar Typhi
uggguauccacgccuggc

SEQ ID NO: 1682193 - RNA, 16 nt, Salmonella enterica enterica serovar Typhi
uggucugaaucugcuc

SEQ ID NO: 1682194 - RNA, 18 nt, Salmonella enterica enterica serovar Typhi
uguauuugaauuuuagau

SEQ ID NO: 1682195 - RNA, 16 nt, Salmonella enterica enterica serovar Typhi
ugucaaucgccugcug

SEQ ID NO: 1682196 - RNA, 11 nt, Salmonella enterica enterica serovar Typhi
ugucaccagca

SEQ ID NO: 1682197 - RNA, 16 nt, Salmonella enterica enterica serovar Typhi
uguauuguucaugcaa

SEQ ID NO: 1682198 - RNA, 17 nt, Salmonella enterica enterica serovar Typhi
uguauuguaauaacgaa

SEQ ID NO: 1682199 - RNA, 23 nt, Salmonella enterica enterica serovar Typhi
uguagcaacccuggcgcuuuaaa

SEQ ID NO: 1682200 - RNA, 13 nt, Salmonella enterica enterica serovar Typhi
uguauccacccgg

SEQ ID NO: 1682201 - RNA, 20 nt, Salmonella enterica enterica serovar Typhi
uguaucgcgcggauuccgcc

SEQ ID NO: 1682202 - RNA, 19 nt, Salmonella enterica enterica serovar Typhi
uguaucacgacuuauugca

SEQ ID NO: 1682203 - RNA, 23 nt, Salmonella enterica enterica serovar Typhi
uguaucugcugacacccucugcg

SEQ ID NO: 1682204 - RNA, 20 nt, Salmonella enterica enterica serovar Typhi
uguccaugacgaccacagcc

SEQ ID NO: 1682205 - RNA, 23 nt, Salmonella enterica enterica serovar Typhi
uguccauguuuuauacucaaaaa

SEQ ID NO: 1682206 - RNA, 18 nt, Salmonella enterica enterica serovar Typhi
uguccauugcgagaaaaa

SEQ ID NO: 1682207 - RNA, 19 nt, Salmonella enterica enterica serovar Typhi
ugucagaucgcccggauca

SEQ ID NO: 1682208 - RNA, 15 nt, Salmonella enterica enterica serovar Typhi
ugucagggcggaaca

SEQ ID NO: 1682209 - RNA, 15 nt, Salmonella enterica enterica serovar Typhi
uguccugaaggacaa

SEQ ID NO: 1682210 - RNA, 16 nt, Salmonella enterica enterica serovar Typhi
uguccuauugcaacgc

SEQ ID NO: 1682211 - RNA, 20 nt, Salmonella enterica enterica serovar Typhi
uguccgccuuaucaggccug

SEQ ID NO: 1682212 - RNA, 13 nt, Salmonella enterica enterica serovar Typhi
uguccgcugcugu

SEQ ID NO: 1682213 - RNA, 15 nt, Salmonella enterica enterica serovar Typhi
uguccgaugcagaca

SEQ ID NO: 1682214 - RNA, 13 nt, Salmonella enterica enterica serovar Typhi
uguccgacgacaa

SEQ ID NO: 1682215 - RNA, 16 nt, Salmonella enterica enterica serovar Typhi
uguccgguguccauca

SEQ ID NO: 1682216 - RNA, 18 nt, Salmonella enterica enterica serovar Typhi
uguccgucuuuucugucg

SEQ ID NO: 1682217 - RNA, 16 nt, Salmonella enterica enterica serovar Typhi
uguccggcgacuccag

SEQ ID NO: 1682218 - RNA, 19 nt, Salmonella enterica enterica serovar Typhi
uguccggcgacuccagaau

SEQ ID NO: 1682219 - RNA, 23 nt, Salmonella enterica enterica serovar Typhi
uguccggcgcaaucuuugccgca

SEQ ID NO: 1682220 - RNA, 21 nt, Salmonella enterica enterica serovar Typhi
ugucgaucaucagacccgcau

SEQ ID NO: 1682221 - RNA, 22 nt, Salmonella enterica enterica serovar Typhi
ugucgaugagcucguuauaagc

SEQ ID NO: 1682222 - RNA, 15 nt, Salmonella enterica enterica serovar Typhi
ugucgauaaacucau

SEQ ID NO: 1682223 - RNA, 12 nt, Salmonella enterica enterica serovar Typhi
ugucgccaauaa

SEQ ID NO: 1682224 - RNA, 20 nt, Salmonella enterica enterica serovar Typhi
ugucgauuuccgguuccagc

SEQ ID NO: 1682225 - RNA, 19 nt, Salmonella enterica enterica serovar Typhi
ugucgaaauugccgcccgu

SEQ ID NO: 1682226 - RNA, 17 nt, Salmonella enterica enterica serovar Typhi
ugucgacaauaaauugc

SEQ ID NO: 1682227 - RNA, 14 nt, Salmonella enterica enterica serovar Typhi
ugucgaauuccgcc

SEQ ID NO: 1682228 - RNA, 17 nt, Salmonella enterica enterica serovar Typhi
ugucgaccgcuccacuc

SEQ ID NO: 1682229 - RNA, 15 nt, Salmonella enterica enterica serovar Typhi
uguccuuuacugcgc

SEQ ID NO: 1682230 - RNA, 18 nt, Salmonella enterica enterica serovar Typhi
uguccuuucugcugccgc

SEQ ID NO: 1682231 - RNA, 22 nt, Salmonella enterica enterica serovar Typhi
uguccuuugcuacaccccuucu

SEQ ID NO: 1682232 - RNA, 15 nt, Salmonella enterica enterica serovar Typhi
ugucgaaaccagcau

SEQ ID NO: 1682233 - RNA, 15 nt, Salmonella enterica enterica serovar Typhi
ugucgucgauuuucu

SEQ ID NO: 1682234 - RNA, 22 nt, Salmonella enterica enterica serovar Typhi
ugucguuaaugcucuuaaaaug

SEQ ID NO: 1682235 - RNA, 23 nt, Salmonella enterica enterica serovar Typhi
ugucggauggcggcguaaacgcc

SEQ ID NO: 1682236 - RNA, 18 nt, Salmonella enterica enterica serovar Typhi
ugucggccugauuucuga

SEQ ID NO: 1682237 - RNA, 13 nt, Salmonella enterica enterica serovar Typhi
ugucucuccagua

SEQ ID NO: 1682238 - RNA, 13 nt, Salmonella enterica enterica serovar Typhi
ugucuccucagca

SEQ ID NO: 1682239 - RNA, 17 nt, Salmonella enterica enterica serovar Typhi
ugucucgucgccagggc

SEQ ID NO: 1682240 - RNA, 18 nt, Salmonella enterica enterica serovar Typhi
ugucuucgucaaugcugc

SEQ ID NO: 1682241 - RNA, 15 nt, Salmonella enterica enterica serovar Typhi
ugucugaauauuaaa

SEQ ID NO: 1682242 - RNA, 13 nt, Salmonella enterica enterica serovar Typhi
ugucuuuauuacg

SEQ ID NO: 1682243 - RNA, 15 nt, Salmonella enterica enterica serovar Typhi
ugucuugcuaucaaa

SEQ ID NO: 1682244 - RNA, 16 nt, Salmonella enterica enterica serovar Typhi
ugugauacgcuuuagg

SEQ ID NO: 1682245 - RNA, 15 nt, Salmonella enterica enterica serovar Typhi
ugugaucaccgcccu

SEQ ID NO: 1682246 - RNA, 12 nt, Salmonella enterica enterica serovar Typhi
ugucuuuuucuc

SEQ ID NO: 1682247 - RNA, 17 nt, Salmonella enterica enterica serovar Typhi
ugugccggaaaucgcgg

SEQ ID NO: 1682248 - RNA, 17 nt, Salmonella enterica enterica serovar Typhi
ugugccaguaaucccgg

SEQ ID NO: 1682249 - RNA, 21 nt, Salmonella enterica enterica serovar Typhi
ugugccagcucguuauuuccg

SEQ ID NO: 1682250 - RNA, 20 nt, Salmonella enterica enterica serovar Typhi
ugugccaguaccgccgccgg

SEQ ID NO: 1682251 - RNA, 22 nt, Salmonella enterica enterica serovar Typhi
ugugauugcagauaauuuugca

SEQ ID NO: 1682252 - RNA, 16 nt, Salmonella enterica enterica serovar Typhi
ugugauuuugcuggug

SEQ ID NO: 1682253 - RNA, 22 nt, Salmonella enterica enterica serovar Typhi
ugugaucgccgcgaggaaaauc

SEQ ID NO: 1682254 - RNA, 13 nt, Salmonella enterica enterica serovar Typhi
ugugaauaaagga

SEQ ID NO: 1682255 - RNA, 21 nt, Salmonella enterica enterica serovar Typhi
ugugauccgcccccuccagua

SEQ ID NO: 1682256 - RNA, 17 nt, Salmonella enterica enterica serovar Typhi
ugugaucugguuuggua

SEQ ID NO: 1682257 - RNA, 14 nt, Salmonella enterica enterica serovar Typhi
ugggcgcaacaguc

SEQ ID NO: 1682258 - RNA, 15 nt, Salmonella enterica enterica serovar Typhi
ugggcgcaacaguca

SEQ ID NO: 1682259 - RNA, 17 nt, Salmonella enterica enterica serovar Typhi
ugggcgcaacagucagc

SEQ ID NO: 1682260 - RNA, 15 nt, Salmonella enterica enterica serovar Typhi
ugggcugagaaaaau

SEQ ID NO: 1682261 - RNA, 19 nt, Salmonella enterica enterica serovar Typhi
uggguaaauaccaggcacu

SEQ ID NO: 1682262 - RNA, 22 nt, Salmonella enterica enterica serovar Typhi
ugggguugcuucuguccuuucu

SEQ ID NO: 1682263 - RNA, 16 nt, Salmonella enterica enterica serovar Typhi
ugggcuugcuuuucuc

SEQ ID NO: 1682264 - RNA, 13 nt, Salmonella enterica enterica serovar Typhi
uggggaaccuggc

SEQ ID NO: 1682265 - RNA, 15 nt, Salmonella enterica enterica serovar Typhi
uggggaaccuggcag

SEQ ID NO: 1682266 - RNA, 17 nt, Salmonella enterica enterica serovar Typhi
uggggaaccuggcagaa

SEQ ID NO: 1682267 - RNA, 22 nt, Salmonella enterica enterica serovar Typhi
ugggcaggagaugaccugccca

SEQ ID NO: 1682268 - RNA, 19 nt, Salmonella enterica enterica serovar Typhi
ugggcagugcucgccaaaa

SEQ ID NO: 1682269 - RNA, 13 nt, Salmonella enterica enterica serovar Typhi
ugggccagcagcg

SEQ ID NO: 1682270 - RNA, 17 nt, Salmonella enterica enterica serovar Typhi
ugggccagcagcgcauc

SEQ ID NO: 1682271 - RNA, 20 nt, Salmonella enterica enterica serovar Typhi
ugggcagugcucgccaaaac

SEQ ID NO: 1682272 - RNA, 20 nt, Salmonella enterica enterica serovar Typhi
uggcugaggccgcucgccau

SEQ ID NO: 1682273 - RNA, 15 nt, Salmonella enterica enterica serovar Typhi
uggcuggccagggca

SEQ ID NO: 1682274 - RNA, 15 nt, Salmonella enterica enterica serovar Typhi
uggcucuugguuuua

SEQ ID NO: 1682275 - RNA, 13 nt, Salmonella enterica enterica serovar Typhi
uggcugagaaaaa

SEQ ID NO: 1682276 - RNA, 14 nt, Salmonella enterica enterica serovar Typhi
uggcugagaaaaau

SEQ ID NO: 1682277 - RNA, 14 nt, Salmonella enterica enterica serovar Typhi
uggcucggccuguc

SEQ ID NO: 1682278 - RNA, 15 nt, Salmonella enterica enterica serovar Typhi
uggcucccgcagcca

SEQ ID NO: 1682279 - RNA, 12 nt, Salmonella enterica enterica serovar Typhi
uggcuguuuccc

SEQ ID NO: 1682280 - RNA, 21 nt, Salmonella enterica enterica serovar Typhi
ugggaaaauuaaucccaaccc

SEQ ID NO: 1682281 - RNA, 19 nt, Salmonella enterica enterica serovar Typhi
ugggaaauaacguuacauu

SEQ ID NO: 1682282 - RNA, 15 nt, Salmonella enterica enterica serovar Typhi
uggcuggcauauugc

SEQ ID NO: 1682283 - RNA, 16 nt, Salmonella enterica enterica serovar Typhi
uggcuggggcguuauc

SEQ ID NO: 1682284 - RNA, 19 nt, Salmonella enterica enterica serovar Typhi
uggcugucguuucauguaa

SEQ ID NO: 1682285 - RNA, 18 nt, Salmonella enterica enterica serovar Typhi
ugggacauaauugcugcc

SEQ ID NO: 1682286 - RNA, 15 nt, Salmonella enterica enterica serovar Typhi
uggcgcgccacuucu

SEQ ID NO: 1682287 - RNA, 15 nt, Salmonella enterica enterica serovar Typhi
uggcgccagccuguc

SEQ ID NO: 1682288 - RNA, 21 nt, Salmonella enterica enterica serovar Typhi
uggcgcggggaacacuaaaac

SEQ ID NO: 1682289 - RNA, 17 nt, Salmonella enterica enterica serovar Typhi
uggcgcgucacaacagc

SEQ ID NO: 1682290 - RNA, 23 nt, Salmonella enterica enterica serovar Typhi
uggcgcggacgcuuaccgggccu

SEQ ID NO: 1682291 - RNA, 14 nt, Salmonella enterica enterica serovar Typhi
uggcgcgaaaacag

SEQ ID NO: 1682292 - RNA, 13 nt, Salmonella enterica enterica serovar Typhi
uggcguaaauauu

SEQ ID NO: 1682293 - RNA, 23 nt, Salmonella enterica enterica serovar Typhi
uggcggcguccggcacgcgcagc

SEQ ID NO: 1682294 - RNA, 17 nt, Salmonella enterica enterica serovar Typhi
uggcuaucuuuauguca

SEQ ID NO: 1682295 - RNA, 20 nt, Salmonella enterica enterica serovar Typhi
uggcucaagauucaguucca

SEQ ID NO: 1682296 - RNA, 16 nt, Salmonella enterica enterica serovar Typhi
uggcucaauccaggug

SEQ ID NO: 1682297 - RNA, 18 nt, Salmonella enterica enterica serovar Typhi
uggcucagauugaacgcu

SEQ ID NO: 1682298 - RNA, 15 nt, Salmonella enterica enterica serovar Typhi
uggcuaauuucaauu

SEQ ID NO: 1682299 - RNA, 20 nt, Salmonella enterica enterica serovar Typhi
uggcgucgacgugucuaugc

SEQ ID NO: 1682300 - RNA, 22 nt, Salmonella enterica enterica serovar Typhi
uggcguccggccacuauuucgg

SEQ ID NO: 1682301 - RNA, 17 nt, Salmonella enterica enterica serovar Typhi
uggcguagauauucccc

SEQ ID NO: 1682302 - RNA, 16 nt, Salmonella enterica enterica serovar Typhi
uggcguagucucccuc

SEQ ID NO: 1682303 - RNA, 23 nt, Salmonella enterica enterica serovar Typhi
uggcguacgcagaucguauccag

SEQ ID NO: 1682304 - RNA, 13 nt, Salmonella enterica enterica serovar Typhi
uggcgcagcgcgg

SEQ ID NO: 1682305 - RNA, 12 nt, Salmonella enterica enterica serovar Typhi
uggcgcagcgcu

SEQ ID NO: 1682306 - RNA, 15 nt, Salmonella enterica enterica serovar Typhi
uggcgcaaugucccu

SEQ ID NO: 1682307 - RNA, 13 nt, Salmonella enterica enterica serovar Typhi
uggcgagcaacuu

SEQ ID NO: 1682308 - RNA, 13 nt, Salmonella enterica enterica serovar Typhi
uggcgauuuccag

SEQ ID NO: 1682309 - RNA, 14 nt, Salmonella enterica enterica serovar Typhi
uggcgauuuccagc

SEQ ID NO: 1682310 - RNA, 21 nt, Salmonella enterica enterica serovar Typhi
uggcgacgccagccggaaaag

SEQ ID NO: 1682311 - RNA, 21 nt, Salmonella enterica enterica serovar Typhi
uggcgacgacgcuguuuaugc

SEQ ID NO: 1682312 - RNA, 19 nt, Salmonella enterica enterica serovar Typhi
uggcgacgaucagcgccac

SEQ ID NO: 1682313 - RNA, 16 nt, Salmonella enterica enterica serovar Typhi
uggcgacgaccgguca

SEQ ID NO: 1682314 - RNA, 15 nt, Salmonella enterica enterica serovar Typhi
uggcgaccagcagau

SEQ ID NO: 1682315 - RNA, 17 nt, Salmonella enterica enterica serovar Typhi
uggcgaauuuacgggcg

SEQ ID NO: 1682316 - RNA, 14 nt, Salmonella enterica enterica serovar Typhi
uggcgaccgggucg

SEQ ID NO: 1682317 - RNA, 11 nt, Salmonella enterica enterica serovar Typhi
uggccugcugg

SEQ ID NO: 1682318 - RNA, 19 nt, Salmonella enterica enterica serovar Typhi
uggccugcucaauacuuuc

SEQ ID NO: 1682319 - RNA, 13 nt, Salmonella enterica enterica serovar Typhi
uggccuucuccac

SEQ ID NO: 1682320 - RNA, 15 nt, Salmonella enterica enterica serovar Typhi
uggccgaauagcuga

SEQ ID NO: 1682321 - RNA, 13 nt, Salmonella enterica enterica serovar Typhi
uggacggcaucag

SEQ ID NO: 1682322 - RNA, 16 nt, Salmonella enterica enterica serovar Typhi
uggacggcaucaggaa

SEQ ID NO: 1682323 - RNA, 19 nt, Salmonella enterica enterica serovar Typhi
uggacgcgaaugucauccg

SEQ ID NO: 1682324 - RNA, 21 nt, Salmonella enterica enterica serovar Typhi
uggacguggguuucaauauag

SEQ ID NO: 1682325 - RNA, 19 nt, Salmonella enterica enterica serovar Typhi
uggagaggccaccagcgcc

SEQ ID NO: 1682326 - RNA, 20 nt, Salmonella enterica enterica serovar Typhi
uggagagcaucaucugccau

SEQ ID NO: 1682327 - RNA, 14 nt, Salmonella enterica enterica serovar Typhi
uggagcgagcuggu

SEQ ID NO: 1682328 - RNA, 20 nt, Salmonella enterica enterica serovar Typhi
uggaguacgggcagaugguc

SEQ ID NO: 1682329 - RNA, 18 nt, Salmonella enterica enterica serovar Typhi
uggaguagauguagcuga

SEQ ID NO: 1682330 - RNA, 19 nt, Salmonella enterica enterica serovar Typhi
uggagguuauccugaaagg

SEQ ID NO: 1682331 - RNA, 13 nt, Salmonella enterica enterica serovar Typhi
uggagguuguuuu

SEQ ID NO: 1682332 - RNA, 17 nt, Salmonella enterica enterica serovar Typhi
uggaggaacagcgccgu

SEQ ID NO: 1682333 - RNA, 16 nt, Salmonella enterica enterica serovar Typhi
uggaucaucggcucag

SEQ ID NO: 1682334 - RNA, 20 nt, Salmonella enterica enterica serovar Typhi
uggaucacuuuugccgucag

SEQ ID NO: 1682335 - RNA, 16 nt, Salmonella enterica enterica serovar Typhi
uggaucccccuggccc

SEQ ID NO: 1682336 - RNA, 23 nt, Salmonella enterica enterica serovar Typhi
uggaugcccaccugaaaaagggu

SEQ ID NO: 1682337 - RNA, 13 nt, Salmonella enterica enterica serovar Typhi
uggaugcguucaa

SEQ ID NO: 1682338 - RNA, 16 nt, Salmonella enterica enterica serovar Typhi
uggauacguuccagca

SEQ ID NO: 1682339 - RNA, 14 nt, Salmonella enterica enterica serovar Typhi
uggauaccgcgcca

SEQ ID NO: 1682340 - RNA, 18 nt, Salmonella enterica enterica serovar Typhi
uggauaauugcucugcca

SEQ ID NO: 1682341 - RNA, 18 nt, Salmonella enterica enterica serovar Typhi
uggauaaggcgugagcca

SEQ ID NO: 1682342 - RNA, 21 nt, Salmonella enterica enterica serovar Typhi
uggauagcaccauaaacggca

SEQ ID NO: 1682343 - RNA, 15 nt, Salmonella enterica enterica serovar Typhi
uggauaaauaggcug

SEQ ID NO: 1682344 - RNA, 19 nt, Salmonella enterica enterica serovar Typhi
uggauaacgaaaaggguca

SEQ ID NO: 1682345 - RNA, 18 nt, Salmonella enterica enterica serovar Typhi
uggagucugaaaauaauu

SEQ ID NO: 1682346 - RNA, 21 nt, Salmonella enterica enterica serovar Typhi
uggcaaguaugaaaagcgcgu

SEQ ID NO: 1682347 - RNA, 17 nt, Salmonella enterica enterica serovar Typhi
uggcaagauuaaccagc

SEQ ID NO: 1682348 - RNA, 17 nt, Salmonella enterica enterica serovar Typhi
uggcaacggcagccagc

SEQ ID NO: 1682349 - RNA, 21 nt, Salmonella enterica enterica serovar Typhi
uggcaagaccgauagagacug

SEQ ID NO: 1682350 - RNA, 20 nt, Salmonella enterica enterica serovar Typhi
uggcaagaaccgcuuuuccu

SEQ ID NO: 1682351 - RNA, 13 nt, Salmonella enterica enterica serovar Typhi
uggcacuggcagc

SEQ ID NO: 1682352 - RNA, 21 nt, Salmonella enterica enterica serovar Typhi
uggcacuggcagccucguccu

SEQ ID NO: 1682353 - RNA, 14 nt, Salmonella enterica enterica serovar Typhi
uggcagacagccau

SEQ ID NO: 1682354 - RNA, 20 nt, Salmonella enterica enterica serovar Typhi
uggcacuuuccgguuuccau

SEQ ID NO: 1682355 - RNA, 15 nt, Salmonella enterica enterica serovar Typhi
uggcagugauggaug

SEQ ID NO: 1682356 - RNA, 15 nt, Salmonella enterica enterica serovar Typhi
uggcagaugaacaua

SEQ ID NO: 1682357 - RNA, 15 nt, Salmonella enterica enterica serovar Typhi
uggcagauaaaccac

SEQ ID NO: 1682358 - RNA, 16 nt, Salmonella enterica enterica serovar Typhi
uggcagaccguggccg

SEQ ID NO: 1682359 - RNA, 15 nt, Salmonella enterica enterica serovar Typhi
uggauggacuguuuc

SEQ ID NO: 1682360 - RNA, 15 nt, Salmonella enterica enterica serovar Typhi
uggaugguuucuucg

SEQ ID NO: 1682361 - RNA, 22 nt, Salmonella enterica enterica serovar Typhi
uggaugguuucuucgcuggcgg

SEQ ID NO: 1682362 - RNA, 22 nt, Salmonella enterica enterica serovar Typhi
uggauuaaaaaaggcagaagaa

SEQ ID NO: 1682363 - RNA, 17 nt, Salmonella enterica enterica serovar Typhi
uggcaaaacgcauccag

SEQ ID NO: 1682364 - RNA, 22 nt, Salmonella enterica enterica serovar Typhi
uggcaaaaaaggccagacucau

SEQ ID NO: 1682365 - RNA, 20 nt, Salmonella enterica enterica serovar Typhi
uggcaaaaggggcguuucuc

SEQ ID NO: 1682366 - RNA, 20 nt, Salmonella enterica enterica serovar Typhi
uggauucaugaucuuuccuu

SEQ ID NO: 1682367 - RNA, 20 nt, Salmonella enterica enterica serovar Typhi
uggcauauuugccccuuccg

SEQ ID NO: 1682368 - RNA, 19 nt, Salmonella enterica enterica serovar Typhi
uggcauaaccgcagcgcgg

SEQ ID NO: 1682369 - RNA, 15 nt, Salmonella enterica enterica serovar Typhi
uggcauggugcagcc

SEQ ID NO: 1682370 - RNA, 16 nt, Salmonella enterica enterica serovar Typhi
uggcauuggcaucugu

SEQ ID NO: 1682371 - RNA, 19 nt, Salmonella enterica enterica serovar Typhi
uggcccaguuaacagaaug

SEQ ID NO: 1682372 - RNA, 17 nt, Salmonella enterica enterica serovar Typhi
uggcccagcgcgguggc

SEQ ID NO: 1682373 - RNA, 17 nt, Salmonella enterica enterica serovar Typhi
uggcccagcuaaaccac

SEQ ID NO: 1682374 - RNA, 20 nt, Salmonella enterica enterica serovar Typhi
uggccacggagugcgcggcg

SEQ ID NO: 1682375 - RNA, 19 nt, Salmonella enterica enterica serovar Typhi
uggccacguagccgucggc

SEQ ID NO: 1682376 - RNA, 22 nt, Salmonella enterica enterica serovar Typhi
uuaacuccuucuaauuccagga

SEQ ID NO: 1682377 - RNA, 22 nt, Salmonella enterica enterica serovar Typhi
uuaagcggauuuuuucgcuuuu

SEQ ID NO: 1682378 - RNA, 22 nt, Salmonella enterica enterica serovar Typhi
uuaagcggugugauaauuagcu

SEQ ID NO: 1682379 - RNA, 16 nt, Salmonella enterica enterica serovar Typhi
ugugccgguaagaaga

SEQ ID NO: 1682380 - RNA, 21 nt, Salmonella enterica enterica serovar Typhi
ugugccgguaagaagaaccag

SEQ ID NO: 1682381 - RNA, 17 nt, Salmonella enterica enterica serovar Typhi
ugugcuuccagcuccau

SEQ ID NO: 1682382 - RNA, 21 nt, Salmonella enterica enterica serovar Typhi
ugugcuuuuuauuuuucuggc

SEQ ID NO: 1682383 - RNA, 21 nt, Salmonella enterica enterica serovar Typhi
uguggaaaacagcgccggcag

SEQ ID NO: 1682384 - RNA, 19 nt, Salmonella enterica enterica serovar Typhi
uuaacguccauaccgguug

SEQ ID NO: 1682385 - RNA, 19 nt, Salmonella enterica enterica serovar Typhi
uuaaccugagaauauuaac

SEQ ID NO: 1682386 - RNA, 21 nt, Salmonella enterica enterica serovar Typhi
uuaacccagauaucagucugc

SEQ ID NO: 1682387 - RNA, 13 nt, Salmonella enterica enterica serovar Typhi
uuaaucacccgcg

SEQ ID NO: 1682388 - RNA, 18 nt, Salmonella enterica enterica serovar Typhi
uuaaucaagcccagcuca

SEQ ID NO: 1682389 - RNA, 15 nt, Salmonella enterica enterica serovar Typhi
uuaaucgcuucaauc

SEQ ID NO: 1682390 - RNA, 21 nt, Salmonella enterica enterica serovar Typhi
uuaauagcguagccugcaugu

SEQ ID NO: 1682391 - RNA, 19 nt, Salmonella enterica enterica serovar Typhi
uuaauacguacugaaauaa

SEQ ID NO: 1682392 - RNA, 18 nt, Salmonella enterica enterica serovar Typhi
uuaauaaugaacaugacg

SEQ ID NO: 1682393 - RNA, 14 nt, Salmonella enterica enterica serovar Typhi
uuaauacgcugucg

SEQ ID NO: 1682394 - RNA, 21 nt, Salmonella enterica enterica serovar Typhi
uuaauuccgcaucauucaucu

SEQ ID NO: 1682395 - RNA, 21 nt, Salmonella enterica enterica serovar Typhi
uuaauugcugaagauaaaauu

SEQ ID NO: 1682396 - RNA, 13 nt, Salmonella enterica enterica serovar Typhi
uuaauucuuuuaa

SEQ ID NO: 1682397 - RNA, 19 nt, Salmonella enterica enterica serovar Typhi
uuaauuaaaugcuugcuuu

SEQ ID NO: 1682398 - RNA, 19 nt, Salmonella enterica enterica serovar Typhi
uuaauuacgcacuacggca

SEQ ID NO: 1682399 - RNA, 16 nt, Salmonella enterica enterica serovar Typhi
uuaaugauuaaaauaa

SEQ ID NO: 1682400 - RNA, 22 nt, Salmonella enterica enterica serovar Typhi
uuaaugaguagaacguauuauu

SEQ ID NO: 1682401 - RNA, 22 nt, Salmonella enterica enterica serovar Typhi
uuaaugccgccguacaaacccu

SEQ ID NO: 1682402 - RNA, 21 nt, Salmonella enterica enterica serovar Typhi
uuaaugcgccccugcaggcga

SEQ ID NO: 1682403 - RNA, 12 nt, Salmonella enterica enterica serovar Typhi
uuaaugcgcgcu

SEQ ID NO: 1682404 - RNA, 17 nt, Salmonella enterica enterica serovar Typhi
uuaaugcuaucccaggc

SEQ ID NO: 1682405 - RNA, 16 nt, Salmonella enterica enterica serovar Typhi
uuaaugcucuccagca

SEQ ID NO: 1682406 - RNA, 15 nt, Salmonella enterica enterica serovar Typhi
uuaaugcucugcugu

SEQ ID NO: 1682407 - RNA, 16 nt, Salmonella enterica enterica serovar Typhi
uuaaugcuguccugca

SEQ ID NO: 1682408 - RNA, 23 nt, Salmonella enterica enterica serovar Typhi
uuaauggucuuaaaugccgccgg

SEQ ID NO: 1682409 - RNA, 19 nt, Salmonella enterica enterica serovar Typhi
uuaauggcagaauaaaaca

SEQ ID NO: 1682410 - RNA, 14 nt, Salmonella enterica enterica serovar Typhi
uuaauguccagcag

SEQ ID NO: 1682411 - RNA, 21 nt, Salmonella enterica enterica serovar Typhi
uuaauguuuagucuuuuagua

SEQ ID NO: 1682412 - RNA, 20 nt, Salmonella enterica enterica serovar Typhi
uuaauguuaggaguaaauaa

SEQ ID NO: 1682413 - RNA, 15 nt, Salmonella enterica enterica serovar Typhi
uuaauuugugccagc

SEQ ID NO: 1682414 - RNA, 16 nt, Salmonella enterica enterica serovar Typhi
uuaauuugcuguuuuu

SEQ ID NO: 1682415 - RNA, 15 nt, Salmonella enterica enterica serovar Typhi
uuaauuucuuuccaa

SEQ ID NO: 1682416 - RNA, 18 nt, Salmonella enterica enterica serovar Typhi
uuacaaguaauaaaauaa

SEQ ID NO: 1682417 - RNA, 14 nt, Salmonella enterica enterica serovar Typhi
uuacagcucauaaa

SEQ ID NO: 1682418 - RNA, 11 nt, Salmonella enterica enterica serovar Typhi
uuaccaacccc

SEQ ID NO: 1682419 - RNA, 18 nt, Salmonella enterica enterica serovar Typhi
uuaccaaugccaaaaaaa

SEQ ID NO: 1682420 - RNA, 23 nt, Salmonella enterica enterica serovar Typhi
uuaccaaugccaaaaaaacuaau

SEQ ID NO: 1682421 - RNA, 23 nt, Salmonella enterica enterica serovar Typhi
uuacaggugccuggguuccaggc

SEQ ID NO: 1682422 - RNA, 19 nt, Salmonella enterica enterica serovar Typhi
uuacaggccggacaggcga

SEQ ID NO: 1682423 - RNA, 15 nt, Salmonella enterica enterica serovar Typhi
uuacaggcgcaucag

SEQ ID NO: 1682424 - RNA, 20 nt, Salmonella enterica enterica serovar Typhi
uuacaggcgcaucagaaaaa

SEQ ID NO: 1682425 - RNA, 22 nt, Salmonella enterica enterica serovar Typhi
uuacaggcgcaucagaaaaacc

SEQ ID NO: 1682426 - RNA, 16 nt, Salmonella enterica enterica serovar Typhi
uuagguucuucaaugc

SEQ ID NO: 1682427 - RNA, 13 nt, Salmonella enterica enterica serovar Typhi
uuaguaacuuaca

SEQ ID NO: 1682428 - RNA, 11 nt, Salmonella enterica enterica serovar Typhi
uuaguaacccc

SEQ ID NO: 1682429 - RNA, 20 nt, Salmonella enterica enterica serovar Typhi
uuaguaccgaacagccaggc

SEQ ID NO: 1682430 - RNA, 21 nt, Salmonella enterica enterica serovar Typhi
uuaguugauucgcuaauaauu

SEQ ID NO: 1682431 - RNA, 14 nt, Salmonella enterica enterica serovar Typhi
uuaguguuauauaa

SEQ ID NO: 1682432 - RNA, 12 nt, Salmonella enterica enterica serovar Typhi
uuaguucaaguu

SEQ ID NO: 1682433 - RNA, 20 nt, Salmonella enterica enterica serovar Typhi
uuagugacguuaucugucag

SEQ ID NO: 1682434 - RNA, 21 nt, Salmonella enterica enterica serovar Typhi
uuauaaauauuaaugaauaaa

SEQ ID NO: 1682435 - RNA, 23 nt, Salmonella enterica enterica serovar Typhi
uuauaaauaaaguguuaucaugu

SEQ ID NO: 1682436 - RNA, 15 nt, Salmonella enterica enterica serovar Typhi
uuauaacguaucguu

SEQ ID NO: 1682437 - RNA, 13 nt, Salmonella enterica enterica serovar Typhi
uuauaacauaaau

SEQ ID NO: 1682438 - RNA, 14 nt, Salmonella enterica enterica serovar Typhi
uuauaaauuuuuua

SEQ ID NO: 1682439 - RNA, 22 nt, Salmonella enterica enterica serovar Typhi
uuauaacuaaacucaucuuuau

SEQ ID NO: 1682440 - RNA, 21 nt, Salmonella enterica enterica serovar Typhi
uuauaagaaccaucuaccaua

SEQ ID NO: 1682441 - RNA, 17 nt, Salmonella enterica enterica serovar Typhi
uuauaagcuuuaaccac

SEQ ID NO: 1682442 - RNA, 13 nt, Salmonella enterica enterica serovar Typhi
uuauaagcgccaa

SEQ ID NO: 1682443 - RNA, 15 nt, Salmonella enterica enterica serovar Typhi
uuauacacucaacca

SEQ ID NO: 1682444 - RNA, 16 nt, Salmonella enterica enterica serovar Typhi
uuauacuugcugcuau

SEQ ID NO: 1682445 - RNA, 15 nt, Salmonella enterica enterica serovar Typhi
uuauacucaaaaaau

SEQ ID NO: 1682446 - RNA, 11 nt, Salmonella enterica enterica serovar Typhi
uuauacugaua

SEQ ID NO: 1682447 - RNA, 15 nt, Salmonella enterica enterica serovar Typhi
uuauacugauaaacu

SEQ ID NO: 1682448 - RNA, 18 nt, Salmonella enterica enterica serovar Typhi
uuacccgggccaucuuuu

SEQ ID NO: 1682449 - RNA, 23 nt, Salmonella enterica enterica serovar Typhi
uuacguugguauucaacgccauc

SEQ ID NO: 1682450 - RNA, 14 nt, Salmonella enterica enterica serovar Typhi
uuaccgcccgcuuc

SEQ ID NO: 1682451 - RNA, 17 nt, Salmonella enterica enterica serovar Typhi
uuacuaauaaauauuca

SEQ ID NO: 1682452 - RNA, 15 nt, Salmonella enterica enterica serovar Typhi
uuacuaauaaauauu

SEQ ID NO: 1682453 - RNA, 14 nt, Salmonella enterica enterica serovar Typhi
uuacucacugccgc

SEQ ID NO: 1682454 - RNA, 12 nt, Salmonella enterica enterica serovar Typhi
uuacuauuuuuc

SEQ ID NO: 1682455 - RNA, 15 nt, Salmonella enterica enterica serovar Typhi
uuacucaguuugccg

SEQ ID NO: 1682456 - RNA, 15 nt, Salmonella enterica enterica serovar Typhi
uuacuuucauuccuu

SEQ ID NO: 1682457 - RNA, 13 nt, Salmonella enterica enterica serovar Typhi
uuacuuucauucc

SEQ ID NO: 1682458 - RNA, 22 nt, Salmonella enterica enterica serovar Typhi
uuacucccgucgccuguuucug

SEQ ID NO: 1682459 - RNA, 18 nt, Salmonella enterica enterica serovar Typhi
uuacugcucguagcguuu

SEQ ID NO: 1682460 - RNA, 16 nt, Salmonella enterica enterica serovar Typhi
uuacugcaagcgaugu

SEQ ID NO: 1682461 - RNA, 12 nt, Salmonella enterica enterica serovar Typhi
uuagcuuccagc

SEQ ID NO: 1682462 - RNA, 22 nt, Salmonella enterica enterica serovar Typhi
uuagcucuuucauuucugccug

SEQ ID NO: 1682463 - RNA, 23 nt, Salmonella enterica enterica serovar Typhi
uuagcugcgcaagaaacaucauc

SEQ ID NO: 1682464 - RNA, 20 nt, Salmonella enterica enterica serovar Typhi
uuagcuuuuuuaugcuguag

SEQ ID NO: 1682465 - RNA, 22 nt, Salmonella enterica enterica serovar Typhi
uuagggcuauuuuacuugccau

SEQ ID NO: 1682466 - RNA, 18 nt, Salmonella enterica enterica serovar Typhi
uuaggguagaaaaaggua

SEQ ID NO: 1682467 - RNA, 19 nt, Salmonella enterica enterica serovar Typhi
uuaggguagaaaaagguaa

SEQ ID NO: 1682468 - RNA, 17 nt, Salmonella enterica enterica serovar Typhi
uuagccccugacgcugc

SEQ ID NO: 1682469 - RNA, 17 nt, Salmonella enterica enterica serovar Typhi
uuagcccaaaaggcuca

SEQ ID NO: 1682470 - RNA, 14 nt, Salmonella enterica enterica serovar Typhi
uuagccacgccguc

SEQ ID NO: 1682471 - RNA, 15 nt, Salmonella enterica enterica serovar Typhi
uuagcaugacaauaa

SEQ ID NO: 1682472 - RNA, 21 nt, Salmonella enterica enterica serovar Typhi
uuagagcacaucacucauaau

SEQ ID NO: 1682473 - RNA, 19 nt, Salmonella enterica enterica serovar Typhi
uuagcaauugccauaaaaa

SEQ ID NO: 1682474 - RNA, 22 nt, Salmonella enterica enterica serovar Typhi
uuagcacccaccaucacuucca

SEQ ID NO: 1682475 - RNA, 17 nt, Salmonella enterica enterica serovar Typhi
uucaagcaguuccagca

SEQ ID NO: 1682476 - RNA, 17 nt, Salmonella enterica enterica serovar Typhi
uucaaguuuagaaaaaa

SEQ ID NO: 1682477 - RNA, 18 nt, Salmonella enterica enterica serovar Typhi
uucaaguuuagaaaaaau

SEQ ID NO: 1682478 - RNA, 14 nt, Salmonella enterica enterica serovar Typhi
uucaagcaguucca

SEQ ID NO: 1682479 - RNA, 23 nt, Salmonella enterica enterica serovar Typhi
uucaagccguuuuggcagcgccc

SEQ ID NO: 1682480 - RNA, 20 nt, Salmonella enterica enterica serovar Typhi
uucaauaauauuaucauaau

SEQ ID NO: 1682481 - RNA, 23 nt, Salmonella enterica enterica serovar Typhi
uucaauacccuuuucuuuaaaca

SEQ ID NO: 1682482 - RNA, 17 nt, Salmonella enterica enterica serovar Typhi
uucaauaaguuagcuuu

SEQ ID NO: 1682483 - RNA, 20 nt, Salmonella enterica enterica serovar Typhi
uucaauaaguuagcuuuuuu

SEQ ID NO: 1682484 - RNA, 21 nt, Salmonella enterica enterica serovar Typhi
uucaauaaguuagcuuuuuua

SEQ ID NO: 1682485 - RNA, 21 nt, Salmonella enterica enterica serovar Typhi
uucaauaaauugaaauucuau

SEQ ID NO: 1682486 - RNA, 22 nt, Salmonella enterica enterica serovar Typhi
uucaauaaauugaaauucuaug

SEQ ID NO: 1682487 - RNA, 15 nt, Salmonella enterica enterica serovar Typhi
uucaaccguuucuuu

SEQ ID NO: 1682488 - RNA, 15 nt, Salmonella enterica enterica serovar Typhi
uucaaccuccugcaa

SEQ ID NO: 1682489 - RNA, 16 nt, Salmonella enterica enterica serovar Typhi
uucaaccuccugcaau

SEQ ID NO: 1682490 - RNA, 12 nt, Salmonella enterica enterica serovar Typhi
uucaaccucacu

SEQ ID NO: 1682491 - RNA, 20 nt, Salmonella enterica enterica serovar Typhi
uucaacgaaugccugcauau

SEQ ID NO: 1682492 - RNA, 18 nt, Salmonella enterica enterica serovar Typhi
uucaacauauuuuucaca

SEQ ID NO: 1682493 - RNA, 17 nt, Salmonella enterica enterica serovar Typhi
uucaaaccuucaagaau

SEQ ID NO: 1682494 - RNA, 23 nt, Salmonella enterica enterica serovar Typhi
uucaaaagccuguuuaccaagca

SEQ ID NO: 1682495 - RNA, 12 nt, Salmonella enterica enterica serovar Typhi
uuauuugaauag

SEQ ID NO: 1682496 - RNA, 12 nt, Salmonella enterica enterica serovar Typhi
uuauuuuuucau

SEQ ID NO: 1682497 - RNA, 12 nt, Salmonella enterica enterica serovar Typhi
uucaaaaaagag

SEQ ID NO: 1682498 - RNA, 23 nt, Salmonella enterica enterica serovar Typhi
uuauucuuugucugucggacuca

SEQ ID NO: 1682499 - RNA, 22 nt, Salmonella enterica enterica serovar Typhi
uuauuuaaaaaggaaagauuac

SEQ ID NO: 1682500 - RNA, 16 nt, Salmonella enterica enterica serovar Typhi
uuauuguuaaaaagac

SEQ ID NO: 1682501 - RNA, 20 nt, Salmonella enterica enterica serovar Typhi
uucacaccgccgccagccau

SEQ ID NO: 1682502 - RNA, 21 nt, Salmonella enterica enterica serovar Typhi
uucacaccguuauccggcaaa

SEQ ID NO: 1682503 - RNA, 20 nt, Salmonella enterica enterica serovar Typhi
uucacaccguuauccggcaa

SEQ ID NO: 1682504 - RNA, 22 nt, Salmonella enterica enterica serovar Typhi
uucacaccaaugucauauuugu

SEQ ID NO: 1682505 - RNA, 16 nt, Salmonella enterica enterica serovar Typhi
uucaauagguugaaag

SEQ ID NO: 1682506 - RNA, 15 nt, Salmonella enterica enterica serovar Typhi
uucaauacgaaaacc

SEQ ID NO: 1682507 - RNA, 18 nt, Salmonella enterica enterica serovar Typhi
uucaaucagcacgcgguc

SEQ ID NO: 1682508 - RNA, 17 nt, Salmonella enterica enterica serovar Typhi
uucaaucaucauauccc

SEQ ID NO: 1682509 - RNA, 17 nt, Salmonella enterica enterica serovar Typhi
uucaauaugccaggcau

SEQ ID NO: 1682510 - RNA, 22 nt, Salmonella enterica enterica serovar Typhi
uucaauauuccuggcgccaccc

SEQ ID NO: 1682511 - RNA, 20 nt, Salmonella enterica enterica serovar Typhi
uucaauauugaacauuuuuu

SEQ ID NO: 1682512 - RNA, 14 nt, Salmonella enterica enterica serovar Typhi
uucaccucccugca

SEQ ID NO: 1682513 - RNA, 20 nt, Salmonella enterica enterica serovar Typhi
uucaccucccugcaacagca

SEQ ID NO: 1682514 - RNA, 19 nt, Salmonella enterica enterica serovar Typhi
uucacgagcggucaggcca

SEQ ID NO: 1682515 - RNA, 16 nt, Salmonella enterica enterica serovar Typhi
uucacgaucaucgcau

SEQ ID NO: 1682516 - RNA, 20 nt, Salmonella enterica enterica serovar Typhi
uucacguaccaggcagcgcg

SEQ ID NO: 1682517 - RNA, 24 nt, Salmonella enterica enterica serovar Typhi
uucacguacccaaauaucaaauac

SEQ ID NO: 1682518 - RNA, 23 nt, Salmonella enterica enterica serovar Typhi
uucaccgcgucguuacgcucguc

SEQ ID NO: 1682519 - RNA, 21 nt, Salmonella enterica enterica serovar Typhi
uucaccggauacccagccaca

SEQ ID NO: 1682520 - RNA, 13 nt, Salmonella enterica enterica serovar Typhi
uucaccggcuggu

SEQ ID NO: 1682521 - RNA, 16 nt, Salmonella enterica enterica serovar Typhi
uucacccguuauucau

SEQ ID NO: 1682522 - RNA, 19 nt, Salmonella enterica enterica serovar Typhi
uucaccccagcgguaaaau

SEQ ID NO: 1682523 - RNA, 23 nt, Salmonella enterica enterica serovar Typhi
uucagcaauuacccgguguuuuu

SEQ ID NO: 1682524 - RNA, 12 nt, Salmonella enterica enterica serovar Typhi
uucagacgucau

SEQ ID NO: 1682525 - RNA, 22 nt, Salmonella enterica enterica serovar Typhi
uucagagcguccacgccaucau

SEQ ID NO: 1682526 - RNA, 19 nt, Salmonella enterica enterica serovar Typhi
uucagaccuuuuacuucac

SEQ ID NO: 1682527 - RNA, 19 nt, Salmonella enterica enterica serovar Typhi
uucagaauacgaccucaaa

SEQ ID NO: 1682528 - RNA, 17 nt, Salmonella enterica enterica serovar Typhi
uucagaauaugccaggg

SEQ ID NO: 1682529 - RNA, 15 nt, Salmonella enterica enterica serovar Typhi
uucacguuuuccagg

SEQ ID NO: 1682530 - RNA, 19 nt, Salmonella enterica enterica serovar Typhi
uucaggauuuacugagcgc

SEQ ID NO: 1682531 - RNA, 20 nt, Salmonella enterica enterica serovar Typhi
uucaggcauccagacccaca

SEQ ID NO: 1682532 - RNA, 18 nt, Salmonella enterica enterica serovar Typhi
uucaggcaaaaaaaaacc

SEQ ID NO: 1682533 - RNA, 23 nt, Salmonella enterica enterica serovar Typhi
uucagcugcggcugaaccacccu

SEQ ID NO: 1682534 - RNA, 23 nt, Salmonella enterica enterica serovar Typhi
uucagcuucagucauaauccuuc

SEQ ID NO: 1682535 - RNA, 15 nt, Salmonella enterica enterica serovar Typhi
uucagcuucugucag

SEQ ID NO: 1682536 - RNA, 14 nt, Salmonella enterica enterica serovar Typhi
uucaggaauacauu

SEQ ID NO: 1682537 - RNA, 13 nt, Salmonella enterica enterica serovar Typhi
uucagccugaagc

SEQ ID NO: 1682538 - RNA, 14 nt, Salmonella enterica enterica serovar Typhi
uucagcccaggcuu

SEQ ID NO: 1682539 - RNA, 13 nt, Salmonella enterica enterica serovar Typhi
uucagccaggugg

SEQ ID NO: 1682540 - RNA, 13 nt, Salmonella enterica enterica serovar Typhi
uucagcagcgccc

SEQ ID NO: 1682541 - RNA, 22 nt, Salmonella enterica enterica serovar Typhi
uucagcagcgcccagccaaagc

SEQ ID NO: 1682542 - RNA, 16 nt, Salmonella enterica enterica serovar Typhi
uucagcauccuccggc

SEQ ID NO: 1682543 - RNA, 19 nt, Salmonella enterica enterica serovar Typhi
uucagcauauccagcgccu

SEQ ID NO: 1682544 - RNA, 14 nt, Salmonella enterica enterica serovar Typhi
uuauggcccgccag

SEQ ID NO: 1682545 - RNA, 16 nt, Salmonella enterica enterica serovar Typhi
uuauggguuuuuuauu

SEQ ID NO: 1682546 - RNA, 20 nt, Salmonella enterica enterica serovar Typhi
uuaugcaucuggucagguga

SEQ ID NO: 1682547 - RNA, 22 nt, Salmonella enterica enterica serovar Typhi
uuaugcaguuccguugcaauau

SEQ ID NO: 1682548 - RNA, 17 nt, Salmonella enterica enterica serovar Typhi
uuaugauuuuaacauca

SEQ ID NO: 1682549 - RNA, 18 nt, Salmonella enterica enterica serovar Typhi
uuaugcggcgcuuccaga

SEQ ID NO: 1682550 - RNA, 15 nt, Salmonella enterica enterica serovar Typhi
uuaugcgguucuccc

SEQ ID NO: 1682551 - RNA, 11 nt, Salmonella enterica enterica serovar Typhi
uuaugccucuu

SEQ ID NO: 1682552 - RNA, 21 nt, Salmonella enterica enterica serovar Typhi
uuaugcgucaaaguugcauca

SEQ ID NO: 1682553 - RNA, 13 nt, Salmonella enterica enterica serovar Typhi
uuauguuugccca

SEQ ID NO: 1682554 - RNA, 17 nt, Salmonella enterica enterica serovar Typhi
uuauguccuuccagcuc

SEQ ID NO: 1682555 - RNA, 18 nt, Salmonella enterica enterica serovar Typhi
uuauuaaagccccuuccu

SEQ ID NO: 1682556 - RNA, 15 nt, Salmonella enterica enterica serovar Typhi
uuauuaacccuuccu

SEQ ID NO: 1682557 - RNA, 23 nt, Salmonella enterica enterica serovar Typhi
uuaucggcgucgcggcaauagcg

SEQ ID NO: 1682558 - RNA, 15 nt, Salmonella enterica enterica serovar Typhi
uuaucgccaaagaua

SEQ ID NO: 1682559 - RNA, 23 nt, Salmonella enterica enterica serovar Typhi
uuaucgggccuacgagauaaaaa

SEQ ID NO: 1682560 - RNA, 18 nt, Salmonella enterica enterica serovar Typhi
uuaucguccgucagaucc

SEQ ID NO: 1682561 - RNA, 14 nt, Salmonella enterica enterica serovar Typhi
uuaucucuuuugcu

SEQ ID NO: 1682562 - RNA, 16 nt, Salmonella enterica enterica serovar Typhi
uuaucucuuuugcuuc

SEQ ID NO: 1682563 - RNA, 16 nt, Salmonella enterica enterica serovar Typhi
uuaucucuacuuuccu

SEQ ID NO: 1682564 - RNA, 17 nt, Salmonella enterica enterica serovar Typhi
uuaucucuacuuuccug

SEQ ID NO: 1682565 - RNA, 20 nt, Salmonella enterica enterica serovar Typhi
uuaucuccccaauugcugcu

SEQ ID NO: 1682566 - RNA, 17 nt, Salmonella enterica enterica serovar Typhi
uuaucuguaauuauaaa

SEQ ID NO: 1682567 - RNA, 12 nt, Salmonella enterica enterica serovar Typhi
uuaucuucaagg

SEQ ID NO: 1682568 - RNA, 18 nt, Salmonella enterica enterica serovar Typhi
uuaucuucaagguuaugc

SEQ ID NO: 1682569 - RNA, 20 nt, Salmonella enterica enterica serovar Typhi
uuaucuuccacgguaaaaca

SEQ ID NO: 1682570 - RNA, 22 nt, Salmonella enterica enterica serovar Typhi
uuaucuuuaccagggaauauga

SEQ ID NO: 1682571 - RNA, 17 nt, Salmonella enterica enterica serovar Typhi
uuaucuuuuacgcuguc

SEQ ID NO: 1682572 - RNA, 19 nt, Salmonella enterica enterica serovar Typhi
uuaugaccaauaauaaucc

SEQ ID NO: 1682573 - RNA, 23 nt, Salmonella enterica enterica serovar Typhi
uuaugaauaguuucaccuucugc

SEQ ID NO: 1682574 - RNA, 21 nt, Salmonella enterica enterica serovar Typhi
uuaugaccguauuacaaguaa

SEQ ID NO: 1682575 - RNA, 16 nt, Salmonella enterica enterica serovar Typhi
uuaugacggggaacag

SEQ ID NO: 1682576 - RNA, 22 nt, Salmonella enterica enterica serovar Typhi
uuaugaucgcccagccacuccu

SEQ ID NO: 1682577 - RNA, 14 nt, Salmonella enterica enterica serovar Typhi
uuauaggucagguu

SEQ ID NO: 1682578 - RNA, 14 nt, Salmonella enterica enterica serovar Typhi
uuauauaaaaauag

SEQ ID NO: 1682579 - RNA, 18 nt, Salmonella enterica enterica serovar Typhi
uuauagcucagcgcggca

SEQ ID NO: 1682580 - RNA, 21 nt, Salmonella enterica enterica serovar Typhi
uuauagacgccggucaugcca

SEQ ID NO: 1682581 - RNA, 22 nt, Salmonella enterica enterica serovar Typhi
uuauagaugucagauccuucau

SEQ ID NO: 1682582 - RNA, 13 nt, Salmonella enterica enterica serovar Typhi
uuauauagucuua

SEQ ID NO: 1682583 - RNA, 17 nt, Salmonella enterica enterica serovar Typhi
uuauauagucuuaauuu

SEQ ID NO: 1682584 - RNA, 13 nt, Salmonella enterica enterica serovar Typhi
uuauauaagcaua

SEQ ID NO: 1682585 - RNA, 16 nt, Salmonella enterica enterica serovar Typhi
uuauauucuucgccca

SEQ ID NO: 1682586 - RNA, 16 nt, Salmonella enterica enterica serovar Typhi
uuauauuacuggcuau

SEQ ID NO: 1682587 - RNA, 24 nt, Salmonella enterica enterica serovar Typhi
uuauauugcguaaaaacccuuuca

SEQ ID NO: 1682588 - RNA, 11 nt, Salmonella enterica enterica serovar Typhi
uuauauuuauu

SEQ ID NO: 1682589 - RNA, 12 nt, Salmonella enterica enterica serovar Typhi
uuauauuuaaaa

SEQ ID NO: 1682590 - RNA, 15 nt, Salmonella enterica enterica serovar Typhi
uuauauuuaaaauuc

SEQ ID NO: 1682591 - RNA, 18 nt, Salmonella enterica enterica serovar Typhi
uuauccggccuacgcuua

SEQ ID NO: 1682592 - RNA, 15 nt, Salmonella enterica enterica serovar Typhi
uuauccggccugcac

SEQ ID NO: 1682593 - RNA, 16 nt, Salmonella enterica enterica serovar Typhi
uuauccguuauuuaau

SEQ ID NO: 1682594 - RNA, 22 nt, Salmonella enterica enterica serovar Typhi
uuauccggcuuacggcuauucc

SEQ ID NO: 1682595 - RNA, 22 nt, Salmonella enterica enterica serovar Typhi
uuaucgaaauagcggugaacuu

SEQ ID NO: 1682596 - RNA, 13 nt, Salmonella enterica enterica serovar Typhi
uuauccugcacga

SEQ ID NO: 1682597 - RNA, 17 nt, Salmonella enterica enterica serovar Typhi
uuauccuguguuuggcc

SEQ ID NO: 1682598 - RNA, 20 nt, Salmonella enterica enterica serovar Typhi
uuauccuguguuuggccgcc

SEQ ID NO: 1682599 - RNA, 18 nt, Salmonella enterica enterica serovar Typhi
uuauccgcagauccagca

SEQ ID NO: 1682600 - RNA, 15 nt, Salmonella enterica enterica serovar Typhi
uuauccggcaaaaga

SEQ ID NO: 1682601 - RNA, 17 nt, Salmonella enterica enterica serovar Typhi
uuaucccgcccgaucuc

SEQ ID NO: 1682602 - RNA, 14 nt, Salmonella enterica enterica serovar Typhi
uuauccaaauccuu

SEQ ID NO: 1682603 - RNA, 18 nt, Salmonella enterica enterica serovar Typhi
uuauccagucccaccggg

SEQ ID NO: 1682604 - RNA, 17 nt, Salmonella enterica enterica serovar Typhi
uuauccacaaacuccag

SEQ ID NO: 1682605 - RNA, 17 nt, Salmonella enterica enterica serovar Typhi
uuaucaucguaaaauca

SEQ ID NO: 1682606 - RNA, 21 nt, Salmonella enterica enterica serovar Typhi
uuaucauaaugucccugccac

SEQ ID NO: 1682607 - RNA, 19 nt, Salmonella enterica enterica serovar Typhi
uuaucacugguuauaugaa

SEQ ID NO: 1682608 - RNA, 23 nt, Salmonella enterica enterica serovar Typhi
uuaucacugguuauaugaauaaa

SEQ ID NO: 1682609 - RNA, 16 nt, Salmonella enterica enterica serovar Typhi
uuaucaaucugcuuuu

SEQ ID NO: 1682610 - RNA, 18 nt, Salmonella enterica enterica serovar Typhi
uucuauuaaaucagauaa

SEQ ID NO: 1682611 - RNA, 19 nt, Salmonella enterica enterica serovar Typhi
uucuaccacccagccagac

SEQ ID NO: 1682612 - RNA, 20 nt, Salmonella enterica enterica serovar Typhi
uucuaccacgcugccgccgc

SEQ ID NO: 1682613 - RNA, 16 nt, Salmonella enterica enterica serovar Typhi
uucucagccagaucca

SEQ ID NO: 1682614 - RNA, 16 nt, Salmonella enterica enterica serovar Typhi
uucucauccagcuugc

SEQ ID NO: 1682615 - RNA, 24 nt, Salmonella enterica enterica serovar Typhi
uucucgggccuguuccggcgagga

SEQ ID NO: 1682616 - RNA, 17 nt, Salmonella enterica enterica serovar Typhi
uucucuaucagcgccuc

SEQ ID NO: 1682617 - RNA, 14 nt, Salmonella enterica enterica serovar Typhi
uucucuuccacaaa

SEQ ID NO: 1682618 - RNA, 15 nt, Salmonella enterica enterica serovar Typhi
uucucugucgccgcc

SEQ ID NO: 1682619 - RNA, 11 nt, Salmonella enterica enterica serovar Typhi
uucugcaaaau

SEQ ID NO: 1682620 - RNA, 23 nt, Salmonella enterica enterica serovar Typhi
uucugcaggcgggugcgcagccc

SEQ ID NO: 1682621 - RNA, 13 nt, Salmonella enterica enterica serovar Typhi
uucucuucugcug

SEQ ID NO: 1682622 - RNA, 16 nt, Salmonella enterica enterica serovar Typhi
uucugauggcuuugcu

SEQ ID NO: 1682623 - RNA, 17 nt, Salmonella enterica enterica serovar Typhi
uucugauuauugacauu

SEQ ID NO: 1682624 - RNA, 13 nt, Salmonella enterica enterica serovar Typhi
uucgguggaaacc

SEQ ID NO: 1682625 - RNA, 15 nt, Salmonella enterica enterica serovar Typhi
uucgcuucgaggaua

SEQ ID NO: 1682626 - RNA, 14 nt, Salmonella enterica enterica serovar Typhi
uucgcuuuuaaaac

SEQ ID NO: 1682627 - RNA, 19 nt, Salmonella enterica enterica serovar Typhi
uucguacccgcaggccugg

SEQ ID NO: 1682628 - RNA, 20 nt, Salmonella enterica enterica serovar Typhi
uucguggcgcuguucuugcu

SEQ ID NO: 1682629 - RNA, 17 nt, Salmonella enterica enterica serovar Typhi
uucguuauaaggccugc

SEQ ID NO: 1682630 - RNA, 19 nt, Salmonella enterica enterica serovar Typhi
uucguuaccgccuuuuuuc

SEQ ID NO: 1682631 - RNA, 15 nt, Salmonella enterica enterica serovar Typhi
uucguuaccggugau

SEQ ID NO: 1682632 - RNA, 17 nt, Salmonella enterica enterica serovar Typhi
uucguuacuuucauaau

SEQ ID NO: 1682633 - RNA, 17 nt, Salmonella enterica enterica serovar Typhi
uucgucaggaggccuga

SEQ ID NO: 1682634 - RNA, 15 nt, Salmonella enterica enterica serovar Typhi
uucuaacgaaacaga

SEQ ID NO: 1682635 - RNA, 14 nt, Salmonella enterica enterica serovar Typhi
uucguuauuuuccu

SEQ ID NO: 1682636 - RNA, 21 nt, Salmonella enterica enterica serovar Typhi
uucguuccgcgauuuccugug

SEQ ID NO: 1682637 - RNA, 23 nt, Salmonella enterica enterica serovar Typhi
uucgccguguucuuacccacugu

SEQ ID NO: 1682638 - RNA, 16 nt, Salmonella enterica enterica serovar Typhi
uucgcauauucugcga

SEQ ID NO: 1682639 - RNA, 19 nt, Salmonella enterica enterica serovar Typhi
uucgcauguugacugcgcu

SEQ ID NO: 1682640 - RNA, 17 nt, Salmonella enterica enterica serovar Typhi
uucgcuacguucaaauu

SEQ ID NO: 1682641 - RNA, 15 nt, Salmonella enterica enterica serovar Typhi
uucgcuuaccaggcc

SEQ ID NO: 1682642 - RNA, 13 nt, Salmonella enterica enterica serovar Typhi
uucgcugcaacuu

SEQ ID NO: 1682643 - RNA, 16 nt, Salmonella enterica enterica serovar Typhi
uuccuuguuccaccug

SEQ ID NO: 1682644 - RNA, 12 nt, Salmonella enterica enterica serovar Typhi
uuccuuucugcg

SEQ ID NO: 1682645 - RNA, 15 nt, Salmonella enterica enterica serovar Typhi
uuccuuugccuuucu

SEQ ID NO: 1682646 - RNA, 12 nt, Salmonella enterica enterica serovar Typhi
uuccuuuuucag

SEQ ID NO: 1682647 - RNA, 12 nt, Salmonella enterica enterica serovar Typhi
uucgcagcgcag

SEQ ID NO: 1682648 - RNA, 18 nt, Salmonella enterica enterica serovar Typhi
uucgcagcgauauuucuc

SEQ ID NO: 1682649 - RNA, 22 nt, Salmonella enterica enterica serovar Typhi
uucgaacgaaaaaagcgccccu

SEQ ID NO: 1682650 - RNA, 21 nt, Salmonella enterica enterica serovar Typhi
uuccaguucauaagucaucca

SEQ ID NO: 1682651 - RNA, 18 nt, Salmonella enterica enterica serovar Typhi
uuccagggcuuccagaau

SEQ ID NO: 1682652 - RNA, 17 nt, Salmonella enterica enterica serovar Typhi
uuccaguugcggcauca

SEQ ID NO: 1682653 - RNA, 17 nt, Salmonella enterica enterica serovar Typhi
uuccagcggcggaaugc

SEQ ID NO: 1682654 - RNA, 12 nt, Salmonella enterica enterica serovar Typhi
uuccagcggcag

SEQ ID NO: 1682655 - RNA, 21 nt, Salmonella enterica enterica serovar Typhi
uuccagcgcgccgucaucgcu

SEQ ID NO: 1682656 - RNA, 18 nt, Salmonella enterica enterica serovar Typhi
uuccagcgcguccagccc

SEQ ID NO: 1682657 - RNA, 19 nt, Salmonella enterica enterica serovar Typhi
uuccagcuguaccaucacc

SEQ ID NO: 1682658 - RNA, 20 nt, Salmonella enterica enterica serovar Typhi
uuccagcuguaccaucaccu

SEQ ID NO: 1682659 - RNA, 13 nt, Salmonella enterica enterica serovar Typhi
uuccaggcgaacc

SEQ ID NO: 1682660 - RNA, 22 nt, Salmonella enterica enterica serovar Typhi
uuccagcucacggauauuaccc

SEQ ID NO: 1682661 - RNA, 12 nt, Salmonella enterica enterica serovar Typhi
uuccauugcugc

SEQ ID NO: 1682662 - RNA, 19 nt, Salmonella enterica enterica serovar Typhi
uuccauucggcgaaagaag

SEQ ID NO: 1682663 - RNA, 14 nt, Salmonella enterica enterica serovar Typhi
uuccauucacacaa

SEQ ID NO: 1682664 - RNA, 19 nt, Salmonella enterica enterica serovar Typhi
uuccauggcaaaauucgua

SEQ ID NO: 1682665 - RNA, 11 nt, Salmonella enterica enterica serovar Typhi
uuccauacauu

SEQ ID NO: 1682666 - RNA, 17 nt, Salmonella enterica enterica serovar Typhi
uuccacacguccauccg

SEQ ID NO: 1682667 - RNA, 23 nt, Salmonella enterica enterica serovar Typhi
uuccacaaaaggauacagcgccg

SEQ ID NO: 1682668 - RNA, 23 nt, Salmonella enterica enterica serovar Typhi
uucaggcugccaaccagcgcuuu

SEQ ID NO: 1682669 - RNA, 20 nt, Salmonella enterica enterica serovar Typhi
uucaggcucaucagcgccau

SEQ ID NO: 1682670 - RNA, 16 nt, Salmonella enterica enterica serovar Typhi
uucagggugaacaugg

SEQ ID NO: 1682671 - RNA, 23 nt, Salmonella enterica enterica serovar Typhi
uucagggcuuauucaagcaacug

SEQ ID NO: 1682672 - RNA, 17 nt, Salmonella enterica enterica serovar Typhi
uuccaccaccuccugcu

SEQ ID NO: 1682673 - RNA, 18 nt, Salmonella enterica enterica serovar Typhi
uuccaccaccuccugcug

SEQ ID NO: 1682674 - RNA, 16 nt, Salmonella enterica enterica serovar Typhi
uuccaccgccaauaaa

SEQ ID NO: 1682675 - RNA, 16 nt, Salmonella enterica enterica serovar Typhi
uuccaccgcaugguua

SEQ ID NO: 1682676 - RNA, 11 nt, Salmonella enterica enterica serovar Typhi
uuccaccgcca

SEQ ID NO: 1682677 - RNA, 23 nt, Salmonella enterica enterica serovar Typhi
uuccacgcguacgguuacaaccc

SEQ ID NO: 1682678 - RNA, 20 nt, Salmonella enterica enterica serovar Typhi
uuccagaauucguacguuuu

SEQ ID NO: 1682679 - RNA, 20 nt, Salmonella enterica enterica serovar Typhi
uuccagauaauccagcgucg

SEQ ID NO: 1682680 - RNA, 18 nt, Salmonella enterica enterica serovar Typhi
uuccagagugcucaauaa

SEQ ID NO: 1682681 - RNA, 21 nt, Salmonella enterica enterica serovar Typhi
uuccagaagcgcuuugccaau

SEQ ID NO: 1682682 - RNA, 21 nt, Salmonella enterica enterica serovar Typhi
uuccagccagugugcgguggc

SEQ ID NO: 1682683 - RNA, 16 nt, Salmonella enterica enterica serovar Typhi
uuccagcauuucuuca

SEQ ID NO: 1682684 - RNA, 21 nt, Salmonella enterica enterica serovar Typhi
uuccagcaucgaccaggauuu

SEQ ID NO: 1682685 - RNA, 22 nt, Salmonella enterica enterica serovar Typhi
uuccagcagauccauuaaaugc

SEQ ID NO: 1682686 - RNA, 18 nt, Salmonella enterica enterica serovar Typhi
uuccggcacucugcgcca

SEQ ID NO: 1682687 - RNA, 22 nt, Salmonella enterica enterica serovar Typhi
uuccggaucgccgaagcggcag

SEQ ID NO: 1682688 - RNA, 15 nt, Salmonella enterica enterica serovar Typhi
uuccgcuuccagaau

SEQ ID NO: 1682689 - RNA, 13 nt, Salmonella enterica enterica serovar Typhi
uuccucccggugc

SEQ ID NO: 1682690 - RNA, 16 nt, Salmonella enterica enterica serovar Typhi
uuccucagaaagcguu

SEQ ID NO: 1682691 - RNA, 12 nt, Salmonella enterica enterica serovar Typhi
uuccucacagcc

SEQ ID NO: 1682692 - RNA, 15 nt, Salmonella enterica enterica serovar Typhi
uuccugcguugacca

SEQ ID NO: 1682693 - RNA, 11 nt, Salmonella enterica enterica serovar Typhi
uuccugucaac

SEQ ID NO: 1682694 - RNA, 18 nt, Salmonella enterica enterica serovar Typhi
uuccugucucuauuaacc

SEQ ID NO: 1682695 - RNA, 16 nt, Salmonella enterica enterica serovar Typhi
uuccugcugcgcuuug

SEQ ID NO: 1682696 - RNA, 16 nt, Salmonella enterica enterica serovar Typhi
uucccaagucacgccc

SEQ ID NO: 1682697 - RNA, 14 nt, Salmonella enterica enterica serovar Typhi
uucccaauaguuua

SEQ ID NO: 1682698 - RNA, 23 nt, Salmonella enterica enterica serovar Typhi
uucccacgggcgcaccauaccua

SEQ ID NO: 1682699 - RNA, 23 nt, Salmonella enterica enterica serovar Typhi
uucccacaguuaacgccaacgcc

SEQ ID NO: 1682700 - RNA, 15 nt, Salmonella enterica enterica serovar Typhi
uucccaacuguauuu

SEQ ID NO: 1682701 - RNA, 11 nt, Salmonella enterica enterica serovar Typhi
uuccauuuuuc

SEQ ID NO: 1682702 - RNA, 12 nt, Salmonella enterica enterica serovar Typhi
uucccagcgccc

SEQ ID NO: 1682703 - RNA, 22 nt, Salmonella enterica enterica serovar Typhi
uucccagguuuuggucagcuca

SEQ ID NO: 1682704 - RNA, 20 nt, Salmonella enterica enterica serovar Typhi
uucccaccgcgaauuucacc

SEQ ID NO: 1682705 - RNA, 16 nt, Salmonella enterica enterica serovar Typhi
uucccacuccgcccag

SEQ ID NO: 1682706 - RNA, 14 nt, Salmonella enterica enterica serovar Typhi
uucccaucgcuuug

SEQ ID NO: 1682707 - RNA, 16 nt, Salmonella enterica enterica serovar Typhi
uucccgccgcaauucc

SEQ ID NO: 1682708 - RNA, 23 nt, Salmonella enterica enterica serovar Typhi
uucccgcaccgcgaugcugcucu

SEQ ID NO: 1682709 - RNA, 11 nt, Salmonella enterica enterica serovar Typhi
uucccgagcgg

SEQ ID NO: 1682710 - RNA, 14 nt, Salmonella enterica enterica serovar Typhi
uucccgaaaggaag

SEQ ID NO: 1682711 - RNA, 11 nt, Salmonella enterica enterica serovar Typhi
uucccgagcga

SEQ ID NO: 1682712 - RNA, 12 nt, Salmonella enterica enterica serovar Typhi
uuccccauaauc

SEQ ID NO: 1682713 - RNA, 15 nt, Salmonella enterica enterica serovar Typhi
uuccccuucuguaag

SEQ ID NO: 1682714 - RNA, 19 nt, Salmonella enterica enterica serovar Typhi
uucccauugggccagcagc

SEQ ID NO: 1682715 - RNA, 15 nt, Salmonella enterica enterica serovar Typhi
uuccccaccaggaau

SEQ ID NO: 1682716 - RNA, 18 nt, Salmonella enterica enterica serovar Typhi
uucccgccgccauugcca

SEQ ID NO: 1682717 - RNA, 23 nt, Salmonella enterica enterica serovar Typhi
uucccgcuauagaaugcaagcag

SEQ ID NO: 1682718 - RNA, 15 nt, Salmonella enterica enterica serovar Typhi
uuccgcaauacagcc

SEQ ID NO: 1682719 - RNA, 12 nt, Salmonella enterica enterica serovar Typhi
uuccgcaauaag

SEQ ID NO: 1682720 - RNA, 20 nt, Salmonella enterica enterica serovar Typhi
uugccugauggcgcugcgcu

SEQ ID NO: 1682721 - RNA, 15 nt, Salmonella enterica enterica serovar Typhi
uugccuucuguuuuu

SEQ ID NO: 1682722 - RNA, 15 nt, Salmonella enterica enterica serovar Typhi
uugcgugucaucaaa

SEQ ID NO: 1682723 - RNA, 14 nt, Salmonella enterica enterica serovar Typhi
uugcgucaccgggc

SEQ ID NO: 1682724 - RNA, 12 nt, Salmonella enterica enterica serovar Typhi
uugcgucaugcg

SEQ ID NO: 1682725 - RNA, 23 nt, Salmonella enterica enterica serovar Typhi
uugcgcccgcucuuauugcucuu

SEQ ID NO: 1682726 - RNA, 14 nt, Salmonella enterica enterica serovar Typhi
uugcgccagcgcca

SEQ ID NO: 1682727 - RNA, 11 nt, Salmonella enterica enterica serovar Typhi
uugcucaagcu

SEQ ID NO: 1682728 - RNA, 12 nt, Salmonella enterica enterica serovar Typhi
uugcucaaugga

SEQ ID NO: 1682729 - RNA, 17 nt, Salmonella enterica enterica serovar Typhi
uugcucaauggauuuuc

SEQ ID NO: 1682730 - RNA, 13 nt, Salmonella enterica enterica serovar Typhi
uugcucaauuuuu

SEQ ID NO: 1682731 - RNA, 22 nt, Salmonella enterica enterica serovar Typhi
uugcucacccauuuuauccucu

SEQ ID NO: 1682732 - RNA, 19 nt, Salmonella enterica enterica serovar Typhi
uugcucaggcgcgaauaau

SEQ ID NO: 1682733 - RNA, 19 nt, Salmonella enterica enterica serovar Typhi
uugcucgcggcgugaugcc

SEQ ID NO: 1682734 - RNA, 20 nt, Salmonella enterica enterica serovar Typhi
uugcccgguggcgcugcgcu

SEQ ID NO: 1682735 - RNA, 16 nt, Salmonella enterica enterica serovar Typhi
uugcccuggaauuuuu

SEQ ID NO: 1682736 - RNA, 18 nt, Salmonella enterica enterica serovar Typhi
uugcccuggaauuuuucc

SEQ ID NO: 1682737 - RNA, 14 nt, Salmonella enterica enterica serovar Typhi
uugcccuuuuguuu

SEQ ID NO: 1682738 - RNA, 14 nt, Salmonella enterica enterica serovar Typhi
uugccggcaucauu

SEQ ID NO: 1682739 - RNA, 19 nt, Salmonella enterica enterica serovar Typhi
uugccucgucuugauuuca

SEQ ID NO: 1682740 - RNA, 24 nt, Salmonella enterica enterica serovar Typhi
uugccgcgccagacgccauaucgc

SEQ ID NO: 1682741 - RNA, 16 nt, Salmonella enterica enterica serovar Typhi
uugccgcccugaaagc

SEQ ID NO: 1682742 - RNA, 15 nt, Salmonella enterica enterica serovar Typhi
uugccgccgagcaga

SEQ ID NO: 1682743 - RNA, 15 nt, Salmonella enterica enterica serovar Typhi
uugccacauuucccg

SEQ ID NO: 1682744 - RNA, 21 nt, Salmonella enterica enterica serovar Typhi
uugccacaauaucaucgucau

SEQ ID NO: 1682745 - RNA, 23 nt, Salmonella enterica enterica serovar Typhi
uugccccguggcgggaugcccca

SEQ ID NO: 1682746 - RNA, 22 nt, Salmonella enterica enterica serovar Typhi
uugccccucccugaaucauauu

SEQ ID NO: 1682747 - RNA, 15 nt, Salmonella enterica enterica serovar Typhi
uugcacguucugcug

SEQ ID NO: 1682748 - RNA, 20 nt, Salmonella enterica enterica serovar Typhi
uugaugauaaccgccgccaa

SEQ ID NO: 1682749 - RNA, 20 nt, Salmonella enterica enterica serovar Typhi
uugcaagaaauguccauaaa

SEQ ID NO: 1682750 - RNA, 12 nt, Salmonella enterica enterica serovar Typhi
uugcaacuauua

SEQ ID NO: 1682751 - RNA, 19 nt, Salmonella enterica enterica serovar Typhi
uugcaagucaccaucagua

SEQ ID NO: 1682752 - RNA, 14 nt, Salmonella enterica enterica serovar Typhi
uugagaaaaccaua

SEQ ID NO: 1682753 - RNA, 18 nt, Salmonella enterica enterica serovar Typhi
uugauaaaacgaauacua

SEQ ID NO: 1682754 - RNA, 16 nt, Salmonella enterica enterica serovar Typhi
uugauaacggaaucac

SEQ ID NO: 1682755 - RNA, 19 nt, Salmonella enterica enterica serovar Typhi
uugauauugugcauacuga

SEQ ID NO: 1682756 - RNA, 13 nt, Salmonella enterica enterica serovar Typhi
uugaucacaaaau

SEQ ID NO: 1682757 - RNA, 22 nt, Salmonella enterica enterica serovar Typhi
uugaacagcgucauccaguguu

SEQ ID NO: 1682758 - RNA, 16 nt, Salmonella enterica enterica serovar Typhi
uugaacauuuuuucag

SEQ ID NO: 1682759 - RNA, 17 nt, Salmonella enterica enterica serovar Typhi
uugaacccguaagcccu

SEQ ID NO: 1682760 - RNA, 13 nt, Salmonella enterica enterica serovar Typhi
uugaaccaucucg

SEQ ID NO: 1682761 - RNA, 16 nt, Salmonella enterica enterica serovar Typhi
uugaaaacaccaggga

SEQ ID NO: 1682762 - RNA, 12 nt, Salmonella enterica enterica serovar Typhi
uucuuuucaggc

SEQ ID NO: 1682763 - RNA, 20 nt, Salmonella enterica enterica serovar Typhi
uucuuuuucgaucagcauau

SEQ ID NO: 1682764 - RNA, 12 nt, Salmonella enterica enterica serovar Typhi
uucuuuuuauau

SEQ ID NO: 1682765 - RNA, 15 nt, Salmonella enterica enterica serovar Typhi
uucuuuuuauauucc

SEQ ID NO: 1682766 - RNA, 15 nt, Salmonella enterica enterica serovar Typhi
uucuuugccuuuuuc

SEQ ID NO: 1682767 - RNA, 17 nt, Salmonella enterica enterica serovar Typhi
uucuuugcgccuuauuc

SEQ ID NO: 1682768 - RNA, 19 nt, Salmonella enterica enterica serovar Typhi
uucuuuacgcagcaagaac

SEQ ID NO: 1682769 - RNA, 17 nt, Salmonella enterica enterica serovar Typhi
uucuuuaauuugugcca

SEQ ID NO: 1682770 - RNA, 15 nt, Salmonella enterica enterica serovar Typhi
uucuuuaaucagauu

SEQ ID NO: 1682771 - RNA, 13 nt, Salmonella enterica enterica serovar Typhi
uucuuucacuguc

SEQ ID NO: 1682772 - RNA, 18 nt, Salmonella enterica enterica serovar Typhi
uucuuucagcucuucaau

SEQ ID NO: 1682773 - RNA, 19 nt, Salmonella enterica enterica serovar Typhi
uucuuuauucacuuuuucu

SEQ ID NO: 1682774 - RNA, 20 nt, Salmonella enterica enterica serovar Typhi
uucuuuaagaacgguuggaa

SEQ ID NO: 1682775 - RNA, 13 nt, Salmonella enterica enterica serovar Typhi
uucugccuuuuuu

SEQ ID NO: 1682776 - RNA, 17 nt, Salmonella enterica enterica serovar Typhi
uucugccagcagaagac

SEQ ID NO: 1682777 - RNA, 12 nt, Salmonella enterica enterica serovar Typhi
uucugccagguu

SEQ ID NO: 1682778 - RNA, 13 nt, Salmonella enterica enterica serovar Typhi
uugaauggcugcu

SEQ ID NO: 1682779 - RNA, 22 nt, Salmonella enterica enterica serovar Typhi
uugaaucgccuggcuugccggc

SEQ ID NO: 1682780 - RNA, 16 nt, Salmonella enterica enterica serovar Typhi
uugaauaaugcccguu

SEQ ID NO: 1682781 - RNA, 17 nt, Salmonella enterica enterica serovar Typhi
uugaauaacguguuaug

SEQ ID NO: 1682782 - RNA, 18 nt, Salmonella enterica enterica serovar Typhi
uugaauaaccauacugac

SEQ ID NO: 1682783 - RNA, 19 nt, Salmonella enterica enterica serovar Typhi
uugaaguuauccagcgccc

SEQ ID NO: 1682784 - RNA, 23 nt, Salmonella enterica enterica serovar Typhi
uugaagugguggcgaacaggcuc

SEQ ID NO: 1682785 - RNA, 15 nt, Salmonella enterica enterica serovar Typhi
uugaacucuuucaga

SEQ ID NO: 1682786 - RNA, 13 nt, Salmonella enterica enterica serovar Typhi
uugaagaaaaacc

SEQ ID NO: 1682787 - RNA, 17 nt, Salmonella enterica enterica serovar Typhi
uugaacuuacccagcaa

SEQ ID NO: 1682788 - RNA, 13 nt, Salmonella enterica enterica serovar Typhi
uugacgcaaacug

SEQ ID NO: 1682789 - RNA, 14 nt, Salmonella enterica enterica serovar Typhi
uugacgaaaagaua

SEQ ID NO: 1682790 - RNA, 14 nt, Salmonella enterica enterica serovar Typhi
uugaccaucgccag

SEQ ID NO: 1682791 - RNA, 17 nt, Salmonella enterica enterica serovar Typhi
uugaccguccccagcca

SEQ ID NO: 1682792 - RNA, 16 nt, Salmonella enterica enterica serovar Typhi
uugaccggaaaaaaau

SEQ ID NO: 1682793 - RNA, 22 nt, Salmonella enterica enterica serovar Typhi
uugacguaacgcuggugaccaa

SEQ ID NO: 1682794 - RNA, 20 nt, Salmonella enterica enterica serovar Typhi
uugacugcgggggcaaaugc

SEQ ID NO: 1682795 - RNA, 16 nt, Salmonella enterica enterica serovar Typhi
uugacucuguuauaua

SEQ ID NO: 1682796 - RNA, 15 nt, Salmonella enterica enterica serovar Typhi
uugaccaacaaucgc

SEQ ID NO: 1682797 - RNA, 13 nt, Salmonella enterica enterica serovar Typhi
uugacaucaggau

SEQ ID NO: 1682798 - RNA, 23 nt, Salmonella enterica enterica serovar Typhi
uuuaccagugcuaaaauuauaca

SEQ ID NO: 1682799 - RNA, 22 nt, Salmonella enterica enterica serovar Typhi
uuuaccauuacgcuauaaaguu

SEQ ID NO: 1682800 - RNA, 13 nt, Salmonella enterica enterica serovar Typhi
uuuaccauucagc

SEQ ID NO: 1682801 - RNA, 23 nt, Salmonella enterica enterica serovar Typhi
uuuacaaccguggcguuuucauu

SEQ ID NO: 1682802 - RNA, 15 nt, Salmonella enterica enterica serovar Typhi
uuuaauuaauccauu

SEQ ID NO: 1682803 - RNA, 16 nt, Salmonella enterica enterica serovar Typhi
uuuaaccucuuuuuca

SEQ ID NO: 1682804 - RNA, 21 nt, Salmonella enterica enterica serovar Typhi
uuuaacgcaaccgucucacca

SEQ ID NO: 1682805 - RNA, 20 nt, Salmonella enterica enterica serovar Typhi
uuuaacuaauggcaauaaua

SEQ ID NO: 1682806 - RNA, 15 nt, Salmonella enterica enterica serovar Typhi
uuuaauuuucuguaa

SEQ ID NO: 1682807 - RNA, 21 nt, Salmonella enterica enterica serovar Typhi
uuuaauuuucuguaauucucc

SEQ ID NO: 1682808 - RNA, 18 nt, Salmonella enterica enterica serovar Typhi
uuuagccaucccggcgac

SEQ ID NO: 1682809 - RNA, 23 nt, Salmonella enterica enterica serovar Typhi
uuuagccugcgcguaaauuucac

SEQ ID NO: 1682810 - RNA, 19 nt, Salmonella enterica enterica serovar Typhi
uuuagcguaggccacaaag

SEQ ID NO: 1682811 - RNA, 16 nt, Salmonella enterica enterica serovar Typhi
uuuagcgccagcagca

SEQ ID NO: 1682812 - RNA, 19 nt, Salmonella enterica enterica serovar Typhi
uuuaggcggcuucacgcca

SEQ ID NO: 1682813 - RNA, 11 nt, Salmonella enterica enterica serovar Typhi
uuuagcuuuuc

SEQ ID NO: 1682814 - RNA, 20 nt, Salmonella enterica enterica serovar Typhi
uuuacgcagauaacuuccuu

SEQ ID NO: 1682815 - RNA, 17 nt, Salmonella enterica enterica serovar Typhi
uuuacuauugccgauaa

SEQ ID NO: 1682816 - RNA, 21 nt, Salmonella enterica enterica serovar Typhi
uuuacgauacguuuaaaauga

SEQ ID NO: 1682817 - RNA, 18 nt, Salmonella enterica enterica serovar Typhi
uuuacuccauucccagcu

SEQ ID NO: 1682818 - RNA, 14 nt, Salmonella enterica enterica serovar Typhi
uuuacugacaauaa

SEQ ID NO: 1682819 - RNA, 20 nt, Salmonella enterica enterica serovar Typhi
uuuacugauuagccuguugg

SEQ ID NO: 1682820 - RNA, 20 nt, Salmonella enterica enterica serovar Typhi
uuuacugcgaaggcuacugc

SEQ ID NO: 1682821 - RNA, 13 nt, Salmonella enterica enterica serovar Typhi
uuuagugcucagc

SEQ ID NO: 1682822 - RNA, 14 nt, Salmonella enterica enterica serovar Typhi
uugcugauaaucaa

SEQ ID NO: 1682823 - RNA, 21 nt, Salmonella enterica enterica serovar Typhi
uugcugagccaucauuaccaa

SEQ ID NO: 1682824 - RNA, 16 nt, Salmonella enterica enterica serovar Typhi
uugcugcgcaggggcu

SEQ ID NO: 1682825 - RNA, 18 nt, Salmonella enterica enterica serovar Typhi
uugcugcggcacgaaaaa

SEQ ID NO: 1682826 - RNA, 15 nt, Salmonella enterica enterica serovar Typhi
uugcugcuauauaac

SEQ ID NO: 1682827 - RNA, 20 nt, Salmonella enterica enterica serovar Typhi
uuguuguuaauuugauuuau

SEQ ID NO: 1682828 - RNA, 16 nt, Salmonella enterica enterica serovar Typhi
uuguuacucaauaaaa

SEQ ID NO: 1682829 - RNA, 13 nt, Salmonella enterica enterica serovar Typhi
uuguuuaccccag

SEQ ID NO: 1682830 - RNA, 13 nt, Salmonella enterica enterica serovar Typhi
uuguuuaaaaacc

SEQ ID NO: 1682831 - RNA, 18 nt, Salmonella enterica enterica serovar Typhi
uuuaaagaucucuaacuu

SEQ ID NO: 1682832 - RNA, 16 nt, Salmonella enterica enterica serovar Typhi
uuuaaaauccggcugc

SEQ ID NO: 1682833 - RNA, 13 nt, Salmonella enterica enterica serovar Typhi
uuuaaaaucaacg

SEQ ID NO: 1682834 - RNA, 15 nt, Salmonella enterica enterica serovar Typhi
uuuaaaccacaccug

SEQ ID NO: 1682835 - RNA, 18 nt, Salmonella enterica enterica serovar Typhi
uuuaaaauguuuuuguug

SEQ ID NO: 1682836 - RNA, 13 nt, Salmonella enterica enterica serovar Typhi
uuuaaacaacaua

SEQ ID NO: 1682837 - RNA, 14 nt, Salmonella enterica enterica serovar Typhi
uuuaacagauaauu

SEQ ID NO: 1682838 - RNA, 21 nt, Salmonella enterica enterica serovar Typhi
uuuaacaaauuaaauccugaa

SEQ ID NO: 1682839 - RNA, 17 nt, Salmonella enterica enterica serovar Typhi
uuuaacaauuuaucaga

SEQ ID NO: 1682840 - RNA, 24 nt, Salmonella enterica enterica serovar Typhi
uuucaccgcgucguuacgcucguc

SEQ ID NO: 1682841 - RNA, 19 nt, Salmonella enterica enterica serovar Typhi
uuucaccuggaugcugccu

SEQ ID NO: 1682842 - RNA, 12 nt, Salmonella enterica enterica serovar Typhi
uuucaccuucug

SEQ ID NO: 1682843 - RNA, 18 nt, Salmonella enterica enterica serovar Typhi
uuucacgccauugccagg

SEQ ID NO: 1682844 - RNA, 21 nt, Salmonella enterica enterica serovar Typhi
uuucacgccuuuugacgcuuc

SEQ ID NO: 1682845 - RNA, 12 nt, Salmonella enterica enterica serovar Typhi
uuucaacuggcu

SEQ ID NO: 1682846 - RNA, 23 nt, Salmonella enterica enterica serovar Typhi
uuucaauaauggcgcgaaaacag

SEQ ID NO: 1682847 - RNA, 18 nt, Salmonella enterica enterica serovar Typhi
uuucaauguaauuacccu

SEQ ID NO: 1682848 - RNA, 17 nt, Salmonella enterica enterica serovar Typhi
uuucaauuccacaggcg

SEQ ID NO: 1682849 - RNA, 19 nt, Salmonella enterica enterica serovar Typhi
uuucaauauagccguggcu

SEQ ID NO: 1682850 - RNA, 23 nt, Salmonella enterica enterica serovar Typhi
uuuauuuggcucugaagcguaaa

SEQ ID NO: 1682851 - RNA, 18 nt, Salmonella enterica enterica serovar Typhi
uuucaacccccucagcaa

SEQ ID NO: 1682852 - RNA, 22 nt, Salmonella enterica enterica serovar Typhi
uuucaacggauugugaaauucg

SEQ ID NO: 1682853 - RNA, 15 nt, Salmonella enterica enterica serovar Typhi
uuucaacugccccuu

SEQ ID NO: 1682854 - RNA, 21 nt, Salmonella enterica enterica serovar Typhi
uuucaaccgcgccaaagauaa

SEQ ID NO: 1682855 - RNA, 23 nt, Salmonella enterica enterica serovar Typhi
uuucaacauauuuuucacacaua

SEQ ID NO: 1682856 - RNA, 20 nt, Salmonella enterica enterica serovar Typhi
uuucaacauauuuuucacac

SEQ ID NO: 1682857 - RNA, 18 nt, Salmonella enterica enterica serovar Typhi
uuuauuaggccuacaaga

SEQ ID NO: 1682858 - RNA, 15 nt, Salmonella enterica enterica serovar Typhi
uuuauacucaaaaaa

SEQ ID NO: 1682859 - RNA, 12 nt, Salmonella enterica enterica serovar Typhi
uuucauccucuu

SEQ ID NO: 1682860 - RNA, 23 nt, Salmonella enterica enterica serovar Typhi
uuucauauuauuauauagacucc

SEQ ID NO: 1682861 - RNA, 14 nt, Salmonella enterica enterica serovar Typhi
uuucauauuuuccu

SEQ ID NO: 1682862 - RNA, 15 nt, Salmonella enterica enterica serovar Typhi
uuucaucuucaguaa

SEQ ID NO: 1682863 - RNA, 19 nt, Salmonella enterica enterica serovar Typhi
uuucaucuccgauaaauaa

SEQ ID NO: 1682864 - RNA, 16 nt, Salmonella enterica enterica serovar Typhi
uuucaugccauacucc

SEQ ID NO: 1682865 - RNA, 21 nt, Salmonella enterica enterica serovar Typhi
uuucauggucaucgcaaauuc

SEQ ID NO: 1682866 - RNA, 20 nt, Salmonella enterica enterica serovar Typhi
uuucauucagggaaucagcg

SEQ ID NO: 1682867 - RNA, 22 nt, Salmonella enterica enterica serovar Typhi
uuuccagcuccagccgcugccu

SEQ ID NO: 1682868 - RNA, 22 nt, Salmonella enterica enterica serovar Typhi
uuuccagcacgcccauauccag

SEQ ID NO: 1682869 - RNA, 20 nt, Salmonella enterica enterica serovar Typhi
uuuccagccccuucgcuguc

SEQ ID NO: 1682870 - RNA, 20 nt, Salmonella enterica enterica serovar Typhi
uuuccagaguacauucucuu

SEQ ID NO: 1682871 - RNA, 23 nt, Salmonella enterica enterica serovar Typhi
uuuccagcacgaccuuuucuuca

SEQ ID NO: 1682872 - RNA, 15 nt, Salmonella enterica enterica serovar Typhi
uuuccagcacgccca

SEQ ID NO: 1682873 - RNA, 22 nt, Salmonella enterica enterica serovar Typhi
uuuccacaaucccggcaacugc

SEQ ID NO: 1682874 - RNA, 21 nt, Salmonella enterica enterica serovar Typhi
uuuccacacaggaguucauca

SEQ ID NO: 1682875 - RNA, 16 nt, Salmonella enterica enterica serovar Typhi
uuucauuucugccugc

SEQ ID NO: 1682876 - RNA, 21 nt, Salmonella enterica enterica serovar Typhi
uuuccaaagcgaagcugcugu

SEQ ID NO: 1682877 - RNA, 21 nt, Salmonella enterica enterica serovar Typhi
uuucagugacgcguuaauauc

SEQ ID NO: 1682878 - RNA, 14 nt, Salmonella enterica enterica serovar Typhi
uuucagugauaaag

SEQ ID NO: 1682879 - RNA, 16 nt, Salmonella enterica enterica serovar Typhi
uuucagugauaaagcc

SEQ ID NO: 1682880 - RNA, 18 nt, Salmonella enterica enterica serovar Typhi
uuucagcucgcaggccau

SEQ ID NO: 1682881 - RNA, 22 nt, Salmonella enterica enterica serovar Typhi
uuucagcggcagcucugccugu

SEQ ID NO: 1682882 - RNA, 16 nt, Salmonella enterica enterica serovar Typhi
uuucauaaugugugua

SEQ ID NO: 1682883 - RNA, 15 nt, Salmonella enterica enterica serovar Typhi
uuucauagaaccacu

SEQ ID NO: 1682884 - RNA, 12 nt, Salmonella enterica enterica serovar Typhi
uuucauaauguu

SEQ ID NO: 1682885 - RNA, 22 nt, Salmonella enterica enterica serovar Typhi
uuucaguuucggccccccccau

SEQ ID NO: 1682886 - RNA, 18 nt, Salmonella enterica enterica serovar Typhi
uuucauaauaagcgcuca

SEQ ID NO: 1682887 - RNA, 23 nt, Salmonella enterica enterica serovar Typhi
uuucacgccauugccaggacuga

SEQ ID NO: 1682888 - RNA, 23 nt, Salmonella enterica enterica serovar Typhi
uuucagcgcagaauuuauuucug

SEQ ID NO: 1682889 - RNA, 20 nt, Salmonella enterica enterica serovar Typhi
uuucagcggcagcucugccu

SEQ ID NO: 1682890 - RNA, 14 nt, Salmonella enterica enterica serovar Typhi
uuucagcagugcaa

SEQ ID NO: 1682891 - RNA, 19 nt, Salmonella enterica enterica serovar Typhi
uuucagccgcgcauagcug

SEQ ID NO: 1682892 - RNA, 18 nt, Salmonella enterica enterica serovar Typhi
uuucagaucggcaaaagu

SEQ ID NO: 1682893 - RNA, 18 nt, Salmonella enterica enterica serovar Typhi
uuucagaucgguaaaagc

SEQ ID NO: 1682894 - RNA, 18 nt, Salmonella enterica enterica serovar Typhi
uuucagaggucaggauuu

SEQ ID NO: 1682895 - RNA, 18 nt, Salmonella enterica enterica serovar Typhi
uuucagauaacgaaccau

SEQ ID NO: 1682896 - RNA, 18 nt, Salmonella enterica enterica serovar Typhi
uuugccagacgggccagg

SEQ ID NO: 1682897 - RNA, 14 nt, Salmonella enterica enterica serovar Typhi
uuugccagcaccag

SEQ ID NO: 1682898 - RNA, 14 nt, Salmonella enterica enterica serovar Typhi
uuugccuuucuuau

SEQ ID NO: 1682899 - RNA, 21 nt, Salmonella enterica enterica serovar Typhi
uuugccccauuguucuuucau

SEQ ID NO: 1682900 - RNA, 12 nt, Salmonella enterica enterica serovar Typhi
uuugcucgccau

SEQ ID NO: 1682901 - RNA, 22 nt, Salmonella enterica enterica serovar Typhi
uuugcucaguucagcggucaua

SEQ ID NO: 1682902 - RNA, 12 nt, Salmonella enterica enterica serovar Typhi
uuugcuccagaa

SEQ ID NO: 1682903 - RNA, 18 nt, Salmonella enterica enterica serovar Typhi
uuugcgucguuccgucag

SEQ ID NO: 1682904 - RNA, 19 nt, Salmonella enterica enterica serovar Typhi
uuugcuacaccccuucugg

SEQ ID NO: 1682905 - RNA, 15 nt, Salmonella enterica enterica serovar Typhi
uuugcguaaaaaaca

SEQ ID NO: 1682906 - RNA, 21 nt, Salmonella enterica enterica serovar Typhi
uuugcgcgaagucgagcucag

SEQ ID NO: 1682907 - RNA, 22 nt, Salmonella enterica enterica serovar Typhi
uuugcgcccgcucuuauugcuc

SEQ ID NO: 1682908 - RNA, 22 nt, Salmonella enterica enterica serovar Typhi
uuugcggacuagacagccucuc

SEQ ID NO: 1682909 - RNA, 22 nt, Salmonella enterica enterica serovar Typhi
uuugcggcguccaguacuuucu

SEQ ID NO: 1682910 - RNA, 15 nt, Salmonella enterica enterica serovar Typhi
uuugccuuucuuauu

SEQ ID NO: 1682911 - RNA, 19 nt, Salmonella enterica enterica serovar Typhi
uuugccuuuugacagcaca

SEQ ID NO: 1682912 - RNA, 13 nt, Salmonella enterica enterica serovar Typhi
uuugcgacaucag

SEQ ID NO: 1682913 - RNA, 20 nt, Salmonella enterica enterica serovar Typhi
uuugcgcaguuuaaaucaca

SEQ ID NO: 1682914 - RNA, 22 nt, Salmonella enterica enterica serovar Typhi
uuugauuuguuuuuuauauuuu

SEQ ID NO: 1682915 - RNA, 17 nt, Salmonella enterica enterica serovar Typhi
uuugcaccgcuaaaaaa

SEQ ID NO: 1682916 - RNA, 20 nt, Salmonella enterica enterica serovar Typhi
uuugcaccgcuaaaaaacag

SEQ ID NO: 1682917 - RNA, 17 nt, Salmonella enterica enterica serovar Typhi
uuugcacguucugcugg

SEQ ID NO: 1682918 - RNA, 12 nt, Salmonella enterica enterica serovar Typhi
uuugcagaaaau

SEQ ID NO: 1682919 - RNA, 21 nt, Salmonella enterica enterica serovar Typhi
uuugauguccggcgcguucau

SEQ ID NO: 1682920 - RNA, 21 nt, Salmonella enterica enterica serovar Typhi
uuugaucccguccgcgcucau

SEQ ID NO: 1682921 - RNA, 22 nt, Salmonella enterica enterica serovar Typhi
uuugauagacguaaugaucaga

SEQ ID NO: 1682922 - RNA, 19 nt, Salmonella enterica enterica serovar Typhi
uuugagguaugucgaauau

SEQ ID NO: 1682923 - RNA, 17 nt, Salmonella enterica enterica serovar Typhi
uuugagucgcauccagu

SEQ ID NO: 1682924 - RNA, 22 nt, Salmonella enterica enterica serovar Typhi
uuucuugaugugucuauuuauu

SEQ ID NO: 1682925 - RNA, 23 nt, Salmonella enterica enterica serovar Typhi
uuucuugccacuggccucccagu

SEQ ID NO: 1682926 - RNA, 21 nt, Salmonella enterica enterica serovar Typhi
uuucuugccacuggccuccca

SEQ ID NO: 1682927 - RNA, 15 nt, Salmonella enterica enterica serovar Typhi
uuucuucuuaacacu

SEQ ID NO: 1682928 - RNA, 17 nt, Salmonella enterica enterica serovar Typhi
uuucuuugcgaaacauc

SEQ ID NO: 1682929 - RNA, 13 nt, Salmonella enterica enterica serovar Typhi
uuucuuccagguu

SEQ ID NO: 1682930 - RNA, 13 nt, Salmonella enterica enterica serovar Typhi
uuucuuauuuauu

SEQ ID NO: 1682931 - RNA, 14 nt, Salmonella enterica enterica serovar Typhi
uuucuguuaucagg

SEQ ID NO: 1682932 - RNA, 14 nt, Salmonella enterica enterica serovar Typhi
uuucuguuccgaaa

SEQ ID NO: 1682933 - RNA, 12 nt, Salmonella enterica enterica serovar Typhi
uuucuuaacccc

SEQ ID NO: 1682934 - RNA, 18 nt, Salmonella enterica enterica serovar Typhi
uuucuuaauaugcugccu

SEQ ID NO: 1682935 - RNA, 13 nt, Salmonella enterica enterica serovar Typhi
uuugaccucgccu

SEQ ID NO: 1682936 - RNA, 22 nt, Salmonella enterica enterica serovar Typhi
uuugacgccgggaaauuuuucg

SEQ ID NO: 1682937 - RNA, 20 nt, Salmonella enterica enterica serovar Typhi
uuugacgacaaacuccagcu

SEQ ID NO: 1682938 - RNA, 22 nt, Salmonella enterica enterica serovar Typhi
uuugagcaucaaacuuuuaaau

SEQ ID NO: 1682939 - RNA, 12 nt, Salmonella enterica enterica serovar Typhi
uuugaggaaacc

SEQ ID NO: 1682940 - RNA, 15 nt, Salmonella enterica enterica serovar Typhi
uuugaacucuuucag

SEQ ID NO: 1682941 - RNA, 13 nt, Salmonella enterica enterica serovar Typhi
uuugaaaaucaca

SEQ ID NO: 1682942 - RNA, 14 nt, Salmonella enterica enterica serovar Typhi
uuucuuucaucaaa

SEQ ID NO: 1682943 - RNA, 23 nt, Salmonella enterica enterica serovar Typhi
uuuccggucgcgcaaucgguaaa

SEQ ID NO: 1682944 - RNA, 21 nt, Salmonella enterica enterica serovar Typhi
uuuccgggauguuaauuucau

SEQ ID NO: 1682945 - RNA, 18 nt, Salmonella enterica enterica serovar Typhi
uuuccgcagccagaauca

SEQ ID NO: 1682946 - RNA, 17 nt, Salmonella enterica enterica serovar Typhi
uuuccgcaucguuauca

SEQ ID NO: 1682947 - RNA, 20 nt, Salmonella enterica enterica serovar Typhi
uuuccgcuaucuguugcgcc

SEQ ID NO: 1682948 - RNA, 18 nt, Salmonella enterica enterica serovar Typhi
uuuccgcgagagaaaaaa

SEQ ID NO: 1682949 - RNA, 14 nt, Salmonella enterica enterica serovar Typhi
uuuccggaaugaga

SEQ ID NO: 1682950 - RNA, 18 nt, Salmonella enterica enterica serovar Typhi
uuucccgcgugaacacca

SEQ ID NO: 1682951 - RNA, 18 nt, Salmonella enterica enterica serovar Typhi
uuucccuuuuuaaaauga

SEQ ID NO: 1682952 - RNA, 20 nt, Salmonella enterica enterica serovar Typhi
uuucccugaugauagcgcca

SEQ ID NO: 1682953 - RNA, 15 nt, Salmonella enterica enterica serovar Typhi
uuucccuucugaaau

SEQ ID NO: 1682954 - RNA, 22 nt, Salmonella enterica enterica serovar Typhi
uuuccccaaagguguuauuucu

SEQ ID NO: 1682955 - RNA, 15 nt, Salmonella enterica enterica serovar Typhi
uuucccccacuucug

SEQ ID NO: 1682956 - RNA, 19 nt, Salmonella enterica enterica serovar Typhi
uuucccccuccauacccua

SEQ ID NO: 1682957 - RNA, 15 nt, Salmonella enterica enterica serovar Typhi
uuuccccgacggccu

SEQ ID NO: 1682958 - RNA, 20 nt, Salmonella enterica enterica serovar Typhi
uuucccaacuguauuuugaa

SEQ ID NO: 1682959 - RNA, 13 nt, Salmonella enterica enterica serovar Typhi
uuucccaguggcg

SEQ ID NO: 1682960 - RNA, 13 nt, Salmonella enterica enterica serovar Typhi
uuucccacuguuc

SEQ ID NO: 1682961 - RNA, 19 nt, Salmonella enterica enterica serovar Typhi
uuuccaguagucgcgccau

SEQ ID NO: 1682962 - RNA, 22 nt, Salmonella enterica enterica serovar Typhi
uuuccauacauuuuuguaauaa

SEQ ID NO: 1682963 - RNA, 11 nt, Salmonella enterica enterica serovar Typhi
uuuccauauuu

SEQ ID NO: 1682964 - RNA, 23 nt, Salmonella enterica enterica serovar Typhi
uuuccugcauuaacggcaacagu

SEQ ID NO: 1682965 - RNA, 16 nt, Salmonella enterica enterica serovar Typhi
uuuccugcugccaucg

SEQ ID NO: 1682966 - RNA, 18 nt, Salmonella enterica enterica serovar Typhi
uuuccugaugauauuucu

SEQ ID NO: 1682967 - RNA, 13 nt, Salmonella enterica enterica serovar Typhi
uuuccugaaaaaa

SEQ ID NO: 1682968 - RNA, 17 nt, Salmonella enterica enterica serovar Typhi
uuuccguugugaacagc

SEQ ID NO: 1682969 - RNA, 22 nt, Salmonella enterica enterica serovar Typhi
uuuccguuuguaacauauuuuu

SEQ ID NO: 1682970 - RNA, 19 nt, Salmonella enterica enterica serovar Typhi
uuucgcgaauaaucuguuu

SEQ ID NO: 1682971 - RNA, 23 nt, Salmonella enterica enterica serovar Typhi
uuucgcgauaauagaacccaaag

SEQ ID NO: 1682972 - RNA, 18 nt, Salmonella enterica enterica serovar Typhi
uuucgccccacuggcccc

SEQ ID NO: 1682973 - RNA, 16 nt, Salmonella enterica enterica serovar Typhi
uuucgaugaaaaagag

SEQ ID NO: 1682974 - RNA, 15 nt, Salmonella enterica enterica serovar Typhi
uuucgcaaacugauc

SEQ ID NO: 1682975 - RNA, 12 nt, Salmonella enterica enterica serovar Typhi
uuucgccagcau

SEQ ID NO: 1682976 - RNA, 16 nt, Salmonella enterica enterica serovar Typhi
uuucgccccacuggcc

SEQ ID NO: 1682977 - RNA, 16 nt, Salmonella enterica enterica serovar Typhi
uuucgacuuucauuuc

SEQ ID NO: 1682978 - RNA, 21 nt, Salmonella enterica enterica serovar Typhi
uuucgacgauaaaaaaaguau

SEQ ID NO: 1682979 - RNA, 15 nt, Salmonella enterica enterica serovar Typhi
uuucgggcacuggcg

SEQ ID NO: 1682980 - RNA, 15 nt, Salmonella enterica enterica serovar Typhi
uuucggacuuccugu

SEQ ID NO: 1682981 - RNA, 19 nt, Salmonella enterica enterica serovar Typhi
uuucuagggauaacaguau

SEQ ID NO: 1682982 - RNA, 13 nt, Salmonella enterica enterica serovar Typhi
uuucuaucccuuc

SEQ ID NO: 1682983 - RNA, 16 nt, Salmonella enterica enterica serovar Typhi
uuucuaucguuauaua

SEQ ID NO: 1682984 - RNA, 13 nt, Salmonella enterica enterica serovar Typhi
uuucuacaaaugu

SEQ ID NO: 1682985 - RNA, 16 nt, Salmonella enterica enterica serovar Typhi
uuucucaaacacuucu

SEQ ID NO: 1682986 - RNA, 18 nt, Salmonella enterica enterica serovar Typhi
uuucucccgccagaugca

SEQ ID NO: 1682987 - RNA, 11 nt, Salmonella enterica enterica serovar Typhi
uuucucagcca

SEQ ID NO: 1682988 - RNA, 13 nt, Salmonella enterica enterica serovar Typhi
uuucucauuaaaa

SEQ ID NO: 1682989 - RNA, 16 nt, Salmonella enterica enterica serovar Typhi
uuucucguguagccag

SEQ ID NO: 1682990 - RNA, 19 nt, Salmonella enterica enterica serovar Typhi
uuucucggcuuuccagcuc

SEQ ID NO: 1682991 - RNA, 14 nt, Salmonella enterica enterica serovar Typhi
uuucucgccgccau

SEQ ID NO: 1682992 - RNA, 16 nt, Salmonella enterica enterica serovar Typhi
uuucuccugauuaauc

SEQ ID NO: 1682993 - RNA, 11 nt, Salmonella enterica enterica serovar Typhi
uuucuccugcg

SEQ ID NO: 1682994 - RNA, 15 nt, Salmonella enterica enterica serovar Typhi
uuucuccugcggccu

SEQ ID NO: 1682995 - RNA, 15 nt, Salmonella enterica enterica serovar Typhi
uuucugcuggccuuu

SEQ ID NO: 1682996 - RNA, 18 nt, Salmonella enterica enterica serovar Typhi
uuucugccuuuaacaaau

SEQ ID NO: 1682997 - RNA, 14 nt, Salmonella enterica enterica serovar Typhi
uuucugcugccagc

SEQ ID NO: 1682998 - RNA, 17 nt, Salmonella enterica enterica serovar Typhi
uuucuggcaacagccau

SEQ ID NO: 1682999 - RNA, 21 nt, Salmonella enterica enterica serovar Typhi
uuucuggcuucagccugugca

SEQ ID NO: 1683000 - RNA, 14 nt, Salmonella enterica enterica serovar Typhi
uuucugaugcgccu

SEQ ID NO: 1683001 - RNA, 22 nt, Salmonella enterica enterica serovar Typhi
uuucucugguuucccugccuca

SEQ ID NO: 1683002 - RNA, 12 nt, Salmonella enterica enterica serovar Typhi
uuucucuucuuu

SEQ ID NO: 1683003 - RNA, 19 nt, Salmonella enterica enterica serovar Typhi
uuucugacagugaugaauc

SEQ ID NO: 1683004 - RNA, 14 nt, Salmonella enterica enterica serovar Typhi
uuucugaauagaaa

SEQ ID NO: 1683005 - RNA, 11 nt, Salmonella enterica enterica serovar Typhi
uuuucaggccg

SEQ ID NO: 1683006 - RNA, 23 nt, Salmonella enterica enterica serovar Typhi
uuuucagccugaagccagcaauc

SEQ ID NO: 1683007 - RNA, 15 nt, Salmonella enterica enterica serovar Typhi
uuuucauauguuuga

SEQ ID NO: 1683008 - RNA, 13 nt, Salmonella enterica enterica serovar Typhi
uuuucaucaucau

SEQ ID NO: 1683009 - RNA, 15 nt, Salmonella enterica enterica serovar Typhi
uuuucacuaaucccc

SEQ ID NO: 1683010 - RNA, 16 nt, Salmonella enterica enterica serovar Typhi
uuuucagcaaauacag

SEQ ID NO: 1683011 - RNA, 18 nt, Salmonella enterica enterica serovar Typhi
uuuucagcggcagcucug

SEQ ID NO: 1683012 - RNA, 21 nt, Salmonella enterica enterica serovar Typhi
uuuucagauaacgaaccauca

SEQ ID NO: 1683013 - RNA, 18 nt, Salmonella enterica enterica serovar Typhi
uuuucagaggucaggauu

SEQ ID NO: 1683014 - RNA, 21 nt, Salmonella enterica enterica serovar Typhi
uuuucaacggcaucaauaauu

SEQ ID NO: 1683015 - RNA, 22 nt, Salmonella enterica enterica serovar Typhi
uuuucaauaauaaaacgacuca

SEQ ID NO: 1683016 - RNA, 12 nt, Salmonella enterica enterica serovar Typhi
uuuucaauaauc

SEQ ID NO: 1683017 - RNA, 17 nt, Salmonella enterica enterica serovar Typhi
uuuucaaccacggauaa

SEQ ID NO: 1683018 - RNA, 14 nt, Salmonella enterica enterica serovar Typhi
uuuuauuuuucaau

SEQ ID NO: 1683019 - RNA, 17 nt, Salmonella enterica enterica serovar Typhi
uuuuauuuuuauauucc

SEQ ID NO: 1683020 - RNA, 14 nt, Salmonella enterica enterica serovar Typhi
uuuucccauaaaag

SEQ ID NO: 1683021 - RNA, 15 nt, Salmonella enterica enterica serovar Typhi
uuuuccgcuuuuccu

SEQ ID NO: 1683022 - RNA, 14 nt, Salmonella enterica enterica serovar Typhi
uuuucccaacugua

SEQ ID NO: 1683023 - RNA, 18 nt, Salmonella enterica enterica serovar Typhi
uuuuccaggugcugccac

SEQ ID NO: 1683024 - RNA, 18 nt, Salmonella enterica enterica serovar Typhi
uuuuccacagacccagua

SEQ ID NO: 1683025 - RNA, 14 nt, Salmonella enterica enterica serovar Typhi
uuuuccacaauacc

SEQ ID NO: 1683026 - RNA, 20 nt, Salmonella enterica enterica serovar Typhi
uuuucauucgaucuguguac

SEQ ID NO: 1683027 - RNA, 20 nt, Salmonella enterica enterica serovar Typhi
uuuucgcccccagcacgaca

SEQ ID NO: 1683028 - RNA, 21 nt, Salmonella enterica enterica serovar Typhi
uuuucggcacaucaauaaauc

SEQ ID NO: 1683029 - RNA, 19 nt, Salmonella enterica enterica serovar Typhi
uuuuccugcugccaucgcu

SEQ ID NO: 1683030 - RNA, 16 nt, Salmonella enterica enterica serovar Typhi
uuuuccugcggcuuga

SEQ ID NO: 1683031 - RNA, 22 nt, Salmonella enterica enterica serovar Typhi
uuuucgcagagucgcagcggcg

SEQ ID NO: 1683032 - RNA, 15 nt, Salmonella enterica enterica serovar Typhi
uuuucgaucuucucc

SEQ ID NO: 1683033 - RNA, 15 nt, Salmonella enterica enterica serovar Typhi
uuuucgaaaauuucg

SEQ ID NO: 1683034 - RNA, 15 nt, Salmonella enterica enterica serovar Typhi
uuuucgacagcggcg

SEQ ID NO: 1683035 - RNA, 15 nt, Salmonella enterica enterica serovar Typhi
uuuuaggcuauaaaa

SEQ ID NO: 1683036 - RNA, 20 nt, Salmonella enterica enterica serovar Typhi
uuuuagcuuaaaaaauccug

SEQ ID NO: 1683037 - RNA, 20 nt, Salmonella enterica enterica serovar Typhi
uuuuacgccacggcaauuua

SEQ ID NO: 1683038 - RNA, 18 nt, Salmonella enterica enterica serovar Typhi
uuuuacuuaaaauugaau

SEQ ID NO: 1683039 - RNA, 19 nt, Salmonella enterica enterica serovar Typhi
uuuuacugcguaaucuuuu

SEQ ID NO: 1683040 - RNA, 14 nt, Salmonella enterica enterica serovar Typhi
uuuuagaauuaucu

SEQ ID NO: 1683041 - RNA, 19 nt, Salmonella enterica enterica serovar Typhi
uuuuagaauuaucugaaag

SEQ ID NO: 1683042 - RNA, 16 nt, Salmonella enterica enterica serovar Typhi
uuuuacuuuuuuaaau

SEQ ID NO: 1683043 - RNA, 13 nt, Salmonella enterica enterica serovar Typhi
uuuuagaaaauaa

SEQ ID NO: 1683044 - RNA, 21 nt, Salmonella enterica enterica serovar Typhi
uuuuagcaaugaugaugaagg

SEQ ID NO: 1683045 - RNA, 16 nt, Salmonella enterica enterica serovar Typhi
uuuuaucgauaauauc

SEQ ID NO: 1683046 - RNA, 16 nt, Salmonella enterica enterica serovar Typhi
uuuuaugcguuuaauu

SEQ ID NO: 1683047 - RNA, 23 nt, Salmonella enterica enterica serovar Typhi
uuuuauggaaucggcuaguaaua

SEQ ID NO: 1683048 - RNA, 12 nt, Salmonella enterica enterica serovar Typhi
uuuuaugcguuu

SEQ ID NO: 1683049 - RNA, 19 nt, Salmonella enterica enterica serovar Typhi
uuuuaugaugcauuugauu

SEQ ID NO: 1683050 - RNA, 20 nt, Salmonella enterica enterica serovar Typhi
uuuuaucgacagauuuugca

SEQ ID NO: 1683051 - RNA, 17 nt, Salmonella enterica enterica serovar Typhi
uuuuaucaggccugccu

SEQ ID NO: 1683052 - RNA, 22 nt, Salmonella enterica enterica serovar Typhi
uuuuauauguugaauauucaau

SEQ ID NO: 1683053 - RNA, 16 nt, Salmonella enterica enterica serovar Typhi
uuuuauuauauuuaaa

SEQ ID NO: 1683054 - RNA, 17 nt, Salmonella enterica enterica serovar Typhi
uuuuaugucauuuauuu

SEQ ID NO: 1683055 - RNA, 17 nt, Salmonella enterica enterica serovar Typhi
uuugucuccucaugccu

SEQ ID NO: 1683056 - RNA, 18 nt, Salmonella enterica enterica serovar Typhi
uuugucgcuguuaaucuc

SEQ ID NO: 1683057 - RNA, 18 nt, Salmonella enterica enterica serovar Typhi
uuugugaguucauaaaag

SEQ ID NO: 1683058 - RNA, 13 nt, Salmonella enterica enterica serovar Typhi
uuugugaguucau

SEQ ID NO: 1683059 - RNA, 16 nt, Salmonella enterica enterica serovar Typhi
uuugucuccucgccag

SEQ ID NO: 1683060 - RNA, 23 nt, Salmonella enterica enterica serovar Typhi
uuuguggccugcuuaaacaguau

SEQ ID NO: 1683061 - RNA, 16 nt, Salmonella enterica enterica serovar Typhi
uuuguggcguguggcu

SEQ ID NO: 1683062 - RNA, 17 nt, Salmonella enterica enterica serovar Typhi
uuuguaaaauacauucu

SEQ ID NO: 1683063 - RNA, 17 nt, Salmonella enterica enterica serovar Typhi
uuuguaacauauuuuua

SEQ ID NO: 1683064 - RNA, 16 nt, Salmonella enterica enterica serovar Typhi
uuuguacuucagagcu

SEQ ID NO: 1683065 - RNA, 15 nt, Salmonella enterica enterica serovar Typhi
uuuguacagcuugcc

SEQ ID NO: 1683066 - RNA, 22 nt, Salmonella enterica enterica serovar Typhi
uuuguauugcgcgucacaagcu

SEQ ID NO: 1683067 - RNA, 20 nt, Salmonella enterica enterica serovar Typhi
uuugcuggaaaaauaagagg

SEQ ID NO: 1683068 - RNA, 22 nt, Salmonella enterica enterica serovar Typhi
uuugcugguugucucaaaaaau

SEQ ID NO: 1683069 - RNA, 15 nt, Salmonella enterica enterica serovar Typhi
uuugcugcauuucuu

SEQ ID NO: 1683070 - RNA, 19 nt, Salmonella enterica enterica serovar Typhi
uuugcugacaaucugcugg

SEQ ID NO: 1683071 - RNA, 20 nt, Salmonella enterica enterica serovar Typhi
uuugcuucaauaaguuagcu

SEQ ID NO: 1683072 - RNA, 17 nt, Salmonella enterica enterica serovar Typhi
uuugcuguuuuuuguug

SEQ ID NO: 1683073 - RNA, 18 nt, Salmonella enterica enterica serovar Typhi
uuugcuguuuuauuuccu

SEQ ID NO: 1683074 - RNA, 12 nt, Salmonella enterica enterica serovar Typhi
uuugcuuccagu

SEQ ID NO: 1683075 - RNA, 22 nt, Salmonella enterica enterica serovar Typhi
uuugcuucgccaucuccaucau

SEQ ID NO: 1683076 - RNA, 18 nt, Salmonella enterica enterica serovar Typhi
uuugcuucucgccuucgg

SEQ ID NO: 1683077 - RNA, 17 nt, Salmonella enterica enterica serovar Typhi
uuugcuuucucgggccu

SEQ ID NO: 1683078 - RNA, 18 nt, Salmonella enterica enterica serovar Typhi
uuugguuacuauuuuuca

SEQ ID NO: 1683079 - RNA, 17 nt, Salmonella enterica enterica serovar Typhi
uuuggcgggcuuauccc

SEQ ID NO: 1683080 - RNA, 21 nt, Salmonella enterica enterica serovar Typhi
uuugggaauuagcgaaucaca

SEQ ID NO: 1683081 - RNA, 18 nt, Salmonella enterica enterica serovar Typhi
uuuggcgaauaaucaacc

SEQ ID NO: 1683082 - RNA, 22 nt, Salmonella enterica enterica serovar Typhi
uuuggcguaaucgauaagcuca

SEQ ID NO: 1683083 - RNA, 24 nt, Salmonella enterica enterica serovar Typhi
uuuggcaucaaaguuauuuaccac

SEQ ID NO: 1683084 - RNA, 12 nt, Salmonella enterica enterica serovar Typhi
uuuuaauuuuua

SEQ ID NO: 1683085 - RNA, 22 nt, Salmonella enterica enterica serovar Typhi
uuuuaauguccagcagugucug

SEQ ID NO: 1683086 - RNA, 13 nt, Salmonella enterica enterica serovar Typhi
uuuuaaauugaag

SEQ ID NO: 1683087 - RNA, 18 nt, Salmonella enterica enterica serovar Typhi
uuuuaagcauccaggaag

SEQ ID NO: 1683088 - RNA, 20 nt, Salmonella enterica enterica serovar Typhi
uuuuaaggcggcaaagauaa

SEQ ID NO: 1683089 - RNA, 18 nt, Salmonella enterica enterica serovar Typhi
uuuguuaucuacagugua

SEQ ID NO: 1683090 - RNA, 18 nt, Salmonella enterica enterica serovar Typhi
uuuguuuuccagauucuc

SEQ ID NO: 1683091 - RNA, 14 nt, Salmonella enterica enterica serovar Typhi
uuuguuuuuuauau

SEQ ID NO: 1683092 - RNA, 13 nt, Salmonella enterica enterica serovar Typhi
uuuuaaaaaaccg

SEQ ID NO: 1683093 - RNA, 12 nt, Salmonella enterica enterica serovar Typhi
uuuguuuaaaaa

SEQ ID NO: 1683094 - RNA, 19 nt, Salmonella enterica enterica serovar Typhi
uuuuaaauaacuuuuaauu

SEQ ID NO: 1683095 - RNA, 17 nt, Salmonella enterica enterica serovar Typhi
uuuuaaauguuuuuuca

SEQ ID NO: 1683096 - RNA, 14 nt, Salmonella enterica enterica serovar Typhi
uuuuaaaauguuuu

SEQ ID NO: 1683097 - RNA, 21 nt, Salmonella enterica enterica serovar Typhi
uuuuaaaauguuuuuguuguu

SEQ ID NO: 1683098 - RNA, 12 nt, Salmonella enterica enterica serovar Typhi
uuuuaaaaguua

SEQ ID NO: 1683099 - RNA, 12 nt, Salmonella enterica enterica serovar Typhi
uuuuaaaagaag

SEQ ID NO: 1683100 - RNA, 16 nt, Salmonella enterica enterica serovar Typhi
uuuuggggaaaauacc

SEQ ID NO: 1683101 - RNA, 24 nt, Salmonella enterica enterica serovar Typhi
uuuugccggauggcacugcgcuua

SEQ ID NO: 1683102 - RNA, 17 nt, Salmonella enterica enterica serovar Typhi
uuuugccguugcuguuc

SEQ ID NO: 1683103 - RNA, 21 nt, Salmonella enterica enterica serovar Typhi
uuuugcuacgucgccuggcau

SEQ ID NO: 1683104 - RNA, 10 nt, Salmonella enterica enterica serovar Typhi
uuuugccgcc

SEQ ID NO: 1683105 - RNA, 18 nt, Salmonella enterica enterica serovar Typhi
uuuugacaacaaaaagau

SEQ ID NO: 1683106 - RNA, 12 nt, Salmonella enterica enterica serovar Typhi
uuuugaauuuuu

SEQ ID NO: 1683107 - RNA, 20 nt, Salmonella enterica enterica serovar Typhi
uuuugauacucaucauaauc

SEQ ID NO: 1683108 - RNA, 22 nt, Salmonella enterica enterica serovar Typhi
uuuugcagcaacugauucaaaa

SEQ ID NO: 1683109 - RNA, 14 nt, Salmonella enterica enterica serovar Typhi
uuuucugcuuucuu

SEQ ID NO: 1683110 - RNA, 23 nt, Salmonella enterica enterica serovar Typhi
uuuucucuucugcugacaucucu

SEQ ID NO: 1683111 - RNA, 19 nt, Salmonella enterica enterica serovar Typhi
uuuucucguguagccagua

SEQ ID NO: 1683112 - RNA, 15 nt, Salmonella enterica enterica serovar Typhi
uuuucucaauacgau

SEQ ID NO: 1683113 - RNA, 17 nt, Salmonella enterica enterica serovar Typhi
uuuugaacauaugaagg

SEQ ID NO: 1683114 - RNA, 11 nt, Salmonella enterica enterica serovar Typhi
uuuucuucaug

SEQ ID NO: 1683115 - RNA, 12 nt, Salmonella enterica enterica serovar Typhi
uuuucuucuucg

SEQ ID NO: 1683116 - RNA, 23 nt, Salmonella enterica enterica serovar Typhi
uuuucuucuggccauuucaucau

SEQ ID NO: 1683117 - RNA, 15 nt, Salmonella enterica enterica serovar Typhi
uuuuucaugcaauaa

SEQ ID NO: 1683118 - RNA, 21 nt, Salmonella enterica enterica serovar Typhi
uuuuuccagcucagaaauaaa

SEQ ID NO: 1683119 - RNA, 12 nt, Salmonella enterica enterica serovar Typhi
uuuuuccagcuc

SEQ ID NO: 1683120 - RNA, 14 nt, Salmonella enterica enterica serovar Typhi
uuuuuccagcucag

SEQ ID NO: 1683121 - RNA, 12 nt, Salmonella enterica enterica serovar Typhi
uuuuucagaucg

SEQ ID NO: 1683122 - RNA, 15 nt, Salmonella enterica enterica serovar Typhi
uuuuucagcaaauac

SEQ ID NO: 1683123 - RNA, 17 nt, Salmonella enterica enterica serovar Typhi
uuuuucagaauaucgcc

SEQ ID NO: 1683124 - RNA, 14 nt, Salmonella enterica enterica serovar Typhi
uuuuucagccgcgc

SEQ ID NO: 1683125 - RNA, 13 nt, Salmonella enterica enterica serovar Typhi
uuuuucagcggca

SEQ ID NO: 1683126 - RNA, 17 nt, Salmonella enterica enterica serovar Typhi
uuuuuaggccaaacuua

SEQ ID NO: 1683127 - RNA, 17 nt, Salmonella enterica enterica serovar Typhi
uuuuuaccgacguuaaa

SEQ ID NO: 1683128 - RNA, 12 nt, Salmonella enterica enterica serovar Typhi
uuuuuaccaauu

SEQ ID NO: 1683129 - RNA, 13 nt, Salmonella enterica enterica serovar Typhi
uuuuuauauaagc

SEQ ID NO: 1683130 - RNA, 15 nt, Salmonella enterica enterica serovar Typhi
uuuuuaauccaggaa

SEQ ID NO: 1683131 - RNA, 12 nt, Salmonella enterica enterica serovar Typhi
uuuuuaauaaua

SEQ ID NO: 1683132 - RNA, 19 nt, Salmonella enterica enterica serovar Typhi
uuuuuaaauguuuuuucau

SEQ ID NO: 1683133 - RNA, 21 nt, Salmonella enterica enterica serovar Typhi
uuuuguauuccuucggugcca

SEQ ID NO: 1683134 - RNA, 13 nt, Salmonella enterica enterica serovar Typhi
uuuugucaucaga

SEQ ID NO: 1683135 - RNA, 17 nt, Salmonella enterica enterica serovar Typhi
uuuugucaugguaaaug

SEQ ID NO: 1683136 - RNA, 15 nt, Salmonella enterica enterica serovar Typhi
uuuuguugauuuuau

SEQ ID NO: 1683137 - RNA, 18 nt, Salmonella enterica enterica serovar Typhi
uuuugugucaaaaaguug

SEQ ID NO: 1683138 - RNA, 20 nt, Salmonella enterica enterica serovar Typhi
uuuuguggccugcuuaaaca

SEQ ID NO: 1683139 - RNA, 13 nt, Salmonella enterica enterica serovar Typhi
aaauguuuuuguu

SEQ ID NO: 1683140 - RNA, 12 nt, Salmonella enterica enterica serovar Typhi
aaauguuuuugu

SEQ ID NO: 1683141 - RNA, 9 nt, Salmonella enterica enterica serovar Typhi
aaauguuuu

SEQ ID NO: 1683142 - RNA, 19 nt, Salmonella enterica enterica serovar Typhi
aaauuaaauaacaaaugaa

SEQ ID NO: 1683143 - RNA, 15 nt, Salmonella enterica enterica serovar Typhi
aaauuaaauccugaa

SEQ ID NO: 1683144 - RNA, 13 nt, Salmonella enterica enterica serovar Typhi
aaauuaaucaggc

SEQ ID NO: 1683145 - RNA, 12 nt, Salmonella enterica enterica serovar Typhi
uuuuucuucagu

SEQ ID NO: 1683146 - RNA, 22 nt, Salmonella enterica enterica serovar Typhi
uuuuucucuguccggaauaacu

SEQ ID NO: 1683147 - RNA, 16 nt, Salmonella enterica enterica serovar Typhi
uuuuugacuaaaguuu

SEQ ID NO: 1683148 - RNA, 20 nt, Salmonella enterica enterica serovar Typhi
uuuuucccgauaacguaaau

SEQ ID NO: 1683149 - RNA, 16 nt, Salmonella enterica enterica serovar Typhi
uuuuucgaucagcaua

SEQ ID NO: 1683150 - RNA, 16 nt, Salmonella enterica enterica serovar Typhi
uuuuucgcgugccauu

SEQ ID NO: 1683151 - RNA, 13 nt, Salmonella enterica enterica serovar Typhi
uuuuuguauuccu

SEQ ID NO: 1683152 - RNA, 18 nt, Salmonella enterica enterica serovar Typhi
uuuuugcuuuaauauuca

SEQ ID NO: 1683153 - RNA, 15 nt, Salmonella enterica enterica serovar Typhi
uuuuugaccauucca

SEQ ID NO: 1683154 - RNA, 16 nt, Salmonella enterica enterica serovar Typhi
aaauucacaccaaugu

SEQ ID NO: 1683155 - RNA, 21 nt, Salmonella enterica enterica serovar Typhi
aaauucacccguuauucauuc

SEQ ID NO: 1683156 - RNA, 19 nt, Salmonella enterica enterica serovar Typhi
aaauucacgcuucucuggc

SEQ ID NO: 1683157 - RNA, 18 nt, Salmonella enterica enterica serovar Typhi
aaauucaaaaaagcagua

SEQ ID NO: 1683158 - RNA, 14 nt, Salmonella enterica enterica serovar Typhi
aaauuauuuuaaau

SEQ ID NO: 1683159 - RNA, 12 nt, Salmonella enterica enterica serovar Typhi
aaauuauuuuca

SEQ ID NO: 1683160 - RNA, 21 nt, Salmonella enterica enterica serovar Typhi
aaauucggcguuacccgucug

SEQ ID NO: 1683161 - RNA, 21 nt, Salmonella enterica enterica serovar Typhi
aaauuccuuccggcgcaauaa

SEQ ID NO: 1683162 - RNA, 11 nt, Salmonella enterica enterica serovar Typhi
uuuuuuggcag

SEQ ID NO: 1683163 - RNA, 13 nt, Salmonella enterica enterica serovar Typhi
uuuuuucaucucc

SEQ ID NO: 1683164 - RNA, 21 nt, Salmonella enterica enterica serovar Typhi
uuuuuucuguuauuuccgcaa

SEQ ID NO: 1683165 - RNA, 20 nt, Salmonella enterica enterica serovar Typhi
aaauuaucuguugauaaaac

SEQ ID NO: 1683166 - RNA, 18 nt, Salmonella enterica enterica serovar Typhi
aaauuauuggcuuuguaa

SEQ ID NO: 1683167 - RNA, 17 nt, Salmonella enterica enterica serovar Typhi
aauacaccgccauauau

SEQ ID NO: 1683168 - RNA, 17 nt, Salmonella enterica enterica serovar Typhi
aauacacgauaaaccuc

SEQ ID NO: 1683169 - RNA, 15 nt, Salmonella enterica enterica serovar Typhi
aauacaauucaacuc

SEQ ID NO: 1683170 - RNA, 18 nt, Salmonella enterica enterica serovar Typhi
aauacaauucaacucacu

SEQ ID NO: 1683171 - RNA, 19 nt, Salmonella enterica enterica serovar Typhi
aauacaauucaacucacua

SEQ ID NO: 1683172 - RNA, 21 nt, Salmonella enterica enterica serovar Typhi
aauaaaggauuguacuuauua

SEQ ID NO: 1683173 - RNA, 20 nt, Salmonella enterica enterica serovar Typhi
aauaaaggcgcuguuggcau

SEQ ID NO: 1683174 - RNA, 16 nt, Salmonella enterica enterica serovar Typhi
aauaaagccagauacg

SEQ ID NO: 1683175 - RNA, 15 nt, Salmonella enterica enterica serovar Typhi
aauaaagacuggccc

SEQ ID NO: 1683176 - RNA, 20 nt, Salmonella enterica enterica serovar Typhi
aauacaucgccaccaccagc

SEQ ID NO: 1683177 - RNA, 21 nt, Salmonella enterica enterica serovar Typhi
aauacagccagguugccagaa

SEQ ID NO: 1683178 - RNA, 21 nt, Salmonella enterica enterica serovar Typhi
aauacaggguuugucagcaua

SEQ ID NO: 1683179 - RNA, 23 nt, Salmonella enterica enterica serovar Typhi
aauacaggguuugucagcauaaa

SEQ ID NO: 1683180 - RNA, 19 nt, Salmonella enterica enterica serovar Typhi
aauacucccggcgcuggac

SEQ ID NO: 1683181 - RNA, 21 nt, Salmonella enterica enterica serovar Typhi
aauacuccugcaacagaagag

SEQ ID NO: 1683182 - RNA, 18 nt, Salmonella enterica enterica serovar Typhi
aauacguuuauucuuuuc

SEQ ID NO: 1683183 - RNA, 17 nt, Salmonella enterica enterica serovar Typhi
aauacguuuauucuuuu

SEQ ID NO: 1683184 - RNA, 14 nt, Salmonella enterica enterica serovar Typhi
aauacuuccugcuc

SEQ ID NO: 1683185 - RNA, 14 nt, Salmonella enterica enterica serovar Typhi
aauacuuaaaccug

SEQ ID NO: 1683186 - RNA, 18 nt, Salmonella enterica enterica serovar Typhi
aauacuucgcucucuuuu

SEQ ID NO: 1683187 - RNA, 18 nt, Salmonella enterica enterica serovar Typhi
aauacgagugacauuauu

SEQ ID NO: 1683188 - RNA, 20 nt, Salmonella enterica enterica serovar Typhi
aauacgagugacauuauuca

SEQ ID NO: 1683189 - RNA, 18 nt, Salmonella enterica enterica serovar Typhi
aauacgugagcgaaguuc

SEQ ID NO: 1683190 - RNA, 20 nt, Salmonella enterica enterica serovar Typhi
aauacgucgugacccacaca

SEQ ID NO: 1683191 - RNA, 19 nt, Salmonella enterica enterica serovar Typhi
aauacgauguacauaggca

SEQ ID NO: 1683192 - RNA, 19 nt, Salmonella enterica enterica serovar Typhi
aauacgguaaacagauaag

SEQ ID NO: 1683193 - RNA, 18 nt, Salmonella enterica enterica serovar Typhi
aauacccauuucuucuuc

SEQ ID NO: 1683194 - RNA, 14 nt, Salmonella enterica enterica serovar Typhi
aauacgaaaauccu

SEQ ID NO: 1683195 - RNA, 16 nt, Salmonella enterica enterica serovar Typhi
aauaccaggcacuuga

SEQ ID NO: 1683196 - RNA, 19 nt, Salmonella enterica enterica serovar Typhi
aauaccaggcggcuuuuuc

SEQ ID NO: 1683197 - RNA, 14 nt, Salmonella enterica enterica serovar Typhi
aauaccagcggcaa

SEQ ID NO: 1683198 - RNA, 17 nt, Salmonella enterica enterica serovar Typhi
aauagcggcacagauac

SEQ ID NO: 1683199 - RNA, 14 nt, Salmonella enterica enterica serovar Typhi
aauagcggcacaga

SEQ ID NO: 1683200 - RNA, 14 nt, Salmonella enterica enterica serovar Typhi
aauagaguaaugac

SEQ ID NO: 1683201 - RNA, 16 nt, Salmonella enterica enterica serovar Typhi
aauagaguaaugacaa

SEQ ID NO: 1683202 - RNA, 16 nt, Salmonella enterica enterica serovar Typhi
aauagaggaaauaaca

SEQ ID NO: 1683203 - RNA, 19 nt, Salmonella enterica enterica serovar Typhi
aauagacgagcgaaaaacu

SEQ ID NO: 1683204 - RNA, 21 nt, Salmonella enterica enterica serovar Typhi
aauagacaacaucccagaaaa

SEQ ID NO: 1683205 - RNA, 17 nt, Salmonella enterica enterica serovar Typhi
aauagagagaaucgggu

SEQ ID NO: 1683206 - RNA, 20 nt, Salmonella enterica enterica serovar Typhi
aauagagcaguuaauaauga

SEQ ID NO: 1683207 - RNA, 23 nt, Salmonella enterica enterica serovar Typhi
aauagagagcgacagcccggcgu

SEQ ID NO: 1683208 - RNA, 21 nt, Salmonella enterica enterica serovar Typhi
aauagacuucacuuucccgga

SEQ ID NO: 1683209 - RNA, 14 nt, Salmonella enterica enterica serovar Typhi
aauagagaaaauaa

SEQ ID NO: 1683210 - RNA, 18 nt, Salmonella enterica enterica serovar Typhi
aauagagaaaauaacaau

SEQ ID NO: 1683211 - RNA, 17 nt, Salmonella enterica enterica serovar Typhi
aauagagaaaucaacga

SEQ ID NO: 1683212 - RNA, 19 nt, Salmonella enterica enterica serovar Typhi
aauagagaaaauaacaaua

SEQ ID NO: 1683213 - RNA, 21 nt, Salmonella enterica enterica serovar Typhi
aauaguauccauaauuuuccc

SEQ ID NO: 1683214 - RNA, 20 nt, Salmonella enterica enterica serovar Typhi
aauaguugucagaccuucaa

SEQ ID NO: 1683215 - RNA, 22 nt, Salmonella enterica enterica serovar Typhi
aauagcuuuuuacucagggcaa

SEQ ID NO: 1683216 - RNA, 20 nt, Salmonella enterica enterica serovar Typhi
aauagcuuuuuacucagggc

SEQ ID NO: 1683217 - RNA, 16 nt, Salmonella enterica enterica serovar Typhi
aauaguaaauagaaaa

SEQ ID NO: 1683218 - RNA, 19 nt, Salmonella enterica enterica serovar Typhi
aauaguaaauagaaaauaa

SEQ ID NO: 1683219 - RNA, 15 nt, Salmonella enterica enterica serovar Typhi
aauaucgcugccggu

SEQ ID NO: 1683220 - RNA, 14 nt, Salmonella enterica enterica serovar Typhi
aauaugaaagagaa

SEQ ID NO: 1683221 - RNA, 15 nt, Salmonella enterica enterica serovar Typhi
aauaugaaagagaaa

SEQ ID NO: 1683222 - RNA, 19 nt, Salmonella enterica enterica serovar Typhi
aauauccuguaacucaucu

SEQ ID NO: 1683223 - RNA, 23 nt, Salmonella enterica enterica serovar Typhi
aauaucgaaauuggaguuaucau

SEQ ID NO: 1683224 - RNA, 12 nt, Salmonella enterica enterica serovar Typhi
aauauccuucag

SEQ ID NO: 1683225 - RNA, 20 nt, Salmonella enterica enterica serovar Typhi
aauaucagccauuaaccaga

SEQ ID NO: 1683226 - RNA, 16 nt, Salmonella enterica enterica serovar Typhi
aauauaugaaccaaga

SEQ ID NO: 1683227 - RNA, 17 nt, Salmonella enterica enterica serovar Typhi
aauauaugacaacacuc

SEQ ID NO: 1683228 - RNA, 17 nt, Salmonella enterica enterica serovar Typhi
aauauaaccaauuuaaa

SEQ ID NO: 1683229 - RNA, 15 nt, Salmonella enterica enterica serovar Typhi
aauauauucaucuuu

SEQ ID NO: 1683230 - RNA, 11 nt, Salmonella enterica enterica serovar Typhi
aauauaugagc

SEQ ID NO: 1683231 - RNA, 17 nt, Salmonella enterica enterica serovar Typhi
aauauauuucacuucau

SEQ ID NO: 1683232 - RNA, 17 nt, Salmonella enterica enterica serovar Typhi
aauauuaacggucuuuc

SEQ ID NO: 1683233 - RNA, 14 nt, Salmonella enterica enterica serovar Typhi
aauaugauuuaaaa

SEQ ID NO: 1683234 - RNA, 11 nt, Salmonella enterica enterica serovar Typhi
aauaugaaauu

SEQ ID NO: 1683235 - RNA, 14 nt, Salmonella enterica enterica serovar Typhi
aauaugaauauccg

SEQ ID NO: 1683236 - RNA, 23 nt, Salmonella enterica enterica serovar Typhi
aauaugauauguguaucuugcuu

SEQ ID NO: 1683237 - RNA, 16 nt, Salmonella enterica enterica serovar Typhi
aauauuaaugaauaaa

SEQ ID NO: 1683238 - RNA, 20 nt, Salmonella enterica enterica serovar Typhi
aauauuagcgguacucuuuu

SEQ ID NO: 1683239 - RNA, 21 nt, Salmonella enterica enterica serovar Typhi
aauauuaaggccgaauuugaa

SEQ ID NO: 1683240 - RNA, 22 nt, Salmonella enterica enterica serovar Typhi
aauauuauugacgcuuucuucc

SEQ ID NO: 1683241 - RNA, 17 nt, Salmonella enterica enterica serovar Typhi
aauauucacgcgaauuc

SEQ ID NO: 1683242 - RNA, 16 nt, Salmonella enterica enterica serovar Typhi
aauauucaucaaaaug

SEQ ID NO: 1683243 - RNA, 21 nt, Salmonella enterica enterica serovar Typhi
aauauucauucugucagaaau

SEQ ID NO: 1683244 - RNA, 14 nt, Salmonella enterica enterica serovar Typhi
aauauucauuucca

SEQ ID NO: 1683245 - RNA, 15 nt, Salmonella enterica enterica serovar Typhi
aauauugacaguaau

SEQ ID NO: 1683246 - RNA, 18 nt, Salmonella enterica enterica serovar Typhi
aauauuguuuaacguuuc

SEQ ID NO: 1683247 - RNA, 13 nt, Salmonella enterica enterica serovar Typhi
aauauuggcuucu

SEQ ID NO: 1683248 - RNA, 17 nt, Salmonella enterica enterica serovar Typhi
aaucaaaaaguuaugcu

SEQ ID NO: 1683249 - RNA, 22 nt, Salmonella enterica enterica serovar Typhi
aaucaacacgucgauuuucccu

SEQ ID NO: 1683250 - RNA, 14 nt, Salmonella enterica enterica serovar Typhi
aauauuuauuauuu

SEQ ID NO: 1683251 - RNA, 17 nt, Salmonella enterica enterica serovar Typhi
aauauuugaucacauca

SEQ ID NO: 1683252 - RNA, 18 nt, Salmonella enterica enterica serovar Typhi
aauauuucuuugucgcca

SEQ ID NO: 1683253 - RNA, 11 nt, Salmonella enterica enterica serovar Typhi
aauauuuuucc

SEQ ID NO: 1683254 - RNA, 12 nt, Salmonella enterica enterica serovar Typhi
aauauuuuuccg

SEQ ID NO: 1683255 - RNA, 17 nt, Salmonella enterica enterica serovar Typhi
aaucaccugccagggug

SEQ ID NO: 1683256 - RNA, 14 nt, Salmonella enterica enterica serovar Typhi
aaucacgcaucacu

SEQ ID NO: 1683257 - RNA, 23 nt, Salmonella enterica enterica serovar Typhi
aaucacgcguaucuggucaucgu

SEQ ID NO: 1683258 - RNA, 21 nt, Salmonella enterica enterica serovar Typhi
aaucacgcccgcagcaauaga

SEQ ID NO: 1683259 - RNA, 15 nt, Salmonella enterica enterica serovar Typhi
aaucacgccgaugac

SEQ ID NO: 1683260 - RNA, 18 nt, Salmonella enterica enterica serovar Typhi
aaucacuaagaccagcau

SEQ ID NO: 1683261 - RNA, 17 nt, Salmonella enterica enterica serovar Typhi
aaucagauugccacagg

SEQ ID NO: 1683262 - RNA, 13 nt, Salmonella enterica enterica serovar Typhi
aaucagaugcuca

SEQ ID NO: 1683263 - RNA, 18 nt, Salmonella enterica enterica serovar Typhi
aaucagcaauuuuguuaa

SEQ ID NO: 1683264 - RNA, 21 nt, Salmonella enterica enterica serovar Typhi
aaucagcagccgggccagacg

SEQ ID NO: 1683265 - RNA, 11 nt, Salmonella enterica enterica serovar Typhi
aaucagcagcg

SEQ ID NO: 1683266 - RNA, 22 nt, Salmonella enterica enterica serovar Typhi
aaucagcgccgucgccaucacc

SEQ ID NO: 1683267 - RNA, 15 nt, Salmonella enterica enterica serovar Typhi
aaucagcgcaauaaa

SEQ ID NO: 1683268 - RNA, 18 nt, Salmonella enterica enterica serovar Typhi
aaucaguggcggcaaaaa

SEQ ID NO: 1683269 - RNA, 22 nt, Salmonella enterica enterica serovar Typhi
aaucaguggcggcaaaaaauau

SEQ ID NO: 1683270 - RNA, 14 nt, Salmonella enterica enterica serovar Typhi
aaucaucaaucgcu

SEQ ID NO: 1683271 - RNA, 21 nt, Salmonella enterica enterica serovar Typhi
aaucaucagaccgauaaauac

SEQ ID NO: 1683272 - RNA, 22 nt, Salmonella enterica enterica serovar Typhi
aaucaucagaccgauaaauacc

SEQ ID NO: 1683273 - RNA, 20 nt, Salmonella enterica enterica serovar Typhi
aaucaacgccgccaggauaa

SEQ ID NO: 1683274 - RNA, 16 nt, Salmonella enterica enterica serovar Typhi
aaucaauguauuuaag

SEQ ID NO: 1683275 - RNA, 15 nt, Salmonella enterica enterica serovar Typhi
aaucaccccaagcaa

SEQ ID NO: 1683276 - RNA, 17 nt, Salmonella enterica enterica serovar Typhi
aaucaccgacagcaccg

SEQ ID NO: 1683277 - RNA, 12 nt, Salmonella enterica enterica serovar Typhi
aaucaccgccag

SEQ ID NO: 1683278 - RNA, 14 nt, Salmonella enterica enterica serovar Typhi
aaucaccagcccga

SEQ ID NO: 1683279 - RNA, 20 nt, Salmonella enterica enterica serovar Typhi
aaucaccacguaacucggca

SEQ ID NO: 1683280 - RNA, 12 nt, Salmonella enterica enterica serovar Typhi
aaucacaucgcc

SEQ ID NO: 1683281 - RNA, 15 nt, Salmonella enterica enterica serovar Typhi
aaucacaucauuaaa

SEQ ID NO: 1683282 - RNA, 13 nt, Salmonella enterica enterica serovar Typhi
aaucacauccgcc

SEQ ID NO: 1683283 - RNA, 17 nt, Salmonella enterica enterica serovar Typhi
aaucacaaaauggcuga

SEQ ID NO: 1683284 - RNA, 22 nt, Salmonella enterica enterica serovar Typhi
aaucuucccaccgcgaauuuca

SEQ ID NO: 1683285 - RNA, 20 nt, Salmonella enterica enterica serovar Typhi
aaucuggccuacggaaagcu

SEQ ID NO: 1683286 - RNA, 21 nt, Salmonella enterica enterica serovar Typhi
aaucugcauguaguaagccau

SEQ ID NO: 1683287 - RNA, 23 nt, Salmonella enterica enterica serovar Typhi
aaucugcgccaaucgcgauauca

SEQ ID NO: 1683288 - RNA, 12 nt, Salmonella enterica enterica serovar Typhi
aaucugcuuuuu

SEQ ID NO: 1683289 - RNA, 20 nt, Salmonella enterica enterica serovar Typhi
aaucugccgucaucgacuuc

SEQ ID NO: 1683290 - RNA, 16 nt, Salmonella enterica enterica serovar Typhi
aaucuggauagucagg

SEQ ID NO: 1683291 - RNA, 16 nt, Salmonella enterica enterica serovar Typhi
aaugaacgagcaauaa

SEQ ID NO: 1683292 - RNA, 18 nt, Salmonella enterica enterica serovar Typhi
aaugaacguuuuguguca

SEQ ID NO: 1683293 - RNA, 21 nt, Salmonella enterica enterica serovar Typhi
aaugaacuacggcccuggcuc

SEQ ID NO: 1683294 - RNA, 18 nt, Salmonella enterica enterica serovar Typhi
aaugaagcggaaaggacg

SEQ ID NO: 1683295 - RNA, 13 nt, Salmonella enterica enterica serovar Typhi
aaugaagcauaaa

SEQ ID NO: 1683296 - RNA, 16 nt, Salmonella enterica enterica serovar Typhi
aaugaagcauaaaaag

SEQ ID NO: 1683297 - RNA, 15 nt, Salmonella enterica enterica serovar Typhi
aaugaucaauggcgc

SEQ ID NO: 1683298 - RNA, 18 nt, Salmonella enterica enterica serovar Typhi
aaugauauuuaaaacugg

SEQ ID NO: 1683299 - RNA, 20 nt, Salmonella enterica enterica serovar Typhi
aaugauguccagaaugcaaa

SEQ ID NO: 1683300 - RNA, 12 nt, Salmonella enterica enterica serovar Typhi
aaugaucagaac

SEQ ID NO: 1683301 - RNA, 19 nt, Salmonella enterica enterica serovar Typhi
aaugaucagaacucacaua

SEQ ID NO: 1683302 - RNA, 12 nt, Salmonella enterica enterica serovar Typhi
aaugaucagacg

SEQ ID NO: 1683303 - RNA, 15 nt, Salmonella enterica enterica serovar Typhi
aaugcacaauacgcc

SEQ ID NO: 1683304 - RNA, 20 nt, Salmonella enterica enterica serovar Typhi
aaugcaauauuacaaagcag

SEQ ID NO: 1683305 - RNA, 23 nt, Salmonella enterica enterica serovar Typhi
aaugauuacggaacaaaacggaa

SEQ ID NO: 1683306 - RNA, 18 nt, Salmonella enterica enterica serovar Typhi
aaugauuacggaacaaaa

SEQ ID NO: 1683307 - RNA, 16 nt, Salmonella enterica enterica serovar Typhi
aaugauuaaaauaaau

SEQ ID NO: 1683308 - RNA, 22 nt, Salmonella enterica enterica serovar Typhi
aaugaguagaacguauuauuau

SEQ ID NO: 1683309 - RNA, 21 nt, Salmonella enterica enterica serovar Typhi
aaugagugaaaugguugcguu

SEQ ID NO: 1683310 - RNA, 14 nt, Salmonella enterica enterica serovar Typhi
aaugagaaaaggaa

SEQ ID NO: 1683311 - RNA, 13 nt, Salmonella enterica enterica serovar Typhi
aaugacuuuuuau

SEQ ID NO: 1683312 - RNA, 15 nt, Salmonella enterica enterica serovar Typhi
aaugaccagcgccca

SEQ ID NO: 1683313 - RNA, 12 nt, Salmonella enterica enterica serovar Typhi
aaucuccagcau

SEQ ID NO: 1683314 - RNA, 20 nt, Salmonella enterica enterica serovar Typhi
aaucuccagaccgcugcgga

SEQ ID NO: 1683315 - RNA, 20 nt, Salmonella enterica enterica serovar Typhi
aaucucaucugcaaaauaua

SEQ ID NO: 1683316 - RNA, 13 nt, Salmonella enterica enterica serovar Typhi
aaucucagauaau

SEQ ID NO: 1683317 - RNA, 23 nt, Salmonella enterica enterica serovar Typhi
aaucucagauaauagcugcggcu

SEQ ID NO: 1683318 - RNA, 14 nt, Salmonella enterica enterica serovar Typhi
aaucucaauaccac

SEQ ID NO: 1683319 - RNA, 14 nt, Salmonella enterica enterica serovar Typhi
aaucguuuuaugcc

SEQ ID NO: 1683320 - RNA, 13 nt, Salmonella enterica enterica serovar Typhi
aaucguuuuaugc

SEQ ID NO: 1683321 - RNA, 13 nt, Salmonella enterica enterica serovar Typhi
aaucuaaaauuau

SEQ ID NO: 1683322 - RNA, 15 nt, Salmonella enterica enterica serovar Typhi
aaucucgaaacaaua

SEQ ID NO: 1683323 - RNA, 16 nt, Salmonella enterica enterica serovar Typhi
aaucucuggccaggca

SEQ ID NO: 1683324 - RNA, 16 nt, Salmonella enterica enterica serovar Typhi
aaucucuacgccggcg

SEQ ID NO: 1683325 - RNA, 15 nt, Salmonella enterica enterica serovar Typhi
aaucucuacacaacg

SEQ ID NO: 1683326 - RNA, 23 nt, Salmonella enterica enterica serovar Typhi
aaucugacgcauccgcuucucua

SEQ ID NO: 1683327 - RNA, 21 nt, Salmonella enterica enterica serovar Typhi
aaucgacaugucggcgaaaau

SEQ ID NO: 1683328 - RNA, 21 nt, Salmonella enterica enterica serovar Typhi
aaucgaaucguucgccaguga

SEQ ID NO: 1683329 - RNA, 12 nt, Salmonella enterica enterica serovar Typhi
aaucgacucacg

SEQ ID NO: 1683330 - RNA, 16 nt, Salmonella enterica enterica serovar Typhi
aaucgaguucgcuuuu

SEQ ID NO: 1683331 - RNA, 13 nt, Salmonella enterica enterica serovar Typhi
aaucaucaucagg

SEQ ID NO: 1683332 - RNA, 20 nt, Salmonella enterica enterica serovar Typhi
aaucgugguuagacaucacg

SEQ ID NO: 1683333 - RNA, 14 nt, Salmonella enterica enterica serovar Typhi
aaucguucuugcac

SEQ ID NO: 1683334 - RNA, 13 nt, Salmonella enterica enterica serovar Typhi
aaucggcuucucc

SEQ ID NO: 1683335 - RNA, 15 nt, Salmonella enterica enterica serovar Typhi
aaucgcaaacgccag

SEQ ID NO: 1683336 - RNA, 17 nt, Salmonella enterica enterica serovar Typhi
aaucgcaucauaaaugg

SEQ ID NO: 1683337 - RNA, 19 nt, Salmonella enterica enterica serovar Typhi
aaucgcaucauaaauggcu

SEQ ID NO: 1683338 - RNA, 13 nt, Salmonella enterica enterica serovar Typhi
aauuaauauuuaa

SEQ ID NO: 1683339 - RNA, 21 nt, Salmonella enterica enterica serovar Typhi
aauuaaucaggcauccugccc

SEQ ID NO: 1683340 - RNA, 17 nt, Salmonella enterica enterica serovar Typhi
aauuaaucccaacccga

SEQ ID NO: 1683341 - RNA, 15 nt, Salmonella enterica enterica serovar Typhi
aauguuguuccagag

SEQ ID NO: 1683342 - RNA, 20 nt, Salmonella enterica enterica serovar Typhi
aauguuuagucuuuuaguau

SEQ ID NO: 1683343 - RNA, 22 nt, Salmonella enterica enterica serovar Typhi
aauguuuuuguuguuaauuuga

SEQ ID NO: 1683344 - RNA, 19 nt, Salmonella enterica enterica serovar Typhi
aauguuuucugccagcaga

SEQ ID NO: 1683345 - RNA, 18 nt, Salmonella enterica enterica serovar Typhi
aauguguguacaaccauc

SEQ ID NO: 1683346 - RNA, 23 nt, Salmonella enterica enterica serovar Typhi
aaugugcaaucacacuacacgaa

SEQ ID NO: 1683347 - RNA, 18 nt, Salmonella enterica enterica serovar Typhi
aauguucgguauaugaau

SEQ ID NO: 1683348 - RNA, 16 nt, Salmonella enterica enterica serovar Typhi
aauguuccgcagggga

SEQ ID NO: 1683349 - RNA, 19 nt, Salmonella enterica enterica serovar Typhi
aauguuagcgucugcggcu

SEQ ID NO: 1683350 - RNA, 15 nt, Salmonella enterica enterica serovar Typhi
aaugcuccaauaaau

SEQ ID NO: 1683351 - RNA, 20 nt, Salmonella enterica enterica serovar Typhi
aaugcucauuauuuggauua

SEQ ID NO: 1683352 - RNA, 19 nt, Salmonella enterica enterica serovar Typhi
aaugccauaauuuauccuc

SEQ ID NO: 1683353 - RNA, 23 nt, Salmonella enterica enterica serovar Typhi
aaugccaucaucaguaacacccg

SEQ ID NO: 1683354 - RNA, 12 nt, Salmonella enterica enterica serovar Typhi
aauggcaauaau

SEQ ID NO: 1683355 - RNA, 16 nt, Salmonella enterica enterica serovar Typhi
aauggcaauaauacag

SEQ ID NO: 1683356 - RNA, 18 nt, Salmonella enterica enterica serovar Typhi
aauggcaaguaaaauagc

SEQ ID NO: 1683357 - RNA, 19 nt, Salmonella enterica enterica serovar Typhi
aauggcagaauaaaacagc

SEQ ID NO: 1683358 - RNA, 18 nt, Salmonella enterica enterica serovar Typhi
aaugcuggugcaucuggg

SEQ ID NO: 1683359 - RNA, 22 nt, Salmonella enterica enterica serovar Typhi
aauguauucucccgucagcaac

SEQ ID NO: 1683360 - RNA, 16 nt, Salmonella enterica enterica serovar Typhi
aaugggcaggagauga

SEQ ID NO: 1683361 - RNA, 21 nt, Salmonella enterica enterica serovar Typhi
aauggcuaugccgacaggggg

SEQ ID NO: 1683362 - RNA, 19 nt, Salmonella enterica enterica serovar Typhi
aauggcucaacuccgccgg

SEQ ID NO: 1683363 - RNA, 18 nt, Salmonella enterica enterica serovar Typhi
aauggggaucgucugcaa

SEQ ID NO: 1683364 - RNA, 18 nt, Salmonella enterica enterica serovar Typhi
aauggucccugauauaca

SEQ ID NO: 1683365 - RNA, 13 nt, Salmonella enterica enterica serovar Typhi
aaugucugaauau

SEQ ID NO: 1683366 - RNA, 16 nt, Salmonella enterica enterica serovar Typhi
aaugucgcaaucggcu

SEQ ID NO: 1683367 - RNA, 16 nt, Salmonella enterica enterica serovar Typhi
aaugucguccaugcug

SEQ ID NO: 1683368 - RNA, 21 nt, Salmonella enterica enterica serovar Typhi
aaugucguuacggcugaagcu

SEQ ID NO: 1683369 - RNA, 12 nt, Salmonella enterica enterica serovar Typhi
aaugucaucauc

SEQ ID NO: 1683370 - RNA, 16 nt, Salmonella enterica enterica serovar Typhi
aauguauuuuuuguaa

SEQ ID NO: 1683371 - RNA, 14 nt, Salmonella enterica enterica serovar Typhi
aagacccgaaccug

SEQ ID NO: 1683372 - RNA, 14 nt, Salmonella enterica enterica serovar Typhi
aagacgaaaucguc

SEQ ID NO: 1683373 - RNA, 21 nt, Salmonella enterica enterica serovar Typhi
aagacgaaaaaugaauaccaa

SEQ ID NO: 1683374 - RNA, 16 nt, Salmonella enterica enterica serovar Typhi
aagacgaauaaggaau

SEQ ID NO: 1683375 - RNA, 14 nt, Salmonella enterica enterica serovar Typhi
aagacauucacaua

SEQ ID NO: 1683376 - RNA, 22 nt, Salmonella enterica enterica serovar Typhi
aagaccaauaaaacgcccccug

SEQ ID NO: 1683377 - RNA, 23 nt, Salmonella enterica enterica serovar Typhi
aagacaugaucuuaccucuccug

SEQ ID NO: 1683378 - RNA, 18 nt, Salmonella enterica enterica serovar Typhi
aagaauuucaaucaucau

SEQ ID NO: 1683379 - RNA, 14 nt, Salmonella enterica enterica serovar Typhi
aagaauuucaauca

SEQ ID NO: 1683380 - RNA, 19 nt, Salmonella enterica enterica serovar Typhi
aagaauuucgcgaauaauc

SEQ ID NO: 1683381 - RNA, 16 nt, Salmonella enterica enterica serovar Typhi
aagaauuugaacucuu

SEQ ID NO: 1683382 - RNA, 20 nt, Salmonella enterica enterica serovar Typhi
aagaauuauuaucaauuuca

SEQ ID NO: 1683383 - RNA, 17 nt, Salmonella enterica enterica serovar Typhi
aagacaaaagcugguga

SEQ ID NO: 1683384 - RNA, 19 nt, Salmonella enterica enterica serovar Typhi
aagacaaaagcuggugaaa

SEQ ID NO: 1683385 - RNA, 16 nt, Salmonella enterica enterica serovar Typhi
aagacaccccagccua

SEQ ID NO: 1683386 - RNA, 19 nt, Salmonella enterica enterica serovar Typhi
aagacagaagcugagaaaa

SEQ ID NO: 1683387 - RNA, 14 nt, Salmonella enterica enterica serovar Typhi
aagaaucacgccga

SEQ ID NO: 1683388 - RNA, 17 nt, Salmonella enterica enterica serovar Typhi
aagaaucacgccgauga

SEQ ID NO: 1683389 - RNA, 21 nt, Salmonella enterica enterica serovar Typhi
aagaauagcgcuuuccugcgu

SEQ ID NO: 1683390 - RNA, 22 nt, Salmonella enterica enterica serovar Typhi
aagaauagccggauaaaauuau

SEQ ID NO: 1683391 - RNA, 12 nt, Salmonella enterica enterica serovar Typhi
aagaauaugaga

SEQ ID NO: 1683392 - RNA, 14 nt, Salmonella enterica enterica serovar Typhi
aagaaugaaaaaaa

SEQ ID NO: 1683393 - RNA, 17 nt, Salmonella enterica enterica serovar Typhi
aagaauguccaucucuu

SEQ ID NO: 1683394 - RNA, 17 nt, Salmonella enterica enterica serovar Typhi
aagaauuauuaccaaug

SEQ ID NO: 1683395 - RNA, 20 nt, Salmonella enterica enterica serovar Typhi
aaauucuuuacgcagcaaga

SEQ ID NO: 1683396 - RNA, 23 nt, Salmonella enterica enterica serovar Typhi
aaauugaauuaagcaauccauuu

SEQ ID NO: 1683397 - RNA, 19 nt, Salmonella enterica enterica serovar Typhi
aaauugaauuauaauaaag

SEQ ID NO: 1683398 - RNA, 14 nt, Salmonella enterica enterica serovar Typhi
aaauugagaauuau

SEQ ID NO: 1683399 - RNA, 13 nt, Salmonella enterica enterica serovar Typhi
aagaauacccuuu

SEQ ID NO: 1683400 - RNA, 17 nt, Salmonella enterica enterica serovar Typhi
aagaauacccuuuacac

SEQ ID NO: 1683401 - RNA, 14 nt, Salmonella enterica enterica serovar Typhi
aagagaaaauaccg

SEQ ID NO: 1683402 - RNA, 16 nt, Salmonella enterica enterica serovar Typhi
aagagaaacauacugu

SEQ ID NO: 1683403 - RNA, 17 nt, Salmonella enterica enterica serovar Typhi
aagagaaaaaucaguca

SEQ ID NO: 1683404 - RNA, 11 nt, Salmonella enterica enterica serovar Typhi
aagagaaaacc

SEQ ID NO: 1683405 - RNA, 14 nt, Salmonella enterica enterica serovar Typhi
aagagagugagaaa

SEQ ID NO: 1683406 - RNA, 12 nt, Salmonella enterica enterica serovar Typhi
aagagagcaaca

SEQ ID NO: 1683407 - RNA, 21 nt, Salmonella enterica enterica serovar Typhi
aagagagcaacauaccgcaga

SEQ ID NO: 1683408 - RNA, 19 nt, Salmonella enterica enterica serovar Typhi
aagacgcucgacguccagc

SEQ ID NO: 1683409 - RNA, 22 nt, Salmonella enterica enterica serovar Typhi
aagacuacuuaccggcgccaga

SEQ ID NO: 1683410 - RNA, 20 nt, Salmonella enterica enterica serovar Typhi
aagacgguuucagugauaaa

SEQ ID NO: 1683411 - RNA, 15 nt, Salmonella enterica enterica serovar Typhi
aagacuuagcccugg

SEQ ID NO: 1683412 - RNA, 18 nt, Salmonella enterica enterica serovar Typhi
aagacugcuccggcaaga

SEQ ID NO: 1683413 - RNA, 13 nt, Salmonella enterica enterica serovar Typhi
aagacuggcaacc

SEQ ID NO: 1683414 - RNA, 16 nt, Salmonella enterica enterica serovar Typhi
aagacuccggcagcau

SEQ ID NO: 1683415 - RNA, 21 nt, Salmonella enterica enterica serovar Typhi
aagaggcauaaaaaaaagccg

SEQ ID NO: 1683416 - RNA, 15 nt, Salmonella enterica enterica serovar Typhi
aagagguauccugaa

SEQ ID NO: 1683417 - RNA, 21 nt, Salmonella enterica enterica serovar Typhi
aagagcacuuugguaaaacgg

SEQ ID NO: 1683418 - RNA, 16 nt, Salmonella enterica enterica serovar Typhi
aagagcacuuugguaa

SEQ ID NO: 1683419 - RNA, 16 nt, Salmonella enterica enterica serovar Typhi
aagagcguuacccaga

SEQ ID NO: 1683420 - RNA, 19 nt, Salmonella enterica enterica serovar Typhi
aagagugacgguuuucacu

SEQ ID NO: 1683421 - RNA, 18 nt, Salmonella enterica enterica serovar Typhi
aagauaaaaagacagaua

SEQ ID NO: 1683422 - RNA, 12 nt, Salmonella enterica enterica serovar Typhi
aagauaaaaaua

SEQ ID NO: 1683423 - RNA, 16 nt, Salmonella enterica enterica serovar Typhi
aagauaaacagcagcg

SEQ ID NO: 1683424 - RNA, 15 nt, Salmonella enterica enterica serovar Typhi
aagauaaaaagacag

SEQ ID NO: 1683425 - RNA, 13 nt, Salmonella enterica enterica serovar Typhi
aagauuuuucacc

SEQ ID NO: 1683426 - RNA, 12 nt, Salmonella enterica enterica serovar Typhi
aagcaaauucag

SEQ ID NO: 1683427 - RNA, 17 nt, Salmonella enterica enterica serovar Typhi
aagcaauccauuuuaaa

SEQ ID NO: 1683428 - RNA, 21 nt, Salmonella enterica enterica serovar Typhi
aagcaauccauuuuaaauaca

SEQ ID NO: 1683429 - RNA, 16 nt, Salmonella enterica enterica serovar Typhi
aagcaauuaauauuua

SEQ ID NO: 1683430 - RNA, 20 nt, Salmonella enterica enterica serovar Typhi
aagcaacuguagaaugcuau

SEQ ID NO: 1683431 - RNA, 20 nt, Salmonella enterica enterica serovar Typhi
aagcaacugauuaaucugcc

SEQ ID NO: 1683432 - RNA, 20 nt, Salmonella enterica enterica serovar Typhi
aagcaagaggugacucacau

SEQ ID NO: 1683433 - RNA, 19 nt, Salmonella enterica enterica serovar Typhi
aagcaccaucgcaaauuca

SEQ ID NO: 1683434 - RNA, 19 nt, Salmonella enterica enterica serovar Typhi
aagcacaucagcaaaugaa

SEQ ID NO: 1683435 - RNA, 18 nt, Salmonella enterica enterica serovar Typhi
aagcacauaacugagacu

SEQ ID NO: 1683436 - RNA, 21 nt, Salmonella enterica enterica serovar Typhi
aagcacgggcuugaauaacau

SEQ ID NO: 1683437 - RNA, 18 nt, Salmonella enterica enterica serovar Typhi
aagcacgccgcuuucugu

SEQ ID NO: 1683438 - RNA, 13 nt, Salmonella enterica enterica serovar Typhi
aagcacugcugcu

SEQ ID NO: 1683439 - RNA, 14 nt, Salmonella enterica enterica serovar Typhi
aagcacugcugcug

SEQ ID NO: 1683440 - RNA, 15 nt, Salmonella enterica enterica serovar Typhi
aagcacugcugcuga

SEQ ID NO: 1683441 - RNA, 19 nt, Salmonella enterica enterica serovar Typhi
aagcacucguaagaggcgu

SEQ ID NO: 1683442 - RNA, 18 nt, Salmonella enterica enterica serovar Typhi
aagcauggcguuaaugcg

SEQ ID NO: 1683443 - RNA, 20 nt, Salmonella enterica enterica serovar Typhi
aagcaugguuaacuccuucu

SEQ ID NO: 1683444 - RNA, 18 nt, Salmonella enterica enterica serovar Typhi
aagcauugccguuuucaa

SEQ ID NO: 1683445 - RNA, 15 nt, Salmonella enterica enterica serovar Typhi
aagccaaaauuuuca

SEQ ID NO: 1683446 - RNA, 17 nt, Salmonella enterica enterica serovar Typhi
aagcauagcgccuucag

SEQ ID NO: 1683447 - RNA, 19 nt, Salmonella enterica enterica serovar Typhi
aagcauagcgccuucaggc

SEQ ID NO: 1683448 - RNA, 14 nt, Salmonella enterica enterica serovar Typhi
aagcauaccuucac

SEQ ID NO: 1683449 - RNA, 17 nt, Salmonella enterica enterica serovar Typhi
aagcagcuugcugcuuu

SEQ ID NO: 1683450 - RNA, 18 nt, Salmonella enterica enterica serovar Typhi
aagcaggcgggacgccau

SEQ ID NO: 1683451 - RNA, 17 nt, Salmonella enterica enterica serovar Typhi
aagcaguuaauacagug

SEQ ID NO: 1683452 - RNA, 15 nt, Salmonella enterica enterica serovar Typhi
aagcagugaaucccc

SEQ ID NO: 1683453 - RNA, 15 nt, Salmonella enterica enterica serovar Typhi
aagcaguuccagcau

SEQ ID NO: 1683454 - RNA, 15 nt, Salmonella enterica enterica serovar Typhi
aagcauaaaaagacg

SEQ ID NO: 1683455 - RNA, 20 nt, Salmonella enterica enterica serovar Typhi
aagcagaccaccccacagua

SEQ ID NO: 1683456 - RNA, 15 nt, Salmonella enterica enterica serovar Typhi
aagcagauaccagcc

SEQ ID NO: 1683457 - RNA, 15 nt, Salmonella enterica enterica serovar Typhi
aagcagcgacaauau

SEQ ID NO: 1683458 - RNA, 12 nt, Salmonella enterica enterica serovar Typhi
aagcagcugcug

SEQ ID NO: 1683459 - RNA, 20 nt, Salmonella enterica enterica serovar Typhi
aagcagcugcugguaccuuu

SEQ ID NO: 1683460 - RNA, 23 nt, Salmonella enterica enterica serovar Typhi
aagcagcuuaucuuuacgcuugu

SEQ ID NO: 1683461 - RNA, 12 nt, Salmonella enterica enterica serovar Typhi
aagcagcuugcu

SEQ ID NO: 1683462 - RNA, 22 nt, Salmonella enterica enterica serovar Typhi
aagauauugucgcccugcaauu

SEQ ID NO: 1683463 - RNA, 22 nt, Salmonella enterica enterica serovar Typhi
aagauauuuuguuuuaaauuca

SEQ ID NO: 1683464 - RNA, 18 nt, Salmonella enterica enterica serovar Typhi
aagaucgccaagcuguga

SEQ ID NO: 1683465 - RNA, 21 nt, Salmonella enterica enterica serovar Typhi
aagaucgcauuuaaucgccug

SEQ ID NO: 1683466 - RNA, 18 nt, Salmonella enterica enterica serovar Typhi
aagaucuaaagccaguuu

SEQ ID NO: 1683467 - RNA, 19 nt, Salmonella enterica enterica serovar Typhi
aagaucguuauccagcagc

SEQ ID NO: 1683468 - RNA, 16 nt, Salmonella enterica enterica serovar Typhi
aagaucguuauccagc

SEQ ID NO: 1683469 - RNA, 20 nt, Salmonella enterica enterica serovar Typhi
aagauuaauugauuacaaag

SEQ ID NO: 1683470 - RNA, 16 nt, Salmonella enterica enterica serovar Typhi
aagauuaaccagcagu

SEQ ID NO: 1683471 - RNA, 19 nt, Salmonella enterica enterica serovar Typhi
aagauuagccccagcgcca

SEQ ID NO: 1683472 - RNA, 20 nt, Salmonella enterica enterica serovar Typhi
aagaugaggagcuggagcag

SEQ ID NO: 1683473 - RNA, 22 nt, Salmonella enterica enterica serovar Typhi
aagaugcguaccgcuaucgcca

SEQ ID NO: 1683474 - RNA, 15 nt, Salmonella enterica enterica serovar Typhi
aagaugcuacccguc

SEQ ID NO: 1683475 - RNA, 12 nt, Salmonella enterica enterica serovar Typhi
aagauuccagau

SEQ ID NO: 1683476 - RNA, 18 nt, Salmonella enterica enterica serovar Typhi
aagauuggccgucacuuu

SEQ ID NO: 1683477 - RNA, 13 nt, Salmonella enterica enterica serovar Typhi
aauaaaaauaaau

SEQ ID NO: 1683478 - RNA, 14 nt, Salmonella enterica enterica serovar Typhi
aauaaaaauaaaua

SEQ ID NO: 1683479 - RNA, 22 nt, Salmonella enterica enterica serovar Typhi
aauaaaaauaagcuauugcgcu

SEQ ID NO: 1683480 - RNA, 11 nt, Salmonella enterica enterica serovar Typhi
aauaaaaguug

SEQ ID NO: 1683481 - RNA, 22 nt, Salmonella enterica enterica serovar Typhi
aauaaacgccaguggaugcgcu

SEQ ID NO: 1683482 - RNA, 17 nt, Salmonella enterica enterica serovar Typhi
aauaaacugcauccccu

SEQ ID NO: 1683483 - RNA, 18 nt, Salmonella enterica enterica serovar Typhi
aauaaagaaagcauuaaa

SEQ ID NO: 1683484 - RNA, 16 nt, Salmonella enterica enterica serovar Typhi
aauaaacacuaaauca

SEQ ID NO: 1683485 - RNA, 20 nt, Salmonella enterica enterica serovar Typhi
aauaaacauuuuuuuugcau

SEQ ID NO: 1683486 - RNA, 14 nt, Salmonella enterica enterica serovar Typhi
aauaaacaucagcc

SEQ ID NO: 1683487 - RNA, 18 nt, Salmonella enterica enterica serovar Typhi
aauaaacaaaaaccugcu

SEQ ID NO: 1683488 - RNA, 14 nt, Salmonella enterica enterica serovar Typhi
aauaaaauuauauu

SEQ ID NO: 1683489 - RNA, 20 nt, Salmonella enterica enterica serovar Typhi
aaguuagccccuuaucaaag

SEQ ID NO: 1683490 - RNA, 15 nt, Salmonella enterica enterica serovar Typhi
aaguugaaaggaaag

SEQ ID NO: 1683491 - RNA, 18 nt, Salmonella enterica enterica serovar Typhi
aaguuguugaccaacaau

SEQ ID NO: 1683492 - RNA, 19 nt, Salmonella enterica enterica serovar Typhi
aaguuuaacgcgcguucau

SEQ ID NO: 1683493 - RNA, 15 nt, Salmonella enterica enterica serovar Typhi
aaguuuaauuccgaa

SEQ ID NO: 1683494 - RNA, 20 nt, Salmonella enterica enterica serovar Typhi
aaguuuagaaaaaauuaaaa

SEQ ID NO: 1683495 - RNA, 19 nt, Salmonella enterica enterica serovar Typhi
aaguuugaaguguuccuga

SEQ ID NO: 1683496 - RNA, 16 nt, Salmonella enterica enterica serovar Typhi
aaguuuuucauaucca

SEQ ID NO: 1683497 - RNA, 15 nt, Salmonella enterica enterica serovar Typhi
aaguuuuucucuuau

SEQ ID NO: 1683498 - RNA, 14 nt, Salmonella enterica enterica serovar Typhi
aagucaccaucagu

SEQ ID NO: 1683499 - RNA, 18 nt, Salmonella enterica enterica serovar Typhi
aagucccuggcgcgccag

SEQ ID NO: 1683500 - RNA, 18 nt, Salmonella enterica enterica serovar Typhi
aaguccaaguauguuaac

SEQ ID NO: 1683501 - RNA, 17 nt, Salmonella enterica enterica serovar Typhi
aaguccuaacaccugcc

SEQ ID NO: 1683502 - RNA, 18 nt, Salmonella enterica enterica serovar Typhi
aagucucaggagugaaca

SEQ ID NO: 1683503 - RNA, 22 nt, Salmonella enterica enterica serovar Typhi
aagucucagggagaacucaucu

SEQ ID NO: 1683504 - RNA, 12 nt, Salmonella enterica enterica serovar Typhi
aagucagacaag

SEQ ID NO: 1683505 - RNA, 13 nt, Salmonella enterica enterica serovar Typhi
aaguaaggcauga

SEQ ID NO: 1683506 - RNA, 15 nt, Salmonella enterica enterica serovar Typhi
aaguaauaaaauaau

SEQ ID NO: 1683507 - RNA, 14 nt, Salmonella enterica enterica serovar Typhi
aaguuaaaacgcca

SEQ ID NO: 1683508 - RNA, 22 nt, Salmonella enterica enterica serovar Typhi
aaguuaaucagcgccgucgcca

SEQ ID NO: 1683509 - RNA, 18 nt, Salmonella enterica enterica serovar Typhi
aagugcagaagcaauccu

SEQ ID NO: 1683510 - RNA, 21 nt, Salmonella enterica enterica serovar Typhi
aagugcauguaaauaaggcug

SEQ ID NO: 1683511 - RNA, 20 nt, Salmonella enterica enterica serovar Typhi
aagcuauccucuuuuaucac

SEQ ID NO: 1683512 - RNA, 15 nt, Salmonella enterica enterica serovar Typhi
aagcuaguaaagaaa

SEQ ID NO: 1683513 - RNA, 16 nt, Salmonella enterica enterica serovar Typhi
aagcuaguaaagaaau

SEQ ID NO: 1683514 - RNA, 20 nt, Salmonella enterica enterica serovar Typhi
aagcuaguaaagaaauuuug

SEQ ID NO: 1683515 - RNA, 19 nt, Salmonella enterica enterica serovar Typhi
aagcguuacggaaaaaaua

SEQ ID NO: 1683516 - RNA, 23 nt, Salmonella enterica enterica serovar Typhi
aagcgucucagauggaaaaaaag

SEQ ID NO: 1683517 - RNA, 18 nt, Salmonella enterica enterica serovar Typhi
aagcgcuuuggucaggcu

SEQ ID NO: 1683518 - RNA, 14 nt, Salmonella enterica enterica serovar Typhi
aagcggcagacgug

SEQ ID NO: 1683519 - RNA, 21 nt, Salmonella enterica enterica serovar Typhi
aagcggauaagauagcaggcg

SEQ ID NO: 1683520 - RNA, 19 nt, Salmonella enterica enterica serovar Typhi
aagcgucaguaaaagcccg

SEQ ID NO: 1683521 - RNA, 22 nt, Salmonella enterica enterica serovar Typhi
aagcgucucagauggaaaaaaa

SEQ ID NO: 1683522 - RNA, 15 nt, Salmonella enterica enterica serovar Typhi
aagcgucaggcgaag

SEQ ID NO: 1683523 - RNA, 18 nt, Salmonella enterica enterica serovar Typhi
aagcgucaguaaaagccc

SEQ ID NO: 1683524 - RNA, 12 nt, Salmonella enterica enterica serovar Typhi
aaggauauugcc

SEQ ID NO: 1683525 - RNA, 21 nt, Salmonella enterica enterica serovar Typhi
aaggauaauaguguuagcguc

SEQ ID NO: 1683526 - RNA, 23 nt, Salmonella enterica enterica serovar Typhi
aagcuuuuucugcgugagccgga

SEQ ID NO: 1683527 - RNA, 21 nt, Salmonella enterica enterica serovar Typhi
aagcuuugcguaaaaaacauc

SEQ ID NO: 1683528 - RNA, 17 nt, Salmonella enterica enterica serovar Typhi
aagcuuugcguaaaaaa

SEQ ID NO: 1683529 - RNA, 19 nt, Salmonella enterica enterica serovar Typhi
aagcuuugcguaaaaaaca

SEQ ID NO: 1683530 - RNA, 20 nt, Salmonella enterica enterica serovar Typhi
aagcuuugcguaaaaaacau

SEQ ID NO: 1683531 - RNA, 19 nt, Salmonella enterica enterica serovar Typhi
aagcugcggcccagauaac

SEQ ID NO: 1683532 - RNA, 21 nt, Salmonella enterica enterica serovar Typhi
aagcugcggcccagauaacgc

SEQ ID NO: 1683533 - RNA, 15 nt, Salmonella enterica enterica serovar Typhi
aagcugcggcccaga

SEQ ID NO: 1683534 - RNA, 16 nt, Salmonella enterica enterica serovar Typhi
aagcugccgucccagc

SEQ ID NO: 1683535 - RNA, 20 nt, Salmonella enterica enterica serovar Typhi
aagcuguuccggcuucguua

SEQ ID NO: 1683536 - RNA, 17 nt, Salmonella enterica enterica serovar Typhi
aagcuuaggauaagaau

SEQ ID NO: 1683537 - RNA, 14 nt, Salmonella enterica enterica serovar Typhi
aagcuuguagaaaa

SEQ ID NO: 1683538 - RNA, 19 nt, Salmonella enterica enterica serovar Typhi
aagcuuucugaauuucacg

SEQ ID NO: 1683539 - RNA, 13 nt, Salmonella enterica enterica serovar Typhi
aagcuuucuguua

SEQ ID NO: 1683540 - RNA, 17 nt, Salmonella enterica enterica serovar Typhi
aaggcuggcacguucuc

SEQ ID NO: 1683541 - RNA, 18 nt, Salmonella enterica enterica serovar Typhi
aaggcugcgcguuuucau

SEQ ID NO: 1683542 - RNA, 15 nt, Salmonella enterica enterica serovar Typhi
aaggcucucuuacca

SEQ ID NO: 1683543 - RNA, 21 nt, Salmonella enterica enterica serovar Typhi
aaggcgcuugcgccaucaucc

SEQ ID NO: 1683544 - RNA, 23 nt, Salmonella enterica enterica serovar Typhi
aaggucugacaacuauugcugcc

SEQ ID NO: 1683545 - RNA, 17 nt, Salmonella enterica enterica serovar Typhi
aagguaacgcgaaaaaa

SEQ ID NO: 1683546 - RNA, 13 nt, Salmonella enterica enterica serovar Typhi
aagguugccgcaa

SEQ ID NO: 1683547 - RNA, 14 nt, Salmonella enterica enterica serovar Typhi
aagguugaucagga

SEQ ID NO: 1683548 - RNA, 15 nt, Salmonella enterica enterica serovar Typhi
aagguugaucaggaa

SEQ ID NO: 1683549 - RNA, 16 nt, Salmonella enterica enterica serovar Typhi
aagguucccugcgcca

SEQ ID NO: 1683550 - RNA, 21 nt, Salmonella enterica enterica serovar Typhi
aagguucuggcauuggcaucu

SEQ ID NO: 1683551 - RNA, 14 nt, Salmonella enterica enterica serovar Typhi
aaggugagaaaaag

SEQ ID NO: 1683552 - RNA, 17 nt, Salmonella enterica enterica serovar Typhi
aaggccaaguuuagaaa

SEQ ID NO: 1683553 - RNA, 11 nt, Salmonella enterica enterica serovar Typhi
aaggccagacu

SEQ ID NO: 1683554 - RNA, 19 nt, Salmonella enterica enterica serovar Typhi
aaggcauuucaaucgccac

SEQ ID NO: 1683555 - RNA, 22 nt, Salmonella enterica enterica serovar Typhi
aaggcauuaagucauaccuguu

SEQ ID NO: 1683556 - RNA, 23 nt, Salmonella enterica enterica serovar Typhi
aaggcauuauguuuugaacauau

SEQ ID NO: 1683557 - RNA, 13 nt, Salmonella enterica enterica serovar Typhi
aaggcaucugcgc

SEQ ID NO: 1683558 - RNA, 19 nt, Salmonella enterica enterica serovar Typhi
aaggcaugauuaaagccac

SEQ ID NO: 1683559 - RNA, 15 nt, Salmonella enterica enterica serovar Typhi
aaggcauucacgcca

SEQ ID NO: 1683560 - RNA, 19 nt, Salmonella enterica enterica serovar Typhi
aaggcaugaugccacgaga

SEQ ID NO: 1683561 - RNA, 16 nt, Salmonella enterica enterica serovar Typhi
aaggcaaaaugccagc

SEQ ID NO: 1683562 - RNA, 17 nt, Salmonella enterica enterica serovar Typhi
aaggcacgcuccugcuc

SEQ ID NO: 1683563 - RNA, 17 nt, Salmonella enterica enterica serovar Typhi
aaggcaccgguuuuuga

SEQ ID NO: 1683564 - RNA, 15 nt, Salmonella enterica enterica serovar Typhi
aaggcgcuagccgca

SEQ ID NO: 1683565 - RNA, 17 nt, Salmonella enterica enterica serovar Typhi
aaggcgcgauccgccca

SEQ ID NO: 1683566 - RNA, 18 nt, Salmonella enterica enterica serovar Typhi
aaggcgauucaacagggc

SEQ ID NO: 1683567 - RNA, 22 nt, Salmonella enterica enterica serovar Typhi
aaggccucaucgggacggcggu

SEQ ID NO: 1683568 - RNA, 20 nt, Salmonella enterica enterica serovar Typhi
aaggccggcagccgcugaua

SEQ ID NO: 1683569 - RNA, 18 nt, Salmonella enterica enterica serovar Typhi
aaggccgggaaaucuucu

SEQ ID NO: 1683570 - RNA, 14 nt, Salmonella enterica enterica serovar Typhi
aaggccgagcgaag

SEQ ID NO: 1683571 - RNA, 22 nt, Salmonella enterica enterica serovar Typhi
aaggccagacucaucgccgcaa

SEQ ID NO: 1683572 - RNA, 20 nt, Salmonella enterica enterica serovar Typhi
acaaaugaccucaagaauau

SEQ ID NO: 1683573 - RNA, 16 nt, Salmonella enterica enterica serovar Typhi
acaaaucgacagccag

SEQ ID NO: 1683574 - RNA, 22 nt, Salmonella enterica enterica serovar Typhi
acaaaucaucgguuacuccuua

SEQ ID NO: 1683575 - RNA, 21 nt, Salmonella enterica enterica serovar Typhi
acaaaucacuggagcgcauuu

SEQ ID NO: 1683576 - RNA, 23 nt, Salmonella enterica enterica serovar Typhi
acaaauagaagccacaaucugau

SEQ ID NO: 1683577 - RNA, 23 nt, Salmonella enterica enterica serovar Typhi
acaaauaacagacgaaaaaaaag

SEQ ID NO: 1683578 - RNA, 13 nt, Salmonella enterica enterica serovar Typhi
acaaauaaaucca

SEQ ID NO: 1683579 - RNA, 21 nt, Salmonella enterica enterica serovar Typhi
acaacaaggauagcuuuguau

SEQ ID NO: 1683580 - RNA, 13 nt, Salmonella enterica enterica serovar Typhi
acaacaaaaagau

SEQ ID NO: 1683581 - RNA, 15 nt, Salmonella enterica enterica serovar Typhi
acaaauucugaagag

SEQ ID NO: 1683582 - RNA, 20 nt, Salmonella enterica enterica serovar Typhi
acaaagguugcgccaaagca

SEQ ID NO: 1683583 - RNA, 17 nt, Salmonella enterica enterica serovar Typhi
acaaagguuuguuuaau

SEQ ID NO: 1683584 - RNA, 14 nt, Salmonella enterica enterica serovar Typhi
acaaagccggauau

SEQ ID NO: 1683585 - RNA, 16 nt, Salmonella enterica enterica serovar Typhi
acaaagccugcuggaa

SEQ ID NO: 1683586 - RNA, 19 nt, Salmonella enterica enterica serovar Typhi
acaaagcguggggaaaacc

SEQ ID NO: 1683587 - RNA, 16 nt, Salmonella enterica enterica serovar Typhi
acaaagaauucuucug

SEQ ID NO: 1683588 - RNA, 19 nt, Salmonella enterica enterica serovar Typhi
acaaagacgaauaaggaau

SEQ ID NO: 1683589 - RNA, 15 nt, Salmonella enterica enterica serovar Typhi
acaaagagcucccca

SEQ ID NO: 1683590 - RNA, 22 nt, Salmonella enterica enterica serovar Typhi
acaaacucacguuccccagcac

SEQ ID NO: 1683591 - RNA, 22 nt, Salmonella enterica enterica serovar Typhi
acaaacgccgucacaaagccca

SEQ ID NO: 1683592 - RNA, 16 nt, Salmonella enterica enterica serovar Typhi
acaaacgcaccgccaa

SEQ ID NO: 1683593 - RNA, 17 nt, Salmonella enterica enterica serovar Typhi
acaaacgccaccgccac

SEQ ID NO: 1683594 - RNA, 19 nt, Salmonella enterica enterica serovar Typhi
acaaaccagacgcguaacc

SEQ ID NO: 1683595 - RNA, 14 nt, Salmonella enterica enterica serovar Typhi
acaaaccaccacca

SEQ ID NO: 1683596 - RNA, 16 nt, Salmonella enterica enterica serovar Typhi
acaaaccacugcugua

SEQ ID NO: 1683597 - RNA, 23 nt, Salmonella enterica enterica serovar Typhi
acaaacagcgccccgacaaaacg

SEQ ID NO: 1683598 - RNA, 22 nt, Salmonella enterica enterica serovar Typhi
acaagccccccgcacagcacau

SEQ ID NO: 1683599 - RNA, 19 nt, Salmonella enterica enterica serovar Typhi
acaagccccccgcacagca

SEQ ID NO: 1683600 - RNA, 22 nt, Salmonella enterica enterica serovar Typhi
acaagcaguaugaccccuccgg

SEQ ID NO: 1683601 - RNA, 11 nt, Salmonella enterica enterica serovar Typhi
acaagcaguua

SEQ ID NO: 1683602 - RNA, 20 nt, Salmonella enterica enterica serovar Typhi
acaagaucaaugugcucaac

SEQ ID NO: 1683603 - RNA, 22 nt, Salmonella enterica enterica serovar Typhi
acaagaggaguguaacgccgaa

SEQ ID NO: 1683604 - RNA, 21 nt, Salmonella enterica enterica serovar Typhi
acaagaauuuaucgcaauaua

SEQ ID NO: 1683605 - RNA, 12 nt, Salmonella enterica enterica serovar Typhi
acaagaagggua

SEQ ID NO: 1683606 - RNA, 19 nt, Salmonella enterica enterica serovar Typhi
acaacuucuaauuuuucca

SEQ ID NO: 1683607 - RNA, 21 nt, Salmonella enterica enterica serovar Typhi
acaacuucuaauuuuuccagc

SEQ ID NO: 1683608 - RNA, 16 nt, Salmonella enterica enterica serovar Typhi
acaacggcaauuuuua

SEQ ID NO: 1683609 - RNA, 19 nt, Salmonella enterica enterica serovar Typhi
acaacgucaguggaaaaca

SEQ ID NO: 1683610 - RNA, 19 nt, Salmonella enterica enterica serovar Typhi
acaacguucggucauggau

SEQ ID NO: 1683611 - RNA, 17 nt, Salmonella enterica enterica serovar Typhi
acaacggccagcaaaau

SEQ ID NO: 1683612 - RNA, 17 nt, Salmonella enterica enterica serovar Typhi
acaacggcgaccuucac

SEQ ID NO: 1683613 - RNA, 16 nt, Salmonella enterica enterica serovar Typhi
acaacgcauauuauga

SEQ ID NO: 1683614 - RNA, 13 nt, Salmonella enterica enterica serovar Typhi
acaaccugcccuu

SEQ ID NO: 1683615 - RNA, 16 nt, Salmonella enterica enterica serovar Typhi
acaacccuuuuccgga

SEQ ID NO: 1683616 - RNA, 17 nt, Salmonella enterica enterica serovar Typhi
acaacacucacaaaacu

SEQ ID NO: 1683617 - RNA, 16 nt, Salmonella enterica enterica serovar Typhi
acaacaucccagaaaa

SEQ ID NO: 1683618 - RNA, 14 nt, Salmonella enterica enterica serovar Typhi
acaacauugaggcu

SEQ ID NO: 1683619 - RNA, 23 nt, Salmonella enterica enterica serovar Typhi
acaaccaggauucaacgcgugau

SEQ ID NO: 1683620 - RNA, 16 nt, Salmonella enterica enterica serovar Typhi
aauuuucacuuauaaa

SEQ ID NO: 1683621 - RNA, 12 nt, Salmonella enterica enterica serovar Typhi
aauuuucaacca

SEQ ID NO: 1683622 - RNA, 20 nt, Salmonella enterica enterica serovar Typhi
aauuuugauaagagaaaaua

SEQ ID NO: 1683623 - RNA, 13 nt, Salmonella enterica enterica serovar Typhi
aauuuuuugauug

SEQ ID NO: 1683624 - RNA, 16 nt, Salmonella enterica enterica serovar Typhi
acaaaaaaaccgcuca

SEQ ID NO: 1683625 - RNA, 22 nt, Salmonella enterica enterica serovar Typhi
aauuuuuccgccuccuccgguu

SEQ ID NO: 1683626 - RNA, 21 nt, Salmonella enterica enterica serovar Typhi
acaaaaagcgcgccgaaaaua

SEQ ID NO: 1683627 - RNA, 18 nt, Salmonella enterica enterica serovar Typhi
acaaaaaaacggccucaa

SEQ ID NO: 1683628 - RNA, 16 nt, Salmonella enterica enterica serovar Typhi
acaaaauucagacuca

SEQ ID NO: 1683629 - RNA, 14 nt, Salmonella enterica enterica serovar Typhi
acaaacacagccau

SEQ ID NO: 1683630 - RNA, 19 nt, Salmonella enterica enterica serovar Typhi
acaaacaccaccaguaacc

SEQ ID NO: 1683631 - RNA, 15 nt, Salmonella enterica enterica serovar Typhi
acaaacaaauaaauc

SEQ ID NO: 1683632 - RNA, 19 nt, Salmonella enterica enterica serovar Typhi
acaaacaaauaaauccaug

SEQ ID NO: 1683633 - RNA, 22 nt, Salmonella enterica enterica serovar Typhi
acaaaauuuugcauaaauaaug

SEQ ID NO: 1683634 - RNA, 12 nt, Salmonella enterica enterica serovar Typhi
acaaaauuuuuu

SEQ ID NO: 1683635 - RNA, 23 nt, Salmonella enterica enterica serovar Typhi
acaaaaggcuggaacagauguuu

SEQ ID NO: 1683636 - RNA, 17 nt, Salmonella enterica enterica serovar Typhi
acaaaagcgguuaagau

SEQ ID NO: 1683637 - RNA, 11 nt, Salmonella enterica enterica serovar Typhi
aauuugacgac

SEQ ID NO: 1683638 - RNA, 18 nt, Salmonella enterica enterica serovar Typhi
aauuugauuuauuuugaa

SEQ ID NO: 1683639 - RNA, 9 nt, Salmonella enterica enterica serovar Typhi
aauuugauu

SEQ ID NO: 1683640 - RNA, 21 nt, Salmonella enterica enterica serovar Typhi
aauuugcuuucucgggccugu

SEQ ID NO: 1683641 - RNA, 17 nt, Salmonella enterica enterica serovar Typhi
aauuuuaccauucagcu

SEQ ID NO: 1683642 - RNA, 21 nt, Salmonella enterica enterica serovar Typhi
aauuuuacuuucauuccuuua

SEQ ID NO: 1683643 - RNA, 18 nt, Salmonella enterica enterica serovar Typhi
aauuugucguucacuugc

SEQ ID NO: 1683644 - RNA, 13 nt, Salmonella enterica enterica serovar Typhi
aauuucgcauaau

SEQ ID NO: 1683645 - RNA, 15 nt, Salmonella enterica enterica serovar Typhi
aauuucggcaaugac

SEQ ID NO: 1683646 - RNA, 20 nt, Salmonella enterica enterica serovar Typhi
aauuucgcgaauaaucuguu

SEQ ID NO: 1683647 - RNA, 13 nt, Salmonella enterica enterica serovar Typhi
aauuauaaagcau

SEQ ID NO: 1683648 - RNA, 17 nt, Salmonella enterica enterica serovar Typhi
aauuauacacucaacca

SEQ ID NO: 1683649 - RNA, 17 nt, Salmonella enterica enterica serovar Typhi
aauuuccaguucaauca

SEQ ID NO: 1683650 - RNA, 22 nt, Salmonella enterica enterica serovar Typhi
aauuuccgcacgcgcgcccaug

SEQ ID NO: 1683651 - RNA, 12 nt, Salmonella enterica enterica serovar Typhi
acaauuucuggc

SEQ ID NO: 1683652 - RNA, 15 nt, Salmonella enterica enterica serovar Typhi
acaauuugcccagcg

SEQ ID NO: 1683653 - RNA, 21 nt, Salmonella enterica enterica serovar Typhi
acaauucauagccacagcgcg

SEQ ID NO: 1683654 - RNA, 17 nt, Salmonella enterica enterica serovar Typhi
acaauuccggcccaggc

SEQ ID NO: 1683655 - RNA, 15 nt, Salmonella enterica enterica serovar Typhi
acaauucaacucacu

SEQ ID NO: 1683656 - RNA, 21 nt, Salmonella enterica enterica serovar Typhi
acaauuacgcaagagagcaac

SEQ ID NO: 1683657 - RNA, 22 nt, Salmonella enterica enterica serovar Typhi
acaaugugccggauggcgcuaa

SEQ ID NO: 1683658 - RNA, 21 nt, Salmonella enterica enterica serovar Typhi
acaaugcgguaaccguauugc

SEQ ID NO: 1683659 - RNA, 14 nt, Salmonella enterica enterica serovar Typhi
acaaugcugacacu

SEQ ID NO: 1683660 - RNA, 14 nt, Salmonella enterica enterica serovar Typhi
acacauagauaaaa

SEQ ID NO: 1683661 - RNA, 18 nt, Salmonella enterica enterica serovar Typhi
acacauaucgccagccau

SEQ ID NO: 1683662 - RNA, 15 nt, Salmonella enterica enterica serovar Typhi
acacaucaggaaugc

SEQ ID NO: 1683663 - RNA, 17 nt, Salmonella enterica enterica serovar Typhi
acacaucacaaucucca

SEQ ID NO: 1683664 - RNA, 13 nt, Salmonella enterica enterica serovar Typhi
acacaguugccuu

SEQ ID NO: 1683665 - RNA, 19 nt, Salmonella enterica enterica serovar Typhi
acacaggcgugguggauau

SEQ ID NO: 1683666 - RNA, 15 nt, Salmonella enterica enterica serovar Typhi
acacaggccugcauu

SEQ ID NO: 1683667 - RNA, 14 nt, Salmonella enterica enterica serovar Typhi
acacaguaaaaaaa

SEQ ID NO: 1683668 - RNA, 13 nt, Salmonella enterica enterica serovar Typhi
acacaacggcaca

SEQ ID NO: 1683669 - RNA, 15 nt, Salmonella enterica enterica serovar Typhi
acacacaacuaagug

SEQ ID NO: 1683670 - RNA, 16 nt, Salmonella enterica enterica serovar Typhi
acacacaaucgguuau

SEQ ID NO: 1683671 - RNA, 13 nt, Salmonella enterica enterica serovar Typhi
acacacgcgcuga

SEQ ID NO: 1683672 - RNA, 19 nt, Salmonella enterica enterica serovar Typhi
acacacguaacaaccagaa

SEQ ID NO: 1683673 - RNA, 22 nt, Salmonella enterica enterica serovar Typhi
acacacaguugccuucgauuaa

SEQ ID NO: 1683674 - RNA, 22 nt, Salmonella enterica enterica serovar Typhi
acacagacuuugcacagucugc

SEQ ID NO: 1683675 - RNA, 12 nt, Salmonella enterica enterica serovar Typhi
acacagaauuac

SEQ ID NO: 1683676 - RNA, 20 nt, Salmonella enterica enterica serovar Typhi
acacagaaaaaccaaaaaau

SEQ ID NO: 1683677 - RNA, 21 nt, Salmonella enterica enterica serovar Typhi
acacagaaaaaccaaaaaaua

SEQ ID NO: 1683678 - RNA, 19 nt, Salmonella enterica enterica serovar Typhi
acaaggcauucaggccgga

SEQ ID NO: 1683679 - RNA, 17 nt, Salmonella enterica enterica serovar Typhi
acaaggcuuuuggcuua

SEQ ID NO: 1683680 - RNA, 21 nt, Salmonella enterica enterica serovar Typhi
acaaggucggcuccuggugag

SEQ ID NO: 1683681 - RNA, 15 nt, Salmonella enterica enterica serovar Typhi
acaaguaauaaaaua

SEQ ID NO: 1683682 - RNA, 16 nt, Salmonella enterica enterica serovar Typhi
acaaguaauaaaauaa

SEQ ID NO: 1683683 - RNA, 18 nt, Salmonella enterica enterica serovar Typhi
acaaguaauaaaauaaua

SEQ ID NO: 1683684 - RNA, 18 nt, Salmonella enterica enterica serovar Typhi
acaauacuuaaaccugcg

SEQ ID NO: 1683685 - RNA, 19 nt, Salmonella enterica enterica serovar Typhi
acaauacuuaaaccugcgc

SEQ ID NO: 1683686 - RNA, 18 nt, Salmonella enterica enterica serovar Typhi
acaauagcaaucuguaac

SEQ ID NO: 1683687 - RNA, 17 nt, Salmonella enterica enterica serovar Typhi
acaauaccaauaagaac

SEQ ID NO: 1683688 - RNA, 19 nt, Salmonella enterica enterica serovar Typhi
acaauaccguuuggaucug

SEQ ID NO: 1683689 - RNA, 20 nt, Salmonella enterica enterica serovar Typhi
acaauaacgccggauauguu

SEQ ID NO: 1683690 - RNA, 22 nt, Salmonella enterica enterica serovar Typhi
acaauauucgccgcgauaauaa

SEQ ID NO: 1683691 - RNA, 18 nt, Salmonella enterica enterica serovar Typhi
acaauaugaccacuaacu

SEQ ID NO: 1683692 - RNA, 18 nt, Salmonella enterica enterica serovar Typhi
acaauauccucgcauccu

SEQ ID NO: 1683693 - RNA, 13 nt, Salmonella enterica enterica serovar Typhi
acaaucagcacca

SEQ ID NO: 1683694 - RNA, 12 nt, Salmonella enterica enterica serovar Typhi
acaaucagaaga

SEQ ID NO: 1683695 - RNA, 23 nt, Salmonella enterica enterica serovar Typhi
acaaucaauucacguuccauuuc

SEQ ID NO: 1683696 - RNA, 16 nt, Salmonella enterica enterica serovar Typhi
acaaucccggcaacug

SEQ ID NO: 1683697 - RNA, 20 nt, Salmonella enterica enterica serovar Typhi
acaaucaggcugcggaugau

SEQ ID NO: 1683698 - RNA, 14 nt, Salmonella enterica enterica serovar Typhi
acaaugacaugucg

SEQ ID NO: 1683699 - RNA, 21 nt, Salmonella enterica enterica serovar Typhi
acaaucgccgugaucccaaug

SEQ ID NO: 1683700 - RNA, 14 nt, Salmonella enterica enterica serovar Typhi
acaaucgccagccc

SEQ ID NO: 1683701 - RNA, 14 nt, Salmonella enterica enterica serovar Typhi
acaaucgcaccagg

SEQ ID NO: 1683702 - RNA, 19 nt, Salmonella enterica enterica serovar Typhi
acaauccguuauuucacag

SEQ ID NO: 1683703 - RNA, 17 nt, Salmonella enterica enterica serovar Typhi
acaaucguuaauucaug

SEQ ID NO: 1683704 - RNA, 15 nt, Salmonella enterica enterica serovar Typhi
acaaucucaauacca

SEQ ID NO: 1683705 - RNA, 20 nt, Salmonella enterica enterica serovar Typhi
acaaucuccagaccgcugcg

SEQ ID NO: 1683706 - RNA, 15 nt, Salmonella enterica enterica serovar Typhi
acaccugaaccagcg

SEQ ID NO: 1683707 - RNA, 12 nt, Salmonella enterica enterica serovar Typhi
acaccuuugggg

SEQ ID NO: 1683708 - RNA, 20 nt, Salmonella enterica enterica serovar Typhi
acaccuguaacgucacauuc

SEQ ID NO: 1683709 - RNA, 14 nt, Salmonella enterica enterica serovar Typhi
acacgauggcaaau

SEQ ID NO: 1683710 - RNA, 18 nt, Salmonella enterica enterica serovar Typhi
acacgccacaaacugcgc

SEQ ID NO: 1683711 - RNA, 14 nt, Salmonella enterica enterica serovar Typhi
acacgaccagcgac

SEQ ID NO: 1683712 - RNA, 18 nt, Salmonella enterica enterica serovar Typhi
acaccguagaucgccagc

SEQ ID NO: 1683713 - RNA, 21 nt, Salmonella enterica enterica serovar Typhi
acaccguauccggccugcagg

SEQ ID NO: 1683714 - RNA, 23 nt, Salmonella enterica enterica serovar Typhi
acaccguuuaucguuaccggcuc

SEQ ID NO: 1683715 - RNA, 23 nt, Salmonella enterica enterica serovar Typhi
acaccgcaggccggauaaggcau

SEQ ID NO: 1683716 - RNA, 15 nt, Salmonella enterica enterica serovar Typhi
acacccgcagccaga

SEQ ID NO: 1683717 - RNA, 15 nt, Salmonella enterica enterica serovar Typhi
acacccgcagccgca

SEQ ID NO: 1683718 - RNA, 12 nt, Salmonella enterica enterica serovar Typhi
acacccaauaua

SEQ ID NO: 1683719 - RNA, 15 nt, Salmonella enterica enterica serovar Typhi
acaccauuucacaaa

SEQ ID NO: 1683720 - RNA, 22 nt, Salmonella enterica enterica serovar Typhi
acaccauuucacaaauuaaaaa

SEQ ID NO: 1683721 - RNA, 20 nt, Salmonella enterica enterica serovar Typhi
acaccagggauuuugcuuuu

SEQ ID NO: 1683722 - RNA, 12 nt, Salmonella enterica enterica serovar Typhi
acaccagcgccg

SEQ ID NO: 1683723 - RNA, 19 nt, Salmonella enterica enterica serovar Typhi
acaccagacugaugaugaa

SEQ ID NO: 1683724 - RNA, 13 nt, Salmonella enterica enterica serovar Typhi
acaccagaaugcu

SEQ ID NO: 1683725 - RNA, 18 nt, Salmonella enterica enterica serovar Typhi
acaccaacggcgacgccc

SEQ ID NO: 1683726 - RNA, 18 nt, Salmonella enterica enterica serovar Typhi
acaccaaugucauauuug

SEQ ID NO: 1683727 - RNA, 23 nt, Salmonella enterica enterica serovar Typhi
acaccaaugucauauuugugagc

SEQ ID NO: 1683728 - RNA, 21 nt, Salmonella enterica enterica serovar Typhi
acacaugcaaaaaagcccauc

SEQ ID NO: 1683729 - RNA, 19 nt, Salmonella enterica enterica serovar Typhi
acacauuuucaaugcacgc

SEQ ID NO: 1683730 - RNA, 15 nt, Salmonella enterica enterica serovar Typhi
acacucaaccaacca

SEQ ID NO: 1683731 - RNA, 11 nt, Salmonella enterica enterica serovar Typhi
acacucaacca

SEQ ID NO: 1683732 - RNA, 20 nt, Salmonella enterica enterica serovar Typhi
acagaaaaaaugcaccgccu

SEQ ID NO: 1683733 - RNA, 22 nt, Salmonella enterica enterica serovar Typhi
acagaaaaucacaaauaacaga

SEQ ID NO: 1683734 - RNA, 17 nt, Salmonella enterica enterica serovar Typhi
acacuaacgcucuucuc

SEQ ID NO: 1683735 - RNA, 22 nt, Salmonella enterica enterica serovar Typhi
acacuaacuaauuguuuguaga

SEQ ID NO: 1683736 - RNA, 18 nt, Salmonella enterica enterica serovar Typhi
acagaagcgcugguaaau

SEQ ID NO: 1683737 - RNA, 17 nt, Salmonella enterica enterica serovar Typhi
acagaagcugagaaaag

SEQ ID NO: 1683738 - RNA, 13 nt, Salmonella enterica enterica serovar Typhi
acagaacugauuu

SEQ ID NO: 1683739 - RNA, 13 nt, Salmonella enterica enterica serovar Typhi
acacuaaaucaua

SEQ ID NO: 1683740 - RNA, 19 nt, Salmonella enterica enterica serovar Typhi
acacguaauucauuacgaa

SEQ ID NO: 1683741 - RNA, 16 nt, Salmonella enterica enterica serovar Typhi
acacgcguaaacuucc

SEQ ID NO: 1683742 - RNA, 14 nt, Salmonella enterica enterica serovar Typhi
acacgcucauguuc

SEQ ID NO: 1683743 - RNA, 14 nt, Salmonella enterica enterica serovar Typhi
acacgccuuccucc

SEQ ID NO: 1683744 - RNA, 17 nt, Salmonella enterica enterica serovar Typhi
acacgcgaauagccaga

SEQ ID NO: 1683745 - RNA, 21 nt, Salmonella enterica enterica serovar Typhi
acacgcgcaccaguucacucc

SEQ ID NO: 1683746 - RNA, 22 nt, Salmonella enterica enterica serovar Typhi
acagcagcgcggcacacagcac

SEQ ID NO: 1683747 - RNA, 14 nt, Salmonella enterica enterica serovar Typhi
acagcagcgcggca

SEQ ID NO: 1683748 - RNA, 14 nt, Salmonella enterica enterica serovar Typhi
acagcaacaucuau

SEQ ID NO: 1683749 - RNA, 14 nt, Salmonella enterica enterica serovar Typhi
acagacgcaggccg

SEQ ID NO: 1683750 - RNA, 19 nt, Salmonella enterica enterica serovar Typhi
acagacgccuuucagacuu

SEQ ID NO: 1683751 - RNA, 12 nt, Salmonella enterica enterica serovar Typhi
acagacgcugcg

SEQ ID NO: 1683752 - RNA, 13 nt, Salmonella enterica enterica serovar Typhi
acagacgaaaaaa

SEQ ID NO: 1683753 - RNA, 23 nt, Salmonella enterica enterica serovar Typhi
acagaagguuauucgccuuucac

SEQ ID NO: 1683754 - RNA, 13 nt, Salmonella enterica enterica serovar Typhi
acagaaucaucag

SEQ ID NO: 1683755 - RNA, 18 nt, Salmonella enterica enterica serovar Typhi
acagaaucaucaggcuau

SEQ ID NO: 1683756 - RNA, 22 nt, Salmonella enterica enterica serovar Typhi
acagaaucaacgccacaccgag

SEQ ID NO: 1683757 - RNA, 15 nt, Salmonella enterica enterica serovar Typhi
acagauacuggaagu

SEQ ID NO: 1683758 - RNA, 19 nt, Salmonella enterica enterica serovar Typhi
acauaccgucaccacgcgc

SEQ ID NO: 1683759 - RNA, 13 nt, Salmonella enterica enterica serovar Typhi
acauaccgcagau

SEQ ID NO: 1683760 - RNA, 20 nt, Salmonella enterica enterica serovar Typhi
acauacgccgccagccacug

SEQ ID NO: 1683761 - RNA, 22 nt, Salmonella enterica enterica serovar Typhi
acauacugaaauuucuuuucca

SEQ ID NO: 1683762 - RNA, 23 nt, Salmonella enterica enterica serovar Typhi
acauacugaaauuucuuuuccag

SEQ ID NO: 1683763 - RNA, 15 nt, Salmonella enterica enterica serovar Typhi
acauagaaaauauau

SEQ ID NO: 1683764 - RNA, 21 nt, Salmonella enterica enterica serovar Typhi
acauagaaaauauaugacaac

SEQ ID NO: 1683765 - RNA, 15 nt, Salmonella enterica enterica serovar Typhi
acauagcuauauuua

SEQ ID NO: 1683766 - RNA, 15 nt, Salmonella enterica enterica serovar Typhi
acauagcugaacaau

SEQ ID NO: 1683767 - RNA, 13 nt, Salmonella enterica enterica serovar Typhi
acauagggcaucg

SEQ ID NO: 1683768 - RNA, 19 nt, Salmonella enterica enterica serovar Typhi
acauaggcaaacaccucag

SEQ ID NO: 1683769 - RNA, 24 nt, Salmonella enterica enterica serovar Typhi
acauaaccggcaaccaaaguccaa

SEQ ID NO: 1683770 - RNA, 13 nt, Salmonella enterica enterica serovar Typhi
acauaaguaaaua

SEQ ID NO: 1683771 - RNA, 16 nt, Salmonella enterica enterica serovar Typhi
acauaagugcaggcug

SEQ ID NO: 1683772 - RNA, 17 nt, Salmonella enterica enterica serovar Typhi
acaguuugugccgccac

SEQ ID NO: 1683773 - RNA, 14 nt, Salmonella enterica enterica serovar Typhi
acagccaaaucagc

SEQ ID NO: 1683774 - RNA, 19 nt, Salmonella enterica enterica serovar Typhi
acaucacgcaaaugcagcg

SEQ ID NO: 1683775 - RNA, 13 nt, Salmonella enterica enterica serovar Typhi
acaucaagagaaa

SEQ ID NO: 1683776 - RNA, 12 nt, Salmonella enterica enterica serovar Typhi
acaucaagccca

SEQ ID NO: 1683777 - RNA, 17 nt, Salmonella enterica enterica serovar Typhi
acauauacucuucgcca

SEQ ID NO: 1683778 - RNA, 14 nt, Salmonella enterica enterica serovar Typhi
acauauaauuaaca

SEQ ID NO: 1683779 - RNA, 13 nt, Salmonella enterica enterica serovar Typhi
acauauacugucu

SEQ ID NO: 1683780 - RNA, 22 nt, Salmonella enterica enterica serovar Typhi
acauauauauccgcuauuacca

SEQ ID NO: 1683781 - RNA, 16 nt, Salmonella enterica enterica serovar Typhi
acauauccgcgcacag

SEQ ID NO: 1683782 - RNA, 18 nt, Salmonella enterica enterica serovar Typhi
acauaucgcaauugauac

SEQ ID NO: 1683783 - RNA, 19 nt, Salmonella enterica enterica serovar Typhi
acauaucgccggggaaaau

SEQ ID NO: 1683784 - RNA, 20 nt, Salmonella enterica enterica serovar Typhi
acauaucgccggggaaaaua

SEQ ID NO: 1683785 - RNA, 12 nt, Salmonella enterica enterica serovar Typhi
acauaugaagga

SEQ ID NO: 1683786 - RNA, 21 nt, Salmonella enterica enterica serovar Typhi
acaucaucguuugcgcgcacg

SEQ ID NO: 1683787 - RNA, 19 nt, Salmonella enterica enterica serovar Typhi
acauccagcgccugcugua

SEQ ID NO: 1683788 - RNA, 12 nt, Salmonella enterica enterica serovar Typhi
acauccagcugu

SEQ ID NO: 1683789 - RNA, 16 nt, Salmonella enterica enterica serovar Typhi
acaucaugcuugcuuu

SEQ ID NO: 1683790 - RNA, 14 nt, Salmonella enterica enterica serovar Typhi
acauccagcgccag

SEQ ID NO: 1683791 - RNA, 21 nt, Salmonella enterica enterica serovar Typhi
acaucaugaugaucuucagcc

SEQ ID NO: 1683792 - RNA, 13 nt, Salmonella enterica enterica serovar Typhi
acauccucuccug

SEQ ID NO: 1683793 - RNA, 17 nt, Salmonella enterica enterica serovar Typhi
acauccugugaaguaaa

SEQ ID NO: 1683794 - RNA, 19 nt, Salmonella enterica enterica serovar Typhi
acauccccgccgagaaaau

SEQ ID NO: 1683795 - RNA, 21 nt, Salmonella enterica enterica serovar Typhi
acauccccgccgagaaaauac

SEQ ID NO: 1683796 - RNA, 12 nt, Salmonella enterica enterica serovar Typhi
acaucguaaauc

SEQ ID NO: 1683797 - RNA, 22 nt, Salmonella enterica enterica serovar Typhi
acaucguaaaucaaaugagaau

SEQ ID NO: 1683798 - RNA, 19 nt, Salmonella enterica enterica serovar Typhi
acaucguguauaccaaaaa

SEQ ID NO: 1683799 - RNA, 20 nt, Salmonella enterica enterica serovar Typhi
acauccugugaaguaaaaaa

SEQ ID NO: 1683800 - RNA, 21 nt, Salmonella enterica enterica serovar Typhi
acaugccggugcgagaaaaag

SEQ ID NO: 1683801 - RNA, 22 nt, Salmonella enterica enterica serovar Typhi
acaugccggugcgagaaaaagc

SEQ ID NO: 1683802 - RNA, 17 nt, Salmonella enterica enterica serovar Typhi
acaugcguaccugcgcg

SEQ ID NO: 1683803 - RNA, 23 nt, Salmonella enterica enterica serovar Typhi
acauguucagcgcagaagcagac

SEQ ID NO: 1683804 - RNA, 22 nt, Salmonella enterica enterica serovar Typhi
acauuggcaaaccccugcucgc

SEQ ID NO: 1683805 - RNA, 12 nt, Salmonella enterica enterica serovar Typhi
acauugccccuc

SEQ ID NO: 1683806 - RNA, 21 nt, Salmonella enterica enterica serovar Typhi
acauugaguaaauaaaucagc

SEQ ID NO: 1683807 - RNA, 18 nt, Salmonella enterica enterica serovar Typhi
acauucugcuuccagaau

SEQ ID NO: 1683808 - RNA, 15 nt, Salmonella enterica enterica serovar Typhi
acauucgauaaccgc

SEQ ID NO: 1683809 - RNA, 13 nt, Salmonella enterica enterica serovar Typhi
acauucagcacau

SEQ ID NO: 1683810 - RNA, 18 nt, Salmonella enterica enterica serovar Typhi
acauucauugccgccagu

SEQ ID NO: 1683811 - RNA, 14 nt, Salmonella enterica enterica serovar Typhi
acauuaugcgcaug

SEQ ID NO: 1683812 - RNA, 17 nt, Salmonella enterica enterica serovar Typhi
acauuauuaaaaugucu

SEQ ID NO: 1683813 - RNA, 21 nt, Salmonella enterica enterica serovar Typhi
acauuauuaaaaugucuuuuc

SEQ ID NO: 1683814 - RNA, 20 nt, Salmonella enterica enterica serovar Typhi
acauucaaaccuucaagaau

SEQ ID NO: 1683815 - RNA, 15 nt, Salmonella enterica enterica serovar Typhi
acauuauugucuuug

SEQ ID NO: 1683816 - RNA, 15 nt, Salmonella enterica enterica serovar Typhi
acauuacaauguaca

SEQ ID NO: 1683817 - RNA, 22 nt, Salmonella enterica enterica serovar Typhi
acauuguaugcaagaacgggcu

SEQ ID NO: 1683818 - RNA, 18 nt, Salmonella enterica enterica serovar Typhi
acauugucagcugaacag

SEQ ID NO: 1683819 - RNA, 20 nt, Salmonella enterica enterica serovar Typhi
acauugcuguggaaaaucug

SEQ ID NO: 1683820 - RNA, 16 nt, Salmonella enterica enterica serovar Typhi
acauugggucguaaua

SEQ ID NO: 1683821 - RNA, 14 nt, Salmonella enterica enterica serovar Typhi
accaacaacagaua

SEQ ID NO: 1683822 - RNA, 15 nt, Salmonella enterica enterica serovar Typhi
accaaaugcccagcu

SEQ ID NO: 1683823 - RNA, 18 nt, Salmonella enterica enterica serovar Typhi
acauuuuuacaguuacca

SEQ ID NO: 1683824 - RNA, 22 nt, Salmonella enterica enterica serovar Typhi
accaauagagagcgacagcccg

SEQ ID NO: 1683825 - RNA, 23 nt, Salmonella enterica enterica serovar Typhi
accaauaauaaucccaacauggu

SEQ ID NO: 1683826 - RNA, 19 nt, Salmonella enterica enterica serovar Typhi
accaauaaaggucggcugc

SEQ ID NO: 1683827 - RNA, 22 nt, Salmonella enterica enterica serovar Typhi
accaauaaaggucggcugcccu

SEQ ID NO: 1683828 - RNA, 14 nt, Salmonella enterica enterica serovar Typhi
accacaacacacgu

SEQ ID NO: 1683829 - RNA, 22 nt, Salmonella enterica enterica serovar Typhi
accacaauaaucgcgagaaaau

SEQ ID NO: 1683830 - RNA, 20 nt, Salmonella enterica enterica serovar Typhi
accaauguuaauaagcagaa

SEQ ID NO: 1683831 - RNA, 15 nt, Salmonella enterica enterica serovar Typhi
accaaugugcaaaga

SEQ ID NO: 1683832 - RNA, 18 nt, Salmonella enterica enterica serovar Typhi
accaauggcgcgucuuaa

SEQ ID NO: 1683833 - RNA, 19 nt, Salmonella enterica enterica serovar Typhi
accaauggcgcgucuuaaa

SEQ ID NO: 1683834 - RNA, 19 nt, Salmonella enterica enterica serovar Typhi
accacacgcuuauccugcc

SEQ ID NO: 1683835 - RNA, 22 nt, Salmonella enterica enterica serovar Typhi
accacagcggacacccgcagcc

SEQ ID NO: 1683836 - RNA, 17 nt, Salmonella enterica enterica serovar Typhi
accagcggcaccagcac

SEQ ID NO: 1683837 - RNA, 17 nt, Salmonella enterica enterica serovar Typhi
accagcggcagcuucag

SEQ ID NO: 1683838 - RNA, 22 nt, Salmonella enterica enterica serovar Typhi
accagcgcuucuguuaaaaaau

SEQ ID NO: 1683839 - RNA, 20 nt, Salmonella enterica enterica serovar Typhi
accagccgagugcuuaugua

SEQ ID NO: 1683840 - RNA, 21 nt, Salmonella enterica enterica serovar Typhi
accagcagcgccagcgaagua

SEQ ID NO: 1683841 - RNA, 12 nt, Salmonella enterica enterica serovar Typhi
accagcccauga

SEQ ID NO: 1683842 - RNA, 14 nt, Salmonella enterica enterica serovar Typhi
accagccccacggu

SEQ ID NO: 1683843 - RNA, 18 nt, Salmonella enterica enterica serovar Typhi
accagccgauaacucuuc

SEQ ID NO: 1683844 - RNA, 18 nt, Salmonella enterica enterica serovar Typhi
accagcugacgacgccag

SEQ ID NO: 1683845 - RNA, 19 nt, Salmonella enterica enterica serovar Typhi
accagcugacgacgccagc

SEQ ID NO: 1683846 - RNA, 20 nt, Salmonella enterica enterica serovar Typhi
accagcugacgacgccagcc

SEQ ID NO: 1683847 - RNA, 22 nt, Salmonella enterica enterica serovar Typhi
accagcgguugcauaaaauccu

SEQ ID NO: 1683848 - RNA, 21 nt, Salmonella enterica enterica serovar Typhi
accagcgucagccagaacgaa

SEQ ID NO: 1683849 - RNA, 20 nt, Salmonella enterica enterica serovar Typhi
accagcgggccgcugauguu

SEQ ID NO: 1683850 - RNA, 19 nt, Salmonella enterica enterica serovar Typhi
accagcguggcuauccaua

SEQ ID NO: 1683851 - RNA, 22 nt, Salmonella enterica enterica serovar Typhi
accagcagcgcggcguacacuu

SEQ ID NO: 1683852 - RNA, 15 nt, Salmonella enterica enterica serovar Typhi
accagcagcgggcug

SEQ ID NO: 1683853 - RNA, 13 nt, Salmonella enterica enterica serovar Typhi
accagccaugcca

SEQ ID NO: 1683854 - RNA, 11 nt, Salmonella enterica enterica serovar Typhi
accagcagcau

SEQ ID NO: 1683855 - RNA, 20 nt, Salmonella enterica enterica serovar Typhi
accagcaaugauaacggcgc

SEQ ID NO: 1683856 - RNA, 22 nt, Salmonella enterica enterica serovar Typhi
accagcaaugauaacggcgcca

SEQ ID NO: 1683857 - RNA, 22 nt, Salmonella enterica enterica serovar Typhi
accagcaauuggccaucuucgu

SEQ ID NO: 1683858 - RNA, 16 nt, Salmonella enterica enterica serovar Typhi
accagcaaugagacaa

SEQ ID NO: 1683859 - RNA, 17 nt, Salmonella enterica enterica serovar Typhi
accacuucggcagaaaa

SEQ ID NO: 1683860 - RNA, 17 nt, Salmonella enterica enterica serovar Typhi
accacguuaccgcgcag

SEQ ID NO: 1683861 - RNA, 15 nt, Salmonella enterica enterica serovar Typhi
accacgucugaagaa

SEQ ID NO: 1683862 - RNA, 14 nt, Salmonella enterica enterica serovar Typhi
accacgcugccgcc

SEQ ID NO: 1683863 - RNA, 17 nt, Salmonella enterica enterica serovar Typhi
accacgcccgccgccag

SEQ ID NO: 1683864 - RNA, 22 nt, Salmonella enterica enterica serovar Typhi
accacgccaucaacagcggaga

SEQ ID NO: 1683865 - RNA, 19 nt, Salmonella enterica enterica serovar Typhi
accacgccauggccgcagc

SEQ ID NO: 1683866 - RNA, 17 nt, Salmonella enterica enterica serovar Typhi
accacguucauuucgua

SEQ ID NO: 1683867 - RNA, 22 nt, Salmonella enterica enterica serovar Typhi
accacuguccgguuacaaccgu

SEQ ID NO: 1683868 - RNA, 13 nt, Salmonella enterica enterica serovar Typhi
accaccguccgag

SEQ ID NO: 1683869 - RNA, 15 nt, Salmonella enterica enterica serovar Typhi
accacgcacaugggc

SEQ ID NO: 1683870 - RNA, 17 nt, Salmonella enterica enterica serovar Typhi
accacgcauaccagcca

SEQ ID NO: 1683871 - RNA, 21 nt, Salmonella enterica enterica serovar Typhi
accacagugacccgccgccag

SEQ ID NO: 1683872 - RNA, 14 nt, Salmonella enterica enterica serovar Typhi
accacauccacccc

SEQ ID NO: 1683873 - RNA, 14 nt, Salmonella enterica enterica serovar Typhi
accaccaggaacgc

SEQ ID NO: 1683874 - RNA, 18 nt, Salmonella enterica enterica serovar Typhi
accaccauacccaguagc

SEQ ID NO: 1683875 - RNA, 20 nt, Salmonella enterica enterica serovar Typhi
accaccauacccaguagcag

SEQ ID NO: 1683876 - RNA, 16 nt, Salmonella enterica enterica serovar Typhi
accaccaguaaccgcc

SEQ ID NO: 1683877 - RNA, 14 nt, Salmonella enterica enterica serovar Typhi
accaccaguacaug

SEQ ID NO: 1683878 - RNA, 21 nt, Salmonella enterica enterica serovar Typhi
accauccgguuuuaaauuccu

SEQ ID NO: 1683879 - RNA, 22 nt, Salmonella enterica enterica serovar Typhi
accaucuggcccugacgaaauu

SEQ ID NO: 1683880 - RNA, 22 nt, Salmonella enterica enterica serovar Typhi
accaugacgcagggcaauauua

SEQ ID NO: 1683881 - RNA, 22 nt, Salmonella enterica enterica serovar Typhi
accaugauccguucgaucagcu

SEQ ID NO: 1683882 - RNA, 17 nt, Salmonella enterica enterica serovar Typhi
accaugauaauaaucau

SEQ ID NO: 1683883 - RNA, 20 nt, Salmonella enterica enterica serovar Typhi
accaggcagcgcgccagcgc

SEQ ID NO: 1683884 - RNA, 13 nt, Salmonella enterica enterica serovar Typhi
accaggcacugca

SEQ ID NO: 1683885 - RNA, 15 nt, Salmonella enterica enterica serovar Typhi
accaggcacugcagg

SEQ ID NO: 1683886 - RNA, 14 nt, Salmonella enterica enterica serovar Typhi
accaggcacuugag

SEQ ID NO: 1683887 - RNA, 15 nt, Salmonella enterica enterica serovar Typhi
accaggcaaaccagc

SEQ ID NO: 1683888 - RNA, 17 nt, Salmonella enterica enterica serovar Typhi
accaggcaaaccagcac

SEQ ID NO: 1683889 - RNA, 21 nt, Salmonella enterica enterica serovar Typhi
accagcuucaugcuggauacc

SEQ ID NO: 1683890 - RNA, 18 nt, Salmonella enterica enterica serovar Typhi
accagcuuguuauccauc

SEQ ID NO: 1683891 - RNA, 16 nt, Salmonella enterica enterica serovar Typhi
accauccgcgccgagg

SEQ ID NO: 1683892 - RNA, 15 nt, Salmonella enterica enterica serovar Typhi
accauccggcgcugc

SEQ ID NO: 1683893 - RNA, 15 nt, Salmonella enterica enterica serovar Typhi
accaucaaaaaaaau

SEQ ID NO: 1683894 - RNA, 16 nt, Salmonella enterica enterica serovar Typhi
accaucaaaaaaaaua

SEQ ID NO: 1683895 - RNA, 23 nt, Salmonella enterica enterica serovar Typhi
accaugggucucauccauccaac

SEQ ID NO: 1683896 - RNA, 14 nt, Salmonella enterica enterica serovar Typhi
accaugcugguugg

SEQ ID NO: 1683897 - RNA, 19 nt, Salmonella enterica enterica serovar Typhi
accaugguucccgccacug

SEQ ID NO: 1683898 - RNA, 18 nt, Salmonella enterica enterica serovar Typhi
acccaccgacaaccccaa

SEQ ID NO: 1683899 - RNA, 10 nt, Salmonella enterica enterica serovar Typhi
acccaaaaau

SEQ ID NO: 1683900 - RNA, 16 nt, Salmonella enterica enterica serovar Typhi
acccaaaaaccccgac

SEQ ID NO: 1683901 - RNA, 19 nt, Salmonella enterica enterica serovar Typhi
acccauacucuuucccggc

SEQ ID NO: 1683902 - RNA, 18 nt, Salmonella enterica enterica serovar Typhi
acccauacaguacagacu

SEQ ID NO: 1683903 - RNA, 18 nt, Salmonella enterica enterica serovar Typhi
acccauauucgucuucau

SEQ ID NO: 1683904 - RNA, 21 nt, Salmonella enterica enterica serovar Typhi
acccauauucgucuucaucuu

SEQ ID NO: 1683905 - RNA, 17 nt, Salmonella enterica enterica serovar Typhi
acccagucgcagccacc

SEQ ID NO: 1683906 - RNA, 14 nt, Salmonella enterica enterica serovar Typhi
acccagugccacca

SEQ ID NO: 1683907 - RNA, 22 nt, Salmonella enterica enterica serovar Typhi
acccaguuuuaagcgcaggugc

SEQ ID NO: 1683908 - RNA, 20 nt, Salmonella enterica enterica serovar Typhi
acccaguucaaaucgaugcc

SEQ ID NO: 1683909 - RNA, 15 nt, Salmonella enterica enterica serovar Typhi
acccaggccaucaga

SEQ ID NO: 1683910 - RNA, 15 nt, Salmonella enterica enterica serovar Typhi
acccacgccagcagc

SEQ ID NO: 1683911 - RNA, 21 nt, Salmonella enterica enterica serovar Typhi
acccacggcaaagaccgcguc

SEQ ID NO: 1683912 - RNA, 16 nt, Salmonella enterica enterica serovar Typhi
acccgaccgucuuugu

SEQ ID NO: 1683913 - RNA, 21 nt, Salmonella enterica enterica serovar Typhi
acccgaccauuuuugacacag

SEQ ID NO: 1683914 - RNA, 14 nt, Salmonella enterica enterica serovar Typhi
acccgacacggcuc

SEQ ID NO: 1683915 - RNA, 20 nt, Salmonella enterica enterica serovar Typhi
acccgauaccgccagcccca

SEQ ID NO: 1683916 - RNA, 22 nt, Salmonella enterica enterica serovar Typhi
acccgaucgccauccugcaccg

SEQ ID NO: 1683917 - RNA, 16 nt, Salmonella enterica enterica serovar Typhi
acccgauaaaaucauc

SEQ ID NO: 1683918 - RNA, 21 nt, Salmonella enterica enterica serovar Typhi
acccgaucgccauccugcacc

SEQ ID NO: 1683919 - RNA, 15 nt, Salmonella enterica enterica serovar Typhi
acccgauaccgccag

SEQ ID NO: 1683920 - RNA, 19 nt, Salmonella enterica enterica serovar Typhi
acccgauaccgccagcccc

SEQ ID NO: 1683921 - RNA, 16 nt, Salmonella enterica enterica serovar Typhi
acccgcccgguuuugu

SEQ ID NO: 1683922 - RNA, 15 nt, Salmonella enterica enterica serovar Typhi
acccgcccagaucag

SEQ ID NO: 1683923 - RNA, 15 nt, Salmonella enterica enterica serovar Typhi
acccgcagccagaac

SEQ ID NO: 1683924 - RNA, 17 nt, Salmonella enterica enterica serovar Typhi
acccgcagccagaacag

SEQ ID NO: 1683925 - RNA, 15 nt, Salmonella enterica enterica serovar Typhi
acccgcagcggaaga

SEQ ID NO: 1683926 - RNA, 20 nt, Salmonella enterica enterica serovar Typhi
acccgauucugccaguucac

SEQ ID NO: 1683927 - RNA, 14 nt, Salmonella enterica enterica serovar Typhi
acccgcaauaccaa

SEQ ID NO: 1683928 - RNA, 13 nt, Salmonella enterica enterica serovar Typhi
acccauccccaua

SEQ ID NO: 1683929 - RNA, 19 nt, Salmonella enterica enterica serovar Typhi
acccaucagggaaaaaugu

SEQ ID NO: 1683930 - RNA, 12 nt, Salmonella enterica enterica serovar Typhi
acccaucaauaa

SEQ ID NO: 1683931 - RNA, 14 nt, Salmonella enterica enterica serovar Typhi
acccaucaauaacg

SEQ ID NO: 1683932 - RNA, 17 nt, Salmonella enterica enterica serovar Typhi
acccauuuuauccucuu

SEQ ID NO: 1683933 - RNA, 20 nt, Salmonella enterica enterica serovar Typhi
accccuugcgcguuucugaa

SEQ ID NO: 1683934 - RNA, 14 nt, Salmonella enterica enterica serovar Typhi
accccggccucgcc

SEQ ID NO: 1683935 - RNA, 17 nt, Salmonella enterica enterica serovar Typhi
accccggcgcggcgcgc

SEQ ID NO: 1683936 - RNA, 20 nt, Salmonella enterica enterica serovar Typhi
acccggugcggcaagcgcgc

SEQ ID NO: 1683937 - RNA, 14 nt, Salmonella enterica enterica serovar Typhi
acccggcccggcgc

SEQ ID NO: 1683938 - RNA, 17 nt, Salmonella enterica enterica serovar Typhi
acccggcgcaaacuuca

SEQ ID NO: 1683939 - RNA, 21 nt, Salmonella enterica enterica serovar Typhi
acccgggccaucuuuuuucac

SEQ ID NO: 1683940 - RNA, 21 nt, Salmonella enterica enterica serovar Typhi
acccggcuuuuuuauugccua

SEQ ID NO: 1683941 - RNA, 18 nt, Salmonella enterica enterica serovar Typhi
acccgggaaaaaugacgc

SEQ ID NO: 1683942 - RNA, 16 nt, Salmonella enterica enterica serovar Typhi
acccgcugcuucacgg

SEQ ID NO: 1683943 - RNA, 16 nt, Salmonella enterica enterica serovar Typhi
acccggcaauucaucc

SEQ ID NO: 1683944 - RNA, 16 nt, Salmonella enterica enterica serovar Typhi
acccggagagaaacaa

SEQ ID NO: 1683945 - RNA, 19 nt, Salmonella enterica enterica serovar Typhi
acccgccgccagcaccgcc

SEQ ID NO: 1683946 - RNA, 17 nt, Salmonella enterica enterica serovar Typhi
acccgccggcagcagcu

SEQ ID NO: 1683947 - RNA, 15 nt, Salmonella enterica enterica serovar Typhi
acccgcgccagcagg

SEQ ID NO: 1683948 - RNA, 21 nt, Salmonella enterica enterica serovar Typhi
acccgcgaucacuaccgccau

SEQ ID NO: 1683949 - RNA, 22 nt, Salmonella enterica enterica serovar Typhi
accgccgcuuuucagggguccc

SEQ ID NO: 1683950 - RNA, 14 nt, Salmonella enterica enterica serovar Typhi
accgccgcgcguca

SEQ ID NO: 1683951 - RNA, 16 nt, Salmonella enterica enterica serovar Typhi
accgcgaugaccauca

SEQ ID NO: 1683952 - RNA, 22 nt, Salmonella enterica enterica serovar Typhi
accgcuuugccgcgcucuuuaa

SEQ ID NO: 1683953 - RNA, 13 nt, Salmonella enterica enterica serovar Typhi
accggaacagaag

SEQ ID NO: 1683954 - RNA, 14 nt, Salmonella enterica enterica serovar Typhi
accggacugcucgc

SEQ ID NO: 1683955 - RNA, 17 nt, Salmonella enterica enterica serovar Typhi
accgcuucgccuucgcc

SEQ ID NO: 1683956 - RNA, 21 nt, Salmonella enterica enterica serovar Typhi
accgcucacgguuucaacuuc

SEQ ID NO: 1683957 - RNA, 23 nt, Salmonella enterica enterica serovar Typhi
accgcuaucauaccuacaccaac

SEQ ID NO: 1683958 - RNA, 14 nt, Salmonella enterica enterica serovar Typhi
accgcuacaaucca

SEQ ID NO: 1683959 - RNA, 13 nt, Salmonella enterica enterica serovar Typhi
accgcguuugcgc

SEQ ID NO: 1683960 - RNA, 16 nt, Salmonella enterica enterica serovar Typhi
accgcuaaugaggaaa

SEQ ID NO: 1683961 - RNA, 19 nt, Salmonella enterica enterica serovar Typhi
accgcguuugcgcaacaga

SEQ ID NO: 1683962 - RNA, 14 nt, Salmonella enterica enterica serovar Typhi
accgcguaaaaagu

SEQ ID NO: 1683963 - RNA, 15 nt, Salmonella enterica enterica serovar Typhi
accgccagucacccu

SEQ ID NO: 1683964 - RNA, 23 nt, Salmonella enterica enterica serovar Typhi
accgcccgcgcuuuagggcuucc

SEQ ID NO: 1683965 - RNA, 22 nt, Salmonella enterica enterica serovar Typhi
accgccagcggcguuuuuuccu

SEQ ID NO: 1683966 - RNA, 21 nt, Salmonella enterica enterica serovar Typhi
accgccgagcauuuccgcagc

SEQ ID NO: 1683967 - RNA, 16 nt, Salmonella enterica enterica serovar Typhi
accgccgacaaucguc

SEQ ID NO: 1683968 - RNA, 20 nt, Salmonella enterica enterica serovar Typhi
accgcccgcggcgaucacca

SEQ ID NO: 1683969 - RNA, 13 nt, Salmonella enterica enterica serovar Typhi
accgccgcccguc

SEQ ID NO: 1683970 - RNA, 18 nt, Salmonella enterica enterica serovar Typhi
accgccgccaccaaaaac

SEQ ID NO: 1683971 - RNA, 18 nt, Salmonella enterica enterica serovar Typhi
accgccgccaaacugcgc

SEQ ID NO: 1683972 - RNA, 23 nt, Salmonella enterica enterica serovar Typhi
accgccacuuugcuuuguagcgc

SEQ ID NO: 1683973 - RNA, 18 nt, Salmonella enterica enterica serovar Typhi
accgccagcaguagcuug

SEQ ID NO: 1683974 - RNA, 12 nt, Salmonella enterica enterica serovar Typhi
accgccagcaga

SEQ ID NO: 1683975 - RNA, 16 nt, Salmonella enterica enterica serovar Typhi
accgcagcuuauucca

SEQ ID NO: 1683976 - RNA, 15 nt, Salmonella enterica enterica serovar Typhi
accgcagcgcggccu

SEQ ID NO: 1683977 - RNA, 21 nt, Salmonella enterica enterica serovar Typhi
accgcaucacgcgaagcggcg

SEQ ID NO: 1683978 - RNA, 15 nt, Salmonella enterica enterica serovar Typhi
accgcaucgcgccca

SEQ ID NO: 1683979 - RNA, 14 nt, Salmonella enterica enterica serovar Typhi
accgcauacugaac

SEQ ID NO: 1683980 - RNA, 21 nt, Salmonella enterica enterica serovar Typhi
accgcaaaccgaauucgucca

SEQ ID NO: 1683981 - RNA, 13 nt, Salmonella enterica enterica serovar Typhi
accgcagccuuga

SEQ ID NO: 1683982 - RNA, 14 nt, Salmonella enterica enterica serovar Typhi
accgcagaagguca

SEQ ID NO: 1683983 - RNA, 20 nt, Salmonella enterica enterica serovar Typhi
accgcagaaggucacgccgg

SEQ ID NO: 1683984 - RNA, 13 nt, Salmonella enterica enterica serovar Typhi
accgauaaauacc

SEQ ID NO: 1683985 - RNA, 12 nt, Salmonella enterica enterica serovar Typhi
accgaucaucau

SEQ ID NO: 1683986 - RNA, 19 nt, Salmonella enterica enterica serovar Typhi
accgauauagagcccucug

SEQ ID NO: 1683987 - RNA, 19 nt, Salmonella enterica enterica serovar Typhi
accgauaaucaccagcccg

SEQ ID NO: 1683988 - RNA, 12 nt, Salmonella enterica enterica serovar Typhi
accgaccugccu

SEQ ID NO: 1683989 - RNA, 13 nt, Salmonella enterica enterica serovar Typhi
accgaccugccuu

SEQ ID NO: 1683990 - RNA, 17 nt, Salmonella enterica enterica serovar Typhi
accgacagauagcccug

SEQ ID NO: 1683991 - RNA, 22 nt, Salmonella enterica enterica serovar Typhi
accgacacgugguacacaauca

SEQ ID NO: 1683992 - RNA, 13 nt, Salmonella enterica enterica serovar Typhi
accgagcagcuug

SEQ ID NO: 1683993 - RNA, 14 nt, Salmonella enterica enterica serovar Typhi
accgaggcaggggc

SEQ ID NO: 1683994 - RNA, 16 nt, Salmonella enterica enterica serovar Typhi
accgacaacguuuuca

SEQ ID NO: 1683995 - RNA, 17 nt, Salmonella enterica enterica serovar Typhi
accgaacagccaggcuu

SEQ ID NO: 1683996 - RNA, 18 nt, Salmonella enterica enterica serovar Typhi
accgaaauccgcuuugag

SEQ ID NO: 1683997 - RNA, 13 nt, Salmonella enterica enterica serovar Typhi
accgaaaucauca

SEQ ID NO: 1683998 - RNA, 22 nt, Salmonella enterica enterica serovar Typhi
accgaaacgcauacgcaggacu

SEQ ID NO: 1683999 - RNA, 14 nt, Salmonella enterica enterica serovar Typhi
acccuuuggccacc

SEQ ID NO: 1684000 - RNA, 18 nt, Salmonella enterica enterica serovar Typhi
acccuauugccacaauau

SEQ ID NO: 1684001 - RNA, 16 nt, Salmonella enterica enterica serovar Typhi
acccgugcgcgucgcc

SEQ ID NO: 1684002 - RNA, 20 nt, Salmonella enterica enterica serovar Typhi
acccguuaaauaccagcacc

SEQ ID NO: 1684003 - RNA, 22 nt, Salmonella enterica enterica serovar Typhi
acccguuacgcagucagcacug

SEQ ID NO: 1684004 - RNA, 17 nt, Salmonella enterica enterica serovar Typhi
acccguuauucauucac

SEQ ID NO: 1684005 - RNA, 21 nt, Salmonella enterica enterica serovar Typhi
acccguuauucauucacccaa

SEQ ID NO: 1684006 - RNA, 16 nt, Salmonella enterica enterica serovar Typhi
acccguucgaaugaga

SEQ ID NO: 1684007 - RNA, 12 nt, Salmonella enterica enterica serovar Typhi
acccguuuucau

SEQ ID NO: 1684008 - RNA, 18 nt, Salmonella enterica enterica serovar Typhi
acccuuccccggcagccu

SEQ ID NO: 1684009 - RNA, 20 nt, Salmonella enterica enterica serovar Typhi
acccuguauuaccugaugag

SEQ ID NO: 1684010 - RNA, 15 nt, Salmonella enterica enterica serovar Typhi
acccugguuugcugg

SEQ ID NO: 1684011 - RNA, 20 nt, Salmonella enterica enterica serovar Typhi
acccuucuucuggcucagac

SEQ ID NO: 1684012 - RNA, 16 nt, Salmonella enterica enterica serovar Typhi
acccugagcgccgcca

SEQ ID NO: 1684013 - RNA, 16 nt, Salmonella enterica enterica serovar Typhi
acccugaaaaguuaca

SEQ ID NO: 1684014 - RNA, 18 nt, Salmonella enterica enterica serovar Typhi
acgggacgaauuuccagc

SEQ ID NO: 1684015 - RNA, 16 nt, Salmonella enterica enterica serovar Typhi
acgggaaggaaauuca

SEQ ID NO: 1684016 - RNA, 14 nt, Salmonella enterica enterica serovar Typhi
acgggaaaucuccc

SEQ ID NO: 1684017 - RNA, 22 nt, Salmonella enterica enterica serovar Typhi
acgggcauuguuaauccagagc

SEQ ID NO: 1684018 - RNA, 12 nt, Salmonella enterica enterica serovar Typhi
acgggccaggcg

SEQ ID NO: 1684019 - RNA, 21 nt, Salmonella enterica enterica serovar Typhi
acguagcuuauaaaucagcuu

SEQ ID NO: 1684020 - RNA, 22 nt, Salmonella enterica enterica serovar Typhi
acguagcaaagcguacaugaau

SEQ ID NO: 1684021 - RNA, 16 nt, Salmonella enterica enterica serovar Typhi
acgggcccuggccgca

SEQ ID NO: 1684022 - RNA, 19 nt, Salmonella enterica enterica serovar Typhi
acgucacaauacuuccgcu

SEQ ID NO: 1684023 - RNA, 12 nt, Salmonella enterica enterica serovar Typhi
acgucaccauca

SEQ ID NO: 1684024 - RNA, 12 nt, Salmonella enterica enterica serovar Typhi
acgucagcugga

SEQ ID NO: 1684025 - RNA, 21 nt, Salmonella enterica enterica serovar Typhi
acgucagcgaccauugcguau

SEQ ID NO: 1684026 - RNA, 21 nt, Salmonella enterica enterica serovar Typhi
acgucaguacguaaccgcaaa

SEQ ID NO: 1684027 - RNA, 22 nt, Salmonella enterica enterica serovar Typhi
acgucauuaccaguugaccaaa

SEQ ID NO: 1684028 - RNA, 23 nt, Salmonella enterica enterica serovar Typhi
acgucaugccuuuuuuaccaauu

SEQ ID NO: 1684029 - RNA, 22 nt, Salmonella enterica enterica serovar Typhi
acgucauaucauccagccccgg

SEQ ID NO: 1684030 - RNA, 15 nt, Salmonella enterica enterica serovar Typhi
acgugaccuuucaac

SEQ ID NO: 1684031 - RNA, 21 nt, Salmonella enterica enterica serovar Typhi
acgugaaacugauaguuuaaa

SEQ ID NO: 1684032 - RNA, 18 nt, Salmonella enterica enterica serovar Typhi
acgucauuuuuucaauuu

SEQ ID NO: 1684033 - RNA, 17 nt, Salmonella enterica enterica serovar Typhi
acgugacgcgccagcgg

SEQ ID NO: 1684034 - RNA, 22 nt, Salmonella enterica enterica serovar Typhi
acgugaugaucguguugcagcc

SEQ ID NO: 1684035 - RNA, 14 nt, Salmonella enterica enterica serovar Typhi
acgugcauaaaacg

SEQ ID NO: 1684036 - RNA, 14 nt, Salmonella enterica enterica serovar Typhi
acguucauccuccu

SEQ ID NO: 1684037 - RNA, 14 nt, Salmonella enterica enterica serovar Typhi
acguucaucuuccc

SEQ ID NO: 1684038 - RNA, 16 nt, Salmonella enterica enterica serovar Typhi
acguucagcauaucca

SEQ ID NO: 1684039 - RNA, 16 nt, Salmonella enterica enterica serovar Typhi
acguguuaugcgccug

SEQ ID NO: 1684040 - RNA, 13 nt, Salmonella enterica enterica serovar Typhi
acguuaauacauc

SEQ ID NO: 1684041 - RNA, 18 nt, Salmonella enterica enterica serovar Typhi
acuacugguggaauaaau

SEQ ID NO: 1684042 - RNA, 22 nt, Salmonella enterica enterica serovar Typhi
acuacugguggaauaaauauaa

SEQ ID NO: 1684043 - RNA, 17 nt, Salmonella enterica enterica serovar Typhi
acuacucguaaucuaaa

SEQ ID NO: 1684044 - RNA, 14 nt, Salmonella enterica enterica serovar Typhi
acuacguguacgcu

SEQ ID NO: 1684045 - RNA, 17 nt, Salmonella enterica enterica serovar Typhi
acuacguucaucaggca

SEQ ID NO: 1684046 - RNA, 21 nt, Salmonella enterica enterica serovar Typhi
acuacgguugccuuucgccag

SEQ ID NO: 1684047 - RNA, 11 nt, Salmonella enterica enterica serovar Typhi
acuacagcccu

SEQ ID NO: 1684048 - RNA, 15 nt, Salmonella enterica enterica serovar Typhi
acuacgguaaaccag

SEQ ID NO: 1684049 - RNA, 21 nt, Salmonella enterica enterica serovar Typhi
acuacgguaaaccaggccagc

SEQ ID NO: 1684050 - RNA, 12 nt, Salmonella enterica enterica serovar Typhi
acuacagaaagc

SEQ ID NO: 1684051 - RNA, 14 nt, Salmonella enterica enterica serovar Typhi
acuacagaaagcca

SEQ ID NO: 1684052 - RNA, 20 nt, Salmonella enterica enterica serovar Typhi
acuauaauugcuuuuuucca

SEQ ID NO: 1684053 - RNA, 16 nt, Salmonella enterica enterica serovar Typhi
acuaauccccauuuuu

SEQ ID NO: 1684054 - RNA, 17 nt, Salmonella enterica enterica serovar Typhi
acuaauccccauuuuuu

SEQ ID NO: 1684055 - RNA, 12 nt, Salmonella enterica enterica serovar Typhi
acuaacuggcaa

SEQ ID NO: 1684056 - RNA, 22 nt, Salmonella enterica enterica serovar Typhi
acuaacggcgucauccugcagg

SEQ ID NO: 1684057 - RNA, 19 nt, Salmonella enterica enterica serovar Typhi
acuaacgaggccaccauca

SEQ ID NO: 1684058 - RNA, 18 nt, Salmonella enterica enterica serovar Typhi
acuaagccaguucucaau

SEQ ID NO: 1684059 - RNA, 19 nt, Salmonella enterica enterica serovar Typhi
acuaagguuuugucauggu

SEQ ID NO: 1684060 - RNA, 22 nt, Salmonella enterica enterica serovar Typhi
acuaacugaccauauaugaaau

SEQ ID NO: 1684061 - RNA, 22 nt, Salmonella enterica enterica serovar Typhi
acguugccguaggcgacgccaa

SEQ ID NO: 1684062 - RNA, 19 nt, Salmonella enterica enterica serovar Typhi
acguuccuucaggagaccu

SEQ ID NO: 1684063 - RNA, 19 nt, Salmonella enterica enterica serovar Typhi
acucaugacuucacacugu

SEQ ID NO: 1684064 - RNA, 16 nt, Salmonella enterica enterica serovar Typhi
acucauuaaaaaaaca

SEQ ID NO: 1684065 - RNA, 14 nt, Salmonella enterica enterica serovar Typhi
acucauuaaaaaaa

SEQ ID NO: 1684066 - RNA, 21 nt, Salmonella enterica enterica serovar Typhi
acucaucacagccacacugcu

SEQ ID NO: 1684067 - RNA, 20 nt, Salmonella enterica enterica serovar Typhi
acucaucgguuaacacauau

SEQ ID NO: 1684068 - RNA, 19 nt, Salmonella enterica enterica serovar Typhi
acucaucggccaccacaua

SEQ ID NO: 1684069 - RNA, 13 nt, Salmonella enterica enterica serovar Typhi
acucaucuuuauu

SEQ ID NO: 1684070 - RNA, 17 nt, Salmonella enterica enterica serovar Typhi
acucaucaugauauaau

SEQ ID NO: 1684071 - RNA, 14 nt, Salmonella enterica enterica serovar Typhi
acucauccagacca

SEQ ID NO: 1684072 - RNA, 14 nt, Salmonella enterica enterica serovar Typhi
acuccagcggcagg

SEQ ID NO: 1684073 - RNA, 17 nt, Salmonella enterica enterica serovar Typhi
acuccagcggcaggauc

SEQ ID NO: 1684074 - RNA, 16 nt, Salmonella enterica enterica serovar Typhi
acuccaugcccacaca

SEQ ID NO: 1684075 - RNA, 16 nt, Salmonella enterica enterica serovar Typhi
acuccauuaaauuacu

SEQ ID NO: 1684076 - RNA, 21 nt, Salmonella enterica enterica serovar Typhi
acuccauucccagcucuuuca

SEQ ID NO: 1684077 - RNA, 15 nt, Salmonella enterica enterica serovar Typhi
acuccauugucggca

SEQ ID NO: 1684078 - RNA, 22 nt, Salmonella enterica enterica serovar Typhi
acuccagcagaccggcaaaaau

SEQ ID NO: 1684079 - RNA, 21 nt, Salmonella enterica enterica serovar Typhi
acuccagcccaucagucccca

SEQ ID NO: 1684080 - RNA, 11 nt, Salmonella enterica enterica serovar Typhi
acuccagcaga

SEQ ID NO: 1684081 - RNA, 12 nt, Salmonella enterica enterica serovar Typhi
acuccagcagac

SEQ ID NO: 1684082 - RNA, 17 nt, Salmonella enterica enterica serovar Typhi
acucagcuaaaaacagc

SEQ ID NO: 1684083 - RNA, 16 nt, Salmonella enterica enterica serovar Typhi
acucagcgacguaauc

SEQ ID NO: 1684084 - RNA, 15 nt, Salmonella enterica enterica serovar Typhi
acucagccagauacc

SEQ ID NO: 1684085 - RNA, 13 nt, Salmonella enterica enterica serovar Typhi
acucagccagguc

SEQ ID NO: 1684086 - RNA, 17 nt, Salmonella enterica enterica serovar Typhi
acucaggcgcaucugac

SEQ ID NO: 1684087 - RNA, 12 nt, Salmonella enterica enterica serovar Typhi
acucacgggcgu

SEQ ID NO: 1684088 - RNA, 15 nt, Salmonella enterica enterica serovar Typhi
acucacgguuuuuau

SEQ ID NO: 1684089 - RNA, 15 nt, Salmonella enterica enterica serovar Typhi
acucacguuccccag

SEQ ID NO: 1684090 - RNA, 18 nt, Salmonella enterica enterica serovar Typhi
acucacguuccccagcac

SEQ ID NO: 1684091 - RNA, 19 nt, Salmonella enterica enterica serovar Typhi
acucacguuccccagcacc

SEQ ID NO: 1684092 - RNA, 21 nt, Salmonella enterica enterica serovar Typhi
acucacguuccccagcaccga

SEQ ID NO: 1684093 - RNA, 22 nt, Salmonella enterica enterica serovar Typhi
acucagaaaauuauuuuaaauu

SEQ ID NO: 1684094 - RNA, 11 nt, Salmonella enterica enterica serovar Typhi
acucagcaaua

SEQ ID NO: 1684095 - RNA, 17 nt, Salmonella enterica enterica serovar Typhi
acucaccguuacaaaua

SEQ ID NO: 1684096 - RNA, 24 nt, Salmonella enterica enterica serovar Typhi
acucacauaacaaaaccagcauca

SEQ ID NO: 1684097 - RNA, 22 nt, Salmonella enterica enterica serovar Typhi
acuaugcuaauccgcugauuaa

SEQ ID NO: 1684098 - RNA, 19 nt, Salmonella enterica enterica serovar Typhi
acucgugcagugauucgua

SEQ ID NO: 1684099 - RNA, 19 nt, Salmonella enterica enterica serovar Typhi
acucguucccguuuauguu

SEQ ID NO: 1684100 - RNA, 21 nt, Salmonella enterica enterica serovar Typhi
acucucaccgaccugccuugc

SEQ ID NO: 1684101 - RNA, 20 nt, Salmonella enterica enterica serovar Typhi
acucucaccgaccugccuug

SEQ ID NO: 1684102 - RNA, 21 nt, Salmonella enterica enterica serovar Typhi
acucgggccagcucuuuucug

SEQ ID NO: 1684103 - RNA, 17 nt, Salmonella enterica enterica serovar Typhi
acucgucccgauauaaa

SEQ ID NO: 1684104 - RNA, 15 nt, Salmonella enterica enterica serovar Typhi
acucguagccaaaau

SEQ ID NO: 1684105 - RNA, 21 nt, Salmonella enterica enterica serovar Typhi
acucguaaucuaaaauuauuu

SEQ ID NO: 1684106 - RNA, 17 nt, Salmonella enterica enterica serovar Typhi
acuccccuuuuuuacua

SEQ ID NO: 1684107 - RNA, 12 nt, Salmonella enterica enterica serovar Typhi
acucccaguccg

SEQ ID NO: 1684108 - RNA, 22 nt, Salmonella enterica enterica serovar Typhi
acucccaggcgcgcagcugcca

SEQ ID NO: 1684109 - RNA, 23 nt, Salmonella enterica enterica serovar Typhi
acucccgcacgcuggcaucaaua

SEQ ID NO: 1684110 - RNA, 19 nt, Salmonella enterica enterica serovar Typhi
acucccuggugacgcgcau

SEQ ID NO: 1684111 - RNA, 19 nt, Salmonella enterica enterica serovar Typhi
acucgcacaguacaccugc

SEQ ID NO: 1684112 - RNA, 14 nt, Salmonella enterica enterica serovar Typhi
acuccgcccuaauc

SEQ ID NO: 1684113 - RNA, 22 nt, Salmonella enterica enterica serovar Typhi
acucuucgacacauuucagcgc

SEQ ID NO: 1684114 - RNA, 19 nt, Salmonella enterica enterica serovar Typhi
acucuuccgggcugacaua

SEQ ID NO: 1684115 - RNA, 15 nt, Salmonella enterica enterica serovar Typhi
acucuuccugcugcg

SEQ ID NO: 1684116 - RNA, 19 nt, Salmonella enterica enterica serovar Typhi
acucuuuacccagcgggug

SEQ ID NO: 1684117 - RNA, 20 nt, Salmonella enterica enterica serovar Typhi
acucuuccagcugcucuccu

SEQ ID NO: 1684118 - RNA, 22 nt, Salmonella enterica enterica serovar Typhi
acucuuccagcugcucuccuug

SEQ ID NO: 1684119 - RNA, 21 nt, Salmonella enterica enterica serovar Typhi
acucuuccaccacggcaaaaa

SEQ ID NO: 1684120 - RNA, 23 nt, Salmonella enterica enterica serovar Typhi
acucuuccccgaucagaaaaccu

SEQ ID NO: 1684121 - RNA, 16 nt, Salmonella enterica enterica serovar Typhi
acucuuccgcaaucac

SEQ ID NO: 1684122 - RNA, 14 nt, Salmonella enterica enterica serovar Typhi
acucuccaccaaau

SEQ ID NO: 1684123 - RNA, 13 nt, Salmonella enterica enterica serovar Typhi
acucuucaucgcg

SEQ ID NO: 1684124 - RNA, 15 nt, Salmonella enterica enterica serovar Typhi
acucucccggcgccc

SEQ ID NO: 1684125 - RNA, 17 nt, Salmonella enterica enterica serovar Typhi
acugaauuaucaggguu

SEQ ID NO: 1684126 - RNA, 16 nt, Salmonella enterica enterica serovar Typhi
acugaccagacagccc

SEQ ID NO: 1684127 - RNA, 17 nt, Salmonella enterica enterica serovar Typhi
acugacaauuuccagau

SEQ ID NO: 1684128 - RNA, 15 nt, Salmonella enterica enterica serovar Typhi
acugaccauauauga

SEQ ID NO: 1684129 - RNA, 20 nt, Salmonella enterica enterica serovar Typhi
acugaagauaaacagcagcg

SEQ ID NO: 1684130 - RNA, 16 nt, Salmonella enterica enterica serovar Typhi
acugaagguuuuuccc

SEQ ID NO: 1684131 - RNA, 23 nt, Salmonella enterica enterica serovar Typhi
acugaaugccuuuuacaauaacc

SEQ ID NO: 1684132 - RNA, 16 nt, Salmonella enterica enterica serovar Typhi
acgcccuucaauauca

SEQ ID NO: 1684133 - RNA, 15 nt, Salmonella enterica enterica serovar Typhi
acgccgauuaaugcu

SEQ ID NO: 1684134 - RNA, 18 nt, Salmonella enterica enterica serovar Typhi
acgccgacgaccggcagc

SEQ ID NO: 1684135 - RNA, 13 nt, Salmonella enterica enterica serovar Typhi
acgccgccgccca

SEQ ID NO: 1684136 - RNA, 15 nt, Salmonella enterica enterica serovar Typhi
acgccgccgcccaga

SEQ ID NO: 1684137 - RNA, 23 nt, Salmonella enterica enterica serovar Typhi
acgccgccgcguccuaccgccgc

SEQ ID NO: 1684138 - RNA, 22 nt, Salmonella enterica enterica serovar Typhi
acgccgcuaucgaccagcaccu

SEQ ID NO: 1684139 - RNA, 14 nt, Salmonella enterica enterica serovar Typhi
acgcccagccguga

SEQ ID NO: 1684140 - RNA, 22 nt, Salmonella enterica enterica serovar Typhi
acgcccagcgccgagaaaauca

SEQ ID NO: 1684141 - RNA, 17 nt, Salmonella enterica enterica serovar Typhi
acgcccagcuauuuuuc

SEQ ID NO: 1684142 - RNA, 16 nt, Salmonella enterica enterica serovar Typhi
acgcccccugccagcg

SEQ ID NO: 1684143 - RNA, 20 nt, Salmonella enterica enterica serovar Typhi
acgcccgaccacgcccagcu

SEQ ID NO: 1684144 - RNA, 18 nt, Salmonella enterica enterica serovar Typhi
acgccccaauaccacaac

SEQ ID NO: 1684145 - RNA, 16 nt, Salmonella enterica enterica serovar Typhi
acgcccauuaugccgc

SEQ ID NO: 1684146 - RNA, 17 nt, Salmonella enterica enterica serovar Typhi
acgcccaugcaaccagu

SEQ ID NO: 1684147 - RNA, 17 nt, Salmonella enterica enterica serovar Typhi
acgcccaucagcauccc

SEQ ID NO: 1684148 - RNA, 21 nt, Salmonella enterica enterica serovar Typhi
acgcccaucagcaucccaccg

SEQ ID NO: 1684149 - RNA, 23 nt, Salmonella enterica enterica serovar Typhi
acgcccaucagcaucccaccgga

SEQ ID NO: 1684150 - RNA, 22 nt, Salmonella enterica enterica serovar Typhi
acgcccggcggguauggcaaug

SEQ ID NO: 1684151 - RNA, 17 nt, Salmonella enterica enterica serovar Typhi
acgcccgccgccagcau

SEQ ID NO: 1684152 - RNA, 15 nt, Salmonella enterica enterica serovar Typhi
acgcccgcauucaua

SEQ ID NO: 1684153 - RNA, 13 nt, Salmonella enterica enterica serovar Typhi
acgcccgcccgcc

SEQ ID NO: 1684154 - RNA, 14 nt, Salmonella enterica enterica serovar Typhi
acgcccucaauauc

SEQ ID NO: 1684155 - RNA, 16 nt, Salmonella enterica enterica serovar Typhi
acgcccugcaaagcaa

SEQ ID NO: 1684156 - RNA, 18 nt, Salmonella enterica enterica serovar Typhi
acgcccugcucccacagc

SEQ ID NO: 1684157 - RNA, 17 nt, Salmonella enterica enterica serovar Typhi
acgccguacuccagccc

SEQ ID NO: 1684158 - RNA, 16 nt, Salmonella enterica enterica serovar Typhi
acgccgucacaaagcc

SEQ ID NO: 1684159 - RNA, 21 nt, Salmonella enterica enterica serovar Typhi
acgccgucacaaagcccaccg

SEQ ID NO: 1684160 - RNA, 22 nt, Salmonella enterica enterica serovar Typhi
acgccguccggcgaacaaacuc

SEQ ID NO: 1684161 - RNA, 20 nt, Salmonella enterica enterica serovar Typhi
acgccucauccggccuggcg

SEQ ID NO: 1684162 - RNA, 16 nt, Salmonella enterica enterica serovar Typhi
acgccguuaccagcau

SEQ ID NO: 1684163 - RNA, 13 nt, Salmonella enterica enterica serovar Typhi
acgccuaaaugaa

SEQ ID NO: 1684164 - RNA, 16 nt, Salmonella enterica enterica serovar Typhi
acgccuaaaaaugagg

SEQ ID NO: 1684165 - RNA, 15 nt, Salmonella enterica enterica serovar Typhi
acgccgguaucauca

SEQ ID NO: 1684166 - RNA, 15 nt, Salmonella enterica enterica serovar Typhi
acgccggugccugcc

SEQ ID NO: 1684167 - RNA, 16 nt, Salmonella enterica enterica serovar Typhi
acgccggugccugccg

SEQ ID NO: 1684168 - RNA, 20 nt, Salmonella enterica enterica serovar Typhi
acgccggugccugccgccuc

SEQ ID NO: 1684169 - RNA, 21 nt, Salmonella enterica enterica serovar Typhi
acgccggggauaucaaugcgc

SEQ ID NO: 1684170 - RNA, 16 nt, Salmonella enterica enterica serovar Typhi
acgccgcuguuuucac

SEQ ID NO: 1684171 - RNA, 18 nt, Salmonella enterica enterica serovar Typhi
acgccgcuguuuucacuc

SEQ ID NO: 1684172 - RNA, 23 nt, Salmonella enterica enterica serovar Typhi
acgccggauauguuugacaagca

SEQ ID NO: 1684173 - RNA, 19 nt, Salmonella enterica enterica serovar Typhi
acgccggcaacacccgccg

SEQ ID NO: 1684174 - RNA, 21 nt, Salmonella enterica enterica serovar Typhi
acgccugaauuucgucaggaa

SEQ ID NO: 1684175 - RNA, 16 nt, Salmonella enterica enterica serovar Typhi
acgccugcauaaagga

SEQ ID NO: 1684176 - RNA, 15 nt, Salmonella enterica enterica serovar Typhi
acgccuccaggcuac

SEQ ID NO: 1684177 - RNA, 22 nt, Salmonella enterica enterica serovar Typhi
acgccugccagauaguuagcua

SEQ ID NO: 1684178 - RNA, 19 nt, Salmonella enterica enterica serovar Typhi
acgccuggugggauaggcu

SEQ ID NO: 1684179 - RNA, 12 nt, Salmonella enterica enterica serovar Typhi
acgccuggagug

SEQ ID NO: 1684180 - RNA, 15 nt, Salmonella enterica enterica serovar Typhi
acgccugcuucacgu

SEQ ID NO: 1684181 - RNA, 22 nt, Salmonella enterica enterica serovar Typhi
acgccuggcgcauuuuaaugau

SEQ ID NO: 1684182 - RNA, 20 nt, Salmonella enterica enterica serovar Typhi
acgccugggauagugcugcg

SEQ ID NO: 1684183 - RNA, 23 nt, Salmonella enterica enterica serovar Typhi
acgcgaagauuaacccggucauc

SEQ ID NO: 1684184 - RNA, 15 nt, Salmonella enterica enterica serovar Typhi
acgccuuugcccggu

SEQ ID NO: 1684185 - RNA, 19 nt, Salmonella enterica enterica serovar Typhi
acgccuuacccgaccuaca

SEQ ID NO: 1684186 - RNA, 19 nt, Salmonella enterica enterica serovar Typhi
acgccuuauccgaccuaca

SEQ ID NO: 1684187 - RNA, 18 nt, Salmonella enterica enterica serovar Typhi
acgccuuccuccagcauc

SEQ ID NO: 1684188 - RNA, 16 nt, Salmonella enterica enterica serovar Typhi
accggaggagugcgcc

SEQ ID NO: 1684189 - RNA, 19 nt, Salmonella enterica enterica serovar Typhi
accggaucgaucccggcaa

SEQ ID NO: 1684190 - RNA, 18 nt, Salmonella enterica enterica serovar Typhi
accggaucaauaaacagc

SEQ ID NO: 1684191 - RNA, 15 nt, Salmonella enterica enterica serovar Typhi
accggauauggcaaa

SEQ ID NO: 1684192 - RNA, 16 nt, Salmonella enterica enterica serovar Typhi
acgcacaguacgcccg

SEQ ID NO: 1684193 - RNA, 21 nt, Salmonella enterica enterica serovar Typhi
accggaugggcagauagaaug

SEQ ID NO: 1684194 - RNA, 23 nt, Salmonella enterica enterica serovar Typhi
accggaugggcagauagaaugcu

SEQ ID NO: 1684195 - RNA, 13 nt, Salmonella enterica enterica serovar Typhi
acgcaccagccag

SEQ ID NO: 1684196 - RNA, 13 nt, Salmonella enterica enterica serovar Typhi
acgcacuaccaga

SEQ ID NO: 1684197 - RNA, 18 nt, Salmonella enterica enterica serovar Typhi
acgcagcaucucaauauc

SEQ ID NO: 1684198 - RNA, 12 nt, Salmonella enterica enterica serovar Typhi
acgcagccaugu

SEQ ID NO: 1684199 - RNA, 14 nt, Salmonella enterica enterica serovar Typhi
acgcagcaucgcca

SEQ ID NO: 1684200 - RNA, 18 nt, Salmonella enterica enterica serovar Typhi
acgcagacuauagguggc

SEQ ID NO: 1684201 - RNA, 12 nt, Salmonella enterica enterica serovar Typhi
acgcagcaagaa

SEQ ID NO: 1684202 - RNA, 14 nt, Salmonella enterica enterica serovar Typhi
acgcagcaagaaca

SEQ ID NO: 1684203 - RNA, 14 nt, Salmonella enterica enterica serovar Typhi
acgcagcauuucgu

SEQ ID NO: 1684204 - RNA, 17 nt, Salmonella enterica enterica serovar Typhi
acgcagccgaggcuuaa

SEQ ID NO: 1684205 - RNA, 17 nt, Salmonella enterica enterica serovar Typhi
acgcagcgcauccacca

SEQ ID NO: 1684206 - RNA, 13 nt, Salmonella enterica enterica serovar Typhi
acgcagcuuaaag

SEQ ID NO: 1684207 - RNA, 20 nt, Salmonella enterica enterica serovar Typhi
acgcagcucauacccuucca

SEQ ID NO: 1684208 - RNA, 14 nt, Salmonella enterica enterica serovar Typhi
acgcagcuccagcu

SEQ ID NO: 1684209 - RNA, 16 nt, Salmonella enterica enterica serovar Typhi
acgcaggcuugcccau

SEQ ID NO: 1684210 - RNA, 22 nt, Salmonella enterica enterica serovar Typhi
acgcaggcuaacgcgccccagg

SEQ ID NO: 1684211 - RNA, 17 nt, Salmonella enterica enterica serovar Typhi
acgcaggcgaaaucaaa

SEQ ID NO: 1684212 - RNA, 17 nt, Salmonella enterica enterica serovar Typhi
acgcaguggcaauuuaa

SEQ ID NO: 1684213 - RNA, 17 nt, Salmonella enterica enterica serovar Typhi
acgcauauccagcagau

SEQ ID NO: 1684214 - RNA, 19 nt, Salmonella enterica enterica serovar Typhi
acgcaucaaauaccuuuuc

SEQ ID NO: 1684215 - RNA, 16 nt, Salmonella enterica enterica serovar Typhi
acgcaucaaagccacc

SEQ ID NO: 1684216 - RNA, 20 nt, Salmonella enterica enterica serovar Typhi
acgcaucaaagccacccacg

SEQ ID NO: 1684217 - RNA, 16 nt, Salmonella enterica enterica serovar Typhi
acgcauccugcacuuu

SEQ ID NO: 1684218 - RNA, 23 nt, Salmonella enterica enterica serovar Typhi
acgcaucgcugcgcuuacacacc

SEQ ID NO: 1684219 - RNA, 22 nt, Salmonella enterica enterica serovar Typhi
acgcaucauauucgcagcucug

SEQ ID NO: 1684220 - RNA, 20 nt, Salmonella enterica enterica serovar Typhi
acgcauaucccacugcacgc

SEQ ID NO: 1684221 - RNA, 18 nt, Salmonella enterica enterica serovar Typhi
acgcaugacccaggcauc

SEQ ID NO: 1684222 - RNA, 18 nt, Salmonella enterica enterica serovar Typhi
acgcaucugggcugagaa

SEQ ID NO: 1684223 - RNA, 15 nt, Salmonella enterica enterica serovar Typhi
acgcaugguuagcca

SEQ ID NO: 1684224 - RNA, 22 nt, Salmonella enterica enterica serovar Typhi
acgcauugccauguuaauacca

SEQ ID NO: 1684225 - RNA, 18 nt, Salmonella enterica enterica serovar Typhi
acgcauuucaagcaggcg

SEQ ID NO: 1684226 - RNA, 15 nt, Salmonella enterica enterica serovar Typhi
acgccaaaaagugaa

SEQ ID NO: 1684227 - RNA, 23 nt, Salmonella enterica enterica serovar Typhi
acgccaagcagcggcguaucuuc

SEQ ID NO: 1684228 - RNA, 14 nt, Salmonella enterica enterica serovar Typhi
acgccacaaacugc

SEQ ID NO: 1684229 - RNA, 16 nt, Salmonella enterica enterica serovar Typhi
acgccaccacagucau

SEQ ID NO: 1684230 - RNA, 15 nt, Salmonella enterica enterica serovar Typhi
acgccacaguugguu

SEQ ID NO: 1684231 - RNA, 16 nt, Salmonella enterica enterica serovar Typhi
acgccagccacugacu

SEQ ID NO: 1684232 - RNA, 12 nt, Salmonella enterica enterica serovar Typhi
acgccagccagc

SEQ ID NO: 1684233 - RNA, 18 nt, Salmonella enterica enterica serovar Typhi
acgccagccauuaaagaa

SEQ ID NO: 1684234 - RNA, 17 nt, Salmonella enterica enterica serovar Typhi
acgccagauuaucggcc

SEQ ID NO: 1684235 - RNA, 17 nt, Salmonella enterica enterica serovar Typhi
acgccagcgggugaucg

SEQ ID NO: 1684236 - RNA, 18 nt, Salmonella enterica enterica serovar Typhi
acgccaccgccaccugcc

SEQ ID NO: 1684237 - RNA, 22 nt, Salmonella enterica enterica serovar Typhi
acgccaccgccgccaccaaaaa

SEQ ID NO: 1684238 - RNA, 23 nt, Salmonella enterica enterica serovar Typhi
acgccaccggguuaaagcccuga

SEQ ID NO: 1684239 - RNA, 18 nt, Salmonella enterica enterica serovar Typhi
acgccagaccgacgccaa

SEQ ID NO: 1684240 - RNA, 16 nt, Salmonella enterica enterica serovar Typhi
acgccaucuuucuuuu

SEQ ID NO: 1684241 - RNA, 18 nt, Salmonella enterica enterica serovar Typhi
acgccaucuuucuuuucg

SEQ ID NO: 1684242 - RNA, 21 nt, Salmonella enterica enterica serovar Typhi
acgccaugacgccaagcugca

SEQ ID NO: 1684243 - RNA, 14 nt, Salmonella enterica enterica serovar Typhi
acgccaucuuccuc

SEQ ID NO: 1684244 - RNA, 15 nt, Salmonella enterica enterica serovar Typhi
acgccaugcaaaaaa

SEQ ID NO: 1684245 - RNA, 23 nt, Salmonella enterica enterica serovar Typhi
acgccaugcucauccaacugcgc

SEQ ID NO: 1684246 - RNA, 21 nt, Salmonella enterica enterica serovar Typhi
acgccaguucccacagcuuca

SEQ ID NO: 1684247 - RNA, 18 nt, Salmonella enterica enterica serovar Typhi
acgccagucuuugcagga

SEQ ID NO: 1684248 - RNA, 22 nt, Salmonella enterica enterica serovar Typhi
acgcuaccgucgccgacaacgc

SEQ ID NO: 1684249 - RNA, 17 nt, Salmonella enterica enterica serovar Typhi
acgcucaaccgguuugu

SEQ ID NO: 1684250 - RNA, 21 nt, Salmonella enterica enterica serovar Typhi
acgcuauguuugcugagaauu

SEQ ID NO: 1684251 - RNA, 13 nt, Salmonella enterica enterica serovar Typhi
acgcuauuuuuca

SEQ ID NO: 1684252 - RNA, 17 nt, Salmonella enterica enterica serovar Typhi
acgcgucugaaugacgc

SEQ ID NO: 1684253 - RNA, 18 nt, Salmonella enterica enterica serovar Typhi
acgcggugacuuuggccg

SEQ ID NO: 1684254 - RNA, 21 nt, Salmonella enterica enterica serovar Typhi
acgcgucaaauagagaaaaua

SEQ ID NO: 1684255 - RNA, 19 nt, Salmonella enterica enterica serovar Typhi
acgcgucagggcgauaaua

SEQ ID NO: 1684256 - RNA, 22 nt, Salmonella enterica enterica serovar Typhi
acgcgucagugaauauccccug

SEQ ID NO: 1684257 - RNA, 15 nt, Salmonella enterica enterica serovar Typhi
acgcguucugaauaa

SEQ ID NO: 1684258 - RNA, 21 nt, Salmonella enterica enterica serovar Typhi
acgcguuuuccagcaccaguu

SEQ ID NO: 1684259 - RNA, 18 nt, Salmonella enterica enterica serovar Typhi
acgcgugaacauggguuu

SEQ ID NO: 1684260 - RNA, 18 nt, Salmonella enterica enterica serovar Typhi
acgcuccagcuggcuggc

SEQ ID NO: 1684261 - RNA, 12 nt, Salmonella enterica enterica serovar Typhi
acgcuccagcag

SEQ ID NO: 1684262 - RNA, 22 nt, Salmonella enterica enterica serovar Typhi
acgcuccgguuuuugcgcgcug

SEQ ID NO: 1684263 - RNA, 15 nt, Salmonella enterica enterica serovar Typhi
acgcuccugcuccug

SEQ ID NO: 1684264 - RNA, 14 nt, Salmonella enterica enterica serovar Typhi
acgcucgcugaugg

SEQ ID NO: 1684265 - RNA, 11 nt, Salmonella enterica enterica serovar Typhi
acgcuccugga

SEQ ID NO: 1684266 - RNA, 13 nt, Salmonella enterica enterica serovar Typhi
acgcugaagcuug

SEQ ID NO: 1684267 - RNA, 23 nt, Salmonella enterica enterica serovar Typhi
acgcugaauaucgucaguaugca

SEQ ID NO: 1684268 - RNA, 15 nt, Salmonella enterica enterica serovar Typhi
acgcggucaggguga

SEQ ID NO: 1684269 - RNA, 21 nt, Salmonella enterica enterica serovar Typhi
acgcgggguaaaauggacuuc

SEQ ID NO: 1684270 - RNA, 17 nt, Salmonella enterica enterica serovar Typhi
acgcggcaucaggcaua

SEQ ID NO: 1684271 - RNA, 18 nt, Salmonella enterica enterica serovar Typhi
acgcggcaucaagcauaa

SEQ ID NO: 1684272 - RNA, 12 nt, Salmonella enterica enterica serovar Typhi
acgcggcgcgcu

SEQ ID NO: 1684273 - RNA, 23 nt, Salmonella enterica enterica serovar Typhi
acgcggccuggaagcgcccaggc

SEQ ID NO: 1684274 - RNA, 12 nt, Salmonella enterica enterica serovar Typhi
acgcggaaguau

SEQ ID NO: 1684275 - RNA, 14 nt, Salmonella enterica enterica serovar Typhi
acgcggaucggcac

SEQ ID NO: 1684276 - RNA, 19 nt, Salmonella enterica enterica serovar Typhi
acgcggaacuggugaaaca

SEQ ID NO: 1684277 - RNA, 20 nt, Salmonella enterica enterica serovar Typhi
acgcgcuuuuucuuccguca

SEQ ID NO: 1684278 - RNA, 14 nt, Salmonella enterica enterica serovar Typhi
acgcgcgcgaaaag

SEQ ID NO: 1684279 - RNA, 20 nt, Salmonella enterica enterica serovar Typhi
acgcgcgccugccgccagca

SEQ ID NO: 1684280 - RNA, 16 nt, Salmonella enterica enterica serovar Typhi
acgcgcggcuacugcc

SEQ ID NO: 1684281 - RNA, 13 nt, Salmonella enterica enterica serovar Typhi
acgcgcguucguu

SEQ ID NO: 1684282 - RNA, 14 nt, Salmonella enterica enterica serovar Typhi
acgcgcuaaaugca

SEQ ID NO: 1684283 - RNA, 15 nt, Salmonella enterica enterica serovar Typhi
acgcgcaucuucacu

SEQ ID NO: 1684284 - RNA, 15 nt, Salmonella enterica enterica serovar Typhi
acgcgccagcaaaau

SEQ ID NO: 1684285 - RNA, 18 nt, Salmonella enterica enterica serovar Typhi
acgcgccgccagcgacuu

SEQ ID NO: 1684286 - RNA, 21 nt, Salmonella enterica enterica serovar Typhi
acgcgccaucgucaccggauc

SEQ ID NO: 1684287 - RNA, 22 nt, Salmonella enterica enterica serovar Typhi
acgcgccgagguuuucauccac

SEQ ID NO: 1684288 - RNA, 14 nt, Salmonella enterica enterica serovar Typhi
acgcgauagauacc

SEQ ID NO: 1684289 - RNA, 20 nt, Salmonella enterica enterica serovar Typhi
acgcgauaaaaacccaccag

SEQ ID NO: 1684290 - RNA, 21 nt, Salmonella enterica enterica serovar Typhi
acgcgauaaaaaacgcccaga

SEQ ID NO: 1684291 - RNA, 21 nt, Salmonella enterica enterica serovar Typhi
acgcgagaagaagaauuauua

SEQ ID NO: 1684292 - RNA, 21 nt, Salmonella enterica enterica serovar Typhi
acgcgcaaaacucucaccgac

SEQ ID NO: 1684293 - RNA, 17 nt, Salmonella enterica enterica serovar Typhi
acgcgauauguuugcgc

SEQ ID NO: 1684294 - RNA, 15 nt, Salmonella enterica enterica serovar Typhi
acgcgaugccaguag

SEQ ID NO: 1684295 - RNA, 22 nt, Salmonella enterica enterica serovar Typhi
acgcugaugcugugcagacugc

SEQ ID NO: 1684296 - RNA, 14 nt, Salmonella enterica enterica serovar Typhi
acgcuuauccugcc

SEQ ID NO: 1684297 - RNA, 22 nt, Salmonella enterica enterica serovar Typhi
acgcuuaucgccaaaccagacc

SEQ ID NO: 1684298 - RNA, 20 nt, Salmonella enterica enterica serovar Typhi
acgcugauacguaacaugac

SEQ ID NO: 1684299 - RNA, 18 nt, Salmonella enterica enterica serovar Typhi
acgcugagagaacugcga

SEQ ID NO: 1684300 - RNA, 17 nt, Salmonella enterica enterica serovar Typhi
acgcugcaaaguuauua

SEQ ID NO: 1684301 - RNA, 21 nt, Salmonella enterica enterica serovar Typhi
acgcugcaaaguuauuacauu

SEQ ID NO: 1684302 - RNA, 15 nt, Salmonella enterica enterica serovar Typhi
acgcugaugaaaacc

SEQ ID NO: 1684303 - RNA, 19 nt, Salmonella enterica enterica serovar Typhi
acgcuuguuguaaagaaau

SEQ ID NO: 1684304 - RNA, 21 nt, Salmonella enterica enterica serovar Typhi
acgcuugcaugaccauccacg

SEQ ID NO: 1684305 - RNA, 14 nt, Salmonella enterica enterica serovar Typhi
acgcuucugcgccg

SEQ ID NO: 1684306 - RNA, 16 nt, Salmonella enterica enterica serovar Typhi
acgcuucagagcaggu

SEQ ID NO: 1684307 - RNA, 20 nt, Salmonella enterica enterica serovar Typhi
acggaguuggaaccaaacac

SEQ ID NO: 1684308 - RNA, 16 nt, Salmonella enterica enterica serovar Typhi
acggaggugccagaga

SEQ ID NO: 1684309 - RNA, 21 nt, Salmonella enterica enterica serovar Typhi
acgcuuuccaguugcggcauc

SEQ ID NO: 1684310 - RNA, 23 nt, Salmonella enterica enterica serovar Typhi
acgcuuuauucugucgccaccac

SEQ ID NO: 1684311 - RNA, 17 nt, Salmonella enterica enterica serovar Typhi
acgcuuuguacagacaa

SEQ ID NO: 1684312 - RNA, 19 nt, Salmonella enterica enterica serovar Typhi
acgcuuucuucccuccccu

SEQ ID NO: 1684313 - RNA, 19 nt, Salmonella enterica enterica serovar Typhi
acggcuaauaugccaggcu

SEQ ID NO: 1684314 - RNA, 19 nt, Salmonella enterica enterica serovar Typhi
acggcugcacaaaauacug

SEQ ID NO: 1684315 - RNA, 21 nt, Salmonella enterica enterica serovar Typhi
acggcgugccaguuuuaaaua

SEQ ID NO: 1684316 - RNA, 14 nt, Salmonella enterica enterica serovar Typhi
acggcuuuucuuca

SEQ ID NO: 1684317 - RNA, 22 nt, Salmonella enterica enterica serovar Typhi
acggcuuuaauaccccuguuca

SEQ ID NO: 1684318 - RNA, 22 nt, Salmonella enterica enterica serovar Typhi
acggcugccuuuguacagcuug

SEQ ID NO: 1684319 - RNA, 18 nt, Salmonella enterica enterica serovar Typhi
acggcuggcaaugcgcug

SEQ ID NO: 1684320 - RNA, 14 nt, Salmonella enterica enterica serovar Typhi
acggcgucagccac

SEQ ID NO: 1684321 - RNA, 18 nt, Salmonella enterica enterica serovar Typhi
acggcguaccagaaugcc

SEQ ID NO: 1684322 - RNA, 20 nt, Salmonella enterica enterica serovar Typhi
acggcgcgccaauaaagcuu

SEQ ID NO: 1684323 - RNA, 22 nt, Salmonella enterica enterica serovar Typhi
acggcgcgacuuuaaucaccug

SEQ ID NO: 1684324 - RNA, 13 nt, Salmonella enterica enterica serovar Typhi
acggcaucaggaa

SEQ ID NO: 1684325 - RNA, 16 nt, Salmonella enterica enterica serovar Typhi
acggcaucaagcccau

SEQ ID NO: 1684326 - RNA, 18 nt, Salmonella enterica enterica serovar Typhi
acggcaucugcggcauga

SEQ ID NO: 1684327 - RNA, 20 nt, Salmonella enterica enterica serovar Typhi
acggcaggcccgauaaacgg

SEQ ID NO: 1684328 - RNA, 18 nt, Salmonella enterica enterica serovar Typhi
acggcaguguuucccaac

SEQ ID NO: 1684329 - RNA, 20 nt, Salmonella enterica enterica serovar Typhi
agaauagccggauaaaauua

SEQ ID NO: 1684330 - RNA, 17 nt, Salmonella enterica enterica serovar Typhi
agaauagcgucaauaau

SEQ ID NO: 1684331 - RNA, 19 nt, Salmonella enterica enterica serovar Typhi
agaauaucggcgucaacgu

SEQ ID NO: 1684332 - RNA, 16 nt, Salmonella enterica enterica serovar Typhi
agaauauaggagagcg

SEQ ID NO: 1684333 - RNA, 21 nt, Salmonella enterica enterica serovar Typhi
agaauaaaaagugcgcacuca

SEQ ID NO: 1684334 - RNA, 23 nt, Salmonella enterica enterica serovar Typhi
agaauaaaaagugcgcacucaga

SEQ ID NO: 1684335 - RNA, 14 nt, Salmonella enterica enterica serovar Typhi
agaauaaaacagcu

SEQ ID NO: 1684336 - RNA, 21 nt, Salmonella enterica enterica serovar Typhi
agaauaacgaugaugaaaaag

SEQ ID NO: 1684337 - RNA, 23 nt, Salmonella enterica enterica serovar Typhi
agaaugccgcccauccagagcag

SEQ ID NO: 1684338 - RNA, 13 nt, Salmonella enterica enterica serovar Typhi
agaaugcccugcu

SEQ ID NO: 1684339 - RNA, 18 nt, Salmonella enterica enterica serovar Typhi
agaauguguucucccugc

SEQ ID NO: 1684340 - RNA, 17 nt, Salmonella enterica enterica serovar Typhi
agaauguguucucccug

SEQ ID NO: 1684341 - RNA, 22 nt, Salmonella enterica enterica serovar Typhi
agaaucauuaauacacugcgua

SEQ ID NO: 1684342 - RNA, 13 nt, Salmonella enterica enterica serovar Typhi
agaaucaccucuu

SEQ ID NO: 1684343 - RNA, 14 nt, Salmonella enterica enterica serovar Typhi
agaauaugcagugc

SEQ ID NO: 1684344 - RNA, 12 nt, Salmonella enterica enterica serovar Typhi
agaauaugccag

SEQ ID NO: 1684345 - RNA, 20 nt, Salmonella enterica enterica serovar Typhi
agaaucaguaacacaaucag

SEQ ID NO: 1684346 - RNA, 21 nt, Salmonella enterica enterica serovar Typhi
agaaauuauuuuaaauuuccu

SEQ ID NO: 1684347 - RNA, 13 nt, Salmonella enterica enterica serovar Typhi
agaagccaucaaa

SEQ ID NO: 1684348 - RNA, 14 nt, Salmonella enterica enterica serovar Typhi
agaagucugugaga

SEQ ID NO: 1684349 - RNA, 16 nt, Salmonella enterica enterica serovar Typhi
agaagugccaguaacu

SEQ ID NO: 1684350 - RNA, 20 nt, Salmonella enterica enterica serovar Typhi
agaagggcaggggaaagcug

SEQ ID NO: 1684351 - RNA, 14 nt, Salmonella enterica enterica serovar Typhi
agacaaaagcuggu

SEQ ID NO: 1684352 - RNA, 16 nt, Salmonella enterica enterica serovar Typhi
agacaaaagcugguga

SEQ ID NO: 1684353 - RNA, 18 nt, Salmonella enterica enterica serovar Typhi
agacaaaagcuggugaaa

SEQ ID NO: 1684354 - RNA, 15 nt, Salmonella enterica enterica serovar Typhi
agacaaaauucagac

SEQ ID NO: 1684355 - RNA, 18 nt, Salmonella enterica enterica serovar Typhi
agacaaaauucagacuca

SEQ ID NO: 1684356 - RNA, 15 nt, Salmonella enterica enterica serovar Typhi
agacaaaguugacuu

SEQ ID NO: 1684357 - RNA, 11 nt, Salmonella enterica enterica serovar Typhi
agacaaauaac

SEQ ID NO: 1684358 - RNA, 16 nt, Salmonella enterica enterica serovar Typhi
agaauuugaacucuuu

SEQ ID NO: 1684359 - RNA, 18 nt, Salmonella enterica enterica serovar Typhi
agaauuuguuuaugccgg

SEQ ID NO: 1684360 - RNA, 16 nt, Salmonella enterica enterica serovar Typhi
agacagauuuggucag

SEQ ID NO: 1684361 - RNA, 14 nt, Salmonella enterica enterica serovar Typhi
agacaccccagccu

SEQ ID NO: 1684362 - RNA, 21 nt, Salmonella enterica enterica serovar Typhi
agacaaugcugacacugauau

SEQ ID NO: 1684363 - RNA, 22 nt, Salmonella enterica enterica serovar Typhi
agacaauugcugcguaacugcc

SEQ ID NO: 1684364 - RNA, 21 nt, Salmonella enterica enterica serovar Typhi
agacaucggagauuucauccu

SEQ ID NO: 1684365 - RNA, 21 nt, Salmonella enterica enterica serovar Typhi
agacauccccgccgagaaaau

SEQ ID NO: 1684366 - RNA, 22 nt, Salmonella enterica enterica serovar Typhi
agacaguguucccugcgcugga

SEQ ID NO: 1684367 - RNA, 15 nt, Salmonella enterica enterica serovar Typhi
agacaguacggauga

SEQ ID NO: 1684368 - RNA, 14 nt, Salmonella enterica enterica serovar Typhi
agacaggacgccag

SEQ ID NO: 1684369 - RNA, 17 nt, Salmonella enterica enterica serovar Typhi
agacaggccagaauuca

SEQ ID NO: 1684370 - RNA, 22 nt, Salmonella enterica enterica serovar Typhi
agacaggugaacauuacaaugu

SEQ ID NO: 1684371 - RNA, 19 nt, Salmonella enterica enterica serovar Typhi
agacagcccuauaacagcg

SEQ ID NO: 1684372 - RNA, 16 nt, Salmonella enterica enterica serovar Typhi
agacagcauuuuucac

SEQ ID NO: 1684373 - RNA, 13 nt, Salmonella enterica enterica serovar Typhi
agaccgauaaaua

SEQ ID NO: 1684374 - RNA, 14 nt, Salmonella enterica enterica serovar Typhi
agaccgacgccaac

SEQ ID NO: 1684375 - RNA, 23 nt, Salmonella enterica enterica serovar Typhi
agaccgccgcuuucaaaaccgac

SEQ ID NO: 1684376 - RNA, 16 nt, Salmonella enterica enterica serovar Typhi
agaccgccuaacagcg

SEQ ID NO: 1684377 - RNA, 18 nt, Salmonella enterica enterica serovar Typhi
agaccgccuaacagcgcc

SEQ ID NO: 1684378 - RNA, 20 nt, Salmonella enterica enterica serovar Typhi
agaccgcugcggaacaccag

SEQ ID NO: 1684379 - RNA, 15 nt, Salmonella enterica enterica serovar Typhi
agaccggcagccugc

SEQ ID NO: 1684380 - RNA, 17 nt, Salmonella enterica enterica serovar Typhi
agaccggcaucucaucu

SEQ ID NO: 1684381 - RNA, 16 nt, Salmonella enterica enterica serovar Typhi
agaccggcgaaaucgu

SEQ ID NO: 1684382 - RNA, 17 nt, Salmonella enterica enterica serovar Typhi
agaccuguaaaaaaacc

SEQ ID NO: 1684383 - RNA, 23 nt, Salmonella enterica enterica serovar Typhi
agaccuuaucgcagucagccuug

SEQ ID NO: 1684384 - RNA, 14 nt, Salmonella enterica enterica serovar Typhi
agaccuucaaccca

SEQ ID NO: 1684385 - RNA, 18 nt, Salmonella enterica enterica serovar Typhi
agaccuuuuacuucacgu

SEQ ID NO: 1684386 - RNA, 16 nt, Salmonella enterica enterica serovar Typhi
agacgacaucuuuucc

SEQ ID NO: 1684387 - RNA, 22 nt, Salmonella enterica enterica serovar Typhi
agacgccaacgucgacagacgc

SEQ ID NO: 1684388 - RNA, 20 nt, Salmonella enterica enterica serovar Typhi
agacgcaucuuuuucccggu

SEQ ID NO: 1684389 - RNA, 21 nt, Salmonella enterica enterica serovar Typhi
agacccgcaauaacgccgaua

SEQ ID NO: 1684390 - RNA, 12 nt, Salmonella enterica enterica serovar Typhi
agaccaauaaaa

SEQ ID NO: 1684391 - RNA, 19 nt, Salmonella enterica enterica serovar Typhi
agaccaauacgaucggcug

SEQ ID NO: 1684392 - RNA, 23 nt, Salmonella enterica enterica serovar Typhi
agaccaauaagucccaucgagcc

SEQ ID NO: 1684393 - RNA, 15 nt, Salmonella enterica enterica serovar Typhi
agaccccgcaucgcc

SEQ ID NO: 1684394 - RNA, 15 nt, Salmonella enterica enterica serovar Typhi
agacauucgcgcacg

SEQ ID NO: 1684395 - RNA, 19 nt, Salmonella enterica enterica serovar Typhi
agacauugguuucaugcau

SEQ ID NO: 1684396 - RNA, 19 nt, Salmonella enterica enterica serovar Typhi
agacaugccgccagaccaa

SEQ ID NO: 1684397 - RNA, 16 nt, Salmonella enterica enterica serovar Typhi
agacaugaucuuaccu

SEQ ID NO: 1684398 - RNA, 15 nt, Salmonella enterica enterica serovar Typhi
agacaugaucuuacc

SEQ ID NO: 1684399 - RNA, 20 nt, Salmonella enterica enterica serovar Typhi
agacgccgaaccuggcgggc

SEQ ID NO: 1684400 - RNA, 18 nt, Salmonella enterica enterica serovar Typhi
agacgccgcgcugcggcg

SEQ ID NO: 1684401 - RNA, 17 nt, Salmonella enterica enterica serovar Typhi
agacgccugggcauuug

SEQ ID NO: 1684402 - RNA, 22 nt, Salmonella enterica enterica serovar Typhi
agacgcugacauccaucaucua

SEQ ID NO: 1684403 - RNA, 21 nt, Salmonella enterica enterica serovar Typhi
agacgcuucauaucgcccagc

SEQ ID NO: 1684404 - RNA, 18 nt, Salmonella enterica enterica serovar Typhi
agacucaccccuucuuua

SEQ ID NO: 1684405 - RNA, 18 nt, Salmonella enterica enterica serovar Typhi
agacgcuggcacuggcag

SEQ ID NO: 1684406 - RNA, 19 nt, Salmonella enterica enterica serovar Typhi
agacgcuuacaucgccauc

SEQ ID NO: 1684407 - RNA, 13 nt, Salmonella enterica enterica serovar Typhi
agacucagcagcg

SEQ ID NO: 1684408 - RNA, 18 nt, Salmonella enterica enterica serovar Typhi
agacucaucgccgcaaug

SEQ ID NO: 1684409 - RNA, 17 nt, Salmonella enterica enterica serovar Typhi
agacugcacuuccugcg

SEQ ID NO: 1684410 - RNA, 21 nt, Salmonella enterica enterica serovar Typhi
agacugcacuuccugcgucag

SEQ ID NO: 1684411 - RNA, 13 nt, Salmonella enterica enterica serovar Typhi
agacugcccggca

SEQ ID NO: 1684412 - RNA, 12 nt, Salmonella enterica enterica serovar Typhi
agacuggaugga

SEQ ID NO: 1684413 - RNA, 21 nt, Salmonella enterica enterica serovar Typhi
agacuguugaaagccccggcu

SEQ ID NO: 1684414 - RNA, 17 nt, Salmonella enterica enterica serovar Typhi
agacugugauggcgguc

SEQ ID NO: 1684415 - RNA, 12 nt, Salmonella enterica enterica serovar Typhi
agacucaggcgc

SEQ ID NO: 1684416 - RNA, 20 nt, Salmonella enterica enterica serovar Typhi
agacucgcucccuuccccca

SEQ ID NO: 1684417 - RNA, 22 nt, Salmonella enterica enterica serovar Typhi
agacucgcuucacgcggauugc

SEQ ID NO: 1684418 - RNA, 16 nt, Salmonella enterica enterica serovar Typhi
agacucgcggguuuca

SEQ ID NO: 1684419 - RNA, 13 nt, Salmonella enterica enterica serovar Typhi
agacugauaucca

SEQ ID NO: 1684420 - RNA, 14 nt, Salmonella enterica enterica serovar Typhi
agacuucuucaguc

SEQ ID NO: 1684421 - RNA, 16 nt, Salmonella enterica enterica serovar Typhi
agacuucuucagucag

SEQ ID NO: 1684422 - RNA, 16 nt, Salmonella enterica enterica serovar Typhi
agacuuuccagcacga

SEQ ID NO: 1684423 - RNA, 18 nt, Salmonella enterica enterica serovar Typhi
agacuuugcacagucugc

SEQ ID NO: 1684424 - RNA, 22 nt, Salmonella enterica enterica serovar Typhi
agagaaacaacaccguaaaagg

SEQ ID NO: 1684425 - RNA, 15 nt, Salmonella enterica enterica serovar Typhi
agagaaacaacaccg

SEQ ID NO: 1684426 - RNA, 10 nt, Salmonella enterica enterica serovar Typhi
agagaaaaaa

SEQ ID NO: 1684427 - RNA, 21 nt, Salmonella enterica enterica serovar Typhi
agagaaaaccccguacaggac

SEQ ID NO: 1684428 - RNA, 14 nt, Salmonella enterica enterica serovar Typhi
agagaagucugagc

SEQ ID NO: 1684429 - RNA, 15 nt, Salmonella enterica enterica serovar Typhi
agagaauaacgauga

SEQ ID NO: 1684430 - RNA, 16 nt, Salmonella enterica enterica serovar Typhi
agagaauuaacagcgc

SEQ ID NO: 1684431 - RNA, 17 nt, Salmonella enterica enterica serovar Typhi
agagaauggccagcaca

SEQ ID NO: 1684432 - RNA, 23 nt, Salmonella enterica enterica serovar Typhi
agagaacgacgcauaaaaaauga

SEQ ID NO: 1684433 - RNA, 22 nt, Salmonella enterica enterica serovar Typhi
agagaacguugccgcaggcaac

SEQ ID NO: 1684434 - RNA, 12 nt, Salmonella enterica enterica serovar Typhi
agagaaccguuc

SEQ ID NO: 1684435 - RNA, 15 nt, Salmonella enterica enterica serovar Typhi
agagaaccaacguca

SEQ ID NO: 1684436 - RNA, 18 nt, Salmonella enterica enterica serovar Typhi
agagaaccugaacaauaa

SEQ ID NO: 1684437 - RNA, 22 nt, Salmonella enterica enterica serovar Typhi
agagaacgaaauauggcacagc

SEQ ID NO: 1684438 - RNA, 12 nt, Salmonella enterica enterica serovar Typhi
agagaacagcau

SEQ ID NO: 1684439 - RNA, 19 nt, Salmonella enterica enterica serovar Typhi
agauaacuauaugcccggg

SEQ ID NO: 1684440 - RNA, 16 nt, Salmonella enterica enterica serovar Typhi
agauaacgcuaugcuu

SEQ ID NO: 1684441 - RNA, 15 nt, Salmonella enterica enterica serovar Typhi
agauaacgcaucaga

SEQ ID NO: 1684442 - RNA, 22 nt, Salmonella enterica enterica serovar Typhi
agauaagccgucauaaaaucaa

SEQ ID NO: 1684443 - RNA, 12 nt, Salmonella enterica enterica serovar Typhi
agauaagcgcca

SEQ ID NO: 1684444 - RNA, 15 nt, Salmonella enterica enterica serovar Typhi
agauaaacagcagcg

SEQ ID NO: 1684445 - RNA, 20 nt, Salmonella enterica enterica serovar Typhi
agauaaaguacggcgcgcca

SEQ ID NO: 1684446 - RNA, 20 nt, Salmonella enterica enterica serovar Typhi
agauaaacagguaaaacaaa

SEQ ID NO: 1684447 - RNA, 19 nt, Salmonella enterica enterica serovar Typhi
agauaaacagguaaaacaa

SEQ ID NO: 1684448 - RNA, 18 nt, Salmonella enterica enterica serovar Typhi
agaguucacguagcucaa

SEQ ID NO: 1684449 - RNA, 23 nt, Salmonella enterica enterica serovar Typhi
agaggcugaaggcgcuccccugc

SEQ ID NO: 1684450 - RNA, 20 nt, Salmonella enterica enterica serovar Typhi
agaggcauaaaaaaaagccg

SEQ ID NO: 1684451 - RNA, 20 nt, Salmonella enterica enterica serovar Typhi
agaggcgccgacuuuacggc

SEQ ID NO: 1684452 - RNA, 19 nt, Salmonella enterica enterica serovar Typhi
agaggaggagaugucccac

SEQ ID NO: 1684453 - RNA, 15 nt, Salmonella enterica enterica serovar Typhi
agaggaauguccagc

SEQ ID NO: 1684454 - RNA, 16 nt, Salmonella enterica enterica serovar Typhi
agagcguggucauuag

SEQ ID NO: 1684455 - RNA, 20 nt, Salmonella enterica enterica serovar Typhi
agagcuaaucaauaaguuuu

SEQ ID NO: 1684456 - RNA, 17 nt, Salmonella enterica enterica serovar Typhi
agagcucgaccaacaua

SEQ ID NO: 1684457 - RNA, 18 nt, Salmonella enterica enterica serovar Typhi
agagcgggucaacgccaa

SEQ ID NO: 1684458 - RNA, 19 nt, Salmonella enterica enterica serovar Typhi
agagcagcgccagcgacag

SEQ ID NO: 1684459 - RNA, 14 nt, Salmonella enterica enterica serovar Typhi
agagcauccgcagc

SEQ ID NO: 1684460 - RNA, 21 nt, Salmonella enterica enterica serovar Typhi
agagcauuuguagcggcaaca

SEQ ID NO: 1684461 - RNA, 18 nt, Salmonella enterica enterica serovar Typhi
agagccggaaccuguccu

SEQ ID NO: 1684462 - RNA, 23 nt, Salmonella enterica enterica serovar Typhi
agagccgcgcagcgcaacgccuu

SEQ ID NO: 1684463 - RNA, 12 nt, Salmonella enterica enterica serovar Typhi
agaaaaaauuaa

SEQ ID NO: 1684464 - RNA, 18 nt, Salmonella enterica enterica serovar Typhi
agaaaaacgcgcaaaacu

SEQ ID NO: 1684465 - RNA, 23 nt, Salmonella enterica enterica serovar Typhi
agaaaacagcaugguguuaguuu

SEQ ID NO: 1684466 - RNA, 13 nt, Salmonella enterica enterica serovar Typhi
agaaaaagaagcc

SEQ ID NO: 1684467 - RNA, 22 nt, Salmonella enterica enterica serovar Typhi
agaaaaagaccgacaucgccag

SEQ ID NO: 1684468 - RNA, 18 nt, Salmonella enterica enterica serovar Typhi
agaaaaccgacagcaaua

SEQ ID NO: 1684469 - RNA, 23 nt, Salmonella enterica enterica serovar Typhi
agaaaacagugauuacaaaaugu

SEQ ID NO: 1684470 - RNA, 16 nt, Salmonella enterica enterica serovar Typhi
agaaaagcgaaaauaa

SEQ ID NO: 1684471 - RNA, 19 nt, Salmonella enterica enterica serovar Typhi
agaaaacuuucauuucacu

SEQ ID NO: 1684472 - RNA, 19 nt, Salmonella enterica enterica serovar Typhi
agaaaaggaagaauaaaua

SEQ ID NO: 1684473 - RNA, 12 nt, Salmonella enterica enterica serovar Typhi
agaaaauaacaa

SEQ ID NO: 1684474 - RNA, 18 nt, Salmonella enterica enterica serovar Typhi
agaaaauaacaauauuaa

SEQ ID NO: 1684475 - RNA, 21 nt, Salmonella enterica enterica serovar Typhi
agaaaauaacaauauuaaaua

SEQ ID NO: 1684476 - RNA, 13 nt, Salmonella enterica enterica serovar Typhi
agaaaauauauug

SEQ ID NO: 1684477 - RNA, 22 nt, Salmonella enterica enterica serovar Typhi
agaaaauauauuggccuuaugc

SEQ ID NO: 1684478 - RNA, 19 nt, Salmonella enterica enterica serovar Typhi
agaaaauagaggaaauaac

SEQ ID NO: 1684479 - RNA, 19 nt, Salmonella enterica enterica serovar Typhi
agaaacaacaccguaaaag

SEQ ID NO: 1684480 - RNA, 13 nt, Salmonella enterica enterica serovar Typhi
agaaacaacacga

SEQ ID NO: 1684481 - RNA, 14 nt, Salmonella enterica enterica serovar Typhi
agaaauaaaaccag

SEQ ID NO: 1684482 - RNA, 14 nt, Salmonella enterica enterica serovar Typhi
agaaauaacucccu

SEQ ID NO: 1684483 - RNA, 22 nt, Salmonella enterica enterica serovar Typhi
agaaauaaaauacgcucaauau

SEQ ID NO: 1684484 - RNA, 12 nt, Salmonella enterica enterica serovar Typhi
agaaauaaaaua

SEQ ID NO: 1684485 - RNA, 14 nt, Salmonella enterica enterica serovar Typhi
agaaauaaaauacg

SEQ ID NO: 1684486 - RNA, 14 nt, Salmonella enterica enterica serovar Typhi
agaaacaccagaau

SEQ ID NO: 1684487 - RNA, 13 nt, Salmonella enterica enterica serovar Typhi
agaaauccacauu

SEQ ID NO: 1684488 - RNA, 20 nt, Salmonella enterica enterica serovar Typhi
agaaauagaacagcuggugc

SEQ ID NO: 1684489 - RNA, 22 nt, Salmonella enterica enterica serovar Typhi
agaaauagacgagcgaaaaacu

SEQ ID NO: 1684490 - RNA, 20 nt, Salmonella enterica enterica serovar Typhi
agaaauacugugcccagagc

SEQ ID NO: 1684491 - RNA, 23 nt, Salmonella enterica enterica serovar Typhi
agaaauagacgagcgaaaaacug

SEQ ID NO: 1684492 - RNA, 14 nt, Salmonella enterica enterica serovar Typhi
agaaauauuuugcc

SEQ ID NO: 1684493 - RNA, 18 nt, Salmonella enterica enterica serovar Typhi
agaaaucaacgaaaucag

SEQ ID NO: 1684494 - RNA, 19 nt, Salmonella enterica enterica serovar Typhi
agaaaucaacgaaaucaga

SEQ ID NO: 1684495 - RNA, 17 nt, Salmonella enterica enterica serovar Typhi
acuuuaccgccguuagc

SEQ ID NO: 1684496 - RNA, 16 nt, Salmonella enterica enterica serovar Typhi
acuuuaaucaccugcc

SEQ ID NO: 1684497 - RNA, 11 nt, Salmonella enterica enterica serovar Typhi
acuuucaaaau

SEQ ID NO: 1684498 - RNA, 15 nt, Salmonella enterica enterica serovar Typhi
acuuucauuccuuua

SEQ ID NO: 1684499 - RNA, 16 nt, Salmonella enterica enterica serovar Typhi
acuuuccaaaauccag

SEQ ID NO: 1684500 - RNA, 17 nt, Salmonella enterica enterica serovar Typhi
acuuuccaaaauccagg

SEQ ID NO: 1684501 - RNA, 17 nt, Salmonella enterica enterica serovar Typhi
acuuuuaaauugaagag

SEQ ID NO: 1684502 - RNA, 18 nt, Salmonella enterica enterica serovar Typhi
acuuugcucuccuuaaaa

SEQ ID NO: 1684503 - RNA, 19 nt, Salmonella enterica enterica serovar Typhi
acuuugcccuuuuugcauu

SEQ ID NO: 1684504 - RNA, 22 nt, Salmonella enterica enterica serovar Typhi
acuuucucggcuuuccagcuca

SEQ ID NO: 1684505 - RNA, 18 nt, Salmonella enterica enterica serovar Typhi
acuuucuugccacuggcc

SEQ ID NO: 1684506 - RNA, 17 nt, Salmonella enterica enterica serovar Typhi
acuuucuugccacuggc

SEQ ID NO: 1684507 - RNA, 20 nt, Salmonella enterica enterica serovar Typhi
acuuuccauucgacaguucc

SEQ ID NO: 1684508 - RNA, 15 nt, Salmonella enterica enterica serovar Typhi
acuuagagccuaucc

SEQ ID NO: 1684509 - RNA, 22 nt, Salmonella enterica enterica serovar Typhi
acuuacuuucuugccacuggcc

SEQ ID NO: 1684510 - RNA, 12 nt, Salmonella enterica enterica serovar Typhi
acuuacuuucuu

SEQ ID NO: 1684511 - RNA, 17 nt, Salmonella enterica enterica serovar Typhi
acuuauuaccacaguca

SEQ ID NO: 1684512 - RNA, 15 nt, Salmonella enterica enterica serovar Typhi
acuucauccggauaa

SEQ ID NO: 1684513 - RNA, 18 nt, Salmonella enterica enterica serovar Typhi
acuucaugcguuagccua

SEQ ID NO: 1684514 - RNA, 16 nt, Salmonella enterica enterica serovar Typhi
acuuauugauccacgg

SEQ ID NO: 1684515 - RNA, 17 nt, Salmonella enterica enterica serovar Typhi
acuuauuuuauuuuuau

SEQ ID NO: 1684516 - RNA, 14 nt, Salmonella enterica enterica serovar Typhi
acuguuugcugaca

SEQ ID NO: 1684517 - RNA, 18 nt, Salmonella enterica enterica serovar Typhi
acuguuuaaugcuuucaa

SEQ ID NO: 1684518 - RNA, 19 nt, Salmonella enterica enterica serovar Typhi
acuguuuuaccaaaucaau

SEQ ID NO: 1684519 - RNA, 20 nt, Salmonella enterica enterica serovar Typhi
acuguuuuaccaaaucaaua

SEQ ID NO: 1684520 - RNA, 15 nt, Salmonella enterica enterica serovar Typhi
acuguuugcugacaa

SEQ ID NO: 1684521 - RNA, 15 nt, Salmonella enterica enterica serovar Typhi
acuguggugugccug

SEQ ID NO: 1684522 - RNA, 18 nt, Salmonella enterica enterica serovar Typhi
acuguggugugccugcgu

SEQ ID NO: 1684523 - RNA, 22 nt, Salmonella enterica enterica serovar Typhi
acugugcugauuuuggcuucac

SEQ ID NO: 1684524 - RNA, 20 nt, Salmonella enterica enterica serovar Typhi
acugugccgucguacucacc

SEQ ID NO: 1684525 - RNA, 16 nt, Salmonella enterica enterica serovar Typhi
acugacuauccacagc

SEQ ID NO: 1684526 - RNA, 15 nt, Salmonella enterica enterica serovar Typhi
acuguaagccucgcu

SEQ ID NO: 1684527 - RNA, 15 nt, Salmonella enterica enterica serovar Typhi
acugacggcgcucuu

SEQ ID NO: 1684528 - RNA, 21 nt, Salmonella enterica enterica serovar Typhi
acugucccagggccaaacugg

SEQ ID NO: 1684529 - RNA, 16 nt, Salmonella enterica enterica serovar Typhi
acugucaaaaauaaca

SEQ ID NO: 1684530 - RNA, 22 nt, Salmonella enterica enterica serovar Typhi
acuuccagaccacuaacccggc

SEQ ID NO: 1684531 - RNA, 20 nt, Salmonella enterica enterica serovar Typhi
acuucggcaaauucuuuuca

SEQ ID NO: 1684532 - RNA, 15 nt, Salmonella enterica enterica serovar Typhi
acuucuaauuuuucc

SEQ ID NO: 1684533 - RNA, 11 nt, Salmonella enterica enterica serovar Typhi
acuucuucagu

SEQ ID NO: 1684534 - RNA, 21 nt, Salmonella enterica enterica serovar Typhi
acuucuugguaccaaacagca

SEQ ID NO: 1684535 - RNA, 22 nt, Salmonella enterica enterica serovar Typhi
acuugccguuuuucucaucaag

SEQ ID NO: 1684536 - RNA, 20 nt, Salmonella enterica enterica serovar Typhi
acuugauuccuggcuugcca

SEQ ID NO: 1684537 - RNA, 14 nt, Salmonella enterica enterica serovar Typhi
acuugauggaaaac

SEQ ID NO: 1684538 - RNA, 23 nt, Salmonella enterica enterica serovar Typhi
acuuggaaaguugcgccgugccu

SEQ ID NO: 1684539 - RNA, 12 nt, Salmonella enterica enterica serovar Typhi
agccaaacacuu

SEQ ID NO: 1684540 - RNA, 19 nt, Salmonella enterica enterica serovar Typhi
agccaaacucugaaaaaau

SEQ ID NO: 1684541 - RNA, 14 nt, Salmonella enterica enterica serovar Typhi
agccaaacugcugu

SEQ ID NO: 1684542 - RNA, 13 nt, Salmonella enterica enterica serovar Typhi
agccaacccacgc

SEQ ID NO: 1684543 - RNA, 20 nt, Salmonella enterica enterica serovar Typhi
agccaacguauaaaauggca

SEQ ID NO: 1684544 - RNA, 16 nt, Salmonella enterica enterica serovar Typhi
agcauuuuucacaguu

SEQ ID NO: 1684545 - RNA, 11 nt, Salmonella enterica enterica serovar Typhi
agcauuuuucc

SEQ ID NO: 1684546 - RNA, 16 nt, Salmonella enterica enterica serovar Typhi
agccaaacaauauccc

SEQ ID NO: 1684547 - RNA, 16 nt, Salmonella enterica enterica serovar Typhi
agcauuucuucaagcg

SEQ ID NO: 1684548 - RNA, 12 nt, Salmonella enterica enterica serovar Typhi
agcauuuguagc

SEQ ID NO: 1684549 - RNA, 17 nt, Salmonella enterica enterica serovar Typhi
agcauuuuaagaaaauu

SEQ ID NO: 1684550 - RNA, 14 nt, Salmonella enterica enterica serovar Typhi
agccacauuguaug

SEQ ID NO: 1684551 - RNA, 15 nt, Salmonella enterica enterica serovar Typhi
agccaccccauuaau

SEQ ID NO: 1684552 - RNA, 14 nt, Salmonella enterica enterica serovar Typhi
agccacagcgguua

SEQ ID NO: 1684553 - RNA, 18 nt, Salmonella enterica enterica serovar Typhi
agccacacccauagcagc

SEQ ID NO: 1684554 - RNA, 16 nt, Salmonella enterica enterica serovar Typhi
agccacaaucugauaa

SEQ ID NO: 1684555 - RNA, 17 nt, Salmonella enterica enterica serovar Typhi
agccacaaucugauaau

SEQ ID NO: 1684556 - RNA, 17 nt, Salmonella enterica enterica serovar Typhi
agccaauccagaauacc

SEQ ID NO: 1684557 - RNA, 12 nt, Salmonella enterica enterica serovar Typhi
agccaauaauca

SEQ ID NO: 1684558 - RNA, 16 nt, Salmonella enterica enterica serovar Typhi
agcauuaccccguggu

SEQ ID NO: 1684559 - RNA, 15 nt, Salmonella enterica enterica serovar Typhi
agcauuauuuuuaac

SEQ ID NO: 1684560 - RNA, 14 nt, Salmonella enterica enterica serovar Typhi
agcauucuauuguu

SEQ ID NO: 1684561 - RNA, 15 nt, Salmonella enterica enterica serovar Typhi
agcauuguauuucag

SEQ ID NO: 1684562 - RNA, 21 nt, Salmonella enterica enterica serovar Typhi
agcauugccguuuucaauaau

SEQ ID NO: 1684563 - RNA, 13 nt, Salmonella enterica enterica serovar Typhi
agcauuuccagcu

SEQ ID NO: 1684564 - RNA, 14 nt, Salmonella enterica enterica serovar Typhi
agcaugcccgccag

SEQ ID NO: 1684565 - RNA, 18 nt, Salmonella enterica enterica serovar Typhi
agcaugggcauccccaug

SEQ ID NO: 1684566 - RNA, 22 nt, Salmonella enterica enterica serovar Typhi
agcaugugaauaugaucugcac

SEQ ID NO: 1684567 - RNA, 17 nt, Salmonella enterica enterica serovar Typhi
agccaccggauugccuu

SEQ ID NO: 1684568 - RNA, 19 nt, Salmonella enterica enterica serovar Typhi
agccacgcccgccgccuga

SEQ ID NO: 1684569 - RNA, 18 nt, Salmonella enterica enterica serovar Typhi
agccacuucaugcgcuuu

SEQ ID NO: 1684570 - RNA, 23 nt, Salmonella enterica enterica serovar Typhi
agccacuucaugcgcuuuuucac

SEQ ID NO: 1684571 - RNA, 13 nt, Salmonella enterica enterica serovar Typhi
agccagacaucac

SEQ ID NO: 1684572 - RNA, 13 nt, Salmonella enterica enterica serovar Typhi
agccagaagccug

SEQ ID NO: 1684573 - RNA, 15 nt, Salmonella enterica enterica serovar Typhi
agccagaacagaagu

SEQ ID NO: 1684574 - RNA, 18 nt, Salmonella enterica enterica serovar Typhi
agccacugcgccauuaac

SEQ ID NO: 1684575 - RNA, 19 nt, Salmonella enterica enterica serovar Typhi
agccacgucugaugcgugg

SEQ ID NO: 1684576 - RNA, 13 nt, Salmonella enterica enterica serovar Typhi
agccacuauccag

SEQ ID NO: 1684577 - RNA, 23 nt, Salmonella enterica enterica serovar Typhi
agccagcguaaauagcccggauc

SEQ ID NO: 1684578 - RNA, 20 nt, Salmonella enterica enterica serovar Typhi
agccagcucaccagccaaau

SEQ ID NO: 1684579 - RNA, 18 nt, Salmonella enterica enterica serovar Typhi
agccagcguuucuggaag

SEQ ID NO: 1684580 - RNA, 19 nt, Salmonella enterica enterica serovar Typhi
agccagcgggcgcagucca

SEQ ID NO: 1684581 - RNA, 18 nt, Salmonella enterica enterica serovar Typhi
agccagcauuuccagcug

SEQ ID NO: 1684582 - RNA, 14 nt, Salmonella enterica enterica serovar Typhi
agccagcaauaaca

SEQ ID NO: 1684583 - RNA, 18 nt, Salmonella enterica enterica serovar Typhi
agccagauaaagcagcga

SEQ ID NO: 1684584 - RNA, 23 nt, Salmonella enterica enterica serovar Typhi
agccagacgcuccgcaguaauca

SEQ ID NO: 1684585 - RNA, 19 nt, Salmonella enterica enterica serovar Typhi
agccagacgcgcagcaccg

SEQ ID NO: 1684586 - RNA, 23 nt, Salmonella enterica enterica serovar Typhi
agccagacggcgcccagccugcc

SEQ ID NO: 1684587 - RNA, 14 nt, Salmonella enterica enterica serovar Typhi
agccauuaaagaag

SEQ ID NO: 1684588 - RNA, 19 nt, Salmonella enterica enterica serovar Typhi
agccauguagaauagcgcc

SEQ ID NO: 1684589 - RNA, 17 nt, Salmonella enterica enterica serovar Typhi
agccauuaaugcaggca

SEQ ID NO: 1684590 - RNA, 15 nt, Salmonella enterica enterica serovar Typhi
agccaugccagcagu

SEQ ID NO: 1684591 - RNA, 17 nt, Salmonella enterica enterica serovar Typhi
agccaugccagcaguuu

SEQ ID NO: 1684592 - RNA, 15 nt, Salmonella enterica enterica serovar Typhi
agccaugccauugcu

SEQ ID NO: 1684593 - RNA, 14 nt, Salmonella enterica enterica serovar Typhi
agccauggcccaaa

SEQ ID NO: 1684594 - RNA, 15 nt, Salmonella enterica enterica serovar Typhi
agccauauggcauuc

SEQ ID NO: 1684595 - RNA, 15 nt, Salmonella enterica enterica serovar Typhi
agccauagcagcaaa

SEQ ID NO: 1684596 - RNA, 20 nt, Salmonella enterica enterica serovar Typhi
agccauacauugaguaaaua

SEQ ID NO: 1684597 - RNA, 18 nt, Salmonella enterica enterica serovar Typhi
agccaguucgccuucuuc

SEQ ID NO: 1684598 - RNA, 22 nt, Salmonella enterica enterica serovar Typhi
agccaguucgccuucuucaucu

SEQ ID NO: 1684599 - RNA, 13 nt, Salmonella enterica enterica serovar Typhi
agccaguucucaa

SEQ ID NO: 1684600 - RNA, 22 nt, Salmonella enterica enterica serovar Typhi
agccaguuguucgauaaccugu

SEQ ID NO: 1684601 - RNA, 15 nt, Salmonella enterica enterica serovar Typhi
agccagguuuugcuc

SEQ ID NO: 1684602 - RNA, 17 nt, Salmonella enterica enterica serovar Typhi
agccaggcgauugucac

SEQ ID NO: 1684603 - RNA, 16 nt, Salmonella enterica enterica serovar Typhi
agccagguugccagaa

SEQ ID NO: 1684604 - RNA, 19 nt, Salmonella enterica enterica serovar Typhi
agccagguggcaauauccu

SEQ ID NO: 1684605 - RNA, 20 nt, Salmonella enterica enterica serovar Typhi
agccagguugcgcccggcgc

SEQ ID NO: 1684606 - RNA, 20 nt, Salmonella enterica enterica serovar Typhi
agccaggcccgguggcgcca

SEQ ID NO: 1684607 - RNA, 13 nt, Salmonella enterica enterica serovar Typhi
agccaggccgcca

SEQ ID NO: 1684608 - RNA, 20 nt, Salmonella enterica enterica serovar Typhi
agccaggccgccagcaacgu

SEQ ID NO: 1684609 - RNA, 19 nt, Salmonella enterica enterica serovar Typhi
agcaucaacccguuuucau

SEQ ID NO: 1684610 - RNA, 16 nt, Salmonella enterica enterica serovar Typhi
agcaucaauagcagcu

SEQ ID NO: 1684611 - RNA, 19 nt, Salmonella enterica enterica serovar Typhi
agcaucaaacuuuuaaauu

SEQ ID NO: 1684612 - RNA, 14 nt, Salmonella enterica enterica serovar Typhi
agcauauccagcgc

SEQ ID NO: 1684613 - RNA, 23 nt, Salmonella enterica enterica serovar Typhi
agcaucagguggaagaaacgcuu

SEQ ID NO: 1684614 - RNA, 13 nt, Salmonella enterica enterica serovar Typhi
agcaucaggugga

SEQ ID NO: 1684615 - RNA, 19 nt, Salmonella enterica enterica serovar Typhi
agcaucccgcaggcggcga

SEQ ID NO: 1684616 - RNA, 22 nt, Salmonella enterica enterica serovar Typhi
agcaucgacccuugcgaccacu

SEQ ID NO: 1684617 - RNA, 20 nt, Salmonella enterica enterica serovar Typhi
agcaucgccgguagcuucag

SEQ ID NO: 1684618 - RNA, 17 nt, Salmonella enterica enterica serovar Typhi
agcaucgcuaaccggcg

SEQ ID NO: 1684619 - RNA, 15 nt, Salmonella enterica enterica serovar Typhi
agcaucgggaaucau

SEQ ID NO: 1684620 - RNA, 15 nt, Salmonella enterica enterica serovar Typhi
agcaucugcauaaug

SEQ ID NO: 1684621 - RNA, 18 nt, Salmonella enterica enterica serovar Typhi
agcaucugauagcccauc

SEQ ID NO: 1684622 - RNA, 20 nt, Salmonella enterica enterica serovar Typhi
agcaucggcagcgccaguga

SEQ ID NO: 1684623 - RNA, 21 nt, Salmonella enterica enterica serovar Typhi
agcaguuuuaucuaugugugg

SEQ ID NO: 1684624 - RNA, 21 nt, Salmonella enterica enterica serovar Typhi
agcauaaaaccgccgcccauu

SEQ ID NO: 1684625 - RNA, 17 nt, Salmonella enterica enterica serovar Typhi
agcauaauaaagcagcg

SEQ ID NO: 1684626 - RNA, 13 nt, Salmonella enterica enterica serovar Typhi
agcauaaaaagac

SEQ ID NO: 1684627 - RNA, 13 nt, Salmonella enterica enterica serovar Typhi
agcauaccgccca

SEQ ID NO: 1684628 - RNA, 17 nt, Salmonella enterica enterica serovar Typhi
agcauacgacaucgcca

SEQ ID NO: 1684629 - RNA, 14 nt, Salmonella enterica enterica serovar Typhi
agcauacugauguc

SEQ ID NO: 1684630 - RNA, 15 nt, Salmonella enterica enterica serovar Typhi
agcauagcguuaucu

SEQ ID NO: 1684631 - RNA, 17 nt, Salmonella enterica enterica serovar Typhi
agcauagcgccaucagg

SEQ ID NO: 1684632 - RNA, 18 nt, Salmonella enterica enterica serovar Typhi
agcauagcgccuucaggc

SEQ ID NO: 1684633 - RNA, 23 nt, Salmonella enterica enterica serovar Typhi
agcauagucgcuccccauaaaga

SEQ ID NO: 1684634 - RNA, 18 nt, Salmonella enterica enterica serovar Typhi
agcagugcuggcaacauu

SEQ ID NO: 1684635 - RNA, 14 nt, Salmonella enterica enterica serovar Typhi
agcagugggaaaau

SEQ ID NO: 1684636 - RNA, 14 nt, Salmonella enterica enterica serovar Typhi
agcaguucagcagc

SEQ ID NO: 1684637 - RNA, 19 nt, Salmonella enterica enterica serovar Typhi
agcaguaucguguuauuuu

SEQ ID NO: 1684638 - RNA, 16 nt, Salmonella enterica enterica serovar Typhi
agcagugauuaugcuc

SEQ ID NO: 1684639 - RNA, 14 nt, Salmonella enterica enterica serovar Typhi
agcagcgcaucaug

SEQ ID NO: 1684640 - RNA, 17 nt, Salmonella enterica enterica serovar Typhi
agcagcgaugacagcag

SEQ ID NO: 1684641 - RNA, 16 nt, Salmonella enterica enterica serovar Typhi
agcagccagacccgcg

SEQ ID NO: 1684642 - RNA, 23 nt, Salmonella enterica enterica serovar Typhi
agcagcggcgguuauccgccagc

SEQ ID NO: 1684643 - RNA, 18 nt, Salmonella enterica enterica serovar Typhi
agcagcggcguaucuucc

SEQ ID NO: 1684644 - RNA, 13 nt, Salmonella enterica enterica serovar Typhi
agcagcuucagca

SEQ ID NO: 1684645 - RNA, 13 nt, Salmonella enterica enterica serovar Typhi
agcagcuccgaaa

SEQ ID NO: 1684646 - RNA, 22 nt, Salmonella enterica enterica serovar Typhi
agcaggaucuccagaucgccac

SEQ ID NO: 1684647 - RNA, 15 nt, Salmonella enterica enterica serovar Typhi
agcaggaacggcagg

SEQ ID NO: 1684648 - RNA, 23 nt, Salmonella enterica enterica serovar Typhi
agcaggaaaagaccauccgguuu

SEQ ID NO: 1684649 - RNA, 20 nt, Salmonella enterica enterica serovar Typhi
agcaggaaaucauagcccug

SEQ ID NO: 1684650 - RNA, 15 nt, Salmonella enterica enterica serovar Typhi
agcagcuuggcggcu

SEQ ID NO: 1684651 - RNA, 17 nt, Salmonella enterica enterica serovar Typhi
agcaggcacuguggugu

SEQ ID NO: 1684652 - RNA, 13 nt, Salmonella enterica enterica serovar Typhi
agcaggcgggcuu

SEQ ID NO: 1684653 - RNA, 24 nt, Salmonella enterica enterica serovar Typhi
agcaggcgggacgccauagcguuu

SEQ ID NO: 1684654 - RNA, 16 nt, Salmonella enterica enterica serovar Typhi
agcagggucaggaacu

SEQ ID NO: 1684655 - RNA, 14 nt, Salmonella enterica enterica serovar Typhi
agcaggcuuugcug

SEQ ID NO: 1684656 - RNA, 15 nt, Salmonella enterica enterica serovar Typhi
agcacaccauuucac

SEQ ID NO: 1684657 - RNA, 16 nt, Salmonella enterica enterica serovar Typhi
agcacaccauuucaca

SEQ ID NO: 1684658 - RNA, 22 nt, Salmonella enterica enterica serovar Typhi
agcacaacgcauuggcaauuaa

SEQ ID NO: 1684659 - RNA, 15 nt, Salmonella enterica enterica serovar Typhi
agcacaagaacuuaa

SEQ ID NO: 1684660 - RNA, 21 nt, Salmonella enterica enterica serovar Typhi
agcacaagaacuuaaauuaau

SEQ ID NO: 1684661 - RNA, 19 nt, Salmonella enterica enterica serovar Typhi
agcaauuccgccaucucau

SEQ ID NO: 1684662 - RNA, 18 nt, Salmonella enterica enterica serovar Typhi
agcaauuggccaucuucg

SEQ ID NO: 1684663 - RNA, 19 nt, Salmonella enterica enterica serovar Typhi
agcaauuucagcauccucc

SEQ ID NO: 1684664 - RNA, 21 nt, Salmonella enterica enterica serovar Typhi
agcaauuucagcauccuccgg

SEQ ID NO: 1684665 - RNA, 19 nt, Salmonella enterica enterica serovar Typhi
agcaauuucucgcccgcca

SEQ ID NO: 1684666 - RNA, 15 nt, Salmonella enterica enterica serovar Typhi
agcacauucagcagc

SEQ ID NO: 1684667 - RNA, 22 nt, Salmonella enterica enterica serovar Typhi
agcacauuacaggcaucuucca

SEQ ID NO: 1684668 - RNA, 12 nt, Salmonella enterica enterica serovar Typhi
agcaccaccugc

SEQ ID NO: 1684669 - RNA, 16 nt, Salmonella enterica enterica serovar Typhi
agcacagcccaguaau

SEQ ID NO: 1684670 - RNA, 17 nt, Salmonella enterica enterica serovar Typhi
agcacagcccaguaaua

SEQ ID NO: 1684671 - RNA, 17 nt, Salmonella enterica enterica serovar Typhi
agcacagcucuaauuga

SEQ ID NO: 1684672 - RNA, 12 nt, Salmonella enterica enterica serovar Typhi
agcacaggccau

SEQ ID NO: 1684673 - RNA, 13 nt, Salmonella enterica enterica serovar Typhi
agcacagcccuac

SEQ ID NO: 1684674 - RNA, 12 nt, Salmonella enterica enterica serovar Typhi
agcacauccaug

SEQ ID NO: 1684675 - RNA, 22 nt, Salmonella enterica enterica serovar Typhi
agcacaucagccguaucuuccg

SEQ ID NO: 1684676 - RNA, 20 nt, Salmonella enterica enterica serovar Typhi
agcaccggauacaagguauc

SEQ ID NO: 1684677 - RNA, 15 nt, Salmonella enterica enterica serovar Typhi
agcaccgccagcgcc

SEQ ID NO: 1684678 - RNA, 13 nt, Salmonella enterica enterica serovar Typhi
agcaccuccagcg

SEQ ID NO: 1684679 - RNA, 21 nt, Salmonella enterica enterica serovar Typhi
agcaccucgguauguccugcc

SEQ ID NO: 1684680 - RNA, 20 nt, Salmonella enterica enterica serovar Typhi
agcaccuggcggagcugcgc

SEQ ID NO: 1684681 - RNA, 12 nt, Salmonella enterica enterica serovar Typhi
agcaccaucaug

SEQ ID NO: 1684682 - RNA, 13 nt, Salmonella enterica enterica serovar Typhi
agcacccaggcac

SEQ ID NO: 1684683 - RNA, 13 nt, Salmonella enterica enterica serovar Typhi
agcaccaggccaa

SEQ ID NO: 1684684 - RNA, 13 nt, Salmonella enterica enterica serovar Typhi
agcaccagcaggu

SEQ ID NO: 1684685 - RNA, 13 nt, Salmonella enterica enterica serovar Typhi
agcaccagcagcg

SEQ ID NO: 1684686 - RNA, 12 nt, Salmonella enterica enterica serovar Typhi
agcaccagcagu

SEQ ID NO: 1684687 - RNA, 13 nt, Salmonella enterica enterica serovar Typhi
agcaccagcagug

SEQ ID NO: 1684688 - RNA, 12 nt, Salmonella enterica enterica serovar Typhi
agcaccagcauu

SEQ ID NO: 1684689 - RNA, 15 nt, Salmonella enterica enterica serovar Typhi
agcaccagcaggugg

SEQ ID NO: 1684690 - RNA, 16 nt, Salmonella enterica enterica serovar Typhi
agcaccuuauccggcc

SEQ ID NO: 1684691 - RNA, 17 nt, Salmonella enterica enterica serovar Typhi
agcaccuuauccggccu

SEQ ID NO: 1684692 - RNA, 19 nt, Salmonella enterica enterica serovar Typhi
agcacgaccuuuucuucau

SEQ ID NO: 1684693 - RNA, 17 nt, Salmonella enterica enterica serovar Typhi
agcacgcuuacccagca

SEQ ID NO: 1684694 - RNA, 19 nt, Salmonella enterica enterica serovar Typhi
agcacggggguuuugugau

SEQ ID NO: 1684695 - RNA, 16 nt, Salmonella enterica enterica serovar Typhi
agcacgcgcugcgccg

SEQ ID NO: 1684696 - RNA, 13 nt, Salmonella enterica enterica serovar Typhi
agcacgcccgguc

SEQ ID NO: 1684697 - RNA, 14 nt, Salmonella enterica enterica serovar Typhi
agcacuaacagcag

SEQ ID NO: 1684698 - RNA, 15 nt, Salmonella enterica enterica serovar Typhi
agcacgugcauggga

SEQ ID NO: 1684699 - RNA, 21 nt, Salmonella enterica enterica serovar Typhi
agcacuaacagcagcagcaaa

SEQ ID NO: 1684700 - RNA, 14 nt, Salmonella enterica enterica serovar Typhi
agcacguaggccug

SEQ ID NO: 1684701 - RNA, 19 nt, Salmonella enterica enterica serovar Typhi
agcagauuuuuauccgucg

SEQ ID NO: 1684702 - RNA, 22 nt, Salmonella enterica enterica serovar Typhi
agcagauaagcgacucuguauu

SEQ ID NO: 1684703 - RNA, 15 nt, Salmonella enterica enterica serovar Typhi
agcagagccggaacc

SEQ ID NO: 1684704 - RNA, 15 nt, Salmonella enterica enterica serovar Typhi
agcagcagagccgga

SEQ ID NO: 1684705 - RNA, 16 nt, Salmonella enterica enterica serovar Typhi
agcagcagcagcgcuu

SEQ ID NO: 1684706 - RNA, 17 nt, Salmonella enterica enterica serovar Typhi
agcagcaacccugccgu

SEQ ID NO: 1684707 - RNA, 15 nt, Salmonella enterica enterica serovar Typhi
agcagcaacccugcc

SEQ ID NO: 1684708 - RNA, 15 nt, Salmonella enterica enterica serovar Typhi
agcacuuuuuccucc

SEQ ID NO: 1684709 - RNA, 23 nt, Salmonella enterica enterica serovar Typhi
agcacugucccagggccaaacug

SEQ ID NO: 1684710 - RNA, 13 nt, Salmonella enterica enterica serovar Typhi
agcagacuguaaa

SEQ ID NO: 1684711 - RNA, 13 nt, Salmonella enterica enterica serovar Typhi
agcagacguuggu

SEQ ID NO: 1684712 - RNA, 13 nt, Salmonella enterica enterica serovar Typhi
agcagacagguga

SEQ ID NO: 1684713 - RNA, 14 nt, Salmonella enterica enterica serovar Typhi
agcagacaggugaa

SEQ ID NO: 1684714 - RNA, 21 nt, Salmonella enterica enterica serovar Typhi
agcagaacuggcgcgaugacu

SEQ ID NO: 1684715 - RNA, 12 nt, Salmonella enterica enterica serovar Typhi
agauuucaucag

SEQ ID NO: 1684716 - RNA, 17 nt, Salmonella enterica enterica serovar Typhi
agauuucaucaggcuga

SEQ ID NO: 1684717 - RNA, 15 nt, Salmonella enterica enterica serovar Typhi
agauuuaucaauuuu

SEQ ID NO: 1684718 - RNA, 15 nt, Salmonella enterica enterica serovar Typhi
agauuuacaacagau

SEQ ID NO: 1684719 - RNA, 16 nt, Salmonella enterica enterica serovar Typhi
agauuucuuaauuccu

SEQ ID NO: 1684720 - RNA, 18 nt, Salmonella enterica enterica serovar Typhi
agauuucuuaauuccuca

SEQ ID NO: 1684721 - RNA, 13 nt, Salmonella enterica enterica serovar Typhi
agauuucuuaauu

SEQ ID NO: 1684722 - RNA, 21 nt, Salmonella enterica enterica serovar Typhi
agauugugcuuuagcuuuacu

SEQ ID NO: 1684723 - RNA, 17 nt, Salmonella enterica enterica serovar Typhi
agauuguuucggauaau

SEQ ID NO: 1684724 - RNA, 13 nt, Salmonella enterica enterica serovar Typhi
agauuuaaaacaa

SEQ ID NO: 1684725 - RNA, 14 nt, Salmonella enterica enterica serovar Typhi
agauuuaaaacaag

SEQ ID NO: 1684726 - RNA, 12 nt, Salmonella enterica enterica serovar Typhi
agauaaugccgc

SEQ ID NO: 1684727 - RNA, 20 nt, Salmonella enterica enterica serovar Typhi
agauaaugcucauuauuugg

SEQ ID NO: 1684728 - RNA, 12 nt, Salmonella enterica enterica serovar Typhi
agauaauagcug

SEQ ID NO: 1684729 - RNA, 18 nt, Salmonella enterica enterica serovar Typhi
agcaaaucgggaaaauga

SEQ ID NO: 1684730 - RNA, 18 nt, Salmonella enterica enterica serovar Typhi
agcaaaccggcaugaaga

SEQ ID NO: 1684731 - RNA, 17 nt, Salmonella enterica enterica serovar Typhi
agcaaagcguacaugaa

SEQ ID NO: 1684732 - RNA, 17 nt, Salmonella enterica enterica serovar Typhi
agauuuuucucacacau

SEQ ID NO: 1684733 - RNA, 15 nt, Salmonella enterica enterica serovar Typhi
agauuuuucgccagg

SEQ ID NO: 1684734 - RNA, 13 nt, Salmonella enterica enterica serovar Typhi
agauuuucaucau

SEQ ID NO: 1684735 - RNA, 16 nt, Salmonella enterica enterica serovar Typhi
agcaaaaucacgcaca

SEQ ID NO: 1684736 - RNA, 15 nt, Salmonella enterica enterica serovar Typhi
agcaaaauggcaauu

SEQ ID NO: 1684737 - RNA, 12 nt, Salmonella enterica enterica serovar Typhi
agcaaaacaccg

SEQ ID NO: 1684738 - RNA, 20 nt, Salmonella enterica enterica serovar Typhi
agcaaaacaccgcucaauau

SEQ ID NO: 1684739 - RNA, 15 nt, Salmonella enterica enterica serovar Typhi
agcaaaaaucaccac

SEQ ID NO: 1684740 - RNA, 14 nt, Salmonella enterica enterica serovar Typhi
agcaaaaaucacca

SEQ ID NO: 1684741 - RNA, 20 nt, Salmonella enterica enterica serovar Typhi
agcaacccuggcgcuuuaaa

SEQ ID NO: 1684742 - RNA, 19 nt, Salmonella enterica enterica serovar Typhi
agcaacagugggcuaugaa

SEQ ID NO: 1684743 - RNA, 21 nt, Salmonella enterica enterica serovar Typhi
agcaacagugggcuaugaaga

SEQ ID NO: 1684744 - RNA, 19 nt, Salmonella enterica enterica serovar Typhi
agcaaccagcuaaccuguu

SEQ ID NO: 1684745 - RNA, 18 nt, Salmonella enterica enterica serovar Typhi
agcaacacagccagcacg

SEQ ID NO: 1684746 - RNA, 20 nt, Salmonella enterica enterica serovar Typhi
agcaacagauugaugcccuc

SEQ ID NO: 1684747 - RNA, 13 nt, Salmonella enterica enterica serovar Typhi
agcaaauucaggg

SEQ ID NO: 1684748 - RNA, 14 nt, Salmonella enterica enterica serovar Typhi
agcaaauugcugau

SEQ ID NO: 1684749 - RNA, 20 nt, Salmonella enterica enterica serovar Typhi
agcaacugcgcgcggguuuc

SEQ ID NO: 1684750 - RNA, 15 nt, Salmonella enterica enterica serovar Typhi
agcaacuguagaaug

SEQ ID NO: 1684751 - RNA, 22 nt, Salmonella enterica enterica serovar Typhi
agcaacuguuuuaccaaaucaa

SEQ ID NO: 1684752 - RNA, 16 nt, Salmonella enterica enterica serovar Typhi
agcaagaauaccacuu

SEQ ID NO: 1684753 - RNA, 22 nt, Salmonella enterica enterica serovar Typhi
agcaagaaguuccgcuuuucug

SEQ ID NO: 1684754 - RNA, 19 nt, Salmonella enterica enterica serovar Typhi
agcaagaacagagcaauua

SEQ ID NO: 1684755 - RNA, 12 nt, Salmonella enterica enterica serovar Typhi
agcaagaacaga

SEQ ID NO: 1684756 - RNA, 16 nt, Salmonella enterica enterica serovar Typhi
agcaagaacagagcaa

SEQ ID NO: 1684757 - RNA, 20 nt, Salmonella enterica enterica serovar Typhi
agcaacgccaucagcaaaau

SEQ ID NO: 1684758 - RNA, 16 nt, Salmonella enterica enterica serovar Typhi
agcaacggaagcugac

SEQ ID NO: 1684759 - RNA, 21 nt, Salmonella enterica enterica serovar Typhi
agcaacguuaaggccgcaaac

SEQ ID NO: 1684760 - RNA, 19 nt, Salmonella enterica enterica serovar Typhi
agcaacguaaucccgccag

SEQ ID NO: 1684761 - RNA, 20 nt, Salmonella enterica enterica serovar Typhi
agcaacguuuguaacagcag

SEQ ID NO: 1684762 - RNA, 16 nt, Salmonella enterica enterica serovar Typhi
agcaauacaauuauug

SEQ ID NO: 1684763 - RNA, 22 nt, Salmonella enterica enterica serovar Typhi
agcaauauuuuguaguuguuuu

SEQ ID NO: 1684764 - RNA, 15 nt, Salmonella enterica enterica serovar Typhi
agcaauauuuuuccg

SEQ ID NO: 1684765 - RNA, 14 nt, Salmonella enterica enterica serovar Typhi
agcaaucaguucuc

SEQ ID NO: 1684766 - RNA, 22 nt, Salmonella enterica enterica serovar Typhi
agcaauuaauauuuaacacauu

SEQ ID NO: 1684767 - RNA, 15 nt, Salmonella enterica enterica serovar Typhi
agcaauuaacaaaua

SEQ ID NO: 1684768 - RNA, 16 nt, Salmonella enterica enterica serovar Typhi
agcaaugcccaaaaua

SEQ ID NO: 1684769 - RNA, 14 nt, Salmonella enterica enterica serovar Typhi
agcaaugauuuuua

SEQ ID NO: 1684770 - RNA, 15 nt, Salmonella enterica enterica serovar Typhi
agcaaugauuuuuag

SEQ ID NO: 1684771 - RNA, 14 nt, Salmonella enterica enterica serovar Typhi
agcaauaaaaggaa

SEQ ID NO: 1684772 - RNA, 13 nt, Salmonella enterica enterica serovar Typhi
agcaaggcggcgg

SEQ ID NO: 1684773 - RNA, 13 nt, Salmonella enterica enterica serovar Typhi
agcaaggcaagaa

SEQ ID NO: 1684774 - RNA, 20 nt, Salmonella enterica enterica serovar Typhi
agcugcgucagcgcuugccg

SEQ ID NO: 1684775 - RNA, 17 nt, Salmonella enterica enterica serovar Typhi
agcugcuggcgagcagg

SEQ ID NO: 1684776 - RNA, 13 nt, Salmonella enterica enterica serovar Typhi
agcugauuuuucg

SEQ ID NO: 1684777 - RNA, 19 nt, Salmonella enterica enterica serovar Typhi
agcugagcuaaucacccac

SEQ ID NO: 1684778 - RNA, 14 nt, Salmonella enterica enterica serovar Typhi
agcugaguaaggac

SEQ ID NO: 1684779 - RNA, 17 nt, Salmonella enterica enterica serovar Typhi
agcugaguaaggacaga

SEQ ID NO: 1684780 - RNA, 15 nt, Salmonella enterica enterica serovar Typhi
agcugauauuuuacu

SEQ ID NO: 1684781 - RNA, 16 nt, Salmonella enterica enterica serovar Typhi
agcugauauuuuacuu

SEQ ID NO: 1684782 - RNA, 18 nt, Salmonella enterica enterica serovar Typhi
agcugauugauuuuguaa

SEQ ID NO: 1684783 - RNA, 20 nt, Salmonella enterica enterica serovar Typhi
agcucggcuucgacauagcc

SEQ ID NO: 1684784 - RNA, 20 nt, Salmonella enterica enterica serovar Typhi
agcucgguucuucggcauaa

SEQ ID NO: 1684785 - RNA, 15 nt, Salmonella enterica enterica serovar Typhi
agcucguuauuuccg

SEQ ID NO: 1684786 - RNA, 22 nt, Salmonella enterica enterica serovar Typhi
agcucugguugcagcgccagag

SEQ ID NO: 1684787 - RNA, 13 nt, Salmonella enterica enterica serovar Typhi
agcugacgcagca

SEQ ID NO: 1684788 - RNA, 19 nt, Salmonella enterica enterica serovar Typhi
agcucuuucauuucugccu

SEQ ID NO: 1684789 - RNA, 22 nt, Salmonella enterica enterica serovar Typhi
agcucuucuucgcucucgccgc

SEQ ID NO: 1684790 - RNA, 14 nt, Salmonella enterica enterica serovar Typhi
agcucugugugacg

SEQ ID NO: 1684791 - RNA, 20 nt, Salmonella enterica enterica serovar Typhi
agcucuucaggcguauauuc

SEQ ID NO: 1684792 - RNA, 16 nt, Salmonella enterica enterica serovar Typhi
agcucuucaauuucca

SEQ ID NO: 1684793 - RNA, 22 nt, Salmonella enterica enterica serovar Typhi
agcuccgcguauucucaaccag

SEQ ID NO: 1684794 - RNA, 19 nt, Salmonella enterica enterica serovar Typhi
agcuccgcaaagcccauca

SEQ ID NO: 1684795 - RNA, 22 nt, Salmonella enterica enterica serovar Typhi
agcucauguagucauauugcgc

SEQ ID NO: 1684796 - RNA, 13 nt, Salmonella enterica enterica serovar Typhi
agcucauuuuuac

SEQ ID NO: 1684797 - RNA, 21 nt, Salmonella enterica enterica serovar Typhi
agcuccuuucggacuuccugu

SEQ ID NO: 1684798 - RNA, 18 nt, Salmonella enterica enterica serovar Typhi
agcuccuuuuaauaaaga

SEQ ID NO: 1684799 - RNA, 23 nt, Salmonella enterica enterica serovar Typhi
agcgguugcauaaaauccuggua

SEQ ID NO: 1684800 - RNA, 19 nt, Salmonella enterica enterica serovar Typhi
agcguaaauagcccggauc

SEQ ID NO: 1684801 - RNA, 23 nt, Salmonella enterica enterica serovar Typhi
agcguccaguccugucccugcca

SEQ ID NO: 1684802 - RNA, 18 nt, Salmonella enterica enterica serovar Typhi
agcguccgccaucgccuc

SEQ ID NO: 1684803 - RNA, 15 nt, Salmonella enterica enterica serovar Typhi
agcguccaguccugu

SEQ ID NO: 1684804 - RNA, 20 nt, Salmonella enterica enterica serovar Typhi
agcguccaguccugucccug

SEQ ID NO: 1684805 - RNA, 22 nt, Salmonella enterica enterica serovar Typhi
agcgucgccagaaccccugcca

SEQ ID NO: 1684806 - RNA, 21 nt, Salmonella enterica enterica serovar Typhi
agcguccgggcaagcccggua

SEQ ID NO: 1684807 - RNA, 19 nt, Salmonella enterica enterica serovar Typhi
agcguccguucugauacuc

SEQ ID NO: 1684808 - RNA, 21 nt, Salmonella enterica enterica serovar Typhi
agcgucaggcgaaguuccggg

SEQ ID NO: 1684809 - RNA, 19 nt, Salmonella enterica enterica serovar Typhi
agcgucagacacaauauug

SEQ ID NO: 1684810 - RNA, 23 nt, Salmonella enterica enterica serovar Typhi
agcgucagcccuucuuuaugcgc

SEQ ID NO: 1684811 - RNA, 13 nt, Salmonella enterica enterica serovar Typhi
agcgucagcaugg

SEQ ID NO: 1684812 - RNA, 13 nt, Salmonella enterica enterica serovar Typhi
agcggguaaacag

SEQ ID NO: 1684813 - RNA, 18 nt, Salmonella enterica enterica serovar Typhi
agcgggucccagaagaaa

SEQ ID NO: 1684814 - RNA, 18 nt, Salmonella enterica enterica serovar Typhi
agcgguaagagccagacg

SEQ ID NO: 1684815 - RNA, 22 nt, Salmonella enterica enterica serovar Typhi
agcgggugcauuuucaccugga

SEQ ID NO: 1684816 - RNA, 15 nt, Salmonella enterica enterica serovar Typhi
agcggcaccagcacg

SEQ ID NO: 1684817 - RNA, 22 nt, Salmonella enterica enterica serovar Typhi
agcggcagaucguuuacgaccu

SEQ ID NO: 1684818 - RNA, 15 nt, Salmonella enterica enterica serovar Typhi
agcggcaaucgccuc

SEQ ID NO: 1684819 - RNA, 14 nt, Salmonella enterica enterica serovar Typhi
agcggcaagacaga

SEQ ID NO: 1684820 - RNA, 19 nt, Salmonella enterica enterica serovar Typhi
agcggcaggauccccaucc

SEQ ID NO: 1684821 - RNA, 20 nt, Salmonella enterica enterica serovar Typhi
agcguucucacggucuccug

SEQ ID NO: 1684822 - RNA, 17 nt, Salmonella enterica enterica serovar Typhi
agcguucuuuccaguuc

SEQ ID NO: 1684823 - RNA, 15 nt, Salmonella enterica enterica serovar Typhi
agcguuucgccguaa

SEQ ID NO: 1684824 - RNA, 19 nt, Salmonella enterica enterica serovar Typhi
agcguuugacggauuuuuu

SEQ ID NO: 1684825 - RNA, 19 nt, Salmonella enterica enterica serovar Typhi
agcguuuauguuugcugau

SEQ ID NO: 1684826 - RNA, 21 nt, Salmonella enterica enterica serovar Typhi
agcguuuuauccguuuccgca

SEQ ID NO: 1684827 - RNA, 19 nt, Salmonella enterica enterica serovar Typhi
agcguuuaaaaagcugcau

SEQ ID NO: 1684828 - RNA, 22 nt, Salmonella enterica enterica serovar Typhi
agcgugaaaagcuuagaacuca

SEQ ID NO: 1684829 - RNA, 15 nt, Salmonella enterica enterica serovar Typhi
agcgugacccagaca

SEQ ID NO: 1684830 - RNA, 20 nt, Salmonella enterica enterica serovar Typhi
agcgugacgaccggcacggu

SEQ ID NO: 1684831 - RNA, 17 nt, Salmonella enterica enterica serovar Typhi
agcgucgcgauccugcc

SEQ ID NO: 1684832 - RNA, 18 nt, Salmonella enterica enterica serovar Typhi
agcgugcaaccccuugcg

SEQ ID NO: 1684833 - RNA, 19 nt, Salmonella enterica enterica serovar Typhi
agcuaaauaaaaauaauca

SEQ ID NO: 1684834 - RNA, 13 nt, Salmonella enterica enterica serovar Typhi
agcuaaaaacagc

SEQ ID NO: 1684835 - RNA, 22 nt, Salmonella enterica enterica serovar Typhi
agcuagccaauaaucgaaauaa

SEQ ID NO: 1684836 - RNA, 18 nt, Salmonella enterica enterica serovar Typhi
agcgcgucagcgccuccg

SEQ ID NO: 1684837 - RNA, 17 nt, Salmonella enterica enterica serovar Typhi
agcgcguaggccagaug

SEQ ID NO: 1684838 - RNA, 21 nt, Salmonella enterica enterica serovar Typhi
agcgcguaaauaccuucuggc

SEQ ID NO: 1684839 - RNA, 19 nt, Salmonella enterica enterica serovar Typhi
agcgcgguuucuauuaaau

SEQ ID NO: 1684840 - RNA, 14 nt, Salmonella enterica enterica serovar Typhi
agcgcguucagggu

SEQ ID NO: 1684841 - RNA, 19 nt, Salmonella enterica enterica serovar Typhi
agcgcguucgccgucacgc

SEQ ID NO: 1684842 - RNA, 15 nt, Salmonella enterica enterica serovar Typhi
agcgcuaacgcgaag

SEQ ID NO: 1684843 - RNA, 14 nt, Salmonella enterica enterica serovar Typhi
agcgcuaagcaaca

SEQ ID NO: 1684844 - RNA, 18 nt, Salmonella enterica enterica serovar Typhi
agcgcgucguugccuuug

SEQ ID NO: 1684845 - RNA, 15 nt, Salmonella enterica enterica serovar Typhi
agcgccuuuuaaggu

SEQ ID NO: 1684846 - RNA, 16 nt, Salmonella enterica enterica serovar Typhi
agcgcgaacaggcugg

SEQ ID NO: 1684847 - RNA, 14 nt, Salmonella enterica enterica serovar Typhi
agcgccuucaggca

SEQ ID NO: 1684848 - RNA, 14 nt, Salmonella enterica enterica serovar Typhi
agcgccuguagcgu

SEQ ID NO: 1684849 - RNA, 20 nt, Salmonella enterica enterica serovar Typhi
agcgccugugcuuucgccac

SEQ ID NO: 1684850 - RNA, 17 nt, Salmonella enterica enterica serovar Typhi
agcgccuguucaacaug

SEQ ID NO: 1684851 - RNA, 14 nt, Salmonella enterica enterica serovar Typhi
agcgcgacauagag

SEQ ID NO: 1684852 - RNA, 15 nt, Salmonella enterica enterica serovar Typhi
agcgcgaaucgccuc

SEQ ID NO: 1684853 - RNA, 20 nt, Salmonella enterica enterica serovar Typhi
agcgcgagagucaaggcauc

SEQ ID NO: 1684854 - RNA, 14 nt, Salmonella enterica enterica serovar Typhi
agcgcgaccgguuu

SEQ ID NO: 1684855 - RNA, 23 nt, Salmonella enterica enterica serovar Typhi
agcgcgaauuuuauuaagcaggc

SEQ ID NO: 1684856 - RNA, 14 nt, Salmonella enterica enterica serovar Typhi
agcgcuuucuucuu

SEQ ID NO: 1684857 - RNA, 14 nt, Salmonella enterica enterica serovar Typhi
agcgcuugugccug

SEQ ID NO: 1684858 - RNA, 16 nt, Salmonella enterica enterica serovar Typhi
agcgcuuugccgcugc

SEQ ID NO: 1684859 - RNA, 21 nt, Salmonella enterica enterica serovar Typhi
agcgcuuuggaggucauuauu

SEQ ID NO: 1684860 - RNA, 23 nt, Salmonella enterica enterica serovar Typhi
agcgcuuuccagucccugaagaa

SEQ ID NO: 1684861 - RNA, 13 nt, Salmonella enterica enterica serovar Typhi
agcgcuuuugccg

SEQ ID NO: 1684862 - RNA, 22 nt, Salmonella enterica enterica serovar Typhi
agcgcuuuccugcguauauuua

SEQ ID NO: 1684863 - RNA, 16 nt, Salmonella enterica enterica serovar Typhi
agcgcuucgcuugccc

SEQ ID NO: 1684864 - RNA, 18 nt, Salmonella enterica enterica serovar Typhi
agcgcuccgggguucuuu

SEQ ID NO: 1684865 - RNA, 22 nt, Salmonella enterica enterica serovar Typhi
agcgcuucuaacgaaacagauu

SEQ ID NO: 1684866 - RNA, 22 nt, Salmonella enterica enterica serovar Typhi
agcgcuuacccgaccgacaaaa

SEQ ID NO: 1684867 - RNA, 16 nt, Salmonella enterica enterica serovar Typhi
agcgcuucgccugccg

SEQ ID NO: 1684868 - RNA, 12 nt, Salmonella enterica enterica serovar Typhi
agcgcuccccac

SEQ ID NO: 1684869 - RNA, 16 nt, Salmonella enterica enterica serovar Typhi
agcgcucaaucagcgc

SEQ ID NO: 1684870 - RNA, 14 nt, Salmonella enterica enterica serovar Typhi
agcgcucaggcagc

SEQ ID NO: 1684871 - RNA, 13 nt, Salmonella enterica enterica serovar Typhi
agcgccgccaaga

SEQ ID NO: 1684872 - RNA, 14 nt, Salmonella enterica enterica serovar Typhi
agcgccgccaagau

SEQ ID NO: 1684873 - RNA, 15 nt, Salmonella enterica enterica serovar Typhi
agcgcccuggucagc

SEQ ID NO: 1684874 - RNA, 23 nt, Salmonella enterica enterica serovar Typhi
agcgccgccagaaucaccucuuu

SEQ ID NO: 1684875 - RNA, 17 nt, Salmonella enterica enterica serovar Typhi
agcgccgccagauaaag

SEQ ID NO: 1684876 - RNA, 22 nt, Salmonella enterica enterica serovar Typhi
agcgccccucuugcagcaagaa

SEQ ID NO: 1684877 - RNA, 13 nt, Salmonella enterica enterica serovar Typhi
agcgccauugcua

SEQ ID NO: 1684878 - RNA, 20 nt, Salmonella enterica enterica serovar Typhi
agcgccauccggcacacaga

SEQ ID NO: 1684879 - RNA, 15 nt, Salmonella enterica enterica serovar Typhi
agcgcccccagcaaa

SEQ ID NO: 1684880 - RNA, 22 nt, Salmonella enterica enterica serovar Typhi
agcgcccgguucaucggcucga

SEQ ID NO: 1684881 - RNA, 21 nt, Salmonella enterica enterica serovar Typhi
agcgcccgcuguccgcccagu

SEQ ID NO: 1684882 - RNA, 16 nt, Salmonella enterica enterica serovar Typhi
agcgccguuaaacugc

SEQ ID NO: 1684883 - RNA, 21 nt, Salmonella enterica enterica serovar Typhi
agcgccgucauggcaaacgaa

SEQ ID NO: 1684884 - RNA, 15 nt, Salmonella enterica enterica serovar Typhi
agcgccgguuucucc

SEQ ID NO: 1684885 - RNA, 20 nt, Salmonella enterica enterica serovar Typhi
agcgccggcagcaguucuuc

SEQ ID NO: 1684886 - RNA, 19 nt, Salmonella enterica enterica serovar Typhi
agcgccggaucgggcuucc

SEQ ID NO: 1684887 - RNA, 15 nt, Salmonella enterica enterica serovar Typhi
agcgccggcagcagu

SEQ ID NO: 1684888 - RNA, 20 nt, Salmonella enterica enterica serovar Typhi
agcgccggaugaggacauaa

SEQ ID NO: 1684889 - RNA, 16 nt, Salmonella enterica enterica serovar Typhi
agcgccggcaaagcca

SEQ ID NO: 1684890 - RNA, 18 nt, Salmonella enterica enterica serovar Typhi
agcgccgcgcgaucaauc

SEQ ID NO: 1684891 - RNA, 19 nt, Salmonella enterica enterica serovar Typhi
agcgccucugauuuuucca

SEQ ID NO: 1684892 - RNA, 16 nt, Salmonella enterica enterica serovar Typhi
agcgccugcugcgcaa

SEQ ID NO: 1684893 - RNA, 20 nt, Salmonella enterica enterica serovar Typhi
agcgccugcugcgcaacauc

SEQ ID NO: 1684894 - RNA, 22 nt, Salmonella enterica enterica serovar Typhi
agcgccuguaaacguuccugcc

SEQ ID NO: 1684895 - RNA, 22 nt, Salmonella enterica enterica serovar Typhi
agcgccugcuguaaaauauccc

SEQ ID NO: 1684896 - RNA, 23 nt, Salmonella enterica enterica serovar Typhi
agcgccuccgcguagcccagcgc

SEQ ID NO: 1684897 - RNA, 16 nt, Salmonella enterica enterica serovar Typhi
agcgccucugauuuuu

SEQ ID NO: 1684898 - RNA, 13 nt, Salmonella enterica enterica serovar Typhi
agcgcaaggccga

SEQ ID NO: 1684899 - RNA, 11 nt, Salmonella enterica enterica serovar Typhi
agcgcaaugcu

SEQ ID NO: 1684900 - RNA, 14 nt, Salmonella enterica enterica serovar Typhi
agcgauuuauccac

SEQ ID NO: 1684901 - RNA, 22 nt, Salmonella enterica enterica serovar Typhi
agcgcaccugccccgcucgaaa

SEQ ID NO: 1684902 - RNA, 23 nt, Salmonella enterica enterica serovar Typhi
agcgcacuguuugcugacaaucu

SEQ ID NO: 1684903 - RNA, 13 nt, Salmonella enterica enterica serovar Typhi
agcgaugcgcgcg

SEQ ID NO: 1684904 - RNA, 15 nt, Salmonella enterica enterica serovar Typhi
agcgaucgagauaag

SEQ ID NO: 1684905 - RNA, 17 nt, Salmonella enterica enterica serovar Typhi
agcgaucgagauaagau

SEQ ID NO: 1684906 - RNA, 23 nt, Salmonella enterica enterica serovar Typhi
agcgaugacgccugccagauagu

SEQ ID NO: 1684907 - RNA, 22 nt, Salmonella enterica enterica serovar Typhi
agcgaugagcgccagcaacagc

SEQ ID NO: 1684908 - RNA, 14 nt, Salmonella enterica enterica serovar Typhi
agcgauagacuguu

SEQ ID NO: 1684909 - RNA, 15 nt, Salmonella enterica enterica serovar Typhi
agcgauauuucuccg

SEQ ID NO: 1684910 - RNA, 18 nt, Salmonella enterica enterica serovar Typhi
agcgauagucguugcgcc

SEQ ID NO: 1684911 - RNA, 17 nt, Salmonella enterica enterica serovar Typhi
agcgaucauaagggagc

SEQ ID NO: 1684912 - RNA, 21 nt, Salmonella enterica enterica serovar Typhi
agcgaguacguaaugugaaaa

SEQ ID NO: 1684913 - RNA, 11 nt, Salmonella enterica enterica serovar Typhi
agcgagucaga

SEQ ID NO: 1684914 - RNA, 16 nt, Salmonella enterica enterica serovar Typhi
agcgcauuugcggcgu

SEQ ID NO: 1684915 - RNA, 23 nt, Salmonella enterica enterica serovar Typhi
agcgccaaaaagaaaaaagugau

SEQ ID NO: 1684916 - RNA, 14 nt, Salmonella enterica enterica serovar Typhi
agcgccaccacaaa

SEQ ID NO: 1684917 - RNA, 13 nt, Salmonella enterica enterica serovar Typhi
agcgccagugacg

SEQ ID NO: 1684918 - RNA, 14 nt, Salmonella enterica enterica serovar Typhi
agcgccagugacgc

SEQ ID NO: 1684919 - RNA, 20 nt, Salmonella enterica enterica serovar Typhi
agcgccaguuuuuccuguuc

SEQ ID NO: 1684920 - RNA, 22 nt, Salmonella enterica enterica serovar Typhi
agcgccauaaaaaacaccuguc

SEQ ID NO: 1684921 - RNA, 18 nt, Salmonella enterica enterica serovar Typhi
agcgccauauaaauaggc

SEQ ID NO: 1684922 - RNA, 14 nt, Salmonella enterica enterica serovar Typhi
agcgccauauugcu

SEQ ID NO: 1684923 - RNA, 16 nt, Salmonella enterica enterica serovar Typhi
agcgccauauugcugu

SEQ ID NO: 1684924 - RNA, 17 nt, Salmonella enterica enterica serovar Typhi
agcgccaucaggcaaug

SEQ ID NO: 1684925 - RNA, 21 nt, Salmonella enterica enterica serovar Typhi
agcgccaucaggcaugccaaa

SEQ ID NO: 1684926 - RNA, 14 nt, Salmonella enterica enterica serovar Typhi
agcgccagcuccau

SEQ ID NO: 1684927 - RNA, 13 nt, Salmonella enterica enterica serovar Typhi
agcgccagcucca

SEQ ID NO: 1684928 - RNA, 16 nt, Salmonella enterica enterica serovar Typhi
agcgccagcgguguuu

SEQ ID NO: 1684929 - RNA, 17 nt, Salmonella enterica enterica serovar Typhi
agcgccagcgccaccug

SEQ ID NO: 1684930 - RNA, 13 nt, Salmonella enterica enterica serovar Typhi
agcgccagcaugg

SEQ ID NO: 1684931 - RNA, 15 nt, Salmonella enterica enterica serovar Typhi
agcgccagcgacaga

SEQ ID NO: 1684932 - RNA, 12 nt, Salmonella enterica enterica serovar Typhi
agcgccagcagc

SEQ ID NO: 1684933 - RNA, 13 nt, Salmonella enterica enterica serovar Typhi
agcgccagcagca

SEQ ID NO: 1684934 - RNA, 17 nt, Salmonella enterica enterica serovar Typhi
agcgccacggagcauaa

SEQ ID NO: 1684935 - RNA, 23 nt, Salmonella enterica enterica serovar Typhi
agcgccacgcgaugcaaccccug

SEQ ID NO: 1684936 - RNA, 17 nt, Salmonella enterica enterica serovar Typhi
agcgccacccauuuucc

SEQ ID NO: 1684937 - RNA, 14 nt, Salmonella enterica enterica serovar Typhi
agcgccacccgaca

SEQ ID NO: 1684938 - RNA, 17 nt, Salmonella enterica enterica serovar Typhi
agcccgcccagcauuac

SEQ ID NO: 1684939 - RNA, 16 nt, Salmonella enterica enterica serovar Typhi
agcccgcccacaggcu

SEQ ID NO: 1684940 - RNA, 16 nt, Salmonella enterica enterica serovar Typhi
agccccucuuauugag

SEQ ID NO: 1684941 - RNA, 17 nt, Salmonella enterica enterica serovar Typhi
agccccggucaacgcgc

SEQ ID NO: 1684942 - RNA, 15 nt, Salmonella enterica enterica serovar Typhi
agccccugacgcugc

SEQ ID NO: 1684943 - RNA, 20 nt, Salmonella enterica enterica serovar Typhi
agcccuauuaggcacuacca

SEQ ID NO: 1684944 - RNA, 14 nt, Salmonella enterica enterica serovar Typhi
agcccgucccuucc

SEQ ID NO: 1684945 - RNA, 16 nt, Salmonella enterica enterica serovar Typhi
agcccgucccuuccgc

SEQ ID NO: 1684946 - RNA, 21 nt, Salmonella enterica enterica serovar Typhi
agcccgucuuuuuccugcaug

SEQ ID NO: 1684947 - RNA, 21 nt, Salmonella enterica enterica serovar Typhi
agcccguccagauaaugauca

SEQ ID NO: 1684948 - RNA, 22 nt, Salmonella enterica enterica serovar Typhi
agcccggccacagcgccagaca

SEQ ID NO: 1684949 - RNA, 18 nt, Salmonella enterica enterica serovar Typhi
agcccggcggaggccauu

SEQ ID NO: 1684950 - RNA, 21 nt, Salmonella enterica enterica serovar Typhi
agcccggcauguccaucagau

SEQ ID NO: 1684951 - RNA, 17 nt, Salmonella enterica enterica serovar Typhi
agcccggccacagcgcc

SEQ ID NO: 1684952 - RNA, 21 nt, Salmonella enterica enterica serovar Typhi
agcccggaaauaaacgccagu

SEQ ID NO: 1684953 - RNA, 19 nt, Salmonella enterica enterica serovar Typhi
agcccaauaucccuauuag

SEQ ID NO: 1684954 - RNA, 14 nt, Salmonella enterica enterica serovar Typhi
agcccacacaucac

SEQ ID NO: 1684955 - RNA, 15 nt, Salmonella enterica enterica serovar Typhi
agccauuuuaaaaau

SEQ ID NO: 1684956 - RNA, 23 nt, Salmonella enterica enterica serovar Typhi
agcccacuggcaaguaugaaaag

SEQ ID NO: 1684957 - RNA, 12 nt, Salmonella enterica enterica serovar Typhi
agcccagcucag

SEQ ID NO: 1684958 - RNA, 17 nt, Salmonella enterica enterica serovar Typhi
agcccagcucauaggau

SEQ ID NO: 1684959 - RNA, 18 nt, Salmonella enterica enterica serovar Typhi
agcccagguagaauccca

SEQ ID NO: 1684960 - RNA, 21 nt, Salmonella enterica enterica serovar Typhi
agcccauggcaggcagcacaa

SEQ ID NO: 1684961 - RNA, 20 nt, Salmonella enterica enterica serovar Typhi
agcccaguaauauccccauc

SEQ ID NO: 1684962 - RNA, 21 nt, Salmonella enterica enterica serovar Typhi
agcccauaaagcacuggugga

SEQ ID NO: 1684963 - RNA, 15 nt, Salmonella enterica enterica serovar Typhi
agcccauaaagcacu

SEQ ID NO: 1684964 - RNA, 13 nt, Salmonella enterica enterica serovar Typhi
agccccagcacca

SEQ ID NO: 1684965 - RNA, 13 nt, Salmonella enterica enterica serovar Typhi
agccccagcgcca

SEQ ID NO: 1684966 - RNA, 18 nt, Salmonella enterica enterica serovar Typhi
agccccagcgccagcgac

SEQ ID NO: 1684967 - RNA, 21 nt, Salmonella enterica enterica serovar Typhi
agccccauaaccgaugcacau

SEQ ID NO: 1684968 - RNA, 18 nt, Salmonella enterica enterica serovar Typhi
agccgcccaucccuaaua

SEQ ID NO: 1684969 - RNA, 23 nt, Salmonella enterica enterica serovar Typhi
agccgcccgcgauaaaaauccug

SEQ ID NO: 1684970 - RNA, 14 nt, Salmonella enterica enterica serovar Typhi
agccgcccacaacc

SEQ ID NO: 1684971 - RNA, 12 nt, Salmonella enterica enterica serovar Typhi
agccgcccaucc

SEQ ID NO: 1684972 - RNA, 21 nt, Salmonella enterica enterica serovar Typhi
agccgccauccggcacaguau

SEQ ID NO: 1684973 - RNA, 16 nt, Salmonella enterica enterica serovar Typhi
agccgccauccggcac

SEQ ID NO: 1684974 - RNA, 22 nt, Salmonella enterica enterica serovar Typhi
agccgccaggcaaucagcagcc

SEQ ID NO: 1684975 - RNA, 14 nt, Salmonella enterica enterica serovar Typhi
agccgcgcgccgcc

SEQ ID NO: 1684976 - RNA, 20 nt, Salmonella enterica enterica serovar Typhi
agccgcgccaucuccuccuc

SEQ ID NO: 1684977 - RNA, 20 nt, Salmonella enterica enterica serovar Typhi
agccgcgcccuaacaggcgc

SEQ ID NO: 1684978 - RNA, 16 nt, Salmonella enterica enterica serovar Typhi
agccgcgcauagcugg

SEQ ID NO: 1684979 - RNA, 18 nt, Salmonella enterica enterica serovar Typhi
agccgcuguuuuucauca

SEQ ID NO: 1684980 - RNA, 16 nt, Salmonella enterica enterica serovar Typhi
agccgcggaccuuuug

SEQ ID NO: 1684981 - RNA, 16 nt, Salmonella enterica enterica serovar Typhi
agccggauuuuaaauu

SEQ ID NO: 1684982 - RNA, 18 nt, Salmonella enterica enterica serovar Typhi
agccggauaaaauuauuu

SEQ ID NO: 1684983 - RNA, 13 nt, Salmonella enterica enterica serovar Typhi
agccggagguuuu

SEQ ID NO: 1684984 - RNA, 16 nt, Salmonella enterica enterica serovar Typhi
agccgcuuuccgccgc

SEQ ID NO: 1684985 - RNA, 19 nt, Salmonella enterica enterica serovar Typhi
agccggaaucauucuacaa

SEQ ID NO: 1684986 - RNA, 15 nt, Salmonella enterica enterica serovar Typhi
agccggaaaagcgcu

SEQ ID NO: 1684987 - RNA, 17 nt, Salmonella enterica enterica serovar Typhi
agccggaaaagcgcugg

SEQ ID NO: 1684988 - RNA, 23 nt, Salmonella enterica enterica serovar Typhi
agcccuuugagaaaacugcgccc

SEQ ID NO: 1684989 - RNA, 15 nt, Salmonella enterica enterica serovar Typhi
agccgaacucuucca

SEQ ID NO: 1684990 - RNA, 17 nt, Salmonella enterica enterica serovar Typhi
agcccugugccgcuggu

SEQ ID NO: 1684991 - RNA, 19 nt, Salmonella enterica enterica serovar Typhi
agcccuuaucgccccagcc

SEQ ID NO: 1684992 - RNA, 20 nt, Salmonella enterica enterica serovar Typhi
agccgaaguuccccguggcc

SEQ ID NO: 1684993 - RNA, 19 nt, Salmonella enterica enterica serovar Typhi
agccgaccaucgcgccgcu

SEQ ID NO: 1684994 - RNA, 21 nt, Salmonella enterica enterica serovar Typhi
agccgaccaucgcgccgcugg

SEQ ID NO: 1684995 - RNA, 16 nt, Salmonella enterica enterica serovar Typhi
agccgacuaucuucuu

SEQ ID NO: 1684996 - RNA, 14 nt, Salmonella enterica enterica serovar Typhi
agccgaccuggcgg

SEQ ID NO: 1684997 - RNA, 13 nt, Salmonella enterica enterica serovar Typhi
agccgcagaacca

SEQ ID NO: 1684998 - RNA, 15 nt, Salmonella enterica enterica serovar Typhi
agccgccaccacaaa

SEQ ID NO: 1684999 - RNA, 22 nt, Salmonella enterica enterica serovar Typhi
agccgauuuuucggcacgcugg

SEQ ID NO: 1685000 - RNA, 16 nt, Salmonella enterica enterica serovar Typhi
agccuucaaguuuuag

SEQ ID NO: 1685001 - RNA, 17 nt, Salmonella enterica enterica serovar Typhi
agccuuauaagaaccau

SEQ ID NO: 1685002 - RNA, 13 nt, Salmonella enterica enterica serovar Typhi
agccuucaacaaa

SEQ ID NO: 1685003 - RNA, 18 nt, Salmonella enterica enterica serovar Typhi
agccuuccuggucugcca

SEQ ID NO: 1685004 - RNA, 22 nt, Salmonella enterica enterica serovar Typhi
agccuucccggggaacagaagc

SEQ ID NO: 1685005 - RNA, 16 nt, Salmonella enterica enterica serovar Typhi
agccuguuccagcugc

SEQ ID NO: 1685006 - RNA, 22 nt, Salmonella enterica enterica serovar Typhi
agccuuaaucaacugcgccaca

SEQ ID NO: 1685007 - RNA, 19 nt, Salmonella enterica enterica serovar Typhi
agccuguuuggacacggac

SEQ ID NO: 1685008 - RNA, 12 nt, Salmonella enterica enterica serovar Typhi
agccuuauaaga

SEQ ID NO: 1685009 - RNA, 23 nt, Salmonella enterica enterica serovar Typhi
agccuggugcccaaccugcgcag

SEQ ID NO: 1685010 - RNA, 21 nt, Salmonella enterica enterica serovar Typhi
agccuggauagcaauuucagc

SEQ ID NO: 1685011 - RNA, 16 nt, Salmonella enterica enterica serovar Typhi
agcgaaacugauauua

SEQ ID NO: 1685012 - RNA, 19 nt, Salmonella enterica enterica serovar Typhi
agcgaaaauaaacgcuuga

SEQ ID NO: 1685013 - RNA, 15 nt, Salmonella enterica enterica serovar Typhi
agcgaaaugcgaauc

SEQ ID NO: 1685014 - RNA, 14 nt, Salmonella enterica enterica serovar Typhi
agccuuuccgcaug

SEQ ID NO: 1685015 - RNA, 16 nt, Salmonella enterica enterica serovar Typhi
agcgagaugaaaaguc

SEQ ID NO: 1685016 - RNA, 14 nt, Salmonella enterica enterica serovar Typhi
agcgagacgcugga

SEQ ID NO: 1685017 - RNA, 15 nt, Salmonella enterica enterica serovar Typhi
agcgagguaaaaagc

SEQ ID NO: 1685018 - RNA, 22 nt, Salmonella enterica enterica serovar Typhi
agcgacgguuuuauccccuuca

SEQ ID NO: 1685019 - RNA, 21 nt, Salmonella enterica enterica serovar Typhi
agcgacgguccuggccaggcu

SEQ ID NO: 1685020 - RNA, 14 nt, Salmonella enterica enterica serovar Typhi
agcgacggcgcugg

SEQ ID NO: 1685021 - RNA, 21 nt, Salmonella enterica enterica serovar Typhi
agcgacguugucuucaucuau

SEQ ID NO: 1685022 - RNA, 23 nt, Salmonella enterica enterica serovar Typhi
agcgacucauucagcaacugcgu

SEQ ID NO: 1685023 - RNA, 21 nt, Salmonella enterica enterica serovar Typhi
agcgacaccugaucuguaggc

SEQ ID NO: 1685024 - RNA, 17 nt, Salmonella enterica enterica serovar Typhi
agcgacacuccgcgcau

SEQ ID NO: 1685025 - RNA, 18 nt, Salmonella enterica enterica serovar Typhi
agcgacaucgucacaaua

SEQ ID NO: 1685026 - RNA, 15 nt, Salmonella enterica enterica serovar Typhi
agcgacagcccggcg

SEQ ID NO: 1685027 - RNA, 22 nt, Salmonella enterica enterica serovar Typhi
agcgaauugccgucgccggaau

SEQ ID NO: 1685028 - RNA, 15 nt, Salmonella enterica enterica serovar Typhi
agcgaaugcgcgcca

SEQ ID NO: 1685029 - RNA, 18 nt, Salmonella enterica enterica serovar Typhi
agcgaauaacauaauauu

SEQ ID NO: 1685030 - RNA, 14 nt, Salmonella enterica enterica serovar Typhi
agcgaaccuuccau

SEQ ID NO: 1685031 - RNA, 19 nt, Salmonella enterica enterica serovar Typhi
agcgaacguccagcggcca

SEQ ID NO: 1685032 - RNA, 20 nt, Salmonella enterica enterica serovar Typhi
agcgaagaagucagugcuga

SEQ ID NO: 1685033 - RNA, 23 nt, Salmonella enterica enterica serovar Typhi
agcgaacaguacggucaggcuca

SEQ ID NO: 1685034 - RNA, 22 nt, Salmonella enterica enterica serovar Typhi
agccuaaugggccagauucuua

SEQ ID NO: 1685035 - RNA, 14 nt, Salmonella enterica enterica serovar Typhi
agccuaccugccgc

SEQ ID NO: 1685036 - RNA, 16 nt, Salmonella enterica enterica serovar Typhi
agccuaccugccgcca

SEQ ID NO: 1685037 - RNA, 24 nt, Salmonella enterica enterica serovar Typhi
agccuaucgccauauacgccacgg

SEQ ID NO: 1685038 - RNA, 13 nt, Salmonella enterica enterica serovar Typhi
agccuauuaucag

SEQ ID NO: 1685039 - RNA, 23 nt, Salmonella enterica enterica serovar Typhi
agccucauuuuugaguuugucau

SEQ ID NO: 1685040 - RNA, 17 nt, Salmonella enterica enterica serovar Typhi
agccugagcgcgaggca

SEQ ID NO: 1685041 - RNA, 21 nt, Salmonella enterica enterica serovar Typhi
agccugacuacgucagauggg

SEQ ID NO: 1685042 - RNA, 18 nt, Salmonella enterica enterica serovar Typhi
agccugauacuuuuacuc

SEQ ID NO: 1685043 - RNA, 21 nt, Salmonella enterica enterica serovar Typhi
agccugcgcguaaauuucacu

SEQ ID NO: 1685044 - RNA, 20 nt, Salmonella enterica enterica serovar Typhi
agccugcccugcggcaggca

SEQ ID NO: 1685045 - RNA, 18 nt, Salmonella enterica enterica serovar Typhi
agccugaagccagcaauc

SEQ ID NO: 1685046 - RNA, 17 nt, Salmonella enterica enterica serovar Typhi
agccugacgaauagcgc

SEQ ID NO: 1685047 - RNA, 11 nt, Salmonella enterica enterica serovar Typhi
agccucuuuca

SEQ ID NO: 1685048 - RNA, 14 nt, Salmonella enterica enterica serovar Typhi
agccguuucuuguc

SEQ ID NO: 1685049 - RNA, 15 nt, Salmonella enterica enterica serovar Typhi
agccguucuccagcg

SEQ ID NO: 1685050 - RNA, 15 nt, Salmonella enterica enterica serovar Typhi
agccguuaccgccga

SEQ ID NO: 1685051 - RNA, 17 nt, Salmonella enterica enterica serovar Typhi
agccguuaccgccgagc

SEQ ID NO: 1685052 - RNA, 23 nt, Salmonella enterica enterica serovar Typhi
agccguucaccagccacugcgcc

SEQ ID NO: 1685053 - RNA, 22 nt, Salmonella enterica enterica serovar Typhi
agccgugccugcuccgccaggg

SEQ ID NO: 1685054 - RNA, 21 nt, Salmonella enterica enterica serovar Typhi
agccgguguuaaccagauaag

SEQ ID NO: 1685055 - RNA, 18 nt, Salmonella enterica enterica serovar Typhi
agccgguuuauccgcaac

SEQ ID NO: 1685056 - RNA, 19 nt, Salmonella enterica enterica serovar Typhi
agccguaacuaugccagaa

SEQ ID NO: 1685057 - RNA, 21 nt, Salmonella enterica enterica serovar Typhi
agccgucgauaaaauccucua

SEQ ID NO: 1685058 - RNA, 19 nt, Salmonella enterica enterica serovar Typhi
agccgggcgggaaccugcu

SEQ ID NO: 1685059 - RNA, 14 nt, Salmonella enterica enterica serovar Typhi
agccggcggaaaaa

SEQ ID NO: 1685060 - RNA, 18 nt, Salmonella enterica enterica serovar Typhi
aguacggcgcgaaucccg

SEQ ID NO: 1685061 - RNA, 15 nt, Salmonella enterica enterica serovar Typhi
aguacgggcagaugg

SEQ ID NO: 1685062 - RNA, 22 nt, Salmonella enterica enterica serovar Typhi
aguacgauagcaauuaauaaac

SEQ ID NO: 1685063 - RNA, 15 nt, Salmonella enterica enterica serovar Typhi
aguacgcaaggaaau

SEQ ID NO: 1685064 - RNA, 15 nt, Salmonella enterica enterica serovar Typhi
aguacgcgaccgccg

SEQ ID NO: 1685065 - RNA, 22 nt, Salmonella enterica enterica serovar Typhi
aguacgcccgugacgccaggca

SEQ ID NO: 1685066 - RNA, 16 nt, Salmonella enterica enterica serovar Typhi
agcuggccuucuccac

SEQ ID NO: 1685067 - RNA, 21 nt, Salmonella enterica enterica serovar Typhi
agcuggcgagaaagugguggg

SEQ ID NO: 1685068 - RNA, 21 nt, Salmonella enterica enterica serovar Typhi
agcuggcaagaccgauagaga

SEQ ID NO: 1685069 - RNA, 15 nt, Salmonella enterica enterica serovar Typhi
aguacugaccagaca

SEQ ID NO: 1685070 - RNA, 16 nt, Salmonella enterica enterica serovar Typhi
aguacuuucuuuugau

SEQ ID NO: 1685071 - RNA, 16 nt, Salmonella enterica enterica serovar Typhi
aguacuucacaaucag

SEQ ID NO: 1685072 - RNA, 14 nt, Salmonella enterica enterica serovar Typhi
aguagaucaccagc

SEQ ID NO: 1685073 - RNA, 15 nt, Salmonella enterica enterica serovar Typhi
aguagcguucuuucc

SEQ ID NO: 1685074 - RNA, 19 nt, Salmonella enterica enterica serovar Typhi
aguagcccugacgaacaga

SEQ ID NO: 1685075 - RNA, 20 nt, Salmonella enterica enterica serovar Typhi
aguagcugagcgucaggcgc

SEQ ID NO: 1685076 - RNA, 16 nt, Salmonella enterica enterica serovar Typhi
aguaggcaugcacucc

SEQ ID NO: 1685077 - RNA, 20 nt, Salmonella enterica enterica serovar Typhi
aguagcguucuuuccaguuc

SEQ ID NO: 1685078 - RNA, 14 nt, Salmonella enterica enterica serovar Typhi
aguagcuaaugauu

SEQ ID NO: 1685079 - RNA, 16 nt, Salmonella enterica enterica serovar Typhi
aguagguauccagcag

SEQ ID NO: 1685080 - RNA, 21 nt, Salmonella enterica enterica serovar Typhi
aguaguuguuauagcgcgccc

SEQ ID NO: 1685081 - RNA, 22 nt, Salmonella enterica enterica serovar Typhi
aguauaauucgucaauaccuaa

SEQ ID NO: 1685082 - RNA, 14 nt, Salmonella enterica enterica serovar Typhi
aguauaaauaccuu

SEQ ID NO: 1685083 - RNA, 15 nt, Salmonella enterica enterica serovar Typhi
aguauaagcgccgcu

SEQ ID NO: 1685084 - RNA, 21 nt, Salmonella enterica enterica serovar Typhi
agucagacaaguagccugcca

SEQ ID NO: 1685085 - RNA, 15 nt, Salmonella enterica enterica serovar Typhi
agucagacaccagcc

SEQ ID NO: 1685086 - RNA, 19 nt, Salmonella enterica enterica serovar Typhi
agucacuuacuuucuugcc

SEQ ID NO: 1685087 - RNA, 15 nt, Salmonella enterica enterica serovar Typhi
agucagcaacaugga

SEQ ID NO: 1685088 - RNA, 14 nt, Salmonella enterica enterica serovar Typhi
agucagcaauuaac

SEQ ID NO: 1685089 - RNA, 15 nt, Salmonella enterica enterica serovar Typhi
agucauaauuaaaaa

SEQ ID NO: 1685090 - RNA, 19 nt, Salmonella enterica enterica serovar Typhi
agucagcuccuuucggacu

SEQ ID NO: 1685091 - RNA, 13 nt, Salmonella enterica enterica serovar Typhi
agucagcguuacu

SEQ ID NO: 1685092 - RNA, 22 nt, Salmonella enterica enterica serovar Typhi
agucagggcgcggcgcaacuuu

SEQ ID NO: 1685093 - RNA, 16 nt, Salmonella enterica enterica serovar Typhi
agucaaauuccagcaa

SEQ ID NO: 1685094 - RNA, 22 nt, Salmonella enterica enterica serovar Typhi
agucaacucaugccgcugcugg

SEQ ID NO: 1685095 - RNA, 18 nt, Salmonella enterica enterica serovar Typhi
agucaaggcauccagcag

SEQ ID NO: 1685096 - RNA, 14 nt, Salmonella enterica enterica serovar Typhi
agucaauaaacugg

SEQ ID NO: 1685097 - RNA, 15 nt, Salmonella enterica enterica serovar Typhi
agucaauaaacugga

SEQ ID NO: 1685098 - RNA, 18 nt, Salmonella enterica enterica serovar Typhi
agucaauaagcuugcuuu

SEQ ID NO: 1685099 - RNA, 14 nt, Salmonella enterica enterica serovar Typhi
agucaaagguaaua

SEQ ID NO: 1685100 - RNA, 17 nt, Salmonella enterica enterica serovar Typhi
agucacagauccagaca

SEQ ID NO: 1685101 - RNA, 17 nt, Salmonella enterica enterica serovar Typhi
aguaucgcucuauaucc

SEQ ID NO: 1685102 - RNA, 19 nt, Salmonella enterica enterica serovar Typhi
aguaucgcucuauauccug

SEQ ID NO: 1685103 - RNA, 23 nt, Salmonella enterica enterica serovar Typhi
aguaucgcucuauauccugcccu

SEQ ID NO: 1685104 - RNA, 20 nt, Salmonella enterica enterica serovar Typhi
aguaucgagauaaugcucau

SEQ ID NO: 1685105 - RNA, 23 nt, Salmonella enterica enterica serovar Typhi
aguaugccucgcgcaccauaaua

SEQ ID NO: 1685106 - RNA, 23 nt, Salmonella enterica enterica serovar Typhi
aguaugaaggguauauaaaucaa

SEQ ID NO: 1685107 - RNA, 22 nt, Salmonella enterica enterica serovar Typhi
aguaucucgccaguaaagacac

SEQ ID NO: 1685108 - RNA, 21 nt, Salmonella enterica enterica serovar Typhi
aguaucucgccaguaaagaca

SEQ ID NO: 1685109 - RNA, 14 nt, Salmonella enterica enterica serovar Typhi
aguauuauccauug

SEQ ID NO: 1685110 - RNA, 19 nt, Salmonella enterica enterica serovar Typhi
aguauggccucuucaaauu

SEQ ID NO: 1685111 - RNA, 21 nt, Salmonella enterica enterica serovar Typhi
aguauggccucuucaaauuug

SEQ ID NO: 1685112 - RNA, 15 nt, Salmonella enterica enterica serovar Typhi
aguauuuacaaaaaa

SEQ ID NO: 1685113 - RNA, 20 nt, Salmonella enterica enterica serovar Typhi
aguauuuacaaaaaagauaa

SEQ ID NO: 1685114 - RNA, 14 nt, Salmonella enterica enterica serovar Typhi
aguauugcaccagg

SEQ ID NO: 1685115 - RNA, 21 nt, Salmonella enterica enterica serovar Typhi
aguccucagcgaauaucucua

SEQ ID NO: 1685116 - RNA, 15 nt, Salmonella enterica enterica serovar Typhi
aguccuccggcugaa

SEQ ID NO: 1685117 - RNA, 15 nt, Salmonella enterica enterica serovar Typhi
aguccgccguugaga

SEQ ID NO: 1685118 - RNA, 16 nt, Salmonella enterica enterica serovar Typhi
aguccgcacgccugca

SEQ ID NO: 1685119 - RNA, 21 nt, Salmonella enterica enterica serovar Typhi
aguccucuaucuuuucaauca

SEQ ID NO: 1685120 - RNA, 21 nt, Salmonella enterica enterica serovar Typhi
aguccugcgcuuugacauugu

SEQ ID NO: 1685121 - RNA, 18 nt, Salmonella enterica enterica serovar Typhi
aguccccuuuucacccaa

SEQ ID NO: 1685122 - RNA, 15 nt, Salmonella enterica enterica serovar Typhi
agucccuaauagcgc

SEQ ID NO: 1685123 - RNA, 20 nt, Salmonella enterica enterica serovar Typhi
agucccgcgcuuuccagccc

SEQ ID NO: 1685124 - RNA, 20 nt, Salmonella enterica enterica serovar Typhi
agucggggcguaaaaauuuu

SEQ ID NO: 1685125 - RNA, 16 nt, Salmonella enterica enterica serovar Typhi
agucgggaucgccaga

SEQ ID NO: 1685126 - RNA, 23 nt, Salmonella enterica enterica serovar Typhi
agucgggcgugccguccugugcu

SEQ ID NO: 1685127 - RNA, 15 nt, Salmonella enterica enterica serovar Typhi
agucgcagcggcugc

SEQ ID NO: 1685128 - RNA, 19 nt, Salmonella enterica enterica serovar Typhi
agucgauguggccuuccuc

SEQ ID NO: 1685129 - RNA, 15 nt, Salmonella enterica enterica serovar Typhi
aguccuguaucuucg

SEQ ID NO: 1685130 - RNA, 17 nt, Salmonella enterica enterica serovar Typhi
agucgauagaucgccac

SEQ ID NO: 1685131 - RNA, 12 nt, Salmonella enterica enterica serovar Typhi
aguccaaauaag

SEQ ID NO: 1685132 - RNA, 13 nt, Salmonella enterica enterica serovar Typhi
aguccagcaucca

SEQ ID NO: 1685133 - RNA, 15 nt, Salmonella enterica enterica serovar Typhi
aguccagccauaauc

SEQ ID NO: 1685134 - RNA, 19 nt, Salmonella enterica enterica serovar Typhi
aguccacguuuuacuuccu

SEQ ID NO: 1685135 - RNA, 21 nt, Salmonella enterica enterica serovar Typhi
aguccauauccguacauaaca

SEQ ID NO: 1685136 - RNA, 21 nt, Salmonella enterica enterica serovar Typhi
aguccauaccguuucaacugc

SEQ ID NO: 1685137 - RNA, 14 nt, Salmonella enterica enterica serovar Typhi
aguccauuuuccua

SEQ ID NO: 1685138 - RNA, 17 nt, Salmonella enterica enterica serovar Typhi
aguccauuuccucaacc

SEQ ID NO: 1685139 - RNA, 19 nt, Salmonella enterica enterica serovar Typhi
agucauccgguucauaauc

SEQ ID NO: 1685140 - RNA, 13 nt, Salmonella enterica enterica serovar Typhi
agucaucugccag

SEQ ID NO: 1685141 - RNA, 16 nt, Salmonella enterica enterica serovar Typhi
agucaucugccaguua

SEQ ID NO: 1685142 - RNA, 15 nt, Salmonella enterica enterica serovar Typhi
agucauaccuguucc

SEQ ID NO: 1685143 - RNA, 21 nt, Salmonella enterica enterica serovar Typhi
agucauauuaucgcgcugaau

SEQ ID NO: 1685144 - RNA, 14 nt, Salmonella enterica enterica serovar Typhi
agucaucaauugcu

SEQ ID NO: 1685145 - RNA, 15 nt, Salmonella enterica enterica serovar Typhi
agucauugacagcaa

SEQ ID NO: 1685146 - RNA, 20 nt, Salmonella enterica enterica serovar Typhi
agugcgcggcgaaaaagccg

SEQ ID NO: 1685147 - RNA, 12 nt, Salmonella enterica enterica serovar Typhi
agugcgcggcga

SEQ ID NO: 1685148 - RNA, 16 nt, Salmonella enterica enterica serovar Typhi
agugcuugcauuuuac

SEQ ID NO: 1685149 - RNA, 16 nt, Salmonella enterica enterica serovar Typhi
agugcuucugcaaaau

SEQ ID NO: 1685150 - RNA, 17 nt, Salmonella enterica enterica serovar Typhi
agugcugcgcaaauacg

SEQ ID NO: 1685151 - RNA, 20 nt, Salmonella enterica enterica serovar Typhi
agugcccgaaagcaauacug

SEQ ID NO: 1685152 - RNA, 22 nt, Salmonella enterica enterica serovar Typhi
agugccaguccgguauaaaacg

SEQ ID NO: 1685153 - RNA, 19 nt, Salmonella enterica enterica serovar Typhi
agugauuuacuccaaaaau

SEQ ID NO: 1685154 - RNA, 16 nt, Salmonella enterica enterica serovar Typhi
agugauuauaaaucaa

SEQ ID NO: 1685155 - RNA, 17 nt, Salmonella enterica enterica serovar Typhi
agugauuauaaaucaau

SEQ ID NO: 1685156 - RNA, 21 nt, Salmonella enterica enterica serovar Typhi
agugaucccgacauaggccag

SEQ ID NO: 1685157 - RNA, 21 nt, Salmonella enterica enterica serovar Typhi
agugauagcgccauggagaaa

SEQ ID NO: 1685158 - RNA, 17 nt, Salmonella enterica enterica serovar Typhi
agugaguacgcaggagg

SEQ ID NO: 1685159 - RNA, 20 nt, Salmonella enterica enterica serovar Typhi
agugaagcgccggaugagga

SEQ ID NO: 1685160 - RNA, 19 nt, Salmonella enterica enterica serovar Typhi
agugaaggccaaguuuaga

SEQ ID NO: 1685161 - RNA, 22 nt, Salmonella enterica enterica serovar Typhi
agugaaggccaaguuuagaaaa

SEQ ID NO: 1685162 - RNA, 18 nt, Salmonella enterica enterica serovar Typhi
agugaacgguugagcuuu

SEQ ID NO: 1685163 - RNA, 19 nt, Salmonella enterica enterica serovar Typhi
agucucgaaacgaaucuca

SEQ ID NO: 1685164 - RNA, 15 nt, Salmonella enterica enterica serovar Typhi
agugaacacccugcc

SEQ ID NO: 1685165 - RNA, 20 nt, Salmonella enterica enterica serovar Typhi
agugaaauuugucgauaaaa

SEQ ID NO: 1685166 - RNA, 17 nt, Salmonella enterica enterica serovar Typhi
agugaaucgacggcaau

SEQ ID NO: 1685167 - RNA, 22 nt, Salmonella enterica enterica serovar Typhi
agugaaaguugguguuucucaa

SEQ ID NO: 1685168 - RNA, 15 nt, Salmonella enterica enterica serovar Typhi
agugaaagaccugcc

SEQ ID NO: 1685169 - RNA, 21 nt, Salmonella enterica enterica serovar Typhi
agucguaauucagcucgcugc

SEQ ID NO: 1685170 - RNA, 15 nt, Salmonella enterica enterica serovar Typhi
agucucccuccugcu

SEQ ID NO: 1685171 - RNA, 20 nt, Salmonella enterica enterica serovar Typhi
agucuccgccaccugaauaa

SEQ ID NO: 1685172 - RNA, 23 nt, Salmonella enterica enterica serovar Typhi
agucucauugaucaguuugguau

SEQ ID NO: 1685173 - RNA, 13 nt, Salmonella enterica enterica serovar Typhi
auaacagcgcugg

SEQ ID NO: 1685174 - RNA, 22 nt, Salmonella enterica enterica serovar Typhi
auaaauuuauuuuuugcuggga

SEQ ID NO: 1685175 - RNA, 19 nt, Salmonella enterica enterica serovar Typhi
auaaauuucauccaugcca

SEQ ID NO: 1685176 - RNA, 20 nt, Salmonella enterica enterica serovar Typhi
auaaauuucauccaugccaa

SEQ ID NO: 1685177 - RNA, 21 nt, Salmonella enterica enterica serovar Typhi
auaaauucugucucaauaaaa

SEQ ID NO: 1685178 - RNA, 21 nt, Salmonella enterica enterica serovar Typhi
auaaauucuuuacgcagcaag

SEQ ID NO: 1685179 - RNA, 22 nt, Salmonella enterica enterica serovar Typhi
auaacgaugauuauuguuaaaa

SEQ ID NO: 1685180 - RNA, 16 nt, Salmonella enterica enterica serovar Typhi
auaacgauaugagcua

SEQ ID NO: 1685181 - RNA, 20 nt, Salmonella enterica enterica serovar Typhi
auaacgaugaugaaaaagaa

SEQ ID NO: 1685182 - RNA, 15 nt, Salmonella enterica enterica serovar Typhi
auaaccaugcucagc

SEQ ID NO: 1685183 - RNA, 14 nt, Salmonella enterica enterica serovar Typhi
auaacaucuuccau

SEQ ID NO: 1685184 - RNA, 16 nt, Salmonella enterica enterica serovar Typhi
auaaccacgaaaauua

SEQ ID NO: 1685185 - RNA, 17 nt, Salmonella enterica enterica serovar Typhi
auaaccacgaaaauuau

SEQ ID NO: 1685186 - RNA, 14 nt, Salmonella enterica enterica serovar Typhi
auaaccagaaaacc

SEQ ID NO: 1685187 - RNA, 21 nt, Salmonella enterica enterica serovar Typhi
auaaaugguacuuuucaucca

SEQ ID NO: 1685188 - RNA, 18 nt, Salmonella enterica enterica serovar Typhi
auaaauguacugcaauaa

SEQ ID NO: 1685189 - RNA, 20 nt, Salmonella enterica enterica serovar Typhi
auaaaugaggcuguuuuuua

SEQ ID NO: 1685190 - RNA, 17 nt, Salmonella enterica enterica serovar Typhi
auaaaucaaaagugcac

SEQ ID NO: 1685191 - RNA, 19 nt, Salmonella enterica enterica serovar Typhi
auaaaucaacauacugauu

SEQ ID NO: 1685192 - RNA, 16 nt, Salmonella enterica enterica serovar Typhi
auaaaucaggaaaaag

SEQ ID NO: 1685193 - RNA, 12 nt, Salmonella enterica enterica serovar Typhi
auaaaucauuac

SEQ ID NO: 1685194 - RNA, 13 nt, Salmonella enterica enterica serovar Typhi
auaaauagccgac

SEQ ID NO: 1685195 - RNA, 18 nt, Salmonella enterica enterica serovar Typhi
auaaauagccagcaucau

SEQ ID NO: 1685196 - RNA, 20 nt, Salmonella enterica enterica serovar Typhi
auaaauaccgcaauaaacac

SEQ ID NO: 1685197 - RNA, 13 nt, Salmonella enterica enterica serovar Typhi
auaaagaaauauu

SEQ ID NO: 1685198 - RNA, 20 nt, Salmonella enterica enterica serovar Typhi
auaaagaccggcacaaccgu

SEQ ID NO: 1685199 - RNA, 17 nt, Salmonella enterica enterica serovar Typhi
auaaacagcagcgcggc

SEQ ID NO: 1685200 - RNA, 20 nt, Salmonella enterica enterica serovar Typhi
auaaacagauaugaaaugag

SEQ ID NO: 1685201 - RNA, 15 nt, Salmonella enterica enterica serovar Typhi
auaaacauaaagaca

SEQ ID NO: 1685202 - RNA, 22 nt, Salmonella enterica enterica serovar Typhi
auaaacagcucggcaaagccca

SEQ ID NO: 1685203 - RNA, 16 nt, Salmonella enterica enterica serovar Typhi
auaaacgccucauccg

SEQ ID NO: 1685204 - RNA, 18 nt, Salmonella enterica enterica serovar Typhi
auaaacgcgccaaguaaa

SEQ ID NO: 1685205 - RNA, 22 nt, Salmonella enterica enterica serovar Typhi
auaaacgggcccggcuuucugu

SEQ ID NO: 1685206 - RNA, 16 nt, Salmonella enterica enterica serovar Typhi
auaaacgguuucagua

SEQ ID NO: 1685207 - RNA, 14 nt, Salmonella enterica enterica serovar Typhi
auaaaauccucuac

SEQ ID NO: 1685208 - RNA, 16 nt, Salmonella enterica enterica serovar Typhi
auaaaauccugcacgc

SEQ ID NO: 1685209 - RNA, 19 nt, Salmonella enterica enterica serovar Typhi
auaaaauagugaucaucau

SEQ ID NO: 1685210 - RNA, 13 nt, Salmonella enterica enterica serovar Typhi
auaaaauggaugc

SEQ ID NO: 1685211 - RNA, 13 nt, Salmonella enterica enterica serovar Typhi
auaaaauucacuu

SEQ ID NO: 1685212 - RNA, 13 nt, Salmonella enterica enterica serovar Typhi
auaaaauuauaaa

SEQ ID NO: 1685213 - RNA, 23 nt, Salmonella enterica enterica serovar Typhi
auaaaagcucuggaaaaauuguu

SEQ ID NO: 1685214 - RNA, 11 nt, Salmonella enterica enterica serovar Typhi
auaaaauaaac

SEQ ID NO: 1685215 - RNA, 18 nt, Salmonella enterica enterica serovar Typhi
auaaaacgcccccugcca

SEQ ID NO: 1685216 - RNA, 14 nt, Salmonella enterica enterica serovar Typhi
auaaaaccauucaa

SEQ ID NO: 1685217 - RNA, 14 nt, Salmonella enterica enterica serovar Typhi
auaaaaccggcaua

SEQ ID NO: 1685218 - RNA, 22 nt, Salmonella enterica enterica serovar Typhi
auaaaaacugcuaaaagaagcu

SEQ ID NO: 1685219 - RNA, 17 nt, Salmonella enterica enterica serovar Typhi
auaaaaauagcuggcug

SEQ ID NO: 1685220 - RNA, 18 nt, Salmonella enterica enterica serovar Typhi
auaaaaauagcuggcugu

SEQ ID NO: 1685221 - RNA, 22 nt, Salmonella enterica enterica serovar Typhi
aguucccuacucucgcaugggg

SEQ ID NO: 1685222 - RNA, 13 nt, Salmonella enterica enterica serovar Typhi
aguucccccaucu

SEQ ID NO: 1685223 - RNA, 23 nt, Salmonella enterica enterica serovar Typhi
aguucaguaugaucaugcccggc

SEQ ID NO: 1685224 - RNA, 14 nt, Salmonella enterica enterica serovar Typhi
aguucauaaaugua

SEQ ID NO: 1685225 - RNA, 12 nt, Salmonella enterica enterica serovar Typhi
aguucgccgcca

SEQ ID NO: 1685226 - RNA, 15 nt, Salmonella enterica enterica serovar Typhi
aguucgccgccagga

SEQ ID NO: 1685227 - RNA, 16 nt, Salmonella enterica enterica serovar Typhi
aguucgccgccaggaa

SEQ ID NO: 1685228 - RNA, 19 nt, Salmonella enterica enterica serovar Typhi
aguuccgccagacucagcc

SEQ ID NO: 1685229 - RNA, 12 nt, Salmonella enterica enterica serovar Typhi
aguuccggauac

SEQ ID NO: 1685230 - RNA, 17 nt, Salmonella enterica enterica serovar Typhi
aguucucaaugaacagu

SEQ ID NO: 1685231 - RNA, 15 nt, Salmonella enterica enterica serovar Typhi
aguucgccuucuuca

SEQ ID NO: 1685232 - RNA, 18 nt, Salmonella enterica enterica serovar Typhi
aguucucgucugcugaaa

SEQ ID NO: 1685233 - RNA, 12 nt, Salmonella enterica enterica serovar Typhi
aguucucuucuu

SEQ ID NO: 1685234 - RNA, 21 nt, Salmonella enterica enterica serovar Typhi
aguuaccauccauuaaaaucu

SEQ ID NO: 1685235 - RNA, 19 nt, Salmonella enterica enterica serovar Typhi
aguuauguuauccccacuu

SEQ ID NO: 1685236 - RNA, 21 nt, Salmonella enterica enterica serovar Typhi
aguucaccaguuuuucgccaa

SEQ ID NO: 1685237 - RNA, 12 nt, Salmonella enterica enterica serovar Typhi
aguucagccgcc

SEQ ID NO: 1685238 - RNA, 15 nt, Salmonella enterica enterica serovar Typhi
aguucagcagcacca

SEQ ID NO: 1685239 - RNA, 20 nt, Salmonella enterica enterica serovar Typhi
aguggcuaauuucaauuuug

SEQ ID NO: 1685240 - RNA, 15 nt, Salmonella enterica enterica serovar Typhi
aguggcuaauuucaa

SEQ ID NO: 1685241 - RNA, 14 nt, Salmonella enterica enterica serovar Typhi
aguggcggcaaaaa

SEQ ID NO: 1685242 - RNA, 16 nt, Salmonella enterica enterica serovar Typhi
aguuaaauaaacaaaa

SEQ ID NO: 1685243 - RNA, 22 nt, Salmonella enterica enterica serovar Typhi
aguuaaauaaacaaaaaccugc

SEQ ID NO: 1685244 - RNA, 21 nt, Salmonella enterica enterica serovar Typhi
aguggcgaaacuccuccggga

SEQ ID NO: 1685245 - RNA, 19 nt, Salmonella enterica enterica serovar Typhi
aguggcauccgaagaacca

SEQ ID NO: 1685246 - RNA, 17 nt, Salmonella enterica enterica serovar Typhi
aguuaauacaguggaaa

SEQ ID NO: 1685247 - RNA, 21 nt, Salmonella enterica enterica serovar Typhi
aguuaaucagcgccgucgcca

SEQ ID NO: 1685248 - RNA, 19 nt, Salmonella enterica enterica serovar Typhi
aguuaagcaacugauuaau

SEQ ID NO: 1685249 - RNA, 14 nt, Salmonella enterica enterica serovar Typhi
aguuggugggugau

SEQ ID NO: 1685250 - RNA, 16 nt, Salmonella enterica enterica serovar Typhi
aguugguguuucucaa

SEQ ID NO: 1685251 - RNA, 16 nt, Salmonella enterica enterica serovar Typhi
aguuuagccagcagcg

SEQ ID NO: 1685252 - RNA, 15 nt, Salmonella enterica enterica serovar Typhi
aguuuagaaaauaua

SEQ ID NO: 1685253 - RNA, 22 nt, Salmonella enterica enterica serovar Typhi
aguuuagaaaauauauuggccu

SEQ ID NO: 1685254 - RNA, 21 nt, Salmonella enterica enterica serovar Typhi
aguugacgccccauguggcca

SEQ ID NO: 1685255 - RNA, 21 nt, Salmonella enterica enterica serovar Typhi
aguugcauauaaggcccauac

SEQ ID NO: 1685256 - RNA, 13 nt, Salmonella enterica enterica serovar Typhi
aguuggcuucagc

SEQ ID NO: 1685257 - RNA, 17 nt, Salmonella enterica enterica serovar Typhi
aguugcccauuuuccuc

SEQ ID NO: 1685258 - RNA, 20 nt, Salmonella enterica enterica serovar Typhi
aguugcccuuaucuggauga

SEQ ID NO: 1685259 - RNA, 19 nt, Salmonella enterica enterica serovar Typhi
aguugcgacuguucaucaa

SEQ ID NO: 1685260 - RNA, 17 nt, Salmonella enterica enterica serovar Typhi
auaaaaacaauaaauaa

SEQ ID NO: 1685261 - RNA, 22 nt, Salmonella enterica enterica serovar Typhi
auaaaaacgcgcucgccagcgc

SEQ ID NO: 1685262 - RNA, 13 nt, Salmonella enterica enterica serovar Typhi
auaaaaacgggua

SEQ ID NO: 1685263 - RNA, 13 nt, Salmonella enterica enterica serovar Typhi
auaaaaaaggcag

SEQ ID NO: 1685264 - RNA, 21 nt, Salmonella enterica enterica serovar Typhi
auaaaaaagccguauuuuauu

SEQ ID NO: 1685265 - RNA, 22 nt, Salmonella enterica enterica serovar Typhi
aguuuuucuacuaacuggcaau

SEQ ID NO: 1685266 - RNA, 22 nt, Salmonella enterica enterica serovar Typhi
aguuugucaacgugugccagga

SEQ ID NO: 1685267 - RNA, 20 nt, Salmonella enterica enterica serovar Typhi
aguuugcgcgauuuauagag

SEQ ID NO: 1685268 - RNA, 17 nt, Salmonella enterica enterica serovar Typhi
aguuugcuuaagcuuug

SEQ ID NO: 1685269 - RNA, 14 nt, Salmonella enterica enterica serovar Typhi
aguuucaugccaua

SEQ ID NO: 1685270 - RNA, 16 nt, Salmonella enterica enterica serovar Typhi
aguuucaugccauacu

SEQ ID NO: 1685271 - RNA, 16 nt, Salmonella enterica enterica serovar Typhi
aguuugcgcgauuuau

SEQ ID NO: 1685272 - RNA, 16 nt, Salmonella enterica enterica serovar Typhi
auagaacgcuugucuu

SEQ ID NO: 1685273 - RNA, 17 nt, Salmonella enterica enterica serovar Typhi
auagaaagucuuuuguu

SEQ ID NO: 1685274 - RNA, 14 nt, Salmonella enterica enterica serovar Typhi
auagaaauagccuu

SEQ ID NO: 1685275 - RNA, 21 nt, Salmonella enterica enterica serovar Typhi
auagaauaggaaauaauuaau

SEQ ID NO: 1685276 - RNA, 23 nt, Salmonella enterica enterica serovar Typhi
auacuuaauucauaacgaccuuu

SEQ ID NO: 1685277 - RNA, 19 nt, Salmonella enterica enterica serovar Typhi
auacuuauugauccacgga

SEQ ID NO: 1685278 - RNA, 13 nt, Salmonella enterica enterica serovar Typhi
auacuucaucagg

SEQ ID NO: 1685279 - RNA, 15 nt, Salmonella enterica enterica serovar Typhi
auagacgacaucuuu

SEQ ID NO: 1685280 - RNA, 18 nt, Salmonella enterica enterica serovar Typhi
auagacgacaucuuuucc

SEQ ID NO: 1685281 - RNA, 15 nt, Salmonella enterica enterica serovar Typhi
auagacgccgaaccu

SEQ ID NO: 1685282 - RNA, 15 nt, Salmonella enterica enterica serovar Typhi
auagacgcuacugug

SEQ ID NO: 1685283 - RNA, 15 nt, Salmonella enterica enterica serovar Typhi
auagacggccugcaa

SEQ ID NO: 1685284 - RNA, 22 nt, Salmonella enterica enterica serovar Typhi
auagacgacaucuuuuccugaa

SEQ ID NO: 1685285 - RNA, 16 nt, Salmonella enterica enterica serovar Typhi
auagacagugauuuac

SEQ ID NO: 1685286 - RNA, 16 nt, Salmonella enterica enterica serovar Typhi
auagacauacaggaau

SEQ ID NO: 1685287 - RNA, 12 nt, Salmonella enterica enterica serovar Typhi
auagacuccguc

SEQ ID NO: 1685288 - RNA, 23 nt, Salmonella enterica enterica serovar Typhi
auagacuccgucaaagaaaacuu

SEQ ID NO: 1685289 - RNA, 23 nt, Salmonella enterica enterica serovar Typhi
auagaucagacgaccauccacca

SEQ ID NO: 1685290 - RNA, 15 nt, Salmonella enterica enterica serovar Typhi
auagauaugaaagaa

SEQ ID NO: 1685291 - RNA, 22 nt, Salmonella enterica enterica serovar Typhi
auagauaucaaacacaaauuuc

SEQ ID NO: 1685292 - RNA, 16 nt, Salmonella enterica enterica serovar Typhi
auagccaacacauaag

SEQ ID NO: 1685293 - RNA, 20 nt, Salmonella enterica enterica serovar Typhi
auagcaucggucaacugaau

SEQ ID NO: 1685294 - RNA, 13 nt, Salmonella enterica enterica serovar Typhi
auagcaucaccag

SEQ ID NO: 1685295 - RNA, 17 nt, Salmonella enterica enterica serovar Typhi
auagcaacuuaauaaua

SEQ ID NO: 1685296 - RNA, 17 nt, Salmonella enterica enterica serovar Typhi
auagcaacguccgcagc

SEQ ID NO: 1685297 - RNA, 13 nt, Salmonella enterica enterica serovar Typhi
auacgcuccagcu

SEQ ID NO: 1685298 - RNA, 20 nt, Salmonella enterica enterica serovar Typhi
auacgcgucaaauagagaaa

SEQ ID NO: 1685299 - RNA, 12 nt, Salmonella enterica enterica serovar Typhi
auacgcugaaga

SEQ ID NO: 1685300 - RNA, 14 nt, Salmonella enterica enterica serovar Typhi
auacgcucaauaua

SEQ ID NO: 1685301 - RNA, 16 nt, Salmonella enterica enterica serovar Typhi
auacgcgucaaauaga

SEQ ID NO: 1685302 - RNA, 15 nt, Salmonella enterica enterica serovar Typhi
auacuaaaacuuuaa

SEQ ID NO: 1685303 - RNA, 17 nt, Salmonella enterica enterica serovar Typhi
auacuaaaacuuuaaca

SEQ ID NO: 1685304 - RNA, 15 nt, Salmonella enterica enterica serovar Typhi
auaccgaaauccgcu

SEQ ID NO: 1685305 - RNA, 13 nt, Salmonella enterica enterica serovar Typhi
auacgaaugggua

SEQ ID NO: 1685306 - RNA, 12 nt, Salmonella enterica enterica serovar Typhi
auaccuuuucau

SEQ ID NO: 1685307 - RNA, 16 nt, Salmonella enterica enterica serovar Typhi
auaccuaacucuuccg

SEQ ID NO: 1685308 - RNA, 16 nt, Salmonella enterica enterica serovar Typhi
auaccuauaaaaauga

SEQ ID NO: 1685309 - RNA, 20 nt, Salmonella enterica enterica serovar Typhi
auaccaugcugccauuuuau

SEQ ID NO: 1685310 - RNA, 20 nt, Salmonella enterica enterica serovar Typhi
auaccagucgacaguauaga

SEQ ID NO: 1685311 - RNA, 15 nt, Salmonella enterica enterica serovar Typhi
auaccccuguucaaa

SEQ ID NO: 1685312 - RNA, 16 nt, Salmonella enterica enterica serovar Typhi
auaccccuguucaaaa

SEQ ID NO: 1685313 - RNA, 21 nt, Salmonella enterica enterica serovar Typhi
auacccaguagcagacagccg

SEQ ID NO: 1685314 - RNA, 18 nt, Salmonella enterica enterica serovar Typhi
auacccaccucguucaaa

SEQ ID NO: 1685315 - RNA, 15 nt, Salmonella enterica enterica serovar Typhi
auaccaccugccaaa

SEQ ID NO: 1685316 - RNA, 19 nt, Salmonella enterica enterica serovar Typhi
auaccaccacuucacuauc

SEQ ID NO: 1685317 - RNA, 21 nt, Salmonella enterica enterica serovar Typhi
auaccagcggcaaacagcgac

SEQ ID NO: 1685318 - RNA, 23 nt, Salmonella enterica enterica serovar Typhi
auaccaagucucaggagugaaca

SEQ ID NO: 1685319 - RNA, 19 nt, Salmonella enterica enterica serovar Typhi
auaauguaaaaaaauaaaa

SEQ ID NO: 1685320 - RNA, 12 nt, Salmonella enterica enterica serovar Typhi
auaauuccccca

SEQ ID NO: 1685321 - RNA, 22 nt, Salmonella enterica enterica serovar Typhi
auaauucgaguugcuuaaaagc

SEQ ID NO: 1685322 - RNA, 19 nt, Salmonella enterica enterica serovar Typhi
auaauucuguaacucauag

SEQ ID NO: 1685323 - RNA, 13 nt, Salmonella enterica enterica serovar Typhi
auaauuuuagaaa

SEQ ID NO: 1685324 - RNA, 11 nt, Salmonella enterica enterica serovar Typhi
auaauugcucu

SEQ ID NO: 1685325 - RNA, 20 nt, Salmonella enterica enterica serovar Typhi
auaacgcggcccgggagaac

SEQ ID NO: 1685326 - RNA, 19 nt, Salmonella enterica enterica serovar Typhi
auaacgcggcuaaucaggg

SEQ ID NO: 1685327 - RNA, 17 nt, Salmonella enterica enterica serovar Typhi
auaacgcccugcgcgcc

SEQ ID NO: 1685328 - RNA, 17 nt, Salmonella enterica enterica serovar Typhi
auaacgccgguuccaac

SEQ ID NO: 1685329 - RNA, 19 nt, Salmonella enterica enterica serovar Typhi
auaacgcgagaagaagaau

SEQ ID NO: 1685330 - RNA, 23 nt, Salmonella enterica enterica serovar Typhi
auaacgcgagaagaagaauuauu

SEQ ID NO: 1685331 - RNA, 22 nt, Salmonella enterica enterica serovar Typhi
auaacgcgauggccaaauaacc

SEQ ID NO: 1685332 - RNA, 18 nt, Salmonella enterica enterica serovar Typhi
auaacggcgcaaagacag

SEQ ID NO: 1685333 - RNA, 20 nt, Salmonella enterica enterica serovar Typhi
auaauccgccuuuuccccca

SEQ ID NO: 1685334 - RNA, 20 nt, Salmonella enterica enterica serovar Typhi
auaaucugugauugaauuca

SEQ ID NO: 1685335 - RNA, 22 nt, Salmonella enterica enterica serovar Typhi
auaaucucugcgacaaucaggu

SEQ ID NO: 1685336 - RNA, 12 nt, Salmonella enterica enterica serovar Typhi
auaauccuuccc

SEQ ID NO: 1685337 - RNA, 15 nt, Salmonella enterica enterica serovar Typhi
auaauccuucccgcu

SEQ ID NO: 1685338 - RNA, 20 nt, Salmonella enterica enterica serovar Typhi
auaauccuuccuuucauuuu

SEQ ID NO: 1685339 - RNA, 21 nt, Salmonella enterica enterica serovar Typhi
auaauggggauuaucaggaug

SEQ ID NO: 1685340 - RNA, 20 nt, Salmonella enterica enterica serovar Typhi
auaaugacgcuauucaugcc

SEQ ID NO: 1685341 - RNA, 15 nt, Salmonella enterica enterica serovar Typhi
auacacguaauacau

SEQ ID NO: 1685342 - RNA, 14 nt, Salmonella enterica enterica serovar Typhi
auacacucaaccau

SEQ ID NO: 1685343 - RNA, 20 nt, Salmonella enterica enterica serovar Typhi
auacaccucggguaaagguu

SEQ ID NO: 1685344 - RNA, 11 nt, Salmonella enterica enterica serovar Typhi
auacaccuuca

SEQ ID NO: 1685345 - RNA, 20 nt, Salmonella enterica enterica serovar Typhi
auacacugcauaaauaucug

SEQ ID NO: 1685346 - RNA, 18 nt, Salmonella enterica enterica serovar Typhi
auacaccgccauauauuu

SEQ ID NO: 1685347 - RNA, 18 nt, Salmonella enterica enterica serovar Typhi
auacaccaaacgaauuua

SEQ ID NO: 1685348 - RNA, 21 nt, Salmonella enterica enterica serovar Typhi
auacaccaaacgaauuuaaau

SEQ ID NO: 1685349 - RNA, 13 nt, Salmonella enterica enterica serovar Typhi
auacaaauauccc

SEQ ID NO: 1685350 - RNA, 14 nt, Salmonella enterica enterica serovar Typhi
auacaaaacccaua

SEQ ID NO: 1685351 - RNA, 18 nt, Salmonella enterica enterica serovar Typhi
auaauuuuauuauauuua

SEQ ID NO: 1685352 - RNA, 17 nt, Salmonella enterica enterica serovar Typhi
auacaggguuugucagc

SEQ ID NO: 1685353 - RNA, 17 nt, Salmonella enterica enterica serovar Typhi
auacaguaguuuucauc

SEQ ID NO: 1685354 - RNA, 13 nt, Salmonella enterica enterica serovar Typhi
auacaguaccuuu

SEQ ID NO: 1685355 - RNA, 16 nt, Salmonella enterica enterica serovar Typhi
auacauaaauccggau

SEQ ID NO: 1685356 - RNA, 23 nt, Salmonella enterica enterica serovar Typhi
auacaggcauggccuucaaucag

SEQ ID NO: 1685357 - RNA, 16 nt, Salmonella enterica enterica serovar Typhi
auacaggaagccggug

SEQ ID NO: 1685358 - RNA, 14 nt, Salmonella enterica enterica serovar Typhi
auacagccagguug

SEQ ID NO: 1685359 - RNA, 18 nt, Salmonella enterica enterica serovar Typhi
auacauuugaauaauucu

SEQ ID NO: 1685360 - RNA, 20 nt, Salmonella enterica enterica serovar Typhi
auacauugaguaaauaaauc

SEQ ID NO: 1685361 - RNA, 14 nt, Salmonella enterica enterica serovar Typhi
auacauucgcucag

SEQ ID NO: 1685362 - RNA, 18 nt, Salmonella enterica enterica serovar Typhi
auacaugccugcgccaug

SEQ ID NO: 1685363 - RNA, 13 nt, Salmonella enterica enterica serovar Typhi
auacaugcuacag

SEQ ID NO: 1685364 - RNA, 18 nt, Salmonella enterica enterica serovar Typhi
auacaucaugcuugcuuu

SEQ ID NO: 1685365 - RNA, 16 nt, Salmonella enterica enterica serovar Typhi
aucaaaaucaucgcca

SEQ ID NO: 1685366 - RNA, 20 nt, Salmonella enterica enterica serovar Typhi
aucaaaacuacgccaaugaa

SEQ ID NO: 1685367 - RNA, 23 nt, Salmonella enterica enterica serovar Typhi
aucaaaacuacgccaaugaacuc

SEQ ID NO: 1685368 - RNA, 18 nt, Salmonella enterica enterica serovar Typhi
auauuugcgugucaucaa

SEQ ID NO: 1685369 - RNA, 19 nt, Salmonella enterica enterica serovar Typhi
auauuugcgugucaucaaa

SEQ ID NO: 1685370 - RNA, 13 nt, Salmonella enterica enterica serovar Typhi
auauuuauuuaau

SEQ ID NO: 1685371 - RNA, 20 nt, Salmonella enterica enterica serovar Typhi
auauuuauuugcauuguacu

SEQ ID NO: 1685372 - RNA, 21 nt, Salmonella enterica enterica serovar Typhi
aucaaauacgcuauuuaaaaa

SEQ ID NO: 1685373 - RNA, 17 nt, Salmonella enterica enterica serovar Typhi
aucaaauaccuuuucau

SEQ ID NO: 1685374 - RNA, 19 nt, Salmonella enterica enterica serovar Typhi
aucaacagcggagagacau

SEQ ID NO: 1685375 - RNA, 20 nt, Salmonella enterica enterica serovar Typhi
aucaacagcgugagcugucg

SEQ ID NO: 1685376 - RNA, 23 nt, Salmonella enterica enterica serovar Typhi
aucaacaggcgauucggacucau

SEQ ID NO: 1685377 - RNA, 14 nt, Salmonella enterica enterica serovar Typhi
aucaacucuccuuu

SEQ ID NO: 1685378 - RNA, 14 nt, Salmonella enterica enterica serovar Typhi
aucaacuccuccgg

SEQ ID NO: 1685379 - RNA, 20 nt, Salmonella enterica enterica serovar Typhi
aucaacuucguucaguucca

SEQ ID NO: 1685380 - RNA, 18 nt, Salmonella enterica enterica serovar Typhi
aucaacguuguccagcgg

SEQ ID NO: 1685381 - RNA, 20 nt, Salmonella enterica enterica serovar Typhi
aucaacgucgucgucuucaa

SEQ ID NO: 1685382 - RNA, 19 nt, Salmonella enterica enterica serovar Typhi
aucaauacagagauauuaa

SEQ ID NO: 1685383 - RNA, 21 nt, Salmonella enterica enterica serovar Typhi
aucaauacagagauauuaaaa

SEQ ID NO: 1685384 - RNA, 21 nt, Salmonella enterica enterica serovar Typhi
aucaaucacuacggguuuuug

SEQ ID NO: 1685385 - RNA, 17 nt, Salmonella enterica enterica serovar Typhi
aucaauaaaauuaucca

SEQ ID NO: 1685386 - RNA, 17 nt, Salmonella enterica enterica serovar Typhi
aucaauaaccgccagca

SEQ ID NO: 1685387 - RNA, 16 nt, Salmonella enterica enterica serovar Typhi
auauugcguaaaaacc

SEQ ID NO: 1685388 - RNA, 17 nt, Salmonella enterica enterica serovar Typhi
auauuuaaucgcuuuua

SEQ ID NO: 1685389 - RNA, 20 nt, Salmonella enterica enterica serovar Typhi
auauuccucuuccucgauau

SEQ ID NO: 1685390 - RNA, 11 nt, Salmonella enterica enterica serovar Typhi
auauuccccac

SEQ ID NO: 1685391 - RNA, 19 nt, Salmonella enterica enterica serovar Typhi
auauucaucaguuuaaccg

SEQ ID NO: 1685392 - RNA, 14 nt, Salmonella enterica enterica serovar Typhi
auauuaucauaaug

SEQ ID NO: 1685393 - RNA, 12 nt, Salmonella enterica enterica serovar Typhi
auauuauauuuu

SEQ ID NO: 1685394 - RNA, 19 nt, Salmonella enterica enterica serovar Typhi
auauuaucgcgcugaauaa

SEQ ID NO: 1685395 - RNA, 19 nt, Salmonella enterica enterica serovar Typhi
auauggccguuuucaugca

SEQ ID NO: 1685396 - RNA, 15 nt, Salmonella enterica enterica serovar Typhi
auaugguuauccagc

SEQ ID NO: 1685397 - RNA, 13 nt, Salmonella enterica enterica serovar Typhi
auauguaaaucgg

SEQ ID NO: 1685398 - RNA, 24 nt, Salmonella enterica enterica serovar Typhi
auauguuugauaaacugcgccaug

SEQ ID NO: 1685399 - RNA, 13 nt, Salmonella enterica enterica serovar Typhi
auauuaaaguuca

SEQ ID NO: 1685400 - RNA, 21 nt, Salmonella enterica enterica serovar Typhi
auauuaaaguucagccgauaa

SEQ ID NO: 1685401 - RNA, 21 nt, Salmonella enterica enterica serovar Typhi
auauuaaauaaauaguaaaua

SEQ ID NO: 1685402 - RNA, 14 nt, Salmonella enterica enterica serovar Typhi
auauuaauuaagga

SEQ ID NO: 1685403 - RNA, 14 nt, Salmonella enterica enterica serovar Typhi
auauuacaacaugu

SEQ ID NO: 1685404 - RNA, 22 nt, Salmonella enterica enterica serovar Typhi
auauuagcgguacucuuuuucc

SEQ ID NO: 1685405 - RNA, 16 nt, Salmonella enterica enterica serovar Typhi
auauuaguguuauaua

SEQ ID NO: 1685406 - RNA, 14 nt, Salmonella enterica enterica serovar Typhi
auauagcaaucaua

SEQ ID NO: 1685407 - RNA, 23 nt, Salmonella enterica enterica serovar Typhi
auauagcuaaugcaauaaacuaa

SEQ ID NO: 1685408 - RNA, 15 nt, Salmonella enterica enterica serovar Typhi
auauaggguuuuccg

SEQ ID NO: 1685409 - RNA, 16 nt, Salmonella enterica enterica serovar Typhi
auauaguuuauugaag

SEQ ID NO: 1685410 - RNA, 23 nt, Salmonella enterica enterica serovar Typhi
auauagagcccucuguccacaca

SEQ ID NO: 1685411 - RNA, 16 nt, Salmonella enterica enterica serovar Typhi
auauagaguugugaaa

SEQ ID NO: 1685412 - RNA, 15 nt, Salmonella enterica enterica serovar Typhi
auauacgccacggcc

SEQ ID NO: 1685413 - RNA, 23 nt, Salmonella enterica enterica serovar Typhi
auauacagccuuuugagcagcau

SEQ ID NO: 1685414 - RNA, 15 nt, Salmonella enterica enterica serovar Typhi
auauacccccugcaa

SEQ ID NO: 1685415 - RNA, 17 nt, Salmonella enterica enterica serovar Typhi
auauacccccugcaauu

SEQ ID NO: 1685416 - RNA, 20 nt, Salmonella enterica enterica serovar Typhi
auauaagcgguauucagguu

SEQ ID NO: 1685417 - RNA, 19 nt, Salmonella enterica enterica serovar Typhi
auauaagcgccgucauccg

SEQ ID NO: 1685418 - RNA, 19 nt, Salmonella enterica enterica serovar Typhi
auagucauugacagcaagu

SEQ ID NO: 1685419 - RNA, 16 nt, Salmonella enterica enterica serovar Typhi
auagucauaauuaaaa

SEQ ID NO: 1685420 - RNA, 11 nt, Salmonella enterica enterica serovar Typhi
auagcgcccca

SEQ ID NO: 1685421 - RNA, 18 nt, Salmonella enterica enterica serovar Typhi
auaguauccauaauuuuc

SEQ ID NO: 1685422 - RNA, 23 nt, Salmonella enterica enterica serovar Typhi
auaguaucgcugcuaaacgagcc

SEQ ID NO: 1685423 - RNA, 16 nt, Salmonella enterica enterica serovar Typhi
auagccgguaacuuuc

SEQ ID NO: 1685424 - RNA, 13 nt, Salmonella enterica enterica serovar Typhi
auagccugggcaa

SEQ ID NO: 1685425 - RNA, 22 nt, Salmonella enterica enterica serovar Typhi
auagccuuugucgaaauugccg

SEQ ID NO: 1685426 - RNA, 17 nt, Salmonella enterica enterica serovar Typhi
auagcgccaucaggcau

SEQ ID NO: 1685427 - RNA, 15 nt, Salmonella enterica enterica serovar Typhi
auagcgccauccugc

SEQ ID NO: 1685428 - RNA, 18 nt, Salmonella enterica enterica serovar Typhi
auagcgaggcagcaggau

SEQ ID NO: 1685429 - RNA, 19 nt, Salmonella enterica enterica serovar Typhi
auauaaaccggaacauaca

SEQ ID NO: 1685430 - RNA, 19 nt, Salmonella enterica enterica serovar Typhi
auaguucaucgugaaauua

SEQ ID NO: 1685431 - RNA, 22 nt, Salmonella enterica enterica serovar Typhi
auaguucaucgugaaauuauuc

SEQ ID NO: 1685432 - RNA, 22 nt, Salmonella enterica enterica serovar Typhi
auagucuuguuacucaauaaaa

SEQ ID NO: 1685433 - RNA, 20 nt, Salmonella enterica enterica serovar Typhi
auauccaguugcgccagcgu

SEQ ID NO: 1685434 - RNA, 23 nt, Salmonella enterica enterica serovar Typhi
auauccauugggggguuagugcu

SEQ ID NO: 1685435 - RNA, 13 nt, Salmonella enterica enterica serovar Typhi
auaucaucaucuc

SEQ ID NO: 1685436 - RNA, 15 nt, Salmonella enterica enterica serovar Typhi
auauaugcaaaacug

SEQ ID NO: 1685437 - RNA, 12 nt, Salmonella enterica enterica serovar Typhi
auauaugaaauc

SEQ ID NO: 1685438 - RNA, 11 nt, Salmonella enterica enterica serovar Typhi
auauaucucua

SEQ ID NO: 1685439 - RNA, 16 nt, Salmonella enterica enterica serovar Typhi
auauauccuaacuuau

SEQ ID NO: 1685440 - RNA, 20 nt, Salmonella enterica enterica serovar Typhi
auauauccgcuauuaccagu

SEQ ID NO: 1685441 - RNA, 22 nt, Salmonella enterica enterica serovar Typhi
auaucgguaagcgccugcugcg

SEQ ID NO: 1685442 - RNA, 14 nt, Salmonella enterica enterica serovar Typhi
auaucgcuaaccaa

SEQ ID NO: 1685443 - RNA, 15 nt, Salmonella enterica enterica serovar Typhi
auaucgcgucaucaa

SEQ ID NO: 1685444 - RNA, 18 nt, Salmonella enterica enterica serovar Typhi
auaucgcuaaccaaacca

SEQ ID NO: 1685445 - RNA, 22 nt, Salmonella enterica enterica serovar Typhi
auaucgcggguaaacucaccca

SEQ ID NO: 1685446 - RNA, 13 nt, Salmonella enterica enterica serovar Typhi
auaucgcgcggca

SEQ ID NO: 1685447 - RNA, 16 nt, Salmonella enterica enterica serovar Typhi
auaucgcggaaauuca

SEQ ID NO: 1685448 - RNA, 17 nt, Salmonella enterica enterica serovar Typhi
auauccuguaacucauc

SEQ ID NO: 1685449 - RNA, 22 nt, Salmonella enterica enterica serovar Typhi
auauccugcuuaauauccaguu

SEQ ID NO: 1685450 - RNA, 14 nt, Salmonella enterica enterica serovar Typhi
auauccuaacuuau

SEQ ID NO: 1685451 - RNA, 13 nt, Salmonella enterica enterica serovar Typhi
auauccuccggca

SEQ ID NO: 1685452 - RNA, 15 nt, Salmonella enterica enterica serovar Typhi
auauccgguacacca

SEQ ID NO: 1685453 - RNA, 15 nt, Salmonella enterica enterica serovar Typhi
auaucccuauuagca

SEQ ID NO: 1685454 - RNA, 14 nt, Salmonella enterica enterica serovar Typhi
auaucccgcaagaa

SEQ ID NO: 1685455 - RNA, 15 nt, Salmonella enterica enterica serovar Typhi
auaucccgcauaccg

SEQ ID NO: 1685456 - RNA, 18 nt, Salmonella enterica enterica serovar Typhi
auaucccggcugacauaa

SEQ ID NO: 1685457 - RNA, 18 nt, Salmonella enterica enterica serovar Typhi
auaucucuacccuauugu

SEQ ID NO: 1685458 - RNA, 21 nt, Salmonella enterica enterica serovar Typhi
auaucugagcugguuucuccg

SEQ ID NO: 1685459 - RNA, 18 nt, Salmonella enterica enterica serovar Typhi
auaugacguauugaaaau

SEQ ID NO: 1685460 - RNA, 15 nt, Salmonella enterica enterica serovar Typhi
auaugauuuaaaaaa

SEQ ID NO: 1685461 - RNA, 13 nt, Salmonella enterica enterica serovar Typhi
auaugauuuaaaa

SEQ ID NO: 1685462 - RNA, 20 nt, Salmonella enterica enterica serovar Typhi
auaugaauuauuuucuaaaa

SEQ ID NO: 1685463 - RNA, 15 nt, Salmonella enterica enterica serovar Typhi
auaugaauaaacugu

SEQ ID NO: 1685464 - RNA, 14 nt, Salmonella enterica enterica serovar Typhi
auaugaaagagaaa

SEQ ID NO: 1685465 - RNA, 15 nt, Salmonella enterica enterica serovar Typhi
auaugaaagagaaau

SEQ ID NO: 1685466 - RNA, 17 nt, Salmonella enterica enterica serovar Typhi
auaugaaccaagauaag

SEQ ID NO: 1685467 - RNA, 19 nt, Salmonella enterica enterica serovar Typhi
auaugcggagccucuuccu

SEQ ID NO: 1685468 - RNA, 22 nt, Salmonella enterica enterica serovar Typhi
auaugcgcugcgaagugaauau

SEQ ID NO: 1685469 - RNA, 15 nt, Salmonella enterica enterica serovar Typhi
auaugcgccaacugc

SEQ ID NO: 1685470 - RNA, 17 nt, Salmonella enterica enterica serovar Typhi
auaugccggauaguuac

SEQ ID NO: 1685471 - RNA, 18 nt, Salmonella enterica enterica serovar Typhi
auaugccccgacaucaga

SEQ ID NO: 1685472 - RNA, 13 nt, Salmonella enterica enterica serovar Typhi
auaugccaggcau

SEQ ID NO: 1685473 - RNA, 19 nt, Salmonella enterica enterica serovar Typhi
auaugccaaguaauaaaga

SEQ ID NO: 1685474 - RNA, 14 nt, Salmonella enterica enterica serovar Typhi
auaugccaaguaau

SEQ ID NO: 1685475 - RNA, 17 nt, Salmonella enterica enterica serovar Typhi
auaugcaggcauaaaaa

SEQ ID NO: 1685476 - RNA, 21 nt, Salmonella enterica enterica serovar Typhi
auaugcaggcauaaaaaagag

SEQ ID NO: 1685477 - RNA, 23 nt, Salmonella enterica enterica serovar Typhi
auaugcggucguauuaccaaccc

SEQ ID NO: 1685478 - RNA, 18 nt, Salmonella enterica enterica serovar Typhi
auaugcuguuuauggcgc

SEQ ID NO: 1685479 - RNA, 20 nt, Salmonella enterica enterica serovar Typhi
auauggauauucaucgccgu

SEQ ID NO: 1685480 - RNA, 17 nt, Salmonella enterica enterica serovar Typhi
auauggaugagucuugc

SEQ ID NO: 1685481 - RNA, 18 nt, Salmonella enterica enterica serovar Typhi
aucuucacuucacaaaca

SEQ ID NO: 1685482 - RNA, 19 nt, Salmonella enterica enterica serovar Typhi
aucuucaccgaugcccagc

SEQ ID NO: 1685483 - RNA, 22 nt, Salmonella enterica enterica serovar Typhi
aucuucauaaauagccagcauc

SEQ ID NO: 1685484 - RNA, 15 nt, Salmonella enterica enterica serovar Typhi
aucuucagcccguuc

SEQ ID NO: 1685485 - RNA, 12 nt, Salmonella enterica enterica serovar Typhi
aucuucaguaag

SEQ ID NO: 1685486 - RNA, 16 nt, Salmonella enterica enterica serovar Typhi
aucuguugcgcaagca

SEQ ID NO: 1685487 - RNA, 15 nt, Salmonella enterica enterica serovar Typhi
aucuguucaaaaaca

SEQ ID NO: 1685488 - RNA, 15 nt, Salmonella enterica enterica serovar Typhi
aucuguuuuagcaug

SEQ ID NO: 1685489 - RNA, 15 nt, Salmonella enterica enterica serovar Typhi
aucuggugauaaagc

SEQ ID NO: 1685490 - RNA, 19 nt, Salmonella enterica enterica serovar Typhi
aucugguggaaaagaaaac

SEQ ID NO: 1685491 - RNA, 18 nt, Salmonella enterica enterica serovar Typhi
aucuggugauaaagcaga

SEQ ID NO: 1685492 - RNA, 18 nt, Salmonella enterica enterica serovar Typhi
aucugguuauccaccagc

SEQ ID NO: 1685493 - RNA, 14 nt, Salmonella enterica enterica serovar Typhi
aucugguucacaga

SEQ ID NO: 1685494 - RNA, 17 nt, Salmonella enterica enterica serovar Typhi
aucugguuugguaaaga

SEQ ID NO: 1685495 - RNA, 17 nt, Salmonella enterica enterica serovar Typhi
aucuguaauuauaaaua

SEQ ID NO: 1685496 - RNA, 20 nt, Salmonella enterica enterica serovar Typhi
aucuguaggcccgguaagcg

SEQ ID NO: 1685497 - RNA, 15 nt, Salmonella enterica enterica serovar Typhi
aucuguauaaauaac

SEQ ID NO: 1685498 - RNA, 21 nt, Salmonella enterica enterica serovar Typhi
aucugucccagccuuccuggu

SEQ ID NO: 1685499 - RNA, 17 nt, Salmonella enterica enterica serovar Typhi
aucugugccagcccaau

SEQ ID NO: 1685500 - RNA, 14 nt, Salmonella enterica enterica serovar Typhi
aucugucugcugua

SEQ ID NO: 1685501 - RNA, 18 nt, Salmonella enterica enterica serovar Typhi
aucugugccagcccaaua

SEQ ID NO: 1685502 - RNA, 16 nt, Salmonella enterica enterica serovar Typhi
aucuggucauggcuua

SEQ ID NO: 1685503 - RNA, 22 nt, Salmonella enterica enterica serovar Typhi
aucuggucaggugauugcccuc

SEQ ID NO: 1685504 - RNA, 14 nt, Salmonella enterica enterica serovar Typhi
aucuggacgccaau

SEQ ID NO: 1685505 - RNA, 18 nt, Salmonella enterica enterica serovar Typhi
aucugcuccgccagcaau

SEQ ID NO: 1685506 - RNA, 17 nt, Salmonella enterica enterica serovar Typhi
aucuugcuuuauuuuua

SEQ ID NO: 1685507 - RNA, 13 nt, Salmonella enterica enterica serovar Typhi
aucuuguccucau

SEQ ID NO: 1685508 - RNA, 16 nt, Salmonella enterica enterica serovar Typhi
aucuuguccucaucau

SEQ ID NO: 1685509 - RNA, 12 nt, Salmonella enterica enterica serovar Typhi
aucuugggaaua

SEQ ID NO: 1685510 - RNA, 21 nt, Salmonella enterica enterica serovar Typhi
aucuucguuggcgcugccgga

SEQ ID NO: 1685511 - RNA, 18 nt, Salmonella enterica enterica serovar Typhi
aucuucuacaaugcggua

SEQ ID NO: 1685512 - RNA, 19 nt, Salmonella enterica enterica serovar Typhi
aucuucuccauugaucacu

SEQ ID NO: 1685513 - RNA, 20 nt, Salmonella enterica enterica serovar Typhi
aucuuccaacuguacgccac

SEQ ID NO: 1685514 - RNA, 13 nt, Salmonella enterica enterica serovar Typhi
aucuuccagcauc

SEQ ID NO: 1685515 - RNA, 20 nt, Salmonella enterica enterica serovar Typhi
aucuucauguucuaacagau

SEQ ID NO: 1685516 - RNA, 13 nt, Salmonella enterica enterica serovar Typhi
aucuucccgcaga

SEQ ID NO: 1685517 - RNA, 13 nt, Salmonella enterica enterica serovar Typhi
aucuucccaccgc

SEQ ID NO: 1685518 - RNA, 21 nt, Salmonella enterica enterica serovar Typhi
aucuuccucacagccuugcca

SEQ ID NO: 1685519 - RNA, 21 nt, Salmonella enterica enterica serovar Typhi
aucuucgccguauucuuaccc

SEQ ID NO: 1685520 - RNA, 21 nt, Salmonella enterica enterica serovar Typhi
aucuucgccguguucuuaccc

SEQ ID NO: 1685521 - RNA, 13 nt, Salmonella enterica enterica serovar Typhi
aucuucgauaaga

SEQ ID NO: 1685522 - RNA, 22 nt, Salmonella enterica enterica serovar Typhi
aucuucggcgggaucuccagaa

SEQ ID NO: 1685523 - RNA, 19 nt, Salmonella enterica enterica serovar Typhi
aucuucggcgggaucucca

SEQ ID NO: 1685524 - RNA, 21 nt, Salmonella enterica enterica serovar Typhi
aucuucggcgggaucuccaga

SEQ ID NO: 1685525 - RNA, 18 nt, Salmonella enterica enterica serovar Typhi
augaaaaauauaaaaagc

SEQ ID NO: 1685526 - RNA, 15 nt, Salmonella enterica enterica serovar Typhi
augaaaaaucggcaa

SEQ ID NO: 1685527 - RNA, 19 nt, Salmonella enterica enterica serovar Typhi
aucuuuuaaaaucagauug

SEQ ID NO: 1685528 - RNA, 10 nt, Salmonella enterica enterica serovar Typhi
augaaaaaaa

SEQ ID NO: 1685529 - RNA, 12 nt, Salmonella enterica enterica serovar Typhi
augaaaacucgg

SEQ ID NO: 1685530 - RNA, 19 nt, Salmonella enterica enterica serovar Typhi
augaaaugagaccaauaag

SEQ ID NO: 1685531 - RNA, 14 nt, Salmonella enterica enterica serovar Typhi
aucuuucuuuuuau

SEQ ID NO: 1685532 - RNA, 20 nt, Salmonella enterica enterica serovar Typhi
aucuuuaugucaguaauaua

SEQ ID NO: 1685533 - RNA, 14 nt, Salmonella enterica enterica serovar Typhi
aucuuugccgcaaa

SEQ ID NO: 1685534 - RNA, 14 nt, Salmonella enterica enterica serovar Typhi
aucuuuguucuguu

SEQ ID NO: 1685535 - RNA, 15 nt, Salmonella enterica enterica serovar Typhi
augaccgccuuuuuu

SEQ ID NO: 1685536 - RNA, 22 nt, Salmonella enterica enterica serovar Typhi
augacauagcauaauaaugaau

SEQ ID NO: 1685537 - RNA, 20 nt, Salmonella enterica enterica serovar Typhi
augaccguuaguaaucggau

SEQ ID NO: 1685538 - RNA, 21 nt, Salmonella enterica enterica serovar Typhi
augacggcaaagcccacgccc

SEQ ID NO: 1685539 - RNA, 17 nt, Salmonella enterica enterica serovar Typhi
augacgcuggaaguaug

SEQ ID NO: 1685540 - RNA, 13 nt, Salmonella enterica enterica serovar Typhi
augacgggggcga

SEQ ID NO: 1685541 - RNA, 18 nt, Salmonella enterica enterica serovar Typhi
augacggcgcguuaucgu

SEQ ID NO: 1685542 - RNA, 23 nt, Salmonella enterica enterica serovar Typhi
augacggcagucgcuacaaccag

SEQ ID NO: 1685543 - RNA, 23 nt, Salmonella enterica enterica serovar Typhi
augacgggaucgaaccgccgacc

SEQ ID NO: 1685544 - RNA, 19 nt, Salmonella enterica enterica serovar Typhi
augacgguauugcuuucaa

SEQ ID NO: 1685545 - RNA, 14 nt, Salmonella enterica enterica serovar Typhi
augacgucagcaag

SEQ ID NO: 1685546 - RNA, 14 nt, Salmonella enterica enterica serovar Typhi
augacguccaggcc

SEQ ID NO: 1685547 - RNA, 23 nt, Salmonella enterica enterica serovar Typhi
augacaauauugccauaaauaca

SEQ ID NO: 1685548 - RNA, 13 nt, Salmonella enterica enterica serovar Typhi
augacagaaagcg

SEQ ID NO: 1685549 - RNA, 13 nt, Salmonella enterica enterica serovar Typhi
augacaacauaaa

SEQ ID NO: 1685550 - RNA, 13 nt, Salmonella enterica enterica serovar Typhi
augacaaaaauua

SEQ ID NO: 1685551 - RNA, 22 nt, Salmonella enterica enterica serovar Typhi
augaacaugacgccgaaauaaa

SEQ ID NO: 1685552 - RNA, 21 nt, Salmonella enterica enterica serovar Typhi
augaaccauaucaaacaggac

SEQ ID NO: 1685553 - RNA, 11 nt, Salmonella enterica enterica serovar Typhi
augaaccggga

SEQ ID NO: 1685554 - RNA, 16 nt, Salmonella enterica enterica serovar Typhi
augaacguuaucggca

SEQ ID NO: 1685555 - RNA, 12 nt, Salmonella enterica enterica serovar Typhi
augagccagccc

SEQ ID NO: 1685556 - RNA, 18 nt, Salmonella enterica enterica serovar Typhi
augagccagauggauaac

SEQ ID NO: 1685557 - RNA, 12 nt, Salmonella enterica enterica serovar Typhi
augagcaggccc

SEQ ID NO: 1685558 - RNA, 22 nt, Salmonella enterica enterica serovar Typhi
augagcgcgaaaucaaagaccu

SEQ ID NO: 1685559 - RNA, 21 nt, Salmonella enterica enterica serovar Typhi
augagcacgcggaagaaauag

SEQ ID NO: 1685560 - RNA, 12 nt, Salmonella enterica enterica serovar Typhi
augagcaggcca

SEQ ID NO: 1685561 - RNA, 13 nt, Salmonella enterica enterica serovar Typhi
augacguucaauu

SEQ ID NO: 1685562 - RNA, 15 nt, Salmonella enterica enterica serovar Typhi
augacuaauggcauu

SEQ ID NO: 1685563 - RNA, 20 nt, Salmonella enterica enterica serovar Typhi
augauacguggcucaaggau

SEQ ID NO: 1685564 - RNA, 19 nt, Salmonella enterica enterica serovar Typhi
augauagcgccauauaaau

SEQ ID NO: 1685565 - RNA, 18 nt, Salmonella enterica enterica serovar Typhi
augauauccagcacgccu

SEQ ID NO: 1685566 - RNA, 20 nt, Salmonella enterica enterica serovar Typhi
augaggauauugguaucaaa

SEQ ID NO: 1685567 - RNA, 20 nt, Salmonella enterica enterica serovar Typhi
augaggacggcccgcugucu

SEQ ID NO: 1685568 - RNA, 19 nt, Salmonella enterica enterica serovar Typhi
augauaauuguuaauuauu

SEQ ID NO: 1685569 - RNA, 13 nt, Salmonella enterica enterica serovar Typhi
augauaaugccgc

SEQ ID NO: 1685570 - RNA, 16 nt, Salmonella enterica enterica serovar Typhi
augauaauaugcucaa

SEQ ID NO: 1685571 - RNA, 15 nt, Salmonella enterica enterica serovar Typhi
augaucauacugccg

SEQ ID NO: 1685572 - RNA, 20 nt, Salmonella enterica enterica serovar Typhi
augaucacuuccgccaccac

SEQ ID NO: 1685573 - RNA, 21 nt, Salmonella enterica enterica serovar Typhi
augauaucggccggaugccag

SEQ ID NO: 1685574 - RNA, 22 nt, Salmonella enterica enterica serovar Typhi
augauaucggccggaugccagu

SEQ ID NO: 1685575 - RNA, 16 nt, Salmonella enterica enterica serovar Typhi
augaucguaugcagcc

SEQ ID NO: 1685576 - RNA, 20 nt, Salmonella enterica enterica serovar Typhi
augaucguaugcagccaggc

SEQ ID NO: 1685577 - RNA, 16 nt, Salmonella enterica enterica serovar Typhi
augaucgcccagccac

SEQ ID NO: 1685578 - RNA, 18 nt, Salmonella enterica enterica serovar Typhi
augaugccacgagaaauc

SEQ ID NO: 1685579 - RNA, 17 nt, Salmonella enterica enterica serovar Typhi
augaugcgcuguaaaug

SEQ ID NO: 1685580 - RNA, 18 nt, Salmonella enterica enterica serovar Typhi
augaugccaggaccaggu

SEQ ID NO: 1685581 - RNA, 16 nt, Salmonella enterica enterica serovar Typhi
augaugcauuugauuu

SEQ ID NO: 1685582 - RNA, 19 nt, Salmonella enterica enterica serovar Typhi
augaucuuaccucuccuga

SEQ ID NO: 1685583 - RNA, 15 nt, Salmonella enterica enterica serovar Typhi
augauuaucaucuau

SEQ ID NO: 1685584 - RNA, 19 nt, Salmonella enterica enterica serovar Typhi
augauuauuguuaaaaaga

SEQ ID NO: 1685585 - RNA, 15 nt, Salmonella enterica enterica serovar Typhi
augauuaauuguacc

SEQ ID NO: 1685586 - RNA, 15 nt, Salmonella enterica enterica serovar Typhi
augauuaaaauaaau

SEQ ID NO: 1685587 - RNA, 14 nt, Salmonella enterica enterica serovar Typhi
augauuaaaauaaa

SEQ ID NO: 1685588 - RNA, 15 nt, Salmonella enterica enterica serovar Typhi
augcaccucgccaaa

SEQ ID NO: 1685589 - RNA, 18 nt, Salmonella enterica enterica serovar Typhi
augcacugcaauuucugc

SEQ ID NO: 1685590 - RNA, 14 nt, Salmonella enterica enterica serovar Typhi
augcagaccucugc

SEQ ID NO: 1685591 - RNA, 14 nt, Salmonella enterica enterica serovar Typhi
augcacugcugaua

SEQ ID NO: 1685592 - RNA, 21 nt, Salmonella enterica enterica serovar Typhi
augcagcaucaugucacccac

SEQ ID NO: 1685593 - RNA, 13 nt, Salmonella enterica enterica serovar Typhi
augcauaaucgcc

SEQ ID NO: 1685594 - RNA, 14 nt, Salmonella enterica enterica serovar Typhi
augcauaaugcagc

SEQ ID NO: 1685595 - RNA, 18 nt, Salmonella enterica enterica serovar Typhi
augcauauuauucaugau

SEQ ID NO: 1685596 - RNA, 20 nt, Salmonella enterica enterica serovar Typhi
augcauacggaugaaauacu

SEQ ID NO: 1685597 - RNA, 14 nt, Salmonella enterica enterica serovar Typhi
augcaaaagaaaaa

SEQ ID NO: 1685598 - RNA, 16 nt, Salmonella enterica enterica serovar Typhi
augcaccagucccagc

SEQ ID NO: 1685599 - RNA, 23 nt, Salmonella enterica enterica serovar Typhi
augauuuucuuauuacaagaaag

SEQ ID NO: 1685600 - RNA, 15 nt, Salmonella enterica enterica serovar Typhi
augauugagcguuuc

SEQ ID NO: 1685601 - RNA, 21 nt, Salmonella enterica enterica serovar Typhi
auggcggugcuuaaccgggau

SEQ ID NO: 1685602 - RNA, 20 nt, Salmonella enterica enterica serovar Typhi
auggcggugcuuaaccggga

SEQ ID NO: 1685603 - RNA, 12 nt, Salmonella enterica enterica serovar Typhi
auggcuggauga

SEQ ID NO: 1685604 - RNA, 21 nt, Salmonella enterica enterica serovar Typhi
auggcgaaaaucggcaggccg

SEQ ID NO: 1685605 - RNA, 18 nt, Salmonella enterica enterica serovar Typhi
auggcgcagcauacgcug

SEQ ID NO: 1685606 - RNA, 22 nt, Salmonella enterica enterica serovar Typhi
auggcgggcgcagguuuuacuu

SEQ ID NO: 1685607 - RNA, 16 nt, Salmonella enterica enterica serovar Typhi
auggcgguauaacugc

SEQ ID NO: 1685608 - RNA, 12 nt, Salmonella enterica enterica serovar Typhi
auggcaaagucg

SEQ ID NO: 1685609 - RNA, 21 nt, Salmonella enterica enterica serovar Typhi
auggccuggcggaugaugcgu

SEQ ID NO: 1685610 - RNA, 14 nt, Salmonella enterica enterica serovar Typhi
auggccugaugacg

SEQ ID NO: 1685611 - RNA, 17 nt, Salmonella enterica enterica serovar Typhi
auggcacaucaggcaaa

SEQ ID NO: 1685612 - RNA, 20 nt, Salmonella enterica enterica serovar Typhi
auggguaggccggauaagcg

SEQ ID NO: 1685613 - RNA, 24 nt, Salmonella enterica enterica serovar Typhi
auggcuucaccguugugcuccagc

SEQ ID NO: 1685614 - RNA, 20 nt, Salmonella enterica enterica serovar Typhi
augggucacauccagacagc

SEQ ID NO: 1685615 - RNA, 17 nt, Salmonella enterica enterica serovar Typhi
auggguuccaguugcac

SEQ ID NO: 1685616 - RNA, 16 nt, Salmonella enterica enterica serovar Typhi
augguauuucagaccg

SEQ ID NO: 1685617 - RNA, 18 nt, Salmonella enterica enterica serovar Typhi
augguugaacaggcugug

SEQ ID NO: 1685618 - RNA, 20 nt, Salmonella enterica enterica serovar Typhi
augguugacuuacaaaaaau

SEQ ID NO: 1685619 - RNA, 11 nt, Salmonella enterica enterica serovar Typhi
augguuauuuu

SEQ ID NO: 1685620 - RNA, 19 nt, Salmonella enterica enterica serovar Typhi
augguuauuaauuacgcug

SEQ ID NO: 1685621 - RNA, 20 nt, Salmonella enterica enterica serovar Typhi
augguucaggcggauauaug

SEQ ID NO: 1685622 - RNA, 19 nt, Salmonella enterica enterica serovar Typhi
auguaaacuccauuaaauu

SEQ ID NO: 1685623 - RNA, 23 nt, Salmonella enterica enterica serovar Typhi
auguaaacuccauuaaauuacuu

SEQ ID NO: 1685624 - RNA, 18 nt, Salmonella enterica enterica serovar Typhi
auggugcggcgcacugcc

SEQ ID NO: 1685625 - RNA, 13 nt, Salmonella enterica enterica serovar Typhi
auggugcucagcc

SEQ ID NO: 1685626 - RNA, 17 nt, Salmonella enterica enterica serovar Typhi
auggucccugauauaca

SEQ ID NO: 1685627 - RNA, 19 nt, Salmonella enterica enterica serovar Typhi
augguggagggguauuuau

SEQ ID NO: 1685628 - RNA, 18 nt, Salmonella enterica enterica serovar Typhi
augguuauaguccacuuu

SEQ ID NO: 1685629 - RNA, 17 nt, Salmonella enterica enterica serovar Typhi
augguuauccagcaggu

SEQ ID NO: 1685630 - RNA, 23 nt, Salmonella enterica enterica serovar Typhi
auguacaggugaaauaggggaga

SEQ ID NO: 1685631 - RNA, 20 nt, Salmonella enterica enterica serovar Typhi
auguacauaggcaauauccu

SEQ ID NO: 1685632 - RNA, 18 nt, Salmonella enterica enterica serovar Typhi
auguaccauugucaaaaa

SEQ ID NO: 1685633 - RNA, 16 nt, Salmonella enterica enterica serovar Typhi
auguacaacuucauga

SEQ ID NO: 1685634 - RNA, 13 nt, Salmonella enterica enterica serovar Typhi
auguacaggugaa

SEQ ID NO: 1685635 - RNA, 20 nt, Salmonella enterica enterica serovar Typhi
auguacacgaaauagcgcag

SEQ ID NO: 1685636 - RNA, 12 nt, Salmonella enterica enterica serovar Typhi
auguaaaugacg

SEQ ID NO: 1685637 - RNA, 16 nt, Salmonella enterica enterica serovar Typhi
auguaacgccuuugcc

SEQ ID NO: 1685638 - RNA, 22 nt, Salmonella enterica enterica serovar Typhi
auguacuguauucgguggaaac

SEQ ID NO: 1685639 - RNA, 20 nt, Salmonella enterica enterica serovar Typhi
auguaccauugucaaaaaua

SEQ ID NO: 1685640 - RNA, 17 nt, Salmonella enterica enterica serovar Typhi
auguaccugcguuaaac

SEQ ID NO: 1685641 - RNA, 16 nt, Salmonella enterica enterica serovar Typhi
auguacgccuaaaaau

SEQ ID NO: 1685642 - RNA, 17 nt, Salmonella enterica enterica serovar Typhi
auguacgccuaaaaaug

SEQ ID NO: 1685643 - RNA, 22 nt, Salmonella enterica enterica serovar Typhi
auguauucucccgucagcaaca

SEQ ID NO: 1685644 - RNA, 20 nt, Salmonella enterica enterica serovar Typhi
augucaucaggcgguguugu

SEQ ID NO: 1685645 - RNA, 14 nt, Salmonella enterica enterica serovar Typhi
augucaucggcuuu

SEQ ID NO: 1685646 - RNA, 23 nt, Salmonella enterica enterica serovar Typhi
augucgauucacguagcguauca

SEQ ID NO: 1685647 - RNA, 22 nt, Salmonella enterica enterica serovar Typhi
augucaucaacauuggaaaacu

SEQ ID NO: 1685648 - RNA, 17 nt, Salmonella enterica enterica serovar Typhi
augucgcgucagguuua

SEQ ID NO: 1685649 - RNA, 17 nt, Salmonella enterica enterica serovar Typhi
augucggcgaaaauccu

SEQ ID NO: 1685650 - RNA, 12 nt, Salmonella enterica enterica serovar Typhi
augucaggauca

SEQ ID NO: 1685651 - RNA, 13 nt, Salmonella enterica enterica serovar Typhi
auguauuuaaguc

SEQ ID NO: 1685652 - RNA, 16 nt, Salmonella enterica enterica serovar Typhi
augucaacuuaaacgu

SEQ ID NO: 1685653 - RNA, 14 nt, Salmonella enterica enterica serovar Typhi
auguucgaacaugc

SEQ ID NO: 1685654 - RNA, 18 nt, Salmonella enterica enterica serovar Typhi
auguuccuggauagauuu

SEQ ID NO: 1685655 - RNA, 23 nt, Salmonella enterica enterica serovar Typhi
auguuccuggacguggguuucaa

SEQ ID NO: 1685656 - RNA, 22 nt, Salmonella enterica enterica serovar Typhi
augugucuauuuauugaagaug

SEQ ID NO: 1685657 - RNA, 17 nt, Salmonella enterica enterica serovar Typhi
auguuagcuucacuucg

SEQ ID NO: 1685658 - RNA, 18 nt, Salmonella enterica enterica serovar Typhi
auguuagcauuauuuuua

SEQ ID NO: 1685659 - RNA, 14 nt, Salmonella enterica enterica serovar Typhi
augugcgccagccu

SEQ ID NO: 1685660 - RNA, 23 nt, Salmonella enterica enterica serovar Typhi
augugcggagaagacgccgccgc

SEQ ID NO: 1685661 - RNA, 19 nt, Salmonella enterica enterica serovar Typhi
augugcuauuuucucuugc

SEQ ID NO: 1685662 - RNA, 19 nt, Salmonella enterica enterica serovar Typhi
augugguugugguaaucaa

SEQ ID NO: 1685663 - RNA, 17 nt, Salmonella enterica enterica serovar Typhi
augucuggcgcuaaaau

SEQ ID NO: 1685664 - RNA, 22 nt, Salmonella enterica enterica serovar Typhi
augucuggcgcuaaaauccacu

SEQ ID NO: 1685665 - RNA, 23 nt, Salmonella enterica enterica serovar Typhi
auggacgggauacggcgagacca

SEQ ID NO: 1685666 - RNA, 14 nt, Salmonella enterica enterica serovar Typhi
auggagaugaaaau

SEQ ID NO: 1685667 - RNA, 16 nt, Salmonella enterica enterica serovar Typhi
auggacagauuuccac

SEQ ID NO: 1685668 - RNA, 18 nt, Salmonella enterica enterica serovar Typhi
auggacaccggaagugaa

SEQ ID NO: 1685669 - RNA, 23 nt, Salmonella enterica enterica serovar Typhi
auggaugcccaccugaaaaaggg

SEQ ID NO: 1685670 - RNA, 18 nt, Salmonella enterica enterica serovar Typhi
auggauaacgaaaagggu

SEQ ID NO: 1685671 - RNA, 20 nt, Salmonella enterica enterica serovar Typhi
augcuuuccagccaugccag

SEQ ID NO: 1685672 - RNA, 15 nt, Salmonella enterica enterica serovar Typhi
augcuuucagcaugu

SEQ ID NO: 1685673 - RNA, 19 nt, Salmonella enterica enterica serovar Typhi
augcuuucaauaaaucaau

SEQ ID NO: 1685674 - RNA, 21 nt, Salmonella enterica enterica serovar Typhi
auggaacucugcgacgccagg

SEQ ID NO: 1685675 - RNA, 22 nt, Salmonella enterica enterica serovar Typhi
auggaacucugcgacgccaggc

SEQ ID NO: 1685676 - RNA, 20 nt, Salmonella enterica enterica serovar Typhi
auggaacugccuggcucauu

SEQ ID NO: 1685677 - RNA, 15 nt, Salmonella enterica enterica serovar Typhi
auggacaaaaaagga

SEQ ID NO: 1685678 - RNA, 21 nt, Salmonella enterica enterica serovar Typhi
augcugauuaaugauuugcuu

SEQ ID NO: 1685679 - RNA, 15 nt, Salmonella enterica enterica serovar Typhi
augcugauacaaagc

SEQ ID NO: 1685680 - RNA, 21 nt, Salmonella enterica enterica serovar Typhi
augcugcaccgcaucaaacuu

SEQ ID NO: 1685681 - RNA, 16 nt, Salmonella enterica enterica serovar Typhi
augcugcaucuuacug

SEQ ID NO: 1685682 - RNA, 13 nt, Salmonella enterica enterica serovar Typhi
augcugcagggcc

SEQ ID NO: 1685683 - RNA, 18 nt, Salmonella enterica enterica serovar Typhi
augcugacggauucuucc

SEQ ID NO: 1685684 - RNA, 20 nt, Salmonella enterica enterica serovar Typhi
augcugaauagccagccccc

SEQ ID NO: 1685685 - RNA, 14 nt, Salmonella enterica enterica serovar Typhi
augcugaacagccg

SEQ ID NO: 1685686 - RNA, 13 nt, Salmonella enterica enterica serovar Typhi
augcugaauagcc

SEQ ID NO: 1685687 - RNA, 15 nt, Salmonella enterica enterica serovar Typhi
augcugaauagccag

SEQ ID NO: 1685688 - RNA, 15 nt, Salmonella enterica enterica serovar Typhi
augcugcucgaagau

SEQ ID NO: 1685689 - RNA, 23 nt, Salmonella enterica enterica serovar Typhi
augcugcgguuauaauaauaauu

SEQ ID NO: 1685690 - RNA, 21 nt, Salmonella enterica enterica serovar Typhi
augcugcguacaaucgcguuu

SEQ ID NO: 1685691 - RNA, 20 nt, Salmonella enterica enterica serovar Typhi
augcugggcgugucccugga

SEQ ID NO: 1685692 - RNA, 22 nt, Salmonella enterica enterica serovar Typhi
augcuuccagccguuuaaucuc

SEQ ID NO: 1685693 - RNA, 15 nt, Salmonella enterica enterica serovar Typhi
augcuuuaaaugccu

SEQ ID NO: 1685694 - RNA, 17 nt, Salmonella enterica enterica serovar Typhi
augcuuuaaaugccugu

SEQ ID NO: 1685695 - RNA, 22 nt, Salmonella enterica enterica serovar Typhi
augcugguuuuagcuuauccca

SEQ ID NO: 1685696 - RNA, 21 nt, Salmonella enterica enterica serovar Typhi
augcugucgccggaaaaaaug

SEQ ID NO: 1685697 - RNA, 21 nt, Salmonella enterica enterica serovar Typhi
augcugugugaccagcaguuc

SEQ ID NO: 1685698 - RNA, 23 nt, Salmonella enterica enterica serovar Typhi
augcucagggcauccgccgccgc

SEQ ID NO: 1685699 - RNA, 22 nt, Salmonella enterica enterica serovar Typhi
augcucaaccaguaccgggccu

SEQ ID NO: 1685700 - RNA, 17 nt, Salmonella enterica enterica serovar Typhi
augcuccaauaaauauu

SEQ ID NO: 1685701 - RNA, 22 nt, Salmonella enterica enterica serovar Typhi
augcuauucagcaguucauucg

SEQ ID NO: 1685702 - RNA, 12 nt, Salmonella enterica enterica serovar Typhi
augcucaaccag

SEQ ID NO: 1685703 - RNA, 21 nt, Salmonella enterica enterica serovar Typhi
augcuccaguuguuccagcag

SEQ ID NO: 1685704 - RNA, 20 nt, Salmonella enterica enterica serovar Typhi
augcucugcugugccaguac

SEQ ID NO: 1685705 - RNA, 13 nt, Salmonella enterica enterica serovar Typhi
augcucuccagca

SEQ ID NO: 1685706 - RNA, 17 nt, Salmonella enterica enterica serovar Typhi
augcguauuuccaccuu

SEQ ID NO: 1685707 - RNA, 20 nt, Salmonella enterica enterica serovar Typhi
augcguagggugaugccuuc

SEQ ID NO: 1685708 - RNA, 16 nt, Salmonella enterica enterica serovar Typhi
augcguccgcccagaa

SEQ ID NO: 1685709 - RNA, 22 nt, Salmonella enterica enterica serovar Typhi
augcgucagcgcggcuuccagu

SEQ ID NO: 1685710 - RNA, 12 nt, Salmonella enterica enterica serovar Typhi
augcguucaaaa

SEQ ID NO: 1685711 - RNA, 21 nt, Salmonella enterica enterica serovar Typhi
augcggcugacgauacucagc

SEQ ID NO: 1685712 - RNA, 18 nt, Salmonella enterica enterica serovar Typhi
augcgguucucccggcau

SEQ ID NO: 1685713 - RNA, 22 nt, Salmonella enterica enterica serovar Typhi
augcguaccugcgcgcaggucu

SEQ ID NO: 1685714 - RNA, 22 nt, Salmonella enterica enterica serovar Typhi
augcauuugauuuguuuuuuau

SEQ ID NO: 1685715 - RNA, 16 nt, Salmonella enterica enterica serovar Typhi
augcgaauaacaucau

SEQ ID NO: 1685716 - RNA, 16 nt, Salmonella enterica enterica serovar Typhi
augcgacuaaccugau

SEQ ID NO: 1685717 - RNA, 16 nt, Salmonella enterica enterica serovar Typhi
augcgcaugggcauaa

SEQ ID NO: 1685718 - RNA, 15 nt, Salmonella enterica enterica serovar Typhi
augcgcaugggcaua

SEQ ID NO: 1685719 - RNA, 23 nt, Salmonella enterica enterica serovar Typhi
augcggcaaaaauccuucuucca

SEQ ID NO: 1685720 - RNA, 17 nt, Salmonella enterica enterica serovar Typhi
augcgcuuccagcauga

SEQ ID NO: 1685721 - RNA, 20 nt, Salmonella enterica enterica serovar Typhi
augcgcgucccggcagugca

SEQ ID NO: 1685722 - RNA, 18 nt, Salmonella enterica enterica serovar Typhi
augcgcgucaggccaggg

SEQ ID NO: 1685723 - RNA, 21 nt, Salmonella enterica enterica serovar Typhi
augcgccugguugacccgcau

SEQ ID NO: 1685724 - RNA, 14 nt, Salmonella enterica enterica serovar Typhi
augcgccugucucc

SEQ ID NO: 1685725 - RNA, 17 nt, Salmonella enterica enterica serovar Typhi
augcgccuguuagggcg

SEQ ID NO: 1685726 - RNA, 13 nt, Salmonella enterica enterica serovar Typhi
augcgccauccca

SEQ ID NO: 1685727 - RNA, 17 nt, Salmonella enterica enterica serovar Typhi
augcgccagcggccagc

SEQ ID NO: 1685728 - RNA, 12 nt, Salmonella enterica enterica serovar Typhi
augcgccaggca

SEQ ID NO: 1685729 - RNA, 22 nt, Salmonella enterica enterica serovar Typhi
augcgccgccuuggcgaccuga

SEQ ID NO: 1685730 - RNA, 17 nt, Salmonella enterica enterica serovar Typhi
augcgcccggagcggug

SEQ ID NO: 1685731 - RNA, 17 nt, Salmonella enterica enterica serovar Typhi
augcgccccugcaggcg

SEQ ID NO: 1685732 - RNA, 15 nt, Salmonella enterica enterica serovar Typhi
aucaggaaaucuucc

SEQ ID NO: 1685733 - RNA, 18 nt, Salmonella enterica enterica serovar Typhi
aucaggaaaucuuccagu

SEQ ID NO: 1685734 - RNA, 18 nt, Salmonella enterica enterica serovar Typhi
aucaggcaugccaaacca

SEQ ID NO: 1685735 - RNA, 19 nt, Salmonella enterica enterica serovar Typhi
aucaggcauucagcggguu

SEQ ID NO: 1685736 - RNA, 15 nt, Salmonella enterica enterica serovar Typhi
aucaggcauaaaccu

SEQ ID NO: 1685737 - RNA, 19 nt, Salmonella enterica enterica serovar Typhi
aucaggccgacaaaugacg

SEQ ID NO: 1685738 - RNA, 19 nt, Salmonella enterica enterica serovar Typhi
aucaggcaauaaacaucag

SEQ ID NO: 1685739 - RNA, 16 nt, Salmonella enterica enterica serovar Typhi
aucaggaugaauauga

SEQ ID NO: 1685740 - RNA, 22 nt, Salmonella enterica enterica serovar Typhi
aucaggauucgacggccagcgc

SEQ ID NO: 1685741 - RNA, 15 nt, Salmonella enterica enterica serovar Typhi
aucaggauuauuaca

SEQ ID NO: 1685742 - RNA, 14 nt, Salmonella enterica enterica serovar Typhi
aucaggaucuucau

SEQ ID NO: 1685743 - RNA, 17 nt, Salmonella enterica enterica serovar Typhi
aucaggccuaccaucgc

SEQ ID NO: 1685744 - RNA, 19 nt, Salmonella enterica enterica serovar Typhi
aucaggccugcaaaccucu

SEQ ID NO: 1685745 - RNA, 20 nt, Salmonella enterica enterica serovar Typhi
aucaggccuacauccggcuc

SEQ ID NO: 1685746 - RNA, 15 nt, Salmonella enterica enterica serovar Typhi
aucaggccuaccagc

SEQ ID NO: 1685747 - RNA, 20 nt, Salmonella enterica enterica serovar Typhi
aucaggcgagagaagaauuc

SEQ ID NO: 1685748 - RNA, 17 nt, Salmonella enterica enterica serovar Typhi
aucaggcgugaugacuu

SEQ ID NO: 1685749 - RNA, 21 nt, Salmonella enterica enterica serovar Typhi
aucaggcguuacagacgcugc

SEQ ID NO: 1685750 - RNA, 14 nt, Salmonella enterica enterica serovar Typhi
aucagguuguccug

SEQ ID NO: 1685751 - RNA, 22 nt, Salmonella enterica enterica serovar Typhi
aucaguacgaccccgccgagaa

SEQ ID NO: 1685752 - RNA, 17 nt, Salmonella enterica enterica serovar Typhi
aucaguaacacaaucag

SEQ ID NO: 1685753 - RNA, 20 nt, Salmonella enterica enterica serovar Typhi
aucaguggcggcaaaaaaua

SEQ ID NO: 1685754 - RNA, 17 nt, Salmonella enterica enterica serovar Typhi
aucagugcaucuucacu

SEQ ID NO: 1685755 - RNA, 19 nt, Salmonella enterica enterica serovar Typhi
aucaguccgggcauaaccu

SEQ ID NO: 1685756 - RNA, 21 nt, Salmonella enterica enterica serovar Typhi
aucauaaaaggcugagaaggu

SEQ ID NO: 1685757 - RNA, 18 nt, Salmonella enterica enterica serovar Typhi
aucauaaagcgcccggug

SEQ ID NO: 1685758 - RNA, 19 nt, Salmonella enterica enterica serovar Typhi
aucaguuccaacccuugcu

SEQ ID NO: 1685759 - RNA, 20 nt, Salmonella enterica enterica serovar Typhi
aucaguuccaaucucuuuug

SEQ ID NO: 1685760 - RNA, 13 nt, Salmonella enterica enterica serovar Typhi
aucauaagggagc

SEQ ID NO: 1685761 - RNA, 22 nt, Salmonella enterica enterica serovar Typhi
aucauagcccugauuaaagaua

SEQ ID NO: 1685762 - RNA, 17 nt, Salmonella enterica enterica serovar Typhi
aucauaucaauauguuc

SEQ ID NO: 1685763 - RNA, 22 nt, Salmonella enterica enterica serovar Typhi
aucaucgcauugagcaggggcu

SEQ ID NO: 1685764 - RNA, 20 nt, Salmonella enterica enterica serovar Typhi
aucaucgcuugcccagcaua

SEQ ID NO: 1685765 - RNA, 22 nt, Salmonella enterica enterica serovar Typhi
aucaucgcgcugauauuuuuac

SEQ ID NO: 1685766 - RNA, 16 nt, Salmonella enterica enterica serovar Typhi
aucaucuucacuucac

SEQ ID NO: 1685767 - RNA, 16 nt, Salmonella enterica enterica serovar Typhi
aucaucuauaauaccu

SEQ ID NO: 1685768 - RNA, 15 nt, Salmonella enterica enterica serovar Typhi
aucaucguaccaaua

SEQ ID NO: 1685769 - RNA, 14 nt, Salmonella enterica enterica serovar Typhi
aucaucacaauuag

SEQ ID NO: 1685770 - RNA, 12 nt, Salmonella enterica enterica serovar Typhi
aucauccagccc

SEQ ID NO: 1685771 - RNA, 14 nt, Salmonella enterica enterica serovar Typhi
aucauccccggcag

SEQ ID NO: 1685772 - RNA, 17 nt, Salmonella enterica enterica serovar Typhi
aucauccagucagcaau

SEQ ID NO: 1685773 - RNA, 20 nt, Salmonella enterica enterica serovar Typhi
aucaucaucggcacagccag

SEQ ID NO: 1685774 - RNA, 16 nt, Salmonella enterica enterica serovar Typhi
aucaugccgcccaggc

SEQ ID NO: 1685775 - RNA, 13 nt, Salmonella enterica enterica serovar Typhi
aucaugcuugcaa

SEQ ID NO: 1685776 - RNA, 16 nt, Salmonella enterica enterica serovar Typhi
aucaugcuugcuuugc

SEQ ID NO: 1685777 - RNA, 15 nt, Salmonella enterica enterica serovar Typhi
aucaugcugaugacu

SEQ ID NO: 1685778 - RNA, 16 nt, Salmonella enterica enterica serovar Typhi
aucaugcugaugacua

SEQ ID NO: 1685779 - RNA, 14 nt, Salmonella enterica enterica serovar Typhi
aucaugcugcaccg

SEQ ID NO: 1685780 - RNA, 15 nt, Salmonella enterica enterica serovar Typhi
aucaugguugaaaaa

SEQ ID NO: 1685781 - RNA, 14 nt, Salmonella enterica enterica serovar Typhi
aucauggcucagau

SEQ ID NO: 1685782 - RNA, 18 nt, Salmonella enterica enterica serovar Typhi
aucauggacagauuucca

SEQ ID NO: 1685783 - RNA, 11 nt, Salmonella enterica enterica serovar Typhi
aucaugcccac

SEQ ID NO: 1685784 - RNA, 15 nt, Salmonella enterica enterica serovar Typhi
aucaugaauaaucgu

SEQ ID NO: 1685785 - RNA, 16 nt, Salmonella enterica enterica serovar Typhi
aucaugaaaaauauaa

SEQ ID NO: 1685786 - RNA, 20 nt, Salmonella enterica enterica serovar Typhi
aucaugaaaaauauaaaaag

SEQ ID NO: 1685787 - RNA, 18 nt, Salmonella enterica enterica serovar Typhi
aucaucuuuuaccgccug

SEQ ID NO: 1685788 - RNA, 18 nt, Salmonella enterica enterica serovar Typhi
aucauuacuuauauuuau

SEQ ID NO: 1685789 - RNA, 18 nt, Salmonella enterica enterica serovar Typhi
aucauucaacgcaucaaa

SEQ ID NO: 1685790 - RNA, 15 nt, Salmonella enterica enterica serovar Typhi
aucauuaucgccaaa

SEQ ID NO: 1685791 - RNA, 16 nt, Salmonella enterica enterica serovar Typhi
aucaugucaaauucaa

SEQ ID NO: 1685792 - RNA, 17 nt, Salmonella enterica enterica serovar Typhi
aucaugucacccacgcc

SEQ ID NO: 1685793 - RNA, 15 nt, Salmonella enterica enterica serovar Typhi
aucaugugaucuaua

SEQ ID NO: 1685794 - RNA, 20 nt, Salmonella enterica enterica serovar Typhi
aucaugguugaaaaaagccg

SEQ ID NO: 1685795 - RNA, 18 nt, Salmonella enterica enterica serovar Typhi
aucauuaauaaccccagc

SEQ ID NO: 1685796 - RNA, 13 nt, Salmonella enterica enterica serovar Typhi
aucauuaauuuac

SEQ ID NO: 1685797 - RNA, 13 nt, Salmonella enterica enterica serovar Typhi
aucauuaccauag

SEQ ID NO: 1685798 - RNA, 22 nt, Salmonella enterica enterica serovar Typhi
aucauuaccuacgcgauaaaaa

SEQ ID NO: 1685799 - RNA, 16 nt, Salmonella enterica enterica serovar Typhi
aucauguuuuucuccc

SEQ ID NO: 1685800 - RNA, 13 nt, Salmonella enterica enterica serovar Typhi
aucauucccgccc

SEQ ID NO: 1685801 - RNA, 16 nt, Salmonella enterica enterica serovar Typhi
aucauucccgcccagu

SEQ ID NO: 1685802 - RNA, 20 nt, Salmonella enterica enterica serovar Typhi
aucauucccgcccaguauuc

SEQ ID NO: 1685803 - RNA, 16 nt, Salmonella enterica enterica serovar Typhi
aucauucucuacgccc

SEQ ID NO: 1685804 - RNA, 22 nt, Salmonella enterica enterica serovar Typhi
aucauucgggaugcauaaaaaa

SEQ ID NO: 1685805 - RNA, 23 nt, Salmonella enterica enterica serovar Typhi
aucauucgggaugcauaaaaaaa

SEQ ID NO: 1685806 - RNA, 14 nt, Salmonella enterica enterica serovar Typhi
aucauugacuucaa

SEQ ID NO: 1685807 - RNA, 18 nt, Salmonella enterica enterica serovar Typhi
aucauuggggaaccuggc

SEQ ID NO: 1685808 - RNA, 18 nt, Salmonella enterica enterica serovar Typhi
aucauuggggggaaauua

SEQ ID NO: 1685809 - RNA, 22 nt, Salmonella enterica enterica serovar Typhi
aucauugguuaacucaagcgaa

SEQ ID NO: 1685810 - RNA, 22 nt, Salmonella enterica enterica serovar Typhi
auccaaacggaccggcgacuau

SEQ ID NO: 1685811 - RNA, 21 nt, Salmonella enterica enterica serovar Typhi
auccaacacggcgcucaggau

SEQ ID NO: 1685812 - RNA, 15 nt, Salmonella enterica enterica serovar Typhi
auccaacgaaacgca

SEQ ID NO: 1685813 - RNA, 13 nt, Salmonella enterica enterica serovar Typhi
auccaagccccuc

SEQ ID NO: 1685814 - RNA, 14 nt, Salmonella enterica enterica serovar Typhi
auccacaaucgucg

SEQ ID NO: 1685815 - RNA, 13 nt, Salmonella enterica enterica serovar Typhi
auccaccagcgcc

SEQ ID NO: 1685816 - RNA, 13 nt, Salmonella enterica enterica serovar Typhi
auccaccaggcau

SEQ ID NO: 1685817 - RNA, 17 nt, Salmonella enterica enterica serovar Typhi
auccacccgguuuacca

SEQ ID NO: 1685818 - RNA, 13 nt, Salmonella enterica enterica serovar Typhi
auccaccaccuga

SEQ ID NO: 1685819 - RNA, 20 nt, Salmonella enterica enterica serovar Typhi
auccaccaccugauucugca

SEQ ID NO: 1685820 - RNA, 15 nt, Salmonella enterica enterica serovar Typhi
auccaccagaauaaa

SEQ ID NO: 1685821 - RNA, 20 nt, Salmonella enterica enterica serovar Typhi
auccaccagcccaucuuucg

SEQ ID NO: 1685822 - RNA, 17 nt, Salmonella enterica enterica serovar Typhi
auccacauugguuuugc

SEQ ID NO: 1685823 - RNA, 16 nt, Salmonella enterica enterica serovar Typhi
auccacagcgccagaa

SEQ ID NO: 1685824 - RNA, 24 nt, Salmonella enterica enterica serovar Typhi
auccagaacugcgaaaucaccgac

SEQ ID NO: 1685825 - RNA, 13 nt, Salmonella enterica enterica serovar Typhi
auccagacccaga

SEQ ID NO: 1685826 - RNA, 18 nt, Salmonella enterica enterica serovar Typhi
auccagaauaccagaauc

SEQ ID NO: 1685827 - RNA, 21 nt, Salmonella enterica enterica serovar Typhi
auccagaauacgccgccgccc

SEQ ID NO: 1685828 - RNA, 19 nt, Salmonella enterica enterica serovar Typhi
auccagauguuauaaacuu

SEQ ID NO: 1685829 - RNA, 22 nt, Salmonella enterica enterica serovar Typhi
auccagacaaauaccuccuggc

SEQ ID NO: 1685830 - RNA, 22 nt, Salmonella enterica enterica serovar Typhi
auccagaggguaauuucuucca

SEQ ID NO: 1685831 - RNA, 20 nt, Salmonella enterica enterica serovar Typhi
auccacuggucgucugaaag

SEQ ID NO: 1685832 - RNA, 23 nt, Salmonella enterica enterica serovar Typhi
auccacucggcgcugucguucca

SEQ ID NO: 1685833 - RNA, 19 nt, Salmonella enterica enterica serovar Typhi
auccacucccugcuuuuuc

SEQ ID NO: 1685834 - RNA, 19 nt, Salmonella enterica enterica serovar Typhi
auccacggguuacaacugc

SEQ ID NO: 1685835 - RNA, 18 nt, Salmonella enterica enterica serovar Typhi
auccaccgguacgcucca

SEQ ID NO: 1685836 - RNA, 15 nt, Salmonella enterica enterica serovar Typhi
auccaccuuauccug

SEQ ID NO: 1685837 - RNA, 22 nt, Salmonella enterica enterica serovar Typhi
auccacgguucucaccguggca

SEQ ID NO: 1685838 - RNA, 17 nt, Salmonella enterica enterica serovar Typhi
auccaucagccaggguu

SEQ ID NO: 1685839 - RNA, 16 nt, Salmonella enterica enterica serovar Typhi
auccaugcuuucaaua

SEQ ID NO: 1685840 - RNA, 21 nt, Salmonella enterica enterica serovar Typhi
auccauguacgcaggcgacug

SEQ ID NO: 1685841 - RNA, 14 nt, Salmonella enterica enterica serovar Typhi
auccauguugccau

SEQ ID NO: 1685842 - RNA, 19 nt, Salmonella enterica enterica serovar Typhi
auccaugccagcgcgggcg

SEQ ID NO: 1685843 - RNA, 16 nt, Salmonella enterica enterica serovar Typhi
aucccacuuaggcagc

SEQ ID NO: 1685844 - RNA, 13 nt, Salmonella enterica enterica serovar Typhi
aucccagaaaaug

SEQ ID NO: 1685845 - RNA, 21 nt, Salmonella enterica enterica serovar Typhi
aucccacucuucaaccggcag

SEQ ID NO: 1685846 - RNA, 21 nt, Salmonella enterica enterica serovar Typhi
aucccauccgggccacucucc

SEQ ID NO: 1685847 - RNA, 17 nt, Salmonella enterica enterica serovar Typhi
aucccaugcaccagucc

SEQ ID NO: 1685848 - RNA, 16 nt, Salmonella enterica enterica serovar Typhi
auccauuuuaaauaca

SEQ ID NO: 1685849 - RNA, 12 nt, Salmonella enterica enterica serovar Typhi
aucccaaucagg

SEQ ID NO: 1685850 - RNA, 17 nt, Salmonella enterica enterica serovar Typhi
aucccacaacuguucuu

SEQ ID NO: 1685851 - RNA, 17 nt, Salmonella enterica enterica serovar Typhi
aucccaccauaaagcga

SEQ ID NO: 1685852 - RNA, 23 nt, Salmonella enterica enterica serovar Typhi
auccaguggugaaaaagcggcug

SEQ ID NO: 1685853 - RNA, 15 nt, Salmonella enterica enterica serovar Typhi
auccagucagaggaa

SEQ ID NO: 1685854 - RNA, 20 nt, Salmonella enterica enterica serovar Typhi
auccaguuuuuuccagcgcg

SEQ ID NO: 1685855 - RNA, 14 nt, Salmonella enterica enterica serovar Typhi
auccaguuucuucg

SEQ ID NO: 1685856 - RNA, 14 nt, Salmonella enterica enterica serovar Typhi
auccaguuuauauu

SEQ ID NO: 1685857 - RNA, 24 nt, Salmonella enterica enterica serovar Typhi
auccaguuucuucggcuucaccga

SEQ ID NO: 1685858 - RNA, 20 nt, Salmonella enterica enterica serovar Typhi
auccaggccgucggcgccag

SEQ ID NO: 1685859 - RNA, 15 nt, Salmonella enterica enterica serovar Typhi
auccaggacgucuug

SEQ ID NO: 1685860 - RNA, 15 nt, Salmonella enterica enterica serovar Typhi
auccaggagcauugg

SEQ ID NO: 1685861 - RNA, 11 nt, Salmonella enterica enterica serovar Typhi
auccaggugga

SEQ ID NO: 1685862 - RNA, 9 nt, Salmonella enterica enterica serovar Typhi
auccaguaa

SEQ ID NO: 1685863 - RNA, 21 nt, Salmonella enterica enterica serovar Typhi
auccaguaacgcguccaacug

SEQ ID NO: 1685864 - RNA, 17 nt, Salmonella enterica enterica serovar Typhi
auccaguaauuuuuccg

SEQ ID NO: 1685865 - RNA, 20 nt, Salmonella enterica enterica serovar Typhi
auccagcaaucguccucaca

SEQ ID NO: 1685866 - RNA, 11 nt, Salmonella enterica enterica serovar Typhi
auccagcacag

SEQ ID NO: 1685867 - RNA, 19 nt, Salmonella enterica enterica serovar Typhi
auccagcaaccagguaauc

SEQ ID NO: 1685868 - RNA, 23 nt, Salmonella enterica enterica serovar Typhi
auccagccccagcgccagcugcg

SEQ ID NO: 1685869 - RNA, 11 nt, Salmonella enterica enterica serovar Typhi
auccagcccca

SEQ ID NO: 1685870 - RNA, 21 nt, Salmonella enterica enterica serovar Typhi
auccagcucuuucaauccuuc

SEQ ID NO: 1685871 - RNA, 16 nt, Salmonella enterica enterica serovar Typhi
auccaggaauuuuccc

SEQ ID NO: 1685872 - RNA, 20 nt, Salmonella enterica enterica serovar Typhi
auccagcuugccgucacagg

SEQ ID NO: 1685873 - RNA, 17 nt, Salmonella enterica enterica serovar Typhi
auccagcgaaccuucca

SEQ ID NO: 1685874 - RNA, 22 nt, Salmonella enterica enterica serovar Typhi
auccagcgccugcuguaaaaua

SEQ ID NO: 1685875 - RNA, 16 nt, Salmonella enterica enterica serovar Typhi
auccagcgcaaaggga

SEQ ID NO: 1685876 - RNA, 15 nt, Salmonella enterica enterica serovar Typhi
auccagcgucacagg

SEQ ID NO: 1685877 - RNA, 22 nt, Salmonella enterica enterica serovar Typhi
aucccgggcgauaaaccagccc

SEQ ID NO: 1685878 - RNA, 21 nt, Salmonella enterica enterica serovar Typhi
aucccgguauuccguuccuuc

SEQ ID NO: 1685879 - RNA, 15 nt, Salmonella enterica enterica serovar Typhi
aucccgucccaccac

SEQ ID NO: 1685880 - RNA, 13 nt, Salmonella enterica enterica serovar Typhi
aucccgugguggg

SEQ ID NO: 1685881 - RNA, 21 nt, Salmonella enterica enterica serovar Typhi
aucccguuuucgucccagcgc

SEQ ID NO: 1685882 - RNA, 17 nt, Salmonella enterica enterica serovar Typhi
aucccuaauaagguauu

SEQ ID NO: 1685883 - RNA, 13 nt, Salmonella enterica enterica serovar Typhi
aucccucaccucc

SEQ ID NO: 1685884 - RNA, 22 nt, Salmonella enterica enterica serovar Typhi
aucccuccaccagcuucaugcu

SEQ ID NO: 1685885 - RNA, 14 nt, Salmonella enterica enterica serovar Typhi
aucccgccgcuggc

SEQ ID NO: 1685886 - RNA, 20 nt, Salmonella enterica enterica serovar Typhi
aucccgcgcgccucgcauaa

SEQ ID NO: 1685887 - RNA, 17 nt, Salmonella enterica enterica serovar Typhi
aucccggcgcgcguggc

SEQ ID NO: 1685888 - RNA, 14 nt, Salmonella enterica enterica serovar Typhi
aucccgccgcaucc

SEQ ID NO: 1685889 - RNA, 15 nt, Salmonella enterica enterica serovar Typhi
aucccgccaaaccgg

SEQ ID NO: 1685890 - RNA, 21 nt, Salmonella enterica enterica serovar Typhi
aucccgccaucguccagccau

SEQ ID NO: 1685891 - RNA, 23 nt, Salmonella enterica enterica serovar Typhi
aucccgccuugcggcgccaggac

SEQ ID NO: 1685892 - RNA, 22 nt, Salmonella enterica enterica serovar Typhi
aucccgacccauacucuuuccc

SEQ ID NO: 1685893 - RNA, 13 nt, Salmonella enterica enterica serovar Typhi
aucccgcaucacc

SEQ ID NO: 1685894 - RNA, 18 nt, Salmonella enterica enterica serovar Typhi
auccccgccgagaaaaua

SEQ ID NO: 1685895 - RNA, 15 nt, Salmonella enterica enterica serovar Typhi
auccccgccgggcuu

SEQ ID NO: 1685896 - RNA, 16 nt, Salmonella enterica enterica serovar Typhi
auccccgccucaccgc

SEQ ID NO: 1685897 - RNA, 13 nt, Salmonella enterica enterica serovar Typhi
aucccccuggccc

SEQ ID NO: 1685898 - RNA, 17 nt, Salmonella enterica enterica serovar Typhi
auccccggcaaccuuaa

SEQ ID NO: 1685899 - RNA, 13 nt, Salmonella enterica enterica serovar Typhi
auccccaaacugc

SEQ ID NO: 1685900 - RNA, 17 nt, Salmonella enterica enterica serovar Typhi
auccccaaacugcucgu

SEQ ID NO: 1685901 - RNA, 22 nt, Salmonella enterica enterica serovar Typhi
aucccauuagggcuauuuuacu

SEQ ID NO: 1685902 - RNA, 18 nt, Salmonella enterica enterica serovar Typhi
auccccagcaucaugucc

SEQ ID NO: 1685903 - RNA, 15 nt, Salmonella enterica enterica serovar Typhi
auccgcgaauaccuu

SEQ ID NO: 1685904 - RNA, 14 nt, Salmonella enterica enterica serovar Typhi
auccgcgccgccgc

SEQ ID NO: 1685905 - RNA, 18 nt, Salmonella enterica enterica serovar Typhi
auccgcagauccagcacg

SEQ ID NO: 1685906 - RNA, 14 nt, Salmonella enterica enterica serovar Typhi
auccgcauccguca

SEQ ID NO: 1685907 - RNA, 18 nt, Salmonella enterica enterica serovar Typhi
auccgcuccacauccugu

SEQ ID NO: 1685908 - RNA, 20 nt, Salmonella enterica enterica serovar Typhi
auccgcuucucuauacggcg

SEQ ID NO: 1685909 - RNA, 18 nt, Salmonella enterica enterica serovar Typhi
auccgcgccggguuuggc

SEQ ID NO: 1685910 - RNA, 20 nt, Salmonella enterica enterica serovar Typhi
auccgcucccgcuucaaaac

SEQ ID NO: 1685911 - RNA, 12 nt, Salmonella enterica enterica serovar Typhi
auccgccgccca

SEQ ID NO: 1685912 - RNA, 15 nt, Salmonella enterica enterica serovar Typhi
auccggauauucugc

SEQ ID NO: 1685913 - RNA, 19 nt, Salmonella enterica enterica serovar Typhi
auccggcaaaagaggcuaa

SEQ ID NO: 1685914 - RNA, 15 nt, Salmonella enterica enterica serovar Typhi
auccggcaaacucag

SEQ ID NO: 1685915 - RNA, 16 nt, Salmonella enterica enterica serovar Typhi
auccgcagauccagca

SEQ ID NO: 1685916 - RNA, 23 nt, Salmonella enterica enterica serovar Typhi
auccgcaacugaaaccaggcacu

SEQ ID NO: 1685917 - RNA, 23 nt, Salmonella enterica enterica serovar Typhi
auccgauuucaugcgcagcauga

SEQ ID NO: 1685918 - RNA, 17 nt, Salmonella enterica enterica serovar Typhi
auccgacgccuguucga

SEQ ID NO: 1685919 - RNA, 15 nt, Salmonella enterica enterica serovar Typhi
auccgacgccuuuac

SEQ ID NO: 1685920 - RNA, 18 nt, Salmonella enterica enterica serovar Typhi
auccgacgcucaaccggu

SEQ ID NO: 1685921 - RNA, 18 nt, Salmonella enterica enterica serovar Typhi
aucccuguucaaaagccu

SEQ ID NO: 1685922 - RNA, 20 nt, Salmonella enterica enterica serovar Typhi
aucccuguucaaaagccugu

SEQ ID NO: 1685923 - RNA, 19 nt, Salmonella enterica enterica serovar Typhi
auccgaaaugaccaccgca

SEQ ID NO: 1685924 - RNA, 15 nt, Salmonella enterica enterica serovar Typhi
auccgacaacaugaa

SEQ ID NO: 1685925 - RNA, 16 nt, Salmonella enterica enterica serovar Typhi
auccgacagauagugg

SEQ ID NO: 1685926 - RNA, 18 nt, Salmonella enterica enterica serovar Typhi
auccguuauuucacagca

SEQ ID NO: 1685927 - RNA, 16 nt, Salmonella enterica enterica serovar Typhi
auccguuucagaaaga

SEQ ID NO: 1685928 - RNA, 14 nt, Salmonella enterica enterica serovar Typhi
auccgugaccugcu

SEQ ID NO: 1685929 - RNA, 12 nt, Salmonella enterica enterica serovar Typhi
auccguuauuua

SEQ ID NO: 1685930 - RNA, 15 nt, Salmonella enterica enterica serovar Typhi
auccucaauguuaac

SEQ ID NO: 1685931 - RNA, 17 nt, Salmonella enterica enterica serovar Typhi
auccucacuugccgagu

SEQ ID NO: 1685932 - RNA, 16 nt, Salmonella enterica enterica serovar Typhi
auccucauacagcccg

SEQ ID NO: 1685933 - RNA, 14 nt, Salmonella enterica enterica serovar Typhi
auccguccucuuuc

SEQ ID NO: 1685934 - RNA, 15 nt, Salmonella enterica enterica serovar Typhi
auccguccucuuucc

SEQ ID NO: 1685935 - RNA, 18 nt, Salmonella enterica enterica serovar Typhi
auccgucaggaugggcuu

SEQ ID NO: 1685936 - RNA, 21 nt, Salmonella enterica enterica serovar Typhi
auccgguugacgauaaaaugc

SEQ ID NO: 1685937 - RNA, 14 nt, Salmonella enterica enterica serovar Typhi
auccggccuggcgc

SEQ ID NO: 1685938 - RNA, 18 nt, Salmonella enterica enterica serovar Typhi
auccggcauuuuucucag

SEQ ID NO: 1685939 - RNA, 21 nt, Salmonella enterica enterica serovar Typhi
auccgggauauaaaauuauug

SEQ ID NO: 1685940 - RNA, 22 nt, Salmonella enterica enterica serovar Typhi
auccggcuuacggcuauuccuc

SEQ ID NO: 1685941 - RNA, 12 nt, Salmonella enterica enterica serovar Typhi
auccggcacugu

SEQ ID NO: 1685942 - RNA, 11 nt, Salmonella enterica enterica serovar Typhi
auccggcacug

SEQ ID NO: 1685943 - RNA, 16 nt, Salmonella enterica enterica serovar Typhi
auccggcaagcgcugg

SEQ ID NO: 1685944 - RNA, 13 nt, Salmonella enterica enterica serovar Typhi
auccggcauuuuu

SEQ ID NO: 1685945 - RNA, 23 nt, Salmonella enterica enterica serovar Typhi
auccggcaguuauuuuacgggcg

SEQ ID NO: 1685946 - RNA, 14 nt, Salmonella enterica enterica serovar Typhi
auccggcagccaau

SEQ ID NO: 1685947 - RNA, 21 nt, Salmonella enterica enterica serovar Typhi
auccucuauuuuuuauauucg

SEQ ID NO: 1685948 - RNA, 13 nt, Salmonella enterica enterica serovar Typhi
auccucuauuuuu

SEQ ID NO: 1685949 - RNA, 16 nt, Salmonella enterica enterica serovar Typhi
auccucgcauccucca

SEQ ID NO: 1685950 - RNA, 17 nt, Salmonella enterica enterica serovar Typhi
auccugacuauugcuga

SEQ ID NO: 1685951 - RNA, 22 nt, Salmonella enterica enterica serovar Typhi
auccugauccugcaacagcacc

SEQ ID NO: 1685952 - RNA, 10 nt, Salmonella enterica enterica serovar Typhi
auccugaucu

SEQ ID NO: 1685953 - RNA, 13 nt, Salmonella enterica enterica serovar Typhi
auccugauuauua

SEQ ID NO: 1685954 - RNA, 13 nt, Salmonella enterica enterica serovar Typhi
auccugaagaugg

SEQ ID NO: 1685955 - RNA, 22 nt, Salmonella enterica enterica serovar Typhi
auccugaaccagcggcaccagc

SEQ ID NO: 1685956 - RNA, 19 nt, Salmonella enterica enterica serovar Typhi
auccugaagacaugcuguu

SEQ ID NO: 1685957 - RNA, 22 nt, Salmonella enterica enterica serovar Typhi
auccugaagacaugcuguugaa

SEQ ID NO: 1685958 - RNA, 18 nt, Salmonella enterica enterica serovar Typhi
auccucuuggguuauuuc

SEQ ID NO: 1685959 - RNA, 19 nt, Salmonella enterica enterica serovar Typhi
auccugcaccgccugcggc

SEQ ID NO: 1685960 - RNA, 21 nt, Salmonella enterica enterica serovar Typhi
auccugcaccgccugcggcau

SEQ ID NO: 1685961 - RNA, 21 nt, Salmonella enterica enterica serovar Typhi
auccugcgccauugcgggagc

SEQ ID NO: 1685962 - RNA, 19 nt, Salmonella enterica enterica serovar Typhi
auccugcucaucgacagaa

SEQ ID NO: 1685963 - RNA, 21 nt, Salmonella enterica enterica serovar Typhi
auccugcggguucaucgccac

SEQ ID NO: 1685964 - RNA, 23 nt, Salmonella enterica enterica serovar Typhi
auccuguaacaacuguuuuucac

SEQ ID NO: 1685965 - RNA, 15 nt, Salmonella enterica enterica serovar Typhi
auccuguaccaccac

SEQ ID NO: 1685966 - RNA, 19 nt, Salmonella enterica enterica serovar Typhi
aucguaaaaucaacagcaa

SEQ ID NO: 1685967 - RNA, 17 nt, Salmonella enterica enterica serovar Typhi
aucguaaaaugaaaaac

SEQ ID NO: 1685968 - RNA, 16 nt, Salmonella enterica enterica serovar Typhi
aucggcucagcaauca

SEQ ID NO: 1685969 - RNA, 16 nt, Salmonella enterica enterica serovar Typhi
aucgguucucugccau

SEQ ID NO: 1685970 - RNA, 17 nt, Salmonella enterica enterica serovar Typhi
aucggcuuauaaaacgc

SEQ ID NO: 1685971 - RNA, 15 nt, Salmonella enterica enterica serovar Typhi
aucggcguugcccau

SEQ ID NO: 1685972 - RNA, 21 nt, Salmonella enterica enterica serovar Typhi
aucguauccggucaauacauc

SEQ ID NO: 1685973 - RNA, 16 nt, Salmonella enterica enterica serovar Typhi
aucgucaccaggaugc

SEQ ID NO: 1685974 - RNA, 21 nt, Salmonella enterica enterica serovar Typhi
aucguaugcgccugucuuaaa

SEQ ID NO: 1685975 - RNA, 23 nt, Salmonella enterica enterica serovar Typhi
aucgucacccuauuuugcgccug

SEQ ID NO: 1685976 - RNA, 19 nt, Salmonella enterica enterica serovar Typhi
aucguaagccgcauuacaa

SEQ ID NO: 1685977 - RNA, 18 nt, Salmonella enterica enterica serovar Typhi
aucguaaaucaaaugaga

SEQ ID NO: 1685978 - RNA, 22 nt, Salmonella enterica enterica serovar Typhi
aucguaaugauuacggaacaaa

SEQ ID NO: 1685979 - RNA, 16 nt, Salmonella enterica enterica serovar Typhi
aucguaccaauaccca

SEQ ID NO: 1685980 - RNA, 20 nt, Salmonella enterica enterica serovar Typhi
aucguagacuaagguuuugu

SEQ ID NO: 1685981 - RNA, 23 nt, Salmonella enterica enterica serovar Typhi
aucguagcaucucuucgacaucu

SEQ ID NO: 1685982 - RNA, 23 nt, Salmonella enterica enterica serovar Typhi
aucguauccagcggcaaaggcau

SEQ ID NO: 1685983 - RNA, 16 nt, Salmonella enterica enterica serovar Typhi
aucgucguuccgccag

SEQ ID NO: 1685984 - RNA, 19 nt, Salmonella enterica enterica serovar Typhi
aucgucguuccgccaggcg

SEQ ID NO: 1685985 - RNA, 16 nt, Salmonella enterica enterica serovar Typhi
aucgucgugucucaga

SEQ ID NO: 1685986 - RNA, 16 nt, Salmonella enterica enterica serovar Typhi
aucgucgggauaagcg

SEQ ID NO: 1685987 - RNA, 19 nt, Salmonella enterica enterica serovar Typhi
aucgugauaggccagacga

SEQ ID NO: 1685988 - RNA, 21 nt, Salmonella enterica enterica serovar Typhi
aucguuuacguuaucauucac

SEQ ID NO: 1685989 - RNA, 15 nt, Salmonella enterica enterica serovar Typhi
aucguuuccagcauc

SEQ ID NO: 1685990 - RNA, 21 nt, Salmonella enterica enterica serovar Typhi
aucguuuuaucucuuuugcuu

SEQ ID NO: 1685991 - RNA, 12 nt, Salmonella enterica enterica serovar Typhi
aucguuuuucuu

SEQ ID NO: 1685992 - RNA, 13 nt, Salmonella enterica enterica serovar Typhi
aucguuuuucuuc

SEQ ID NO: 1685993 - RNA, 13 nt, Salmonella enterica enterica serovar Typhi
aucgcugcgcccg

SEQ ID NO: 1685994 - RNA, 16 nt, Salmonella enterica enterica serovar Typhi
aucgcugacgaucaug

SEQ ID NO: 1685995 - RNA, 17 nt, Salmonella enterica enterica serovar Typhi
aucgcucuauauccugc

SEQ ID NO: 1685996 - RNA, 18 nt, Salmonella enterica enterica serovar Typhi
aucgcucuauauccugcc

SEQ ID NO: 1685997 - RNA, 23 nt, Salmonella enterica enterica serovar Typhi
aucgcuaucugacagccaaacug

SEQ ID NO: 1685998 - RNA, 18 nt, Salmonella enterica enterica serovar Typhi
aucgcuccauucugucga

SEQ ID NO: 1685999 - RNA, 13 nt, Salmonella enterica enterica serovar Typhi
aucgcuccggaac

SEQ ID NO: 1686000 - RNA, 23 nt, Salmonella enterica enterica serovar Typhi
aucgcucaggagcgccugacagg

SEQ ID NO: 1686001 - RNA, 16 nt, Salmonella enterica enterica serovar Typhi
aucgcucaacuccugc

SEQ ID NO: 1686002 - RNA, 22 nt, Salmonella enterica enterica serovar Typhi
aucgccuggugugaacaucacg

SEQ ID NO: 1686003 - RNA, 14 nt, Salmonella enterica enterica serovar Typhi
aucgccuggagcug

SEQ ID NO: 1686004 - RNA, 14 nt, Salmonella enterica enterica serovar Typhi
aucgcuguggcauu

SEQ ID NO: 1686005 - RNA, 23 nt, Salmonella enterica enterica serovar Typhi
aucgcuuuaacgcugcaaaguua

SEQ ID NO: 1686006 - RNA, 17 nt, Salmonella enterica enterica serovar Typhi
aucgcuuucggcaaagc

SEQ ID NO: 1686007 - RNA, 15 nt, Salmonella enterica enterica serovar Typhi
aucgcuugcccagca

SEQ ID NO: 1686008 - RNA, 14 nt, Salmonella enterica enterica serovar Typhi
aucggaccuccgcg

SEQ ID NO: 1686009 - RNA, 22 nt, Salmonella enterica enterica serovar Typhi
aucggcaucuuuaaccgccugc

SEQ ID NO: 1686010 - RNA, 23 nt, Salmonella enterica enterica serovar Typhi
aucggcgccggggugcuguucuu

SEQ ID NO: 1686011 - RNA, 20 nt, Salmonella enterica enterica serovar Typhi
aucgccgcaaugaccacaaa

SEQ ID NO: 1686012 - RNA, 19 nt, Salmonella enterica enterica serovar Typhi
aucgccgaucacaaaguca

SEQ ID NO: 1686013 - RNA, 18 nt, Salmonella enterica enterica serovar Typhi
aucgccgacuaauuauuu

SEQ ID NO: 1686014 - RNA, 21 nt, Salmonella enterica enterica serovar Typhi
aucgccgcccaguggcaaaau

SEQ ID NO: 1686015 - RNA, 19 nt, Salmonella enterica enterica serovar Typhi
aucgccgcgacagucgcag

SEQ ID NO: 1686016 - RNA, 19 nt, Salmonella enterica enterica serovar Typhi
aucgccagcguuagcacau

SEQ ID NO: 1686017 - RNA, 14 nt, Salmonella enterica enterica serovar Typhi
aucgccagcgccug

SEQ ID NO: 1686018 - RNA, 21 nt, Salmonella enterica enterica serovar Typhi
aucgccaucgauagcagcgcu

SEQ ID NO: 1686019 - RNA, 23 nt, Salmonella enterica enterica serovar Typhi
aucgacuggcggaauggcgggcg

SEQ ID NO: 1686020 - RNA, 19 nt, Salmonella enterica enterica serovar Typhi
aucgccaccguaacuacaa

SEQ ID NO: 1686021 - RNA, 23 nt, Salmonella enterica enterica serovar Typhi
aucgccacgauagacagcaccau

SEQ ID NO: 1686022 - RNA, 14 nt, Salmonella enterica enterica serovar Typhi
aucgaugugauaaa

SEQ ID NO: 1686023 - RNA, 21 nt, Salmonella enterica enterica serovar Typhi
aucgauuuagagcuaaucaau

SEQ ID NO: 1686024 - RNA, 18 nt, Salmonella enterica enterica serovar Typhi
aucgacaacgcguuuauu

SEQ ID NO: 1686025 - RNA, 19 nt, Salmonella enterica enterica serovar Typhi
aucgacauaaguaaauaac

SEQ ID NO: 1686026 - RNA, 18 nt, Salmonella enterica enterica serovar Typhi
aucgacaguggcuuuaac

SEQ ID NO: 1686027 - RNA, 15 nt, Salmonella enterica enterica serovar Typhi
aucgacauuaugauc

SEQ ID NO: 1686028 - RNA, 20 nt, Salmonella enterica enterica serovar Typhi
aucgacgauaacaagccggc

SEQ ID NO: 1686029 - RNA, 22 nt, Salmonella enterica enterica serovar Typhi
aucgacccccaccucaaucacc

SEQ ID NO: 1686030 - RNA, 23 nt, Salmonella enterica enterica serovar Typhi
aucgaccauacuaaugcugccca

SEQ ID NO: 1686031 - RNA, 18 nt, Salmonella enterica enterica serovar Typhi
aucgaauggggaaauaaa

SEQ ID NO: 1686032 - RNA, 15 nt, Salmonella enterica enterica serovar Typhi
aucgaauccagcagg

SEQ ID NO: 1686033 - RNA, 22 nt, Salmonella enterica enterica serovar Typhi
aucgacaaaagauuuaucaauu

SEQ ID NO: 1686034 - RNA, 16 nt, Salmonella enterica enterica serovar Typhi
auccuuucucugguuu

SEQ ID NO: 1686035 - RNA, 18 nt, Salmonella enterica enterica serovar Typhi
auccuguucaaacaucag

SEQ ID NO: 1686036 - RNA, 21 nt, Salmonella enterica enterica serovar Typhi
auccuguccggcguaccauuu

SEQ ID NO: 1686037 - RNA, 11 nt, Salmonella enterica enterica serovar Typhi
auccuucgccg

SEQ ID NO: 1686038 - RNA, 13 nt, Salmonella enterica enterica serovar Typhi
auccuuccagccc

SEQ ID NO: 1686039 - RNA, 14 nt, Salmonella enterica enterica serovar Typhi
auccuuccagcccg

SEQ ID NO: 1686040 - RNA, 22 nt, Salmonella enterica enterica serovar Typhi
auccuucauucagaucaaaaau

SEQ ID NO: 1686041 - RNA, 14 nt, Salmonella enterica enterica serovar Typhi
auccuuaucagacu

SEQ ID NO: 1686042 - RNA, 21 nt, Salmonella enterica enterica serovar Typhi
auccuucaaucgguacgccaa

SEQ ID NO: 1686043 - RNA, 21 nt, Salmonella enterica enterica serovar Typhi
auccuucuaccuucaccccca

SEQ ID NO: 1686044 - RNA, 16 nt, Salmonella enterica enterica serovar Typhi
auccuugcacgccaaa

SEQ ID NO: 1686045 - RNA, 17 nt, Salmonella enterica enterica serovar Typhi
auccuuuaauuaaucca

SEQ ID NO: 1686046 - RNA, 24 nt, Salmonella enterica enterica serovar Typhi
caauugccacauagcauccagacc

SEQ ID NO: 1686047 - RNA, 14 nt, Salmonella enterica enterica serovar Typhi
caauuccacaggcg

SEQ ID NO: 1686048 - RNA, 23 nt, Salmonella enterica enterica serovar Typhi
caauucgagauuuuucugcgcca

SEQ ID NO: 1686049 - RNA, 20 nt, Salmonella enterica enterica serovar Typhi
caauucuggaaucaauuucc

SEQ ID NO: 1686050 - RNA, 22 nt, Salmonella enterica enterica serovar Typhi
caauucuggaaucaauuucccu

SEQ ID NO: 1686051 - RNA, 13 nt, Salmonella enterica enterica serovar Typhi
caauucagaaagu

SEQ ID NO: 1686052 - RNA, 12 nt, Salmonella enterica enterica serovar Typhi
caauuacguugg

SEQ ID NO: 1686053 - RNA, 22 nt, Salmonella enterica enterica serovar Typhi
caauuacguuggggauaaccag

SEQ ID NO: 1686054 - RNA, 21 nt, Salmonella enterica enterica serovar Typhi
caauuauauugcguaaaaacc

SEQ ID NO: 1686055 - RNA, 22 nt, Salmonella enterica enterica serovar Typhi
caauuauauugcguaaaaaccc

SEQ ID NO: 1686056 - RNA, 17 nt, Salmonella enterica enterica serovar Typhi
caauuagcgacgcauac

SEQ ID NO: 1686057 - RNA, 14 nt, Salmonella enterica enterica serovar Typhi
caauuaacaaauaa

SEQ ID NO: 1686058 - RNA, 15 nt, Salmonella enterica enterica serovar Typhi
caaucaguuccaauc

SEQ ID NO: 1686059 - RNA, 20 nt, Salmonella enterica enterica serovar Typhi
caauuaauauuuaacacauu

SEQ ID NO: 1686060 - RNA, 14 nt, Salmonella enterica enterica serovar Typhi
caaucagcaccauu

SEQ ID NO: 1686061 - RNA, 19 nt, Salmonella enterica enterica serovar Typhi
caaucagccccagcaccag

SEQ ID NO: 1686062 - RNA, 14 nt, Salmonella enterica enterica serovar Typhi
caaucagaagaaau

SEQ ID NO: 1686063 - RNA, 19 nt, Salmonella enterica enterica serovar Typhi
caaucagguauuuccugcu

SEQ ID NO: 1686064 - RNA, 20 nt, Salmonella enterica enterica serovar Typhi
caaucaguacgcgcgcggcg

SEQ ID NO: 1686065 - RNA, 18 nt, Salmonella enterica enterica serovar Typhi
caauuuugccgcaucgau

SEQ ID NO: 1686066 - RNA, 15 nt, Salmonella enterica enterica serovar Typhi
caauuuucaguuuua

SEQ ID NO: 1686067 - RNA, 23 nt, Salmonella enterica enterica serovar Typhi
caauuugugagauaaaaaagcug

SEQ ID NO: 1686068 - RNA, 15 nt, Salmonella enterica enterica serovar Typhi
caauuuuaagaauau

SEQ ID NO: 1686069 - RNA, 16 nt, Salmonella enterica enterica serovar Typhi
cacaaaacccgcagcc

SEQ ID NO: 1686070 - RNA, 20 nt, Salmonella enterica enterica serovar Typhi
cacaaaaacacccgcagccg

SEQ ID NO: 1686071 - RNA, 20 nt, Salmonella enterica enterica serovar Typhi
caauuuuuacaaauuuaaac

SEQ ID NO: 1686072 - RNA, 18 nt, Salmonella enterica enterica serovar Typhi
caauuucagcauccuccg

SEQ ID NO: 1686073 - RNA, 17 nt, Salmonella enterica enterica serovar Typhi
caauuucccuucaauca

SEQ ID NO: 1686074 - RNA, 20 nt, Salmonella enterica enterica serovar Typhi
caauuuccccugcgaacagc

SEQ ID NO: 1686075 - RNA, 16 nt, Salmonella enterica enterica serovar Typhi
caauuuccgcugaaau

SEQ ID NO: 1686076 - RNA, 15 nt, Salmonella enterica enterica serovar Typhi
cacaaacaauuuacg

SEQ ID NO: 1686077 - RNA, 23 nt, Salmonella enterica enterica serovar Typhi
cacaaacaauuuacgcagcccca

SEQ ID NO: 1686078 - RNA, 14 nt, Salmonella enterica enterica serovar Typhi
cacaaacaauuucc

SEQ ID NO: 1686079 - RNA, 20 nt, Salmonella enterica enterica serovar Typhi
cacaaaaggauacagcgccg

SEQ ID NO: 1686080 - RNA, 16 nt, Salmonella enterica enterica serovar Typhi
cacaaaauggcugaua

SEQ ID NO: 1686081 - RNA, 23 nt, Salmonella enterica enterica serovar Typhi
cacaaaauuuugcauaaauaaug

SEQ ID NO: 1686082 - RNA, 14 nt, Salmonella enterica enterica serovar Typhi
cacaaauuucgagc

SEQ ID NO: 1686083 - RNA, 21 nt, Salmonella enterica enterica serovar Typhi
cacaaauuugaauaaaacggg

SEQ ID NO: 1686084 - RNA, 20 nt, Salmonella enterica enterica serovar Typhi
cacaaauuuugauaaaaaca

SEQ ID NO: 1686085 - RNA, 18 nt, Salmonella enterica enterica serovar Typhi
cacaaaucuguuaucugg

SEQ ID NO: 1686086 - RNA, 14 nt, Salmonella enterica enterica serovar Typhi
cacaaagaauucuu

SEQ ID NO: 1686087 - RNA, 17 nt, Salmonella enterica enterica serovar Typhi
cacaaagacgaauaagg

SEQ ID NO: 1686088 - RNA, 17 nt, Salmonella enterica enterica serovar Typhi
cacaaccggcuggcuau

SEQ ID NO: 1686089 - RNA, 15 nt, Salmonella enterica enterica serovar Typhi
cacaaccugaaagaa

SEQ ID NO: 1686090 - RNA, 17 nt, Salmonella enterica enterica serovar Typhi
cacaaccuccacgccca

SEQ ID NO: 1686091 - RNA, 19 nt, Salmonella enterica enterica serovar Typhi
cacaaccuccacgcccagc

SEQ ID NO: 1686092 - RNA, 12 nt, Salmonella enterica enterica serovar Typhi
cacaacccaaag

SEQ ID NO: 1686093 - RNA, 12 nt, Salmonella enterica enterica serovar Typhi
cacaacguaaua

SEQ ID NO: 1686094 - RNA, 16 nt, Salmonella enterica enterica serovar Typhi
cacaacguaaucauca

SEQ ID NO: 1686095 - RNA, 22 nt, Salmonella enterica enterica serovar Typhi
cacaacgcgaguauucgcgccc

SEQ ID NO: 1686096 - RNA, 16 nt, Salmonella enterica enterica serovar Typhi
cacaacgcgaguauuc

SEQ ID NO: 1686097 - RNA, 21 nt, Salmonella enterica enterica serovar Typhi
cacaacgugaugaucguguug

SEQ ID NO: 1686098 - RNA, 14 nt, Salmonella enterica enterica serovar Typhi
cacaacgucauccc

SEQ ID NO: 1686099 - RNA, 15 nt, Salmonella enterica enterica serovar Typhi
cacacugcgccgcca

SEQ ID NO: 1686100 - RNA, 22 nt, Salmonella enterica enterica serovar Typhi
cacacuguuuaaugcuuucaau

SEQ ID NO: 1686101 - RNA, 13 nt, Salmonella enterica enterica serovar Typhi
cacacuuaccgac

SEQ ID NO: 1686102 - RNA, 15 nt, Salmonella enterica enterica serovar Typhi
cacacuuucugcuuu

SEQ ID NO: 1686103 - RNA, 14 nt, Salmonella enterica enterica serovar Typhi
cacacuuucaucag

SEQ ID NO: 1686104 - RNA, 15 nt, Salmonella enterica enterica serovar Typhi
cacacuuucaucagc

SEQ ID NO: 1686105 - RNA, 14 nt, Salmonella enterica enterica serovar Typhi
cacacggcauucac

SEQ ID NO: 1686106 - RNA, 15 nt, Salmonella enterica enterica serovar Typhi
cacacggccaccaua

SEQ ID NO: 1686107 - RNA, 19 nt, Salmonella enterica enterica serovar Typhi
cacacgucugagcaggcgg

SEQ ID NO: 1686108 - RNA, 14 nt, Salmonella enterica enterica serovar Typhi
cacacugcaucgaa

SEQ ID NO: 1686109 - RNA, 20 nt, Salmonella enterica enterica serovar Typhi
cacacgccuggccaggcuuu

SEQ ID NO: 1686110 - RNA, 21 nt, Salmonella enterica enterica serovar Typhi
cacaccguuacgaccccauua

SEQ ID NO: 1686111 - RNA, 22 nt, Salmonella enterica enterica serovar Typhi
cacaccugaugguuauuuucag

SEQ ID NO: 1686112 - RNA, 15 nt, Salmonella enterica enterica serovar Typhi
cacaccauuucacaa

SEQ ID NO: 1686113 - RNA, 14 nt, Salmonella enterica enterica serovar Typhi
cacacccauagcag

SEQ ID NO: 1686114 - RNA, 20 nt, Salmonella enterica enterica serovar Typhi
cacaagccccacgcccgcca

SEQ ID NO: 1686115 - RNA, 17 nt, Salmonella enterica enterica serovar Typhi
cacaagcuguuucuccg

SEQ ID NO: 1686116 - RNA, 16 nt, Salmonella enterica enterica serovar Typhi
cacaagagcagcaacc

SEQ ID NO: 1686117 - RNA, 19 nt, Salmonella enterica enterica serovar Typhi
cacaagagcagcaacccug

SEQ ID NO: 1686118 - RNA, 14 nt, Salmonella enterica enterica serovar Typhi
cacaauauccgccc

SEQ ID NO: 1686119 - RNA, 20 nt, Salmonella enterica enterica serovar Typhi
cacaaucgccgugaucccaa

SEQ ID NO: 1686120 - RNA, 19 nt, Salmonella enterica enterica serovar Typhi
cacaaucuccagaccgcug

SEQ ID NO: 1686121 - RNA, 21 nt, Salmonella enterica enterica serovar Typhi
cacaaucccgccagacccgca

SEQ ID NO: 1686122 - RNA, 13 nt, Salmonella enterica enterica serovar Typhi
cacaaucaaggca

SEQ ID NO: 1686123 - RNA, 18 nt, Salmonella enterica enterica serovar Typhi
cacaaucagccacggcaa

SEQ ID NO: 1686124 - RNA, 13 nt, Salmonella enterica enterica serovar Typhi
cacacacuguuua

SEQ ID NO: 1686125 - RNA, 20 nt, Salmonella enterica enterica serovar Typhi
cacacagcagaaagcaacag

SEQ ID NO: 1686126 - RNA, 23 nt, Salmonella enterica enterica serovar Typhi
cacacacuguuuaaugcuuucaa

SEQ ID NO: 1686127 - RNA, 13 nt, Salmonella enterica enterica serovar Typhi
cacacaugcaaaa

SEQ ID NO: 1686128 - RNA, 23 nt, Salmonella enterica enterica serovar Typhi
cacaauuuucuuaauaugcugcc

SEQ ID NO: 1686129 - RNA, 20 nt, Salmonella enterica enterica serovar Typhi
cacaauugccagcagguauc

SEQ ID NO: 1686130 - RNA, 22 nt, Salmonella enterica enterica serovar Typhi
cacaaugacagaaaugcaggga

SEQ ID NO: 1686131 - RNA, 13 nt, Salmonella enterica enterica serovar Typhi
cacaaugacaugu

SEQ ID NO: 1686132 - RNA, 17 nt, Salmonella enterica enterica serovar Typhi
cacaggcuuggcagccc

SEQ ID NO: 1686133 - RNA, 23 nt, Salmonella enterica enterica serovar Typhi
cacaggcuucgacaaacagcuau

SEQ ID NO: 1686134 - RNA, 18 nt, Salmonella enterica enterica serovar Typhi
cacagggacuauaggcaa

SEQ ID NO: 1686135 - RNA, 19 nt, Salmonella enterica enterica serovar Typhi
cacaguaaccccauacagu

SEQ ID NO: 1686136 - RNA, 20 nt, Salmonella enterica enterica serovar Typhi
cacaguaaaaaaacgccugu

SEQ ID NO: 1686137 - RNA, 14 nt, Salmonella enterica enterica serovar Typhi
cacagguacaggcc

SEQ ID NO: 1686138 - RNA, 13 nt, Salmonella enterica enterica serovar Typhi
cacagguuaucgc

SEQ ID NO: 1686139 - RNA, 21 nt, Salmonella enterica enterica serovar Typhi
cacagcuugccguagcgcgcu

SEQ ID NO: 1686140 - RNA, 22 nt, Salmonella enterica enterica serovar Typhi
cacagcuugccguagcgcgcuu

SEQ ID NO: 1686141 - RNA, 18 nt, Salmonella enterica enterica serovar Typhi
cacaggcggaaaacauuc

SEQ ID NO: 1686142 - RNA, 19 nt, Salmonella enterica enterica serovar Typhi
cacaggcggcgguucaacc

SEQ ID NO: 1686143 - RNA, 12 nt, Salmonella enterica enterica serovar Typhi
cacaggcggcca

SEQ ID NO: 1686144 - RNA, 17 nt, Salmonella enterica enterica serovar Typhi
cacauacagcacuuccc

SEQ ID NO: 1686145 - RNA, 15 nt, Salmonella enterica enterica serovar Typhi
cacauauauuucugu

SEQ ID NO: 1686146 - RNA, 21 nt, Salmonella enterica enterica serovar Typhi
cacauauaacaaacgccgcuc

SEQ ID NO: 1686147 - RNA, 14 nt, Salmonella enterica enterica serovar Typhi
cacauaggcaaaca

SEQ ID NO: 1686148 - RNA, 15 nt, Salmonella enterica enterica serovar Typhi
cacauaggcaaacac

SEQ ID NO: 1686149 - RNA, 19 nt, Salmonella enterica enterica serovar Typhi
cacaguaauggacagguaa

SEQ ID NO: 1686150 - RNA, 19 nt, Salmonella enterica enterica serovar Typhi
cacaguacaccugcagguu

SEQ ID NO: 1686151 - RNA, 15 nt, Salmonella enterica enterica serovar Typhi
cacagccacacugcu

SEQ ID NO: 1686152 - RNA, 19 nt, Salmonella enterica enterica serovar Typhi
cacagccaguaagaacgag

SEQ ID NO: 1686153 - RNA, 22 nt, Salmonella enterica enterica serovar Typhi
cacagcaugaauaaccucccgc

SEQ ID NO: 1686154 - RNA, 14 nt, Salmonella enterica enterica serovar Typhi
cacagccccagcac

SEQ ID NO: 1686155 - RNA, 16 nt, Salmonella enterica enterica serovar Typhi
cacagccccagcacca

SEQ ID NO: 1686156 - RNA, 21 nt, Salmonella enterica enterica serovar Typhi
cacagcguacaauggcaggca

SEQ ID NO: 1686157 - RNA, 13 nt, Salmonella enterica enterica serovar Typhi
cacagccuuauaa

SEQ ID NO: 1686158 - RNA, 16 nt, Salmonella enterica enterica serovar Typhi
cacagcgccagacacu

SEQ ID NO: 1686159 - RNA, 14 nt, Salmonella enterica enterica serovar Typhi
cacagcgcgcgaca

SEQ ID NO: 1686160 - RNA, 14 nt, Salmonella enterica enterica serovar Typhi
cacagcggaauaga

SEQ ID NO: 1686161 - RNA, 19 nt, Salmonella enterica enterica serovar Typhi
cacagacccaguacaaaca

SEQ ID NO: 1686162 - RNA, 16 nt, Salmonella enterica enterica serovar Typhi
cacagacccaguacaa

SEQ ID NO: 1686163 - RNA, 20 nt, Salmonella enterica enterica serovar Typhi
cacagaaggcuaacagcugg

SEQ ID NO: 1686164 - RNA, 15 nt, Salmonella enterica enterica serovar Typhi
cacagcaaacauccc

SEQ ID NO: 1686165 - RNA, 17 nt, Salmonella enterica enterica serovar Typhi
cacagcaaacauccccg

SEQ ID NO: 1686166 - RNA, 17 nt, Salmonella enterica enterica serovar Typhi
cacagcaaaugaaagga

SEQ ID NO: 1686167 - RNA, 14 nt, Salmonella enterica enterica serovar Typhi
cacagcagaaagca

SEQ ID NO: 1686168 - RNA, 19 nt, Salmonella enterica enterica serovar Typhi
cacagcaccauguugacca

SEQ ID NO: 1686169 - RNA, 15 nt, Salmonella enterica enterica serovar Typhi
cacagcacauagaag

SEQ ID NO: 1686170 - RNA, 22 nt, Salmonella enterica enterica serovar Typhi
cacagcacauagaagcucaugu

SEQ ID NO: 1686171 - RNA, 16 nt, Salmonella enterica enterica serovar Typhi
cacagcacaauaccuu

SEQ ID NO: 1686172 - RNA, 15 nt, Salmonella enterica enterica serovar Typhi
cacaugaccugaaua

SEQ ID NO: 1686173 - RNA, 14 nt, Salmonella enterica enterica serovar Typhi
cacaugagaagggc

SEQ ID NO: 1686174 - RNA, 16 nt, Salmonella enterica enterica serovar Typhi
cacaucgugcgccauu

SEQ ID NO: 1686175 - RNA, 20 nt, Salmonella enterica enterica serovar Typhi
cacaugcaaaaaagcccauc

SEQ ID NO: 1686176 - RNA, 14 nt, Salmonella enterica enterica serovar Typhi
cacauguuggcauu

SEQ ID NO: 1686177 - RNA, 14 nt, Salmonella enterica enterica serovar Typhi
cacauauugcgcuu

SEQ ID NO: 1686178 - RNA, 17 nt, Salmonella enterica enterica serovar Typhi
cacauauugcgcuucac

SEQ ID NO: 1686179 - RNA, 15 nt, Salmonella enterica enterica serovar Typhi
cacaucacaaucucc

SEQ ID NO: 1686180 - RNA, 20 nt, Salmonella enterica enterica serovar Typhi
cacaucagccaacuuuuucu

SEQ ID NO: 1686181 - RNA, 16 nt, Salmonella enterica enterica serovar Typhi
cacauccgccagcgcc

SEQ ID NO: 1686182 - RNA, 20 nt, Salmonella enterica enterica serovar Typhi
cacaucgacaugcagaucgc

SEQ ID NO: 1686183 - RNA, 13 nt, Salmonella enterica enterica serovar Typhi
cacauccagcccc

SEQ ID NO: 1686184 - RNA, 20 nt, Salmonella enterica enterica serovar Typhi
cacaucaugaugaucuucag

SEQ ID NO: 1686185 - RNA, 13 nt, Salmonella enterica enterica serovar Typhi
cacauccagcgcc

SEQ ID NO: 1686186 - RNA, 13 nt, Salmonella enterica enterica serovar Typhi
cacauccauguac

SEQ ID NO: 1686187 - RNA, 21 nt, Salmonella enterica enterica serovar Typhi
cacauucagagcguccacgcc

SEQ ID NO: 1686188 - RNA, 23 nt, Salmonella enterica enterica serovar Typhi
cacauucagcagcgcccagccaa

SEQ ID NO: 1686189 - RNA, 12 nt, Salmonella enterica enterica serovar Typhi
cacauuccauuu

SEQ ID NO: 1686190 - RNA, 22 nt, Salmonella enterica enterica serovar Typhi
cacauucugcccgcguuuccac

SEQ ID NO: 1686191 - RNA, 14 nt, Salmonella enterica enterica serovar Typhi
cacauuggccccug

SEQ ID NO: 1686192 - RNA, 15 nt, Salmonella enterica enterica serovar Typhi
cacauuggccccugg

SEQ ID NO: 1686193 - RNA, 16 nt, Salmonella enterica enterica serovar Typhi
cacauuguaugcaaga

SEQ ID NO: 1686194 - RNA, 10 nt, Salmonella enterica enterica serovar Typhi
caccaaaaac

SEQ ID NO: 1686195 - RNA, 12 nt, Salmonella enterica enterica serovar Typhi
caccaaaaagcc

SEQ ID NO: 1686196 - RNA, 13 nt, Salmonella enterica enterica serovar Typhi
caccaaaaagcca

SEQ ID NO: 1686197 - RNA, 17 nt, Salmonella enterica enterica serovar Typhi
caccaaaaauucuuuua

SEQ ID NO: 1686198 - RNA, 23 nt, Salmonella enterica enterica serovar Typhi
caccaacgauaaauuuucagaca

SEQ ID NO: 1686199 - RNA, 19 nt, Salmonella enterica enterica serovar Typhi
caccaaagccaggccgcca

SEQ ID NO: 1686200 - RNA, 15 nt, Salmonella enterica enterica serovar Typhi
caccaaaucccccaa

SEQ ID NO: 1686201 - RNA, 17 nt, Salmonella enterica enterica serovar Typhi
caccaauacgugagcga

SEQ ID NO: 1686202 - RNA, 22 nt, Salmonella enterica enterica serovar Typhi
caccaauacgugagcgaaguuc

SEQ ID NO: 1686203 - RNA, 21 nt, Salmonella enterica enterica serovar Typhi
caccaacggcgacgcccgcca

SEQ ID NO: 1686204 - RNA, 19 nt, Salmonella enterica enterica serovar Typhi
caccacguaaugcgccccg

SEQ ID NO: 1686205 - RNA, 21 nt, Salmonella enterica enterica serovar Typhi
caccacguaaugcgccccggc

SEQ ID NO: 1686206 - RNA, 22 nt, Salmonella enterica enterica serovar Typhi
caccacgguguaccccgccuga

SEQ ID NO: 1686207 - RNA, 18 nt, Salmonella enterica enterica serovar Typhi
caccacgguguaccccgc

SEQ ID NO: 1686208 - RNA, 21 nt, Salmonella enterica enterica serovar Typhi
caccacgaucuugucacaaua

SEQ ID NO: 1686209 - RNA, 15 nt, Salmonella enterica enterica serovar Typhi
caccacgcccuucac

SEQ ID NO: 1686210 - RNA, 15 nt, Salmonella enterica enterica serovar Typhi
caccacgccgagaaa

SEQ ID NO: 1686211 - RNA, 12 nt, Salmonella enterica enterica serovar Typhi
caccagacgcug

SEQ ID NO: 1686212 - RNA, 21 nt, Salmonella enterica enterica serovar Typhi
caccagacgcuggcacuggca

SEQ ID NO: 1686213 - RNA, 20 nt, Salmonella enterica enterica serovar Typhi
caccagacuaaaacgugcug

SEQ ID NO: 1686214 - RNA, 15 nt, Salmonella enterica enterica serovar Typhi
caccagaaucgccag

SEQ ID NO: 1686215 - RNA, 23 nt, Salmonella enterica enterica serovar Typhi
caccacuggcagcgccugacggc

SEQ ID NO: 1686216 - RNA, 19 nt, Salmonella enterica enterica serovar Typhi
caccacuggcagcgccuga

SEQ ID NO: 1686217 - RNA, 20 nt, Salmonella enterica enterica serovar Typhi
caccacuuuguuuuuguccg

SEQ ID NO: 1686218 - RNA, 21 nt, Salmonella enterica enterica serovar Typhi
caccagaacucccuguuccug

SEQ ID NO: 1686219 - RNA, 18 nt, Salmonella enterica enterica serovar Typhi
caccagaauaaugcccac

SEQ ID NO: 1686220 - RNA, 14 nt, Salmonella enterica enterica serovar Typhi
caccacaaaggcgc

SEQ ID NO: 1686221 - RNA, 22 nt, Salmonella enterica enterica serovar Typhi
caccaaugucauauuugugagc

SEQ ID NO: 1686222 - RNA, 19 nt, Salmonella enterica enterica serovar Typhi
caccacagucaucgcgcca

SEQ ID NO: 1686223 - RNA, 14 nt, Salmonella enterica enterica serovar Typhi
caccaccaggaacg

SEQ ID NO: 1686224 - RNA, 16 nt, Salmonella enterica enterica serovar Typhi
caccaccgcaggcagc

SEQ ID NO: 1686225 - RNA, 24 nt, Salmonella enterica enterica serovar Typhi
caccaccaugggucucauccaucc

SEQ ID NO: 1686226 - RNA, 18 nt, Salmonella enterica enterica serovar Typhi
caccaccaguacauggcu

SEQ ID NO: 1686227 - RNA, 13 nt, Salmonella enterica enterica serovar Typhi
caccaccgccacu

SEQ ID NO: 1686228 - RNA, 19 nt, Salmonella enterica enterica serovar Typhi
caccaucaugcaagagucc

SEQ ID NO: 1686229 - RNA, 14 nt, Salmonella enterica enterica serovar Typhi
caccaucccggcgu

SEQ ID NO: 1686230 - RNA, 13 nt, Salmonella enterica enterica serovar Typhi
caccaucccgcuc

SEQ ID NO: 1686231 - RNA, 19 nt, Salmonella enterica enterica serovar Typhi
caccaucgucgccagaccc

SEQ ID NO: 1686232 - RNA, 20 nt, Salmonella enterica enterica serovar Typhi
caccaucgucgccagaccca

SEQ ID NO: 1686233 - RNA, 17 nt, Salmonella enterica enterica serovar Typhi
caccauccggcgcugcg

SEQ ID NO: 1686234 - RNA, 21 nt, Salmonella enterica enterica serovar Typhi
caccaucgucgccagacccag

SEQ ID NO: 1686235 - RNA, 19 nt, Salmonella enterica enterica serovar Typhi
caccaucguugccagcggc

SEQ ID NO: 1686236 - RNA, 20 nt, Salmonella enterica enterica serovar Typhi
caccaucguugccagcggcc

SEQ ID NO: 1686237 - RNA, 13 nt, Salmonella enterica enterica serovar Typhi
caccaucuuuuug

SEQ ID NO: 1686238 - RNA, 13 nt, Salmonella enterica enterica serovar Typhi
caccaucuuuuuu

SEQ ID NO: 1686239 - RNA, 18 nt, Salmonella enterica enterica serovar Typhi
caccauguugaccagguc

SEQ ID NO: 1686240 - RNA, 18 nt, Salmonella enterica enterica serovar Typhi
caccauguggcgcggccu

SEQ ID NO: 1686241 - RNA, 16 nt, Salmonella enterica enterica serovar Typhi
caccauucccagcgcc

SEQ ID NO: 1686242 - RNA, 14 nt, Salmonella enterica enterica serovar Typhi
caccauuucacaaa

SEQ ID NO: 1686243 - RNA, 20 nt, Salmonella enterica enterica serovar Typhi
cacccaauauagaguccuga

SEQ ID NO: 1686244 - RNA, 14 nt, Salmonella enterica enterica serovar Typhi
cacccaugccgcga

SEQ ID NO: 1686245 - RNA, 14 nt, Salmonella enterica enterica serovar Typhi
caccccaacaaaua

SEQ ID NO: 1686246 - RNA, 21 nt, Salmonella enterica enterica serovar Typhi
caccccaacaaauagcacaca

SEQ ID NO: 1686247 - RNA, 20 nt, Salmonella enterica enterica serovar Typhi
cacccaguuuuuuucugcca

SEQ ID NO: 1686248 - RNA, 15 nt, Salmonella enterica enterica serovar Typhi
cacccgcagccagaa

SEQ ID NO: 1686249 - RNA, 18 nt, Salmonella enterica enterica serovar Typhi
cacccgauaaaaucaucg

SEQ ID NO: 1686250 - RNA, 15 nt, Salmonella enterica enterica serovar Typhi
caccccuugcgcguu

SEQ ID NO: 1686251 - RNA, 18 nt, Salmonella enterica enterica serovar Typhi
cacccgaaagucaaaaua

SEQ ID NO: 1686252 - RNA, 21 nt, Salmonella enterica enterica serovar Typhi
caccagcccaucuuucgccag

SEQ ID NO: 1686253 - RNA, 14 nt, Salmonella enterica enterica serovar Typhi
caccagccguucac

SEQ ID NO: 1686254 - RNA, 17 nt, Salmonella enterica enterica serovar Typhi
caccagccaggccgcca

SEQ ID NO: 1686255 - RNA, 16 nt, Salmonella enterica enterica serovar Typhi
caccagcacagcccag

SEQ ID NO: 1686256 - RNA, 13 nt, Salmonella enterica enterica serovar Typhi
caccagcacagcc

SEQ ID NO: 1686257 - RNA, 19 nt, Salmonella enterica enterica serovar Typhi
caccagcagggcaugauua

SEQ ID NO: 1686258 - RNA, 16 nt, Salmonella enterica enterica serovar Typhi
caccagcgccugcgcu

SEQ ID NO: 1686259 - RNA, 14 nt, Salmonella enterica enterica serovar Typhi
caccagcgccaggc

SEQ ID NO: 1686260 - RNA, 13 nt, Salmonella enterica enterica serovar Typhi
caccagcgccaga

SEQ ID NO: 1686261 - RNA, 18 nt, Salmonella enterica enterica serovar Typhi
caccagcgauaucaacgu

SEQ ID NO: 1686262 - RNA, 20 nt, Salmonella enterica enterica serovar Typhi
caccagccguucaccagcca

SEQ ID NO: 1686263 - RNA, 15 nt, Salmonella enterica enterica serovar Typhi
caccagcgucgcaug

SEQ ID NO: 1686264 - RNA, 15 nt, Salmonella enterica enterica serovar Typhi
caccaguucacuccu

SEQ ID NO: 1686265 - RNA, 21 nt, Salmonella enterica enterica serovar Typhi
caccaguucacuccuaagaga

SEQ ID NO: 1686266 - RNA, 19 nt, Salmonella enterica enterica serovar Typhi
caccaguagcgcgacgcca

SEQ ID NO: 1686267 - RNA, 22 nt, Salmonella enterica enterica serovar Typhi
caccauauagacauacaggaau

SEQ ID NO: 1686268 - RNA, 14 nt, Salmonella enterica enterica serovar Typhi
caccauaucuuuca

SEQ ID NO: 1686269 - RNA, 17 nt, Salmonella enterica enterica serovar Typhi
caccauauucgccaccg

SEQ ID NO: 1686270 - RNA, 15 nt, Salmonella enterica enterica serovar Typhi
caccauaaaaccauu

SEQ ID NO: 1686271 - RNA, 18 nt, Salmonella enterica enterica serovar Typhi
caccauaccuauaaaaau

SEQ ID NO: 1686272 - RNA, 17 nt, Salmonella enterica enterica serovar Typhi
caccagggauuuugcuu

SEQ ID NO: 1686273 - RNA, 20 nt, Salmonella enterica enterica serovar Typhi
caccaggcguaagaucccag

SEQ ID NO: 1686274 - RNA, 21 nt, Salmonella enterica enterica serovar Typhi
caccaggaaugcggccauccu

SEQ ID NO: 1686275 - RNA, 20 nt, Salmonella enterica enterica serovar Typhi
caccaggaagacuauccagc

SEQ ID NO: 1686276 - RNA, 23 nt, Salmonella enterica enterica serovar Typhi
caccaggauacguucauccuccu

SEQ ID NO: 1686277 - RNA, 22 nt, Salmonella enterica enterica serovar Typhi
caccgguacacacgcgcugacc

SEQ ID NO: 1686278 - RNA, 20 nt, Salmonella enterica enterica serovar Typhi
caccggguccagucgcgccg

SEQ ID NO: 1686279 - RNA, 21 nt, Salmonella enterica enterica serovar Typhi
caccgguugcgcaaccuccgc

SEQ ID NO: 1686280 - RNA, 13 nt, Salmonella enterica enterica serovar Typhi
caccgucaauaac

SEQ ID NO: 1686281 - RNA, 16 nt, Salmonella enterica enterica serovar Typhi
caccguagaucgccag

SEQ ID NO: 1686282 - RNA, 19 nt, Salmonella enterica enterica serovar Typhi
caccguaggccugauaaga

SEQ ID NO: 1686283 - RNA, 22 nt, Salmonella enterica enterica serovar Typhi
caccguaucgacauaguacccu

SEQ ID NO: 1686284 - RNA, 19 nt, Salmonella enterica enterica serovar Typhi
caccgucuccggcgcgccg

SEQ ID NO: 1686285 - RNA, 23 nt, Salmonella enterica enterica serovar Typhi
caccgucgagaaaccgcucgccg

SEQ ID NO: 1686286 - RNA, 19 nt, Salmonella enterica enterica serovar Typhi
caccgucgcggcaucguag

SEQ ID NO: 1686287 - RNA, 23 nt, Salmonella enterica enterica serovar Typhi
caccguugggcgcgacgccuggg

SEQ ID NO: 1686288 - RNA, 18 nt, Salmonella enterica enterica serovar Typhi
caccguugugcuccagcg

SEQ ID NO: 1686289 - RNA, 18 nt, Salmonella enterica enterica serovar Typhi
caccguuugcagccagau

SEQ ID NO: 1686290 - RNA, 14 nt, Salmonella enterica enterica serovar Typhi
caccguuuuccagg

SEQ ID NO: 1686291 - RNA, 15 nt, Salmonella enterica enterica serovar Typhi
caccuaacccaccau

SEQ ID NO: 1686292 - RNA, 14 nt, Salmonella enterica enterica serovar Typhi
caccugaucgccaa

SEQ ID NO: 1686293 - RNA, 22 nt, Salmonella enterica enterica serovar Typhi
caccugauugauacgcgcccga

SEQ ID NO: 1686294 - RNA, 16 nt, Salmonella enterica enterica serovar Typhi
caccucuuuaugcggc

SEQ ID NO: 1686295 - RNA, 23 nt, Salmonella enterica enterica serovar Typhi
caccucuuuaugcggcgcuucca

SEQ ID NO: 1686296 - RNA, 20 nt, Salmonella enterica enterica serovar Typhi
caccugaauaacccgcagcc

SEQ ID NO: 1686297 - RNA, 13 nt, Salmonella enterica enterica serovar Typhi
caccucgcaauau

SEQ ID NO: 1686298 - RNA, 23 nt, Salmonella enterica enterica serovar Typhi
caccucgcgacggugagcugaaa

SEQ ID NO: 1686299 - RNA, 23 nt, Salmonella enterica enterica serovar Typhi
caccucaucgcuaccuucuuccc

SEQ ID NO: 1686300 - RNA, 17 nt, Salmonella enterica enterica serovar Typhi
caccucaucacccaguc

SEQ ID NO: 1686301 - RNA, 22 nt, Salmonella enterica enterica serovar Typhi
caccucaagguagcgugucuac

SEQ ID NO: 1686302 - RNA, 13 nt, Salmonella enterica enterica serovar Typhi
caccucagccaac

SEQ ID NO: 1686303 - RNA, 12 nt, Salmonella enterica enterica serovar Typhi
caccucauauuu

SEQ ID NO: 1686304 - RNA, 16 nt, Salmonella enterica enterica serovar Typhi
caccucacuccagacc

SEQ ID NO: 1686305 - RNA, 20 nt, Salmonella enterica enterica serovar Typhi
caccucagguaaauccgcca

SEQ ID NO: 1686306 - RNA, 18 nt, Salmonella enterica enterica serovar Typhi
cacgacuaucgucacccu

SEQ ID NO: 1686307 - RNA, 22 nt, Salmonella enterica enterica serovar Typhi
cacgacuaucgucacccuauuu

SEQ ID NO: 1686308 - RNA, 13 nt, Salmonella enterica enterica serovar Typhi
cacgacgccgccg

SEQ ID NO: 1686309 - RNA, 17 nt, Salmonella enterica enterica serovar Typhi
cacgaaaaauaaaaaaa

SEQ ID NO: 1686310 - RNA, 18 nt, Salmonella enterica enterica serovar Typhi
caccuuuuuauuuacugc

SEQ ID NO: 1686311 - RNA, 17 nt, Salmonella enterica enterica serovar Typhi
cacgaacgauauaaaaa

SEQ ID NO: 1686312 - RNA, 13 nt, Salmonella enterica enterica serovar Typhi
cacgaaucaggau

SEQ ID NO: 1686313 - RNA, 18 nt, Salmonella enterica enterica serovar Typhi
cacgaaugucgcgucagg

SEQ ID NO: 1686314 - RNA, 15 nt, Salmonella enterica enterica serovar Typhi
cacgaagcuccagua

SEQ ID NO: 1686315 - RNA, 22 nt, Salmonella enterica enterica serovar Typhi
caccuucggucccaucgcgcca

SEQ ID NO: 1686316 - RNA, 21 nt, Salmonella enterica enterica serovar Typhi
caccuuugaaaaucacaucgc

SEQ ID NO: 1686317 - RNA, 20 nt, Salmonella enterica enterica serovar Typhi
caccugcuguugcggaauac

SEQ ID NO: 1686318 - RNA, 18 nt, Salmonella enterica enterica serovar Typhi
caccuuacgcacaugauc

SEQ ID NO: 1686319 - RNA, 18 nt, Salmonella enterica enterica serovar Typhi
caccuguaaccccagcau

SEQ ID NO: 1686320 - RNA, 15 nt, Salmonella enterica enterica serovar Typhi
caccuggugcauuuu

SEQ ID NO: 1686321 - RNA, 21 nt, Salmonella enterica enterica serovar Typhi
caccuggucuauucguucucu

SEQ ID NO: 1686322 - RNA, 23 nt, Salmonella enterica enterica serovar Typhi
caccuggucuauucguucucuga

SEQ ID NO: 1686323 - RNA, 22 nt, Salmonella enterica enterica serovar Typhi
caccgcggagaucgcucccgcg

SEQ ID NO: 1686324 - RNA, 18 nt, Salmonella enterica enterica serovar Typhi
caccgcggcaaccagccc

SEQ ID NO: 1686325 - RNA, 20 nt, Salmonella enterica enterica serovar Typhi
caccgcggcaaccagcccau

SEQ ID NO: 1686326 - RNA, 21 nt, Salmonella enterica enterica serovar Typhi
caccgcggcgcucgccagccc

SEQ ID NO: 1686327 - RNA, 13 nt, Salmonella enterica enterica serovar Typhi
caccgcgaugacc

SEQ ID NO: 1686328 - RNA, 19 nt, Salmonella enterica enterica serovar Typhi
caccgcgaauuucaccacc

SEQ ID NO: 1686329 - RNA, 17 nt, Salmonella enterica enterica serovar Typhi
caccgccgcgauagacc

SEQ ID NO: 1686330 - RNA, 18 nt, Salmonella enterica enterica serovar Typhi
caccgccagucccagcac

SEQ ID NO: 1686331 - RNA, 15 nt, Salmonella enterica enterica serovar Typhi
caccgccauauauuu

SEQ ID NO: 1686332 - RNA, 18 nt, Salmonella enterica enterica serovar Typhi
caccgccgccaccaaaaa

SEQ ID NO: 1686333 - RNA, 16 nt, Salmonella enterica enterica serovar Typhi
caccgcccuggcggga

SEQ ID NO: 1686334 - RNA, 16 nt, Salmonella enterica enterica serovar Typhi
caccgcccgccgggcg

SEQ ID NO: 1686335 - RNA, 20 nt, Salmonella enterica enterica serovar Typhi
caccgcugcgcucacgcggc

SEQ ID NO: 1686336 - RNA, 13 nt, Salmonella enterica enterica serovar Typhi
caccggaagugaa

SEQ ID NO: 1686337 - RNA, 23 nt, Salmonella enterica enterica serovar Typhi
caccgcuaaucccagcgcgcgcg

SEQ ID NO: 1686338 - RNA, 22 nt, Salmonella enterica enterica serovar Typhi
caccgcgucguuacgcucguca

SEQ ID NO: 1686339 - RNA, 15 nt, Salmonella enterica enterica serovar Typhi
caccggaguuaccau

SEQ ID NO: 1686340 - RNA, 14 nt, Salmonella enterica enterica serovar Typhi
caccggauacccag

SEQ ID NO: 1686341 - RNA, 20 nt, Salmonella enterica enterica serovar Typhi
caccggccauugccgcgccg

SEQ ID NO: 1686342 - RNA, 21 nt, Salmonella enterica enterica serovar Typhi
caccggcccgguugucccggu

SEQ ID NO: 1686343 - RNA, 15 nt, Salmonella enterica enterica serovar Typhi
caccggcccccggcc

SEQ ID NO: 1686344 - RNA, 12 nt, Salmonella enterica enterica serovar Typhi
caccggcggcca

SEQ ID NO: 1686345 - RNA, 21 nt, Salmonella enterica enterica serovar Typhi
caccgggagaaaacgcggccu

SEQ ID NO: 1686346 - RNA, 12 nt, Salmonella enterica enterica serovar Typhi
caccgacuccuc

SEQ ID NO: 1686347 - RNA, 15 nt, Salmonella enterica enterica serovar Typhi
caccgaccugccuug

SEQ ID NO: 1686348 - RNA, 14 nt, Salmonella enterica enterica serovar Typhi
caccgaggguuugu

SEQ ID NO: 1686349 - RNA, 22 nt, Salmonella enterica enterica serovar Typhi
caccgcaaauucgucgccgcca

SEQ ID NO: 1686350 - RNA, 15 nt, Salmonella enterica enterica serovar Typhi
caccgcauccgcauc

SEQ ID NO: 1686351 - RNA, 18 nt, Salmonella enterica enterica serovar Typhi
caccgccacuuccgcuac

SEQ ID NO: 1686352 - RNA, 18 nt, Salmonella enterica enterica serovar Typhi
caccgccagacgccccaa

SEQ ID NO: 1686353 - RNA, 13 nt, Salmonella enterica enterica serovar Typhi
caccgccagagca

SEQ ID NO: 1686354 - RNA, 16 nt, Salmonella enterica enterica serovar Typhi
caccgccagcgccgcg

SEQ ID NO: 1686355 - RNA, 13 nt, Salmonella enterica enterica serovar Typhi
caccgccagcagu

SEQ ID NO: 1686356 - RNA, 17 nt, Salmonella enterica enterica serovar Typhi
cacccuugcggcuugca

SEQ ID NO: 1686357 - RNA, 10 nt, Salmonella enterica enterica serovar Typhi
cacccugccc

SEQ ID NO: 1686358 - RNA, 12 nt, Salmonella enterica enterica serovar Typhi
cacccugccccg

SEQ ID NO: 1686359 - RNA, 12 nt, Salmonella enterica enterica serovar Typhi
cacccgccggca

SEQ ID NO: 1686360 - RNA, 15 nt, Salmonella enterica enterica serovar Typhi
cacccggagagaaac

SEQ ID NO: 1686361 - RNA, 18 nt, Salmonella enterica enterica serovar Typhi
cacccggcugacugccgu

SEQ ID NO: 1686362 - RNA, 14 nt, Salmonella enterica enterica serovar Typhi
cacggccagcagcc

SEQ ID NO: 1686363 - RNA, 13 nt, Salmonella enterica enterica serovar Typhi
cacggcucgccuu

SEQ ID NO: 1686364 - RNA, 19 nt, Salmonella enterica enterica serovar Typhi
cacggcucgaucccgaccc

SEQ ID NO: 1686365 - RNA, 19 nt, Salmonella enterica enterica serovar Typhi
cacggcguacuccacuguc

SEQ ID NO: 1686366 - RNA, 13 nt, Salmonella enterica enterica serovar Typhi
cacggccaccaua

SEQ ID NO: 1686367 - RNA, 15 nt, Salmonella enterica enterica serovar Typhi
cacggccacagccau

SEQ ID NO: 1686368 - RNA, 15 nt, Salmonella enterica enterica serovar Typhi
cacggcauaagccuc

SEQ ID NO: 1686369 - RNA, 17 nt, Salmonella enterica enterica serovar Typhi
cacggcauaagccucau

SEQ ID NO: 1686370 - RNA, 21 nt, Salmonella enterica enterica serovar Typhi
cacggcaacgccguacuccag

SEQ ID NO: 1686371 - RNA, 19 nt, Salmonella enterica enterica serovar Typhi
cacggaucaucuacccgua

SEQ ID NO: 1686372 - RNA, 15 nt, Salmonella enterica enterica serovar Typhi
cacggauggccucug

SEQ ID NO: 1686373 - RNA, 18 nt, Salmonella enterica enterica serovar Typhi
cacgcuuuuacaucgcug

SEQ ID NO: 1686374 - RNA, 19 nt, Salmonella enterica enterica serovar Typhi
cacggaacaacggcacaca

SEQ ID NO: 1686375 - RNA, 20 nt, Salmonella enterica enterica serovar Typhi
cacggaauccccggcuucca

SEQ ID NO: 1686376 - RNA, 23 nt, Salmonella enterica enterica serovar Typhi
cacggaauccccggcuuccagcg

SEQ ID NO: 1686377 - RNA, 19 nt, Salmonella enterica enterica serovar Typhi
cacggagagucgcaccgcg

SEQ ID NO: 1686378 - RNA, 20 nt, Salmonella enterica enterica serovar Typhi
cacgcggucgucaucggcga

SEQ ID NO: 1686379 - RNA, 17 nt, Salmonella enterica enterica serovar Typhi
cacgcguaaacuuccgc

SEQ ID NO: 1686380 - RNA, 22 nt, Salmonella enterica enterica serovar Typhi
cacgcggaaucgucacagaccc

SEQ ID NO: 1686381 - RNA, 14 nt, Salmonella enterica enterica serovar Typhi
cacgcgccagccgu

SEQ ID NO: 1686382 - RNA, 16 nt, Salmonella enterica enterica serovar Typhi
cacgcgccagcaccac

SEQ ID NO: 1686383 - RNA, 13 nt, Salmonella enterica enterica serovar Typhi
cacgcgcggcgcc

SEQ ID NO: 1686384 - RNA, 19 nt, Salmonella enterica enterica serovar Typhi
cacgcgcggcuacugccag

SEQ ID NO: 1686385 - RNA, 21 nt, Salmonella enterica enterica serovar Typhi
cacgcgcgccugccgccagca

SEQ ID NO: 1686386 - RNA, 19 nt, Salmonella enterica enterica serovar Typhi
cacgcgcgcugcgccugga

SEQ ID NO: 1686387 - RNA, 13 nt, Salmonella enterica enterica serovar Typhi
cacgccuuccucc

SEQ ID NO: 1686388 - RNA, 22 nt, Salmonella enterica enterica serovar Typhi
cacgccucuggcguacgcagau

SEQ ID NO: 1686389 - RNA, 14 nt, Salmonella enterica enterica serovar Typhi
cacgccugcuucac

SEQ ID NO: 1686390 - RNA, 20 nt, Salmonella enterica enterica serovar Typhi
cacgcuccugcuccugcggc

SEQ ID NO: 1686391 - RNA, 18 nt, Salmonella enterica enterica serovar Typhi
cacgcucccggaaccgac

SEQ ID NO: 1686392 - RNA, 18 nt, Salmonella enterica enterica serovar Typhi
cacgcuaaaaaaggcaga

SEQ ID NO: 1686393 - RNA, 19 nt, Salmonella enterica enterica serovar Typhi
cacgcucaauggcgcgcca

SEQ ID NO: 1686394 - RNA, 17 nt, Salmonella enterica enterica serovar Typhi
cacgcugaggcgccguc

SEQ ID NO: 1686395 - RNA, 18 nt, Salmonella enterica enterica serovar Typhi
cacgcugaugcugugcag

SEQ ID NO: 1686396 - RNA, 18 nt, Salmonella enterica enterica serovar Typhi
cacgcugaccacgccgcc

SEQ ID NO: 1686397 - RNA, 22 nt, Salmonella enterica enterica serovar Typhi
cacgcucaagaugauagccauu

SEQ ID NO: 1686398 - RNA, 13 nt, Salmonella enterica enterica serovar Typhi
cacgcccgcagca

SEQ ID NO: 1686399 - RNA, 22 nt, Salmonella enterica enterica serovar Typhi
cacgccgacucacgcagcgcuc

SEQ ID NO: 1686400 - RNA, 16 nt, Salmonella enterica enterica serovar Typhi
cacgccgcuccacagc

SEQ ID NO: 1686401 - RNA, 12 nt, Salmonella enterica enterica serovar Typhi
cacgccgcgcug

SEQ ID NO: 1686402 - RNA, 19 nt, Salmonella enterica enterica serovar Typhi
cacgccgccauccggcacu

SEQ ID NO: 1686403 - RNA, 23 nt, Salmonella enterica enterica serovar Typhi
cacgccgcccgccugagcgcgca

SEQ ID NO: 1686404 - RNA, 15 nt, Salmonella enterica enterica serovar Typhi
cacgccgucgaugau

SEQ ID NO: 1686405 - RNA, 14 nt, Salmonella enterica enterica serovar Typhi
cacgccguccagca

SEQ ID NO: 1686406 - RNA, 20 nt, Salmonella enterica enterica serovar Typhi
cacgccguccagcaccaccu

SEQ ID NO: 1686407 - RNA, 13 nt, Salmonella enterica enterica serovar Typhi
cacgccagcagcu

SEQ ID NO: 1686408 - RNA, 18 nt, Salmonella enterica enterica serovar Typhi
cacgccagauaaaucagc

SEQ ID NO: 1686409 - RNA, 11 nt, Salmonella enterica enterica serovar Typhi
cacgccaccgg

SEQ ID NO: 1686410 - RNA, 21 nt, Salmonella enterica enterica serovar Typhi
cacgcaucgggucgcgcgccg

SEQ ID NO: 1686411 - RNA, 22 nt, Salmonella enterica enterica serovar Typhi
cacgcauggcguugcugcaaau

SEQ ID NO: 1686412 - RNA, 18 nt, Salmonella enterica enterica serovar Typhi
cacgcauugccacagccu

SEQ ID NO: 1686413 - RNA, 17 nt, Salmonella enterica enterica serovar Typhi
cacgccaaaaagugaau

SEQ ID NO: 1686414 - RNA, 11 nt, Salmonella enterica enterica serovar Typhi
cacgcccagcg

SEQ ID NO: 1686415 - RNA, 17 nt, Salmonella enterica enterica serovar Typhi
cacgcccauauccagcu

SEQ ID NO: 1686416 - RNA, 14 nt, Salmonella enterica enterica serovar Typhi
cacgccaucggcua

SEQ ID NO: 1686417 - RNA, 17 nt, Salmonella enterica enterica serovar Typhi
cacgccauggccgcagc

SEQ ID NO: 1686418 - RNA, 16 nt, Salmonella enterica enterica serovar Typhi
cacgccaucagggacg

SEQ ID NO: 1686419 - RNA, 20 nt, Salmonella enterica enterica serovar Typhi
cacgccagggagggccaacc

SEQ ID NO: 1686420 - RNA, 20 nt, Salmonella enterica enterica serovar Typhi
cacgaucgagucaggcgcca

SEQ ID NO: 1686421 - RNA, 11 nt, Salmonella enterica enterica serovar Typhi
cacgaucaucg

SEQ ID NO: 1686422 - RNA, 16 nt, Salmonella enterica enterica serovar Typhi
cacgaucgaugcccug

SEQ ID NO: 1686423 - RNA, 17 nt, Salmonella enterica enterica serovar Typhi
cacgauacgccccugcu

SEQ ID NO: 1686424 - RNA, 21 nt, Salmonella enterica enterica serovar Typhi
cacgauaaccagaucggcuau

SEQ ID NO: 1686425 - RNA, 24 nt, Salmonella enterica enterica serovar Typhi
cacgauagacagcaccaucaugca

SEQ ID NO: 1686426 - RNA, 15 nt, Salmonella enterica enterica serovar Typhi
cacgaugcauaugca

SEQ ID NO: 1686427 - RNA, 19 nt, Salmonella enterica enterica serovar Typhi
cacgauguucaacgucagc

SEQ ID NO: 1686428 - RNA, 19 nt, Salmonella enterica enterica serovar Typhi
cacgcagggggucgcgggu

SEQ ID NO: 1686429 - RNA, 13 nt, Salmonella enterica enterica serovar Typhi
cacgcagccaugu

SEQ ID NO: 1686430 - RNA, 24 nt, Salmonella enterica enterica serovar Typhi
cacgcagcgcagaccgagcgcaug

SEQ ID NO: 1686431 - RNA, 20 nt, Salmonella enterica enterica serovar Typhi
cacgcagauaucuuccagcg

SEQ ID NO: 1686432 - RNA, 24 nt, Salmonella enterica enterica serovar Typhi
cacgcagacgccgcgguugacggc

SEQ ID NO: 1686433 - RNA, 19 nt, Salmonella enterica enterica serovar Typhi
cacgcacgacagugcuaua

SEQ ID NO: 1686434 - RNA, 22 nt, Salmonella enterica enterica serovar Typhi
cacgcacaucccgaauacgcug

SEQ ID NO: 1686435 - RNA, 16 nt, Salmonella enterica enterica serovar Typhi
cacgcaaugcguccgu

SEQ ID NO: 1686436 - RNA, 18 nt, Salmonella enterica enterica serovar Typhi
cacggguagcuagccaau

SEQ ID NO: 1686437 - RNA, 18 nt, Salmonella enterica enterica serovar Typhi
cacggggcggacgaugaa

SEQ ID NO: 1686438 - RNA, 15 nt, Salmonella enterica enterica serovar Typhi
cacgggcgcaccaua

SEQ ID NO: 1686439 - RNA, 17 nt, Salmonella enterica enterica serovar Typhi
cacggucaaucaucaga

SEQ ID NO: 1686440 - RNA, 16 nt, Salmonella enterica enterica serovar Typhi
cacgguaaaacacgcc

SEQ ID NO: 1686441 - RNA, 14 nt, Salmonella enterica enterica serovar Typhi
cacgguaaaccucu

SEQ ID NO: 1686442 - RNA, 18 nt, Salmonella enterica enterica serovar Typhi
cacggugugaucaccgcc

SEQ ID NO: 1686443 - RNA, 19 nt, Salmonella enterica enterica serovar Typhi
cacgucacgcaacaggccg

SEQ ID NO: 1686444 - RNA, 19 nt, Salmonella enterica enterica serovar Typhi
cacgucagcgaccauugcg

SEQ ID NO: 1686445 - RNA, 14 nt, Salmonella enterica enterica serovar Typhi
cacgucauccuccu

SEQ ID NO: 1686446 - RNA, 13 nt, Salmonella enterica enterica serovar Typhi
cacgguugaagcg

SEQ ID NO: 1686447 - RNA, 17 nt, Salmonella enterica enterica serovar Typhi
cacgguuucugcgcgcu

SEQ ID NO: 1686448 - RNA, 17 nt, Salmonella enterica enterica serovar Typhi
cacguaacucggcagcg

SEQ ID NO: 1686449 - RNA, 15 nt, Salmonella enterica enterica serovar Typhi
cacguaguaaugcau

SEQ ID NO: 1686450 - RNA, 19 nt, Salmonella enterica enterica serovar Typhi
cacguacccaaauaucaaa

SEQ ID NO: 1686451 - RNA, 17 nt, Salmonella enterica enterica serovar Typhi
cacguuauaccacuggu

SEQ ID NO: 1686452 - RNA, 16 nt, Salmonella enterica enterica serovar Typhi
cacguuuugcagcgcc

SEQ ID NO: 1686453 - RNA, 13 nt, Salmonella enterica enterica serovar Typhi
cacguuuuuacuc

SEQ ID NO: 1686454 - RNA, 17 nt, Salmonella enterica enterica serovar Typhi
cacgugguacacaauca

SEQ ID NO: 1686455 - RNA, 18 nt, Salmonella enterica enterica serovar Typhi
cacgucuccucagaugua

SEQ ID NO: 1686456 - RNA, 15 nt, Salmonella enterica enterica serovar Typhi
cacuaacugaccaua

SEQ ID NO: 1686457 - RNA, 16 nt, Salmonella enterica enterica serovar Typhi
cacuaacgauguaaaa

SEQ ID NO: 1686458 - RNA, 20 nt, Salmonella enterica enterica serovar Typhi
cacuaacgauguaaaaccug

SEQ ID NO: 1686459 - RNA, 13 nt, Salmonella enterica enterica serovar Typhi
cacuaccagaaac

SEQ ID NO: 1686460 - RNA, 15 nt, Salmonella enterica enterica serovar Typhi
cacuaccgggcagca

SEQ ID NO: 1686461 - RNA, 21 nt, Salmonella enterica enterica serovar Typhi
cacuaccgggcagcaucucga

SEQ ID NO: 1686462 - RNA, 14 nt, Salmonella enterica enterica serovar Typhi
cacuaauuugaguc

SEQ ID NO: 1686463 - RNA, 12 nt, Salmonella enterica enterica serovar Typhi
cacuaauuugcg

SEQ ID NO: 1686464 - RNA, 18 nt, Salmonella enterica enterica serovar Typhi
cacuaauccccauuuuuu

SEQ ID NO: 1686465 - RNA, 16 nt, Salmonella enterica enterica serovar Typhi
cacuaccgccgcggau

SEQ ID NO: 1686466 - RNA, 16 nt, Salmonella enterica enterica serovar Typhi
cacuacggguuuuugu

SEQ ID NO: 1686467 - RNA, 18 nt, Salmonella enterica enterica serovar Typhi
cacuacggguuuuugugu

SEQ ID NO: 1686468 - RNA, 22 nt, Salmonella enterica enterica serovar Typhi
cacuacgguccaguugcccucu

SEQ ID NO: 1686469 - RNA, 17 nt, Salmonella enterica enterica serovar Typhi
cacuagcacuacggcaa

SEQ ID NO: 1686470 - RNA, 15 nt, Salmonella enterica enterica serovar Typhi
cacuauccagucagc

SEQ ID NO: 1686471 - RNA, 18 nt, Salmonella enterica enterica serovar Typhi
cacuauauguccuuuacu

SEQ ID NO: 1686472 - RNA, 14 nt, Salmonella enterica enterica serovar Typhi
cacucagaaaauua

SEQ ID NO: 1686473 - RNA, 19 nt, Salmonella enterica enterica serovar Typhi
cacucacaaaacuauuuuc

SEQ ID NO: 1686474 - RNA, 14 nt, Salmonella enterica enterica serovar Typhi
cacucaaccaacca

SEQ ID NO: 1686475 - RNA, 21 nt, Salmonella enterica enterica serovar Typhi
cacucagaaaauuauuuuaaa

SEQ ID NO: 1686476 - RNA, 18 nt, Salmonella enterica enterica serovar Typhi
cacucagaaaauuauuuu

SEQ ID NO: 1686477 - RNA, 16 nt, Salmonella enterica enterica serovar Typhi
cacucaggcagauggu

SEQ ID NO: 1686478 - RNA, 14 nt, Salmonella enterica enterica serovar Typhi
cacucuuuuuggcu

SEQ ID NO: 1686479 - RNA, 19 nt, Salmonella enterica enterica serovar Typhi
cacugaagccuggugccca

SEQ ID NO: 1686480 - RNA, 19 nt, Salmonella enterica enterica serovar Typhi
cacugaauuacugcguaaa

SEQ ID NO: 1686481 - RNA, 16 nt, Salmonella enterica enterica serovar Typhi
cacugacgaaaaccgu

SEQ ID NO: 1686482 - RNA, 15 nt, Salmonella enterica enterica serovar Typhi
cacugacuauccaca

SEQ ID NO: 1686483 - RNA, 18 nt, Salmonella enterica enterica serovar Typhi
cacugacuauccacagcg

SEQ ID NO: 1686484 - RNA, 21 nt, Salmonella enterica enterica serovar Typhi
cacugacucuuccgggcgcga

SEQ ID NO: 1686485 - RNA, 15 nt, Salmonella enterica enterica serovar Typhi
cacuccccagaauga

SEQ ID NO: 1686486 - RNA, 23 nt, Salmonella enterica enterica serovar Typhi
cacucccgauucaacguuucgcu

SEQ ID NO: 1686487 - RNA, 17 nt, Salmonella enterica enterica serovar Typhi
cacuccuaagagaaaac

SEQ ID NO: 1686488 - RNA, 19 nt, Salmonella enterica enterica serovar Typhi
cacucguaacgcauaucca

SEQ ID NO: 1686489 - RNA, 14 nt, Salmonella enterica enterica serovar Typhi
cacucgcucauuug

SEQ ID NO: 1686490 - RNA, 15 nt, Salmonella enterica enterica serovar Typhi
auucugcgccagcca

SEQ ID NO: 1686491 - RNA, 15 nt, Salmonella enterica enterica serovar Typhi
auucuucgucagaug

SEQ ID NO: 1686492 - RNA, 15 nt, Salmonella enterica enterica serovar Typhi
auucuucuuagaaua

SEQ ID NO: 1686493 - RNA, 19 nt, Salmonella enterica enterica serovar Typhi
auucuuuaauuugugccag

SEQ ID NO: 1686494 - RNA, 19 nt, Salmonella enterica enterica serovar Typhi
auucuuucgcguaaacacu

SEQ ID NO: 1686495 - RNA, 20 nt, Salmonella enterica enterica serovar Typhi
auucuuuacuaauaccugga

SEQ ID NO: 1686496 - RNA, 21 nt, Salmonella enterica enterica serovar Typhi
auugaacauuuuuucagccug

SEQ ID NO: 1686497 - RNA, 17 nt, Salmonella enterica enterica serovar Typhi
auugaacggcucaaaau

SEQ ID NO: 1686498 - RNA, 12 nt, Salmonella enterica enterica serovar Typhi
auugaacgugau

SEQ ID NO: 1686499 - RNA, 17 nt, Salmonella enterica enterica serovar Typhi
auucuuuucacgcauug

SEQ ID NO: 1686500 - RNA, 14 nt, Salmonella enterica enterica serovar Typhi
auucguaacaugcu

SEQ ID NO: 1686501 - RNA, 15 nt, Salmonella enterica enterica serovar Typhi
auucgucaauaccua

SEQ ID NO: 1686502 - RNA, 17 nt, Salmonella enterica enterica serovar Typhi
auucuaaaaguaagcua

SEQ ID NO: 1686503 - RNA, 19 nt, Salmonella enterica enterica serovar Typhi
auucuaacauaaugaaucc

SEQ ID NO: 1686504 - RNA, 16 nt, Salmonella enterica enterica serovar Typhi
auucgucaccgaauag

SEQ ID NO: 1686505 - RNA, 17 nt, Salmonella enterica enterica serovar Typhi
auucuacaaguucagua

SEQ ID NO: 1686506 - RNA, 19 nt, Salmonella enterica enterica serovar Typhi
auucucugcccccgagcca

SEQ ID NO: 1686507 - RNA, 14 nt, Salmonella enterica enterica serovar Typhi
auucucccaaauuu

SEQ ID NO: 1686508 - RNA, 22 nt, Salmonella enterica enterica serovar Typhi
auucugaaaaggggauaacaac

SEQ ID NO: 1686509 - RNA, 20 nt, Salmonella enterica enterica serovar Typhi
auucucuucuaccacgcugc

SEQ ID NO: 1686510 - RNA, 17 nt, Salmonella enterica enterica serovar Typhi
auucucugucgccgccc

SEQ ID NO: 1686511 - RNA, 19 nt, Salmonella enterica enterica serovar Typhi
auucuacaguuugucauca

SEQ ID NO: 1686512 - RNA, 19 nt, Salmonella enterica enterica serovar Typhi
auucucaucagaccgugaa

SEQ ID NO: 1686513 - RNA, 19 nt, Salmonella enterica enterica serovar Typhi
auugcggggguuguuuuac

SEQ ID NO: 1686514 - RNA, 15 nt, Salmonella enterica enterica serovar Typhi
auugcgguucugcau

SEQ ID NO: 1686515 - RNA, 22 nt, Salmonella enterica enterica serovar Typhi
auugcguaucguaagccaccgc

SEQ ID NO: 1686516 - RNA, 20 nt, Salmonella enterica enterica serovar Typhi
auugcucuuccggcauaaaa

SEQ ID NO: 1686517 - RNA, 21 nt, Salmonella enterica enterica serovar Typhi
auugcgccugggauaagcaga

SEQ ID NO: 1686518 - RNA, 13 nt, Salmonella enterica enterica serovar Typhi
auugcgccaccuu

SEQ ID NO: 1686519 - RNA, 17 nt, Salmonella enterica enterica serovar Typhi
auugccauaaaaacaau

SEQ ID NO: 1686520 - RNA, 23 nt, Salmonella enterica enterica serovar Typhi
auugccauaaauacaauucaacu

SEQ ID NO: 1686521 - RNA, 23 nt, Salmonella enterica enterica serovar Typhi
auugccaguccggaugucucagc

SEQ ID NO: 1686522 - RNA, 20 nt, Salmonella enterica enterica serovar Typhi
auugccaugcgacuaaccug

SEQ ID NO: 1686523 - RNA, 18 nt, Salmonella enterica enterica serovar Typhi
auugccauguuaauacca

SEQ ID NO: 1686524 - RNA, 13 nt, Salmonella enterica enterica serovar Typhi
auugcauaucgcu

SEQ ID NO: 1686525 - RNA, 18 nt, Salmonella enterica enterica serovar Typhi
auuggaaaacuccagcag

SEQ ID NO: 1686526 - RNA, 16 nt, Salmonella enterica enterica serovar Typhi
auuggcggcaaagaaa

SEQ ID NO: 1686527 - RNA, 20 nt, Salmonella enterica enterica serovar Typhi
auuggcgcgucaucaauauc

SEQ ID NO: 1686528 - RNA, 21 nt, Salmonella enterica enterica serovar Typhi
auuggcggacgaaucuggaua

SEQ ID NO: 1686529 - RNA, 15 nt, Salmonella enterica enterica serovar Typhi
auuggcggcaaagaa

SEQ ID NO: 1686530 - RNA, 16 nt, Salmonella enterica enterica serovar Typhi
auuggcgcagccuguu

SEQ ID NO: 1686531 - RNA, 14 nt, Salmonella enterica enterica serovar Typhi
auugcugcuauuuc

SEQ ID NO: 1686532 - RNA, 14 nt, Salmonella enterica enterica serovar Typhi
auugcugagcugac

SEQ ID NO: 1686533 - RNA, 18 nt, Salmonella enterica enterica serovar Typhi
auugcuuuuggcaacggc

SEQ ID NO: 1686534 - RNA, 18 nt, Salmonella enterica enterica serovar Typhi
auugaucacaaaaucauu

SEQ ID NO: 1686535 - RNA, 22 nt, Salmonella enterica enterica serovar Typhi
auugaucacaaaaucauugcgu

SEQ ID NO: 1686536 - RNA, 20 nt, Salmonella enterica enterica serovar Typhi
auugaauuugacgacaugca

SEQ ID NO: 1686537 - RNA, 19 nt, Salmonella enterica enterica serovar Typhi
auugaauucaccgcaugac

SEQ ID NO: 1686538 - RNA, 13 nt, Salmonella enterica enterica serovar Typhi
auugauucccggu

SEQ ID NO: 1686539 - RNA, 17 nt, Salmonella enterica enterica serovar Typhi
auugcagcgaccuggga

SEQ ID NO: 1686540 - RNA, 22 nt, Salmonella enterica enterica serovar Typhi
auugcagggugcagcaaauaau

SEQ ID NO: 1686541 - RNA, 17 nt, Salmonella enterica enterica serovar Typhi
auugauuggcaaacugu

SEQ ID NO: 1686542 - RNA, 12 nt, Salmonella enterica enterica serovar Typhi
auuccaauauuu

SEQ ID NO: 1686543 - RNA, 14 nt, Salmonella enterica enterica serovar Typhi
auuccaaaauaaua

SEQ ID NO: 1686544 - RNA, 17 nt, Salmonella enterica enterica serovar Typhi
auucauuauuuuuaaau

SEQ ID NO: 1686545 - RNA, 22 nt, Salmonella enterica enterica serovar Typhi
auucauuauuuuuaaauaacuu

SEQ ID NO: 1686546 - RNA, 22 nt, Salmonella enterica enterica serovar Typhi
auucauuguccguaauuugcuu

SEQ ID NO: 1686547 - RNA, 21 nt, Salmonella enterica enterica serovar Typhi
auucauucacccaauaaauaa

SEQ ID NO: 1686548 - RNA, 15 nt, Salmonella enterica enterica serovar Typhi
auucauucccauacu

SEQ ID NO: 1686549 - RNA, 15 nt, Salmonella enterica enterica serovar Typhi
auucauuucaaugua

SEQ ID NO: 1686550 - RNA, 14 nt, Salmonella enterica enterica serovar Typhi
auucauuuccagca

SEQ ID NO: 1686551 - RNA, 14 nt, Salmonella enterica enterica serovar Typhi
auuccaguccuuuc

SEQ ID NO: 1686552 - RNA, 15 nt, Salmonella enterica enterica serovar Typhi
auuccagucgcucca

SEQ ID NO: 1686553 - RNA, 23 nt, Salmonella enterica enterica serovar Typhi
auuccagggcauuuuuuccagua

SEQ ID NO: 1686554 - RNA, 13 nt, Salmonella enterica enterica serovar Typhi
auuccauuggcca

SEQ ID NO: 1686555 - RNA, 21 nt, Salmonella enterica enterica serovar Typhi
auuccagaaaggaugcccgua

SEQ ID NO: 1686556 - RNA, 11 nt, Salmonella enterica enterica serovar Typhi
auuccagaccc

SEQ ID NO: 1686557 - RNA, 18 nt, Salmonella enterica enterica serovar Typhi
auuccagcgugccgagca

SEQ ID NO: 1686558 - RNA, 22 nt, Salmonella enterica enterica serovar Typhi
auuccagcgugccgagcaacag

SEQ ID NO: 1686559 - RNA, 22 nt, Salmonella enterica enterica serovar Typhi
auuccagggcauuuuuuccagu

SEQ ID NO: 1686560 - RNA, 14 nt, Salmonella enterica enterica serovar Typhi
auguugaaccguca

SEQ ID NO: 1686561 - RNA, 21 nt, Salmonella enterica enterica serovar Typhi
auguugaucguaaaaugaaaa

SEQ ID NO: 1686562 - RNA, 15 nt, Salmonella enterica enterica serovar Typhi
auguugccacaggcu

SEQ ID NO: 1686563 - RNA, 13 nt, Salmonella enterica enterica serovar Typhi
auguucuuucgcc

SEQ ID NO: 1686564 - RNA, 16 nt, Salmonella enterica enterica serovar Typhi
auucauaccuuuaagc

SEQ ID NO: 1686565 - RNA, 15 nt, Salmonella enterica enterica serovar Typhi
auucaucaucuuguc

SEQ ID NO: 1686566 - RNA, 14 nt, Salmonella enterica enterica serovar Typhi
auucauauuagcuc

SEQ ID NO: 1686567 - RNA, 12 nt, Salmonella enterica enterica serovar Typhi
auucauauugcc

SEQ ID NO: 1686568 - RNA, 15 nt, Salmonella enterica enterica serovar Typhi
auucaucaaaaugca

SEQ ID NO: 1686569 - RNA, 21 nt, Salmonella enterica enterica serovar Typhi
auucaugaucuuuccuuuuuc

SEQ ID NO: 1686570 - RNA, 19 nt, Salmonella enterica enterica serovar Typhi
auucaugccagaagcaaau

SEQ ID NO: 1686571 - RNA, 19 nt, Salmonella enterica enterica serovar Typhi
auucaugguacucaacauc

SEQ ID NO: 1686572 - RNA, 21 nt, Salmonella enterica enterica serovar Typhi
auucaugguacucaacaucau

SEQ ID NO: 1686573 - RNA, 13 nt, Salmonella enterica enterica serovar Typhi
auucaucuccucu

SEQ ID NO: 1686574 - RNA, 15 nt, Salmonella enterica enterica serovar Typhi
auucaucuccucuuc

SEQ ID NO: 1686575 - RNA, 17 nt, Salmonella enterica enterica serovar Typhi
auucgcuuguuucacug

SEQ ID NO: 1686576 - RNA, 20 nt, Salmonella enterica enterica serovar Typhi
auucggaaugaugugcuauu

SEQ ID NO: 1686577 - RNA, 19 nt, Salmonella enterica enterica serovar Typhi
auucggccuucgguuuuau

SEQ ID NO: 1686578 - RNA, 16 nt, Salmonella enterica enterica serovar Typhi
auucggcgaaagaagc

SEQ ID NO: 1686579 - RNA, 22 nt, Salmonella enterica enterica serovar Typhi
auucgggacaaacccccagcca

SEQ ID NO: 1686580 - RNA, 23 nt, Salmonella enterica enterica serovar Typhi
auucgcgcuaucgcuaaagacgu

SEQ ID NO: 1686581 - RNA, 23 nt, Salmonella enterica enterica serovar Typhi
auucgcgcuaaaugacaaauaga

SEQ ID NO: 1686582 - RNA, 14 nt, Salmonella enterica enterica serovar Typhi
auucgcuaauaaau

SEQ ID NO: 1686583 - RNA, 14 nt, Salmonella enterica enterica serovar Typhi
auucgcuaauaauu

SEQ ID NO: 1686584 - RNA, 19 nt, Salmonella enterica enterica serovar Typhi
auucgcuaauccccccuuu

SEQ ID NO: 1686585 - RNA, 15 nt, Salmonella enterica enterica serovar Typhi
auucgccccagcaua

SEQ ID NO: 1686586 - RNA, 18 nt, Salmonella enterica enterica serovar Typhi
auucgccaguaaggggau

SEQ ID NO: 1686587 - RNA, 23 nt, Salmonella enterica enterica serovar Typhi
auucgccaccgcgcgcuuaaucg

SEQ ID NO: 1686588 - RNA, 22 nt, Salmonella enterica enterica serovar Typhi
auucgacugcggucguauuuac

SEQ ID NO: 1686589 - RNA, 21 nt, Salmonella enterica enterica serovar Typhi
auuccuuuuuccgccaccugu

SEQ ID NO: 1686590 - RNA, 20 nt, Salmonella enterica enterica serovar Typhi
auuccuuuuuccgccaccug

SEQ ID NO: 1686591 - RNA, 22 nt, Salmonella enterica enterica serovar Typhi
auucgacaguucccggcaacag

SEQ ID NO: 1686592 - RNA, 17 nt, Salmonella enterica enterica serovar Typhi
auuccuuguccgaugca

SEQ ID NO: 1686593 - RNA, 12 nt, Salmonella enterica enterica serovar Typhi
auuccuucggug

SEQ ID NO: 1686594 - RNA, 14 nt, Salmonella enterica enterica serovar Typhi
auuccuggauuaaa

SEQ ID NO: 1686595 - RNA, 14 nt, Salmonella enterica enterica serovar Typhi
auuccugcauguuu

SEQ ID NO: 1686596 - RNA, 20 nt, Salmonella enterica enterica serovar Typhi
auuccugccgccgcaccacu

SEQ ID NO: 1686597 - RNA, 18 nt, Salmonella enterica enterica serovar Typhi
auucccggcggaaaugcg

SEQ ID NO: 1686598 - RNA, 15 nt, Salmonella enterica enterica serovar Typhi
auucccguaaaagaa

SEQ ID NO: 1686599 - RNA, 17 nt, Salmonella enterica enterica serovar Typhi
auucccguaucuucaug

SEQ ID NO: 1686600 - RNA, 21 nt, Salmonella enterica enterica serovar Typhi
auucccguaucuucauguucu

SEQ ID NO: 1686601 - RNA, 16 nt, Salmonella enterica enterica serovar Typhi
auucccgucccugcau

SEQ ID NO: 1686602 - RNA, 21 nt, Salmonella enterica enterica serovar Typhi
auucccugguucgaauccagg

SEQ ID NO: 1686603 - RNA, 19 nt, Salmonella enterica enterica serovar Typhi
auucccugguucgaaucca

SEQ ID NO: 1686604 - RNA, 20 nt, Salmonella enterica enterica serovar Typhi
auucccacgcauaguccugc

SEQ ID NO: 1686605 - RNA, 15 nt, Salmonella enterica enterica serovar Typhi
auuccgcuuccagaa

SEQ ID NO: 1686606 - RNA, 13 nt, Salmonella enterica enterica serovar Typhi
auuccgcgcauaa

SEQ ID NO: 1686607 - RNA, 14 nt, Salmonella enterica enterica serovar Typhi
auuccggcacaacc

SEQ ID NO: 1686608 - RNA, 21 nt, Salmonella enterica enterica serovar Typhi
auuccgcgcuaucgguaucau

SEQ ID NO: 1686609 - RNA, 18 nt, Salmonella enterica enterica serovar Typhi
auuccucgaucgccuggc

SEQ ID NO: 1686610 - RNA, 16 nt, Salmonella enterica enterica serovar Typhi
auuccucagaauccgu

SEQ ID NO: 1686611 - RNA, 14 nt, Salmonella enterica enterica serovar Typhi
auuucacaaauuaa

SEQ ID NO: 1686612 - RNA, 20 nt, Salmonella enterica enterica serovar Typhi
auuuaugauuuuaacaucac

SEQ ID NO: 1686613 - RNA, 17 nt, Salmonella enterica enterica serovar Typhi
auuucaccuuuggcuuc

SEQ ID NO: 1686614 - RNA, 14 nt, Salmonella enterica enterica serovar Typhi
auuucacgcagcac

SEQ ID NO: 1686615 - RNA, 14 nt, Salmonella enterica enterica serovar Typhi
auuucacuucauca

SEQ ID NO: 1686616 - RNA, 15 nt, Salmonella enterica enterica serovar Typhi
auuucacuucaucau

SEQ ID NO: 1686617 - RNA, 18 nt, Salmonella enterica enterica serovar Typhi
auuucacguuucaucucu

SEQ ID NO: 1686618 - RNA, 23 nt, Salmonella enterica enterica serovar Typhi
auuucacgucacguucauccugg

SEQ ID NO: 1686619 - RNA, 17 nt, Salmonella enterica enterica serovar Typhi
auuucagggcuuauuca

SEQ ID NO: 1686620 - RNA, 14 nt, Salmonella enterica enterica serovar Typhi
auuucauaauaagc

SEQ ID NO: 1686621 - RNA, 17 nt, Salmonella enterica enterica serovar Typhi
auuucaguacagccaaa

SEQ ID NO: 1686622 - RNA, 21 nt, Salmonella enterica enterica serovar Typhi
auuucaguacagccaaaaaua

SEQ ID NO: 1686623 - RNA, 14 nt, Salmonella enterica enterica serovar Typhi
auuuccauuuuuca

SEQ ID NO: 1686624 - RNA, 14 nt, Salmonella enterica enterica serovar Typhi
auuuccauauuaac

SEQ ID NO: 1686625 - RNA, 21 nt, Salmonella enterica enterica serovar Typhi
auuuccgguuccagcggccgc

SEQ ID NO: 1686626 - RNA, 21 nt, Salmonella enterica enterica serovar Typhi
auuuccggaccguuaucaaaa

SEQ ID NO: 1686627 - RNA, 16 nt, Salmonella enterica enterica serovar Typhi
auuuccgccauuuuuc

SEQ ID NO: 1686628 - RNA, 14 nt, Salmonella enterica enterica serovar Typhi
auuucccuucaauc

SEQ ID NO: 1686629 - RNA, 15 nt, Salmonella enterica enterica serovar Typhi
auuucccccacuucu

SEQ ID NO: 1686630 - RNA, 19 nt, Salmonella enterica enterica serovar Typhi
auuucgacgauaaaaaaag

SEQ ID NO: 1686631 - RNA, 21 nt, Salmonella enterica enterica serovar Typhi
auuucgacgauaaaaaaagua

SEQ ID NO: 1686632 - RNA, 20 nt, Salmonella enterica enterica serovar Typhi
auuucgacgucaacgguaaa

SEQ ID NO: 1686633 - RNA, 22 nt, Salmonella enterica enterica serovar Typhi
auuucgacgucaacgguaaaau

SEQ ID NO: 1686634 - RNA, 20 nt, Salmonella enterica enterica serovar Typhi
auuucgaaacaggaaaaaca

SEQ ID NO: 1686635 - RNA, 20 nt, Salmonella enterica enterica serovar Typhi
auuucgcuggcggccccucu

SEQ ID NO: 1686636 - RNA, 22 nt, Salmonella enterica enterica serovar Typhi
auuucgcuggcggccccucuuc

SEQ ID NO: 1686637 - RNA, 19 nt, Salmonella enterica enterica serovar Typhi
auuucgccuauuuucucuu

SEQ ID NO: 1686638 - RNA, 18 nt, Salmonella enterica enterica serovar Typhi
auuucgcaacgccgccga

SEQ ID NO: 1686639 - RNA, 22 nt, Salmonella enterica enterica serovar Typhi
auuuacaaaugaccucaagaau

SEQ ID NO: 1686640 - RNA, 17 nt, Salmonella enterica enterica serovar Typhi
auuuaccagugcuaaaa

SEQ ID NO: 1686641 - RNA, 11 nt, Salmonella enterica enterica serovar Typhi
auuuacugccg

SEQ ID NO: 1686642 - RNA, 16 nt, Salmonella enterica enterica serovar Typhi
auuuacuccaaaaaua

SEQ ID NO: 1686643 - RNA, 14 nt, Salmonella enterica enterica serovar Typhi
auuuaggauuuguc

SEQ ID NO: 1686644 - RNA, 14 nt, Salmonella enterica enterica serovar Typhi
auuuaucaauaacc

SEQ ID NO: 1686645 - RNA, 16 nt, Salmonella enterica enterica serovar Typhi
auuuaucaauuuuuaa

SEQ ID NO: 1686646 - RNA, 14 nt, Salmonella enterica enterica serovar Typhi
auuuauauuagggc

SEQ ID NO: 1686647 - RNA, 15 nt, Salmonella enterica enterica serovar Typhi
auuuaggucuuguca

SEQ ID NO: 1686648 - RNA, 15 nt, Salmonella enterica enterica serovar Typhi
auugguagacgcacc

SEQ ID NO: 1686649 - RNA, 23 nt, Salmonella enterica enterica serovar Typhi
auuggcgucgacgugucuaugcu

SEQ ID NO: 1686650 - RNA, 14 nt, Salmonella enterica enterica serovar Typhi
auuggucugauuca

SEQ ID NO: 1686651 - RNA, 17 nt, Salmonella enterica enterica serovar Typhi
auuggucauucggcggu

SEQ ID NO: 1686652 - RNA, 13 nt, Salmonella enterica enterica serovar Typhi
auuuaaaauucca

SEQ ID NO: 1686653 - RNA, 19 nt, Salmonella enterica enterica serovar Typhi
auuucucuuuuauuauuuu

SEQ ID NO: 1686654 - RNA, 20 nt, Salmonella enterica enterica serovar Typhi
auuucgucgauguuacgacc

SEQ ID NO: 1686655 - RNA, 19 nt, Salmonella enterica enterica serovar Typhi
auuucggcgcuguuuuccg

SEQ ID NO: 1686656 - RNA, 15 nt, Salmonella enterica enterica serovar Typhi
auuucguagccgcgc

SEQ ID NO: 1686657 - RNA, 23 nt, Salmonella enterica enterica serovar Typhi
auuucguagccgcgcgccgccuc

SEQ ID NO: 1686658 - RNA, 17 nt, Salmonella enterica enterica serovar Typhi
auuucugccugcuucag

SEQ ID NO: 1686659 - RNA, 18 nt, Salmonella enterica enterica serovar Typhi
auuucugaccacauuuuc

SEQ ID NO: 1686660 - RNA, 14 nt, Salmonella enterica enterica serovar Typhi
auuucuggccccug

SEQ ID NO: 1686661 - RNA, 17 nt, Salmonella enterica enterica serovar Typhi
auuucugcugccagcgc

SEQ ID NO: 1686662 - RNA, 23 nt, Salmonella enterica enterica serovar Typhi
auuucugcugccagcgccgccgc

SEQ ID NO: 1686663 - RNA, 17 nt, Salmonella enterica enterica serovar Typhi
auuucuuaauuccucag

SEQ ID NO: 1686664 - RNA, 14 nt, Salmonella enterica enterica serovar Typhi
auuucuuagcgcca

SEQ ID NO: 1686665 - RNA, 23 nt, Salmonella enterica enterica serovar Typhi
auuucuuagcacccaccaucacu

SEQ ID NO: 1686666 - RNA, 15 nt, Salmonella enterica enterica serovar Typhi
auuugcaucaaacuu

SEQ ID NO: 1686667 - RNA, 14 nt, Salmonella enterica enterica serovar Typhi
auuugcuguuuuau

SEQ ID NO: 1686668 - RNA, 14 nt, Salmonella enterica enterica serovar Typhi
auuugacguuaucc

SEQ ID NO: 1686669 - RNA, 17 nt, Salmonella enterica enterica serovar Typhi
auuuguagcugcgccug

SEQ ID NO: 1686670 - RNA, 19 nt, Salmonella enterica enterica serovar Typhi
auuuguacaaaaaauguga

SEQ ID NO: 1686671 - RNA, 15 nt, Salmonella enterica enterica serovar Typhi
auuuguugguuuaaa

SEQ ID NO: 1686672 - RNA, 13 nt, Salmonella enterica enterica serovar Typhi
auuuugcuuggcc

SEQ ID NO: 1686673 - RNA, 19 nt, Salmonella enterica enterica serovar Typhi
auuuuggacggcgucacca

SEQ ID NO: 1686674 - RNA, 15 nt, Salmonella enterica enterica serovar Typhi
auuuuuacaaauuua

SEQ ID NO: 1686675 - RNA, 15 nt, Salmonella enterica enterica serovar Typhi
auuuuuaguaacuua

SEQ ID NO: 1686676 - RNA, 20 nt, Salmonella enterica enterica serovar Typhi
auuuuuaagguauugauuuu

SEQ ID NO: 1686677 - RNA, 13 nt, Salmonella enterica enterica serovar Typhi
auuuugccuucaa

SEQ ID NO: 1686678 - RNA, 12 nt, Salmonella enterica enterica serovar Typhi
auuuugcgccua

SEQ ID NO: 1686679 - RNA, 22 nt, Salmonella enterica enterica serovar Typhi
auuuugcucauauuguguuuuu

SEQ ID NO: 1686680 - RNA, 16 nt, Salmonella enterica enterica serovar Typhi
auuuugcacuguuuuu

SEQ ID NO: 1686681 - RNA, 14 nt, Salmonella enterica enterica serovar Typhi
auuuugaauuuuua

SEQ ID NO: 1686682 - RNA, 19 nt, Salmonella enterica enterica serovar Typhi
auuuucuccggaagcauaa

SEQ ID NO: 1686683 - RNA, 18 nt, Salmonella enterica enterica serovar Typhi
auuuucuuucaucaaacg

SEQ ID NO: 1686684 - RNA, 21 nt, Salmonella enterica enterica serovar Typhi
auuuucgucguuucuacaaua

SEQ ID NO: 1686685 - RNA, 14 nt, Salmonella enterica enterica serovar Typhi
auuuucaaaaacaa

SEQ ID NO: 1686686 - RNA, 20 nt, Salmonella enterica enterica serovar Typhi
auuuuauuuuucaaugccau

SEQ ID NO: 1686687 - RNA, 14 nt, Salmonella enterica enterica serovar Typhi
auuuuacgagaacc

SEQ ID NO: 1686688 - RNA, 23 nt, Salmonella enterica enterica serovar Typhi
auuuuaccuucgcguuuaucacc

SEQ ID NO: 1686689 - RNA, 16 nt, Salmonella enterica enterica serovar Typhi
caacgggcaaugccac

SEQ ID NO: 1686690 - RNA, 17 nt, Salmonella enterica enterica serovar Typhi
caacgggacggcggcca

SEQ ID NO: 1686691 - RNA, 16 nt, Salmonella enterica enterica serovar Typhi
caacgccuucugcuug

SEQ ID NO: 1686692 - RNA, 14 nt, Salmonella enterica enterica serovar Typhi
caacgccuccaggc

SEQ ID NO: 1686693 - RNA, 13 nt, Salmonella enterica enterica serovar Typhi
caacgccuccugc

SEQ ID NO: 1686694 - RNA, 14 nt, Salmonella enterica enterica serovar Typhi
caacgcgcaucaac

SEQ ID NO: 1686695 - RNA, 14 nt, Salmonella enterica enterica serovar Typhi
caacgccgccuggc

SEQ ID NO: 1686696 - RNA, 13 nt, Salmonella enterica enterica serovar Typhi
caacgccggcaac

SEQ ID NO: 1686697 - RNA, 19 nt, Salmonella enterica enterica serovar Typhi
caacgccggcaacacccgc

SEQ ID NO: 1686698 - RNA, 15 nt, Salmonella enterica enterica serovar Typhi
caacgcauaaaaacg

SEQ ID NO: 1686699 - RNA, 16 nt, Salmonella enterica enterica serovar Typhi
caacgcaggcuggaga

SEQ ID NO: 1686700 - RNA, 17 nt, Salmonella enterica enterica serovar Typhi
caacgcaggcuggagag

SEQ ID NO: 1686701 - RNA, 14 nt, Salmonella enterica enterica serovar Typhi
caacgcaucaaaua

SEQ ID NO: 1686702 - RNA, 18 nt, Salmonella enterica enterica serovar Typhi
caacguuucuuucaucag

SEQ ID NO: 1686703 - RNA, 18 nt, Salmonella enterica enterica serovar Typhi
caacuauuaauucuuuua

SEQ ID NO: 1686704 - RNA, 17 nt, Salmonella enterica enterica serovar Typhi
caacguuuguaacagca

SEQ ID NO: 1686705 - RNA, 21 nt, Salmonella enterica enterica serovar Typhi
caacguuuguaacagcaggac

SEQ ID NO: 1686706 - RNA, 14 nt, Salmonella enterica enterica serovar Typhi
caacuccacaaaua

SEQ ID NO: 1686707 - RNA, 22 nt, Salmonella enterica enterica serovar Typhi
caacucgccgguuuuuuuacuc

SEQ ID NO: 1686708 - RNA, 21 nt, Salmonella enterica enterica serovar Typhi
caacucgaauuauuuaggguu

SEQ ID NO: 1686709 - RNA, 20 nt, Salmonella enterica enterica serovar Typhi
caaccugccgaugaaagagc

SEQ ID NO: 1686710 - RNA, 12 nt, Salmonella enterica enterica serovar Typhi
caaccugcgcug

SEQ ID NO: 1686711 - RNA, 17 nt, Salmonella enterica enterica serovar Typhi
caaccugcgcugacggc

SEQ ID NO: 1686712 - RNA, 23 nt, Salmonella enterica enterica serovar Typhi
caaccuguaggccggauaagcau

SEQ ID NO: 1686713 - RNA, 16 nt, Salmonella enterica enterica serovar Typhi
caacaucaguucagaa

SEQ ID NO: 1686714 - RNA, 12 nt, Salmonella enterica enterica serovar Typhi
caacaucauccc

SEQ ID NO: 1686715 - RNA, 17 nt, Salmonella enterica enterica serovar Typhi
caacaucgcaaaauucc

SEQ ID NO: 1686716 - RNA, 19 nt, Salmonella enterica enterica serovar Typhi
caacaucauuauuccccuc

SEQ ID NO: 1686717 - RNA, 16 nt, Salmonella enterica enterica serovar Typhi
caacauauuugcccug

SEQ ID NO: 1686718 - RNA, 20 nt, Salmonella enterica enterica serovar Typhi
caacauauuuuucacacaua

SEQ ID NO: 1686719 - RNA, 20 nt, Salmonella enterica enterica serovar Typhi
caacauagcuaaauaaaaau

SEQ ID NO: 1686720 - RNA, 23 nt, Salmonella enterica enterica serovar Typhi
caacauagcuaaauaaaaauaau

SEQ ID NO: 1686721 - RNA, 16 nt, Salmonella enterica enterica serovar Typhi
caacgagaauaagacc

SEQ ID NO: 1686722 - RNA, 22 nt, Salmonella enterica enterica serovar Typhi
caacgcaaugcgauaagcgucu

SEQ ID NO: 1686723 - RNA, 23 nt, Salmonella enterica enterica serovar Typhi
caacgcaaugcgauaagcgucuu

SEQ ID NO: 1686724 - RNA, 20 nt, Salmonella enterica enterica serovar Typhi
caacgaccggcgcagcgccc

SEQ ID NO: 1686725 - RNA, 23 nt, Salmonella enterica enterica serovar Typhi
caacgaccgucgugccugcggua

SEQ ID NO: 1686726 - RNA, 23 nt, Salmonella enterica enterica serovar Typhi
caacgacccgaagggcgaagcgc

SEQ ID NO: 1686727 - RNA, 14 nt, Salmonella enterica enterica serovar Typhi
caagagaaauaaca

SEQ ID NO: 1686728 - RNA, 15 nt, Salmonella enterica enterica serovar Typhi
caagagcagcaaccc

SEQ ID NO: 1686729 - RNA, 19 nt, Salmonella enterica enterica serovar Typhi
caagagcagcaacccugcc

SEQ ID NO: 1686730 - RNA, 15 nt, Salmonella enterica enterica serovar Typhi
caagagauucaggcc

SEQ ID NO: 1686731 - RNA, 19 nt, Salmonella enterica enterica serovar Typhi
caagaauuacaucaauaaa

SEQ ID NO: 1686732 - RNA, 22 nt, Salmonella enterica enterica serovar Typhi
caagacacgcuuccagaugaag

SEQ ID NO: 1686733 - RNA, 16 nt, Salmonella enterica enterica serovar Typhi
caagaauuuaucgcaa

SEQ ID NO: 1686734 - RNA, 18 nt, Salmonella enterica enterica serovar Typhi
caagaauuauuucaggaa

SEQ ID NO: 1686735 - RNA, 17 nt, Salmonella enterica enterica serovar Typhi
caagacccgaaccugcg

SEQ ID NO: 1686736 - RNA, 16 nt, Salmonella enterica enterica serovar Typhi
caagaccgggcugcac

SEQ ID NO: 1686737 - RNA, 21 nt, Salmonella enterica enterica serovar Typhi
caagaccgauagagacugccg

SEQ ID NO: 1686738 - RNA, 22 nt, Salmonella enterica enterica serovar Typhi
caagaccgauagagacugccgc

SEQ ID NO: 1686739 - RNA, 17 nt, Salmonella enterica enterica serovar Typhi
caagagcguccaguccu

SEQ ID NO: 1686740 - RNA, 14 nt, Salmonella enterica enterica serovar Typhi
caagauccguccau

SEQ ID NO: 1686741 - RNA, 13 nt, Salmonella enterica enterica serovar Typhi
caagaugcugaau

SEQ ID NO: 1686742 - RNA, 17 nt, Salmonella enterica enterica serovar Typhi
caagauccaacacggcg

SEQ ID NO: 1686743 - RNA, 18 nt, Salmonella enterica enterica serovar Typhi
caagaucgcgcagcaggc

SEQ ID NO: 1686744 - RNA, 20 nt, Salmonella enterica enterica serovar Typhi
caagaucgguugaaccaucu

SEQ ID NO: 1686745 - RNA, 16 nt, Salmonella enterica enterica serovar Typhi
caacuuuuucuuaagc

SEQ ID NO: 1686746 - RNA, 18 nt, Salmonella enterica enterica serovar Typhi
caagaacagagcaauuac

SEQ ID NO: 1686747 - RNA, 17 nt, Salmonella enterica enterica serovar Typhi
caagaaccgcuuuuccu

SEQ ID NO: 1686748 - RNA, 18 nt, Salmonella enterica enterica serovar Typhi
caagaagcguugaccgua

SEQ ID NO: 1686749 - RNA, 19 nt, Salmonella enterica enterica serovar Typhi
caagaagauuucuuaauuc

SEQ ID NO: 1686750 - RNA, 16 nt, Salmonella enterica enterica serovar Typhi
caagaauaugagauug

SEQ ID NO: 1686751 - RNA, 12 nt, Salmonella enterica enterica serovar Typhi
caagaaucaaua

SEQ ID NO: 1686752 - RNA, 20 nt, Salmonella enterica enterica serovar Typhi
caagaaugaccagccgaagu

SEQ ID NO: 1686753 - RNA, 21 nt, Salmonella enterica enterica serovar Typhi
caagaaugaccagccgaaguu

SEQ ID NO: 1686754 - RNA, 22 nt, Salmonella enterica enterica serovar Typhi
caaucacugaugccacacccug

SEQ ID NO: 1686755 - RNA, 19 nt, Salmonella enterica enterica serovar Typhi
caaucacguuauagccgcc

SEQ ID NO: 1686756 - RNA, 16 nt, Salmonella enterica enterica serovar Typhi
caaucacgcccagcgc

SEQ ID NO: 1686757 - RNA, 15 nt, Salmonella enterica enterica serovar Typhi
caaucaccaucccau

SEQ ID NO: 1686758 - RNA, 14 nt, Salmonella enterica enterica serovar Typhi
caaucacaaaaugg

SEQ ID NO: 1686759 - RNA, 15 nt, Salmonella enterica enterica serovar Typhi
caaucacaaaauggc

SEQ ID NO: 1686760 - RNA, 13 nt, Salmonella enterica enterica serovar Typhi
caauauuaaauga

SEQ ID NO: 1686761 - RNA, 14 nt, Salmonella enterica enterica serovar Typhi
caauauuaaaugac

SEQ ID NO: 1686762 - RNA, 16 nt, Salmonella enterica enterica serovar Typhi
caaucaacuccauaau

SEQ ID NO: 1686763 - RNA, 22 nt, Salmonella enterica enterica serovar Typhi
caauaugguuauccagcaggua

SEQ ID NO: 1686764 - RNA, 22 nt, Salmonella enterica enterica serovar Typhi
caauaugguauucgugcaucag

SEQ ID NO: 1686765 - RNA, 17 nt, Salmonella enterica enterica serovar Typhi
caauaugugcaucggca

SEQ ID NO: 1686766 - RNA, 18 nt, Salmonella enterica enterica serovar Typhi
caauaugucuuaaacagc

SEQ ID NO: 1686767 - RNA, 23 nt, Salmonella enterica enterica serovar Typhi
caauauguuuaaagaagaaagac

SEQ ID NO: 1686768 - RNA, 15 nt, Salmonella enterica enterica serovar Typhi
caauaugcuguuuau

SEQ ID NO: 1686769 - RNA, 16 nt, Salmonella enterica enterica serovar Typhi
caauaugcuguuuaug

SEQ ID NO: 1686770 - RNA, 21 nt, Salmonella enterica enterica serovar Typhi
caauaugcuguuuauggcgcu

SEQ ID NO: 1686771 - RNA, 17 nt, Salmonella enterica enterica serovar Typhi
caauagagcaguuaaua

SEQ ID NO: 1686772 - RNA, 21 nt, Salmonella enterica enterica serovar Typhi
caauagagcaguuaauaauga

SEQ ID NO: 1686773 - RNA, 23 nt, Salmonella enterica enterica serovar Typhi
caauaccuguaaacgcuucugcg

SEQ ID NO: 1686774 - RNA, 21 nt, Salmonella enterica enterica serovar Typhi
caauagagugcgauuugacau

SEQ ID NO: 1686775 - RNA, 16 nt, Salmonella enterica enterica serovar Typhi
caauagacuucacuuu

SEQ ID NO: 1686776 - RNA, 14 nt, Salmonella enterica enterica serovar Typhi
caauauaugagcaa

SEQ ID NO: 1686777 - RNA, 21 nt, Salmonella enterica enterica serovar Typhi
caauauaguugagccauucca

SEQ ID NO: 1686778 - RNA, 14 nt, Salmonella enterica enterica serovar Typhi
caauaccaauuacc

SEQ ID NO: 1686779 - RNA, 14 nt, Salmonella enterica enterica serovar Typhi
caauaccacgcccg

SEQ ID NO: 1686780 - RNA, 15 nt, Salmonella enterica enterica serovar Typhi
caauaccaauuaccg

SEQ ID NO: 1686781 - RNA, 18 nt, Salmonella enterica enterica serovar Typhi
caauaaucgcgagaaaau

SEQ ID NO: 1686782 - RNA, 16 nt, Salmonella enterica enterica serovar Typhi
caauaaucgaaauaaa

SEQ ID NO: 1686783 - RNA, 23 nt, Salmonella enterica enterica serovar Typhi
caauacaggcgaccgggcagaca

SEQ ID NO: 1686784 - RNA, 16 nt, Salmonella enterica enterica serovar Typhi
caaguugcgccacugc

SEQ ID NO: 1686785 - RNA, 14 nt, Salmonella enterica enterica serovar Typhi
caauaaccgccagc

SEQ ID NO: 1686786 - RNA, 23 nt, Salmonella enterica enterica serovar Typhi
caauaacgccggauauguuugac

SEQ ID NO: 1686787 - RNA, 20 nt, Salmonella enterica enterica serovar Typhi
caauaacgaccccaauagcg

SEQ ID NO: 1686788 - RNA, 13 nt, Salmonella enterica enterica serovar Typhi
caauaagaacuuu

SEQ ID NO: 1686789 - RNA, 18 nt, Salmonella enterica enterica serovar Typhi
caauaaucccuucuuuua

SEQ ID NO: 1686790 - RNA, 17 nt, Salmonella enterica enterica serovar Typhi
caauaagcgguaauaau

SEQ ID NO: 1686791 - RNA, 13 nt, Salmonella enterica enterica serovar Typhi
caauaagccagac

SEQ ID NO: 1686792 - RNA, 14 nt, Salmonella enterica enterica serovar Typhi
caaggcguucacac

SEQ ID NO: 1686793 - RNA, 19 nt, Salmonella enterica enterica serovar Typhi
caaggcuauuagccaaagc

SEQ ID NO: 1686794 - RNA, 17 nt, Salmonella enterica enterica serovar Typhi
caaguaauaaaauaaua

SEQ ID NO: 1686795 - RNA, 14 nt, Salmonella enterica enterica serovar Typhi
caaguaauaaagag

SEQ ID NO: 1686796 - RNA, 13 nt, Salmonella enterica enterica serovar Typhi
caaguaauaaaau

SEQ ID NO: 1686797 - RNA, 16 nt, Salmonella enterica enterica serovar Typhi
caaguaauaaaauaau

SEQ ID NO: 1686798 - RNA, 15 nt, Salmonella enterica enterica serovar Typhi
caagcgccaguaaug

SEQ ID NO: 1686799 - RNA, 17 nt, Salmonella enterica enterica serovar Typhi
caagcaaugccagaaau

SEQ ID NO: 1686800 - RNA, 17 nt, Salmonella enterica enterica serovar Typhi
caagcgcggacagcaga

SEQ ID NO: 1686801 - RNA, 16 nt, Salmonella enterica enterica serovar Typhi
caagcgcuaagcaaca

SEQ ID NO: 1686802 - RNA, 18 nt, Salmonella enterica enterica serovar Typhi
caagcgcggacagcagaa

SEQ ID NO: 1686803 - RNA, 20 nt, Salmonella enterica enterica serovar Typhi
caagcucaucgggcaacuga

SEQ ID NO: 1686804 - RNA, 19 nt, Salmonella enterica enterica serovar Typhi
caagcaacuguagaaugcu

SEQ ID NO: 1686805 - RNA, 16 nt, Salmonella enterica enterica serovar Typhi
caagauuucaaaaccc

SEQ ID NO: 1686806 - RNA, 17 nt, Salmonella enterica enterica serovar Typhi
caagauuucaaaacccg

SEQ ID NO: 1686807 - RNA, 21 nt, Salmonella enterica enterica serovar Typhi
caagauuaagaccguauaaua

SEQ ID NO: 1686808 - RNA, 14 nt, Salmonella enterica enterica serovar Typhi
caagcuggaauacc

SEQ ID NO: 1686809 - RNA, 15 nt, Salmonella enterica enterica serovar Typhi
caagcugguaaaugc

SEQ ID NO: 1686810 - RNA, 14 nt, Salmonella enterica enterica serovar Typhi
caagcugcuuuuug

SEQ ID NO: 1686811 - RNA, 20 nt, Salmonella enterica enterica serovar Typhi
caagcugguaaaugcgccua

SEQ ID NO: 1686812 - RNA, 22 nt, Salmonella enterica enterica serovar Typhi
caagcuguagcguuuccacgac

SEQ ID NO: 1686813 - RNA, 18 nt, Salmonella enterica enterica serovar Typhi
caagcugacggauacgcu

SEQ ID NO: 1686814 - RNA, 15 nt, Salmonella enterica enterica serovar Typhi
caaggcauucaggcc

SEQ ID NO: 1686815 - RNA, 16 nt, Salmonella enterica enterica serovar Typhi
caacagcgugagcugu

SEQ ID NO: 1686816 - RNA, 21 nt, Salmonella enterica enterica serovar Typhi
caacagguaccccgccaccgc

SEQ ID NO: 1686817 - RNA, 17 nt, Salmonella enterica enterica serovar Typhi
caacagguuaaucagca

SEQ ID NO: 1686818 - RNA, 20 nt, Salmonella enterica enterica serovar Typhi
caacagcggcggcaguugcc

SEQ ID NO: 1686819 - RNA, 14 nt, Salmonella enterica enterica serovar Typhi
caacagccgccugu

SEQ ID NO: 1686820 - RNA, 12 nt, Salmonella enterica enterica serovar Typhi
caacagcaaugu

SEQ ID NO: 1686821 - RNA, 12 nt, Salmonella enterica enterica serovar Typhi
caacagcaccag

SEQ ID NO: 1686822 - RNA, 16 nt, Salmonella enterica enterica serovar Typhi
caacauaaauaaacag

SEQ ID NO: 1686823 - RNA, 20 nt, Salmonella enterica enterica serovar Typhi
caacaguaccugauaaaauu

SEQ ID NO: 1686824 - RNA, 14 nt, Salmonella enterica enterica serovar Typhi
caacaacaguugca

SEQ ID NO: 1686825 - RNA, 19 nt, Salmonella enterica enterica serovar Typhi
caacaaccucuuuuuccgc

SEQ ID NO: 1686826 - RNA, 18 nt, Salmonella enterica enterica serovar Typhi
caacaacaggccgccgag

SEQ ID NO: 1686827 - RNA, 23 nt, Salmonella enterica enterica serovar Typhi
caacaacuucaaaauagguguug

SEQ ID NO: 1686828 - RNA, 21 nt, Salmonella enterica enterica serovar Typhi
caacaaguccuucuucccccu

SEQ ID NO: 1686829 - RNA, 16 nt, Salmonella enterica enterica serovar Typhi
caacaccguaaaagga

SEQ ID NO: 1686830 - RNA, 16 nt, Salmonella enterica enterica serovar Typhi
caacacgacaaaagca

SEQ ID NO: 1686831 - RNA, 20 nt, Salmonella enterica enterica serovar Typhi
caacaaguccuucuuccccc

SEQ ID NO: 1686832 - RNA, 14 nt, Salmonella enterica enterica serovar Typhi
caaaugaagucugg

SEQ ID NO: 1686833 - RNA, 15 nt, Salmonella enterica enterica serovar Typhi
caaaucgacagccag

SEQ ID NO: 1686834 - RNA, 20 nt, Salmonella enterica enterica serovar Typhi
caaaucugccgggagcagau

SEQ ID NO: 1686835 - RNA, 17 nt, Salmonella enterica enterica serovar Typhi
caaauccuccauaaaua

SEQ ID NO: 1686836 - RNA, 18 nt, Salmonella enterica enterica serovar Typhi
caacaaagccugcuggaa

SEQ ID NO: 1686837 - RNA, 14 nt, Salmonella enterica enterica serovar Typhi
caacaaacauaagc

SEQ ID NO: 1686838 - RNA, 21 nt, Salmonella enterica enterica serovar Typhi
caaauucagcgucgagcaccu

SEQ ID NO: 1686839 - RNA, 22 nt, Salmonella enterica enterica serovar Typhi
caaauuccggcacaaccuggcu

SEQ ID NO: 1686840 - RNA, 16 nt, Salmonella enterica enterica serovar Typhi
caaauuccagcaauga

SEQ ID NO: 1686841 - RNA, 17 nt, Salmonella enterica enterica serovar Typhi
caaauucagaccccugu

SEQ ID NO: 1686842 - RNA, 16 nt, Salmonella enterica enterica serovar Typhi
caaaggcguaaaaagg

SEQ ID NO: 1686843 - RNA, 10 nt, Salmonella enterica enterica serovar Typhi
caaagggagc

SEQ ID NO: 1686844 - RNA, 23 nt, Salmonella enterica enterica serovar Typhi
caaagggcccguggaaaaacuca

SEQ ID NO: 1686845 - RNA, 15 nt, Salmonella enterica enterica serovar Typhi
caaagggcaccuggg

SEQ ID NO: 1686846 - RNA, 18 nt, Salmonella enterica enterica serovar Typhi
caaauaaggacuuuaucu

SEQ ID NO: 1686847 - RNA, 17 nt, Salmonella enterica enterica serovar Typhi
caaauaaagccagauac

SEQ ID NO: 1686848 - RNA, 22 nt, Salmonella enterica enterica serovar Typhi
caaauaaagcggucuuucaaca

SEQ ID NO: 1686849 - RNA, 17 nt, Salmonella enterica enterica serovar Typhi
caaauaaauccaugaga

SEQ ID NO: 1686850 - RNA, 21 nt, Salmonella enterica enterica serovar Typhi
caaauaaauccaugagaagaa

SEQ ID NO: 1686851 - RNA, 18 nt, Salmonella enterica enterica serovar Typhi
caaauaccggacagacuu

SEQ ID NO: 1686852 - RNA, 14 nt, Salmonella enterica enterica serovar Typhi
caaauagagaaaau

SEQ ID NO: 1686853 - RNA, 16 nt, Salmonella enterica enterica serovar Typhi
caaauacuggaaaaaa

SEQ ID NO: 1686854 - RNA, 17 nt, Salmonella enterica enterica serovar Typhi
caaauaugauaugugua

SEQ ID NO: 1686855 - RNA, 22 nt, Salmonella enterica enterica serovar Typhi
caaauauccuaccacgccgcua

SEQ ID NO: 1686856 - RNA, 20 nt, Salmonella enterica enterica serovar Typhi
caaauagagaaaauaacaau

SEQ ID NO: 1686857 - RNA, 15 nt, Salmonella enterica enterica serovar Typhi
caaauagagaaaaua

SEQ ID NO: 1686858 - RNA, 19 nt, Salmonella enterica enterica serovar Typhi
caaauagagaaaauaacaa

SEQ ID NO: 1686859 - RNA, 21 nt, Salmonella enterica enterica serovar Typhi
caaauccacuggucgucugaa

SEQ ID NO: 1686860 - RNA, 14 nt, Salmonella enterica enterica serovar Typhi
caaaucaacauuau

SEQ ID NO: 1686861 - RNA, 16 nt, Salmonella enterica enterica serovar Typhi
caaacuggccacagca

SEQ ID NO: 1686862 - RNA, 16 nt, Salmonella enterica enterica serovar Typhi
caaacugcgcgccgcc

SEQ ID NO: 1686863 - RNA, 14 nt, Salmonella enterica enterica serovar Typhi
caaacugcgcgccc

SEQ ID NO: 1686864 - RNA, 19 nt, Salmonella enterica enterica serovar Typhi
caaacugcgcgcccgccuc

SEQ ID NO: 1686865 - RNA, 13 nt, Salmonella enterica enterica serovar Typhi
caaacuuccacac

SEQ ID NO: 1686866 - RNA, 15 nt, Salmonella enterica enterica serovar Typhi
caaagauuagcccca

SEQ ID NO: 1686867 - RNA, 19 nt, Salmonella enterica enterica serovar Typhi
caaagauuagccccagcgc

SEQ ID NO: 1686868 - RNA, 19 nt, Salmonella enterica enterica serovar Typhi
caaagcgagguaaaaagcg

SEQ ID NO: 1686869 - RNA, 17 nt, Salmonella enterica enterica serovar Typhi
caaagauaaucugaaua

SEQ ID NO: 1686870 - RNA, 15 nt, Salmonella enterica enterica serovar Typhi
caaagcucaacgcag

SEQ ID NO: 1686871 - RNA, 22 nt, Salmonella enterica enterica serovar Typhi
caaagcguucugaacuguaacc

SEQ ID NO: 1686872 - RNA, 16 nt, Salmonella enterica enterica serovar Typhi
caaagcgguaaaucgc

SEQ ID NO: 1686873 - RNA, 12 nt, Salmonella enterica enterica serovar Typhi
caaacaccacca

SEQ ID NO: 1686874 - RNA, 21 nt, Salmonella enterica enterica serovar Typhi
caaacacagccaucuucugcg

SEQ ID NO: 1686875 - RNA, 14 nt, Salmonella enterica enterica serovar Typhi
caaacaccaccagu

SEQ ID NO: 1686876 - RNA, 14 nt, Salmonella enterica enterica serovar Typhi
caaacaccagauca

SEQ ID NO: 1686877 - RNA, 18 nt, Salmonella enterica enterica serovar Typhi
caaacaccucagccaccc

SEQ ID NO: 1686878 - RNA, 19 nt, Salmonella enterica enterica serovar Typhi
caaacagcagaacaaccag

SEQ ID NO: 1686879 - RNA, 15 nt, Salmonella enterica enterica serovar Typhi
caaacaccugaacca

SEQ ID NO: 1686880 - RNA, 18 nt, Salmonella enterica enterica serovar Typhi
caaacagcgacucgcugg

SEQ ID NO: 1686881 - RNA, 21 nt, Salmonella enterica enterica serovar Typhi
caaacaggcggcuguugguuu

SEQ ID NO: 1686882 - RNA, 16 nt, Salmonella enterica enterica serovar Typhi
caaacauagccucaag

SEQ ID NO: 1686883 - RNA, 16 nt, Salmonella enterica enterica serovar Typhi
caaacagugggaagca

SEQ ID NO: 1686884 - RNA, 16 nt, Salmonella enterica enterica serovar Typhi
caaacagugaaaaaac

SEQ ID NO: 1686885 - RNA, 22 nt, Salmonella enterica enterica serovar Typhi
caaacaguucauuucaggcaaa

SEQ ID NO: 1686886 - RNA, 13 nt, Salmonella enterica enterica serovar Typhi
caaacaguuccug

SEQ ID NO: 1686887 - RNA, 14 nt, Salmonella enterica enterica serovar Typhi
caaaccacugcugu

SEQ ID NO: 1686888 - RNA, 12 nt, Salmonella enterica enterica serovar Typhi
caaaccauguac

SEQ ID NO: 1686889 - RNA, 15 nt, Salmonella enterica enterica serovar Typhi
caaaccccggacaca

SEQ ID NO: 1686890 - RNA, 21 nt, Salmonella enterica enterica serovar Typhi
caaaccccagauuacugcccu

SEQ ID NO: 1686891 - RNA, 22 nt, Salmonella enterica enterica serovar Typhi
caaaccaacaucgcugaauuuc

SEQ ID NO: 1686892 - RNA, 12 nt, Salmonella enterica enterica serovar Typhi
caaaccaccacc

SEQ ID NO: 1686893 - RNA, 12 nt, Salmonella enterica enterica serovar Typhi
caaaccacugcu

SEQ ID NO: 1686894 - RNA, 21 nt, Salmonella enterica enterica serovar Typhi
caaaccacagugaugacggca

SEQ ID NO: 1686895 - RNA, 14 nt, Salmonella enterica enterica serovar Typhi
caaacaugcggcuu

SEQ ID NO: 1686896 - RNA, 16 nt, Salmonella enterica enterica serovar Typhi
caaacauuagcggugc

SEQ ID NO: 1686897 - RNA, 19 nt, Salmonella enterica enterica serovar Typhi
caaacgaaccguggccucc

SEQ ID NO: 1686898 - RNA, 21 nt, Salmonella enterica enterica serovar Typhi
caaaccugagcauauaaauaa

SEQ ID NO: 1686899 - RNA, 15 nt, Salmonella enterica enterica serovar Typhi
caaacgauaaaagcu

SEQ ID NO: 1686900 - RNA, 16 nt, Salmonella enterica enterica serovar Typhi
caaacgauaaaagcuc

SEQ ID NO: 1686901 - RNA, 23 nt, Salmonella enterica enterica serovar Typhi
caaaccgauagcuaucacacaua

SEQ ID NO: 1686902 - RNA, 21 nt, Salmonella enterica enterica serovar Typhi
caaaccgguaaucccuucacg

SEQ ID NO: 1686903 - RNA, 20 nt, Salmonella enterica enterica serovar Typhi
caaacgccauagcaucgacc

SEQ ID NO: 1686904 - RNA, 12 nt, Salmonella enterica enterica serovar Typhi
caaacgccaccg

SEQ ID NO: 1686905 - RNA, 11 nt, Salmonella enterica enterica serovar Typhi
caaacgccagc

SEQ ID NO: 1686906 - RNA, 14 nt, Salmonella enterica enterica serovar Typhi
caaacgcgccgcua

SEQ ID NO: 1686907 - RNA, 20 nt, Salmonella enterica enterica serovar Typhi
caaacgcgauacacuccggc

SEQ ID NO: 1686908 - RNA, 15 nt, Salmonella enterica enterica serovar Typhi
caaacgccugcuccg

SEQ ID NO: 1686909 - RNA, 13 nt, Salmonella enterica enterica serovar Typhi
caaacgcuuuuuu

SEQ ID NO: 1686910 - RNA, 23 nt, Salmonella enterica enterica serovar Typhi
caaacggcacuacagcccuuuca

SEQ ID NO: 1686911 - RNA, 16 nt, Salmonella enterica enterica serovar Typhi
caaacggaucuuccac

SEQ ID NO: 1686912 - RNA, 22 nt, Salmonella enterica enterica serovar Typhi
caaacucgcugccgaccuggcu

SEQ ID NO: 1686913 - RNA, 22 nt, Salmonella enterica enterica serovar Typhi
caaacuccgcgcuggcaauaaa

SEQ ID NO: 1686914 - RNA, 21 nt, Salmonella enterica enterica serovar Typhi
caaacggccugcgcuggaacu

SEQ ID NO: 1686915 - RNA, 15 nt, Salmonella enterica enterica serovar Typhi
caaacggcgccagcu

SEQ ID NO: 1686916 - RNA, 16 nt, Salmonella enterica enterica serovar Typhi
caaacuauuuuuagcc

SEQ ID NO: 1686917 - RNA, 23 nt, Salmonella enterica enterica serovar Typhi
caaacuaauggcgcagcgguugc

SEQ ID NO: 1686918 - RNA, 18 nt, Salmonella enterica enterica serovar Typhi
caaaauaaauauccuccg

SEQ ID NO: 1686919 - RNA, 23 nt, Salmonella enterica enterica serovar Typhi
caaaaggucgauuaaacgccugg

SEQ ID NO: 1686920 - RNA, 13 nt, Salmonella enterica enterica serovar Typhi
auuuuucacaugc

SEQ ID NO: 1686921 - RNA, 14 nt, Salmonella enterica enterica serovar Typhi
caaaaucacgcaca

SEQ ID NO: 1686922 - RNA, 20 nt, Salmonella enterica enterica serovar Typhi
caaaaucacgcacacgucug

SEQ ID NO: 1686923 - RNA, 15 nt, Salmonella enterica enterica serovar Typhi
caaaauauauaauuu

SEQ ID NO: 1686924 - RNA, 16 nt, Salmonella enterica enterica serovar Typhi
caaaauaauacguuua

SEQ ID NO: 1686925 - RNA, 18 nt, Salmonella enterica enterica serovar Typhi
caaaauaacgcuucaccu

SEQ ID NO: 1686926 - RNA, 18 nt, Salmonella enterica enterica serovar Typhi
caaaauaacguuuaaacu

SEQ ID NO: 1686927 - RNA, 15 nt, Salmonella enterica enterica serovar Typhi
caaaauaagucauau

SEQ ID NO: 1686928 - RNA, 17 nt, Salmonella enterica enterica serovar Typhi
caaaauaagucauauca

SEQ ID NO: 1686929 - RNA, 18 nt, Salmonella enterica enterica serovar Typhi
caaaauuuuuuaucaggu

SEQ ID NO: 1686930 - RNA, 22 nt, Salmonella enterica enterica serovar Typhi
caaaauuugugguggucauccg

SEQ ID NO: 1686931 - RNA, 14 nt, Salmonella enterica enterica serovar Typhi
caaaauucacacca

SEQ ID NO: 1686932 - RNA, 12 nt, Salmonella enterica enterica serovar Typhi
caaaaugaggac

SEQ ID NO: 1686933 - RNA, 15 nt, Salmonella enterica enterica serovar Typhi
caaaaugaggacaca

SEQ ID NO: 1686934 - RNA, 18 nt, Salmonella enterica enterica serovar Typhi
caaaaucggcuucuccca

SEQ ID NO: 1686935 - RNA, 16 nt, Salmonella enterica enterica serovar Typhi
caaaaucccggcuggg

SEQ ID NO: 1686936 - RNA, 19 nt, Salmonella enterica enterica serovar Typhi
caaaaucccggcuggguuc

SEQ ID NO: 1686937 - RNA, 14 nt, Salmonella enterica enterica serovar Typhi
caaaaucaucauca

SEQ ID NO: 1686938 - RNA, 20 nt, Salmonella enterica enterica serovar Typhi
caaaauccuuguugauaaaa

SEQ ID NO: 1686939 - RNA, 14 nt, Salmonella enterica enterica serovar Typhi
cauccaucagcgcg

SEQ ID NO: 1686940 - RNA, 14 nt, Salmonella enterica enterica serovar Typhi
cauccaucaucuau

SEQ ID NO: 1686941 - RNA, 15 nt, Salmonella enterica enterica serovar Typhi
cauccaucacuccuu

SEQ ID NO: 1686942 - RNA, 21 nt, Salmonella enterica enterica serovar Typhi
cauccaggaaguaaauuauuc

SEQ ID NO: 1686943 - RNA, 16 nt, Salmonella enterica enterica serovar Typhi
cauccagucagcaauu

SEQ ID NO: 1686944 - RNA, 20 nt, Salmonella enterica enterica serovar Typhi
cauccagcuugccgucacag

SEQ ID NO: 1686945 - RNA, 14 nt, Salmonella enterica enterica serovar Typhi
cauccagcgccugc

SEQ ID NO: 1686946 - RNA, 17 nt, Salmonella enterica enterica serovar Typhi
cauccagcgaaccuucc

SEQ ID NO: 1686947 - RNA, 14 nt, Salmonella enterica enterica serovar Typhi
cauccagaucggca

SEQ ID NO: 1686948 - RNA, 14 nt, Salmonella enterica enterica serovar Typhi
cauccacagcgcca

SEQ ID NO: 1686949 - RNA, 18 nt, Salmonella enterica enterica serovar Typhi
cauccagcagcagcaccg

SEQ ID NO: 1686950 - RNA, 19 nt, Salmonella enterica enterica serovar Typhi
caucauucaacgcaucaaa

SEQ ID NO: 1686951 - RNA, 14 nt, Salmonella enterica enterica serovar Typhi
caucauuauucccc

SEQ ID NO: 1686952 - RNA, 19 nt, Salmonella enterica enterica serovar Typhi
caucauuaaagcgcucaag

SEQ ID NO: 1686953 - RNA, 18 nt, Salmonella enterica enterica serovar Typhi
caucauuaauauaauccu

SEQ ID NO: 1686954 - RNA, 17 nt, Salmonella enterica enterica serovar Typhi
caucaggaucuucaucc

SEQ ID NO: 1686955 - RNA, 17 nt, Salmonella enterica enterica serovar Typhi
caucaugucacccacgc

SEQ ID NO: 1686956 - RNA, 20 nt, Salmonella enterica enterica serovar Typhi
caucauguugaaauauuuga

SEQ ID NO: 1686957 - RNA, 23 nt, Salmonella enterica enterica serovar Typhi
cauccggcgcugcgcggcgugca

SEQ ID NO: 1686958 - RNA, 21 nt, Salmonella enterica enterica serovar Typhi
cauccugcgccauugcgggag

SEQ ID NO: 1686959 - RNA, 17 nt, Salmonella enterica enterica serovar Typhi
cauccugccgcaccagu

SEQ ID NO: 1686960 - RNA, 22 nt, Salmonella enterica enterica serovar Typhi
cauccggcgauggugcggcgca

SEQ ID NO: 1686961 - RNA, 16 nt, Salmonella enterica enterica serovar Typhi
cauccggcaaacucag

SEQ ID NO: 1686962 - RNA, 19 nt, Salmonella enterica enterica serovar Typhi
cauccggcaaacucagcgg

SEQ ID NO: 1686963 - RNA, 23 nt, Salmonella enterica enterica serovar Typhi
cauccgauuucauggucaucgca

SEQ ID NO: 1686964 - RNA, 19 nt, Salmonella enterica enterica serovar Typhi
cauccgcaagacacgcuuc

SEQ ID NO: 1686965 - RNA, 22 nt, Salmonella enterica enterica serovar Typhi
cauccgaccacggccacagcca

SEQ ID NO: 1686966 - RNA, 16 nt, Salmonella enterica enterica serovar Typhi
caucccgucccaccac

SEQ ID NO: 1686967 - RNA, 16 nt, Salmonella enterica enterica serovar Typhi
caucccauccgggcca

SEQ ID NO: 1686968 - RNA, 16 nt, Salmonella enterica enterica serovar Typhi
caucccaugcaccagu

SEQ ID NO: 1686969 - RNA, 16 nt, Salmonella enterica enterica serovar Typhi
cauccaugccagcgcg

SEQ ID NO: 1686970 - RNA, 21 nt, Salmonella enterica enterica serovar Typhi
caucccgauaauggcgccgau

SEQ ID NO: 1686971 - RNA, 14 nt, Salmonella enterica enterica serovar Typhi
caucccggcaacgu

SEQ ID NO: 1686972 - RNA, 19 nt, Salmonella enterica enterica serovar Typhi
caucggcaaacgccgccug

SEQ ID NO: 1686973 - RNA, 21 nt, Salmonella enterica enterica serovar Typhi
caucgcuuuuaggcugaaagc

SEQ ID NO: 1686974 - RNA, 18 nt, Salmonella enterica enterica serovar Typhi
caucgcuucuacagccac

SEQ ID NO: 1686975 - RNA, 20 nt, Salmonella enterica enterica serovar Typhi
caucgcuucuauuaccgcag

SEQ ID NO: 1686976 - RNA, 16 nt, Salmonella enterica enterica serovar Typhi
caucgcuugcccagca

SEQ ID NO: 1686977 - RNA, 21 nt, Salmonella enterica enterica serovar Typhi
caucgcuggugugcagccagu

SEQ ID NO: 1686978 - RNA, 20 nt, Salmonella enterica enterica serovar Typhi
caucgcuggcgcgcgcgccu

SEQ ID NO: 1686979 - RNA, 13 nt, Salmonella enterica enterica serovar Typhi
caucgcucccggc

SEQ ID NO: 1686980 - RNA, 12 nt, Salmonella enterica enterica serovar Typhi
caucgcuccggc

SEQ ID NO: 1686981 - RNA, 18 nt, Salmonella enterica enterica serovar Typhi
caucgccgcggcgcuggc

SEQ ID NO: 1686982 - RNA, 20 nt, Salmonella enterica enterica serovar Typhi
caucgccggagccgccuggc

SEQ ID NO: 1686983 - RNA, 15 nt, Salmonella enterica enterica serovar Typhi
caucgccagauaaau

SEQ ID NO: 1686984 - RNA, 17 nt, Salmonella enterica enterica serovar Typhi
caucgccgauuccugcu

SEQ ID NO: 1686985 - RNA, 14 nt, Salmonella enterica enterica serovar Typhi
caucgccgccucgc

SEQ ID NO: 1686986 - RNA, 18 nt, Salmonella enterica enterica serovar Typhi
caucgccaccgcauggaa

SEQ ID NO: 1686987 - RNA, 20 nt, Salmonella enterica enterica serovar Typhi
caucgcauauugcguaucgu

SEQ ID NO: 1686988 - RNA, 17 nt, Salmonella enterica enterica serovar Typhi
caucgcagauuccgaac

SEQ ID NO: 1686989 - RNA, 16 nt, Salmonella enterica enterica serovar Typhi
caucgcaaugccacca

SEQ ID NO: 1686990 - RNA, 20 nt, Salmonella enterica enterica serovar Typhi
caucgcaaugccaccacacg

SEQ ID NO: 1686991 - RNA, 14 nt, Salmonella enterica enterica serovar Typhi
caucgcaaaauucc

SEQ ID NO: 1686992 - RNA, 17 nt, Salmonella enterica enterica serovar Typhi
caucgauuuccugauga

SEQ ID NO: 1686993 - RNA, 16 nt, Salmonella enterica enterica serovar Typhi
cauccuguaccaccac

SEQ ID NO: 1686994 - RNA, 18 nt, Salmonella enterica enterica serovar Typhi
cauccugcggguucaucg

SEQ ID NO: 1686995 - RNA, 20 nt, Salmonella enterica enterica serovar Typhi
cauccugcggguucaucgcc

SEQ ID NO: 1686996 - RNA, 21 nt, Salmonella enterica enterica serovar Typhi
cauccugcggguucaucgcca

SEQ ID NO: 1686997 - RNA, 14 nt, Salmonella enterica enterica serovar Typhi
cauccugcggcagu

SEQ ID NO: 1686998 - RNA, 20 nt, Salmonella enterica enterica serovar Typhi
cauccuguaccaccacgccc

SEQ ID NO: 1686999 - RNA, 21 nt, Salmonella enterica enterica serovar Typhi
caucgucgccagacccagcgc

SEQ ID NO: 1687000 - RNA, 22 nt, Salmonella enterica enterica serovar Typhi
caucggcacacuuucgcccggc

SEQ ID NO: 1687001 - RNA, 17 nt, Salmonella enterica enterica serovar Typhi
caucguuugcaguuccg

SEQ ID NO: 1687002 - RNA, 21 nt, Salmonella enterica enterica serovar Typhi
caucguggccgauauugccuu

SEQ ID NO: 1687003 - RNA, 19 nt, Salmonella enterica enterica serovar Typhi
caucgugguuaauacauca

SEQ ID NO: 1687004 - RNA, 16 nt, Salmonella enterica enterica serovar Typhi
caucgugagcgcguca

SEQ ID NO: 1687005 - RNA, 15 nt, Salmonella enterica enterica serovar Typhi
caucuaacacaaauu

SEQ ID NO: 1687006 - RNA, 20 nt, Salmonella enterica enterica serovar Typhi
caucuaacacaaauucgcua

SEQ ID NO: 1687007 - RNA, 22 nt, Salmonella enterica enterica serovar Typhi
caucucaauaucguugccgccg

SEQ ID NO: 1687008 - RNA, 15 nt, Salmonella enterica enterica serovar Typhi
caucucaucggcuuu

SEQ ID NO: 1687009 - RNA, 12 nt, Salmonella enterica enterica serovar Typhi
caucucaucuug

SEQ ID NO: 1687010 - RNA, 21 nt, Salmonella enterica enterica serovar Typhi
caucuccagcguggcagugag

SEQ ID NO: 1687011 - RNA, 16 nt, Salmonella enterica enterica serovar Typhi
caucacuuccuguauc

SEQ ID NO: 1687012 - RNA, 21 nt, Salmonella enterica enterica serovar Typhi
caucacuuccuguaucacuga

SEQ ID NO: 1687013 - RNA, 15 nt, Salmonella enterica enterica serovar Typhi
caucagaaaaaccuc

SEQ ID NO: 1687014 - RNA, 17 nt, Salmonella enterica enterica serovar Typhi
caucagaaugcugguca

SEQ ID NO: 1687015 - RNA, 22 nt, Salmonella enterica enterica serovar Typhi
caucagacaguacggaugaugu

SEQ ID NO: 1687016 - RNA, 18 nt, Salmonella enterica enterica serovar Typhi
caucagaccgauaaauac

SEQ ID NO: 1687017 - RNA, 17 nt, Salmonella enterica enterica serovar Typhi
caucagaccgccaagcg

SEQ ID NO: 1687018 - RNA, 22 nt, Salmonella enterica enterica serovar Typhi
caucagacuacuuuuacccuuc

SEQ ID NO: 1687019 - RNA, 15 nt, Salmonella enterica enterica serovar Typhi
caucagcaaaugaac

SEQ ID NO: 1687020 - RNA, 14 nt, Salmonella enterica enterica serovar Typhi
caucagcaaaauac

SEQ ID NO: 1687021 - RNA, 20 nt, Salmonella enterica enterica serovar Typhi
caucagacuacuuuuacccu

SEQ ID NO: 1687022 - RNA, 21 nt, Salmonella enterica enterica serovar Typhi
caucagcgcuaccagcgcggc

SEQ ID NO: 1687023 - RNA, 15 nt, Salmonella enterica enterica serovar Typhi
caucacagccacacu

SEQ ID NO: 1687024 - RNA, 16 nt, Salmonella enterica enterica serovar Typhi
caucacagccacacug

SEQ ID NO: 1687025 - RNA, 17 nt, Salmonella enterica enterica serovar Typhi
caucacaucaaagcccc

SEQ ID NO: 1687026 - RNA, 20 nt, Salmonella enterica enterica serovar Typhi
caucaauucuuuaauuugug

SEQ ID NO: 1687027 - RNA, 22 nt, Salmonella enterica enterica serovar Typhi
caucacaaucuccagaccgcug

SEQ ID NO: 1687028 - RNA, 18 nt, Salmonella enterica enterica serovar Typhi
caucacaaugaccucuuu

SEQ ID NO: 1687029 - RNA, 22 nt, Salmonella enterica enterica serovar Typhi
caucaccaguugcgaagccacu

SEQ ID NO: 1687030 - RNA, 19 nt, Salmonella enterica enterica serovar Typhi
caucacguucgcgcauacc

SEQ ID NO: 1687031 - RNA, 14 nt, Salmonella enterica enterica serovar Typhi
caucacguccuccc

SEQ ID NO: 1687032 - RNA, 19 nt, Salmonella enterica enterica serovar Typhi
caucacuaccauuuccggc

SEQ ID NO: 1687033 - RNA, 18 nt, Salmonella enterica enterica serovar Typhi
caucaacagcggagagac

SEQ ID NO: 1687034 - RNA, 18 nt, Salmonella enterica enterica serovar Typhi
caucaauacccggccccu

SEQ ID NO: 1687035 - RNA, 13 nt, Salmonella enterica enterica serovar Typhi
caucaaucaccuu

SEQ ID NO: 1687036 - RNA, 15 nt, Salmonella enterica enterica serovar Typhi
caucaaugcccagcg

SEQ ID NO: 1687037 - RNA, 21 nt, Salmonella enterica enterica serovar Typhi
caucaaucacuacggguuuuu

SEQ ID NO: 1687038 - RNA, 20 nt, Salmonella enterica enterica serovar Typhi
caucaaucgcuaucugacag

SEQ ID NO: 1687039 - RNA, 13 nt, Salmonella enterica enterica serovar Typhi
caucaaagccacc

SEQ ID NO: 1687040 - RNA, 19 nt, Salmonella enterica enterica serovar Typhi
caucaaagaaauacccuuc

SEQ ID NO: 1687041 - RNA, 20 nt, Salmonella enterica enterica serovar Typhi
cauauuugcgugucaucaaa

SEQ ID NO: 1687042 - RNA, 17 nt, Salmonella enterica enterica serovar Typhi
caucaaaguuauuuacc

SEQ ID NO: 1687043 - RNA, 16 nt, Salmonella enterica enterica serovar Typhi
cauauuguguuuuuua

SEQ ID NO: 1687044 - RNA, 14 nt, Salmonella enterica enterica serovar Typhi
cauauugccgcaca

SEQ ID NO: 1687045 - RNA, 20 nt, Salmonella enterica enterica serovar Typhi
cauauugcgcuucacuaacu

SEQ ID NO: 1687046 - RNA, 20 nt, Salmonella enterica enterica serovar Typhi
cauauugcgacaacuagaau

SEQ ID NO: 1687047 - RNA, 20 nt, Salmonella enterica enterica serovar Typhi
cauauucuuugcgccuuauu

SEQ ID NO: 1687048 - RNA, 15 nt, Salmonella enterica enterica serovar Typhi
cauauccaagccccu

SEQ ID NO: 1687049 - RNA, 20 nt, Salmonella enterica enterica serovar Typhi
cauauucauaucgaagccca

SEQ ID NO: 1687050 - RNA, 20 nt, Salmonella enterica enterica serovar Typhi
cauauuccagaagcgcuuug

SEQ ID NO: 1687051 - RNA, 15 nt, Salmonella enterica enterica serovar Typhi
cauauucgccaccgc

SEQ ID NO: 1687052 - RNA, 15 nt, Salmonella enterica enterica serovar Typhi
cauaguuugcauaac

SEQ ID NO: 1687053 - RNA, 16 nt, Salmonella enterica enterica serovar Typhi
cauaguuuuuccccau

SEQ ID NO: 1687054 - RNA, 16 nt, Salmonella enterica enterica serovar Typhi
cauagucgucuauuuc

SEQ ID NO: 1687055 - RNA, 13 nt, Salmonella enterica enterica serovar Typhi
cauaucaguugcc

SEQ ID NO: 1687056 - RNA, 12 nt, Salmonella enterica enterica serovar Typhi
cauaggacugau

SEQ ID NO: 1687057 - RNA, 16 nt, Salmonella enterica enterica serovar Typhi
cauagcguugauaugc

SEQ ID NO: 1687058 - RNA, 19 nt, Salmonella enterica enterica serovar Typhi
cauagcgggcagcauugac

SEQ ID NO: 1687059 - RNA, 18 nt, Salmonella enterica enterica serovar Typhi
cauagcgucaucaacaua

SEQ ID NO: 1687060 - RNA, 18 nt, Salmonella enterica enterica serovar Typhi
cauagcguuaucuggucg

SEQ ID NO: 1687061 - RNA, 20 nt, Salmonella enterica enterica serovar Typhi
cauaguacccucugcaccag

SEQ ID NO: 1687062 - RNA, 12 nt, Salmonella enterica enterica serovar Typhi
cauagaaccacu

SEQ ID NO: 1687063 - RNA, 17 nt, Salmonella enterica enterica serovar Typhi
cauagaaccacuuauuu

SEQ ID NO: 1687064 - RNA, 16 nt, Salmonella enterica enterica serovar Typhi
cauagaaauagccccg

SEQ ID NO: 1687065 - RNA, 17 nt, Salmonella enterica enterica serovar Typhi
cauagaaaucagcaggu

SEQ ID NO: 1687066 - RNA, 23 nt, Salmonella enterica enterica serovar Typhi
cauagacgcccugcaaagcaaaa

SEQ ID NO: 1687067 - RNA, 14 nt, Salmonella enterica enterica serovar Typhi
cauagacgcccugc

SEQ ID NO: 1687068 - RNA, 15 nt, Salmonella enterica enterica serovar Typhi
cauaauuuuccccag

SEQ ID NO: 1687069 - RNA, 19 nt, Salmonella enterica enterica serovar Typhi
cauaauggaacugccuggc

SEQ ID NO: 1687070 - RNA, 22 nt, Salmonella enterica enterica serovar Typhi
cauaauggaacugccuggcuca

SEQ ID NO: 1687071 - RNA, 21 nt, Salmonella enterica enterica serovar Typhi
cauaauggcccaguguacugc

SEQ ID NO: 1687072 - RNA, 23 nt, Salmonella enterica enterica serovar Typhi
cauaauggcgacgccuucaguca

SEQ ID NO: 1687073 - RNA, 22 nt, Salmonella enterica enterica serovar Typhi
cauagccguggcuggcgucccg

SEQ ID NO: 1687074 - RNA, 19 nt, Salmonella enterica enterica serovar Typhi
cauagcggccagauggcaa

SEQ ID NO: 1687075 - RNA, 20 nt, Salmonella enterica enterica serovar Typhi
cauagcggacuaaauuccug

SEQ ID NO: 1687076 - RNA, 19 nt, Salmonella enterica enterica serovar Typhi
cauagcgcgaaugauuuua

SEQ ID NO: 1687077 - RNA, 19 nt, Salmonella enterica enterica serovar Typhi
cauagcagaguacuggaau

SEQ ID NO: 1687078 - RNA, 17 nt, Salmonella enterica enterica serovar Typhi
cauagauaccuucuuca

SEQ ID NO: 1687079 - RNA, 13 nt, Salmonella enterica enterica serovar Typhi
cauagauaacuau

SEQ ID NO: 1687080 - RNA, 15 nt, Salmonella enterica enterica serovar Typhi
cauagauaccuucuu

SEQ ID NO: 1687081 - RNA, 17 nt, Salmonella enterica enterica serovar Typhi
cauagaguaucgccugu

SEQ ID NO: 1687082 - RNA, 20 nt, Salmonella enterica enterica serovar Typhi
cauucauaagcaaacagugg

SEQ ID NO: 1687083 - RNA, 14 nt, Salmonella enterica enterica serovar Typhi
cauucaggcuuucc

SEQ ID NO: 1687084 - RNA, 15 nt, Salmonella enterica enterica serovar Typhi
cauucaggccucugc

SEQ ID NO: 1687085 - RNA, 19 nt, Salmonella enterica enterica serovar Typhi
cauucagugaauuaugacc

SEQ ID NO: 1687086 - RNA, 19 nt, Salmonella enterica enterica serovar Typhi
cauucaggcaggcgaaacc

SEQ ID NO: 1687087 - RNA, 23 nt, Salmonella enterica enterica serovar Typhi
cauucaggcaggcgaaaccggcc

SEQ ID NO: 1687088 - RNA, 13 nt, Salmonella enterica enterica serovar Typhi
cauucacgccacc

SEQ ID NO: 1687089 - RNA, 16 nt, Salmonella enterica enterica serovar Typhi
cauucacgccaccauc

SEQ ID NO: 1687090 - RNA, 19 nt, Salmonella enterica enterica serovar Typhi
cauucauugucuuuuucuc

SEQ ID NO: 1687091 - RNA, 14 nt, Salmonella enterica enterica serovar Typhi
cauucccagcgccc

SEQ ID NO: 1687092 - RNA, 16 nt, Salmonella enterica enterica serovar Typhi
cauucccgccaauaac

SEQ ID NO: 1687093 - RNA, 17 nt, Salmonella enterica enterica serovar Typhi
cauucccguaaaagaag

SEQ ID NO: 1687094 - RNA, 22 nt, Salmonella enterica enterica serovar Typhi
cauucgccaccaggcucaaauu

SEQ ID NO: 1687095 - RNA, 15 nt, Salmonella enterica enterica serovar Typhi
cauucgccccagcau

SEQ ID NO: 1687096 - RNA, 23 nt, Salmonella enterica enterica serovar Typhi
cauucgcagcaaaaucuucuggc

SEQ ID NO: 1687097 - RNA, 20 nt, Salmonella enterica enterica serovar Typhi
cauucgaucuguguacuuuu

SEQ ID NO: 1687098 - RNA, 17 nt, Salmonella enterica enterica serovar Typhi
cauucgaauccuccugu

SEQ ID NO: 1687099 - RNA, 17 nt, Salmonella enterica enterica serovar Typhi
cauuccuuuagcuucca

SEQ ID NO: 1687100 - RNA, 18 nt, Salmonella enterica enterica serovar Typhi
cauuccuuuagcuuccag

SEQ ID NO: 1687101 - RNA, 18 nt, Salmonella enterica enterica serovar Typhi
cauuauuuuuaaauaacu

SEQ ID NO: 1687102 - RNA, 20 nt, Salmonella enterica enterica serovar Typhi
cauuauuuuagugaaaaaau

SEQ ID NO: 1687103 - RNA, 19 nt, Salmonella enterica enterica serovar Typhi
cauucaacgcaucaaauac

SEQ ID NO: 1687104 - RNA, 14 nt, Salmonella enterica enterica serovar Typhi
cauuaugcuggguu

SEQ ID NO: 1687105 - RNA, 22 nt, Salmonella enterica enterica serovar Typhi
cauguuagcaaaaaugccguua

SEQ ID NO: 1687106 - RNA, 19 nt, Salmonella enterica enterica serovar Typhi
cauguguggguaggguugc

SEQ ID NO: 1687107 - RNA, 17 nt, Salmonella enterica enterica serovar Typhi
cauguucccaugucagc

SEQ ID NO: 1687108 - RNA, 16 nt, Salmonella enterica enterica serovar Typhi
cauuaccuggcaacau

SEQ ID NO: 1687109 - RNA, 15 nt, Salmonella enterica enterica serovar Typhi
cauuacuguaaaccg

SEQ ID NO: 1687110 - RNA, 23 nt, Salmonella enterica enterica serovar Typhi
cauuaguucaaguuuagaaaaaa

SEQ ID NO: 1687111 - RNA, 17 nt, Salmonella enterica enterica serovar Typhi
cauucgcuccucagcgc

SEQ ID NO: 1687112 - RNA, 15 nt, Salmonella enterica enterica serovar Typhi
cauucgguaguucca

SEQ ID NO: 1687113 - RNA, 23 nt, Salmonella enterica enterica serovar Typhi
cauucgggacaaacccccagcca

SEQ ID NO: 1687114 - RNA, 17 nt, Salmonella enterica enterica serovar Typhi
cauugcaggcuuuuuca

SEQ ID NO: 1687115 - RNA, 20 nt, Salmonella enterica enterica serovar Typhi
cauugccauguuaauaccag

SEQ ID NO: 1687116 - RNA, 18 nt, Salmonella enterica enterica serovar Typhi
cauugccccagcccugcu

SEQ ID NO: 1687117 - RNA, 22 nt, Salmonella enterica enterica serovar Typhi
cauuggggggaaauuaaacugc

SEQ ID NO: 1687118 - RNA, 19 nt, Salmonella enterica enterica serovar Typhi
cauugguggggcuaaguga

SEQ ID NO: 1687119 - RNA, 16 nt, Salmonella enterica enterica serovar Typhi
cauuggcgucugcugg

SEQ ID NO: 1687120 - RNA, 18 nt, Salmonella enterica enterica serovar Typhi
cauuggcgucugcuggcc

SEQ ID NO: 1687121 - RNA, 20 nt, Salmonella enterica enterica serovar Typhi
cauugggauggauaaauagg

SEQ ID NO: 1687122 - RNA, 12 nt, Salmonella enterica enterica serovar Typhi
cauugcccggcg

SEQ ID NO: 1687123 - RNA, 22 nt, Salmonella enterica enterica serovar Typhi
cauugcgcucuaucgccgcccg

SEQ ID NO: 1687124 - RNA, 19 nt, Salmonella enterica enterica serovar Typhi
cauugcuaggaacagugac

SEQ ID NO: 1687125 - RNA, 13 nt, Salmonella enterica enterica serovar Typhi
cauugcguauuuc

SEQ ID NO: 1687126 - RNA, 16 nt, Salmonella enterica enterica serovar Typhi
cauuuaccuuucccca

SEQ ID NO: 1687127 - RNA, 19 nt, Salmonella enterica enterica serovar Typhi
cauuuacgccagccagaau

SEQ ID NO: 1687128 - RNA, 17 nt, Salmonella enterica enterica serovar Typhi
cauuuacgccagccaga

SEQ ID NO: 1687129 - RNA, 20 nt, Salmonella enterica enterica serovar Typhi
cauuguacuuuuaaaucauc

SEQ ID NO: 1687130 - RNA, 19 nt, Salmonella enterica enterica serovar Typhi
cauuguagucaauaaacug

SEQ ID NO: 1687131 - RNA, 21 nt, Salmonella enterica enterica serovar Typhi
cauuguagucaauaaacugga

SEQ ID NO: 1687132 - RNA, 19 nt, Salmonella enterica enterica serovar Typhi
cauuguauuucagggaaaa

SEQ ID NO: 1687133 - RNA, 16 nt, Salmonella enterica enterica serovar Typhi
cauuucacaaauuaaa

SEQ ID NO: 1687134 - RNA, 19 nt, Salmonella enterica enterica serovar Typhi
cauuucaaucgccaccaca

SEQ ID NO: 1687135 - RNA, 15 nt, Salmonella enterica enterica serovar Typhi
cauuuaugccgccau

SEQ ID NO: 1687136 - RNA, 20 nt, Salmonella enterica enterica serovar Typhi
cauuucacgauacuguugca

SEQ ID NO: 1687137 - RNA, 15 nt, Salmonella enterica enterica serovar Typhi
cauuucacuuguucu

SEQ ID NO: 1687138 - RNA, 16 nt, Salmonella enterica enterica serovar Typhi
cauuucacuauaaaaa

SEQ ID NO: 1687139 - RNA, 19 nt, Salmonella enterica enterica serovar Typhi
cauuucagcgcagaauuua

SEQ ID NO: 1687140 - RNA, 16 nt, Salmonella enterica enterica serovar Typhi
cauuucacuuguucuu

SEQ ID NO: 1687141 - RNA, 18 nt, Salmonella enterica enterica serovar Typhi
cauuucaggcaaaggaau

SEQ ID NO: 1687142 - RNA, 18 nt, Salmonella enterica enterica serovar Typhi
cauuucagucuaauuuau

SEQ ID NO: 1687143 - RNA, 19 nt, Salmonella enterica enterica serovar Typhi
cauuucauauucaaaaucc

SEQ ID NO: 1687144 - RNA, 23 nt, Salmonella enterica enterica serovar Typhi
cauuuccggcgcgccuaaaccaa

SEQ ID NO: 1687145 - RNA, 18 nt, Salmonella enterica enterica serovar Typhi
cauuucccaauaguuuau

SEQ ID NO: 1687146 - RNA, 14 nt, Salmonella enterica enterica serovar Typhi
cauuucgccgccau

SEQ ID NO: 1687147 - RNA, 15 nt, Salmonella enterica enterica serovar Typhi
cauuuccucugcgga

SEQ ID NO: 1687148 - RNA, 17 nt, Salmonella enterica enterica serovar Typhi
cauuuccggcggcaacc

SEQ ID NO: 1687149 - RNA, 23 nt, Salmonella enterica enterica serovar Typhi
caugaacguuggcgauaaggucg

SEQ ID NO: 1687150 - RNA, 14 nt, Salmonella enterica enterica serovar Typhi
caugaagaaaauac

SEQ ID NO: 1687151 - RNA, 24 nt, Salmonella enterica enterica serovar Typhi
caugaagauggucuguaccaccag

SEQ ID NO: 1687152 - RNA, 20 nt, Salmonella enterica enterica serovar Typhi
caugaauuacagcucauaaa

SEQ ID NO: 1687153 - RNA, 19 nt, Salmonella enterica enterica serovar Typhi
caugaaucaucacaauuag

SEQ ID NO: 1687154 - RNA, 23 nt, Salmonella enterica enterica serovar Typhi
caugaauaucaaaccacgcugag

SEQ ID NO: 1687155 - RNA, 23 nt, Salmonella enterica enterica serovar Typhi
caugacguuuugggaaaaccagu

SEQ ID NO: 1687156 - RNA, 16 nt, Salmonella enterica enterica serovar Typhi
caugaccggaugugcc

SEQ ID NO: 1687157 - RNA, 18 nt, Salmonella enterica enterica serovar Typhi
caugaccauccacgggcu

SEQ ID NO: 1687158 - RNA, 14 nt, Salmonella enterica enterica serovar Typhi
caugaccauucaca

SEQ ID NO: 1687159 - RNA, 14 nt, Salmonella enterica enterica serovar Typhi
caugaccagcgccg

SEQ ID NO: 1687160 - RNA, 14 nt, Salmonella enterica enterica serovar Typhi
caugaccaccagcg

SEQ ID NO: 1687161 - RNA, 14 nt, Salmonella enterica enterica serovar Typhi
caugacauccauga

SEQ ID NO: 1687162 - RNA, 15 nt, Salmonella enterica enterica serovar Typhi
caugacaucagaagu

SEQ ID NO: 1687163 - RNA, 17 nt, Salmonella enterica enterica serovar Typhi
caugaugagcgccauau

SEQ ID NO: 1687164 - RNA, 14 nt, Salmonella enterica enterica serovar Typhi
caugaugaucuuca

SEQ ID NO: 1687165 - RNA, 17 nt, Salmonella enterica enterica serovar Typhi
caugcagcucaagcgcc

SEQ ID NO: 1687166 - RNA, 22 nt, Salmonella enterica enterica serovar Typhi
caugcagagcaacgagaaccca

SEQ ID NO: 1687167 - RNA, 18 nt, Salmonella enterica enterica serovar Typhi
caugcaucucuucaaaca

SEQ ID NO: 1687168 - RNA, 14 nt, Salmonella enterica enterica serovar Typhi
caugccaaaccaga

SEQ ID NO: 1687169 - RNA, 18 nt, Salmonella enterica enterica serovar Typhi
caugagucgcgcgcgcca

SEQ ID NO: 1687170 - RNA, 23 nt, Salmonella enterica enterica serovar Typhi
caugagucgcgcgcgccagucau

SEQ ID NO: 1687171 - RNA, 21 nt, Salmonella enterica enterica serovar Typhi
caugaucauacugccgccgug

SEQ ID NO: 1687172 - RNA, 14 nt, Salmonella enterica enterica serovar Typhi
caugaucgccgcca

SEQ ID NO: 1687173 - RNA, 22 nt, Salmonella enterica enterica serovar Typhi
caugauccguucgaucagcugg

SEQ ID NO: 1687174 - RNA, 16 nt, Salmonella enterica enterica serovar Typhi
caugaucauacugccg

SEQ ID NO: 1687175 - RNA, 23 nt, Salmonella enterica enterica serovar Typhi
caugauaguaucgcugcuaaacg

SEQ ID NO: 1687176 - RNA, 16 nt, Salmonella enterica enterica serovar Typhi
caugauagggcagcag

SEQ ID NO: 1687177 - RNA, 14 nt, Salmonella enterica enterica serovar Typhi
caugccauugcuuu

SEQ ID NO: 1687178 - RNA, 18 nt, Salmonella enterica enterica serovar Typhi
caugccaucauuaauuua

SEQ ID NO: 1687179 - RNA, 14 nt, Salmonella enterica enterica serovar Typhi
caugccgccaaacu

SEQ ID NO: 1687180 - RNA, 15 nt, Salmonella enterica enterica serovar Typhi
caugccagaauugca

SEQ ID NO: 1687181 - RNA, 22 nt, Salmonella enterica enterica serovar Typhi
caugccacaacagaagcggccu

SEQ ID NO: 1687182 - RNA, 17 nt, Salmonella enterica enterica serovar Typhi
caugcuacaggcaaguu

SEQ ID NO: 1687183 - RNA, 19 nt, Salmonella enterica enterica serovar Typhi
caugcuacaggcaaguuua

SEQ ID NO: 1687184 - RNA, 21 nt, Salmonella enterica enterica serovar Typhi
caugcuacaggcaaguuuaau

SEQ ID NO: 1687185 - RNA, 15 nt, Salmonella enterica enterica serovar Typhi
caugcuauucagcag

SEQ ID NO: 1687186 - RNA, 19 nt, Salmonella enterica enterica serovar Typhi
caugcuauucagcaguuca

SEQ ID NO: 1687187 - RNA, 14 nt, Salmonella enterica enterica serovar Typhi
caugccgcccaggc

SEQ ID NO: 1687188 - RNA, 18 nt, Salmonella enterica enterica serovar Typhi
caugccggcuuuccgcac

SEQ ID NO: 1687189 - RNA, 15 nt, Salmonella enterica enterica serovar Typhi
caugccgcugcuggc

SEQ ID NO: 1687190 - RNA, 15 nt, Salmonella enterica enterica serovar Typhi
caugcucauccaacu

SEQ ID NO: 1687191 - RNA, 19 nt, Salmonella enterica enterica serovar Typhi
caugcucauccaacugcgc

SEQ ID NO: 1687192 - RNA, 20 nt, Salmonella enterica enterica serovar Typhi
caugcucauuuugauaaauc

SEQ ID NO: 1687193 - RNA, 21 nt, Salmonella enterica enterica serovar Typhi
caugcuggauaccgaauuccg

SEQ ID NO: 1687194 - RNA, 13 nt, Salmonella enterica enterica serovar Typhi
cauggcccaaaag

SEQ ID NO: 1687195 - RNA, 15 nt, Salmonella enterica enterica serovar Typhi
caugcuucucaaaga

SEQ ID NO: 1687196 - RNA, 17 nt, Salmonella enterica enterica serovar Typhi
cauggcgcgacauggcg

SEQ ID NO: 1687197 - RNA, 21 nt, Salmonella enterica enterica serovar Typhi
cauggcgaauccguugaucgu

SEQ ID NO: 1687198 - RNA, 22 nt, Salmonella enterica enterica serovar Typhi
cauguggccagcggccagccau

SEQ ID NO: 1687199 - RNA, 23 nt, Salmonella enterica enterica serovar Typhi
caugucggccuuuuugcgccgcg

SEQ ID NO: 1687200 - RNA, 17 nt, Salmonella enterica enterica serovar Typhi
cauguccggcgacucca

SEQ ID NO: 1687201 - RNA, 23 nt, Salmonella enterica enterica serovar Typhi
cauguccggcgacuccagaauau

SEQ ID NO: 1687202 - RNA, 23 nt, Salmonella enterica enterica serovar Typhi
cauguccgauagcauuauugcca

SEQ ID NO: 1687203 - RNA, 19 nt, Salmonella enterica enterica serovar Typhi
cauguagcgcggcagcgcg

SEQ ID NO: 1687204 - RNA, 21 nt, Salmonella enterica enterica serovar Typhi
cauguagcgcggcagcgcgca

SEQ ID NO: 1687205 - RNA, 19 nt, Salmonella enterica enterica serovar Typhi
caugguugacuuacaaaaa

SEQ ID NO: 1687206 - RNA, 14 nt, Salmonella enterica enterica serovar Typhi
cauggcuaaaagaa

SEQ ID NO: 1687207 - RNA, 14 nt, Salmonella enterica enterica serovar Typhi
cauguaaacuccau

SEQ ID NO: 1687208 - RNA, 19 nt, Salmonella enterica enterica serovar Typhi
cauguaaacuccauuaaau

SEQ ID NO: 1687209 - RNA, 19 nt, Salmonella enterica enterica serovar Typhi
cauggcggcgacaaugcuc

SEQ ID NO: 1687210 - RNA, 16 nt, Salmonella enterica enterica serovar Typhi
cauguaaauaaggcug

SEQ ID NO: 1687211 - RNA, 13 nt, Salmonella enterica enterica serovar Typhi
cauguaaaugacg

SEQ ID NO: 1687212 - RNA, 15 nt, Salmonella enterica enterica serovar Typhi
cagcgugacccagac

SEQ ID NO: 1687213 - RNA, 23 nt, Salmonella enterica enterica serovar Typhi
cagcgugaguuaugacggggaac

SEQ ID NO: 1687214 - RNA, 22 nt, Salmonella enterica enterica serovar Typhi
cagcguggugacgguugagagg

SEQ ID NO: 1687215 - RNA, 18 nt, Salmonella enterica enterica serovar Typhi
cagcgugccuucaaauau

SEQ ID NO: 1687216 - RNA, 12 nt, Salmonella enterica enterica serovar Typhi
cagcgucugccc

SEQ ID NO: 1687217 - RNA, 16 nt, Salmonella enterica enterica serovar Typhi
cagcgucucagcaggc

SEQ ID NO: 1687218 - RNA, 14 nt, Salmonella enterica enterica serovar Typhi
cagcgucgcuuugg

SEQ ID NO: 1687219 - RNA, 16 nt, Salmonella enterica enterica serovar Typhi
cagcgucgcaugggua

SEQ ID NO: 1687220 - RNA, 15 nt, Salmonella enterica enterica serovar Typhi
cagcguuuugcgcuc

SEQ ID NO: 1687221 - RNA, 13 nt, Salmonella enterica enterica serovar Typhi
cagcguuuccagc

SEQ ID NO: 1687222 - RNA, 14 nt, Salmonella enterica enterica serovar Typhi
cagcguugaccagc

SEQ ID NO: 1687223 - RNA, 22 nt, Salmonella enterica enterica serovar Typhi
cagcguugcguguuguacagca

SEQ ID NO: 1687224 - RNA, 21 nt, Salmonella enterica enterica serovar Typhi
cagcguacaauggcaggcaua

SEQ ID NO: 1687225 - RNA, 20 nt, Salmonella enterica enterica serovar Typhi
cagcguacaggcggaaauca

SEQ ID NO: 1687226 - RNA, 17 nt, Salmonella enterica enterica serovar Typhi
cagcguaccacgccgca

SEQ ID NO: 1687227 - RNA, 22 nt, Salmonella enterica enterica serovar Typhi
cagcguaaucggcaggccaacg

SEQ ID NO: 1687228 - RNA, 21 nt, Salmonella enterica enterica serovar Typhi
cagcguaauuguugccccgcu

SEQ ID NO: 1687229 - RNA, 23 nt, Salmonella enterica enterica serovar Typhi
cagcgguuacuuuugaacauaaa

SEQ ID NO: 1687230 - RNA, 18 nt, Salmonella enterica enterica serovar Typhi
cagcgucagcagaguguc

SEQ ID NO: 1687231 - RNA, 13 nt, Salmonella enterica enterica serovar Typhi
cagcgucauuaaa

SEQ ID NO: 1687232 - RNA, 15 nt, Salmonella enterica enterica serovar Typhi
cagcgucaucagauc

SEQ ID NO: 1687233 - RNA, 18 nt, Salmonella enterica enterica serovar Typhi
cagcgucaucaggccauu

SEQ ID NO: 1687234 - RNA, 16 nt, Salmonella enterica enterica serovar Typhi
cagcgucgacagcccc

SEQ ID NO: 1687235 - RNA, 22 nt, Salmonella enterica enterica serovar Typhi
cagcguccgccaucgccucgau

SEQ ID NO: 1687236 - RNA, 16 nt, Salmonella enterica enterica serovar Typhi
cagcgucccggcgucu

SEQ ID NO: 1687237 - RNA, 17 nt, Salmonella enterica enterica serovar Typhi
cacugagcgcgccauga

SEQ ID NO: 1687238 - RNA, 18 nt, Salmonella enterica enterica serovar Typhi
cacugauaccccagcgau

SEQ ID NO: 1687239 - RNA, 12 nt, Salmonella enterica enterica serovar Typhi
cagcgggaacau

SEQ ID NO: 1687240 - RNA, 15 nt, Salmonella enterica enterica serovar Typhi
cagcgguaugcaccu

SEQ ID NO: 1687241 - RNA, 21 nt, Salmonella enterica enterica serovar Typhi
cagcgggugaucgcuugccac

SEQ ID NO: 1687242 - RNA, 21 nt, Salmonella enterica enterica serovar Typhi
cagcgggcuaugcugaagcag

SEQ ID NO: 1687243 - RNA, 17 nt, Salmonella enterica enterica serovar Typhi
cagcugacgacgccagc

SEQ ID NO: 1687244 - RNA, 22 nt, Salmonella enterica enterica serovar Typhi
cagcucugccuguagcagcgcc

SEQ ID NO: 1687245 - RNA, 20 nt, Salmonella enterica enterica serovar Typhi
cagcucuuucaauccuucuu

SEQ ID NO: 1687246 - RNA, 21 nt, Salmonella enterica enterica serovar Typhi
cagcugacgcagcaguucccc

SEQ ID NO: 1687247 - RNA, 18 nt, Salmonella enterica enterica serovar Typhi
cagcuccuuuuaauaaag

SEQ ID NO: 1687248 - RNA, 19 nt, Salmonella enterica enterica serovar Typhi
cagcucagaaauaaaacca

SEQ ID NO: 1687249 - RNA, 19 nt, Salmonella enterica enterica serovar Typhi
cagcucagcuuuaaugcuu

SEQ ID NO: 1687250 - RNA, 16 nt, Salmonella enterica enterica serovar Typhi
cagcucauacccuucc

SEQ ID NO: 1687251 - RNA, 17 nt, Salmonella enterica enterica serovar Typhi
cagcucauacccuucca

SEQ ID NO: 1687252 - RNA, 20 nt, Salmonella enterica enterica serovar Typhi
cagcucauacccuuccaguu

SEQ ID NO: 1687253 - RNA, 20 nt, Salmonella enterica enterica serovar Typhi
cagcucacgcgccagcacca

SEQ ID NO: 1687254 - RNA, 14 nt, Salmonella enterica enterica serovar Typhi
cagcuucugauacu

SEQ ID NO: 1687255 - RNA, 15 nt, Salmonella enterica enterica serovar Typhi
cagcuugcuggccgc

SEQ ID NO: 1687256 - RNA, 17 nt, Salmonella enterica enterica serovar Typhi
cagcuucgguccggcgc

SEQ ID NO: 1687257 - RNA, 15 nt, Salmonella enterica enterica serovar Typhi
cagcuucgccccggc

SEQ ID NO: 1687258 - RNA, 17 nt, Salmonella enterica enterica serovar Typhi
cagcugggccugcuccg

SEQ ID NO: 1687259 - RNA, 15 nt, Salmonella enterica enterica serovar Typhi
cagcugggccugcuc

SEQ ID NO: 1687260 - RNA, 21 nt, Salmonella enterica enterica serovar Typhi
cagcuuccugcacgccugcuu

SEQ ID NO: 1687261 - RNA, 17 nt, Salmonella enterica enterica serovar Typhi
cagcugguuaaccaccu

SEQ ID NO: 1687262 - RNA, 22 nt, Salmonella enterica enterica serovar Typhi
cagcugguuaaccaccucauua

SEQ ID NO: 1687263 - RNA, 18 nt, Salmonella enterica enterica serovar Typhi
cagcuuguuuacgcccuc

SEQ ID NO: 1687264 - RNA, 19 nt, Salmonella enterica enterica serovar Typhi
cagcuuuaaugcuuuccag

SEQ ID NO: 1687265 - RNA, 14 nt, Salmonella enterica enterica serovar Typhi
caggaaaagaccau

SEQ ID NO: 1687266 - RNA, 16 nt, Salmonella enterica enterica serovar Typhi
caggaaagagccgcgc

SEQ ID NO: 1687267 - RNA, 22 nt, Salmonella enterica enterica serovar Typhi
caggaaagagccgcgcagcgca

SEQ ID NO: 1687268 - RNA, 13 nt, Salmonella enterica enterica serovar Typhi
caggaaaaacaug

SEQ ID NO: 1687269 - RNA, 21 nt, Salmonella enterica enterica serovar Typhi
caggccaaacccugcgccgca

SEQ ID NO: 1687270 - RNA, 18 nt, Salmonella enterica enterica serovar Typhi
caggccaaacagcggcuc

SEQ ID NO: 1687271 - RNA, 21 nt, Salmonella enterica enterica serovar Typhi
caggccaaaaccacagugacc

SEQ ID NO: 1687272 - RNA, 20 nt, Salmonella enterica enterica serovar Typhi
caggccaacguaguuauugu

SEQ ID NO: 1687273 - RNA, 23 nt, Salmonella enterica enterica serovar Typhi
caggccaagcgccuguucaacau

SEQ ID NO: 1687274 - RNA, 23 nt, Salmonella enterica enterica serovar Typhi
caggccagauauugccgaccauu

SEQ ID NO: 1687275 - RNA, 19 nt, Salmonella enterica enterica serovar Typhi
caggccagaauucagcaug

SEQ ID NO: 1687276 - RNA, 15 nt, Salmonella enterica enterica serovar Typhi
caggcauacagaugc

SEQ ID NO: 1687277 - RNA, 21 nt, Salmonella enterica enterica serovar Typhi
caggcauagaguaucgccugu

SEQ ID NO: 1687278 - RNA, 17 nt, Salmonella enterica enterica serovar Typhi
caggcauccgugaccug

SEQ ID NO: 1687279 - RNA, 16 nt, Salmonella enterica enterica serovar Typhi
caggcauccugcccug

SEQ ID NO: 1687280 - RNA, 17 nt, Salmonella enterica enterica serovar Typhi
caggcauccugcccugg

SEQ ID NO: 1687281 - RNA, 19 nt, Salmonella enterica enterica serovar Typhi
caggcauccgugaccugcu

SEQ ID NO: 1687282 - RNA, 20 nt, Salmonella enterica enterica serovar Typhi
caggcauugauaaagcgcuc

SEQ ID NO: 1687283 - RNA, 17 nt, Salmonella enterica enterica serovar Typhi
caggcauggcagcaggg

SEQ ID NO: 1687284 - RNA, 18 nt, Salmonella enterica enterica serovar Typhi
caggcauccagacccaca

SEQ ID NO: 1687285 - RNA, 12 nt, Salmonella enterica enterica serovar Typhi
caggcauggcca

SEQ ID NO: 1687286 - RNA, 15 nt, Salmonella enterica enterica serovar Typhi
caggcauuaaaaaaa

SEQ ID NO: 1687287 - RNA, 12 nt, Salmonella enterica enterica serovar Typhi
caggcccagccg

SEQ ID NO: 1687288 - RNA, 22 nt, Salmonella enterica enterica serovar Typhi
caggccaugcgccgcgucagca

SEQ ID NO: 1687289 - RNA, 20 nt, Salmonella enterica enterica serovar Typhi
caggccauuuuuucgaugau

SEQ ID NO: 1687290 - RNA, 21 nt, Salmonella enterica enterica serovar Typhi
caggccaugcgccgcgucagc

SEQ ID NO: 1687291 - RNA, 16 nt, Salmonella enterica enterica serovar Typhi
caggcccaugaucagg

SEQ ID NO: 1687292 - RNA, 22 nt, Salmonella enterica enterica serovar Typhi
caggcaaaucaacauuauuaaa

SEQ ID NO: 1687293 - RNA, 18 nt, Salmonella enterica enterica serovar Typhi
caggcaaaaggccuuuuu

SEQ ID NO: 1687294 - RNA, 17 nt, Salmonella enterica enterica serovar Typhi
caggcaagacgcaugac

SEQ ID NO: 1687295 - RNA, 22 nt, Salmonella enterica enterica serovar Typhi
caggcaagacacagcgucgcgc

SEQ ID NO: 1687296 - RNA, 11 nt, Salmonella enterica enterica serovar Typhi
caggaugcuga

SEQ ID NO: 1687297 - RNA, 19 nt, Salmonella enterica enterica serovar Typhi
caggcacagaagcgccugu

SEQ ID NO: 1687298 - RNA, 17 nt, Salmonella enterica enterica serovar Typhi
caggcaaguuuaauucc

SEQ ID NO: 1687299 - RNA, 13 nt, Salmonella enterica enterica serovar Typhi
caggcacgccugu

SEQ ID NO: 1687300 - RNA, 16 nt, Salmonella enterica enterica serovar Typhi
caggcacgccugugcu

SEQ ID NO: 1687301 - RNA, 20 nt, Salmonella enterica enterica serovar Typhi
caggcacgggugccuguucu

SEQ ID NO: 1687302 - RNA, 18 nt, Salmonella enterica enterica serovar Typhi
caggcauaaaaaagagga

SEQ ID NO: 1687303 - RNA, 14 nt, Salmonella enterica enterica serovar Typhi
caggaacagauacu

SEQ ID NO: 1687304 - RNA, 17 nt, Salmonella enterica enterica serovar Typhi
caggaaaucuuccaguu

SEQ ID NO: 1687305 - RNA, 21 nt, Salmonella enterica enterica serovar Typhi
caggaaauccagcagaauaac

SEQ ID NO: 1687306 - RNA, 14 nt, Salmonella enterica enterica serovar Typhi
caggaaaucuucca

SEQ ID NO: 1687307 - RNA, 15 nt, Salmonella enterica enterica serovar Typhi
caggaaccgccgaug

SEQ ID NO: 1687308 - RNA, 20 nt, Salmonella enterica enterica serovar Typhi
caggaacagauacuggaagu

SEQ ID NO: 1687309 - RNA, 21 nt, Salmonella enterica enterica serovar Typhi
caggaucaaaaucgcgcccca

SEQ ID NO: 1687310 - RNA, 16 nt, Salmonella enterica enterica serovar Typhi
caggaucaauucugau

SEQ ID NO: 1687311 - RNA, 19 nt, Salmonella enterica enterica serovar Typhi
caggaucaaaaucgcgccc

SEQ ID NO: 1687312 - RNA, 16 nt, Salmonella enterica enterica serovar Typhi
caggaugccaaccacc

SEQ ID NO: 1687313 - RNA, 14 nt, Salmonella enterica enterica serovar Typhi
caggcuugcccauu

SEQ ID NO: 1687314 - RNA, 15 nt, Salmonella enterica enterica serovar Typhi
caggcuugccgcgcc

SEQ ID NO: 1687315 - RNA, 21 nt, Salmonella enterica enterica serovar Typhi
caggcuuuaaauucagcaccc

SEQ ID NO: 1687316 - RNA, 15 nt, Salmonella enterica enterica serovar Typhi
caggcuuuucaggcu

SEQ ID NO: 1687317 - RNA, 21 nt, Salmonella enterica enterica serovar Typhi
caggcuuuucaggcuguggcu

SEQ ID NO: 1687318 - RNA, 23 nt, Salmonella enterica enterica serovar Typhi
cagggaaaagaaguggacuucca

SEQ ID NO: 1687319 - RNA, 14 nt, Salmonella enterica enterica serovar Typhi
cagggaaagccagu

SEQ ID NO: 1687320 - RNA, 23 nt, Salmonella enterica enterica serovar Typhi
caggcuguugaggaaauucugac

SEQ ID NO: 1687321 - RNA, 14 nt, Salmonella enterica enterica serovar Typhi
caggcugucugcca

SEQ ID NO: 1687322 - RNA, 19 nt, Salmonella enterica enterica serovar Typhi
caggcugguggagagcagu

SEQ ID NO: 1687323 - RNA, 21 nt, Salmonella enterica enterica serovar Typhi
caggcuucaucggauagauga

SEQ ID NO: 1687324 - RNA, 17 nt, Salmonella enterica enterica serovar Typhi
caggcuuaacacccgga

SEQ ID NO: 1687325 - RNA, 15 nt, Salmonella enterica enterica serovar Typhi
caggcuguugcgcau

SEQ ID NO: 1687326 - RNA, 15 nt, Salmonella enterica enterica serovar Typhi
caggcugccaaccag

SEQ ID NO: 1687327 - RNA, 22 nt, Salmonella enterica enterica serovar Typhi
caggcugccgacaacgccuccu

SEQ ID NO: 1687328 - RNA, 15 nt, Salmonella enterica enterica serovar Typhi
caggcuggagagcaa

SEQ ID NO: 1687329 - RNA, 18 nt, Salmonella enterica enterica serovar Typhi
caggcgucauagccgcgc

SEQ ID NO: 1687330 - RNA, 17 nt, Salmonella enterica enterica serovar Typhi
caggcggcauggguaaa

SEQ ID NO: 1687331 - RNA, 19 nt, Salmonella enterica enterica serovar Typhi
caggcgucauagccgcgcg

SEQ ID NO: 1687332 - RNA, 17 nt, Salmonella enterica enterica serovar Typhi
caggcguagagaggcau

SEQ ID NO: 1687333 - RNA, 17 nt, Salmonella enterica enterica serovar Typhi
caggcguaagaucccag

SEQ ID NO: 1687334 - RNA, 18 nt, Salmonella enterica enterica serovar Typhi
caggcguaagaucccagg

SEQ ID NO: 1687335 - RNA, 16 nt, Salmonella enterica enterica serovar Typhi
caggcggcaaaaaacg

SEQ ID NO: 1687336 - RNA, 14 nt, Salmonella enterica enterica serovar Typhi
caggcggcaugggu

SEQ ID NO: 1687337 - RNA, 19 nt, Salmonella enterica enterica serovar Typhi
caggcggaugaaacagucc

SEQ ID NO: 1687338 - RNA, 17 nt, Salmonella enterica enterica serovar Typhi
caggcgauuacaacgcg

SEQ ID NO: 1687339 - RNA, 24 nt, Salmonella enterica enterica serovar Typhi
caggcgcagagugagcaggcuaug

SEQ ID NO: 1687340 - RNA, 23 nt, Salmonella enterica enterica serovar Typhi
caggcgacucauuacgccgcguu

SEQ ID NO: 1687341 - RNA, 19 nt, Salmonella enterica enterica serovar Typhi
caggcgacggaaacgcugu

SEQ ID NO: 1687342 - RNA, 15 nt, Salmonella enterica enterica serovar Typhi
caggccuacccgcgu

SEQ ID NO: 1687343 - RNA, 13 nt, Salmonella enterica enterica serovar Typhi
caggcgacgccgc

SEQ ID NO: 1687344 - RNA, 16 nt, Salmonella enterica enterica serovar Typhi
caggcgaccgggcaga

SEQ ID NO: 1687345 - RNA, 22 nt, Salmonella enterica enterica serovar Typhi
caggccugcauuugcuggcgug

SEQ ID NO: 1687346 - RNA, 23 nt, Salmonella enterica enterica serovar Typhi
caggccugacuccggguaacgga

SEQ ID NO: 1687347 - RNA, 19 nt, Salmonella enterica enterica serovar Typhi
caggccugauaagcgcagc

SEQ ID NO: 1687348 - RNA, 16 nt, Salmonella enterica enterica serovar Typhi
caggccugagccgaac

SEQ ID NO: 1687349 - RNA, 16 nt, Salmonella enterica enterica serovar Typhi
caggccuguaaaccgc

SEQ ID NO: 1687350 - RNA, 17 nt, Salmonella enterica enterica serovar Typhi
caguuccaaucucuuuu

SEQ ID NO: 1687351 - RNA, 14 nt, Salmonella enterica enterica serovar Typhi
caguuccccgccgc

SEQ ID NO: 1687352 - RNA, 12 nt, Salmonella enterica enterica serovar Typhi
caguuccugugc

SEQ ID NO: 1687353 - RNA, 20 nt, Salmonella enterica enterica serovar Typhi
caguuccgccagacucagcc

SEQ ID NO: 1687354 - RNA, 16 nt, Salmonella enterica enterica serovar Typhi
caguuccccgccgcgg

SEQ ID NO: 1687355 - RNA, 22 nt, Salmonella enterica enterica serovar Typhi
caguucgauaaucccggcgcgc

SEQ ID NO: 1687356 - RNA, 16 nt, Salmonella enterica enterica serovar Typhi
caguuaccccgaagcg

SEQ ID NO: 1687357 - RNA, 24 nt, Salmonella enterica enterica serovar Typhi
caguuauuaaucaagcccagcuca

SEQ ID NO: 1687358 - RNA, 19 nt, Salmonella enterica enterica serovar Typhi
caguucacuccuaagagaa

SEQ ID NO: 1687359 - RNA, 20 nt, Salmonella enterica enterica serovar Typhi
caguucacuccuaagagaaa

SEQ ID NO: 1687360 - RNA, 16 nt, Salmonella enterica enterica serovar Typhi
caguucacgccgccgc

SEQ ID NO: 1687361 - RNA, 16 nt, Salmonella enterica enterica serovar Typhi
caguucaccggcggcc

SEQ ID NO: 1687362 - RNA, 19 nt, Salmonella enterica enterica serovar Typhi
caguucaaacggcccggcg

SEQ ID NO: 1687363 - RNA, 14 nt, Salmonella enterica enterica serovar Typhi
caguuauuuuuuuu

SEQ ID NO: 1687364 - RNA, 18 nt, Salmonella enterica enterica serovar Typhi
caguuauuuuacgggcgu

SEQ ID NO: 1687365 - RNA, 23 nt, Salmonella enterica enterica serovar Typhi
caguucagcagcaccacucccca

SEQ ID NO: 1687366 - RNA, 20 nt, Salmonella enterica enterica serovar Typhi
caguucacgacugauagguu

SEQ ID NO: 1687367 - RNA, 12 nt, Salmonella enterica enterica serovar Typhi
caguucauuaac

SEQ ID NO: 1687368 - RNA, 13 nt, Salmonella enterica enterica serovar Typhi
caguucauuccgc

SEQ ID NO: 1687369 - RNA, 17 nt, Salmonella enterica enterica serovar Typhi
caguucauucgccacca

SEQ ID NO: 1687370 - RNA, 23 nt, Salmonella enterica enterica serovar Typhi
caguucauauuugcuggcuugcu

SEQ ID NO: 1687371 - RNA, 16 nt, Salmonella enterica enterica serovar Typhi
caguucagcggucaua

SEQ ID NO: 1687372 - RNA, 18 nt, Salmonella enterica enterica serovar Typhi
caguucauccacgucaua

SEQ ID NO: 1687373 - RNA, 19 nt, Salmonella enterica enterica serovar Typhi
caguucauccacgucauaa

SEQ ID NO: 1687374 - RNA, 23 nt, Salmonella enterica enterica serovar Typhi
cagugcgaugggcuucagauguu

SEQ ID NO: 1687375 - RNA, 23 nt, Salmonella enterica enterica serovar Typhi
cagugccugauagcgcugugcua

SEQ ID NO: 1687376 - RNA, 18 nt, Salmonella enterica enterica serovar Typhi
cagugcuaaaauuauaca

SEQ ID NO: 1687377 - RNA, 20 nt, Salmonella enterica enterica serovar Typhi
caguggcuuuaacgucagca

SEQ ID NO: 1687378 - RNA, 13 nt, Salmonella enterica enterica serovar Typhi
cagugggaaaauu

SEQ ID NO: 1687379 - RNA, 23 nt, Salmonella enterica enterica serovar Typhi
caguggcuuaccguaugcaaaag

SEQ ID NO: 1687380 - RNA, 22 nt, Salmonella enterica enterica serovar Typhi
caguggucguuagccagauggc

SEQ ID NO: 1687381 - RNA, 20 nt, Salmonella enterica enterica serovar Typhi
cagugggcgucaaaaucccg

SEQ ID NO: 1687382 - RNA, 14 nt, Salmonella enterica enterica serovar Typhi
caguccucgcccac

SEQ ID NO: 1687383 - RNA, 21 nt, Salmonella enterica enterica serovar Typhi
cagugaugaaucgcuauugag

SEQ ID NO: 1687384 - RNA, 20 nt, Salmonella enterica enterica serovar Typhi
cagugauccaucgguucucu

SEQ ID NO: 1687385 - RNA, 22 nt, Salmonella enterica enterica serovar Typhi
cagugauccaucgguucucugc

SEQ ID NO: 1687386 - RNA, 17 nt, Salmonella enterica enterica serovar Typhi
cagugauuaugcucccg

SEQ ID NO: 1687387 - RNA, 24 nt, Salmonella enterica enterica serovar Typhi
cagugauuacaaaaugugcaauca

SEQ ID NO: 1687388 - RNA, 22 nt, Salmonella enterica enterica serovar Typhi
cagugauuuacuccaaaaauaa

SEQ ID NO: 1687389 - RNA, 21 nt, Salmonella enterica enterica serovar Typhi
caguccgguggcgaaaacgcu

SEQ ID NO: 1687390 - RNA, 17 nt, Salmonella enterica enterica serovar Typhi
caguccgggcauaaccu

SEQ ID NO: 1687391 - RNA, 16 nt, Salmonella enterica enterica serovar Typhi
caguccuccggcugaa

SEQ ID NO: 1687392 - RNA, 23 nt, Salmonella enterica enterica serovar Typhi
caguccgguacgacgacccuuuu

SEQ ID NO: 1687393 - RNA, 19 nt, Salmonella enterica enterica serovar Typhi
caguccgcgcgcuuuuuug

SEQ ID NO: 1687394 - RNA, 21 nt, Salmonella enterica enterica serovar Typhi
cauaagcuuaggauaagaaua

SEQ ID NO: 1687395 - RNA, 14 nt, Salmonella enterica enterica serovar Typhi
cauaagcgcggcgg

SEQ ID NO: 1687396 - RNA, 19 nt, Salmonella enterica enterica serovar Typhi
cauaaggguaagcaauaug

SEQ ID NO: 1687397 - RNA, 23 nt, Salmonella enterica enterica serovar Typhi
cauaagcaaauccucgucaaggu

SEQ ID NO: 1687398 - RNA, 21 nt, Salmonella enterica enterica serovar Typhi
cauaagcacaccauuucacaa

SEQ ID NO: 1687399 - RNA, 14 nt, Salmonella enterica enterica serovar Typhi
cauaagcaauaggu

SEQ ID NO: 1687400 - RNA, 15 nt, Salmonella enterica enterica serovar Typhi
cauaagcaaauccuc

SEQ ID NO: 1687401 - RNA, 21 nt, Salmonella enterica enterica serovar Typhi
cauaaaggcuuuaaagcaggc

SEQ ID NO: 1687402 - RNA, 20 nt, Salmonella enterica enterica serovar Typhi
cauaagagauggaaugagca

SEQ ID NO: 1687403 - RNA, 21 nt, Salmonella enterica enterica serovar Typhi
cauaagagauggaaugagcau

SEQ ID NO: 1687404 - RNA, 17 nt, Salmonella enterica enterica serovar Typhi
cauaauaaacugcaucc

SEQ ID NO: 1687405 - RNA, 20 nt, Salmonella enterica enterica serovar Typhi
cauaauaaacugcauccccu

SEQ ID NO: 1687406 - RNA, 14 nt, Salmonella enterica enterica serovar Typhi
cauaauaaugaaua

SEQ ID NO: 1687407 - RNA, 16 nt, Salmonella enterica enterica serovar Typhi
cauaauaaugacuaau

SEQ ID NO: 1687408 - RNA, 12 nt, Salmonella enterica enterica serovar Typhi
cauaagucaucc

SEQ ID NO: 1687409 - RNA, 22 nt, Salmonella enterica enterica serovar Typhi
cauaagugauacaugcuacagg

SEQ ID NO: 1687410 - RNA, 14 nt, Salmonella enterica enterica serovar Typhi
cauaauauccugca

SEQ ID NO: 1687411 - RNA, 12 nt, Salmonella enterica enterica serovar Typhi
cauaaaaccauu

SEQ ID NO: 1687412 - RNA, 18 nt, Salmonella enterica enterica serovar Typhi
caguuuuugcauuauauu

SEQ ID NO: 1687413 - RNA, 23 nt, Salmonella enterica enterica serovar Typhi
caguuuuuuacuuucaaaauacu

SEQ ID NO: 1687414 - RNA, 15 nt, Salmonella enterica enterica serovar Typhi
caguuuuugaacaua

SEQ ID NO: 1687415 - RNA, 12 nt, Salmonella enterica enterica serovar Typhi
caguuuuuccuu

SEQ ID NO: 1687416 - RNA, 17 nt, Salmonella enterica enterica serovar Typhi
caguuuuugcauuauau

SEQ ID NO: 1687417 - RNA, 19 nt, Salmonella enterica enterica serovar Typhi
caguuuugaucgaaucucc

SEQ ID NO: 1687418 - RNA, 15 nt, Salmonella enterica enterica serovar Typhi
caguuuuuccuuucu

SEQ ID NO: 1687419 - RNA, 15 nt, Salmonella enterica enterica serovar Typhi
caguuuuuauaacua

SEQ ID NO: 1687420 - RNA, 16 nt, Salmonella enterica enterica serovar Typhi
cauaaagcgucuuaga

SEQ ID NO: 1687421 - RNA, 15 nt, Salmonella enterica enterica serovar Typhi
cauaaacaaaacaac

SEQ ID NO: 1687422 - RNA, 15 nt, Salmonella enterica enterica serovar Typhi
caguuucgccagcgc

SEQ ID NO: 1687423 - RNA, 16 nt, Salmonella enterica enterica serovar Typhi
caguucuaacaggaag

SEQ ID NO: 1687424 - RNA, 14 nt, Salmonella enterica enterica serovar Typhi
caguuucaucaucg

SEQ ID NO: 1687425 - RNA, 17 nt, Salmonella enterica enterica serovar Typhi
cagucauucucuuucug

SEQ ID NO: 1687426 - RNA, 13 nt, Salmonella enterica enterica serovar Typhi
cagucauuaauuc

SEQ ID NO: 1687427 - RNA, 23 nt, Salmonella enterica enterica serovar Typhi
caguccagcgcggguucuuucca

SEQ ID NO: 1687428 - RNA, 19 nt, Salmonella enterica enterica serovar Typhi
caguccaccuguaaccgcu

SEQ ID NO: 1687429 - RNA, 19 nt, Salmonella enterica enterica serovar Typhi
cagucccaaugcggaaacc

SEQ ID NO: 1687430 - RNA, 14 nt, Salmonella enterica enterica serovar Typhi
caguccccuuuuca

SEQ ID NO: 1687431 - RNA, 22 nt, Salmonella enterica enterica serovar Typhi
caguaccugacuuuuccauacu

SEQ ID NO: 1687432 - RNA, 15 nt, Salmonella enterica enterica serovar Typhi
caguaccuucaacgc

SEQ ID NO: 1687433 - RNA, 18 nt, Salmonella enterica enterica serovar Typhi
caguacaaacgcaccgcc

SEQ ID NO: 1687434 - RNA, 23 nt, Salmonella enterica enterica serovar Typhi
caguaauuuuucucccagcagac

SEQ ID NO: 1687435 - RNA, 17 nt, Salmonella enterica enterica serovar Typhi
caguacaaacaaauaaa

SEQ ID NO: 1687436 - RNA, 11 nt, Salmonella enterica enterica serovar Typhi
caguaccuuua

SEQ ID NO: 1687437 - RNA, 15 nt, Salmonella enterica enterica serovar Typhi
caguacgcugccauc

SEQ ID NO: 1687438 - RNA, 17 nt, Salmonella enterica enterica serovar Typhi
caguaucguguuauuuu

SEQ ID NO: 1687439 - RNA, 13 nt, Salmonella enterica enterica serovar Typhi
caguaguaaaccg

SEQ ID NO: 1687440 - RNA, 21 nt, Salmonella enterica enterica serovar Typhi
caguaggcgaacuucauccac

SEQ ID NO: 1687441 - RNA, 18 nt, Salmonella enterica enterica serovar Typhi
caguaggcaugcacucca

SEQ ID NO: 1687442 - RNA, 16 nt, Salmonella enterica enterica serovar Typhi
caguagcgcgacgcca

SEQ ID NO: 1687443 - RNA, 13 nt, Salmonella enterica enterica serovar Typhi
caguagcgcgccc

SEQ ID NO: 1687444 - RNA, 19 nt, Salmonella enterica enterica serovar Typhi
caguacguaacggaaaagc

SEQ ID NO: 1687445 - RNA, 15 nt, Salmonella enterica enterica serovar Typhi
cagguucgaaucccg

SEQ ID NO: 1687446 - RNA, 12 nt, Salmonella enterica enterica serovar Typhi
cagguucagcaa

SEQ ID NO: 1687447 - RNA, 15 nt, Salmonella enterica enterica serovar Typhi
cagguuacucuucca

SEQ ID NO: 1687448 - RNA, 15 nt, Salmonella enterica enterica serovar Typhi
cagguuaaucagcac

SEQ ID NO: 1687449 - RNA, 12 nt, Salmonella enterica enterica serovar Typhi
cagguuaaccca

SEQ ID NO: 1687450 - RNA, 17 nt, Salmonella enterica enterica serovar Typhi
cagguuaaagccucuuu

SEQ ID NO: 1687451 - RNA, 15 nt, Salmonella enterica enterica serovar Typhi
caguaauccggcaac

SEQ ID NO: 1687452 - RNA, 16 nt, Salmonella enterica enterica serovar Typhi
caguaaucgcacggcu

SEQ ID NO: 1687453 - RNA, 23 nt, Salmonella enterica enterica serovar Typhi
caguaauggacagguaaaccggu

SEQ ID NO: 1687454 - RNA, 20 nt, Salmonella enterica enterica serovar Typhi
caguaauuuuucucccagca

SEQ ID NO: 1687455 - RNA, 17 nt, Salmonella enterica enterica serovar Typhi
caguaauaugaauugau

SEQ ID NO: 1687456 - RNA, 22 nt, Salmonella enterica enterica serovar Typhi
caguaaucaccgucuccggcgc

SEQ ID NO: 1687457 - RNA, 21 nt, Salmonella enterica enterica serovar Typhi
caguaaccuauuuuacaaaau

SEQ ID NO: 1687458 - RNA, 15 nt, Salmonella enterica enterica serovar Typhi
caguaaccgccacag

SEQ ID NO: 1687459 - RNA, 17 nt, Salmonella enterica enterica serovar Typhi
caguaaccgccacagca

SEQ ID NO: 1687460 - RNA, 12 nt, Salmonella enterica enterica serovar Typhi
caguaacacccg

SEQ ID NO: 1687461 - RNA, 20 nt, Salmonella enterica enterica serovar Typhi
caguaaauuaaacagcugua

SEQ ID NO: 1687462 - RNA, 13 nt, Salmonella enterica enterica serovar Typhi
cagguuuuacuuc

SEQ ID NO: 1687463 - RNA, 18 nt, Salmonella enterica enterica serovar Typhi
cagguuucuggcaacagc

SEQ ID NO: 1687464 - RNA, 20 nt, Salmonella enterica enterica serovar Typhi
cagguuucuggcaacagcca

SEQ ID NO: 1687465 - RNA, 17 nt, Salmonella enterica enterica serovar Typhi
cagguuuacguagcagc

SEQ ID NO: 1687466 - RNA, 20 nt, Salmonella enterica enterica serovar Typhi
cagguuuacguagcagcgcg

SEQ ID NO: 1687467 - RNA, 13 nt, Salmonella enterica enterica serovar Typhi
cagguuucaucgc

SEQ ID NO: 1687468 - RNA, 23 nt, Salmonella enterica enterica serovar Typhi
cagguuucaucgccgauuccugc

SEQ ID NO: 1687469 - RNA, 19 nt, Salmonella enterica enterica serovar Typhi
cagguuuaaacgaacgaga

SEQ ID NO: 1687470 - RNA, 17 nt, Salmonella enterica enterica serovar Typhi
cagguuuacccugauuu

SEQ ID NO: 1687471 - RNA, 13 nt, Salmonella enterica enterica serovar Typhi
caggucgcucuuu

SEQ ID NO: 1687472 - RNA, 16 nt, Salmonella enterica enterica serovar Typhi
caggucggccaaccgc

SEQ ID NO: 1687473 - RNA, 15 nt, Salmonella enterica enterica serovar Typhi
caggucgaugauuuu

SEQ ID NO: 1687474 - RNA, 14 nt, Salmonella enterica enterica serovar Typhi
caggucugcaccac

SEQ ID NO: 1687475 - RNA, 14 nt, Salmonella enterica enterica serovar Typhi
caggucugagauaa

SEQ ID NO: 1687476 - RNA, 21 nt, Salmonella enterica enterica serovar Typhi
caggucuauugccuaaauaac

SEQ ID NO: 1687477 - RNA, 21 nt, Salmonella enterica enterica serovar Typhi
caggucguccguugccaccca

SEQ ID NO: 1687478 - RNA, 22 nt, Salmonella enterica enterica serovar Typhi
caggugauugcccuccagccau

SEQ ID NO: 1687479 - RNA, 13 nt, Salmonella enterica enterica serovar Typhi
caggugaccaggc

SEQ ID NO: 1687480 - RNA, 24 nt, Salmonella enterica enterica serovar Typhi
cagguauuucgaggggcaggaagg

SEQ ID NO: 1687481 - RNA, 13 nt, Salmonella enterica enterica serovar Typhi
cagguauucuaac

SEQ ID NO: 1687482 - RNA, 20 nt, Salmonella enterica enterica serovar Typhi
cagguauucuaacugaucag

SEQ ID NO: 1687483 - RNA, 19 nt, Salmonella enterica enterica serovar Typhi
caggucaucaccuccagca

SEQ ID NO: 1687484 - RNA, 23 nt, Salmonella enterica enterica serovar Typhi
caggucaucaccuccagcacgcg

SEQ ID NO: 1687485 - RNA, 19 nt, Salmonella enterica enterica serovar Typhi
cagguagcgccuuuacugg

SEQ ID NO: 1687486 - RNA, 18 nt, Salmonella enterica enterica serovar Typhi
cagguagcagaccgguac

SEQ ID NO: 1687487 - RNA, 13 nt, Salmonella enterica enterica serovar Typhi
cagguaucauaug

SEQ ID NO: 1687488 - RNA, 17 nt, Salmonella enterica enterica serovar Typhi
cagguaguugucggcgg

SEQ ID NO: 1687489 - RNA, 16 nt, Salmonella enterica enterica serovar Typhi
cagguauuaaauacag

SEQ ID NO: 1687490 - RNA, 18 nt, Salmonella enterica enterica serovar Typhi
cagguauuaaauacagag

SEQ ID NO: 1687491 - RNA, 14 nt, Salmonella enterica enterica serovar Typhi
cagguagcagaccg

SEQ ID NO: 1687492 - RNA, 21 nt, Salmonella enterica enterica serovar Typhi
cagguaccccagccauauuuc

SEQ ID NO: 1687493 - RNA, 22 nt, Salmonella enterica enterica serovar Typhi
cagguacgcguuucacaaccuc

SEQ ID NO: 1687494 - RNA, 15 nt, Salmonella enterica enterica serovar Typhi
cagguaaugacuuuu

SEQ ID NO: 1687495 - RNA, 19 nt, Salmonella enterica enterica serovar Typhi
cagguaauacaggguuugu

SEQ ID NO: 1687496 - RNA, 22 nt, Salmonella enterica enterica serovar Typhi
cagggauauuccauacaguggc

SEQ ID NO: 1687497 - RNA, 17 nt, Salmonella enterica enterica serovar Typhi
cagggauauacaaauau

SEQ ID NO: 1687498 - RNA, 19 nt, Salmonella enterica enterica serovar Typhi
cagggauuuugcuuuuucg

SEQ ID NO: 1687499 - RNA, 13 nt, Salmonella enterica enterica serovar Typhi
cagggauccugua

SEQ ID NO: 1687500 - RNA, 19 nt, Salmonella enterica enterica serovar Typhi
cagggauccuguaacaacu

SEQ ID NO: 1687501 - RNA, 19 nt, Salmonella enterica enterica serovar Typhi
ccaaaauaauaaaaaucgg

SEQ ID NO: 1687502 - RNA, 19 nt, Salmonella enterica enterica serovar Typhi
ccaaaaugcgcaaagcaua

SEQ ID NO: 1687503 - RNA, 21 nt, Salmonella enterica enterica serovar Typhi
ccaaaauucacgcuucucugg

SEQ ID NO: 1687504 - RNA, 16 nt, Salmonella enterica enterica serovar Typhi
ccaaacgaauuuaaau

SEQ ID NO: 1687505 - RNA, 19 nt, Salmonella enterica enterica serovar Typhi
ccaaacaucgcucgcgcca

SEQ ID NO: 1687506 - RNA, 21 nt, Salmonella enterica enterica serovar Typhi
ccaaaagguuagguuaaauag

SEQ ID NO: 1687507 - RNA, 13 nt, Salmonella enterica enterica serovar Typhi
ccaaaaaccccga

SEQ ID NO: 1687508 - RNA, 22 nt, Salmonella enterica enterica serovar Typhi
ccaaaaaccguagcguugccaa

SEQ ID NO: 1687509 - RNA, 12 nt, Salmonella enterica enterica serovar Typhi
cauuucugccug

SEQ ID NO: 1687510 - RNA, 18 nt, Salmonella enterica enterica serovar Typhi
ccaaagccaggccgccag

SEQ ID NO: 1687511 - RNA, 17 nt, Salmonella enterica enterica serovar Typhi
ccaaagcgcugcugcuc

SEQ ID NO: 1687512 - RNA, 16 nt, Salmonella enterica enterica serovar Typhi
ccaaagggagcagacu

SEQ ID NO: 1687513 - RNA, 14 nt, Salmonella enterica enterica serovar Typhi
ccaaagcagcugcu

SEQ ID NO: 1687514 - RNA, 23 nt, Salmonella enterica enterica serovar Typhi
ccaaagcaccauucuucaacaau

SEQ ID NO: 1687515 - RNA, 19 nt, Salmonella enterica enterica serovar Typhi
ccaaagcaaucgccagcgc

SEQ ID NO: 1687516 - RNA, 23 nt, Salmonella enterica enterica serovar Typhi
ccaaacgaugaccauaaaugaaa

SEQ ID NO: 1687517 - RNA, 13 nt, Salmonella enterica enterica serovar Typhi
ccaaacuccucac

SEQ ID NO: 1687518 - RNA, 18 nt, Salmonella enterica enterica serovar Typhi
ccaaacugcgcgccgccc

SEQ ID NO: 1687519 - RNA, 19 nt, Salmonella enterica enterica serovar Typhi
ccaaacuccucacugcgua

SEQ ID NO: 1687520 - RNA, 18 nt, Salmonella enterica enterica serovar Typhi
ccaaacucugaaaaaauu

SEQ ID NO: 1687521 - RNA, 15 nt, Salmonella enterica enterica serovar Typhi
ccaaacuggcugugc

SEQ ID NO: 1687522 - RNA, 22 nt, Salmonella enterica enterica serovar Typhi
ccaaacuggcugugccaauaac

SEQ ID NO: 1687523 - RNA, 15 nt, Salmonella enterica enterica serovar Typhi
ccaaaguccaacugu

SEQ ID NO: 1687524 - RNA, 17 nt, Salmonella enterica enterica serovar Typhi
ccaaagugguuccaggc

SEQ ID NO: 1687525 - RNA, 19 nt, Salmonella enterica enterica serovar Typhi
ccaaagugguuccaggcgc

SEQ ID NO: 1687526 - RNA, 22 nt, Salmonella enterica enterica serovar Typhi
ccaaaguuaaucagcgccgucg

SEQ ID NO: 1687527 - RNA, 19 nt, Salmonella enterica enterica serovar Typhi
ccaaauaaaagccgccgug

SEQ ID NO: 1687528 - RNA, 18 nt, Salmonella enterica enterica serovar Typhi
ccaaaucuguucugucca

SEQ ID NO: 1687529 - RNA, 20 nt, Salmonella enterica enterica serovar Typhi
ccaaaucucccccggcacca

SEQ ID NO: 1687530 - RNA, 22 nt, Salmonella enterica enterica serovar Typhi
ccaaauaggcgaggaaaacauu

SEQ ID NO: 1687531 - RNA, 19 nt, Salmonella enterica enterica serovar Typhi
ccaaauaguccagcaucca

SEQ ID NO: 1687532 - RNA, 12 nt, Salmonella enterica enterica serovar Typhi
ccaaauauuucu

SEQ ID NO: 1687533 - RNA, 15 nt, Salmonella enterica enterica serovar Typhi
ccaaaucaauagaau

SEQ ID NO: 1687534 - RNA, 14 nt, Salmonella enterica enterica serovar Typhi
ccaacgccaacaua

SEQ ID NO: 1687535 - RNA, 17 nt, Salmonella enterica enterica serovar Typhi
ccaacgaaacucagcgg

SEQ ID NO: 1687536 - RNA, 20 nt, Salmonella enterica enterica serovar Typhi
ccaacgaaacucagcggccc

SEQ ID NO: 1687537 - RNA, 21 nt, Salmonella enterica enterica serovar Typhi
ccaacgagaauaagaccaaua

SEQ ID NO: 1687538 - RNA, 15 nt, Salmonella enterica enterica serovar Typhi
ccaaccgugcuucac

SEQ ID NO: 1687539 - RNA, 22 nt, Salmonella enterica enterica serovar Typhi
ccaacggcgacgcccgccaucu

SEQ ID NO: 1687540 - RNA, 19 nt, Salmonella enterica enterica serovar Typhi
ccaacgcuucacaaccuga

SEQ ID NO: 1687541 - RNA, 14 nt, Salmonella enterica enterica serovar Typhi
ccaacguauaaaau

SEQ ID NO: 1687542 - RNA, 17 nt, Salmonella enterica enterica serovar Typhi
ccaacugucgccauccu

SEQ ID NO: 1687543 - RNA, 17 nt, Salmonella enterica enterica serovar Typhi
ccaacugcgccugaaga

SEQ ID NO: 1687544 - RNA, 21 nt, Salmonella enterica enterica serovar Typhi
ccaaaugccugccguuuuuaa

SEQ ID NO: 1687545 - RNA, 18 nt, Salmonella enterica enterica serovar Typhi
ccaacagcaauguuucaa

SEQ ID NO: 1687546 - RNA, 18 nt, Salmonella enterica enterica serovar Typhi
ccaacaaucgcaccaggc

SEQ ID NO: 1687547 - RNA, 15 nt, Salmonella enterica enterica serovar Typhi
ccaacaaugccacgc

SEQ ID NO: 1687548 - RNA, 20 nt, Salmonella enterica enterica serovar Typhi
ccaacaaugccacgccccua

SEQ ID NO: 1687549 - RNA, 19 nt, Salmonella enterica enterica serovar Typhi
ccaaccaucggcacacuuu

SEQ ID NO: 1687550 - RNA, 11 nt, Salmonella enterica enterica serovar Typhi
ccaaccgccag

SEQ ID NO: 1687551 - RNA, 14 nt, Salmonella enterica enterica serovar Typhi
ccaaccgccagcca

SEQ ID NO: 1687552 - RNA, 23 nt, Salmonella enterica enterica serovar Typhi
ccaaccgcgacggggcgcagaaa

SEQ ID NO: 1687553 - RNA, 20 nt, Salmonella enterica enterica serovar Typhi
ccaacauagcggcaaggaaa

SEQ ID NO: 1687554 - RNA, 23 nt, Salmonella enterica enterica serovar Typhi
ccaacauagcuaaauaaaaauaa

SEQ ID NO: 1687555 - RNA, 13 nt, Salmonella enterica enterica serovar Typhi
ccaacaggaacau

SEQ ID NO: 1687556 - RNA, 21 nt, Salmonella enterica enterica serovar Typhi
ccaacagggcggccuccuggc

SEQ ID NO: 1687557 - RNA, 12 nt, Salmonella enterica enterica serovar Typhi
ccaaccaaccca

SEQ ID NO: 1687558 - RNA, 12 nt, Salmonella enterica enterica serovar Typhi
ccaacagucaug

SEQ ID NO: 1687559 - RNA, 16 nt, Salmonella enterica enterica serovar Typhi
ccaaccaggcaaacca

SEQ ID NO: 1687560 - RNA, 23 nt, Salmonella enterica enterica serovar Typhi
ccaaggcaucugcgcaacuggaa

SEQ ID NO: 1687561 - RNA, 20 nt, Salmonella enterica enterica serovar Typhi
ccaaggcaugauuaaagcca

SEQ ID NO: 1687562 - RNA, 20 nt, Salmonella enterica enterica serovar Typhi
ccaagcuguggaaacugugc

SEQ ID NO: 1687563 - RNA, 17 nt, Salmonella enterica enterica serovar Typhi
ccaagucuccgcccagc

SEQ ID NO: 1687564 - RNA, 22 nt, Salmonella enterica enterica serovar Typhi
ccaagcgcgguaaauuucuuga

SEQ ID NO: 1687565 - RNA, 19 nt, Salmonella enterica enterica serovar Typhi
ccaagcggcaucucgccaa

SEQ ID NO: 1687566 - RNA, 17 nt, Salmonella enterica enterica serovar Typhi
ccaagcgucagcauggu

SEQ ID NO: 1687567 - RNA, 15 nt, Salmonella enterica enterica serovar Typhi
ccaagcguaguacgu

SEQ ID NO: 1687568 - RNA, 12 nt, Salmonella enterica enterica serovar Typhi
ccaagaaugaaa

SEQ ID NO: 1687569 - RNA, 21 nt, Salmonella enterica enterica serovar Typhi
ccaagauaagaaguaaacaga

SEQ ID NO: 1687570 - RNA, 21 nt, Salmonella enterica enterica serovar Typhi
ccaagaucgccaagcugugau

SEQ ID NO: 1687571 - RNA, 17 nt, Salmonella enterica enterica serovar Typhi
ccaaucgccgccgcgug

SEQ ID NO: 1687572 - RNA, 13 nt, Salmonella enterica enterica serovar Typhi
ccaaucuccagca

SEQ ID NO: 1687573 - RNA, 15 nt, Salmonella enterica enterica serovar Typhi
ccaaugcaacgccuu

SEQ ID NO: 1687574 - RNA, 13 nt, Salmonella enterica enterica serovar Typhi
ccaaucagcccca

SEQ ID NO: 1687575 - RNA, 16 nt, Salmonella enterica enterica serovar Typhi
ccaauccugcacccgc

SEQ ID NO: 1687576 - RNA, 19 nt, Salmonella enterica enterica serovar Typhi
ccaaucgagaagccaucaa

SEQ ID NO: 1687577 - RNA, 17 nt, Salmonella enterica enterica serovar Typhi
ccaaucagcggguauug

SEQ ID NO: 1687578 - RNA, 17 nt, Salmonella enterica enterica serovar Typhi
ccaaucaacgccgccag

SEQ ID NO: 1687579 - RNA, 12 nt, Salmonella enterica enterica serovar Typhi
ccaauaagaacu

SEQ ID NO: 1687580 - RNA, 14 nt, Salmonella enterica enterica serovar Typhi
ccaauaaacgccag

SEQ ID NO: 1687581 - RNA, 16 nt, Salmonella enterica enterica serovar Typhi
ccaauaauaaucccaa

SEQ ID NO: 1687582 - RNA, 19 nt, Salmonella enterica enterica serovar Typhi
ccaauaaugccgccgucgc

SEQ ID NO: 1687583 - RNA, 12 nt, Salmonella enterica enterica serovar Typhi
ccaauacccagc

SEQ ID NO: 1687584 - RNA, 16 nt, Salmonella enterica enterica serovar Typhi
ccaauaguauccauaa

SEQ ID NO: 1687585 - RNA, 13 nt, Salmonella enterica enterica serovar Typhi
ccacacugcaucg

SEQ ID NO: 1687586 - RNA, 21 nt, Salmonella enterica enterica serovar Typhi
ccacacggaauccccggcuuc

SEQ ID NO: 1687587 - RNA, 21 nt, Salmonella enterica enterica serovar Typhi
ccacaccugaugguuauuuuc

SEQ ID NO: 1687588 - RNA, 14 nt, Salmonella enterica enterica serovar Typhi
ccacaauuguagcu

SEQ ID NO: 1687589 - RNA, 17 nt, Salmonella enterica enterica serovar Typhi
ccacacccauagcagcu

SEQ ID NO: 1687590 - RNA, 18 nt, Salmonella enterica enterica serovar Typhi
ccacagccaccgccagca

SEQ ID NO: 1687591 - RNA, 20 nt, Salmonella enterica enterica serovar Typhi
ccacagccgcauuuuuucuu

SEQ ID NO: 1687592 - RNA, 14 nt, Salmonella enterica enterica serovar Typhi
ccacagccucagca

SEQ ID NO: 1687593 - RNA, 20 nt, Salmonella enterica enterica serovar Typhi
ccacagcgaauuccggccau

SEQ ID NO: 1687594 - RNA, 23 nt, Salmonella enterica enterica serovar Typhi
ccacaggaccacguucccgauuc

SEQ ID NO: 1687595 - RNA, 17 nt, Salmonella enterica enterica serovar Typhi
ccacagcgccagacacu

SEQ ID NO: 1687596 - RNA, 20 nt, Salmonella enterica enterica serovar Typhi
ccacaggcgcuaauuaauuc

SEQ ID NO: 1687597 - RNA, 9 nt, Salmonella enterica enterica serovar Typhi
ccacaggcu

SEQ ID NO: 1687598 - RNA, 16 nt, Salmonella enterica enterica serovar Typhi
ccacaggccaacauag

SEQ ID NO: 1687599 - RNA, 18 nt, Salmonella enterica enterica serovar Typhi
ccaauguacguaaaacca

SEQ ID NO: 1687600 - RNA, 17 nt, Salmonella enterica enterica serovar Typhi
ccaauguacacgaaaua

SEQ ID NO: 1687601 - RNA, 21 nt, Salmonella enterica enterica serovar Typhi
ccaauggcgcgucuuaaaauu

SEQ ID NO: 1687602 - RNA, 14 nt, Salmonella enterica enterica serovar Typhi
ccaaugcgaaaaua

SEQ ID NO: 1687603 - RNA, 22 nt, Salmonella enterica enterica serovar Typhi
ccaaugcuuagucagccuuaau

SEQ ID NO: 1687604 - RNA, 15 nt, Salmonella enterica enterica serovar Typhi
ccaauguuaauaagc

SEQ ID NO: 1687605 - RNA, 23 nt, Salmonella enterica enterica serovar Typhi
ccacaaccgcccccaacugagcg

SEQ ID NO: 1687606 - RNA, 18 nt, Salmonella enterica enterica serovar Typhi
ccacaacgugauaaccaa

SEQ ID NO: 1687607 - RNA, 23 nt, Salmonella enterica enterica serovar Typhi
ccacaagagcagcaacccugccg

SEQ ID NO: 1687608 - RNA, 22 nt, Salmonella enterica enterica serovar Typhi
ccacaagagcagcaacccugcc

SEQ ID NO: 1687609 - RNA, 19 nt, Salmonella enterica enterica serovar Typhi
ccacaagaaaugcaggcgu

SEQ ID NO: 1687610 - RNA, 19 nt, Salmonella enterica enterica serovar Typhi
ccacaauggcaggcagcag

SEQ ID NO: 1687611 - RNA, 18 nt, Salmonella enterica enterica serovar Typhi
ccacaauugccagcaggu

SEQ ID NO: 1687612 - RNA, 21 nt, Salmonella enterica enterica serovar Typhi
ccaauugccacauagcaucca

SEQ ID NO: 1687613 - RNA, 22 nt, Salmonella enterica enterica serovar Typhi
ccacaaauuuugauaaaaacac

SEQ ID NO: 1687614 - RNA, 21 nt, Salmonella enterica enterica serovar Typhi
ccacaaauuuugauaaaaaca

SEQ ID NO: 1687615 - RNA, 16 nt, Salmonella enterica enterica serovar Typhi
ccaccaugcugguugg

SEQ ID NO: 1687616 - RNA, 18 nt, Salmonella enterica enterica serovar Typhi
ccaccaucgucgccagac

SEQ ID NO: 1687617 - RNA, 17 nt, Salmonella enterica enterica serovar Typhi
ccaccaucagacccgau

SEQ ID NO: 1687618 - RNA, 15 nt, Salmonella enterica enterica serovar Typhi
ccaccauaggccagc

SEQ ID NO: 1687619 - RNA, 15 nt, Salmonella enterica enterica serovar Typhi
ccaccagguucagca

SEQ ID NO: 1687620 - RNA, 16 nt, Salmonella enterica enterica serovar Typhi
ccaccagcuuaucuga

SEQ ID NO: 1687621 - RNA, 18 nt, Salmonella enterica enterica serovar Typhi
ccaccagccggagccggu

SEQ ID NO: 1687622 - RNA, 22 nt, Salmonella enterica enterica serovar Typhi
ccaccagcgccauaauccagaa

SEQ ID NO: 1687623 - RNA, 18 nt, Salmonella enterica enterica serovar Typhi
ccaccagcgccagcggcu

SEQ ID NO: 1687624 - RNA, 17 nt, Salmonella enterica enterica serovar Typhi
ccaccagcgccaggcca

SEQ ID NO: 1687625 - RNA, 23 nt, Salmonella enterica enterica serovar Typhi
ccaccagcccaucuuucgccagc

SEQ ID NO: 1687626 - RNA, 13 nt, Salmonella enterica enterica serovar Typhi
ccaccacgcagcc

SEQ ID NO: 1687627 - RNA, 13 nt, Salmonella enterica enterica serovar Typhi
ccaccacgcccaa

SEQ ID NO: 1687628 - RNA, 18 nt, Salmonella enterica enterica serovar Typhi
ccaccacguaaugcgccc

SEQ ID NO: 1687629 - RNA, 20 nt, Salmonella enterica enterica serovar Typhi
ccaccacguuaccgcgcagu

SEQ ID NO: 1687630 - RNA, 12 nt, Salmonella enterica enterica serovar Typhi
ccaccagaaccu

SEQ ID NO: 1687631 - RNA, 21 nt, Salmonella enterica enterica serovar Typhi
ccacaucggauuauuuucacg

SEQ ID NO: 1687632 - RNA, 17 nt, Salmonella enterica enterica serovar Typhi
ccacaugaccagcgccg

SEQ ID NO: 1687633 - RNA, 22 nt, Salmonella enterica enterica serovar Typhi
ccacaguugguucugcucaaug

SEQ ID NO: 1687634 - RNA, 23 nt, Salmonella enterica enterica serovar Typhi
ccacauccagcgccagcgccacc

SEQ ID NO: 1687635 - RNA, 22 nt, Salmonella enterica enterica serovar Typhi
ccacaucagaccgccaagcgcg

SEQ ID NO: 1687636 - RNA, 16 nt, Salmonella enterica enterica serovar Typhi
ccacauauaaguaacu

SEQ ID NO: 1687637 - RNA, 19 nt, Salmonella enterica enterica serovar Typhi
ccacauauaaguaacuggu

SEQ ID NO: 1687638 - RNA, 15 nt, Salmonella enterica enterica serovar Typhi
ccacauagcauccag

SEQ ID NO: 1687639 - RNA, 17 nt, Salmonella enterica enterica serovar Typhi
ccacauagcauccagac

SEQ ID NO: 1687640 - RNA, 17 nt, Salmonella enterica enterica serovar Typhi
ccaccaaagccaggccg

SEQ ID NO: 1687641 - RNA, 19 nt, Salmonella enterica enterica serovar Typhi
ccaccaaagccaggccgcc

SEQ ID NO: 1687642 - RNA, 15 nt, Salmonella enterica enterica serovar Typhi
ccacauugaccccau

SEQ ID NO: 1687643 - RNA, 13 nt, Salmonella enterica enterica serovar Typhi
ccaccaccgccac

SEQ ID NO: 1687644 - RNA, 17 nt, Salmonella enterica enterica serovar Typhi
ccacgaucugauucaau

SEQ ID NO: 1687645 - RNA, 17 nt, Salmonella enterica enterica serovar Typhi
ccacgauagacagcacc

SEQ ID NO: 1687646 - RNA, 16 nt, Salmonella enterica enterica serovar Typhi
ccacgaaagucuguuc

SEQ ID NO: 1687647 - RNA, 23 nt, Salmonella enterica enterica serovar Typhi
ccaccuuugaaaaucacaucgcc

SEQ ID NO: 1687648 - RNA, 19 nt, Salmonella enterica enterica serovar Typhi
ccaccuucucuuuaugcgu

SEQ ID NO: 1687649 - RNA, 21 nt, Salmonella enterica enterica serovar Typhi
ccaccguaugugcgccgugca

SEQ ID NO: 1687650 - RNA, 22 nt, Salmonella enterica enterica serovar Typhi
ccaccguaugugcgccgugcag

SEQ ID NO: 1687651 - RNA, 19 nt, Salmonella enterica enterica serovar Typhi
ccacggauaagccagcccu

SEQ ID NO: 1687652 - RNA, 14 nt, Salmonella enterica enterica serovar Typhi
ccacgcuuuuuuau

SEQ ID NO: 1687653 - RNA, 16 nt, Salmonella enterica enterica serovar Typhi
ccacgcuuuuuuauuu

SEQ ID NO: 1687654 - RNA, 19 nt, Salmonella enterica enterica serovar Typhi
ccacggauggccucugcca

SEQ ID NO: 1687655 - RNA, 22 nt, Salmonella enterica enterica serovar Typhi
ccacgcugauacguaacaugac

SEQ ID NO: 1687656 - RNA, 14 nt, Salmonella enterica enterica serovar Typhi
ccacgcugccgccg

SEQ ID NO: 1687657 - RNA, 14 nt, Salmonella enterica enterica serovar Typhi
ccacgcuuuuccuu

SEQ ID NO: 1687658 - RNA, 15 nt, Salmonella enterica enterica serovar Typhi
ccacgcugccgccgc

SEQ ID NO: 1687659 - RNA, 21 nt, Salmonella enterica enterica serovar Typhi
ccacgauguaugccgaccgug

SEQ ID NO: 1687660 - RNA, 11 nt, Salmonella enterica enterica serovar Typhi
ccacgccaccg

SEQ ID NO: 1687661 - RNA, 15 nt, Salmonella enterica enterica serovar Typhi
ccacgccaccgccgc

SEQ ID NO: 1687662 - RNA, 18 nt, Salmonella enterica enterica serovar Typhi
ccacgccaccgccgccac

SEQ ID NO: 1687663 - RNA, 15 nt, Salmonella enterica enterica serovar Typhi
ccacgccagcagcuc

SEQ ID NO: 1687664 - RNA, 15 nt, Salmonella enterica enterica serovar Typhi
ccacgccaccgggcc

SEQ ID NO: 1687665 - RNA, 17 nt, Salmonella enterica enterica serovar Typhi
ccacgccauggccgcag

SEQ ID NO: 1687666 - RNA, 15 nt, Salmonella enterica enterica serovar Typhi
ccacgccaucgcggc

SEQ ID NO: 1687667 - RNA, 17 nt, Salmonella enterica enterica serovar Typhi
ccacgccaucgcggcgc

SEQ ID NO: 1687668 - RNA, 18 nt, Salmonella enterica enterica serovar Typhi
ccacgccccuaaggcagc

SEQ ID NO: 1687669 - RNA, 16 nt, Salmonella enterica enterica serovar Typhi
ccacgguguaccccgc

SEQ ID NO: 1687670 - RNA, 15 nt, Salmonella enterica enterica serovar Typhi
ccacgguguaccccg

SEQ ID NO: 1687671 - RNA, 15 nt, Salmonella enterica enterica serovar Typhi
ccacggcuucagcgg

SEQ ID NO: 1687672 - RNA, 21 nt, Salmonella enterica enterica serovar Typhi
ccacgggcgcguuaaugcauu

SEQ ID NO: 1687673 - RNA, 17 nt, Salmonella enterica enterica serovar Typhi
ccacgggguuggcccuc

SEQ ID NO: 1687674 - RNA, 20 nt, Salmonella enterica enterica serovar Typhi
ccacggcguguugaaauccu

SEQ ID NO: 1687675 - RNA, 15 nt, Salmonella enterica enterica serovar Typhi
ccacggccagcagcc

SEQ ID NO: 1687676 - RNA, 21 nt, Salmonella enterica enterica serovar Typhi
ccacggccaacgcgcccucug

SEQ ID NO: 1687677 - RNA, 17 nt, Salmonella enterica enterica serovar Typhi
ccagcagcgcaccugcc

SEQ ID NO: 1687678 - RNA, 20 nt, Salmonella enterica enterica serovar Typhi
ccagcagccagccguugugc

SEQ ID NO: 1687679 - RNA, 15 nt, Salmonella enterica enterica serovar Typhi
ccagcagccacagga

SEQ ID NO: 1687680 - RNA, 12 nt, Salmonella enterica enterica serovar Typhi
ccagcagccaca

SEQ ID NO: 1687681 - RNA, 16 nt, Salmonella enterica enterica serovar Typhi
ccagcauccaugccag

SEQ ID NO: 1687682 - RNA, 21 nt, Salmonella enterica enterica serovar Typhi
ccagcauccaugccagcgcgg

SEQ ID NO: 1687683 - RNA, 11 nt, Salmonella enterica enterica serovar Typhi
ccagcagcgcc

SEQ ID NO: 1687684 - RNA, 15 nt, Salmonella enterica enterica serovar Typhi
ccagcaugcccgcca

SEQ ID NO: 1687685 - RNA, 18 nt, Salmonella enterica enterica serovar Typhi
ccagcauggcgucggcga

SEQ ID NO: 1687686 - RNA, 22 nt, Salmonella enterica enterica serovar Typhi
ccagcauggcgucggcgacuuu

SEQ ID NO: 1687687 - RNA, 11 nt, Salmonella enterica enterica serovar Typhi
ccagcauggcg

SEQ ID NO: 1687688 - RNA, 21 nt, Salmonella enterica enterica serovar Typhi
ccagcaucgguagaaugaaug

SEQ ID NO: 1687689 - RNA, 16 nt, Salmonella enterica enterica serovar Typhi
ccagcaucgcccgggc

SEQ ID NO: 1687690 - RNA, 14 nt, Salmonella enterica enterica serovar Typhi
ccagccccagcccu

SEQ ID NO: 1687691 - RNA, 17 nt, Salmonella enterica enterica serovar Typhi
ccagccauaaaugcuga

SEQ ID NO: 1687692 - RNA, 17 nt, Salmonella enterica enterica serovar Typhi
ccagccauagcagcaaa

SEQ ID NO: 1687693 - RNA, 18 nt, Salmonella enterica enterica serovar Typhi
ccagccagcgccaccaaa

SEQ ID NO: 1687694 - RNA, 18 nt, Salmonella enterica enterica serovar Typhi
ccagccaggaaccgccga

SEQ ID NO: 1687695 - RNA, 12 nt, Salmonella enterica enterica serovar Typhi
ccagccaaacaa

SEQ ID NO: 1687696 - RNA, 17 nt, Salmonella enterica enterica serovar Typhi
ccagcauuuccagcugg

SEQ ID NO: 1687697 - RNA, 16 nt, Salmonella enterica enterica serovar Typhi
ccagcauuucuucaag

SEQ ID NO: 1687698 - RNA, 17 nt, Salmonella enterica enterica serovar Typhi
ccagcauuaacccggcc

SEQ ID NO: 1687699 - RNA, 15 nt, Salmonella enterica enterica serovar Typhi
ccagccacuccuuac

SEQ ID NO: 1687700 - RNA, 12 nt, Salmonella enterica enterica serovar Typhi
ccagccacaaga

SEQ ID NO: 1687701 - RNA, 14 nt, Salmonella enterica enterica serovar Typhi
ccagccacugcgcc

SEQ ID NO: 1687702 - RNA, 15 nt, Salmonella enterica enterica serovar Typhi
ccagccagacgccag

SEQ ID NO: 1687703 - RNA, 16 nt, Salmonella enterica enterica serovar Typhi
ccagccagacgccagc

SEQ ID NO: 1687704 - RNA, 15 nt, Salmonella enterica enterica serovar Typhi
ccagcaccaucuuuu

SEQ ID NO: 1687705 - RNA, 16 nt, Salmonella enterica enterica serovar Typhi
ccagcaaugccgccgc

SEQ ID NO: 1687706 - RNA, 16 nt, Salmonella enterica enterica serovar Typhi
ccagcaaugauuuuau

SEQ ID NO: 1687707 - RNA, 16 nt, Salmonella enterica enterica serovar Typhi
ccagcaccaucuuuuc

SEQ ID NO: 1687708 - RNA, 19 nt, Salmonella enterica enterica serovar Typhi
ccagcacuaacagcagcag

SEQ ID NO: 1687709 - RNA, 19 nt, Salmonella enterica enterica serovar Typhi
ccagcaaggcugccgccag

SEQ ID NO: 1687710 - RNA, 21 nt, Salmonella enterica enterica serovar Typhi
ccagcaauaacaccggcggcg

SEQ ID NO: 1687711 - RNA, 12 nt, Salmonella enterica enterica serovar Typhi
ccagcaaggcaa

SEQ ID NO: 1687712 - RNA, 14 nt, Salmonella enterica enterica serovar Typhi
ccagcaacggcggg

SEQ ID NO: 1687713 - RNA, 20 nt, Salmonella enterica enterica serovar Typhi
ccagcaacgagcuuuuuucu

SEQ ID NO: 1687714 - RNA, 21 nt, Salmonella enterica enterica serovar Typhi
ccagaucgcgguaacggccug

SEQ ID NO: 1687715 - RNA, 15 nt, Salmonella enterica enterica serovar Typhi
ccagaugaaacugca

SEQ ID NO: 1687716 - RNA, 15 nt, Salmonella enterica enterica serovar Typhi
ccagacaugcacaug

SEQ ID NO: 1687717 - RNA, 14 nt, Salmonella enterica enterica serovar Typhi
ccagaccaauagag

SEQ ID NO: 1687718 - RNA, 15 nt, Salmonella enterica enterica serovar Typhi
ccagaccaauagaga

SEQ ID NO: 1687719 - RNA, 19 nt, Salmonella enterica enterica serovar Typhi
ccagacaggacgccagcgc

SEQ ID NO: 1687720 - RNA, 18 nt, Salmonella enterica enterica serovar Typhi
ccagacagauaacaccag

SEQ ID NO: 1687721 - RNA, 19 nt, Salmonella enterica enterica serovar Typhi
ccagacagauaacaccagc

SEQ ID NO: 1687722 - RNA, 20 nt, Salmonella enterica enterica serovar Typhi
ccagacagauaacaccagcg

SEQ ID NO: 1687723 - RNA, 14 nt, Salmonella enterica enterica serovar Typhi
ccagacccgggacu

SEQ ID NO: 1687724 - RNA, 19 nt, Salmonella enterica enterica serovar Typhi
ccagaccauucaaccagcc

SEQ ID NO: 1687725 - RNA, 22 nt, Salmonella enterica enterica serovar Typhi
ccagaccgauauuuugcugcac

SEQ ID NO: 1687726 - RNA, 14 nt, Salmonella enterica enterica serovar Typhi
ccagaccgcuuaac

SEQ ID NO: 1687727 - RNA, 21 nt, Salmonella enterica enterica serovar Typhi
ccagaccggauugcccgcggc

SEQ ID NO: 1687728 - RNA, 23 nt, Salmonella enterica enterica serovar Typhi
ccagaccugaauauucggcucca

SEQ ID NO: 1687729 - RNA, 20 nt, Salmonella enterica enterica serovar Typhi
ccagacgcugauagccacgg

SEQ ID NO: 1687730 - RNA, 20 nt, Salmonella enterica enterica serovar Typhi
ccagacgccauaucgccgcc

SEQ ID NO: 1687731 - RNA, 19 nt, Salmonella enterica enterica serovar Typhi
ccagacgcguaaccccugc

SEQ ID NO: 1687732 - RNA, 18 nt, Salmonella enterica enterica serovar Typhi
ccagaggugaaccauuga

SEQ ID NO: 1687733 - RNA, 20 nt, Salmonella enterica enterica serovar Typhi
ccagaggaucuggacgccaa

SEQ ID NO: 1687734 - RNA, 15 nt, Salmonella enterica enterica serovar Typhi
ccagagcgacaauga

SEQ ID NO: 1687735 - RNA, 22 nt, Salmonella enterica enterica serovar Typhi
ccagagcgacaaugaaccagcc

SEQ ID NO: 1687736 - RNA, 16 nt, Salmonella enterica enterica serovar Typhi
ccagagccccaaugcu

SEQ ID NO: 1687737 - RNA, 15 nt, Salmonella enterica enterica serovar Typhi
ccagacucgcucccu

SEQ ID NO: 1687738 - RNA, 16 nt, Salmonella enterica enterica serovar Typhi
ccagacucagccaggu

SEQ ID NO: 1687739 - RNA, 15 nt, Salmonella enterica enterica serovar Typhi
ccagacuaaaacgug

SEQ ID NO: 1687740 - RNA, 21 nt, Salmonella enterica enterica serovar Typhi
ccagagagcguuucuacgcca

SEQ ID NO: 1687741 - RNA, 16 nt, Salmonella enterica enterica serovar Typhi
ccagacugugauggcg

SEQ ID NO: 1687742 - RNA, 16 nt, Salmonella enterica enterica serovar Typhi
ccagacuuuccagcac

SEQ ID NO: 1687743 - RNA, 18 nt, Salmonella enterica enterica serovar Typhi
ccagacuuuccagcacga

SEQ ID NO: 1687744 - RNA, 17 nt, Salmonella enterica enterica serovar Typhi
ccacguucuuccagaac

SEQ ID NO: 1687745 - RNA, 14 nt, Salmonella enterica enterica serovar Typhi
ccacuuucagcucc

SEQ ID NO: 1687746 - RNA, 12 nt, Salmonella enterica enterica serovar Typhi
ccacuuugcgcu

SEQ ID NO: 1687747 - RNA, 20 nt, Salmonella enterica enterica serovar Typhi
ccagaaaaccgacagcaaua

SEQ ID NO: 1687748 - RNA, 15 nt, Salmonella enterica enterica serovar Typhi
ccacuuugggccgaa

SEQ ID NO: 1687749 - RNA, 16 nt, Salmonella enterica enterica serovar Typhi
ccacuuugcgcuccug

SEQ ID NO: 1687750 - RNA, 21 nt, Salmonella enterica enterica serovar Typhi
ccagaacugcgaaaucaccga

SEQ ID NO: 1687751 - RNA, 12 nt, Salmonella enterica enterica serovar Typhi
ccagaagaaaau

SEQ ID NO: 1687752 - RNA, 17 nt, Salmonella enterica enterica serovar Typhi
ccagaagcacuucucca

SEQ ID NO: 1687753 - RNA, 18 nt, Salmonella enterica enterica serovar Typhi
ccagaacgagaggaggag

SEQ ID NO: 1687754 - RNA, 14 nt, Salmonella enterica enterica serovar Typhi
ccagaacggcagcg

SEQ ID NO: 1687755 - RNA, 19 nt, Salmonella enterica enterica serovar Typhi
ccagaacugcgaaaucacc

SEQ ID NO: 1687756 - RNA, 23 nt, Salmonella enterica enterica serovar Typhi
ccagaacgaauuuacucgccaau

SEQ ID NO: 1687757 - RNA, 13 nt, Salmonella enterica enterica serovar Typhi
ccagaacggcagc

SEQ ID NO: 1687758 - RNA, 17 nt, Salmonella enterica enterica serovar Typhi
ccagaaacgguccugau

SEQ ID NO: 1687759 - RNA, 18 nt, Salmonella enterica enterica serovar Typhi
ccagaauucagcauguac

SEQ ID NO: 1687760 - RNA, 23 nt, Salmonella enterica enterica serovar Typhi
ccagacaauccgcggcaaacccc

SEQ ID NO: 1687761 - RNA, 23 nt, Salmonella enterica enterica serovar Typhi
ccagacaaaaucuuuccagcucc

SEQ ID NO: 1687762 - RNA, 17 nt, Salmonella enterica enterica serovar Typhi
ccagacacggugugccg

SEQ ID NO: 1687763 - RNA, 16 nt, Salmonella enterica enterica serovar Typhi
ccagacaagcacauaa

SEQ ID NO: 1687764 - RNA, 20 nt, Salmonella enterica enterica serovar Typhi
ccagaagcgcuuugccaaug

SEQ ID NO: 1687765 - RNA, 13 nt, Salmonella enterica enterica serovar Typhi
ccagaaucuggcc

SEQ ID NO: 1687766 - RNA, 17 nt, Salmonella enterica enterica serovar Typhi
ccagaaugccagcgccg

SEQ ID NO: 1687767 - RNA, 18 nt, Salmonella enterica enterica serovar Typhi
ccagaaugcccagcaagg

SEQ ID NO: 1687768 - RNA, 21 nt, Salmonella enterica enterica serovar Typhi
ccagaaugcccugcuguucca

SEQ ID NO: 1687769 - RNA, 15 nt, Salmonella enterica enterica serovar Typhi
ccagguuaauccuua

SEQ ID NO: 1687770 - RNA, 13 nt, Salmonella enterica enterica serovar Typhi
ccagguuuuacau

SEQ ID NO: 1687771 - RNA, 16 nt, Salmonella enterica enterica serovar Typhi
ccagguuuugcucuga

SEQ ID NO: 1687772 - RNA, 20 nt, Salmonella enterica enterica serovar Typhi
ccaguaacgcguccaacugg

SEQ ID NO: 1687773 - RNA, 22 nt, Salmonella enterica enterica serovar Typhi
ccaguaaaaucggaccuccgcg

SEQ ID NO: 1687774 - RNA, 16 nt, Salmonella enterica enterica serovar Typhi
ccagguuauucaggug

SEQ ID NO: 1687775 - RNA, 17 nt, Salmonella enterica enterica serovar Typhi
ccagguucaagcuggaa

SEQ ID NO: 1687776 - RNA, 19 nt, Salmonella enterica enterica serovar Typhi
ccagguuccccaaugauca

SEQ ID NO: 1687777 - RNA, 21 nt, Salmonella enterica enterica serovar Typhi
ccaggggaugauuuucaggca

SEQ ID NO: 1687778 - RNA, 14 nt, Salmonella enterica enterica serovar Typhi
ccagggcgauuccc

SEQ ID NO: 1687779 - RNA, 19 nt, Salmonella enterica enterica serovar Typhi
ccagggcgggauccccugc

SEQ ID NO: 1687780 - RNA, 20 nt, Salmonella enterica enterica serovar Typhi
ccaggugacuuugcccuuuu

SEQ ID NO: 1687781 - RNA, 21 nt, Salmonella enterica enterica serovar Typhi
ccaggccguggcgcaucuccu

SEQ ID NO: 1687782 - RNA, 21 nt, Salmonella enterica enterica serovar Typhi
ccaggccugaugagcgcagcg

SEQ ID NO: 1687783 - RNA, 20 nt, Salmonella enterica enterica serovar Typhi
ccaggccgucggcgccagcc

SEQ ID NO: 1687784 - RNA, 21 nt, Salmonella enterica enterica serovar Typhi
ccaggccgucggcgccagcca

SEQ ID NO: 1687785 - RNA, 12 nt, Salmonella enterica enterica serovar Typhi
ccaggcagcgcg

SEQ ID NO: 1687786 - RNA, 23 nt, Salmonella enterica enterica serovar Typhi
ccaggcacuugagaaauuauuuu

SEQ ID NO: 1687787 - RNA, 17 nt, Salmonella enterica enterica serovar Typhi
ccaggcgaccagaugca

SEQ ID NO: 1687788 - RNA, 16 nt, Salmonella enterica enterica serovar Typhi
ccaggcgauaccgcgc

SEQ ID NO: 1687789 - RNA, 14 nt, Salmonella enterica enterica serovar Typhi
ccaggcgcgcaccg

SEQ ID NO: 1687790 - RNA, 17 nt, Salmonella enterica enterica serovar Typhi
ccaggcgcgcagcugcc

SEQ ID NO: 1687791 - RNA, 21 nt, Salmonella enterica enterica serovar Typhi
ccagggauuuugcuuuuucgg

SEQ ID NO: 1687792 - RNA, 15 nt, Salmonella enterica enterica serovar Typhi
ccagcucauguaguc

SEQ ID NO: 1687793 - RNA, 14 nt, Salmonella enterica enterica serovar Typhi
ccagcucauuuuua

SEQ ID NO: 1687794 - RNA, 23 nt, Salmonella enterica enterica serovar Typhi
ccagcucaccgagacugcccggc

SEQ ID NO: 1687795 - RNA, 13 nt, Salmonella enterica enterica serovar Typhi
ccagcucauagga

SEQ ID NO: 1687796 - RNA, 16 nt, Salmonella enterica enterica serovar Typhi
ccagcucgucuugugu

SEQ ID NO: 1687797 - RNA, 15 nt, Salmonella enterica enterica serovar Typhi
ccagcucguuauuuc

SEQ ID NO: 1687798 - RNA, 19 nt, Salmonella enterica enterica serovar Typhi
ccagcuccgcgcuuauuga

SEQ ID NO: 1687799 - RNA, 15 nt, Salmonella enterica enterica serovar Typhi
ccagcgugcgcagcg

SEQ ID NO: 1687800 - RNA, 15 nt, Salmonella enterica enterica serovar Typhi
ccagcgugccgagca

SEQ ID NO: 1687801 - RNA, 19 nt, Salmonella enterica enterica serovar Typhi
ccagcgugacccagacaaa

SEQ ID NO: 1687802 - RNA, 18 nt, Salmonella enterica enterica serovar Typhi
ccagcguauaauuaagcu

SEQ ID NO: 1687803 - RNA, 21 nt, Salmonella enterica enterica serovar Typhi
ccagcguauaauuaagcugcg

SEQ ID NO: 1687804 - RNA, 20 nt, Salmonella enterica enterica serovar Typhi
ccagcguaugauagcgagca

SEQ ID NO: 1687805 - RNA, 23 nt, Salmonella enterica enterica serovar Typhi
ccagcguaugauagcgagcaaga

SEQ ID NO: 1687806 - RNA, 15 nt, Salmonella enterica enterica serovar Typhi
ccagcgucacaggcu

SEQ ID NO: 1687807 - RNA, 18 nt, Salmonella enterica enterica serovar Typhi
ccagcguacaucuuccau

SEQ ID NO: 1687808 - RNA, 17 nt, Salmonella enterica enterica serovar Typhi
ccagcguaccacgccgc

SEQ ID NO: 1687809 - RNA, 19 nt, Salmonella enterica enterica serovar Typhi
ccagcguagauucacugug

SEQ ID NO: 1687810 - RNA, 15 nt, Salmonella enterica enterica serovar Typhi
ccagcguagcuaaac

SEQ ID NO: 1687811 - RNA, 20 nt, Salmonella enterica enterica serovar Typhi
ccagcggcgcgcgguuaugc

SEQ ID NO: 1687812 - RNA, 18 nt, Salmonella enterica enterica serovar Typhi
ccagcggcggcuugccuu

SEQ ID NO: 1687813 - RNA, 12 nt, Salmonella enterica enterica serovar Typhi
ccagcggccgcu

SEQ ID NO: 1687814 - RNA, 19 nt, Salmonella enterica enterica serovar Typhi
ccagcggcgccaucaccau

SEQ ID NO: 1687815 - RNA, 13 nt, Salmonella enterica enterica serovar Typhi
ccagcggccagcc

SEQ ID NO: 1687816 - RNA, 15 nt, Salmonella enterica enterica serovar Typhi
ccagcccccugccag

SEQ ID NO: 1687817 - RNA, 21 nt, Salmonella enterica enterica serovar Typhi
ccagccccuucgcuguccauu

SEQ ID NO: 1687818 - RNA, 11 nt, Salmonella enterica enterica serovar Typhi
ccagcuuaaau

SEQ ID NO: 1687819 - RNA, 18 nt, Salmonella enterica enterica serovar Typhi
ccagcuugccgucacagg

SEQ ID NO: 1687820 - RNA, 11 nt, Salmonella enterica enterica serovar Typhi
ccagcuugaau

SEQ ID NO: 1687821 - RNA, 18 nt, Salmonella enterica enterica serovar Typhi
ccagcuguuuaagcgccu

SEQ ID NO: 1687822 - RNA, 23 nt, Salmonella enterica enterica serovar Typhi
ccagcugguuaaccaccucauua

SEQ ID NO: 1687823 - RNA, 23 nt, Salmonella enterica enterica serovar Typhi
ccagcucugccgguugaccggcc

SEQ ID NO: 1687824 - RNA, 12 nt, Salmonella enterica enterica serovar Typhi
ccagcucuucuu

SEQ ID NO: 1687825 - RNA, 14 nt, Salmonella enterica enterica serovar Typhi
ccagcucuucuucg

SEQ ID NO: 1687826 - RNA, 17 nt, Salmonella enterica enterica serovar Typhi
ccagcugacgacgccag

SEQ ID NO: 1687827 - RNA, 15 nt, Salmonella enterica enterica serovar Typhi
ccagcucuucuucgc

SEQ ID NO: 1687828 - RNA, 21 nt, Salmonella enterica enterica serovar Typhi
ccagcucuuuaggcaggaaau

SEQ ID NO: 1687829 - RNA, 14 nt, Salmonella enterica enterica serovar Typhi
ccagcucuuucaau

SEQ ID NO: 1687830 - RNA, 16 nt, Salmonella enterica enterica serovar Typhi
ccaggauaguacugac

SEQ ID NO: 1687831 - RNA, 22 nt, Salmonella enterica enterica serovar Typhi
ccaggauaguacugaccagaca

SEQ ID NO: 1687832 - RNA, 15 nt, Salmonella enterica enterica serovar Typhi
ccaggauaauaauga

SEQ ID NO: 1687833 - RNA, 15 nt, Salmonella enterica enterica serovar Typhi
ccaggagcaaaccga

SEQ ID NO: 1687834 - RNA, 19 nt, Salmonella enterica enterica serovar Typhi
ccaggaguuaaaccuggua

SEQ ID NO: 1687835 - RNA, 14 nt, Salmonella enterica enterica serovar Typhi
ccaggaacuaacuc

SEQ ID NO: 1687836 - RNA, 19 nt, Salmonella enterica enterica serovar Typhi
ccaggaagaguaucucucu

SEQ ID NO: 1687837 - RNA, 17 nt, Salmonella enterica enterica serovar Typhi
ccaguuuuuuccagcgc

SEQ ID NO: 1687838 - RNA, 21 nt, Salmonella enterica enterica serovar Typhi
ccaguuuuugcauuauauuuu

SEQ ID NO: 1687839 - RNA, 20 nt, Salmonella enterica enterica serovar Typhi
ccauaauacuuaauucauaa

SEQ ID NO: 1687840 - RNA, 18 nt, Salmonella enterica enterica serovar Typhi
ccauaauaaugacuaauu

SEQ ID NO: 1687841 - RNA, 12 nt, Salmonella enterica enterica serovar Typhi
ccauaaaaugau

SEQ ID NO: 1687842 - RNA, 18 nt, Salmonella enterica enterica serovar Typhi
ccaguucccccgguuacc

SEQ ID NO: 1687843 - RNA, 12 nt, Salmonella enterica enterica serovar Typhi
ccaguuccccau

SEQ ID NO: 1687844 - RNA, 21 nt, Salmonella enterica enterica serovar Typhi
ccagugugcgguggcaacgcu

SEQ ID NO: 1687845 - RNA, 13 nt, Salmonella enterica enterica serovar Typhi
ccaguggcaaaau

SEQ ID NO: 1687846 - RNA, 15 nt, Salmonella enterica enterica serovar Typhi
ccaguggaugcgcua

SEQ ID NO: 1687847 - RNA, 15 nt, Salmonella enterica enterica serovar Typhi
ccaguacuuucuuuu

SEQ ID NO: 1687848 - RNA, 21 nt, Salmonella enterica enterica serovar Typhi
ccaguacuuuggccuaacagu

SEQ ID NO: 1687849 - RNA, 19 nt, Salmonella enterica enterica serovar Typhi
ccaguuaacagaaugcuga

SEQ ID NO: 1687850 - RNA, 22 nt, Salmonella enterica enterica serovar Typhi
ccaguuaucaggacauaaaaca

SEQ ID NO: 1687851 - RNA, 19 nt, Salmonella enterica enterica serovar Typhi
ccaguuagcgaucgcgccg

SEQ ID NO: 1687852 - RNA, 15 nt, Salmonella enterica enterica serovar Typhi
ccaguaccgccgccg

SEQ ID NO: 1687853 - RNA, 21 nt, Salmonella enterica enterica serovar Typhi
ccaguacgucaacaaugcuuu

SEQ ID NO: 1687854 - RNA, 14 nt, Salmonella enterica enterica serovar Typhi
ccaguaccagcacu

SEQ ID NO: 1687855 - RNA, 17 nt, Salmonella enterica enterica serovar Typhi
ccaguacaaacaaauaa

SEQ ID NO: 1687856 - RNA, 19 nt, Salmonella enterica enterica serovar Typhi
ccaguacaaacaaauaaau

SEQ ID NO: 1687857 - RNA, 14 nt, Salmonella enterica enterica serovar Typhi
ccaguaauuuuucu

SEQ ID NO: 1687858 - RNA, 14 nt, Salmonella enterica enterica serovar Typhi
ccaucaaauaauac

SEQ ID NO: 1687859 - RNA, 16 nt, Salmonella enterica enterica serovar Typhi
ccaucaaacgcagcaa

SEQ ID NO: 1687860 - RNA, 23 nt, Salmonella enterica enterica serovar Typhi
ccauauuuuuucugccaguuucu

SEQ ID NO: 1687861 - RNA, 15 nt, Salmonella enterica enterica serovar Typhi
ccaucaaaaaaaaua

SEQ ID NO: 1687862 - RNA, 18 nt, Salmonella enterica enterica serovar Typhi
ccauauuuaugcagcgcg

SEQ ID NO: 1687863 - RNA, 23 nt, Salmonella enterica enterica serovar Typhi
ccauagcguuuaaaaagcugcau

SEQ ID NO: 1687864 - RNA, 21 nt, Salmonella enterica enterica serovar Typhi
ccauauauuuacugaauaaau

SEQ ID NO: 1687865 - RNA, 14 nt, Salmonella enterica enterica serovar Typhi
ccauauaugaaauc

SEQ ID NO: 1687866 - RNA, 19 nt, Salmonella enterica enterica serovar Typhi
ccauauuguucaguuucaa

SEQ ID NO: 1687867 - RNA, 12 nt, Salmonella enterica enterica serovar Typhi
ccauauugcugu

SEQ ID NO: 1687868 - RNA, 19 nt, Salmonella enterica enterica serovar Typhi
ccauauaacagaauaagcc

SEQ ID NO: 1687869 - RNA, 20 nt, Salmonella enterica enterica serovar Typhi
ccauauagacauacaggaau

SEQ ID NO: 1687870 - RNA, 13 nt, Salmonella enterica enterica serovar Typhi
ccauauacucuuu

SEQ ID NO: 1687871 - RNA, 22 nt, Salmonella enterica enterica serovar Typhi
ccauacgauucagguuuugcug

SEQ ID NO: 1687872 - RNA, 19 nt, Salmonella enterica enterica serovar Typhi
ccauaccuaaugcccgcuu

SEQ ID NO: 1687873 - RNA, 19 nt, Salmonella enterica enterica serovar Typhi
ccauaccggacuccaggca

SEQ ID NO: 1687874 - RNA, 20 nt, Salmonella enterica enterica serovar Typhi
ccauacuauccaacagaagg

SEQ ID NO: 1687875 - RNA, 15 nt, Salmonella enterica enterica serovar Typhi
ccauaccccaucauc

SEQ ID NO: 1687876 - RNA, 17 nt, Salmonella enterica enterica serovar Typhi
ccauaaucgauauaauu

SEQ ID NO: 1687877 - RNA, 21 nt, Salmonella enterica enterica serovar Typhi
ccauagccaacacauaagcca

SEQ ID NO: 1687878 - RNA, 23 nt, Salmonella enterica enterica serovar Typhi
ccauagccaacacauaagccacu

SEQ ID NO: 1687879 - RNA, 22 nt, Salmonella enterica enterica serovar Typhi
ccauagcagcuccgaaacaauc

SEQ ID NO: 1687880 - RNA, 20 nt, Salmonella enterica enterica serovar Typhi
ccauagauaccuucuucacu

SEQ ID NO: 1687881 - RNA, 14 nt, Salmonella enterica enterica serovar Typhi
ccauagacaguacg

SEQ ID NO: 1687882 - RNA, 20 nt, Salmonella enterica enterica serovar Typhi
ccauacuccugccugacaau

SEQ ID NO: 1687883 - RNA, 16 nt, Salmonella enterica enterica serovar Typhi
ccauacuuacugcugu

SEQ ID NO: 1687884 - RNA, 22 nt, Salmonella enterica enterica serovar Typhi
ccauccucauuuuguugcucca

SEQ ID NO: 1687885 - RNA, 16 nt, Salmonella enterica enterica serovar Typhi
ccauccgggccacucu

SEQ ID NO: 1687886 - RNA, 15 nt, Salmonella enterica enterica serovar Typhi
ccauccggcaucucu

SEQ ID NO: 1687887 - RNA, 19 nt, Salmonella enterica enterica serovar Typhi
ccauccggcauuuuucuca

SEQ ID NO: 1687888 - RNA, 16 nt, Salmonella enterica enterica serovar Typhi
ccaucucuuccgcggu

SEQ ID NO: 1687889 - RNA, 22 nt, Salmonella enterica enterica serovar Typhi
ccaucugaacucuuccagauac

SEQ ID NO: 1687890 - RNA, 22 nt, Salmonella enterica enterica serovar Typhi
ccaucgcuuuacguuuggcggc

SEQ ID NO: 1687891 - RNA, 20 nt, Salmonella enterica enterica serovar Typhi
ccaucgccugaugaccgccg

SEQ ID NO: 1687892 - RNA, 21 nt, Salmonella enterica enterica serovar Typhi
ccaucgccugaugaccgccgu

SEQ ID NO: 1687893 - RNA, 18 nt, Salmonella enterica enterica serovar Typhi
ccaucgcgccaucggcuu

SEQ ID NO: 1687894 - RNA, 22 nt, Salmonella enterica enterica serovar Typhi
ccaugccacaacagaagcggcc

SEQ ID NO: 1687895 - RNA, 16 nt, Salmonella enterica enterica serovar Typhi
ccaugcauaaugcagc

SEQ ID NO: 1687896 - RNA, 22 nt, Salmonella enterica enterica serovar Typhi
ccaugcaccagucccagcccca

SEQ ID NO: 1687897 - RNA, 19 nt, Salmonella enterica enterica serovar Typhi
ccaugauucaucccgcugu

SEQ ID NO: 1687898 - RNA, 22 nt, Salmonella enterica enterica serovar Typhi
ccaugccggcuuuccgcaccgc

SEQ ID NO: 1687899 - RNA, 21 nt, Salmonella enterica enterica serovar Typhi
ccaucuggcguugccugcuau

SEQ ID NO: 1687900 - RNA, 15 nt, Salmonella enterica enterica serovar Typhi
ccaucuuccagcauc

SEQ ID NO: 1687901 - RNA, 14 nt, Salmonella enterica enterica serovar Typhi
ccaugauaauaauc

SEQ ID NO: 1687902 - RNA, 15 nt, Salmonella enterica enterica serovar Typhi
ccaugaucgccgcca

SEQ ID NO: 1687903 - RNA, 14 nt, Salmonella enterica enterica serovar Typhi
ccaugaucgucagg

SEQ ID NO: 1687904 - RNA, 15 nt, Salmonella enterica enterica serovar Typhi
ccaugagcgaaacuc

SEQ ID NO: 1687905 - RNA, 14 nt, Salmonella enterica enterica serovar Typhi
ccaugacguucaau

SEQ ID NO: 1687906 - RNA, 22 nt, Salmonella enterica enterica serovar Typhi
ccaugaccaccagcgcgaccgg

SEQ ID NO: 1687907 - RNA, 17 nt, Salmonella enterica enterica serovar Typhi
ccaugacgaccacagcc

SEQ ID NO: 1687908 - RNA, 20 nt, Salmonella enterica enterica serovar Typhi
ccccgcuuucagcguugcag

SEQ ID NO: 1687909 - RNA, 17 nt, Salmonella enterica enterica serovar Typhi
ccccggcuuuauuacuu

SEQ ID NO: 1687910 - RNA, 13 nt, Salmonella enterica enterica serovar Typhi
ccccggcuuccag

SEQ ID NO: 1687911 - RNA, 17 nt, Salmonella enterica enterica serovar Typhi
ccccggcgcccggaggg

SEQ ID NO: 1687912 - RNA, 23 nt, Salmonella enterica enterica serovar Typhi
ccccggcgggguuuuuuuaugcg

SEQ ID NO: 1687913 - RNA, 15 nt, Salmonella enterica enterica serovar Typhi
ccccggcgaaagaaa

SEQ ID NO: 1687914 - RNA, 15 nt, Salmonella enterica enterica serovar Typhi
ccccggccucgcccg

SEQ ID NO: 1687915 - RNA, 16 nt, Salmonella enterica enterica serovar Typhi
ccccuaccgaggcagg

SEQ ID NO: 1687916 - RNA, 22 nt, Salmonella enterica enterica serovar Typhi
ccccugcgguuucuaccaccca

SEQ ID NO: 1687917 - RNA, 14 nt, Salmonella enterica enterica serovar Typhi
ccccuaucuggugc

SEQ ID NO: 1687918 - RNA, 16 nt, Salmonella enterica enterica serovar Typhi
ccccggugagcgccgc

SEQ ID NO: 1687919 - RNA, 14 nt, Salmonella enterica enterica serovar Typhi
ccccgucauauuac

SEQ ID NO: 1687920 - RNA, 12 nt, Salmonella enterica enterica serovar Typhi
ccccgucagucg

SEQ ID NO: 1687921 - RNA, 22 nt, Salmonella enterica enterica serovar Typhi
cccauuugcggguggugugcgu

SEQ ID NO: 1687922 - RNA, 22 nt, Salmonella enterica enterica serovar Typhi
cccauuuaacagauaauuaaua

SEQ ID NO: 1687923 - RNA, 15 nt, Salmonella enterica enterica serovar Typhi
cccauugggccagca

SEQ ID NO: 1687924 - RNA, 15 nt, Salmonella enterica enterica serovar Typhi
cccauugucaucagu

SEQ ID NO: 1687925 - RNA, 21 nt, Salmonella enterica enterica serovar Typhi
cccauugucaucaguaugagc

SEQ ID NO: 1687926 - RNA, 15 nt, Salmonella enterica enterica serovar Typhi
cccauucugcugaug

SEQ ID NO: 1687927 - RNA, 11 nt, Salmonella enterica enterica serovar Typhi
ccccagcgcca

SEQ ID NO: 1687928 - RNA, 17 nt, Salmonella enterica enterica serovar Typhi
ccccagcguaccacgcc

SEQ ID NO: 1687929 - RNA, 13 nt, Salmonella enterica enterica serovar Typhi
ccccagcugcggc

SEQ ID NO: 1687930 - RNA, 13 nt, Salmonella enterica enterica serovar Typhi
ccccagucuuccu

SEQ ID NO: 1687931 - RNA, 14 nt, Salmonella enterica enterica serovar Typhi
ccccauaaauaauc

SEQ ID NO: 1687932 - RNA, 14 nt, Salmonella enterica enterica serovar Typhi
ccccauuaaacugg

SEQ ID NO: 1687933 - RNA, 15 nt, Salmonella enterica enterica serovar Typhi
ccccaugugccuugc

SEQ ID NO: 1687934 - RNA, 19 nt, Salmonella enterica enterica serovar Typhi
cccccgguagccacaccca

SEQ ID NO: 1687935 - RNA, 13 nt, Salmonella enterica enterica serovar Typhi
cccccucggcagc

SEQ ID NO: 1687936 - RNA, 17 nt, Salmonella enterica enterica serovar Typhi
cccccuccauacccuau

SEQ ID NO: 1687937 - RNA, 14 nt, Salmonella enterica enterica serovar Typhi
ccccauucugcuga

SEQ ID NO: 1687938 - RNA, 11 nt, Salmonella enterica enterica serovar Typhi
cccaucccaga

SEQ ID NO: 1687939 - RNA, 14 nt, Salmonella enterica enterica serovar Typhi
cccaucauugacuu

SEQ ID NO: 1687940 - RNA, 21 nt, Salmonella enterica enterica serovar Typhi
cccauccgggccacucuccag

SEQ ID NO: 1687941 - RNA, 17 nt, Salmonella enterica enterica serovar Typhi
cccauccgucaggaugg

SEQ ID NO: 1687942 - RNA, 22 nt, Salmonella enterica enterica serovar Typhi
cccaucaauaacgauaauuuua

SEQ ID NO: 1687943 - RNA, 14 nt, Salmonella enterica enterica serovar Typhi
cccaucgccguagg

SEQ ID NO: 1687944 - RNA, 18 nt, Salmonella enterica enterica serovar Typhi
cccaucguaacgccgucg

SEQ ID NO: 1687945 - RNA, 20 nt, Salmonella enterica enterica serovar Typhi
cccaucgcuuugcagaaaau

SEQ ID NO: 1687946 - RNA, 14 nt, Salmonella enterica enterica serovar Typhi
cccaguggcaaaau

SEQ ID NO: 1687947 - RNA, 18 nt, Salmonella enterica enterica serovar Typhi
cccaguuuuuuucugcca

SEQ ID NO: 1687948 - RNA, 15 nt, Salmonella enterica enterica serovar Typhi
cccauaguagcuaau

SEQ ID NO: 1687949 - RNA, 22 nt, Salmonella enterica enterica serovar Typhi
cccauagaugggccgaguaauc

SEQ ID NO: 1687950 - RNA, 19 nt, Salmonella enterica enterica serovar Typhi
cccauauuccagaaaggau

SEQ ID NO: 1687951 - RNA, 20 nt, Salmonella enterica enterica serovar Typhi
cccauauugauggccacauc

SEQ ID NO: 1687952 - RNA, 13 nt, Salmonella enterica enterica serovar Typhi
cccauaaacaggu

SEQ ID NO: 1687953 - RNA, 19 nt, Salmonella enterica enterica serovar Typhi
cccauaaccgaugcacaug

SEQ ID NO: 1687954 - RNA, 22 nt, Salmonella enterica enterica serovar Typhi
cccauacugacggcgcucuuua

SEQ ID NO: 1687955 - RNA, 22 nt, Salmonella enterica enterica serovar Typhi
cccagcaugggcauccccaugu

SEQ ID NO: 1687956 - RNA, 17 nt, Salmonella enterica enterica serovar Typhi
cccagcaugagccagcc

SEQ ID NO: 1687957 - RNA, 13 nt, Salmonella enterica enterica serovar Typhi
cccagccacgcgu

SEQ ID NO: 1687958 - RNA, 13 nt, Salmonella enterica enterica serovar Typhi
cccagcauuacug

SEQ ID NO: 1687959 - RNA, 14 nt, Salmonella enterica enterica serovar Typhi
cccagccagacgcc

SEQ ID NO: 1687960 - RNA, 22 nt, Salmonella enterica enterica serovar Typhi
cccagcugagcuaaucacccac

SEQ ID NO: 1687961 - RNA, 19 nt, Salmonella enterica enterica serovar Typhi
cccaggauaguacugacca

SEQ ID NO: 1687962 - RNA, 18 nt, Salmonella enterica enterica serovar Typhi
cccaggcgcuauucccag

SEQ ID NO: 1687963 - RNA, 12 nt, Salmonella enterica enterica serovar Typhi
cccaggcgcgca

SEQ ID NO: 1687964 - RNA, 21 nt, Salmonella enterica enterica serovar Typhi
cccaguccuuccggcgagaga

SEQ ID NO: 1687965 - RNA, 18 nt, Salmonella enterica enterica serovar Typhi
cccagucuuccugcggua

SEQ ID NO: 1687966 - RNA, 17 nt, Salmonella enterica enterica serovar Typhi
cccagugccaccagccg

SEQ ID NO: 1687967 - RNA, 18 nt, Salmonella enterica enterica serovar Typhi
cccagugccaccagccgg

SEQ ID NO: 1687968 - RNA, 14 nt, Salmonella enterica enterica serovar Typhi
cccaguaccagcac

SEQ ID NO: 1687969 - RNA, 22 nt, Salmonella enterica enterica serovar Typhi
cccagucauucucuuucugcgc

SEQ ID NO: 1687970 - RNA, 13 nt, Salmonella enterica enterica serovar Typhi
cccaggcguccag

SEQ ID NO: 1687971 - RNA, 19 nt, Salmonella enterica enterica serovar Typhi
cccaggcggguagucccag

SEQ ID NO: 1687972 - RNA, 20 nt, Salmonella enterica enterica serovar Typhi
cccagguuucaaugccgccg

SEQ ID NO: 1687973 - RNA, 21 nt, Salmonella enterica enterica serovar Typhi
cccagguuugaggcuugcagc

SEQ ID NO: 1687974 - RNA, 19 nt, Salmonella enterica enterica serovar Typhi
cccaguaaauuaacgcgaa

SEQ ID NO: 1687975 - RNA, 16 nt, Salmonella enterica enterica serovar Typhi
cccaguaauccggcaa

SEQ ID NO: 1687976 - RNA, 18 nt, Salmonella enterica enterica serovar Typhi
cccaguaauccggcaacu

SEQ ID NO: 1687977 - RNA, 15 nt, Salmonella enterica enterica serovar Typhi
ccaugcuuucaauaa

SEQ ID NO: 1687978 - RNA, 23 nt, Salmonella enterica enterica serovar Typhi
ccaugcugugugaccagcaguuc

SEQ ID NO: 1687979 - RNA, 17 nt, Salmonella enterica enterica serovar Typhi
ccauggagagugagcca

SEQ ID NO: 1687980 - RNA, 21 nt, Salmonella enterica enterica serovar Typhi
ccauggaacauccucuccuga

SEQ ID NO: 1687981 - RNA, 14 nt, Salmonella enterica enterica serovar Typhi
ccauggccgcagcc

SEQ ID NO: 1687982 - RNA, 16 nt, Salmonella enterica enterica serovar Typhi
ccauggcaggcagcac

SEQ ID NO: 1687983 - RNA, 15 nt, Salmonella enterica enterica serovar Typhi
ccaugcuauucagca

SEQ ID NO: 1687984 - RNA, 22 nt, Salmonella enterica enterica serovar Typhi
ccaugcuauccgccgccagcca

SEQ ID NO: 1687985 - RNA, 19 nt, Salmonella enterica enterica serovar Typhi
ccaugcgacuaaccugauc

SEQ ID NO: 1687986 - RNA, 21 nt, Salmonella enterica enterica serovar Typhi
ccaugcggcugaguucaggca

SEQ ID NO: 1687987 - RNA, 23 nt, Salmonella enterica enterica serovar Typhi
ccauggucagacgcucagccuua

SEQ ID NO: 1687988 - RNA, 17 nt, Salmonella enterica enterica serovar Typhi
ccaugggucucauccau

SEQ ID NO: 1687989 - RNA, 14 nt, Salmonella enterica enterica serovar Typhi
ccauguacuccuga

SEQ ID NO: 1687990 - RNA, 23 nt, Salmonella enterica enterica serovar Typhi
ccaugguucacaauacagaacau

SEQ ID NO: 1687991 - RNA, 19 nt, Salmonella enterica enterica serovar Typhi
ccaugguucccgccacuga

SEQ ID NO: 1687992 - RNA, 18 nt, Salmonella enterica enterica serovar Typhi
ccaugucagcgcaaagcc

SEQ ID NO: 1687993 - RNA, 15 nt, Salmonella enterica enterica serovar Typhi
ccauguucauaaagu

SEQ ID NO: 1687994 - RNA, 21 nt, Salmonella enterica enterica serovar Typhi
ccauguugagcgcuugcugcg

SEQ ID NO: 1687995 - RNA, 19 nt, Salmonella enterica enterica serovar Typhi
ccauguugcguaaauaaau

SEQ ID NO: 1687996 - RNA, 18 nt, Salmonella enterica enterica serovar Typhi
ccauguugcguaaauaaa

SEQ ID NO: 1687997 - RNA, 23 nt, Salmonella enterica enterica serovar Typhi
ccauguuuuauacucaaaaaauc

SEQ ID NO: 1687998 - RNA, 14 nt, Salmonella enterica enterica serovar Typhi
ccauguuuguuuaa

SEQ ID NO: 1687999 - RNA, 16 nt, Salmonella enterica enterica serovar Typhi
ccauguuuaccaucgc

SEQ ID NO: 1688000 - RNA, 14 nt, Salmonella enterica enterica serovar Typhi
ccauucaaccagcc

SEQ ID NO: 1688001 - RNA, 15 nt, Salmonella enterica enterica serovar Typhi
ccauucaacacauuc

SEQ ID NO: 1688002 - RNA, 24 nt, Salmonella enterica enterica serovar Typhi
ccauuauuuauuuucauacuauuu

SEQ ID NO: 1688003 - RNA, 17 nt, Salmonella enterica enterica serovar Typhi
ccauuauuguguucuca

SEQ ID NO: 1688004 - RNA, 16 nt, Salmonella enterica enterica serovar Typhi
ccauuauuuauuuuca

SEQ ID NO: 1688005 - RNA, 17 nt, Salmonella enterica enterica serovar Typhi
ccauuaugcucaccgcg

SEQ ID NO: 1688006 - RNA, 12 nt, Salmonella enterica enterica serovar Typhi
ccauuauucgga

SEQ ID NO: 1688007 - RNA, 13 nt, Salmonella enterica enterica serovar Typhi
ccauuagcuguug

SEQ ID NO: 1688008 - RNA, 14 nt, Salmonella enterica enterica serovar Typhi
ccauuacgcccccu

SEQ ID NO: 1688009 - RNA, 21 nt, Salmonella enterica enterica serovar Typhi
ccauugggggguuagugcugu

SEQ ID NO: 1688010 - RNA, 21 nt, Salmonella enterica enterica serovar Typhi
ccauuggcuauuuuuugcugg

SEQ ID NO: 1688011 - RNA, 18 nt, Salmonella enterica enterica serovar Typhi
ccauugcugaggaucacc

SEQ ID NO: 1688012 - RNA, 16 nt, Salmonella enterica enterica serovar Typhi
ccauugcuuuuuugau

SEQ ID NO: 1688013 - RNA, 19 nt, Salmonella enterica enterica serovar Typhi
ccauucuuucgcguaaaca

SEQ ID NO: 1688014 - RNA, 15 nt, Salmonella enterica enterica serovar Typhi
ccauucgcccaguca

SEQ ID NO: 1688015 - RNA, 18 nt, Salmonella enterica enterica serovar Typhi
ccauucccguaaaagaag

SEQ ID NO: 1688016 - RNA, 14 nt, Salmonella enterica enterica serovar Typhi
ccauuccaggucau

SEQ ID NO: 1688017 - RNA, 14 nt, Salmonella enterica enterica serovar Typhi
ccauucccaccaua

SEQ ID NO: 1688018 - RNA, 13 nt, Salmonella enterica enterica serovar Typhi
ccauucccagccg

SEQ ID NO: 1688019 - RNA, 14 nt, Salmonella enterica enterica serovar Typhi
ccauucccguaaaa

SEQ ID NO: 1688020 - RNA, 15 nt, Salmonella enterica enterica serovar Typhi
ccauuccccacgcca

SEQ ID NO: 1688021 - RNA, 22 nt, Salmonella enterica enterica serovar Typhi
cccaaucuugcguaccacguua

SEQ ID NO: 1688022 - RNA, 21 nt, Salmonella enterica enterica serovar Typhi
cccacaguaauggacagguaa

SEQ ID NO: 1688023 - RNA, 20 nt, Salmonella enterica enterica serovar Typhi
cccaccauaaagcgaauaau

SEQ ID NO: 1688024 - RNA, 15 nt, Salmonella enterica enterica serovar Typhi
cccaccaucacuucc

SEQ ID NO: 1688025 - RNA, 16 nt, Salmonella enterica enterica serovar Typhi
cccaccaucacuucca

SEQ ID NO: 1688026 - RNA, 16 nt, Salmonella enterica enterica serovar Typhi
cccaccauaggccagc

SEQ ID NO: 1688027 - RNA, 13 nt, Salmonella enterica enterica serovar Typhi
cccaccgacacaa

SEQ ID NO: 1688028 - RNA, 11 nt, Salmonella enterica enterica serovar Typhi
cccaauaauga

SEQ ID NO: 1688029 - RNA, 14 nt, Salmonella enterica enterica serovar Typhi
cccaauaaugaacg

SEQ ID NO: 1688030 - RNA, 23 nt, Salmonella enterica enterica serovar Typhi
cccaauaaugaacgagcaauaac

SEQ ID NO: 1688031 - RNA, 15 nt, Salmonella enterica enterica serovar Typhi
cccaauaccacaacc

SEQ ID NO: 1688032 - RNA, 15 nt, Salmonella enterica enterica serovar Typhi
cccaacugagcgcca

SEQ ID NO: 1688033 - RNA, 14 nt, Salmonella enterica enterica serovar Typhi
cccaagaacaugac

SEQ ID NO: 1688034 - RNA, 17 nt, Salmonella enterica enterica serovar Typhi
cccaacgacagcacuac

SEQ ID NO: 1688035 - RNA, 15 nt, Salmonella enterica enterica serovar Typhi
cccaacgaccauaaa

SEQ ID NO: 1688036 - RNA, 17 nt, Salmonella enterica enterica serovar Typhi
cccaccgccaaccgccc

SEQ ID NO: 1688037 - RNA, 21 nt, Salmonella enterica enterica serovar Typhi
cccacgauacgccccugcugg

SEQ ID NO: 1688038 - RNA, 19 nt, Salmonella enterica enterica serovar Typhi
cccacgacgcgguacccac

SEQ ID NO: 1688039 - RNA, 14 nt, Salmonella enterica enterica serovar Typhi
cccacgcccgccau

SEQ ID NO: 1688040 - RNA, 15 nt, Salmonella enterica enterica serovar Typhi
cccacugauaaaauu

SEQ ID NO: 1688041 - RNA, 14 nt, Salmonella enterica enterica serovar Typhi
cccacgccagcagc

SEQ ID NO: 1688042 - RNA, 18 nt, Salmonella enterica enterica serovar Typhi
cccacgcauaguccugcc

SEQ ID NO: 1688043 - RNA, 17 nt, Salmonella enterica enterica serovar Typhi
cccacgcauaguccugc

SEQ ID NO: 1688044 - RNA, 22 nt, Salmonella enterica enterica serovar Typhi
cccacgcaaaauggccugcugg

SEQ ID NO: 1688045 - RNA, 20 nt, Salmonella enterica enterica serovar Typhi
cccacuuauggucguauuuu

SEQ ID NO: 1688046 - RNA, 19 nt, Salmonella enterica enterica serovar Typhi
cccagaaaauuaacgacaa

SEQ ID NO: 1688047 - RNA, 17 nt, Salmonella enterica enterica serovar Typhi
cccacuuuacacgcgcu

SEQ ID NO: 1688048 - RNA, 16 nt, Salmonella enterica enterica serovar Typhi
cccagaaugccgccca

SEQ ID NO: 1688049 - RNA, 18 nt, Salmonella enterica enterica serovar Typhi
cccacuuugcucaccacg

SEQ ID NO: 1688050 - RNA, 16 nt, Salmonella enterica enterica serovar Typhi
cccagaauccgcgcau

SEQ ID NO: 1688051 - RNA, 20 nt, Salmonella enterica enterica serovar Typhi
cccagauguugauacagaaa

SEQ ID NO: 1688052 - RNA, 14 nt, Salmonella enterica enterica serovar Typhi
cccagcaaaccggc

SEQ ID NO: 1688053 - RNA, 20 nt, Salmonella enterica enterica serovar Typhi
cccagagucacuagcacuac

SEQ ID NO: 1688054 - RNA, 23 nt, Salmonella enterica enterica serovar Typhi
cccagauaucaggauugaugguc

SEQ ID NO: 1688055 - RNA, 20 nt, Salmonella enterica enterica serovar Typhi
cgacccgcugcgugaaaagg

SEQ ID NO: 1688056 - RNA, 12 nt, Salmonella enterica enterica serovar Typhi
cgaccgcagcag

SEQ ID NO: 1688057 - RNA, 21 nt, Salmonella enterica enterica serovar Typhi
cgaccggauuggucugauuca

SEQ ID NO: 1688058 - RNA, 20 nt, Salmonella enterica enterica serovar Typhi
cgaccggcacucaccucuuc

SEQ ID NO: 1688059 - RNA, 14 nt, Salmonella enterica enterica serovar Typhi
cgaccggauugguc

SEQ ID NO: 1688060 - RNA, 18 nt, Salmonella enterica enterica serovar Typhi
cgaccgguccaccggggg

SEQ ID NO: 1688061 - RNA, 15 nt, Salmonella enterica enterica serovar Typhi
cgaccgucagcagca

SEQ ID NO: 1688062 - RNA, 22 nt, Salmonella enterica enterica serovar Typhi
cgaccgugauuuuuaccgccgg

SEQ ID NO: 1688063 - RNA, 17 nt, Salmonella enterica enterica serovar Typhi
cgaccugcauauuuuuc

SEQ ID NO: 1688064 - RNA, 20 nt, Salmonella enterica enterica serovar Typhi
cgacgcccugcccaugaagc

SEQ ID NO: 1688065 - RNA, 12 nt, Salmonella enterica enterica serovar Typhi
cgacgcauugag

SEQ ID NO: 1688066 - RNA, 20 nt, Salmonella enterica enterica serovar Typhi
cgacgcauugagacaugccg

SEQ ID NO: 1688067 - RNA, 17 nt, Salmonella enterica enterica serovar Typhi
cgacgcauuucuccuga

SEQ ID NO: 1688068 - RNA, 20 nt, Salmonella enterica enterica serovar Typhi
cgacgagguuuccggcggga

SEQ ID NO: 1688069 - RNA, 22 nt, Salmonella enterica enterica serovar Typhi
cgacgagguuuccggcgggagc

SEQ ID NO: 1688070 - RNA, 13 nt, Salmonella enterica enterica serovar Typhi
cgacgacuucacc

SEQ ID NO: 1688071 - RNA, 14 nt, Salmonella enterica enterica serovar Typhi
cgaccuucacgccg

SEQ ID NO: 1688072 - RNA, 14 nt, Salmonella enterica enterica serovar Typhi
cgaccuuauuccca

SEQ ID NO: 1688073 - RNA, 17 nt, Salmonella enterica enterica serovar Typhi
cgaccagcagcgggcug

SEQ ID NO: 1688074 - RNA, 15 nt, Salmonella enterica enterica serovar Typhi
cgaccagacacggug

SEQ ID NO: 1688075 - RNA, 15 nt, Salmonella enterica enterica serovar Typhi
cgaccacccgcgacc

SEQ ID NO: 1688076 - RNA, 13 nt, Salmonella enterica enterica serovar Typhi
cgaccacgccacc

SEQ ID NO: 1688077 - RNA, 13 nt, Salmonella enterica enterica serovar Typhi
cgaccacggccac

SEQ ID NO: 1688078 - RNA, 15 nt, Salmonella enterica enterica serovar Typhi
cgaccacuccggcau

SEQ ID NO: 1688079 - RNA, 17 nt, Salmonella enterica enterica serovar Typhi
cgaccacuucaacgccg

SEQ ID NO: 1688080 - RNA, 21 nt, Salmonella enterica enterica serovar Typhi
cgaccauaaauagccgaccgc

SEQ ID NO: 1688081 - RNA, 20 nt, Salmonella enterica enterica serovar Typhi
cgaccaugguucccgccacu

SEQ ID NO: 1688082 - RNA, 16 nt, Salmonella enterica enterica serovar Typhi
cgacccgcaucgccgc

SEQ ID NO: 1688083 - RNA, 21 nt, Salmonella enterica enterica serovar Typhi
cgaccauuggcaccaccagga

SEQ ID NO: 1688084 - RNA, 13 nt, Salmonella enterica enterica serovar Typhi
cgacccacaaugg

SEQ ID NO: 1688085 - RNA, 24 nt, Salmonella enterica enterica serovar Typhi
cgacaucgccaguugcagauuacu

SEQ ID NO: 1688086 - RNA, 15 nt, Salmonella enterica enterica serovar Typhi
cgacaucgccaccgc

SEQ ID NO: 1688087 - RNA, 12 nt, Salmonella enterica enterica serovar Typhi
cgacaucgccag

SEQ ID NO: 1688088 - RNA, 12 nt, Salmonella enterica enterica serovar Typhi
cgacaucagaug

SEQ ID NO: 1688089 - RNA, 12 nt, Salmonella enterica enterica serovar Typhi
cgacaucagcca

SEQ ID NO: 1688090 - RNA, 15 nt, Salmonella enterica enterica serovar Typhi
cgacauagccuuugu

SEQ ID NO: 1688091 - RNA, 19 nt, Salmonella enterica enterica serovar Typhi
cgacauuuuuguuaauauu

SEQ ID NO: 1688092 - RNA, 17 nt, Salmonella enterica enterica serovar Typhi
cgacauucgauguuacu

SEQ ID NO: 1688093 - RNA, 18 nt, Salmonella enterica enterica serovar Typhi
cgacaugcuccugcaucu

SEQ ID NO: 1688094 - RNA, 17 nt, Salmonella enterica enterica serovar Typhi
cgacaugucaugacuua

SEQ ID NO: 1688095 - RNA, 17 nt, Salmonella enterica enterica serovar Typhi
cgacaucuuuuccugaa

SEQ ID NO: 1688096 - RNA, 21 nt, Salmonella enterica enterica serovar Typhi
cgacagccgcguuuugccgcu

SEQ ID NO: 1688097 - RNA, 20 nt, Salmonella enterica enterica serovar Typhi
cgacagccagcauuuccagc

SEQ ID NO: 1688098 - RNA, 13 nt, Salmonella enterica enterica serovar Typhi
cgacagcccccau

SEQ ID NO: 1688099 - RNA, 17 nt, Salmonella enterica enterica serovar Typhi
cgacagggcgugaacca

SEQ ID NO: 1688100 - RNA, 19 nt, Salmonella enterica enterica serovar Typhi
cgacaggguuugccagcac

SEQ ID NO: 1688101 - RNA, 17 nt, Salmonella enterica enterica serovar Typhi
cgacauaaaacccgccu

SEQ ID NO: 1688102 - RNA, 16 nt, Salmonella enterica enterica serovar Typhi
cgacauaaccggcaac

SEQ ID NO: 1688103 - RNA, 17 nt, Salmonella enterica enterica serovar Typhi
cgacaguucccggcaac

SEQ ID NO: 1688104 - RNA, 16 nt, Salmonella enterica enterica serovar Typhi
cgacaguaacugcaaa

SEQ ID NO: 1688105 - RNA, 18 nt, Salmonella enterica enterica serovar Typhi
cgacaguacgguaauucc

SEQ ID NO: 1688106 - RNA, 13 nt, Salmonella enterica enterica serovar Typhi
cgacaguaacugc

SEQ ID NO: 1688107 - RNA, 22 nt, Salmonella enterica enterica serovar Typhi
cgaauuccuuuuuccgccaccu

SEQ ID NO: 1688108 - RNA, 22 nt, Salmonella enterica enterica serovar Typhi
cgaaugugcaccuuaaccgucu

SEQ ID NO: 1688109 - RNA, 22 nt, Salmonella enterica enterica serovar Typhi
cgaaucgccuguaccgggcaga

SEQ ID NO: 1688110 - RNA, 18 nt, Salmonella enterica enterica serovar Typhi
cgaaugcgccagcgagac

SEQ ID NO: 1688111 - RNA, 19 nt, Salmonella enterica enterica serovar Typhi
cgaauggccuccagcagca

SEQ ID NO: 1688112 - RNA, 17 nt, Salmonella enterica enterica serovar Typhi
cgaauaacgccagguag

SEQ ID NO: 1688113 - RNA, 13 nt, Salmonella enterica enterica serovar Typhi
cgaauaauuauuu

SEQ ID NO: 1688114 - RNA, 16 nt, Salmonella enterica enterica serovar Typhi
cgaauaauuauuuucg

SEQ ID NO: 1688115 - RNA, 22 nt, Salmonella enterica enterica serovar Typhi
cgaauacuacugguggaauaaa

SEQ ID NO: 1688116 - RNA, 21 nt, Salmonella enterica enterica serovar Typhi
cgaauagaguaauacauccau

SEQ ID NO: 1688117 - RNA, 19 nt, Salmonella enterica enterica serovar Typhi
cgaauccccaucuccagac

SEQ ID NO: 1688118 - RNA, 12 nt, Salmonella enterica enterica serovar Typhi
cgaauccggggg

SEQ ID NO: 1688119 - RNA, 18 nt, Salmonella enterica enterica serovar Typhi
cgaauccccaucuccaga

SEQ ID NO: 1688120 - RNA, 13 nt, Salmonella enterica enterica serovar Typhi
cgaauccagcagg

SEQ ID NO: 1688121 - RNA, 21 nt, Salmonella enterica enterica serovar Typhi
cgaaucgacaauccgccacgc

SEQ ID NO: 1688122 - RNA, 12 nt, Salmonella enterica enterica serovar Typhi
cgaauccuccug

SEQ ID NO: 1688123 - RNA, 13 nt, Salmonella enterica enterica serovar Typhi
cgaauccuccugu

SEQ ID NO: 1688124 - RNA, 23 nt, Salmonella enterica enterica serovar Typhi
cgacagaauaugcauauucauau

SEQ ID NO: 1688125 - RNA, 19 nt, Salmonella enterica enterica serovar Typhi
cgacagauuggucagcagc

SEQ ID NO: 1688126 - RNA, 21 nt, Salmonella enterica enterica serovar Typhi
cgacacgcgcgcugcgccugg

SEQ ID NO: 1688127 - RNA, 18 nt, Salmonella enterica enterica serovar Typhi
cgacacggcgcagauauu

SEQ ID NO: 1688128 - RNA, 15 nt, Salmonella enterica enterica serovar Typhi
cgacacuccgcgcau

SEQ ID NO: 1688129 - RNA, 19 nt, Salmonella enterica enterica serovar Typhi
cgacacccgauacacgccg

SEQ ID NO: 1688130 - RNA, 15 nt, Salmonella enterica enterica serovar Typhi
cgacacaacggcaca

SEQ ID NO: 1688131 - RNA, 17 nt, Salmonella enterica enterica serovar Typhi
cgacaauguccgccaga

SEQ ID NO: 1688132 - RNA, 21 nt, Salmonella enterica enterica serovar Typhi
cgacacauucaggcuuuccac

SEQ ID NO: 1688133 - RNA, 14 nt, Salmonella enterica enterica serovar Typhi
cgacacaucaucgc

SEQ ID NO: 1688134 - RNA, 15 nt, Salmonella enterica enterica serovar Typhi
cgacacauccugcgg

SEQ ID NO: 1688135 - RNA, 13 nt, Salmonella enterica enterica serovar Typhi
cgacacaucaucg

SEQ ID NO: 1688136 - RNA, 18 nt, Salmonella enterica enterica serovar Typhi
cgacaaaccacugcugua

SEQ ID NO: 1688137 - RNA, 16 nt, Salmonella enterica enterica serovar Typhi
cgacaaacuccagcuc

SEQ ID NO: 1688138 - RNA, 15 nt, Salmonella enterica enterica serovar Typhi
cgacaaacagcgccc

SEQ ID NO: 1688139 - RNA, 23 nt, Salmonella enterica enterica serovar Typhi
cgacaaaacuuuuggugcccauc

SEQ ID NO: 1688140 - RNA, 20 nt, Salmonella enterica enterica serovar Typhi
cgacaaaaccguucugagcg

SEQ ID NO: 1688141 - RNA, 14 nt, Salmonella enterica enterica serovar Typhi
cgaauugucgguuu

SEQ ID NO: 1688142 - RNA, 15 nt, Salmonella enterica enterica serovar Typhi
cgaauuucaccaccg

SEQ ID NO: 1688143 - RNA, 15 nt, Salmonella enterica enterica serovar Typhi
cgaauuucacgcagc

SEQ ID NO: 1688144 - RNA, 21 nt, Salmonella enterica enterica serovar Typhi
cgaauuuauaagccugagcgc

SEQ ID NO: 1688145 - RNA, 12 nt, Salmonella enterica enterica serovar Typhi
cgaauuuccagc

SEQ ID NO: 1688146 - RNA, 19 nt, Salmonella enterica enterica serovar Typhi
cgacaagcuaauccccagc

SEQ ID NO: 1688147 - RNA, 23 nt, Salmonella enterica enterica serovar Typhi
cgacaagaagauuucuuaauucc

SEQ ID NO: 1688148 - RNA, 21 nt, Salmonella enterica enterica serovar Typhi
cgacaacuucuaauuuuucca

SEQ ID NO: 1688149 - RNA, 23 nt, Salmonella enterica enterica serovar Typhi
cgacaacuucuaauuuuuccagc

SEQ ID NO: 1688150 - RNA, 22 nt, Salmonella enterica enterica serovar Typhi
cgacaaagcguggggaaaaccc

SEQ ID NO: 1688151 - RNA, 13 nt, Salmonella enterica enterica serovar Typhi
cgacaaagccgac

SEQ ID NO: 1688152 - RNA, 15 nt, Salmonella enterica enterica serovar Typhi
cgacaacaaguccaa

SEQ ID NO: 1688153 - RNA, 18 nt, Salmonella enterica enterica serovar Typhi
cgacaacgccuccugccg

SEQ ID NO: 1688154 - RNA, 15 nt, Salmonella enterica enterica serovar Typhi
cgaagaucagugaga

SEQ ID NO: 1688155 - RNA, 13 nt, Salmonella enterica enterica serovar Typhi
cgaagaugaggag

SEQ ID NO: 1688156 - RNA, 18 nt, Salmonella enterica enterica serovar Typhi
cgaacggcuuuccagcag

SEQ ID NO: 1688157 - RNA, 12 nt, Salmonella enterica enterica serovar Typhi
cgaacggccuga

SEQ ID NO: 1688158 - RNA, 15 nt, Salmonella enterica enterica serovar Typhi
cgaacugauggcgcu

SEQ ID NO: 1688159 - RNA, 13 nt, Salmonella enterica enterica serovar Typhi
cgaacugauggcg

SEQ ID NO: 1688160 - RNA, 18 nt, Salmonella enterica enterica serovar Typhi
cgaacugauggcgcuaag

SEQ ID NO: 1688161 - RNA, 19 nt, Salmonella enterica enterica serovar Typhi
cgaacuucauccacgccga

SEQ ID NO: 1688162 - RNA, 16 nt, Salmonella enterica enterica serovar Typhi
cgaacuucauccacgc

SEQ ID NO: 1688163 - RNA, 15 nt, Salmonella enterica enterica serovar Typhi
cgaaggaagauagcg

SEQ ID NO: 1688164 - RNA, 23 nt, Salmonella enterica enterica serovar Typhi
cgaagccgcgggcgguauuacau

SEQ ID NO: 1688165 - RNA, 14 nt, Salmonella enterica enterica serovar Typhi
cgaagcgcggcagu

SEQ ID NO: 1688166 - RNA, 22 nt, Salmonella enterica enterica serovar Typhi
cgaagugcagcguuuccagcca

SEQ ID NO: 1688167 - RNA, 14 nt, Salmonella enterica enterica serovar Typhi
cgaagucgccaccc

SEQ ID NO: 1688168 - RNA, 18 nt, Salmonella enterica enterica serovar Typhi
cgaagggggccgggaaag

SEQ ID NO: 1688169 - RNA, 18 nt, Salmonella enterica enterica serovar Typhi
cgaagguaaacgcgacca

SEQ ID NO: 1688170 - RNA, 16 nt, Salmonella enterica enterica serovar Typhi
ccuucgucaaaauggg

SEQ ID NO: 1688171 - RNA, 17 nt, Salmonella enterica enterica serovar Typhi
ccuucgguuuuauauuc

SEQ ID NO: 1688172 - RNA, 14 nt, Salmonella enterica enterica serovar Typhi
ccuucuccacucau

SEQ ID NO: 1688173 - RNA, 18 nt, Salmonella enterica enterica serovar Typhi
ccuucugguagccagaca

SEQ ID NO: 1688174 - RNA, 19 nt, Salmonella enterica enterica serovar Typhi
ccuucugguagccagacau

SEQ ID NO: 1688175 - RNA, 20 nt, Salmonella enterica enterica serovar Typhi
ccuucuucccauauuuuuuc

SEQ ID NO: 1688176 - RNA, 12 nt, Salmonella enterica enterica serovar Typhi
ccuucuuccccc

SEQ ID NO: 1688177 - RNA, 14 nt, Salmonella enterica enterica serovar Typhi
ccuucuucccccug

SEQ ID NO: 1688178 - RNA, 17 nt, Salmonella enterica enterica serovar Typhi
ccuucucugucgagcau

SEQ ID NO: 1688179 - RNA, 22 nt, Salmonella enterica enterica serovar Typhi
ccuucucuccuagaaacccauu

SEQ ID NO: 1688180 - RNA, 21 nt, Salmonella enterica enterica serovar Typhi
ccuucugcgcccgccugcugu

SEQ ID NO: 1688181 - RNA, 19 nt, Salmonella enterica enterica serovar Typhi
ccuugaaguuauccagcgc

SEQ ID NO: 1688182 - RNA, 20 nt, Salmonella enterica enterica serovar Typhi
ccuugaaguuauccagcgcc

SEQ ID NO: 1688183 - RNA, 12 nt, Salmonella enterica enterica serovar Typhi
ccuucuuuuacu

SEQ ID NO: 1688184 - RNA, 21 nt, Salmonella enterica enterica serovar Typhi
ccuucuuuauucacuuuuucu

SEQ ID NO: 1688185 - RNA, 20 nt, Salmonella enterica enterica serovar Typhi
ccuucuuuauucacuuuuuc

SEQ ID NO: 1688186 - RNA, 17 nt, Salmonella enterica enterica serovar Typhi
ccuucuucgccgucaua

SEQ ID NO: 1688187 - RNA, 19 nt, Salmonella enterica enterica serovar Typhi
ccuuccgcaagcucaccau

SEQ ID NO: 1688188 - RNA, 22 nt, Salmonella enterica enterica serovar Typhi
ccuuccgcaagcucaccaucuu

SEQ ID NO: 1688189 - RNA, 19 nt, Salmonella enterica enterica serovar Typhi
ccuuccucauuuuugccca

SEQ ID NO: 1688190 - RNA, 15 nt, Salmonella enterica enterica serovar Typhi
ccuuccagaaauaaa

SEQ ID NO: 1688191 - RNA, 20 nt, Salmonella enterica enterica serovar Typhi
ccuguggcuguugguuuauu

SEQ ID NO: 1688192 - RNA, 18 nt, Salmonella enterica enterica serovar Typhi
ccuguguaaugaaagaaa

SEQ ID NO: 1688193 - RNA, 19 nt, Salmonella enterica enterica serovar Typhi
ccuguguuacgccaauaau

SEQ ID NO: 1688194 - RNA, 20 nt, Salmonella enterica enterica serovar Typhi
ccuucggccuccgcuuccug

SEQ ID NO: 1688195 - RNA, 18 nt, Salmonella enterica enterica serovar Typhi
ccuucgggcgauuuuugc

SEQ ID NO: 1688196 - RNA, 19 nt, Salmonella enterica enterica serovar Typhi
ccuucgccggguugagcga

SEQ ID NO: 1688197 - RNA, 13 nt, Salmonella enterica enterica serovar Typhi
ccuucgccuucac

SEQ ID NO: 1688198 - RNA, 16 nt, Salmonella enterica enterica serovar Typhi
ccuucgcccggcgcgc

SEQ ID NO: 1688199 - RNA, 20 nt, Salmonella enterica enterica serovar Typhi
ccuucgcggugaucccaggc

SEQ ID NO: 1688200 - RNA, 14 nt, Salmonella enterica enterica serovar Typhi
ccuucgcccucgcc

SEQ ID NO: 1688201 - RNA, 14 nt, Salmonella enterica enterica serovar Typhi
ccuucgcccggcgc

SEQ ID NO: 1688202 - RNA, 17 nt, Salmonella enterica enterica serovar Typhi
ccuucgaugaucaugcg

SEQ ID NO: 1688203 - RNA, 17 nt, Salmonella enterica enterica serovar Typhi
ccuucgaccgucagcag

SEQ ID NO: 1688204 - RNA, 17 nt, Salmonella enterica enterica serovar Typhi
ccuuccuguggaaggca

SEQ ID NO: 1688205 - RNA, 24 nt, Salmonella enterica enterica serovar Typhi
ccuucgauaguccauuuuccuaug

SEQ ID NO: 1688206 - RNA, 14 nt, Salmonella enterica enterica serovar Typhi
ccuuguaagggagg

SEQ ID NO: 1688207 - RNA, 12 nt, Salmonella enterica enterica serovar Typhi
ccuuguuuuaac

SEQ ID NO: 1688208 - RNA, 18 nt, Salmonella enterica enterica serovar Typhi
ccuuuaaccucuuuuuca

SEQ ID NO: 1688209 - RNA, 19 nt, Salmonella enterica enterica serovar Typhi
ccuuuaaccucuuuuucau

SEQ ID NO: 1688210 - RNA, 22 nt, Salmonella enterica enterica serovar Typhi
ccuuuaacgccuucauauuaaa

SEQ ID NO: 1688211 - RNA, 18 nt, Salmonella enterica enterica serovar Typhi
ccuuuacugacaauaagu

SEQ ID NO: 1688212 - RNA, 17 nt, Salmonella enterica enterica serovar Typhi
ccuugagcaaaacaccg

SEQ ID NO: 1688213 - RNA, 22 nt, Salmonella enterica enterica serovar Typhi
ccuugagcaaaacaccgcucaa

SEQ ID NO: 1688214 - RNA, 21 nt, Salmonella enterica enterica serovar Typhi
ccuugcuggccuguucaagug

SEQ ID NO: 1688215 - RNA, 18 nt, Salmonella enterica enterica serovar Typhi
ccuugcgggauacaugcc

SEQ ID NO: 1688216 - RNA, 23 nt, Salmonella enterica enterica serovar Typhi
ccuugcgggcaugggaaauaacg

SEQ ID NO: 1688217 - RNA, 14 nt, Salmonella enterica enterica serovar Typhi
ccuugcgcagccag

SEQ ID NO: 1688218 - RNA, 20 nt, Salmonella enterica enterica serovar Typhi
ccuugcccguauugaagcga

SEQ ID NO: 1688219 - RNA, 15 nt, Salmonella enterica enterica serovar Typhi
ccuuucggacuuccu

SEQ ID NO: 1688220 - RNA, 13 nt, Salmonella enterica enterica serovar Typhi
ccuuuccugugcu

SEQ ID NO: 1688221 - RNA, 14 nt, Salmonella enterica enterica serovar Typhi
ccuuuccugugcuc

SEQ ID NO: 1688222 - RNA, 12 nt, Salmonella enterica enterica serovar Typhi
ccuuucaacgga

SEQ ID NO: 1688223 - RNA, 18 nt, Salmonella enterica enterica serovar Typhi
ccuuucaaaaaagagaag

SEQ ID NO: 1688224 - RNA, 14 nt, Salmonella enterica enterica serovar Typhi
ccuuuaucugcccu

SEQ ID NO: 1688225 - RNA, 17 nt, Salmonella enterica enterica serovar Typhi
ccuuuacuguugccuuu

SEQ ID NO: 1688226 - RNA, 19 nt, Salmonella enterica enterica serovar Typhi
ccuuucgugcacuucaugc

SEQ ID NO: 1688227 - RNA, 21 nt, Salmonella enterica enterica serovar Typhi
ccuuucucugguuucccugcc

SEQ ID NO: 1688228 - RNA, 16 nt, Salmonella enterica enterica serovar Typhi
ccuuucuuauuuuuuu

SEQ ID NO: 1688229 - RNA, 14 nt, Salmonella enterica enterica serovar Typhi
ccuuugacaaccug

SEQ ID NO: 1688230 - RNA, 13 nt, Salmonella enterica enterica serovar Typhi
ccuuugaccauua

SEQ ID NO: 1688231 - RNA, 15 nt, Salmonella enterica enterica serovar Typhi
ccuuuuaagguuaca

SEQ ID NO: 1688232 - RNA, 16 nt, Salmonella enterica enterica serovar Typhi
ccuuuuagcacuuuaa

SEQ ID NO: 1688233 - RNA, 18 nt, Salmonella enterica enterica serovar Typhi
ccuuugugaucugguuug

SEQ ID NO: 1688234 - RNA, 13 nt, Salmonella enterica enterica serovar Typhi
ccuuugucaucca

SEQ ID NO: 1688235 - RNA, 14 nt, Salmonella enterica enterica serovar Typhi
ccuuuggccaccag

SEQ ID NO: 1688236 - RNA, 16 nt, Salmonella enterica enterica serovar Typhi
ccuuugccgguuuuug

SEQ ID NO: 1688237 - RNA, 15 nt, Salmonella enterica enterica serovar Typhi
ccuuugccuucgccg

SEQ ID NO: 1688238 - RNA, 23 nt, Salmonella enterica enterica serovar Typhi
ccuuuggaggagagcgucaugaa

SEQ ID NO: 1688239 - RNA, 22 nt, Salmonella enterica enterica serovar Typhi
cgaaaacggcgcaggcaaauca

SEQ ID NO: 1688240 - RNA, 23 nt, Salmonella enterica enterica serovar Typhi
cgaaaacggcgcaggcaaaucaa

SEQ ID NO: 1688241 - RNA, 22 nt, Salmonella enterica enterica serovar Typhi
cgaaaaccgagcgcaugguaga

SEQ ID NO: 1688242 - RNA, 16 nt, Salmonella enterica enterica serovar Typhi
cgaaaaacccgcuuca

SEQ ID NO: 1688243 - RNA, 19 nt, Salmonella enterica enterica serovar Typhi
cgaaaauaaacgcuugacu

SEQ ID NO: 1688244 - RNA, 12 nt, Salmonella enterica enterica serovar Typhi
cgaaaaucaucc

SEQ ID NO: 1688245 - RNA, 20 nt, Salmonella enterica enterica serovar Typhi
cgaaacaggaaaaacauggg

SEQ ID NO: 1688246 - RNA, 18 nt, Salmonella enterica enterica serovar Typhi
cgaaacagauuaaaaagc

SEQ ID NO: 1688247 - RNA, 13 nt, Salmonella enterica enterica serovar Typhi
ccuuuuuuguauu

SEQ ID NO: 1688248 - RNA, 20 nt, Salmonella enterica enterica serovar Typhi
ccuuuuuugguuauccagca

SEQ ID NO: 1688249 - RNA, 13 nt, Salmonella enterica enterica serovar Typhi
ccuuuuucaauuu

SEQ ID NO: 1688250 - RNA, 19 nt, Salmonella enterica enterica serovar Typhi
ccuuuuucaugcaauaauc

SEQ ID NO: 1688251 - RNA, 15 nt, Salmonella enterica enterica serovar Typhi
ccuuuuugcagcgcg

SEQ ID NO: 1688252 - RNA, 19 nt, Salmonella enterica enterica serovar Typhi
ccuuuuugcauucgcuccu

SEQ ID NO: 1688253 - RNA, 14 nt, Salmonella enterica enterica serovar Typhi
ccuuuugacgcuuc

SEQ ID NO: 1688254 - RNA, 20 nt, Salmonella enterica enterica serovar Typhi
ccuuuuucaauuuccaguuu

SEQ ID NO: 1688255 - RNA, 13 nt, Salmonella enterica enterica serovar Typhi
ccuuuugcagaau

SEQ ID NO: 1688256 - RNA, 20 nt, Salmonella enterica enterica serovar Typhi
cgaacagguuauuguugcua

SEQ ID NO: 1688257 - RNA, 17 nt, Salmonella enterica enterica serovar Typhi
cgaacagcgcuccacgc

SEQ ID NO: 1688258 - RNA, 12 nt, Salmonella enterica enterica serovar Typhi
cgaacagccagg

SEQ ID NO: 1688259 - RNA, 13 nt, Salmonella enterica enterica serovar Typhi
cgaacagcccgcu

SEQ ID NO: 1688260 - RNA, 20 nt, Salmonella enterica enterica serovar Typhi
cgaacaucugcguugcgcgc

SEQ ID NO: 1688261 - RNA, 17 nt, Salmonella enterica enterica serovar Typhi
cgaacauuucagcgcca

SEQ ID NO: 1688262 - RNA, 22 nt, Salmonella enterica enterica serovar Typhi
cgaacauccuugcacgccaaaa

SEQ ID NO: 1688263 - RNA, 13 nt, Salmonella enterica enterica serovar Typhi
cgaaccaccagcc

SEQ ID NO: 1688264 - RNA, 18 nt, Salmonella enterica enterica serovar Typhi
cgaaccguaaacgccugc

SEQ ID NO: 1688265 - RNA, 21 nt, Salmonella enterica enterica serovar Typhi
cgaaccggaccagcacaaaaa

SEQ ID NO: 1688266 - RNA, 17 nt, Salmonella enterica enterica serovar Typhi
cgaacccaucagggaaa

SEQ ID NO: 1688267 - RNA, 15 nt, Salmonella enterica enterica serovar Typhi
cgaacgcuaugcgcc

SEQ ID NO: 1688268 - RNA, 20 nt, Salmonella enterica enterica serovar Typhi
cgaacgccgacaucacgcaa

SEQ ID NO: 1688269 - RNA, 19 nt, Salmonella enterica enterica serovar Typhi
cgaaccuuaagcgcgaaau

SEQ ID NO: 1688270 - RNA, 20 nt, Salmonella enterica enterica serovar Typhi
cgaaccugguacaccagacg

SEQ ID NO: 1688271 - RNA, 17 nt, Salmonella enterica enterica serovar Typhi
cgaaacucagcggccca

SEQ ID NO: 1688272 - RNA, 13 nt, Salmonella enterica enterica serovar Typhi
cgaaagcugccuu

SEQ ID NO: 1688273 - RNA, 15 nt, Salmonella enterica enterica serovar Typhi
cgaaagcugccuuuu

SEQ ID NO: 1688274 - RNA, 17 nt, Salmonella enterica enterica serovar Typhi
cgaaagcgaccuucucc

SEQ ID NO: 1688275 - RNA, 15 nt, Salmonella enterica enterica serovar Typhi
cgaaagauaaaaaua

SEQ ID NO: 1688276 - RNA, 19 nt, Salmonella enterica enterica serovar Typhi
cgaacaaguaguuguuaua

SEQ ID NO: 1688277 - RNA, 17 nt, Salmonella enterica enterica serovar Typhi
cgaaauuuucuucuucg

SEQ ID NO: 1688278 - RNA, 17 nt, Salmonella enterica enterica serovar Typhi
cgaaauguccauccauu

SEQ ID NO: 1688279 - RNA, 20 nt, Salmonella enterica enterica serovar Typhi
cgaaaucaaagaccuccgcc

SEQ ID NO: 1688280 - RNA, 16 nt, Salmonella enterica enterica serovar Typhi
cgaaaucaucaauggc

SEQ ID NO: 1688281 - RNA, 14 nt, Salmonella enterica enterica serovar Typhi
cgaugucgccgccg

SEQ ID NO: 1688282 - RNA, 22 nt, Salmonella enterica enterica serovar Typhi
cgauggggcaagcucagcggca

SEQ ID NO: 1688283 - RNA, 22 nt, Salmonella enterica enterica serovar Typhi
cgaugcucagggcauccgccgc

SEQ ID NO: 1688284 - RNA, 17 nt, Salmonella enterica enterica serovar Typhi
cgaugcugcuccaucuc

SEQ ID NO: 1688285 - RNA, 19 nt, Salmonella enterica enterica serovar Typhi
cgaugccguuuuaacguca

SEQ ID NO: 1688286 - RNA, 14 nt, Salmonella enterica enterica serovar Typhi
cgaugccucacccc

SEQ ID NO: 1688287 - RNA, 12 nt, Salmonella enterica enterica serovar Typhi
cgaucaccacgc

SEQ ID NO: 1688288 - RNA, 15 nt, Salmonella enterica enterica serovar Typhi
cgauguuugccacgc

SEQ ID NO: 1688289 - RNA, 22 nt, Salmonella enterica enterica serovar Typhi
cgauugccgguccguucucuca

SEQ ID NO: 1688290 - RNA, 15 nt, Salmonella enterica enterica serovar Typhi
cgauuuauccaccgc

SEQ ID NO: 1688291 - RNA, 21 nt, Salmonella enterica enterica serovar Typhi
cgauuuuuucgacauuaccca

SEQ ID NO: 1688292 - RNA, 19 nt, Salmonella enterica enterica serovar Typhi
cgauuuuugaucucuuuag

SEQ ID NO: 1688293 - RNA, 18 nt, Salmonella enterica enterica serovar Typhi
cgauuuucuccggaagca

SEQ ID NO: 1688294 - RNA, 20 nt, Salmonella enterica enterica serovar Typhi
cgauuuccuguguuacgcca

SEQ ID NO: 1688295 - RNA, 18 nt, Salmonella enterica enterica serovar Typhi
cgauuucauuggucuuca

SEQ ID NO: 1688296 - RNA, 12 nt, Salmonella enterica enterica serovar Typhi
cgauuuccccug

SEQ ID NO: 1688297 - RNA, 12 nt, Salmonella enterica enterica serovar Typhi
cgauuuauucuu

SEQ ID NO: 1688298 - RNA, 21 nt, Salmonella enterica enterica serovar Typhi
cgauuuauucuuugucugucg

SEQ ID NO: 1688299 - RNA, 19 nt, Salmonella enterica enterica serovar Typhi
cgcacgccagauaaaucag

SEQ ID NO: 1688300 - RNA, 18 nt, Salmonella enterica enterica serovar Typhi
cgcagagauagccagcga

SEQ ID NO: 1688301 - RNA, 12 nt, Salmonella enterica enterica serovar Typhi
cgcagacccuuu

SEQ ID NO: 1688302 - RNA, 14 nt, Salmonella enterica enterica serovar Typhi
cgcagacacugcca

SEQ ID NO: 1688303 - RNA, 15 nt, Salmonella enterica enterica serovar Typhi
cgcagaauuuauuuc

SEQ ID NO: 1688304 - RNA, 15 nt, Salmonella enterica enterica serovar Typhi
cgcacuaccagcucg

SEQ ID NO: 1688305 - RNA, 21 nt, Salmonella enterica enterica serovar Typhi
cgcacuaccagaaacaacacg

SEQ ID NO: 1688306 - RNA, 21 nt, Salmonella enterica enterica serovar Typhi
cgcaaucacgcguuauacgca

SEQ ID NO: 1688307 - RNA, 19 nt, Salmonella enterica enterica serovar Typhi
cgcaaggaaauauuaauua

SEQ ID NO: 1688308 - RNA, 15 nt, Salmonella enterica enterica serovar Typhi
cgcaaucaugacaga

SEQ ID NO: 1688309 - RNA, 13 nt, Salmonella enterica enterica serovar Typhi
cgcaauccccugg

SEQ ID NO: 1688310 - RNA, 16 nt, Salmonella enterica enterica serovar Typhi
cgcaaucggcuuugac

SEQ ID NO: 1688311 - RNA, 15 nt, Salmonella enterica enterica serovar Typhi
cgcaaugccaccaca

SEQ ID NO: 1688312 - RNA, 21 nt, Salmonella enterica enterica serovar Typhi
cgcaaucucuuuauugcuggu

SEQ ID NO: 1688313 - RNA, 22 nt, Salmonella enterica enterica serovar Typhi
cgcaauuccugacugcgcgccu

SEQ ID NO: 1688314 - RNA, 13 nt, Salmonella enterica enterica serovar Typhi
cgcaauucuucua

SEQ ID NO: 1688315 - RNA, 23 nt, Salmonella enterica enterica serovar Typhi
cgcaauugguaauuaaaggcagc

SEQ ID NO: 1688316 - RNA, 22 nt, Salmonella enterica enterica serovar Typhi
cgcacaaucgccgugaucccaa

SEQ ID NO: 1688317 - RNA, 15 nt, Salmonella enterica enterica serovar Typhi
cgcacaugaucuucg

SEQ ID NO: 1688318 - RNA, 20 nt, Salmonella enterica enterica serovar Typhi
cgcaaaaucgcaaacgccag

SEQ ID NO: 1688319 - RNA, 14 nt, Salmonella enterica enterica serovar Typhi
cgcaaccuccgcgg

SEQ ID NO: 1688320 - RNA, 18 nt, Salmonella enterica enterica serovar Typhi
cgcaagauuccagauagc

SEQ ID NO: 1688321 - RNA, 19 nt, Salmonella enterica enterica serovar Typhi
cgcaacuuaguguccacuc

SEQ ID NO: 1688322 - RNA, 22 nt, Salmonella enterica enterica serovar Typhi
cgcaagcucaccaucuucauga

SEQ ID NO: 1688323 - RNA, 22 nt, Salmonella enterica enterica serovar Typhi
cgcaaucacauacagcacuucc

SEQ ID NO: 1688324 - RNA, 11 nt, Salmonella enterica enterica serovar Typhi
cgcaaggaaau

SEQ ID NO: 1688325 - RNA, 18 nt, Salmonella enterica enterica serovar Typhi
cgccagacccgcaauaac

SEQ ID NO: 1688326 - RNA, 21 nt, Salmonella enterica enterica serovar Typhi
cgccagacucagccaggucug

SEQ ID NO: 1688327 - RNA, 16 nt, Salmonella enterica enterica serovar Typhi
cgccagacucagccag

SEQ ID NO: 1688328 - RNA, 17 nt, Salmonella enterica enterica serovar Typhi
cgccagaaaagaaccga

SEQ ID NO: 1688329 - RNA, 20 nt, Salmonella enterica enterica serovar Typhi
cgccacuucuuugaccagcg

SEQ ID NO: 1688330 - RNA, 14 nt, Salmonella enterica enterica serovar Typhi
cgccacuuccagcg

SEQ ID NO: 1688331 - RNA, 19 nt, Salmonella enterica enterica serovar Typhi
cgccacuuccagcgcgccg

SEQ ID NO: 1688332 - RNA, 17 nt, Salmonella enterica enterica serovar Typhi
cgccacgcgccaggucu

SEQ ID NO: 1688333 - RNA, 14 nt, Salmonella enterica enterica serovar Typhi
cgccaccgcgcgca

SEQ ID NO: 1688334 - RNA, 15 nt, Salmonella enterica enterica serovar Typhi
cgccaccgccgccac

SEQ ID NO: 1688335 - RNA, 13 nt, Salmonella enterica enterica serovar Typhi
cgccaccgccgcu

SEQ ID NO: 1688336 - RNA, 15 nt, Salmonella enterica enterica serovar Typhi
cgccaaucuguaauu

SEQ ID NO: 1688337 - RNA, 12 nt, Salmonella enterica enterica serovar Typhi
cgccacccggcu

SEQ ID NO: 1688338 - RNA, 13 nt, Salmonella enterica enterica serovar Typhi
cgccaagcgcggc

SEQ ID NO: 1688339 - RNA, 17 nt, Salmonella enterica enterica serovar Typhi
cgccaagcggcaacucu

SEQ ID NO: 1688340 - RNA, 14 nt, Salmonella enterica enterica serovar Typhi
cgccaagcugugau

SEQ ID NO: 1688341 - RNA, 15 nt, Salmonella enterica enterica serovar Typhi
cgccaaguacgccuu

SEQ ID NO: 1688342 - RNA, 12 nt, Salmonella enterica enterica serovar Typhi
cgccaauaucca

SEQ ID NO: 1688343 - RNA, 14 nt, Salmonella enterica enterica serovar Typhi
cgccaauauccauu

SEQ ID NO: 1688344 - RNA, 15 nt, Salmonella enterica enterica serovar Typhi
cgccaauccaugccg

SEQ ID NO: 1688345 - RNA, 22 nt, Salmonella enterica enterica serovar Typhi
cgccaaucggcgucuugccgca

SEQ ID NO: 1688346 - RNA, 18 nt, Salmonella enterica enterica serovar Typhi
cgccaaucgcgauaucaa

SEQ ID NO: 1688347 - RNA, 12 nt, Salmonella enterica enterica serovar Typhi
cgccaaucggcg

SEQ ID NO: 1688348 - RNA, 15 nt, Salmonella enterica enterica serovar Typhi
cgccaauaccgccgu

SEQ ID NO: 1688349 - RNA, 22 nt, Salmonella enterica enterica serovar Typhi
cgccaaaccugccacaggccaa

SEQ ID NO: 1688350 - RNA, 18 nt, Salmonella enterica enterica serovar Typhi
cgccaaagaaacgcugau

SEQ ID NO: 1688351 - RNA, 14 nt, Salmonella enterica enterica serovar Typhi
cgccaaacgggcaa

SEQ ID NO: 1688352 - RNA, 19 nt, Salmonella enterica enterica serovar Typhi
cgccaaaccugccacaggc

SEQ ID NO: 1688353 - RNA, 16 nt, Salmonella enterica enterica serovar Typhi
cgccaaaccagacccg

SEQ ID NO: 1688354 - RNA, 19 nt, Salmonella enterica enterica serovar Typhi
cgccaaagcgauccggcau

SEQ ID NO: 1688355 - RNA, 20 nt, Salmonella enterica enterica serovar Typhi
cgccaaagggauaagaaaga

SEQ ID NO: 1688356 - RNA, 17 nt, Salmonella enterica enterica serovar Typhi
cgccaaaguuaaucagc

SEQ ID NO: 1688357 - RNA, 15 nt, Salmonella enterica enterica serovar Typhi
cgccaaccaucggca

SEQ ID NO: 1688358 - RNA, 14 nt, Salmonella enterica enterica serovar Typhi
cgccaaccucccaa

SEQ ID NO: 1688359 - RNA, 18 nt, Salmonella enterica enterica serovar Typhi
cgccaacgccacugccau

SEQ ID NO: 1688360 - RNA, 21 nt, Salmonella enterica enterica serovar Typhi
cgccaacuuuuugcgcaauac

SEQ ID NO: 1688361 - RNA, 16 nt, Salmonella enterica enterica serovar Typhi
cgcauguuucgcuuca

SEQ ID NO: 1688362 - RNA, 21 nt, Salmonella enterica enterica serovar Typhi
cgcauguuucgcuucaauucg

SEQ ID NO: 1688363 - RNA, 13 nt, Salmonella enterica enterica serovar Typhi
cgcauguuugccu

SEQ ID NO: 1688364 - RNA, 19 nt, Salmonella enterica enterica serovar Typhi
cgcauucucugucgccgcc

SEQ ID NO: 1688365 - RNA, 20 nt, Salmonella enterica enterica serovar Typhi
cgcauucucugucgccgccc

SEQ ID NO: 1688366 - RNA, 16 nt, Salmonella enterica enterica serovar Typhi
cgcauucuuuuuucuc

SEQ ID NO: 1688367 - RNA, 20 nt, Salmonella enterica enterica serovar Typhi
cgcauucuucagcgcguccu

SEQ ID NO: 1688368 - RNA, 20 nt, Salmonella enterica enterica serovar Typhi
cgcauugcgcuauuacucuu

SEQ ID NO: 1688369 - RNA, 19 nt, Salmonella enterica enterica serovar Typhi
cgcauuuuucuucacgccg

SEQ ID NO: 1688370 - RNA, 19 nt, Salmonella enterica enterica serovar Typhi
cgcauuuuuucuucaguuc

SEQ ID NO: 1688371 - RNA, 17 nt, Salmonella enterica enterica serovar Typhi
cgcagcacaugcaauuu

SEQ ID NO: 1688372 - RNA, 14 nt, Salmonella enterica enterica serovar Typhi
cgcagcaacgguuu

SEQ ID NO: 1688373 - RNA, 12 nt, Salmonella enterica enterica serovar Typhi
cgcagcaccgcc

SEQ ID NO: 1688374 - RNA, 16 nt, Salmonella enterica enterica serovar Typhi
cgcagcaacaguugcu

SEQ ID NO: 1688375 - RNA, 18 nt, Salmonella enterica enterica serovar Typhi
cgcagcaaacgccauagc

SEQ ID NO: 1688376 - RNA, 23 nt, Salmonella enterica enterica serovar Typhi
cgcagaucguauccagcggcaaa

SEQ ID NO: 1688377 - RNA, 12 nt, Salmonella enterica enterica serovar Typhi
cgcagaugcugc

SEQ ID NO: 1688378 - RNA, 14 nt, Salmonella enterica enterica serovar Typhi
cgcagaucgccugg

SEQ ID NO: 1688379 - RNA, 12 nt, Salmonella enterica enterica serovar Typhi
cgcaggcgagcg

SEQ ID NO: 1688380 - RNA, 12 nt, Salmonella enterica enterica serovar Typhi
cgcagggcugcu

SEQ ID NO: 1688381 - RNA, 16 nt, Salmonella enterica enterica serovar Typhi
cgcagugcagcggaug

SEQ ID NO: 1688382 - RNA, 16 nt, Salmonella enterica enterica serovar Typhi
cgcagugaccagcauc

SEQ ID NO: 1688383 - RNA, 16 nt, Salmonella enterica enterica serovar Typhi
cgcagucguuccagac

SEQ ID NO: 1688384 - RNA, 16 nt, Salmonella enterica enterica serovar Typhi
cgcaggggggaaauga

SEQ ID NO: 1688385 - RNA, 12 nt, Salmonella enterica enterica serovar Typhi
cgcaucgguaau

SEQ ID NO: 1688386 - RNA, 16 nt, Salmonella enterica enterica serovar Typhi
cgcaucucccugccag

SEQ ID NO: 1688387 - RNA, 20 nt, Salmonella enterica enterica serovar Typhi
cgcaucugacaucagaaaau

SEQ ID NO: 1688388 - RNA, 16 nt, Salmonella enterica enterica serovar Typhi
cgcaucuucgcccggc

SEQ ID NO: 1688389 - RNA, 14 nt, Salmonella enterica enterica serovar Typhi
cgcaucuuuuuccc

SEQ ID NO: 1688390 - RNA, 21 nt, Salmonella enterica enterica serovar Typhi
cgcaucgccgcggcgcuggcc

SEQ ID NO: 1688391 - RNA, 17 nt, Salmonella enterica enterica serovar Typhi
cgcaucgccgcggcgcu

SEQ ID NO: 1688392 - RNA, 16 nt, Salmonella enterica enterica serovar Typhi
cgcauccgucaaaaug

SEQ ID NO: 1688393 - RNA, 22 nt, Salmonella enterica enterica serovar Typhi
cgcauccgggaguuucaugcca

SEQ ID NO: 1688394 - RNA, 23 nt, Salmonella enterica enterica serovar Typhi
cgcauccuguuuuuucagcgcgc

SEQ ID NO: 1688395 - RNA, 16 nt, Salmonella enterica enterica serovar Typhi
cgcauccaguuguuua

SEQ ID NO: 1688396 - RNA, 14 nt, Salmonella enterica enterica serovar Typhi
cgcaucccgccaac

SEQ ID NO: 1688397 - RNA, 15 nt, Salmonella enterica enterica serovar Typhi
cgcaucauucaucuc

SEQ ID NO: 1688398 - RNA, 16 nt, Salmonella enterica enterica serovar Typhi
cgcaucacggcagcac

SEQ ID NO: 1688399 - RNA, 13 nt, Salmonella enterica enterica serovar Typhi
cgcauauuuuuua

SEQ ID NO: 1688400 - RNA, 22 nt, Salmonella enterica enterica serovar Typhi
cgcauagacgcccugcaaagca

SEQ ID NO: 1688401 - RNA, 20 nt, Salmonella enterica enterica serovar Typhi
cgcauagcggccagauggca

SEQ ID NO: 1688402 - RNA, 17 nt, Salmonella enterica enterica serovar Typhi
cgcauaccuucaugcau

SEQ ID NO: 1688403 - RNA, 19 nt, Salmonella enterica enterica serovar Typhi
cgcauacucuuggagagca

SEQ ID NO: 1688404 - RNA, 15 nt, Salmonella enterica enterica serovar Typhi
cgcaguucgccgcca

SEQ ID NO: 1688405 - RNA, 19 nt, Salmonella enterica enterica serovar Typhi
cgcaguucauccacgcggg

SEQ ID NO: 1688406 - RNA, 14 nt, Salmonella enterica enterica serovar Typhi
cgcaguucaauauu

SEQ ID NO: 1688407 - RNA, 16 nt, Salmonella enterica enterica serovar Typhi
cgcaguucaauauuca

SEQ ID NO: 1688408 - RNA, 20 nt, Salmonella enterica enterica serovar Typhi
cgagcaggaaccacaucgcg

SEQ ID NO: 1688409 - RNA, 16 nt, Salmonella enterica enterica serovar Typhi
cgagcaggaauagcuc

SEQ ID NO: 1688410 - RNA, 14 nt, Salmonella enterica enterica serovar Typhi
cgagcaggacgcgc

SEQ ID NO: 1688411 - RNA, 18 nt, Salmonella enterica enterica serovar Typhi
cgagcacuguagcggcug

SEQ ID NO: 1688412 - RNA, 14 nt, Salmonella enterica enterica serovar Typhi
cgagcacuuuuucc

SEQ ID NO: 1688413 - RNA, 21 nt, Salmonella enterica enterica serovar Typhi
cgagcaaaacccggugcggca

SEQ ID NO: 1688414 - RNA, 13 nt, Salmonella enterica enterica serovar Typhi
cgagcaauaguga

SEQ ID NO: 1688415 - RNA, 20 nt, Salmonella enterica enterica serovar Typhi
cgagccauuaaugcaggcag

SEQ ID NO: 1688416 - RNA, 14 nt, Salmonella enterica enterica serovar Typhi
cgagcaguucagca

SEQ ID NO: 1688417 - RNA, 16 nt, Salmonella enterica enterica serovar Typhi
cgagagucaaggcauc

SEQ ID NO: 1688418 - RNA, 15 nt, Salmonella enterica enterica serovar Typhi
cgagaguuugugaug

SEQ ID NO: 1688419 - RNA, 14 nt, Salmonella enterica enterica serovar Typhi
cgagagaaaaaaau

SEQ ID NO: 1688420 - RNA, 15 nt, Salmonella enterica enterica serovar Typhi
cgagaucgccaccgc

SEQ ID NO: 1688421 - RNA, 13 nt, Salmonella enterica enterica serovar Typhi
cgagaugaaaagu

SEQ ID NO: 1688422 - RNA, 23 nt, Salmonella enterica enterica serovar Typhi
cgagauuuuucugcgccaccagc

SEQ ID NO: 1688423 - RNA, 21 nt, Salmonella enterica enterica serovar Typhi
cgagauuuaccgggaaauguc

SEQ ID NO: 1688424 - RNA, 21 nt, Salmonella enterica enterica serovar Typhi
cgagauuacugcgugcuggcg

SEQ ID NO: 1688425 - RNA, 17 nt, Salmonella enterica enterica serovar Typhi
cgagacugcccggcaua

SEQ ID NO: 1688426 - RNA, 14 nt, Salmonella enterica enterica serovar Typhi
cgagacccagcgcg

SEQ ID NO: 1688427 - RNA, 17 nt, Salmonella enterica enterica serovar Typhi
cgagaccaucaacagcg

SEQ ID NO: 1688428 - RNA, 18 nt, Salmonella enterica enterica serovar Typhi
cgagaaguucucacccau

SEQ ID NO: 1688429 - RNA, 18 nt, Salmonella enterica enterica serovar Typhi
cgagaauacugaagucga

SEQ ID NO: 1688430 - RNA, 21 nt, Salmonella enterica enterica serovar Typhi
cgagaaccaacugccaaacca

SEQ ID NO: 1688431 - RNA, 16 nt, Salmonella enterica enterica serovar Typhi
cgacggggcgcagaag

SEQ ID NO: 1688432 - RNA, 13 nt, Salmonella enterica enterica serovar Typhi
cgacgucccguca

SEQ ID NO: 1688433 - RNA, 21 nt, Salmonella enterica enterica serovar Typhi
cgacggucuuuuucgacggca

SEQ ID NO: 1688434 - RNA, 21 nt, Salmonella enterica enterica serovar Typhi
cgacgggcggcgacagagaau

SEQ ID NO: 1688435 - RNA, 17 nt, Salmonella enterica enterica serovar Typhi
cgacgccuuuaccaccc

SEQ ID NO: 1688436 - RNA, 17 nt, Salmonella enterica enterica serovar Typhi
cgacgcguggcaucuua

SEQ ID NO: 1688437 - RNA, 21 nt, Salmonella enterica enterica serovar Typhi
cgacgcguuucacaucgccag

SEQ ID NO: 1688438 - RNA, 12 nt, Salmonella enterica enterica serovar Typhi
cgacgcgggccg

SEQ ID NO: 1688439 - RNA, 23 nt, Salmonella enterica enterica serovar Typhi
cgacggagauuaacagcgcgacc

SEQ ID NO: 1688440 - RNA, 14 nt, Salmonella enterica enterica serovar Typhi
cgacgcuguuuaug

SEQ ID NO: 1688441 - RNA, 18 nt, Salmonella enterica enterica serovar Typhi
cgacggccaguugcgcag

SEQ ID NO: 1688442 - RNA, 15 nt, Salmonella enterica enterica serovar Typhi
cgacucuuuuuucag

SEQ ID NO: 1688443 - RNA, 12 nt, Salmonella enterica enterica serovar Typhi
cgacugaacaua

SEQ ID NO: 1688444 - RNA, 22 nt, Salmonella enterica enterica serovar Typhi
cgacugcggucguauuuaccgc

SEQ ID NO: 1688445 - RNA, 17 nt, Salmonella enterica enterica serovar Typhi
cgacuuaucuuccacgc

SEQ ID NO: 1688446 - RNA, 13 nt, Salmonella enterica enterica serovar Typhi
cgacuuaucuucc

SEQ ID NO: 1688447 - RNA, 16 nt, Salmonella enterica enterica serovar Typhi
cgacuuauuugcucag

SEQ ID NO: 1688448 - RNA, 14 nt, Salmonella enterica enterica serovar Typhi
cgagaaaaaacuca

SEQ ID NO: 1688449 - RNA, 19 nt, Salmonella enterica enterica serovar Typhi
cgacuccaauaauggagau

SEQ ID NO: 1688450 - RNA, 13 nt, Salmonella enterica enterica serovar Typhi
cgacuccagaaua

SEQ ID NO: 1688451 - RNA, 14 nt, Salmonella enterica enterica serovar Typhi
cgacucacgcgcgc

SEQ ID NO: 1688452 - RNA, 14 nt, Salmonella enterica enterica serovar Typhi
cgacuaucuucuuc

SEQ ID NO: 1688453 - RNA, 12 nt, Salmonella enterica enterica serovar Typhi
cgacucccaggc

SEQ ID NO: 1688454 - RNA, 15 nt, Salmonella enterica enterica serovar Typhi
cgacuccggauagag

SEQ ID NO: 1688455 - RNA, 19 nt, Salmonella enterica enterica serovar Typhi
cgacucccaggcgcgcagc

SEQ ID NO: 1688456 - RNA, 21 nt, Salmonella enterica enterica serovar Typhi
cgacguuugcguaaagcuguu

SEQ ID NO: 1688457 - RNA, 20 nt, Salmonella enterica enterica serovar Typhi
cgacguuguucgcuucuucu

SEQ ID NO: 1688458 - RNA, 13 nt, Salmonella enterica enterica serovar Typhi
cgacguugcgccu

SEQ ID NO: 1688459 - RNA, 17 nt, Salmonella enterica enterica serovar Typhi
cgacguuaucucgccag

SEQ ID NO: 1688460 - RNA, 22 nt, Salmonella enterica enterica serovar Typhi
cgagugaggaccguacucagau

SEQ ID NO: 1688461 - RNA, 16 nt, Salmonella enterica enterica serovar Typhi
cgagucuuaccagguc

SEQ ID NO: 1688462 - RNA, 13 nt, Salmonella enterica enterica serovar Typhi
cgagucgccgcuu

SEQ ID NO: 1688463 - RNA, 14 nt, Salmonella enterica enterica serovar Typhi
cgagucacccugca

SEQ ID NO: 1688464 - RNA, 18 nt, Salmonella enterica enterica serovar Typhi
cgagguucccgccgccau

SEQ ID NO: 1688465 - RNA, 14 nt, Salmonella enterica enterica serovar Typhi
cgaggggcaggaag

SEQ ID NO: 1688466 - RNA, 14 nt, Salmonella enterica enterica serovar Typhi
cgagggugggcgca

SEQ ID NO: 1688467 - RNA, 17 nt, Salmonella enterica enterica serovar Typhi
cgaggugaauaaauccu

SEQ ID NO: 1688468 - RNA, 13 nt, Salmonella enterica enterica serovar Typhi
cgauaccggcaac

SEQ ID NO: 1688469 - RNA, 20 nt, Salmonella enterica enterica serovar Typhi
cgauagagaguuccuccugg

SEQ ID NO: 1688470 - RNA, 14 nt, Salmonella enterica enterica serovar Typhi
cgauagaucgccac

SEQ ID NO: 1688471 - RNA, 14 nt, Salmonella enterica enterica serovar Typhi
cgauagcauuuuua

SEQ ID NO: 1688472 - RNA, 18 nt, Salmonella enterica enterica serovar Typhi
cgauauuacuccagcgua

SEQ ID NO: 1688473 - RNA, 19 nt, Salmonella enterica enterica serovar Typhi
cgauagcuaucacacauau

SEQ ID NO: 1688474 - RNA, 16 nt, Salmonella enterica enterica serovar Typhi
cgauagcugcugacgu

SEQ ID NO: 1688475 - RNA, 23 nt, Salmonella enterica enterica serovar Typhi
cgauaucgucauuaacgggaaac

SEQ ID NO: 1688476 - RNA, 18 nt, Salmonella enterica enterica serovar Typhi
cgauaguccauuuuccua

SEQ ID NO: 1688477 - RNA, 23 nt, Salmonella enterica enterica serovar Typhi
cgaguuuuaacacuauauguccu

SEQ ID NO: 1688478 - RNA, 12 nt, Salmonella enterica enterica serovar Typhi
cgaguucaaguc

SEQ ID NO: 1688479 - RNA, 18 nt, Salmonella enterica enterica serovar Typhi
cgauaaugcgguucauuu

SEQ ID NO: 1688480 - RNA, 14 nt, Salmonella enterica enterica serovar Typhi
cgauaaucaccagc

SEQ ID NO: 1688481 - RNA, 17 nt, Salmonella enterica enterica serovar Typhi
cgauaauugcucaccca

SEQ ID NO: 1688482 - RNA, 21 nt, Salmonella enterica enterica serovar Typhi
cgauaauauccgacgccuguu

SEQ ID NO: 1688483 - RNA, 15 nt, Salmonella enterica enterica serovar Typhi
cgauaaucaccagcc

SEQ ID NO: 1688484 - RNA, 15 nt, Salmonella enterica enterica serovar Typhi
cgauaacucuucauc

SEQ ID NO: 1688485 - RNA, 15 nt, Salmonella enterica enterica serovar Typhi
cgauaagaacuccaa

SEQ ID NO: 1688486 - RNA, 18 nt, Salmonella enterica enterica serovar Typhi
cgagccgucgccggccug

SEQ ID NO: 1688487 - RNA, 13 nt, Salmonella enterica enterica serovar Typhi
cgagcgccugaug

SEQ ID NO: 1688488 - RNA, 21 nt, Salmonella enterica enterica serovar Typhi
cgagcgauagagaguuccucc

SEQ ID NO: 1688489 - RNA, 13 nt, Salmonella enterica enterica serovar Typhi
cgagcgauagaga

SEQ ID NO: 1688490 - RNA, 23 nt, Salmonella enterica enterica serovar Typhi
cgagcgauagagaguuccuccug

SEQ ID NO: 1688491 - RNA, 19 nt, Salmonella enterica enterica serovar Typhi
cgagcgaucauaagggagc

SEQ ID NO: 1688492 - RNA, 18 nt, Salmonella enterica enterica serovar Typhi
cgagcggccaaagggagc

SEQ ID NO: 1688493 - RNA, 19 nt, Salmonella enterica enterica serovar Typhi
cgagcggccaaagggagca

SEQ ID NO: 1688494 - RNA, 18 nt, Salmonella enterica enterica serovar Typhi
cgagcgcgucagcgccuc

SEQ ID NO: 1688495 - RNA, 18 nt, Salmonella enterica enterica serovar Typhi
cgaggaacaucagccagc

SEQ ID NO: 1688496 - RNA, 14 nt, Salmonella enterica enterica serovar Typhi
cgagcuuuuuucuu

SEQ ID NO: 1688497 - RNA, 23 nt, Salmonella enterica enterica serovar Typhi
cgaggaacaucagccagcagcuc

SEQ ID NO: 1688498 - RNA, 22 nt, Salmonella enterica enterica serovar Typhi
cgaggaguaguuaaaaaagguc

SEQ ID NO: 1688499 - RNA, 22 nt, Salmonella enterica enterica serovar Typhi
cgaggcuuuguccuuugcuaca

SEQ ID NO: 1688500 - RNA, 20 nt, Salmonella enterica enterica serovar Typhi
cgagggauuuccuggcaguu

SEQ ID NO: 1688501 - RNA, 15 nt, Salmonella enterica enterica serovar Typhi
cgaggcgcccaacgc

SEQ ID NO: 1688502 - RNA, 22 nt, Salmonella enterica enterica serovar Typhi
ccggcuccgaccaucgccgcga

SEQ ID NO: 1688503 - RNA, 22 nt, Salmonella enterica enterica serovar Typhi
ccggcguuucguuuagcgccug

SEQ ID NO: 1688504 - RNA, 19 nt, Salmonella enterica enterica serovar Typhi
ccggcguuuuuagugacag

SEQ ID NO: 1688505 - RNA, 18 nt, Salmonella enterica enterica serovar Typhi
ccggcguucucccgggcc

SEQ ID NO: 1688506 - RNA, 14 nt, Salmonella enterica enterica serovar Typhi
ccggcguugcgccg

SEQ ID NO: 1688507 - RNA, 13 nt, Salmonella enterica enterica serovar Typhi
ccggcguugaaau

SEQ ID NO: 1688508 - RNA, 13 nt, Salmonella enterica enterica serovar Typhi
ccggcgugauaaa

SEQ ID NO: 1688509 - RNA, 20 nt, Salmonella enterica enterica serovar Typhi
ccggcuuaaugcccggcccg

SEQ ID NO: 1688510 - RNA, 11 nt, Salmonella enterica enterica serovar Typhi
ccggcuucagc

SEQ ID NO: 1688511 - RNA, 21 nt, Salmonella enterica enterica serovar Typhi
ccggcugcgucgcuucuuguu

SEQ ID NO: 1688512 - RNA, 11 nt, Salmonella enterica enterica serovar Typhi
ccggcggccua

SEQ ID NO: 1688513 - RNA, 20 nt, Salmonella enterica enterica serovar Typhi
ccggcggucaugcuggcgau

SEQ ID NO: 1688514 - RNA, 17 nt, Salmonella enterica enterica serovar Typhi
ccggcguaauugcgccu

SEQ ID NO: 1688515 - RNA, 18 nt, Salmonella enterica enterica serovar Typhi
ccggcgucauacugccaa

SEQ ID NO: 1688516 - RNA, 14 nt, Salmonella enterica enterica serovar Typhi
ccgggcugcacgcc

SEQ ID NO: 1688517 - RNA, 21 nt, Salmonella enterica enterica serovar Typhi
ccgggcugaacgccaggccgu

SEQ ID NO: 1688518 - RNA, 13 nt, Salmonella enterica enterica serovar Typhi
ccgggcuucagga

SEQ ID NO: 1688519 - RNA, 18 nt, Salmonella enterica enterica serovar Typhi
ccggggaucguucugcug

SEQ ID NO: 1688520 - RNA, 23 nt, Salmonella enterica enterica serovar Typhi
ccgggcucauuuuauccaacagc

SEQ ID NO: 1688521 - RNA, 22 nt, Salmonella enterica enterica serovar Typhi
ccgggcgucacccgccggcagc

SEQ ID NO: 1688522 - RNA, 16 nt, Salmonella enterica enterica serovar Typhi
ccgggcgucacccgcc

SEQ ID NO: 1688523 - RNA, 17 nt, Salmonella enterica enterica serovar Typhi
ccgggcggcgcagcgcg

SEQ ID NO: 1688524 - RNA, 14 nt, Salmonella enterica enterica serovar Typhi
ccgggcggcgcagc

SEQ ID NO: 1688525 - RNA, 22 nt, Salmonella enterica enterica serovar Typhi
ccggcuuuaugauggugagagc

SEQ ID NO: 1688526 - RNA, 16 nt, Salmonella enterica enterica serovar Typhi
ccggcuuuuuucaccu

SEQ ID NO: 1688527 - RNA, 20 nt, Salmonella enterica enterica serovar Typhi
ccgggaaaucuucuacuuca

SEQ ID NO: 1688528 - RNA, 19 nt, Salmonella enterica enterica serovar Typhi
ccgggaaaugucuggcgcu

SEQ ID NO: 1688529 - RNA, 13 nt, Salmonella enterica enterica serovar Typhi
ccgggaacuggca

SEQ ID NO: 1688530 - RNA, 17 nt, Salmonella enterica enterica serovar Typhi
ccgggccaaugccgccu

SEQ ID NO: 1688531 - RNA, 23 nt, Salmonella enterica enterica serovar Typhi
ccgggagaaaacgcggccuggaa

SEQ ID NO: 1688532 - RNA, 15 nt, Salmonella enterica enterica serovar Typhi
ccgggacuucaggca

SEQ ID NO: 1688533 - RNA, 19 nt, Salmonella enterica enterica serovar Typhi
ccgggagaaaacgcggccu

SEQ ID NO: 1688534 - RNA, 17 nt, Salmonella enterica enterica serovar Typhi
ccgggagaacgccgggc

SEQ ID NO: 1688535 - RNA, 20 nt, Salmonella enterica enterica serovar Typhi
ccgguaaauccacaaccggc

SEQ ID NO: 1688536 - RNA, 16 nt, Salmonella enterica enterica serovar Typhi
ccgguaacgccguagg

SEQ ID NO: 1688537 - RNA, 19 nt, Salmonella enterica enterica serovar Typhi
ccgguaaagcagugcagua

SEQ ID NO: 1688538 - RNA, 13 nt, Salmonella enterica enterica serovar Typhi
ccggguucugcgg

SEQ ID NO: 1688539 - RNA, 20 nt, Salmonella enterica enterica serovar Typhi
ccggguucagcgacaggcug

SEQ ID NO: 1688540 - RNA, 19 nt, Salmonella enterica enterica serovar Typhi
ccggguucgcccggcauga

SEQ ID NO: 1688541 - RNA, 14 nt, Salmonella enterica enterica serovar Typhi
ccggguuaaagccc

SEQ ID NO: 1688542 - RNA, 21 nt, Salmonella enterica enterica serovar Typhi
ccggguauuucugaaaaaccg

SEQ ID NO: 1688543 - RNA, 20 nt, Salmonella enterica enterica serovar Typhi
ccgggguucgaauccccgcc

SEQ ID NO: 1688544 - RNA, 21 nt, Salmonella enterica enterica serovar Typhi
ccggguaaugcugcagggccg

SEQ ID NO: 1688545 - RNA, 18 nt, Salmonella enterica enterica serovar Typhi
ccggguaucugggcggca

SEQ ID NO: 1688546 - RNA, 15 nt, Salmonella enterica enterica serovar Typhi
ccgguaacguaaaua

SEQ ID NO: 1688547 - RNA, 17 nt, Salmonella enterica enterica serovar Typhi
ccgguauaaaaccccuu

SEQ ID NO: 1688548 - RNA, 13 nt, Salmonella enterica enterica serovar Typhi
ccgguauccagcg

SEQ ID NO: 1688549 - RNA, 19 nt, Salmonella enterica enterica serovar Typhi
ccggugacaugaaaauaug

SEQ ID NO: 1688550 - RNA, 21 nt, Salmonella enterica enterica serovar Typhi
ccggucgcgccagcgaccacc

SEQ ID NO: 1688551 - RNA, 23 nt, Salmonella enterica enterica serovar Typhi
ccgucaggcuugccgcgccagac

SEQ ID NO: 1688552 - RNA, 17 nt, Salmonella enterica enterica serovar Typhi
ccgucgauaaaauccuc

SEQ ID NO: 1688553 - RNA, 16 nt, Salmonella enterica enterica serovar Typhi
ccgucggcgccagcca

SEQ ID NO: 1688554 - RNA, 17 nt, Salmonella enterica enterica serovar Typhi
ccgucggcgccagccac

SEQ ID NO: 1688555 - RNA, 14 nt, Salmonella enterica enterica serovar Typhi
ccgucggcaauaaa

SEQ ID NO: 1688556 - RNA, 18 nt, Salmonella enterica enterica serovar Typhi
ccgucggcaauuaacauu

SEQ ID NO: 1688557 - RNA, 14 nt, Salmonella enterica enterica serovar Typhi
ccgucuucagguca

SEQ ID NO: 1688558 - RNA, 18 nt, Salmonella enterica enterica serovar Typhi
ccgucuuacgaucccacg

SEQ ID NO: 1688559 - RNA, 18 nt, Salmonella enterica enterica serovar Typhi
ccgucuggcgugccgggc

SEQ ID NO: 1688560 - RNA, 11 nt, Salmonella enterica enterica serovar Typhi
ccgucucgguu

SEQ ID NO: 1688561 - RNA, 18 nt, Salmonella enterica enterica serovar Typhi
ccgucguugcugucgcgc

SEQ ID NO: 1688562 - RNA, 15 nt, Salmonella enterica enterica serovar Typhi
ccgucucaaccagca

SEQ ID NO: 1688563 - RNA, 13 nt, Salmonella enterica enterica serovar Typhi
ccgucucaccagg

SEQ ID NO: 1688564 - RNA, 20 nt, Salmonella enterica enterica serovar Typhi
ccgucucuuuaucuaacugc

SEQ ID NO: 1688565 - RNA, 22 nt, Salmonella enterica enterica serovar Typhi
ccgucucuuuaucuaacugcgg

SEQ ID NO: 1688566 - RNA, 16 nt, Salmonella enterica enterica serovar Typhi
ccgucggcgucugcgc

SEQ ID NO: 1688567 - RNA, 19 nt, Salmonella enterica enterica serovar Typhi
ccgucgucaccgccgcgcu

SEQ ID NO: 1688568 - RNA, 17 nt, Salmonella enterica enterica serovar Typhi
ccgucguagccaccauc

SEQ ID NO: 1688569 - RNA, 14 nt, Salmonella enterica enterica serovar Typhi
ccggugagcgccgc

SEQ ID NO: 1688570 - RNA, 19 nt, Salmonella enterica enterica serovar Typhi
ccggugccauuccagccgg

SEQ ID NO: 1688571 - RNA, 20 nt, Salmonella enterica enterica serovar Typhi
ccggugcagaccucugcaaa

SEQ ID NO: 1688572 - RNA, 18 nt, Salmonella enterica enterica serovar Typhi
ccguaaacgccugcacca

SEQ ID NO: 1688573 - RNA, 23 nt, Salmonella enterica enterica serovar Typhi
ccgguuuuuuuuugccugaaaug

SEQ ID NO: 1688574 - RNA, 14 nt, Salmonella enterica enterica serovar Typhi
ccguaaauuccuug

SEQ ID NO: 1688575 - RNA, 16 nt, Salmonella enterica enterica serovar Typhi
ccguagcugcgcgccg

SEQ ID NO: 1688576 - RNA, 15 nt, Salmonella enterica enterica serovar Typhi
ccguacgauguucga

SEQ ID NO: 1688577 - RNA, 17 nt, Salmonella enterica enterica serovar Typhi
ccgucagauucugcggu

SEQ ID NO: 1688578 - RNA, 18 nt, Salmonella enterica enterica serovar Typhi
ccgucagaauggcgcguu

SEQ ID NO: 1688579 - RNA, 16 nt, Salmonella enterica enterica serovar Typhi
ccguaguagguaucca

SEQ ID NO: 1688580 - RNA, 18 nt, Salmonella enterica enterica serovar Typhi
ccuacagguugucgcaac

SEQ ID NO: 1688581 - RNA, 22 nt, Salmonella enterica enterica serovar Typhi
ccuacagguugucgcaacgugu

SEQ ID NO: 1688582 - RNA, 17 nt, Salmonella enterica enterica serovar Typhi
ccuaauagccagcccca

SEQ ID NO: 1688583 - RNA, 17 nt, Salmonella enterica enterica serovar Typhi
ccguuucagccccuugc

SEQ ID NO: 1688584 - RNA, 15 nt, Salmonella enterica enterica serovar Typhi
ccguuugcagccaga

SEQ ID NO: 1688585 - RNA, 12 nt, Salmonella enterica enterica serovar Typhi
ccguuuguaaca

SEQ ID NO: 1688586 - RNA, 19 nt, Salmonella enterica enterica serovar Typhi
ccguuuguaacauauuuuu

SEQ ID NO: 1688587 - RNA, 19 nt, Salmonella enterica enterica serovar Typhi
ccguuuucuccuucaucca

SEQ ID NO: 1688588 - RNA, 21 nt, Salmonella enterica enterica serovar Typhi
ccguuuucgcccccagcacga

SEQ ID NO: 1688589 - RNA, 17 nt, Salmonella enterica enterica serovar Typhi
ccguugcgcccaucauc

SEQ ID NO: 1688590 - RNA, 14 nt, Salmonella enterica enterica serovar Typhi
ccguugcgucacga

SEQ ID NO: 1688591 - RNA, 22 nt, Salmonella enterica enterica serovar Typhi
ccguucccucgacaauuucacc

SEQ ID NO: 1688592 - RNA, 14 nt, Salmonella enterica enterica serovar Typhi
ccgugccugcuccg

SEQ ID NO: 1688593 - RNA, 14 nt, Salmonella enterica enterica serovar Typhi
ccgugcccagcauc

SEQ ID NO: 1688594 - RNA, 19 nt, Salmonella enterica enterica serovar Typhi
ccgucuuuucugucguguc

SEQ ID NO: 1688595 - RNA, 21 nt, Salmonella enterica enterica serovar Typhi
ccgugaaagcauaccuucaca

SEQ ID NO: 1688596 - RNA, 18 nt, Salmonella enterica enterica serovar Typhi
ccgugaaugccaagcgca

SEQ ID NO: 1688597 - RNA, 16 nt, Salmonella enterica enterica serovar Typhi
ccgugacgucccacaa

SEQ ID NO: 1688598 - RNA, 18 nt, Salmonella enterica enterica serovar Typhi
ccguguucaugcagccau

SEQ ID NO: 1688599 - RNA, 13 nt, Salmonella enterica enterica serovar Typhi
ccuccccaggcgc

SEQ ID NO: 1688600 - RNA, 18 nt, Salmonella enterica enterica serovar Typhi
ccuccccaggcgcuauuc

SEQ ID NO: 1688601 - RNA, 13 nt, Salmonella enterica enterica serovar Typhi
ccucccaguuccc

SEQ ID NO: 1688602 - RNA, 17 nt, Salmonella enterica enterica serovar Typhi
ccuccauggcuugucgc

SEQ ID NO: 1688603 - RNA, 21 nt, Salmonella enterica enterica serovar Typhi
ccuccauggcuugucgccaac

SEQ ID NO: 1688604 - RNA, 12 nt, Salmonella enterica enterica serovar Typhi
ccucccugccua

SEQ ID NO: 1688605 - RNA, 11 nt, Salmonella enterica enterica serovar Typhi
ccucccuuucu

SEQ ID NO: 1688606 - RNA, 23 nt, Salmonella enterica enterica serovar Typhi
ccuccgcguagcccagcgccgca

SEQ ID NO: 1688607 - RNA, 19 nt, Salmonella enterica enterica serovar Typhi
ccuccgcuuccugcgccag

SEQ ID NO: 1688608 - RNA, 18 nt, Salmonella enterica enterica serovar Typhi
ccuccggaucgacagcaa

SEQ ID NO: 1688609 - RNA, 17 nt, Salmonella enterica enterica serovar Typhi
ccuccggaugacgccgc

SEQ ID NO: 1688610 - RNA, 11 nt, Salmonella enterica enterica serovar Typhi
ccuccgcccgg

SEQ ID NO: 1688611 - RNA, 17 nt, Salmonella enterica enterica serovar Typhi
ccuccgcgcagcaacag

SEQ ID NO: 1688612 - RNA, 17 nt, Salmonella enterica enterica serovar Typhi
ccuccuucgcgccugug

SEQ ID NO: 1688613 - RNA, 16 nt, Salmonella enterica enterica serovar Typhi
ccuccuuguaagggag

SEQ ID NO: 1688614 - RNA, 19 nt, Salmonella enterica enterica serovar Typhi
ccuccugccgaugccgccg

SEQ ID NO: 1688615 - RNA, 23 nt, Salmonella enterica enterica serovar Typhi
ccuccugauaaccuauuuugcaa

SEQ ID NO: 1688616 - RNA, 13 nt, Salmonella enterica enterica serovar Typhi
ccuccggcuucag

SEQ ID NO: 1688617 - RNA, 18 nt, Salmonella enterica enterica serovar Typhi
ccuccggcugaagcccca

SEQ ID NO: 1688618 - RNA, 22 nt, Salmonella enterica enterica serovar Typhi
ccuccacgcccagcgccgagaa

SEQ ID NO: 1688619 - RNA, 13 nt, Salmonella enterica enterica serovar Typhi
ccuccaauucagg

SEQ ID NO: 1688620 - RNA, 16 nt, Salmonella enterica enterica serovar Typhi
ccucauuuuguugcuc

SEQ ID NO: 1688621 - RNA, 17 nt, Salmonella enterica enterica serovar Typhi
ccuccagcgccuguuga

SEQ ID NO: 1688622 - RNA, 20 nt, Salmonella enterica enterica serovar Typhi
ccuccagccauaaugcaauc

SEQ ID NO: 1688623 - RNA, 19 nt, Salmonella enterica enterica serovar Typhi
ccuacgauuucgcucgcuu

SEQ ID NO: 1688624 - RNA, 11 nt, Salmonella enterica enterica serovar Typhi
ccuaccgccau

SEQ ID NO: 1688625 - RNA, 13 nt, Salmonella enterica enterica serovar Typhi
ccuaccgaggcag

SEQ ID NO: 1688626 - RNA, 16 nt, Salmonella enterica enterica serovar Typhi
ccuaccgaggcagggg

SEQ ID NO: 1688627 - RNA, 18 nt, Salmonella enterica enterica serovar Typhi
ccucaucccggcuuaaau

SEQ ID NO: 1688628 - RNA, 20 nt, Salmonella enterica enterica serovar Typhi
ccucauucagcggcugcgcc

SEQ ID NO: 1688629 - RNA, 22 nt, Salmonella enterica enterica serovar Typhi
ccucauuacuggaucgcuccau

SEQ ID NO: 1688630 - RNA, 16 nt, Salmonella enterica enterica serovar Typhi
ccucaucugcuucaac

SEQ ID NO: 1688631 - RNA, 18 nt, Salmonella enterica enterica serovar Typhi
ccucauccagauguuaua

SEQ ID NO: 1688632 - RNA, 13 nt, Salmonella enterica enterica serovar Typhi
ccucauccccagc

SEQ ID NO: 1688633 - RNA, 22 nt, Salmonella enterica enterica serovar Typhi
ccucauccccagcaucaugucc

SEQ ID NO: 1688634 - RNA, 19 nt, Salmonella enterica enterica serovar Typhi
ccucauauuuguaucuggu

SEQ ID NO: 1688635 - RNA, 20 nt, Salmonella enterica enterica serovar Typhi
ccucgcgcauccgggccgcu

SEQ ID NO: 1688636 - RNA, 20 nt, Salmonella enterica enterica serovar Typhi
ccuccuuguaagggaggugc

SEQ ID NO: 1688637 - RNA, 14 nt, Salmonella enterica enterica serovar Typhi
ccucgaaguauuac

SEQ ID NO: 1688638 - RNA, 19 nt, Salmonella enterica enterica serovar Typhi
ccucgacaauuucaccuuu

SEQ ID NO: 1688639 - RNA, 16 nt, Salmonella enterica enterica serovar Typhi
ccucgaccaguuuuuc

SEQ ID NO: 1688640 - RNA, 21 nt, Salmonella enterica enterica serovar Typhi
ccucgguggccuuguagcgcu

SEQ ID NO: 1688641 - RNA, 13 nt, Salmonella enterica enterica serovar Typhi
ccucgcucaccgg

SEQ ID NO: 1688642 - RNA, 19 nt, Salmonella enterica enterica serovar Typhi
ccucguucggcgcaccugu

SEQ ID NO: 1688643 - RNA, 22 nt, Salmonella enterica enterica serovar Typhi
ccucucccacugcgaacgcauc

SEQ ID NO: 1688644 - RNA, 23 nt, Salmonella enterica enterica serovar Typhi
ccucucaccguggugaccgccag

SEQ ID NO: 1688645 - RNA, 16 nt, Salmonella enterica enterica serovar Typhi
ccucuugcagcaagaa

SEQ ID NO: 1688646 - RNA, 20 nt, Salmonella enterica enterica serovar Typhi
ccucuucuuuuaauugccag

SEQ ID NO: 1688647 - RNA, 19 nt, Salmonella enterica enterica serovar Typhi
ccucugauuggcuguuagu

SEQ ID NO: 1688648 - RNA, 20 nt, Salmonella enterica enterica serovar Typhi
ccucugcaccagaacucccu

SEQ ID NO: 1688649 - RNA, 12 nt, Salmonella enterica enterica serovar Typhi
ccucugauuuuu

SEQ ID NO: 1688650 - RNA, 13 nt, Salmonella enterica enterica serovar Typhi
ccugaaacgcggc

SEQ ID NO: 1688651 - RNA, 17 nt, Salmonella enterica enterica serovar Typhi
ccucuuucaugcggucu

SEQ ID NO: 1688652 - RNA, 15 nt, Salmonella enterica enterica serovar Typhi
ccucuuucugauaac

SEQ ID NO: 1688653 - RNA, 13 nt, Salmonella enterica enterica serovar Typhi
ccucuugugcgac

SEQ ID NO: 1688654 - RNA, 13 nt, Salmonella enterica enterica serovar Typhi
ccugaaccagcgg

SEQ ID NO: 1688655 - RNA, 19 nt, Salmonella enterica enterica serovar Typhi
ccugaaauaacagacuccg

SEQ ID NO: 1688656 - RNA, 14 nt, Salmonella enterica enterica serovar Typhi
ccugaaacgugcau

SEQ ID NO: 1688657 - RNA, 15 nt, Salmonella enterica enterica serovar Typhi
ccugaaagaagcgcc

SEQ ID NO: 1688658 - RNA, 15 nt, Salmonella enterica enterica serovar Typhi
ccugaagccauccuc

SEQ ID NO: 1688659 - RNA, 15 nt, Salmonella enterica enterica serovar Typhi
ccugaaggacaagcu

SEQ ID NO: 1688660 - RNA, 16 nt, Salmonella enterica enterica serovar Typhi
ccugaaggacaagcug

SEQ ID NO: 1688661 - RNA, 18 nt, Salmonella enterica enterica serovar Typhi
ccugaaggacaagcugcg

SEQ ID NO: 1688662 - RNA, 16 nt, Salmonella enterica enterica serovar Typhi
ccugccguuugcgcca

SEQ ID NO: 1688663 - RNA, 17 nt, Salmonella enterica enterica serovar Typhi
ccugccguuuauuauuu

SEQ ID NO: 1688664 - RNA, 23 nt, Salmonella enterica enterica serovar Typhi
ccugccgucaaacuuaaugccug

SEQ ID NO: 1688665 - RNA, 15 nt, Salmonella enterica enterica serovar Typhi
ccugccggcggcaga

SEQ ID NO: 1688666 - RNA, 17 nt, Salmonella enterica enterica serovar Typhi
ccugccggaaaaugcgc

SEQ ID NO: 1688667 - RNA, 22 nt, Salmonella enterica enterica serovar Typhi
ccugccggauuuuacauagcag

SEQ ID NO: 1688668 - RNA, 21 nt, Salmonella enterica enterica serovar Typhi
ccugccuuugucacccgcuuu

SEQ ID NO: 1688669 - RNA, 21 nt, Salmonella enterica enterica serovar Typhi
ccugcgaaaagcgugcgccuu

SEQ ID NO: 1688670 - RNA, 21 nt, Salmonella enterica enterica serovar Typhi
ccugccugacaaugacgcuuc

SEQ ID NO: 1688671 - RNA, 23 nt, Salmonella enterica enterica serovar Typhi
ccugccugaagcgcaguguuaau

SEQ ID NO: 1688672 - RNA, 13 nt, Salmonella enterica enterica serovar Typhi
ccugccucaacau

SEQ ID NO: 1688673 - RNA, 18 nt, Salmonella enterica enterica serovar Typhi
ccugcgauagcugcugac

SEQ ID NO: 1688674 - RNA, 20 nt, Salmonella enterica enterica serovar Typhi
ccugcgagcuguagcgaagg

SEQ ID NO: 1688675 - RNA, 22 nt, Salmonella enterica enterica serovar Typhi
ccugcgaucugugucguccagg

SEQ ID NO: 1688676 - RNA, 19 nt, Salmonella enterica enterica serovar Typhi
ccugcggacgcagcucaua

SEQ ID NO: 1688677 - RNA, 19 nt, Salmonella enterica enterica serovar Typhi
ccugcgcucauauacccug

SEQ ID NO: 1688678 - RNA, 16 nt, Salmonella enterica enterica serovar Typhi
ccugcgguaaacgcuc

SEQ ID NO: 1688679 - RNA, 17 nt, Salmonella enterica enterica serovar Typhi
ccugcgguaaucgccgc

SEQ ID NO: 1688680 - RNA, 18 nt, Salmonella enterica enterica serovar Typhi
ccugcgguuucuaccacc

SEQ ID NO: 1688681 - RNA, 22 nt, Salmonella enterica enterica serovar Typhi
ccugcgguuucuaccacccagc

SEQ ID NO: 1688682 - RNA, 14 nt, Salmonella enterica enterica serovar Typhi
ccugcggcugauug

SEQ ID NO: 1688683 - RNA, 15 nt, Salmonella enterica enterica serovar Typhi
ccugcggccucgccu

SEQ ID NO: 1688684 - RNA, 23 nt, Salmonella enterica enterica serovar Typhi
ccugcggccaugaucgccgccau

SEQ ID NO: 1688685 - RNA, 16 nt, Salmonella enterica enterica serovar Typhi
ccugcggcguggaaaa

SEQ ID NO: 1688686 - RNA, 19 nt, Salmonella enterica enterica serovar Typhi
ccugcaucgauuccccacc

SEQ ID NO: 1688687 - RNA, 14 nt, Salmonella enterica enterica serovar Typhi
ccugcaucaacagg

SEQ ID NO: 1688688 - RNA, 23 nt, Salmonella enterica enterica serovar Typhi
ccugcauauauccuaacuuauua

SEQ ID NO: 1688689 - RNA, 12 nt, Salmonella enterica enterica serovar Typhi
ccugcccuuuca

SEQ ID NO: 1688690 - RNA, 14 nt, Salmonella enterica enterica serovar Typhi
ccugccgccuccag

SEQ ID NO: 1688691 - RNA, 19 nt, Salmonella enterica enterica serovar Typhi
ccugcccuuucuucaaugg

SEQ ID NO: 1688692 - RNA, 22 nt, Salmonella enterica enterica serovar Typhi
ccugcaacuccugggcaaaaua

SEQ ID NO: 1688693 - RNA, 12 nt, Salmonella enterica enterica serovar Typhi
ccugcaauuccg

SEQ ID NO: 1688694 - RNA, 23 nt, Salmonella enterica enterica serovar Typhi
ccugaauaacccgcagcccugcg

SEQ ID NO: 1688695 - RNA, 15 nt, Salmonella enterica enterica serovar Typhi
ccugaauauggccag

SEQ ID NO: 1688696 - RNA, 20 nt, Salmonella enterica enterica serovar Typhi
ccugaauauggccagucccc

SEQ ID NO: 1688697 - RNA, 14 nt, Salmonella enterica enterica serovar Typhi
ccugaaucauauuc

SEQ ID NO: 1688698 - RNA, 13 nt, Salmonella enterica enterica serovar Typhi
ccugcacuuccag

SEQ ID NO: 1688699 - RNA, 23 nt, Salmonella enterica enterica serovar Typhi
ccugcacguuacccgccagucgg

SEQ ID NO: 1688700 - RNA, 21 nt, Salmonella enterica enterica serovar Typhi
ccuguauuuucguuugcauuc

SEQ ID NO: 1688701 - RNA, 14 nt, Salmonella enterica enterica serovar Typhi
ccuguagcagcgcc

SEQ ID NO: 1688702 - RNA, 15 nt, Salmonella enterica enterica serovar Typhi
ccuguaucaaaccaa

SEQ ID NO: 1688703 - RNA, 14 nt, Salmonella enterica enterica serovar Typhi
ccugugcuuugauu

SEQ ID NO: 1688704 - RNA, 19 nt, Salmonella enterica enterica serovar Typhi
ccugugcuuucgccaccag

SEQ ID NO: 1688705 - RNA, 23 nt, Salmonella enterica enterica serovar Typhi
ccugucgcgccauguugcguaaa

SEQ ID NO: 1688706 - RNA, 16 nt, Salmonella enterica enterica serovar Typhi
ccugucggucuuuuuc

SEQ ID NO: 1688707 - RNA, 18 nt, Salmonella enterica enterica serovar Typhi
ccugucggucuuuuucgc

SEQ ID NO: 1688708 - RNA, 16 nt, Salmonella enterica enterica serovar Typhi
ccugucgaucauccac

SEQ ID NO: 1688709 - RNA, 15 nt, Salmonella enterica enterica serovar Typhi
ccuguaaccccagca

SEQ ID NO: 1688710 - RNA, 21 nt, Salmonella enterica enterica serovar Typhi
ccuguaaccccagcaucugca

SEQ ID NO: 1688711 - RNA, 16 nt, Salmonella enterica enterica serovar Typhi
ccuguaaccuuaaaag

SEQ ID NO: 1688712 - RNA, 18 nt, Salmonella enterica enterica serovar Typhi
ccuguaaacguuccugcc

SEQ ID NO: 1688713 - RNA, 12 nt, Salmonella enterica enterica serovar Typhi
ccuguaaagcuu

SEQ ID NO: 1688714 - RNA, 21 nt, Salmonella enterica enterica serovar Typhi
ccuguaacaacuguuuuucac

SEQ ID NO: 1688715 - RNA, 14 nt, Salmonella enterica enterica serovar Typhi
ccuguaacacacug

SEQ ID NO: 1688716 - RNA, 17 nt, Salmonella enterica enterica serovar Typhi
ccuguaccgggcagaca

SEQ ID NO: 1688717 - RNA, 14 nt, Salmonella enterica enterica serovar Typhi
ccuguaccaccacg

SEQ ID NO: 1688718 - RNA, 17 nt, Salmonella enterica enterica serovar Typhi
ccuguaaggcucucuua

SEQ ID NO: 1688719 - RNA, 20 nt, Salmonella enterica enterica serovar Typhi
ccugguaaggcaaauaugcu

SEQ ID NO: 1688720 - RNA, 16 nt, Salmonella enterica enterica serovar Typhi
ccuggguuccaggcgg

SEQ ID NO: 1688721 - RNA, 18 nt, Salmonella enterica enterica serovar Typhi
ccugggucguugacguga

SEQ ID NO: 1688722 - RNA, 15 nt, Salmonella enterica enterica serovar Typhi
ccuggccaauggcuc

SEQ ID NO: 1688723 - RNA, 17 nt, Salmonella enterica enterica serovar Typhi
ccuggcaguucagucgg

SEQ ID NO: 1688724 - RNA, 21 nt, Salmonella enterica enterica serovar Typhi
ccuggcagguauuaauccugc

SEQ ID NO: 1688725 - RNA, 20 nt, Salmonella enterica enterica serovar Typhi
ccuggcagaaaggugaaaaa

SEQ ID NO: 1688726 - RNA, 14 nt, Salmonella enterica enterica serovar Typhi
ccuggauuuuaccu

SEQ ID NO: 1688727 - RNA, 22 nt, Salmonella enterica enterica serovar Typhi
ccuggcgggcagccuucaaguu

SEQ ID NO: 1688728 - RNA, 14 nt, Salmonella enterica enterica serovar Typhi
ccuggcgggcagcc

SEQ ID NO: 1688729 - RNA, 20 nt, Salmonella enterica enterica serovar Typhi
ccuggcgggaaacagguacu

SEQ ID NO: 1688730 - RNA, 16 nt, Salmonella enterica enterica serovar Typhi
ccuggcguaugcuuuc

SEQ ID NO: 1688731 - RNA, 20 nt, Salmonella enterica enterica serovar Typhi
ccuggcguaugcuuucagca

SEQ ID NO: 1688732 - RNA, 21 nt, Salmonella enterica enterica serovar Typhi
ccuggcgugcgauuugcucaa

SEQ ID NO: 1688733 - RNA, 18 nt, Salmonella enterica enterica serovar Typhi
ccugcugccaucgcuucu

SEQ ID NO: 1688734 - RNA, 23 nt, Salmonella enterica enterica serovar Typhi
ccuggauacguuccagcagcgca

SEQ ID NO: 1688735 - RNA, 18 nt, Salmonella enterica enterica serovar Typhi
ccuggagaucagcauggu

SEQ ID NO: 1688736 - RNA, 18 nt, Salmonella enterica enterica serovar Typhi
ccugcugacaaaaacggc

SEQ ID NO: 1688737 - RNA, 16 nt, Salmonella enterica enterica serovar Typhi
ccuggagagcagcgcc

SEQ ID NO: 1688738 - RNA, 20 nt, Salmonella enterica enterica serovar Typhi
ccugcugccagccgccgccg

SEQ ID NO: 1688739 - RNA, 21 nt, Salmonella enterica enterica serovar Typhi
ccugcugacuacgguugccuu

SEQ ID NO: 1688740 - RNA, 23 nt, Salmonella enterica enterica serovar Typhi
ccugcgugccguugaccagcuga

SEQ ID NO: 1688741 - RNA, 15 nt, Salmonella enterica enterica serovar Typhi
ccgccgcuggcgggc

SEQ ID NO: 1688742 - RNA, 18 nt, Salmonella enterica enterica serovar Typhi
ccgccgcuggucaacacg

SEQ ID NO: 1688743 - RNA, 23 nt, Salmonella enterica enterica serovar Typhi
ccgccggagaggggacucaccgu

SEQ ID NO: 1688744 - RNA, 17 nt, Salmonella enterica enterica serovar Typhi
ccgccgccaaacugcgc

SEQ ID NO: 1688745 - RNA, 18 nt, Salmonella enterica enterica serovar Typhi
ccgccgcaggccaucaua

SEQ ID NO: 1688746 - RNA, 14 nt, Salmonella enterica enterica serovar Typhi
ccgccgcacaggcg

SEQ ID NO: 1688747 - RNA, 14 nt, Salmonella enterica enterica serovar Typhi
ccgccgcaacgcgc

SEQ ID NO: 1688748 - RNA, 18 nt, Salmonella enterica enterica serovar Typhi
ccgccgcaauuccugacu

SEQ ID NO: 1688749 - RNA, 14 nt, Salmonella enterica enterica serovar Typhi
ccgccgcgagcagc

SEQ ID NO: 1688750 - RNA, 13 nt, Salmonella enterica enterica serovar Typhi
ccgccgcgaccag

SEQ ID NO: 1688751 - RNA, 19 nt, Salmonella enterica enterica serovar Typhi
ccgccgccagcaccgccgc

SEQ ID NO: 1688752 - RNA, 14 nt, Salmonella enterica enterica serovar Typhi
ccgccgcggccagc

SEQ ID NO: 1688753 - RNA, 18 nt, Salmonella enterica enterica serovar Typhi
ccgccgcuauuaccccgc

SEQ ID NO: 1688754 - RNA, 20 nt, Salmonella enterica enterica serovar Typhi
ccgccgcguccuaccgccgc

SEQ ID NO: 1688755 - RNA, 17 nt, Salmonella enterica enterica serovar Typhi
ccgccgcgauguuugcu

SEQ ID NO: 1688756 - RNA, 16 nt, Salmonella enterica enterica serovar Typhi
ccgccccagcagcagc

SEQ ID NO: 1688757 - RNA, 14 nt, Salmonella enterica enterica serovar Typhi
ccgcccauccaggg

SEQ ID NO: 1688758 - RNA, 13 nt, Salmonella enterica enterica serovar Typhi
ccgcccagucacg

SEQ ID NO: 1688759 - RNA, 18 nt, Salmonella enterica enterica serovar Typhi
ccgcccaguaccagcacu

SEQ ID NO: 1688760 - RNA, 22 nt, Salmonella enterica enterica serovar Typhi
ccgcccauuaauaucagcccca

SEQ ID NO: 1688761 - RNA, 13 nt, Salmonella enterica enterica serovar Typhi
ccgcccauccaga

SEQ ID NO: 1688762 - RNA, 22 nt, Salmonella enterica enterica serovar Typhi
ccgccaucuuuacccugagccu

SEQ ID NO: 1688763 - RNA, 12 nt, Salmonella enterica enterica serovar Typhi
ccgccaugaaaa

SEQ ID NO: 1688764 - RNA, 22 nt, Salmonella enterica enterica serovar Typhi
ccgccauugccaguaccgacgc

SEQ ID NO: 1688765 - RNA, 17 nt, Salmonella enterica enterica serovar Typhi
ccgccaucuccggcagc

SEQ ID NO: 1688766 - RNA, 20 nt, Salmonella enterica enterica serovar Typhi
ccgccaucucauucgccagc

SEQ ID NO: 1688767 - RNA, 13 nt, Salmonella enterica enterica serovar Typhi
ccgcccguccgcu

SEQ ID NO: 1688768 - RNA, 20 nt, Salmonella enterica enterica serovar Typhi
ccgccgagcauuuccgcagc

SEQ ID NO: 1688769 - RNA, 21 nt, Salmonella enterica enterica serovar Typhi
ccgcgcagaaucacuucaucc

SEQ ID NO: 1688770 - RNA, 12 nt, Salmonella enterica enterica serovar Typhi
ccgcgccgccgc

SEQ ID NO: 1688771 - RNA, 18 nt, Salmonella enterica enterica serovar Typhi
ccgccuugcggcgccagg

SEQ ID NO: 1688772 - RNA, 17 nt, Salmonella enterica enterica serovar Typhi
ccgccuucagcgcgccc

SEQ ID NO: 1688773 - RNA, 22 nt, Salmonella enterica enterica serovar Typhi
ccgccugccagauccaacacau

SEQ ID NO: 1688774 - RNA, 15 nt, Salmonella enterica enterica serovar Typhi
ccgccugccgcgccc

SEQ ID NO: 1688775 - RNA, 18 nt, Salmonella enterica enterica serovar Typhi
ccgcgaggaucugcuuau

SEQ ID NO: 1688776 - RNA, 15 nt, Salmonella enterica enterica serovar Typhi
ccgcgacuuuggcuu

SEQ ID NO: 1688777 - RNA, 16 nt, Salmonella enterica enterica serovar Typhi
ccgccugaaucgccgc

SEQ ID NO: 1688778 - RNA, 11 nt, Salmonella enterica enterica serovar Typhi
ccgccuccggg

SEQ ID NO: 1688779 - RNA, 16 nt, Salmonella enterica enterica serovar Typhi
ccgccucgaccccuuc

SEQ ID NO: 1688780 - RNA, 20 nt, Salmonella enterica enterica serovar Typhi
ccgccucgcgauccgccagc

SEQ ID NO: 1688781 - RNA, 15 nt, Salmonella enterica enterica serovar Typhi
ccgccgugcucacua

SEQ ID NO: 1688782 - RNA, 16 nt, Salmonella enterica enterica serovar Typhi
ccgccuaacagcgccg

SEQ ID NO: 1688783 - RNA, 12 nt, Salmonella enterica enterica serovar Typhi
ccgccucaaacg

SEQ ID NO: 1688784 - RNA, 14 nt, Salmonella enterica enterica serovar Typhi
ccgccgugauaaau

SEQ ID NO: 1688785 - RNA, 12 nt, Salmonella enterica enterica serovar Typhi
ccgccguccugg

SEQ ID NO: 1688786 - RNA, 17 nt, Salmonella enterica enterica serovar Typhi
ccgccgggcgucacccg

SEQ ID NO: 1688787 - RNA, 15 nt, Salmonella enterica enterica serovar Typhi
ccgccgggcaacacg

SEQ ID NO: 1688788 - RNA, 13 nt, Salmonella enterica enterica serovar Typhi
ccgcucugcuguu

SEQ ID NO: 1688789 - RNA, 20 nt, Salmonella enterica enterica serovar Typhi
ccgcucaccaccgccgcgag

SEQ ID NO: 1688790 - RNA, 18 nt, Salmonella enterica enterica serovar Typhi
ccgcuuccagcgcgucgg

SEQ ID NO: 1688791 - RNA, 12 nt, Salmonella enterica enterica serovar Typhi
ccgcuuccagcg

SEQ ID NO: 1688792 - RNA, 23 nt, Salmonella enterica enterica serovar Typhi
ccgcuucauuggcgucugcuggc

SEQ ID NO: 1688793 - RNA, 13 nt, Salmonella enterica enterica serovar Typhi
ccgcuuccagaau

SEQ ID NO: 1688794 - RNA, 21 nt, Salmonella enterica enterica serovar Typhi
ccgcuguuaugcacgcgcggc

SEQ ID NO: 1688795 - RNA, 19 nt, Salmonella enterica enterica serovar Typhi
ccgcuguuacugucggcga

SEQ ID NO: 1688796 - RNA, 16 nt, Salmonella enterica enterica serovar Typhi
ccgcuucacgcgcggc

SEQ ID NO: 1688797 - RNA, 19 nt, Salmonella enterica enterica serovar Typhi
ccgcuuaaauuaccgccgc

SEQ ID NO: 1688798 - RNA, 12 nt, Salmonella enterica enterica serovar Typhi
ccgcuggcgucu

SEQ ID NO: 1688799 - RNA, 12 nt, Salmonella enterica enterica serovar Typhi
ccgcuggaauaa

SEQ ID NO: 1688800 - RNA, 16 nt, Salmonella enterica enterica serovar Typhi
ccgcguuguccccuca

SEQ ID NO: 1688801 - RNA, 19 nt, Salmonella enterica enterica serovar Typhi
ccgcguugguuaaggcggc

SEQ ID NO: 1688802 - RNA, 14 nt, Salmonella enterica enterica serovar Typhi
ccgcguuggcggcu

SEQ ID NO: 1688803 - RNA, 13 nt, Salmonella enterica enterica serovar Typhi
ccgcguuuuagca

SEQ ID NO: 1688804 - RNA, 16 nt, Salmonella enterica enterica serovar Typhi
ccgcuaucgccaaacu

SEQ ID NO: 1688805 - RNA, 20 nt, Salmonella enterica enterica serovar Typhi
ccgcguagcccagcgccgca

SEQ ID NO: 1688806 - RNA, 19 nt, Salmonella enterica enterica serovar Typhi
ccgcguaucauugcgcucu

SEQ ID NO: 1688807 - RNA, 20 nt, Salmonella enterica enterica serovar Typhi
ccgcguccuaccgccgcgau

SEQ ID NO: 1688808 - RNA, 13 nt, Salmonella enterica enterica serovar Typhi
ccgcgucccgacc

SEQ ID NO: 1688809 - RNA, 12 nt, Salmonella enterica enterica serovar Typhi
ccgcgucagcac

SEQ ID NO: 1688810 - RNA, 20 nt, Salmonella enterica enterica serovar Typhi
ccgcguaccugugcagguac

SEQ ID NO: 1688811 - RNA, 13 nt, Salmonella enterica enterica serovar Typhi
ccgcguaaaaagu

SEQ ID NO: 1688812 - RNA, 19 nt, Salmonella enterica enterica serovar Typhi
ccgcgguacgaaucgccgc

SEQ ID NO: 1688813 - RNA, 15 nt, Salmonella enterica enterica serovar Typhi
ccgcggcggacagcg

SEQ ID NO: 1688814 - RNA, 20 nt, Salmonella enterica enterica serovar Typhi
ccgcggcggacagcggcagc

SEQ ID NO: 1688815 - RNA, 13 nt, Salmonella enterica enterica serovar Typhi
ccgcgcgaagagg

SEQ ID NO: 1688816 - RNA, 17 nt, Salmonella enterica enterica serovar Typhi
ccgcgccuaccagcgcu

SEQ ID NO: 1688817 - RNA, 12 nt, Salmonella enterica enterica serovar Typhi
ccgcgccgucgg

SEQ ID NO: 1688818 - RNA, 21 nt, Salmonella enterica enterica serovar Typhi
ccggcauuaugcaggcgucgg

SEQ ID NO: 1688819 - RNA, 20 nt, Salmonella enterica enterica serovar Typhi
ccggcaggcagcgccagcgg

SEQ ID NO: 1688820 - RNA, 18 nt, Salmonella enterica enterica serovar Typhi
ccggcaggagcggagaga

SEQ ID NO: 1688821 - RNA, 18 nt, Salmonella enterica enterica serovar Typhi
ccggcacggucaaucauc

SEQ ID NO: 1688822 - RNA, 19 nt, Salmonella enterica enterica serovar Typhi
ccggauagcggcuucgcca

SEQ ID NO: 1688823 - RNA, 20 nt, Salmonella enterica enterica serovar Typhi
ccggauaauacgaaauugag

SEQ ID NO: 1688824 - RNA, 22 nt, Salmonella enterica enterica serovar Typhi
ccggauaaggcggagccgccau

SEQ ID NO: 1688825 - RNA, 23 nt, Salmonella enterica enterica serovar Typhi
ccggauaaggcgcuugcgccgcc

SEQ ID NO: 1688826 - RNA, 21 nt, Salmonella enterica enterica serovar Typhi
ccggauaaggcgcuugugaua

SEQ ID NO: 1688827 - RNA, 14 nt, Salmonella enterica enterica serovar Typhi
ccggcacgcgcagc

SEQ ID NO: 1688828 - RNA, 21 nt, Salmonella enterica enterica serovar Typhi
ccgcuuuugccgcgacuuccg

SEQ ID NO: 1688829 - RNA, 16 nt, Salmonella enterica enterica serovar Typhi
ccgcuuuuuccagcau

SEQ ID NO: 1688830 - RNA, 22 nt, Salmonella enterica enterica serovar Typhi
ccggaaagaauaaucgccgccg

SEQ ID NO: 1688831 - RNA, 12 nt, Salmonella enterica enterica serovar Typhi
ccggaaaucaca

SEQ ID NO: 1688832 - RNA, 22 nt, Salmonella enterica enterica serovar Typhi
ccggaaaucacaaacaccacca

SEQ ID NO: 1688833 - RNA, 13 nt, Salmonella enterica enterica serovar Typhi
ccgcuuugauuug

SEQ ID NO: 1688834 - RNA, 16 nt, Salmonella enterica enterica serovar Typhi
ccgcuuugccgcgcuc

SEQ ID NO: 1688835 - RNA, 18 nt, Salmonella enterica enterica serovar Typhi
ccgcuuuaccgccuuccu

SEQ ID NO: 1688836 - RNA, 21 nt, Salmonella enterica enterica serovar Typhi
ccgcuuuaucguaaccgaugu

SEQ ID NO: 1688837 - RNA, 20 nt, Salmonella enterica enterica serovar Typhi
ccggaagcgauugucggcgc

SEQ ID NO: 1688838 - RNA, 17 nt, Salmonella enterica enterica serovar Typhi
ccggaaccuguccuuua

SEQ ID NO: 1688839 - RNA, 14 nt, Salmonella enterica enterica serovar Typhi
ccggaacagggccg

SEQ ID NO: 1688840 - RNA, 20 nt, Salmonella enterica enterica serovar Typhi
ccggaacaggcuuuucaggc

SEQ ID NO: 1688841 - RNA, 17 nt, Salmonella enterica enterica serovar Typhi
ccggaacaaaagaaagc

SEQ ID NO: 1688842 - RNA, 22 nt, Salmonella enterica enterica serovar Typhi
ccggaaauggucgcuccggaac

SEQ ID NO: 1688843 - RNA, 15 nt, Salmonella enterica enterica serovar Typhi
ccggaacaaaagaaa

SEQ ID NO: 1688844 - RNA, 20 nt, Salmonella enterica enterica serovar Typhi
ccggacuccaggcaacguug

SEQ ID NO: 1688845 - RNA, 19 nt, Salmonella enterica enterica serovar Typhi
ccggagaggcguucaugcc

SEQ ID NO: 1688846 - RNA, 16 nt, Salmonella enterica enterica serovar Typhi
ccggauaacggcgcga

SEQ ID NO: 1688847 - RNA, 22 nt, Salmonella enterica enterica serovar Typhi
ccggauaagcgcagcgccauca

SEQ ID NO: 1688848 - RNA, 21 nt, Salmonella enterica enterica serovar Typhi
ccggauaaggcgcuugcgcca

SEQ ID NO: 1688849 - RNA, 21 nt, Salmonella enterica enterica serovar Typhi
ccggauaaggcgcuugcgccg

SEQ ID NO: 1688850 - RNA, 22 nt, Salmonella enterica enterica serovar Typhi
ccggauaaggcgcuugcgccgc

SEQ ID NO: 1688851 - RNA, 21 nt, Salmonella enterica enterica serovar Typhi
ccggaaucgccugcgucgccc

SEQ ID NO: 1688852 - RNA, 15 nt, Salmonella enterica enterica serovar Typhi
ccggaauuugcuucu

SEQ ID NO: 1688853 - RNA, 20 nt, Salmonella enterica enterica serovar Typhi
ccggacaacgcaaacuguau

SEQ ID NO: 1688854 - RNA, 14 nt, Salmonella enterica enterica serovar Typhi
ccggacaaggcggu

SEQ ID NO: 1688855 - RNA, 21 nt, Salmonella enterica enterica serovar Typhi
ccggacaaggcgguacgccgc

SEQ ID NO: 1688856 - RNA, 14 nt, Salmonella enterica enterica serovar Typhi
ccggacaucauccc

SEQ ID NO: 1688857 - RNA, 16 nt, Salmonella enterica enterica serovar Typhi
ccgaggcuaagccaga

SEQ ID NO: 1688858 - RNA, 23 nt, Salmonella enterica enterica serovar Typhi
ccgagccgcccuucacaaccauc

SEQ ID NO: 1688859 - RNA, 15 nt, Salmonella enterica enterica serovar Typhi
ccgauaacgcggccc

SEQ ID NO: 1688860 - RNA, 22 nt, Salmonella enterica enterica serovar Typhi
ccgagugcuuauguaggccuga

SEQ ID NO: 1688861 - RNA, 20 nt, Salmonella enterica enterica serovar Typhi
ccgaguggaaucagccagga

SEQ ID NO: 1688862 - RNA, 16 nt, Salmonella enterica enterica serovar Typhi
ccgaguuucugguaga

SEQ ID NO: 1688863 - RNA, 23 nt, Salmonella enterica enterica serovar Typhi
ccgaucagcaccacgcccggauc

SEQ ID NO: 1688864 - RNA, 17 nt, Salmonella enterica enterica serovar Typhi
ccgaucaggccgcagac

SEQ ID NO: 1688865 - RNA, 12 nt, Salmonella enterica enterica serovar Typhi
ccgaucucccag

SEQ ID NO: 1688866 - RNA, 13 nt, Salmonella enterica enterica serovar Typhi
ccgaucucccagc

SEQ ID NO: 1688867 - RNA, 22 nt, Salmonella enterica enterica serovar Typhi
ccgaucuacgcuauuuccagaa

SEQ ID NO: 1688868 - RNA, 22 nt, Salmonella enterica enterica serovar Typhi
ccgaucaucccgcccagcaaca

SEQ ID NO: 1688869 - RNA, 12 nt, Salmonella enterica enterica serovar Typhi
ccgagcaacaga

SEQ ID NO: 1688870 - RNA, 23 nt, Salmonella enterica enterica serovar Typhi
ccgacguuaaaugucugaauauu

SEQ ID NO: 1688871 - RNA, 16 nt, Salmonella enterica enterica serovar Typhi
ccgacuaauuauuuuu

SEQ ID NO: 1688872 - RNA, 22 nt, Salmonella enterica enterica serovar Typhi
ccgacuuuuuugccuuucagau

SEQ ID NO: 1688873 - RNA, 14 nt, Salmonella enterica enterica serovar Typhi
ccgagaauccacuc

SEQ ID NO: 1688874 - RNA, 17 nt, Salmonella enterica enterica serovar Typhi
ccgacgaaaaagccaaa

SEQ ID NO: 1688875 - RNA, 16 nt, Salmonella enterica enterica serovar Typhi
ccgacgacaagcagaa

SEQ ID NO: 1688876 - RNA, 13 nt, Salmonella enterica enterica serovar Typhi
ccgaaucgccgcu

SEQ ID NO: 1688877 - RNA, 13 nt, Salmonella enterica enterica serovar Typhi
ccgacgccagcca

SEQ ID NO: 1688878 - RNA, 13 nt, Salmonella enterica enterica serovar Typhi
ccgacguaguuca

SEQ ID NO: 1688879 - RNA, 18 nt, Salmonella enterica enterica serovar Typhi
ccgacgguuauugcgcug

SEQ ID NO: 1688880 - RNA, 10 nt, Salmonella enterica enterica serovar Typhi
ccgcagccgg

SEQ ID NO: 1688881 - RNA, 14 nt, Salmonella enterica enterica serovar Typhi
ccgcagccagaaca

SEQ ID NO: 1688882 - RNA, 22 nt, Salmonella enterica enterica serovar Typhi
ccgcagccaacaacaggccgcc

SEQ ID NO: 1688883 - RNA, 16 nt, Salmonella enterica enterica serovar Typhi
ccgcaggagagccaga

SEQ ID NO: 1688884 - RNA, 17 nt, Salmonella enterica enterica serovar Typhi
ccgcaggcucuuuuucu

SEQ ID NO: 1688885 - RNA, 14 nt, Salmonella enterica enterica serovar Typhi
ccgcaggccuggcu

SEQ ID NO: 1688886 - RNA, 14 nt, Salmonella enterica enterica serovar Typhi
ccgcaggcuuccag

SEQ ID NO: 1688887 - RNA, 20 nt, Salmonella enterica enterica serovar Typhi
ccgcagugaagaauggcgcc

SEQ ID NO: 1688888 - RNA, 15 nt, Salmonella enterica enterica serovar Typhi
ccgcaauacagcccg

SEQ ID NO: 1688889 - RNA, 16 nt, Salmonella enterica enterica serovar Typhi
ccgcacgguuagccgg

SEQ ID NO: 1688890 - RNA, 15 nt, Salmonella enterica enterica serovar Typhi
ccgcaaacgccgaag

SEQ ID NO: 1688891 - RNA, 13 nt, Salmonella enterica enterica serovar Typhi
ccgcaaaaaauac

SEQ ID NO: 1688892 - RNA, 12 nt, Salmonella enterica enterica serovar Typhi
ccgcaaaaccuu

SEQ ID NO: 1688893 - RNA, 21 nt, Salmonella enterica enterica serovar Typhi
ccgcaaaaccuucauaaauac

SEQ ID NO: 1688894 - RNA, 12 nt, Salmonella enterica enterica serovar Typhi
ccgauuuuucgg

SEQ ID NO: 1688895 - RNA, 18 nt, Salmonella enterica enterica serovar Typhi
ccgauuuuucggcacgcu

SEQ ID NO: 1688896 - RNA, 22 nt, Salmonella enterica enterica serovar Typhi
ccgauuuuuuaucucgccgucg

SEQ ID NO: 1688897 - RNA, 23 nt, Salmonella enterica enterica serovar Typhi
ccgcaagaaacaggcugacaaag

SEQ ID NO: 1688898 - RNA, 18 nt, Salmonella enterica enterica serovar Typhi
ccgcaacugaaaccaggc

SEQ ID NO: 1688899 - RNA, 15 nt, Salmonella enterica enterica serovar Typhi
ccgcaacggucgguc

SEQ ID NO: 1688900 - RNA, 20 nt, Salmonella enterica enterica serovar Typhi
ccgaugucgccacgccgccc

SEQ ID NO: 1688901 - RNA, 15 nt, Salmonella enterica enterica serovar Typhi
ccgaugaacgacgcu

SEQ ID NO: 1688902 - RNA, 21 nt, Salmonella enterica enterica serovar Typhi
ccgaugagaaguagcccauau

SEQ ID NO: 1688903 - RNA, 21 nt, Salmonella enterica enterica serovar Typhi
cccuguaacagaauuaacgca

SEQ ID NO: 1688904 - RNA, 22 nt, Salmonella enterica enterica serovar Typhi
cccuguuauucagggcuuuauu

SEQ ID NO: 1688905 - RNA, 14 nt, Salmonella enterica enterica serovar Typhi
cccuguccuccaug

SEQ ID NO: 1688906 - RNA, 20 nt, Salmonella enterica enterica serovar Typhi
cccuguggaaacuccagcgg

SEQ ID NO: 1688907 - RNA, 14 nt, Salmonella enterica enterica serovar Typhi
cccuuaucaaaggc

SEQ ID NO: 1688908 - RNA, 21 nt, Salmonella enterica enterica serovar Typhi
cccuuaugucauucaggucua

SEQ ID NO: 1688909 - RNA, 11 nt, Salmonella enterica enterica serovar Typhi
cccuuaucugg

SEQ ID NO: 1688910 - RNA, 19 nt, Salmonella enterica enterica serovar Typhi
cccuuaucuggaugaggac

SEQ ID NO: 1688911 - RNA, 23 nt, Salmonella enterica enterica serovar Typhi
cccuucgcggaauuucaggaagc

SEQ ID NO: 1688912 - RNA, 14 nt, Salmonella enterica enterica serovar Typhi
cccuucgcccggcg

SEQ ID NO: 1688913 - RNA, 22 nt, Salmonella enterica enterica serovar Typhi
cccuucgacaaucagcaccauu

SEQ ID NO: 1688914 - RNA, 16 nt, Salmonella enterica enterica serovar Typhi
cccuucaccgcuuuuc

SEQ ID NO: 1688915 - RNA, 14 nt, Salmonella enterica enterica serovar Typhi
cccuucaucuucca

SEQ ID NO: 1688916 - RNA, 20 nt, Salmonella enterica enterica serovar Typhi
ccgaauagcgacaaaugaag

SEQ ID NO: 1688917 - RNA, 14 nt, Salmonella enterica enterica serovar Typhi
ccgaacaugccgcc

SEQ ID NO: 1688918 - RNA, 18 nt, Salmonella enterica enterica serovar Typhi
ccgaagaacagauucauu

SEQ ID NO: 1688919 - RNA, 13 nt, Salmonella enterica enterica serovar Typhi
cccuuuuugcauu

SEQ ID NO: 1688920 - RNA, 21 nt, Salmonella enterica enterica serovar Typhi
cccuuuuugcauucgcuccuc

SEQ ID NO: 1688921 - RNA, 12 nt, Salmonella enterica enterica serovar Typhi
cccuugcgcguu

SEQ ID NO: 1688922 - RNA, 15 nt, Salmonella enterica enterica serovar Typhi
cccugagucuugccu

SEQ ID NO: 1688923 - RNA, 13 nt, Salmonella enterica enterica serovar Typhi
cccugagcccaca

SEQ ID NO: 1688924 - RNA, 14 nt, Salmonella enterica enterica serovar Typhi
cccugacgccgcug

SEQ ID NO: 1688925 - RNA, 18 nt, Salmonella enterica enterica serovar Typhi
cccugaauuucaauaauc

SEQ ID NO: 1688926 - RNA, 11 nt, Salmonella enterica enterica serovar Typhi
cccugaaacug

SEQ ID NO: 1688927 - RNA, 16 nt, Salmonella enterica enterica serovar Typhi
cccugaaaccguggaa

SEQ ID NO: 1688928 - RNA, 14 nt, Salmonella enterica enterica serovar Typhi
cccugauggcgcgc

SEQ ID NO: 1688929 - RNA, 13 nt, Salmonella enterica enterica serovar Typhi
cccugauguagcu

SEQ ID NO: 1688930 - RNA, 21 nt, Salmonella enterica enterica serovar Typhi
cccugauauacaaaacccaua

SEQ ID NO: 1688931 - RNA, 23 nt, Salmonella enterica enterica serovar Typhi
cccugauauacaaaacccauauc

SEQ ID NO: 1688932 - RNA, 21 nt, Salmonella enterica enterica serovar Typhi
cccugcaaacuauguacgcca

SEQ ID NO: 1688933 - RNA, 24 nt, Salmonella enterica enterica serovar Typhi
cccugcaaagcaaaaaucaccaca

SEQ ID NO: 1688934 - RNA, 19 nt, Salmonella enterica enterica serovar Typhi
cccucugagcugguguaau

SEQ ID NO: 1688935 - RNA, 16 nt, Salmonella enterica enterica serovar Typhi
cccucugauuggcugu

SEQ ID NO: 1688936 - RNA, 14 nt, Salmonella enterica enterica serovar Typhi
cccucuuccaucag

SEQ ID NO: 1688937 - RNA, 20 nt, Salmonella enterica enterica serovar Typhi
cccugccgucucaaccagca

SEQ ID NO: 1688938 - RNA, 19 nt, Salmonella enterica enterica serovar Typhi
cccugcgaacagcgcucca

SEQ ID NO: 1688939 - RNA, 19 nt, Salmonella enterica enterica serovar Typhi
cccugcgccucaagcgcuu

SEQ ID NO: 1688940 - RNA, 15 nt, Salmonella enterica enterica serovar Typhi
cccugcgcggccugc

SEQ ID NO: 1688941 - RNA, 20 nt, Salmonella enterica enterica serovar Typhi
cccugcgcggccugcgccag

SEQ ID NO: 1688942 - RNA, 17 nt, Salmonella enterica enterica serovar Typhi
cccugcgcuuucaacca

SEQ ID NO: 1688943 - RNA, 20 nt, Salmonella enterica enterica serovar Typhi
cccugccagcguaagcgccc

SEQ ID NO: 1688944 - RNA, 17 nt, Salmonella enterica enterica serovar Typhi
cccugccacaaccgccc

SEQ ID NO: 1688945 - RNA, 23 nt, Salmonella enterica enterica serovar Typhi
cccugccacaacggcaauuuuua

SEQ ID NO: 1688946 - RNA, 18 nt, Salmonella enterica enterica serovar Typhi
cccugccauucccagccg

SEQ ID NO: 1688947 - RNA, 16 nt, Salmonella enterica enterica serovar Typhi
cccugcgguagcgccg

SEQ ID NO: 1688948 - RNA, 22 nt, Salmonella enterica enterica serovar Typhi
cccugcgguagcuccagacagg

SEQ ID NO: 1688949 - RNA, 13 nt, Salmonella enterica enterica serovar Typhi
cccugcucccaca

SEQ ID NO: 1688950 - RNA, 14 nt, Salmonella enterica enterica serovar Typhi
cccugcuccugcca

SEQ ID NO: 1688951 - RNA, 13 nt, Salmonella enterica enterica serovar Typhi
cccugcuccugcc

SEQ ID NO: 1688952 - RNA, 21 nt, Salmonella enterica enterica serovar Typhi
cccugcuggcgaaccaccagc

SEQ ID NO: 1688953 - RNA, 17 nt, Salmonella enterica enterica serovar Typhi
cccugcugauacacaac

SEQ ID NO: 1688954 - RNA, 18 nt, Salmonella enterica enterica serovar Typhi
cggcgcauuuucggcagc

SEQ ID NO: 1688955 - RNA, 12 nt, Salmonella enterica enterica serovar Typhi
cggcgccaacgc

SEQ ID NO: 1688956 - RNA, 18 nt, Salmonella enterica enterica serovar Typhi
cggcgccaaucaccgcca

SEQ ID NO: 1688957 - RNA, 21 nt, Salmonella enterica enterica serovar Typhi
cggcgccaaucaccgccagca

SEQ ID NO: 1688958 - RNA, 21 nt, Salmonella enterica enterica serovar Typhi
cggcgccaauuaacucuuccg

SEQ ID NO: 1688959 - RNA, 13 nt, Salmonella enterica enterica serovar Typhi
cggcgcacugccu

SEQ ID NO: 1688960 - RNA, 18 nt, Salmonella enterica enterica serovar Typhi
cggcgcacuuccucuccc

SEQ ID NO: 1688961 - RNA, 23 nt, Salmonella enterica enterica serovar Typhi
cggcgcagcgaccuccgcgcagc

SEQ ID NO: 1688962 - RNA, 19 nt, Salmonella enterica enterica serovar Typhi
cggcgcaaauggcugcgac

SEQ ID NO: 1688963 - RNA, 15 nt, Salmonella enterica enterica serovar Typhi
cggcgcaaaucgcca

SEQ ID NO: 1688964 - RNA, 17 nt, Salmonella enterica enterica serovar Typhi
cggcgauuuccagcgcc

SEQ ID NO: 1688965 - RNA, 19 nt, Salmonella enterica enterica serovar Typhi
cggcgauuuccagcgccgc

SEQ ID NO: 1688966 - RNA, 23 nt, Salmonella enterica enterica serovar Typhi
cggcgccgaucaucccgcccagc

SEQ ID NO: 1688967 - RNA, 15 nt, Salmonella enterica enterica serovar Typhi
cggcgcccauccgcc

SEQ ID NO: 1688968 - RNA, 14 nt, Salmonella enterica enterica serovar Typhi
cggcgcccggaggg

SEQ ID NO: 1688969 - RNA, 17 nt, Salmonella enterica enterica serovar Typhi
cggcgcccagccugccu

SEQ ID NO: 1688970 - RNA, 22 nt, Salmonella enterica enterica serovar Typhi
cggcgcccagcuuacgcgcaga

SEQ ID NO: 1688971 - RNA, 21 nt, Salmonella enterica enterica serovar Typhi
cggcgcccagcuuacgcgcag

SEQ ID NO: 1688972 - RNA, 20 nt, Salmonella enterica enterica serovar Typhi
cggcgcgucgggcagggaug

SEQ ID NO: 1688973 - RNA, 20 nt, Salmonella enterica enterica serovar Typhi
cggcgcgucuucccggcgcu

SEQ ID NO: 1688974 - RNA, 23 nt, Salmonella enterica enterica serovar Typhi
cggcgcgggugaugacgcgcagg

SEQ ID NO: 1688975 - RNA, 13 nt, Salmonella enterica enterica serovar Typhi
cggcgcgccgcuc

SEQ ID NO: 1688976 - RNA, 14 nt, Salmonella enterica enterica serovar Typhi
cggcgcgccuucca

SEQ ID NO: 1688977 - RNA, 20 nt, Salmonella enterica enterica serovar Typhi
cggcgcgccuuccagcaauu

SEQ ID NO: 1688978 - RNA, 24 nt, Salmonella enterica enterica serovar Typhi
cggcgcgaaacaggucggcaugca

SEQ ID NO: 1688979 - RNA, 17 nt, Salmonella enterica enterica serovar Typhi
cggcgcgaaagcgccuu

SEQ ID NO: 1688980 - RNA, 14 nt, Salmonella enterica enterica serovar Typhi
cggcgccuuccggc

SEQ ID NO: 1688981 - RNA, 17 nt, Salmonella enterica enterica serovar Typhi
cggcgcgauauccacca

SEQ ID NO: 1688982 - RNA, 14 nt, Salmonella enterica enterica serovar Typhi
cggcgcgaaucccg

SEQ ID NO: 1688983 - RNA, 22 nt, Salmonella enterica enterica serovar Typhi
cggcgauaaaugucaggaucag

SEQ ID NO: 1688984 - RNA, 16 nt, Salmonella enterica enterica serovar Typhi
cggcgauagcgcccca

SEQ ID NO: 1688985 - RNA, 20 nt, Salmonella enterica enterica serovar Typhi
cggcgaccuucacgccgcca

SEQ ID NO: 1688986 - RNA, 15 nt, Salmonella enterica enterica serovar Typhi
cggcgacgcccgcca

SEQ ID NO: 1688987 - RNA, 18 nt, Salmonella enterica enterica serovar Typhi
cggcgacuauugcgccga

SEQ ID NO: 1688988 - RNA, 20 nt, Salmonella enterica enterica serovar Typhi
cggcgacggacucgcgcaga

SEQ ID NO: 1688989 - RNA, 16 nt, Salmonella enterica enterica serovar Typhi
cggcgacgugacgcgc

SEQ ID NO: 1688990 - RNA, 18 nt, Salmonella enterica enterica serovar Typhi
cggcgaauuaaucgucga

SEQ ID NO: 1688991 - RNA, 16 nt, Salmonella enterica enterica serovar Typhi
cggcgacaagaauaug

SEQ ID NO: 1688992 - RNA, 14 nt, Salmonella enterica enterica serovar Typhi
cggcgaccggcaaa

SEQ ID NO: 1688993 - RNA, 15 nt, Salmonella enterica enterica serovar Typhi
cggcgaaggucgcgc

SEQ ID NO: 1688994 - RNA, 18 nt, Salmonella enterica enterica serovar Typhi
cggcgaaggucgcgccgc

SEQ ID NO: 1688995 - RNA, 17 nt, Salmonella enterica enterica serovar Typhi
cggcgaagggggccggg

SEQ ID NO: 1688996 - RNA, 18 nt, Salmonella enterica enterica serovar Typhi
cggcgaacucggucaggg

SEQ ID NO: 1688997 - RNA, 15 nt, Salmonella enterica enterica serovar Typhi
cggcgaaccggcauc

SEQ ID NO: 1688998 - RNA, 19 nt, Salmonella enterica enterica serovar Typhi
cggcgaaccggcaucggca

SEQ ID NO: 1688999 - RNA, 18 nt, Salmonella enterica enterica serovar Typhi
cggcgaacguuggcuggg

SEQ ID NO: 1689000 - RNA, 13 nt, Salmonella enterica enterica serovar Typhi
cggcccaggcauc

SEQ ID NO: 1689001 - RNA, 23 nt, Salmonella enterica enterica serovar Typhi
cggccaugacucaaacagauagc

SEQ ID NO: 1689002 - RNA, 18 nt, Salmonella enterica enterica serovar Typhi
cggcgaaaaagccggcgg

SEQ ID NO: 1689003 - RNA, 21 nt, Salmonella enterica enterica serovar Typhi
cggcgaaagaagcgcuggaga

SEQ ID NO: 1689004 - RNA, 18 nt, Salmonella enterica enterica serovar Typhi
cggcgaaaaccgagcauc

SEQ ID NO: 1689005 - RNA, 18 nt, Salmonella enterica enterica serovar Typhi
cggcugaguucaggcacg

SEQ ID NO: 1689006 - RNA, 22 nt, Salmonella enterica enterica serovar Typhi
cggcugacgauacucagcccca

SEQ ID NO: 1689007 - RNA, 22 nt, Salmonella enterica enterica serovar Typhi
cggcucgccuuugcgcccguac

SEQ ID NO: 1689008 - RNA, 22 nt, Salmonella enterica enterica serovar Typhi
cggcuccagguugcucagguua

SEQ ID NO: 1689009 - RNA, 16 nt, Salmonella enterica enterica serovar Typhi
cggcgugaauaaaaua

SEQ ID NO: 1689010 - RNA, 22 nt, Salmonella enterica enterica serovar Typhi
cggcgugaaagcgcuugauaau

SEQ ID NO: 1689011 - RNA, 14 nt, Salmonella enterica enterica serovar Typhi
cggcgugaaagcgc

SEQ ID NO: 1689012 - RNA, 14 nt, Salmonella enterica enterica serovar Typhi
cggcgucugaugaa

SEQ ID NO: 1689013 - RNA, 16 nt, Salmonella enterica enterica serovar Typhi
cggcgucugcgcgcug

SEQ ID NO: 1689014 - RNA, 12 nt, Salmonella enterica enterica serovar Typhi
cggcguucugcg

SEQ ID NO: 1689015 - RNA, 13 nt, Salmonella enterica enterica serovar Typhi
cggcguugcgccc

SEQ ID NO: 1689016 - RNA, 19 nt, Salmonella enterica enterica serovar Typhi
cggcguugcgcccaggcca

SEQ ID NO: 1689017 - RNA, 19 nt, Salmonella enterica enterica serovar Typhi
cggcguuggcgauuuccag

SEQ ID NO: 1689018 - RNA, 19 nt, Salmonella enterica enterica serovar Typhi
cggcgcuuccugcagugga

SEQ ID NO: 1689019 - RNA, 13 nt, Salmonella enterica enterica serovar Typhi
cggcgcuggcgcu

SEQ ID NO: 1689020 - RNA, 23 nt, Salmonella enterica enterica serovar Typhi
cggcggaaaaaagcagcaucccg

SEQ ID NO: 1689021 - RNA, 16 nt, Salmonella enterica enterica serovar Typhi
cggcggaaaagcgccc

SEQ ID NO: 1689022 - RNA, 13 nt, Salmonella enterica enterica serovar Typhi
cggcggcaguccc

SEQ ID NO: 1689023 - RNA, 14 nt, Salmonella enterica enterica serovar Typhi
cggcgucaacucag

SEQ ID NO: 1689024 - RNA, 15 nt, Salmonella enterica enterica serovar Typhi
cggcgguucaucgga

SEQ ID NO: 1689025 - RNA, 20 nt, Salmonella enterica enterica serovar Typhi
cggcgguuauccuccggguc

SEQ ID NO: 1689026 - RNA, 15 nt, Salmonella enterica enterica serovar Typhi
cggcguccaucaccg

SEQ ID NO: 1689027 - RNA, 21 nt, Salmonella enterica enterica serovar Typhi
cggcgucacguucgucgccgg

SEQ ID NO: 1689028 - RNA, 21 nt, Salmonella enterica enterica serovar Typhi
cggcgucaccaccgcaggcag

SEQ ID NO: 1689029 - RNA, 20 nt, Salmonella enterica enterica serovar Typhi
cggcguccggcacgcgcagc

SEQ ID NO: 1689030 - RNA, 17 nt, Salmonella enterica enterica serovar Typhi
cgggaaaagcguccggg

SEQ ID NO: 1689031 - RNA, 20 nt, Salmonella enterica enterica serovar Typhi
cgggaaaagguuucggcgau

SEQ ID NO: 1689032 - RNA, 15 nt, Salmonella enterica enterica serovar Typhi
cgggaaauagagcag

SEQ ID NO: 1689033 - RNA, 17 nt, Salmonella enterica enterica serovar Typhi
cggcuugucauccugcu

SEQ ID NO: 1689034 - RNA, 19 nt, Salmonella enterica enterica serovar Typhi
cggcuggacgucaugccgc

SEQ ID NO: 1689035 - RNA, 15 nt, Salmonella enterica enterica serovar Typhi
cggcugcgcugccag

SEQ ID NO: 1689036 - RNA, 22 nt, Salmonella enterica enterica serovar Typhi
cggcugauggcguuccacccag

SEQ ID NO: 1689037 - RNA, 17 nt, Salmonella enterica enterica serovar Typhi
cgggaaagggcggcagc

SEQ ID NO: 1689038 - RNA, 22 nt, Salmonella enterica enterica serovar Typhi
cgggacuuuaaacgucaugcug

SEQ ID NO: 1689039 - RNA, 16 nt, Salmonella enterica enterica serovar Typhi
cgggaucagcgcgcuc

SEQ ID NO: 1689040 - RNA, 14 nt, Salmonella enterica enterica serovar Typhi
cgggauauccucuu

SEQ ID NO: 1689041 - RNA, 17 nt, Salmonella enterica enterica serovar Typhi
cgggauccccugcuccu

SEQ ID NO: 1689042 - RNA, 15 nt, Salmonella enterica enterica serovar Typhi
cgggaucgagcgcgg

SEQ ID NO: 1689043 - RNA, 16 nt, Salmonella enterica enterica serovar Typhi
cgggaucgaaccgccg

SEQ ID NO: 1689044 - RNA, 22 nt, Salmonella enterica enterica serovar Typhi
cgggaucgccagaucgaacagc

SEQ ID NO: 1689045 - RNA, 19 nt, Salmonella enterica enterica serovar Typhi
cgggauacggcgagaccau

SEQ ID NO: 1689046 - RNA, 14 nt, Salmonella enterica enterica serovar Typhi
cgggauauaaaauu

SEQ ID NO: 1689047 - RNA, 18 nt, Salmonella enterica enterica serovar Typhi
cgggagguucaccaccac

SEQ ID NO: 1689048 - RNA, 20 nt, Salmonella enterica enterica serovar Typhi
cgggaugguuaaauucauau

SEQ ID NO: 1689049 - RNA, 22 nt, Salmonella enterica enterica serovar Typhi
cgggauggccgccgagcuguga

SEQ ID NO: 1689050 - RNA, 16 nt, Salmonella enterica enterica serovar Typhi
cgggaugcauaaaaaa

SEQ ID NO: 1689051 - RNA, 17 nt, Salmonella enterica enterica serovar Typhi
cgggaugcauaaaaaaa

SEQ ID NO: 1689052 - RNA, 14 nt, Salmonella enterica enterica serovar Typhi
cgggaucuccagaa

SEQ ID NO: 1689053 - RNA, 23 nt, Salmonella enterica enterica serovar Typhi
cgggcacuccggcucgcacauau

SEQ ID NO: 1689054 - RNA, 20 nt, Salmonella enterica enterica serovar Typhi
cgggcaaugccacugcccuc

SEQ ID NO: 1689055 - RNA, 17 nt, Salmonella enterica enterica serovar Typhi
cgggcaaugccaccagc

SEQ ID NO: 1689056 - RNA, 21 nt, Salmonella enterica enterica serovar Typhi
cgggcagauggucgcauggcu

SEQ ID NO: 1689057 - RNA, 15 nt, Salmonella enterica enterica serovar Typhi
cgggcaucgccgcaa

SEQ ID NO: 1689058 - RNA, 19 nt, Salmonella enterica enterica serovar Typhi
cgggcagcggcaagacaga

SEQ ID NO: 1689059 - RNA, 19 nt, Salmonella enterica enterica serovar Typhi
cgggauuguauaccgcuuu

SEQ ID NO: 1689060 - RNA, 14 nt, Salmonella enterica enterica serovar Typhi
cggguuaggcaagc

SEQ ID NO: 1689061 - RNA, 15 nt, Salmonella enterica enterica serovar Typhi
cggguuaaagcccug

SEQ ID NO: 1689062 - RNA, 21 nt, Salmonella enterica enterica serovar Typhi
cggguuaaaucgcgcaaauau

SEQ ID NO: 1689063 - RNA, 20 nt, Salmonella enterica enterica serovar Typhi
cggguuuggucagguaagcu

SEQ ID NO: 1689064 - RNA, 12 nt, Salmonella enterica enterica serovar Typhi
cggguuuuccug

SEQ ID NO: 1689065 - RNA, 23 nt, Salmonella enterica enterica serovar Typhi
cggguugcacauuguugcaggga

SEQ ID NO: 1689066 - RNA, 18 nt, Salmonella enterica enterica serovar Typhi
cgguaaucgccugccagc

SEQ ID NO: 1689067 - RNA, 16 nt, Salmonella enterica enterica serovar Typhi
cgguaagucugauaac

SEQ ID NO: 1689068 - RNA, 22 nt, Salmonella enterica enterica serovar Typhi
cgguaaucaccagaucggcauc

SEQ ID NO: 1689069 - RNA, 14 nt, Salmonella enterica enterica serovar Typhi
cgguaaucacugcc

SEQ ID NO: 1689070 - RNA, 20 nt, Salmonella enterica enterica serovar Typhi
cgguaacgauacccaccagc

SEQ ID NO: 1689071 - RNA, 22 nt, Salmonella enterica enterica serovar Typhi
cgguaagcccauggcaggcagc

SEQ ID NO: 1689072 - RNA, 13 nt, Salmonella enterica enterica serovar Typhi
cgguaagccgaaa

SEQ ID NO: 1689073 - RNA, 23 nt, Salmonella enterica enterica serovar Typhi
cgguaagaaugcgcgucaggcca

SEQ ID NO: 1689074 - RNA, 13 nt, Salmonella enterica enterica serovar Typhi
cgguaaacaccac

SEQ ID NO: 1689075 - RNA, 15 nt, Salmonella enterica enterica serovar Typhi
cgguaaaccaggcca

SEQ ID NO: 1689076 - RNA, 14 nt, Salmonella enterica enterica serovar Typhi
cgguaaaccucuuu

SEQ ID NO: 1689077 - RNA, 16 nt, Salmonella enterica enterica serovar Typhi
cgguaaaccaggccag

SEQ ID NO: 1689078 - RNA, 17 nt, Salmonella enterica enterica serovar Typhi
cgguaaaccaggccagc

SEQ ID NO: 1689079 - RNA, 15 nt, Salmonella enterica enterica serovar Typhi
cgguaaaggcgaccg

SEQ ID NO: 1689080 - RNA, 13 nt, Salmonella enterica enterica serovar Typhi
cgguaaacgucga

SEQ ID NO: 1689081 - RNA, 17 nt, Salmonella enterica enterica serovar Typhi
cgguaaagcagugcagu

SEQ ID NO: 1689082 - RNA, 20 nt, Salmonella enterica enterica serovar Typhi
cgguaacagcuugaucauca

SEQ ID NO: 1689083 - RNA, 23 nt, Salmonella enterica enterica serovar Typhi
cgguaacgacuuauuugcucagu

SEQ ID NO: 1689084 - RNA, 18 nt, Salmonella enterica enterica serovar Typhi
cgguauuuauccagcagg

SEQ ID NO: 1689085 - RNA, 16 nt, Salmonella enterica enterica serovar Typhi
cgguaugcaccucuuu

SEQ ID NO: 1689086 - RNA, 23 nt, Salmonella enterica enterica serovar Typhi
cgguauuaucaauaguuaauuaa

SEQ ID NO: 1689087 - RNA, 16 nt, Salmonella enterica enterica serovar Typhi
cgguauccgcauucua

SEQ ID NO: 1689088 - RNA, 14 nt, Salmonella enterica enterica serovar Typhi
cgguauaacugccu

SEQ ID NO: 1689089 - RNA, 20 nt, Salmonella enterica enterica serovar Typhi
cgguauaaauuuccgcagcc

SEQ ID NO: 1689090 - RNA, 16 nt, Salmonella enterica enterica serovar Typhi
cgguagcuuuuuaaau

SEQ ID NO: 1689091 - RNA, 17 nt, Salmonella enterica enterica serovar Typhi
cgguagagcgcggucag

SEQ ID NO: 1689092 - RNA, 18 nt, Salmonella enterica enterica serovar Typhi
cgguagagcgcggucagg

SEQ ID NO: 1689093 - RNA, 16 nt, Salmonella enterica enterica serovar Typhi
cgguagaggcgccgac

SEQ ID NO: 1689094 - RNA, 15 nt, Salmonella enterica enterica serovar Typhi
cgguacggcauggcg

SEQ ID NO: 1689095 - RNA, 14 nt, Salmonella enterica enterica serovar Typhi
cgguacucuuuuuc

SEQ ID NO: 1689096 - RNA, 14 nt, Salmonella enterica enterica serovar Typhi
cgguacuccccuuu

SEQ ID NO: 1689097 - RNA, 16 nt, Salmonella enterica enterica serovar Typhi
cgguacacgcagucca

SEQ ID NO: 1689098 - RNA, 15 nt, Salmonella enterica enterica serovar Typhi
cgguaccauaccugc

SEQ ID NO: 1689099 - RNA, 18 nt, Salmonella enterica enterica serovar Typhi
cgguacccgcugcuucac

SEQ ID NO: 1689100 - RNA, 16 nt, Salmonella enterica enterica serovar Typhi
cgguacgcaucaccag

SEQ ID NO: 1689101 - RNA, 17 nt, Salmonella enterica enterica serovar Typhi
cgggggcgaucagcagg

SEQ ID NO: 1689102 - RNA, 23 nt, Salmonella enterica enterica serovar Typhi
cggguaaacgucccugccacagu

SEQ ID NO: 1689103 - RNA, 14 nt, Salmonella enterica enterica serovar Typhi
cgggguuugcagau

SEQ ID NO: 1689104 - RNA, 24 nt, Salmonella enterica enterica serovar Typhi
cggggcuuuugagucgcauccagu

SEQ ID NO: 1689105 - RNA, 19 nt, Salmonella enterica enterica serovar Typhi
cgggucagcgucugcccca

SEQ ID NO: 1689106 - RNA, 18 nt, Salmonella enterica enterica serovar Typhi
cggguccagucgcgccgc

SEQ ID NO: 1689107 - RNA, 22 nt, Salmonella enterica enterica serovar Typhi
cggguaaacaaacacagccauc

SEQ ID NO: 1689108 - RNA, 17 nt, Salmonella enterica enterica serovar Typhi
cgggucagauucagcau

SEQ ID NO: 1689109 - RNA, 24 nt, Salmonella enterica enterica serovar Typhi
cggggaacacucuaaaucuaccca

SEQ ID NO: 1689110 - RNA, 16 nt, Salmonella enterica enterica serovar Typhi
cggggaacacggacag

SEQ ID NO: 1689111 - RNA, 23 nt, Salmonella enterica enterica serovar Typhi
cggggaacacggacagcaacccg

SEQ ID NO: 1689112 - RNA, 23 nt, Salmonella enterica enterica serovar Typhi
cggggcaucuauuuaacagagag

SEQ ID NO: 1689113 - RNA, 18 nt, Salmonella enterica enterica serovar Typhi
cggggcguuaaucaccgg

SEQ ID NO: 1689114 - RNA, 17 nt, Salmonella enterica enterica serovar Typhi
cggggaucgguuuaucc

SEQ ID NO: 1689115 - RNA, 19 nt, Salmonella enterica enterica serovar Typhi
cggggaucguucugcugau

SEQ ID NO: 1689116 - RNA, 21 nt, Salmonella enterica enterica serovar Typhi
cggggauuuuuuugcccggug

SEQ ID NO: 1689117 - RNA, 22 nt, Salmonella enterica enterica serovar Typhi
cggucugcuucagccacuggcu

SEQ ID NO: 1689118 - RNA, 19 nt, Salmonella enterica enterica serovar Typhi
cggucuggaugcguucaaa

SEQ ID NO: 1689119 - RNA, 15 nt, Salmonella enterica enterica serovar Typhi
cggucuuucaacaua

SEQ ID NO: 1689120 - RNA, 13 nt, Salmonella enterica enterica serovar Typhi
cggugaagaaaaa

SEQ ID NO: 1689121 - RNA, 17 nt, Salmonella enterica enterica serovar Typhi
cggugaagaaaaucccg

SEQ ID NO: 1689122 - RNA, 15 nt, Salmonella enterica enterica serovar Typhi
cggucagcggcgcgc

SEQ ID NO: 1689123 - RNA, 22 nt, Salmonella enterica enterica serovar Typhi
cggucagcggcgcgccgcucga

SEQ ID NO: 1689124 - RNA, 16 nt, Salmonella enterica enterica serovar Typhi
cggucugcgcgccgca

SEQ ID NO: 1689125 - RNA, 21 nt, Salmonella enterica enterica serovar Typhi
cggugaucccaggccggcaua

SEQ ID NO: 1689126 - RNA, 14 nt, Salmonella enterica enterica serovar Typhi
cggugauauugugu

SEQ ID NO: 1689127 - RNA, 21 nt, Salmonella enterica enterica serovar Typhi
cggugccuuguucgcagguca

SEQ ID NO: 1689128 - RNA, 22 nt, Salmonella enterica enterica serovar Typhi
cggugcgagaaaaagcaauaau

SEQ ID NO: 1689129 - RNA, 16 nt, Salmonella enterica enterica serovar Typhi
cgguguggcccagcgc

SEQ ID NO: 1689130 - RNA, 16 nt, Salmonella enterica enterica serovar Typhi
cgguguuaaccagaua

SEQ ID NO: 1689131 - RNA, 13 nt, Salmonella enterica enterica serovar Typhi
cgguucauccugc

SEQ ID NO: 1689132 - RNA, 15 nt, Salmonella enterica enterica serovar Typhi
cgguguaccccgccu

SEQ ID NO: 1689133 - RNA, 19 nt, Salmonella enterica enterica serovar Typhi
cggugcggucacaggcaua

SEQ ID NO: 1689134 - RNA, 17 nt, Salmonella enterica enterica serovar Typhi
cggugcguuuaaagaga

SEQ ID NO: 1689135 - RNA, 17 nt, Salmonella enterica enterica serovar Typhi
cggugcggcaagcgcgc

SEQ ID NO: 1689136 - RNA, 16 nt, Salmonella enterica enterica serovar Typhi
cggugcuuucuccugc

SEQ ID NO: 1689137 - RNA, 16 nt, Salmonella enterica enterica serovar Typhi
cgguggcgcugugcuu

SEQ ID NO: 1689138 - RNA, 22 nt, Salmonella enterica enterica serovar Typhi
cgguucuucccacuccgcccag

SEQ ID NO: 1689139 - RNA, 15 nt, Salmonella enterica enterica serovar Typhi
cgguucuucccacuc

SEQ ID NO: 1689140 - RNA, 15 nt, Salmonella enterica enterica serovar Typhi
cgguucucugccauc

SEQ ID NO: 1689141 - RNA, 14 nt, Salmonella enterica enterica serovar Typhi
cgguucgccgcgcg

SEQ ID NO: 1689142 - RNA, 15 nt, Salmonella enterica enterica serovar Typhi
cgguuccggggaaag

SEQ ID NO: 1689143 - RNA, 15 nt, Salmonella enterica enterica serovar Typhi
cgguugcaauuccgc

SEQ ID NO: 1689144 - RNA, 22 nt, Salmonella enterica enterica serovar Typhi
cgguuuuuuuguggccugcuua

SEQ ID NO: 1689145 - RNA, 23 nt, Salmonella enterica enterica serovar Typhi
cgguuuuuuuguggccugcuuaa

SEQ ID NO: 1689146 - RNA, 16 nt, Salmonella enterica enterica serovar Typhi
cguaaaaaacaucaua

SEQ ID NO: 1689147 - RNA, 21 nt, Salmonella enterica enterica serovar Typhi
cgguuuuuuuguggccugcuu

SEQ ID NO: 1689148 - RNA, 15 nt, Salmonella enterica enterica serovar Typhi
cguaaaacaacagcg

SEQ ID NO: 1689149 - RNA, 16 nt, Salmonella enterica enterica serovar Typhi
cguaagcgggaugggu

SEQ ID NO: 1689150 - RNA, 22 nt, Salmonella enterica enterica serovar Typhi
cguaagccaccgcccagagaau

SEQ ID NO: 1689151 - RNA, 22 nt, Salmonella enterica enterica serovar Typhi
cguaagcgcccguccaugagua

SEQ ID NO: 1689152 - RNA, 17 nt, Salmonella enterica enterica serovar Typhi
cguaaguuaaaacgcca

SEQ ID NO: 1689153 - RNA, 20 nt, Salmonella enterica enterica serovar Typhi
cguaagccaguucucuucuu

SEQ ID NO: 1689154 - RNA, 19 nt, Salmonella enterica enterica serovar Typhi
cguaacuugauuccuggcu

SEQ ID NO: 1689155 - RNA, 23 nt, Salmonella enterica enterica serovar Typhi
cguaaauucucuauacugcugac

SEQ ID NO: 1689156 - RNA, 18 nt, Salmonella enterica enterica serovar Typhi
cguaacagacgcaucuuu

SEQ ID NO: 1689157 - RNA, 23 nt, Salmonella enterica enterica serovar Typhi
cguaacagacgcaucuuuuuccc

SEQ ID NO: 1689158 - RNA, 19 nt, Salmonella enterica enterica serovar Typhi
cguaaaagcgauaaagaca

SEQ ID NO: 1689159 - RNA, 14 nt, Salmonella enterica enterica serovar Typhi
cguaaaauauacag

SEQ ID NO: 1689160 - RNA, 18 nt, Salmonella enterica enterica serovar Typhi
cguaaaacaacagcggcg

SEQ ID NO: 1689161 - RNA, 15 nt, Salmonella enterica enterica serovar Typhi
cguaaaacuuuucug

SEQ ID NO: 1689162 - RNA, 12 nt, Salmonella enterica enterica serovar Typhi
cguacagcgcca

SEQ ID NO: 1689163 - RNA, 14 nt, Salmonella enterica enterica serovar Typhi
cguaauuauuacag

SEQ ID NO: 1689164 - RNA, 20 nt, Salmonella enterica enterica serovar Typhi
cguaauuguugccccgcuuu

SEQ ID NO: 1689165 - RNA, 19 nt, Salmonella enterica enterica serovar Typhi
cguaauuugcgacauggcg

SEQ ID NO: 1689166 - RNA, 15 nt, Salmonella enterica enterica serovar Typhi
cguaauacgaucuuc

SEQ ID NO: 1689167 - RNA, 23 nt, Salmonella enterica enterica serovar Typhi
cguaauaugaauauccgccgccc

SEQ ID NO: 1689168 - RNA, 19 nt, Salmonella enterica enterica serovar Typhi
cguaaucuaaaauuauuuu

SEQ ID NO: 1689169 - RNA, 17 nt, Salmonella enterica enterica serovar Typhi
cguaauggguaaaaaua

SEQ ID NO: 1689170 - RNA, 19 nt, Salmonella enterica enterica serovar Typhi
cguaauuaaccgcgccgcu

SEQ ID NO: 1689171 - RNA, 22 nt, Salmonella enterica enterica serovar Typhi
cguaaugugaaaaacgggagau

SEQ ID NO: 1689172 - RNA, 20 nt, Salmonella enterica enterica serovar Typhi
cguaaugcgccccggcggcg

SEQ ID NO: 1689173 - RNA, 21 nt, Salmonella enterica enterica serovar Typhi
cguaaucuuuucauauuauuu

SEQ ID NO: 1689174 - RNA, 22 nt, Salmonella enterica enterica serovar Typhi
cguaaucuuuucauauuauuug

SEQ ID NO: 1689175 - RNA, 12 nt, Salmonella enterica enterica serovar Typhi
cguaaugagcac

SEQ ID NO: 1689176 - RNA, 13 nt, Salmonella enterica enterica serovar Typhi
cguacggaaggua

SEQ ID NO: 1689177 - RNA, 15 nt, Salmonella enterica enterica serovar Typhi
cguacucagcagacc

SEQ ID NO: 1689178 - RNA, 14 nt, Salmonella enterica enterica serovar Typhi
cguaccgcgcgccc

SEQ ID NO: 1689179 - RNA, 20 nt, Salmonella enterica enterica serovar Typhi
cguaccggcgcucagccaga

SEQ ID NO: 1689180 - RNA, 21 nt, Salmonella enterica enterica serovar Typhi
cguacgcagaucguauccagc

SEQ ID NO: 1689181 - RNA, 20 nt, Salmonella enterica enterica serovar Typhi
cguacauguccagaucuuca

SEQ ID NO: 1689182 - RNA, 18 nt, Salmonella enterica enterica serovar Typhi
cguacauaacagcagcag

SEQ ID NO: 1689183 - RNA, 21 nt, Salmonella enterica enterica serovar Typhi
cguacaggcggaaaucaacaa

SEQ ID NO: 1689184 - RNA, 22 nt, Salmonella enterica enterica serovar Typhi
cguaccacgccgcacacagcag

SEQ ID NO: 1689185 - RNA, 23 nt, Salmonella enterica enterica serovar Typhi
cguaccaauacccagcgccaacg

SEQ ID NO: 1689186 - RNA, 20 nt, Salmonella enterica enterica serovar Typhi
cguacccggcuuacaacauu

SEQ ID NO: 1689187 - RNA, 13 nt, Salmonella enterica enterica serovar Typhi
cguaccccaaucu

SEQ ID NO: 1689188 - RNA, 20 nt, Salmonella enterica enterica serovar Typhi
cguaccgaagaacauaaaca

SEQ ID NO: 1689189 - RNA, 13 nt, Salmonella enterica enterica serovar Typhi
cguaccagcgccc

SEQ ID NO: 1689190 - RNA, 19 nt, Salmonella enterica enterica serovar Typhi
cguaccaucgcgcaagacc

SEQ ID NO: 1689191 - RNA, 12 nt, Salmonella enterica enterica serovar Typhi
cggaccuccgcg

SEQ ID NO: 1689192 - RNA, 18 nt, Salmonella enterica enterica serovar Typhi
cggaccuccgcguaccuc

SEQ ID NO: 1689193 - RNA, 15 nt, Salmonella enterica enterica serovar Typhi
cggacgccgggugau

SEQ ID NO: 1689194 - RNA, 14 nt, Salmonella enterica enterica serovar Typhi
cggaccccucuucu

SEQ ID NO: 1689195 - RNA, 12 nt, Salmonella enterica enterica serovar Typhi
cggacagcagca

SEQ ID NO: 1689196 - RNA, 16 nt, Salmonella enterica enterica serovar Typhi
cggacacgcucauaaa

SEQ ID NO: 1689197 - RNA, 18 nt, Salmonella enterica enterica serovar Typhi
cggacacccgcagccaga

SEQ ID NO: 1689198 - RNA, 16 nt, Salmonella enterica enterica serovar Typhi
cggacacaugaccuga

SEQ ID NO: 1689199 - RNA, 14 nt, Salmonella enterica enterica serovar Typhi
cggacacccgcagc

SEQ ID NO: 1689200 - RNA, 15 nt, Salmonella enterica enterica serovar Typhi
cggacacccgcagcc

SEQ ID NO: 1689201 - RNA, 15 nt, Salmonella enterica enterica serovar Typhi
cggaauggcgacgac

SEQ ID NO: 1689202 - RNA, 15 nt, Salmonella enterica enterica serovar Typhi
cggacaacgcuccag

SEQ ID NO: 1689203 - RNA, 17 nt, Salmonella enterica enterica serovar Typhi
cggaaugaugugcuauu

SEQ ID NO: 1689204 - RNA, 23 nt, Salmonella enterica enterica serovar Typhi
cggaauggauaacgaaaaggguc

SEQ ID NO: 1689205 - RNA, 23 nt, Salmonella enterica enterica serovar Typhi
cggacggucggcguaauguugcu

SEQ ID NO: 1689206 - RNA, 14 nt, Salmonella enterica enterica serovar Typhi
cggacguugcuccg

SEQ ID NO: 1689207 - RNA, 12 nt, Salmonella enterica enterica serovar Typhi
cggacucagggu

SEQ ID NO: 1689208 - RNA, 16 nt, Salmonella enterica enterica serovar Typhi
cggacuagacagccuc

SEQ ID NO: 1689209 - RNA, 15 nt, Salmonella enterica enterica serovar Typhi
cggacucgcuggaca

SEQ ID NO: 1689210 - RNA, 16 nt, Salmonella enterica enterica serovar Typhi
cggacucgcuggacau

SEQ ID NO: 1689211 - RNA, 11 nt, Salmonella enterica enterica serovar Typhi
cggacugcugg

SEQ ID NO: 1689212 - RNA, 16 nt, Salmonella enterica enterica serovar Typhi
cggagaaaaagcgaua

SEQ ID NO: 1689213 - RNA, 22 nt, Salmonella enterica enterica serovar Typhi
cggagaacggcacaauagcgcu

SEQ ID NO: 1689214 - RNA, 22 nt, Salmonella enterica enterica serovar Typhi
cggagaacgguucauccagcag

SEQ ID NO: 1689215 - RNA, 17 nt, Salmonella enterica enterica serovar Typhi
cggagaagacgccgccg

SEQ ID NO: 1689216 - RNA, 19 nt, Salmonella enterica enterica serovar Typhi
cggagaaaagcgaaaauaa

SEQ ID NO: 1689217 - RNA, 15 nt, Salmonella enterica enterica serovar Typhi
cggagauacuuucuu

SEQ ID NO: 1689218 - RNA, 21 nt, Salmonella enterica enterica serovar Typhi
cggaggccagauucaccacca

SEQ ID NO: 1689219 - RNA, 14 nt, Salmonella enterica enterica serovar Typhi
cggaguccagcaac

SEQ ID NO: 1689220 - RNA, 23 nt, Salmonella enterica enterica serovar Typhi
cggagugcgcggcgaaaaagccg

SEQ ID NO: 1689221 - RNA, 15 nt, Salmonella enterica enterica serovar Typhi
cggaaguauccugga

SEQ ID NO: 1689222 - RNA, 21 nt, Salmonella enterica enterica serovar Typhi
cggaaggugccguauggcguc

SEQ ID NO: 1689223 - RNA, 19 nt, Salmonella enterica enterica serovar Typhi
cggaauaugcgcuuuuuuc

SEQ ID NO: 1689224 - RNA, 19 nt, Salmonella enterica enterica serovar Typhi
cggaaucgcgauccagccc

SEQ ID NO: 1689225 - RNA, 16 nt, Salmonella enterica enterica serovar Typhi
cggaagugcucuccac

SEQ ID NO: 1689226 - RNA, 23 nt, Salmonella enterica enterica serovar Typhi
cggaauaacuccagugcagaaag

SEQ ID NO: 1689227 - RNA, 15 nt, Salmonella enterica enterica serovar Typhi
cggaauaccgucaaa

SEQ ID NO: 1689228 - RNA, 21 nt, Salmonella enterica enterica serovar Typhi
cggaagacuggcgcagcaaac

SEQ ID NO: 1689229 - RNA, 16 nt, Salmonella enterica enterica serovar Typhi
cggaacccagcaaauc

SEQ ID NO: 1689230 - RNA, 13 nt, Salmonella enterica enterica serovar Typhi
cggaacaccagcg

SEQ ID NO: 1689231 - RNA, 17 nt, Salmonella enterica enterica serovar Typhi
cggaaccaaaugcccag

SEQ ID NO: 1689232 - RNA, 16 nt, Salmonella enterica enterica serovar Typhi
cggaacagggccgcau

SEQ ID NO: 1689233 - RNA, 16 nt, Salmonella enterica enterica serovar Typhi
cgcuugugccugcugc

SEQ ID NO: 1689234 - RNA, 22 nt, Salmonella enterica enterica serovar Typhi
cgcuuugaggaucaauuuuucg

SEQ ID NO: 1689235 - RNA, 19 nt, Salmonella enterica enterica serovar Typhi
cgcuuugacauugucauaa

SEQ ID NO: 1689236 - RNA, 19 nt, Salmonella enterica enterica serovar Typhi
cggaaauuagcccgcuuca

SEQ ID NO: 1689237 - RNA, 14 nt, Salmonella enterica enterica serovar Typhi
cgcuuuguuuucca

SEQ ID NO: 1689238 - RNA, 20 nt, Salmonella enterica enterica serovar Typhi
cgcugccacacucucuccag

SEQ ID NO: 1689239 - RNA, 19 nt, Salmonella enterica enterica serovar Typhi
cgcugccggaaagccccag

SEQ ID NO: 1689240 - RNA, 14 nt, Salmonella enterica enterica serovar Typhi
cgcuucaccggcgu

SEQ ID NO: 1689241 - RNA, 20 nt, Salmonella enterica enterica serovar Typhi
cgcuucaccggcgugcgcuu

SEQ ID NO: 1689242 - RNA, 18 nt, Salmonella enterica enterica serovar Typhi
cgcuuccaguccagcgcg

SEQ ID NO: 1689243 - RNA, 15 nt, Salmonella enterica enterica serovar Typhi
cgcuuccaccucuuc

SEQ ID NO: 1689244 - RNA, 15 nt, Salmonella enterica enterica serovar Typhi
cgcuucguauuucuu

SEQ ID NO: 1689245 - RNA, 23 nt, Salmonella enterica enterica serovar Typhi
cgcuucucuauacggcgcgcagu

SEQ ID NO: 1689246 - RNA, 16 nt, Salmonella enterica enterica serovar Typhi
cgcuucguuccgcgau

SEQ ID NO: 1689247 - RNA, 16 nt, Salmonella enterica enterica serovar Typhi
cggcacucaccucuuc

SEQ ID NO: 1689248 - RNA, 16 nt, Salmonella enterica enterica serovar Typhi
cggcagccgccaccac

SEQ ID NO: 1689249 - RNA, 13 nt, Salmonella enterica enterica serovar Typhi
cggcagccgccac

SEQ ID NO: 1689250 - RNA, 16 nt, Salmonella enterica enterica serovar Typhi
cggcagccaauuuagg

SEQ ID NO: 1689251 - RNA, 15 nt, Salmonella enterica enterica serovar Typhi
cggcacaaccuggcu

SEQ ID NO: 1689252 - RNA, 22 nt, Salmonella enterica enterica serovar Typhi
cggcacauauuccggcgcuggc

SEQ ID NO: 1689253 - RNA, 23 nt, Salmonella enterica enterica serovar Typhi
cggcacauaggcaaacaccucag

SEQ ID NO: 1689254 - RNA, 13 nt, Salmonella enterica enterica serovar Typhi
cggcacagccagu

SEQ ID NO: 1689255 - RNA, 20 nt, Salmonella enterica enterica serovar Typhi
cggcacgucgucccaggcca

SEQ ID NO: 1689256 - RNA, 14 nt, Salmonella enterica enterica serovar Typhi
cggcaccggacauc

SEQ ID NO: 1689257 - RNA, 17 nt, Salmonella enterica enterica serovar Typhi
cggcaaggaaaaccagu

SEQ ID NO: 1689258 - RNA, 17 nt, Salmonella enterica enterica serovar Typhi
cggcaagcgcugggcga

SEQ ID NO: 1689259 - RNA, 14 nt, Salmonella enterica enterica serovar Typhi
cggcaagcuggcga

SEQ ID NO: 1689260 - RNA, 18 nt, Salmonella enterica enterica serovar Typhi
cggcaagcgggcguugcu

SEQ ID NO: 1689261 - RNA, 17 nt, Salmonella enterica enterica serovar Typhi
cggcaagucagaccagu

SEQ ID NO: 1689262 - RNA, 23 nt, Salmonella enterica enterica serovar Typhi
cggcaauauugccgcacgguacu

SEQ ID NO: 1689263 - RNA, 14 nt, Salmonella enterica enterica serovar Typhi
cggcaauacuggac

SEQ ID NO: 1689264 - RNA, 18 nt, Salmonella enterica enterica serovar Typhi
cggcaaugcggguuucgu

SEQ ID NO: 1689265 - RNA, 12 nt, Salmonella enterica enterica serovar Typhi
cggcaacugcgc

SEQ ID NO: 1689266 - RNA, 17 nt, Salmonella enterica enterica serovar Typhi
cggaucaugguugaaaa

SEQ ID NO: 1689267 - RNA, 22 nt, Salmonella enterica enterica serovar Typhi
cggauaccggcgcagcaucugc

SEQ ID NO: 1689268 - RNA, 18 nt, Salmonella enterica enterica serovar Typhi
cggauagucauaauuaaa

SEQ ID NO: 1689269 - RNA, 23 nt, Salmonella enterica enterica serovar Typhi
cggauaugcgucuuaaugguggu

SEQ ID NO: 1689270 - RNA, 15 nt, Salmonella enterica enterica serovar Typhi
cggaucaccggcauu

SEQ ID NO: 1689271 - RNA, 14 nt, Salmonella enterica enterica serovar Typhi
cggauaucagacag

SEQ ID NO: 1689272 - RNA, 23 nt, Salmonella enterica enterica serovar Typhi
cggcauguccggcgacuccagaa

SEQ ID NO: 1689273 - RNA, 15 nt, Salmonella enterica enterica serovar Typhi
cggcauuaauuucuu

SEQ ID NO: 1689274 - RNA, 21 nt, Salmonella enterica enterica serovar Typhi
cggcaugcaucucuucaaaca

SEQ ID NO: 1689275 - RNA, 19 nt, Salmonella enterica enterica serovar Typhi
cggcaugaauugccguggu

SEQ ID NO: 1689276 - RNA, 22 nt, Salmonella enterica enterica serovar Typhi
cggcaucuuuaaccgccugcuc

SEQ ID NO: 1689277 - RNA, 19 nt, Salmonella enterica enterica serovar Typhi
cggcaucuuuaaccgccug

SEQ ID NO: 1689278 - RNA, 20 nt, Salmonella enterica enterica serovar Typhi
cggcaugauagggcgccugu

SEQ ID NO: 1689279 - RNA, 15 nt, Salmonella enterica enterica serovar Typhi
cggcaucucuucguu

SEQ ID NO: 1689280 - RNA, 17 nt, Salmonella enterica enterica serovar Typhi
cggcaucucaaggucug

SEQ ID NO: 1689281 - RNA, 11 nt, Salmonella enterica enterica serovar Typhi
cggcagcucug

SEQ ID NO: 1689282 - RNA, 12 nt, Salmonella enterica enterica serovar Typhi
cggcagcuucca

SEQ ID NO: 1689283 - RNA, 18 nt, Salmonella enterica enterica serovar Typhi
cggcagcuuccagcaaac

SEQ ID NO: 1689284 - RNA, 21 nt, Salmonella enterica enterica serovar Typhi
cggcauuucaccgucaauaac

SEQ ID NO: 1689285 - RNA, 21 nt, Salmonella enterica enterica serovar Typhi
cggcauuucugucugacgacc

SEQ ID NO: 1689286 - RNA, 17 nt, Salmonella enterica enterica serovar Typhi
cggcauucacgucgcgc

SEQ ID NO: 1689287 - RNA, 19 nt, Salmonella enterica enterica serovar Typhi
cggccaaagcgcgacugga

SEQ ID NO: 1689288 - RNA, 21 nt, Salmonella enterica enterica serovar Typhi
cggcauuuuucucaggacgcc

SEQ ID NO: 1689289 - RNA, 16 nt, Salmonella enterica enterica serovar Typhi
cggccacagcgccaga

SEQ ID NO: 1689290 - RNA, 14 nt, Salmonella enterica enterica serovar Typhi
cggccacaaaacag

SEQ ID NO: 1689291 - RNA, 17 nt, Salmonella enterica enterica serovar Typhi
cggccagcgucaucaga

SEQ ID NO: 1689292 - RNA, 19 nt, Salmonella enterica enterica serovar Typhi
cggccaggauggcccgguu

SEQ ID NO: 1689293 - RNA, 20 nt, Salmonella enterica enterica serovar Typhi
cggccaggcaaagauccacc

SEQ ID NO: 1689294 - RNA, 15 nt, Salmonella enterica enterica serovar Typhi
cggccauagcgugag

SEQ ID NO: 1689295 - RNA, 20 nt, Salmonella enterica enterica serovar Typhi
cggccaguucuuguaguuuu

SEQ ID NO: 1689296 - RNA, 21 nt, Salmonella enterica enterica serovar Typhi
cggccaccauuacgcccccuc

SEQ ID NO: 1689297 - RNA, 21 nt, Salmonella enterica enterica serovar Typhi
cggccacgguguggcccagcg

SEQ ID NO: 1689298 - RNA, 21 nt, Salmonella enterica enterica serovar Typhi
cggccagauaguggcugaggc

SEQ ID NO: 1689299 - RNA, 15 nt, Salmonella enterica enterica serovar Typhi
cgcguauaacgccgc

SEQ ID NO: 1689300 - RNA, 17 nt, Salmonella enterica enterica serovar Typhi
cgcgucaaauagagaaa

SEQ ID NO: 1689301 - RNA, 18 nt, Salmonella enterica enterica serovar Typhi
cgcguagcccagcgccgc

SEQ ID NO: 1689302 - RNA, 18 nt, Salmonella enterica enterica serovar Typhi
cgcgucagcgccuccgcg

SEQ ID NO: 1689303 - RNA, 23 nt, Salmonella enterica enterica serovar Typhi
cgcgucacaaaaacacccgcagc

SEQ ID NO: 1689304 - RNA, 17 nt, Salmonella enterica enterica serovar Typhi
cgcguauucucaaccag

SEQ ID NO: 1689305 - RNA, 17 nt, Salmonella enterica enterica serovar Typhi
cgcgucacaacagccgg

SEQ ID NO: 1689306 - RNA, 14 nt, Salmonella enterica enterica serovar Typhi
cgcgucacaagcuc

SEQ ID NO: 1689307 - RNA, 19 nt, Salmonella enterica enterica serovar Typhi
cgcgugaauugcgguuuau

SEQ ID NO: 1689308 - RNA, 20 nt, Salmonella enterica enterica serovar Typhi
cgcgugcuguaccgcguccu

SEQ ID NO: 1689309 - RNA, 16 nt, Salmonella enterica enterica serovar Typhi
cgcgucguucacgcca

SEQ ID NO: 1689310 - RNA, 22 nt, Salmonella enterica enterica serovar Typhi
cgcgggcgguauuauccgccgc

SEQ ID NO: 1689311 - RNA, 12 nt, Salmonella enterica enterica serovar Typhi
cgcggggaacac

SEQ ID NO: 1689312 - RNA, 16 nt, Salmonella enterica enterica serovar Typhi
cgcguagcccagcgcc

SEQ ID NO: 1689313 - RNA, 14 nt, Salmonella enterica enterica serovar Typhi
cgcguagcccagcg

SEQ ID NO: 1689314 - RNA, 13 nt, Salmonella enterica enterica serovar Typhi
cgcguaccagcgc

SEQ ID NO: 1689315 - RNA, 17 nt, Salmonella enterica enterica serovar Typhi
cgcguaaccccugcccg

SEQ ID NO: 1689316 - RNA, 14 nt, Salmonella enterica enterica serovar Typhi
cgcucaacuccugc

SEQ ID NO: 1689317 - RNA, 16 nt, Salmonella enterica enterica serovar Typhi
cgcuaucaggcacuga

SEQ ID NO: 1689318 - RNA, 13 nt, Salmonella enterica enterica serovar Typhi
cgcuaucaaaaug

SEQ ID NO: 1689319 - RNA, 14 nt, Salmonella enterica enterica serovar Typhi
cgcuauauuccagc

SEQ ID NO: 1689320 - RNA, 16 nt, Salmonella enterica enterica serovar Typhi
cgcucaauagccagaa

SEQ ID NO: 1689321 - RNA, 16 nt, Salmonella enterica enterica serovar Typhi
cgcucaagaugauagc

SEQ ID NO: 1689322 - RNA, 16 nt, Salmonella enterica enterica serovar Typhi
cgcuagggcaucagac

SEQ ID NO: 1689323 - RNA, 15 nt, Salmonella enterica enterica serovar Typhi
cgcuagcucaacgcc

SEQ ID NO: 1689324 - RNA, 14 nt, Salmonella enterica enterica serovar Typhi
cgcuagccgcaucc

SEQ ID NO: 1689325 - RNA, 13 nt, Salmonella enterica enterica serovar Typhi
cgcucacgauaac

SEQ ID NO: 1689326 - RNA, 16 nt, Salmonella enterica enterica serovar Typhi
cgcucaccuccgccac

SEQ ID NO: 1689327 - RNA, 16 nt, Salmonella enterica enterica serovar Typhi
cgcucaccaccgccgc

SEQ ID NO: 1689328 - RNA, 19 nt, Salmonella enterica enterica serovar Typhi
cgcguucgccgucacgccg

SEQ ID NO: 1689329 - RNA, 18 nt, Salmonella enterica enterica serovar Typhi
cgcguuaauuuuccccgc

SEQ ID NO: 1689330 - RNA, 18 nt, Salmonella enterica enterica serovar Typhi
cgcguucugaauaaauug

SEQ ID NO: 1689331 - RNA, 14 nt, Salmonella enterica enterica serovar Typhi
cgcguucgcgcagu

SEQ ID NO: 1689332 - RNA, 22 nt, Salmonella enterica enterica serovar Typhi
cgcuacauccgccagccgccau

SEQ ID NO: 1689333 - RNA, 17 nt, Salmonella enterica enterica serovar Typhi
cgcuaauuuuuaaauga

SEQ ID NO: 1689334 - RNA, 19 nt, Salmonella enterica enterica serovar Typhi
cgcuaccagcgcggcgcca

SEQ ID NO: 1689335 - RNA, 20 nt, Salmonella enterica enterica serovar Typhi
cgcguuuaaauaaaaauucc

SEQ ID NO: 1689336 - RNA, 21 nt, Salmonella enterica enterica serovar Typhi
cgcuaaugcccggcgcggcau

SEQ ID NO: 1689337 - RNA, 21 nt, Salmonella enterica enterica serovar Typhi
cgcuaaucccgcucgccaggu

SEQ ID NO: 1689338 - RNA, 16 nt, Salmonella enterica enterica serovar Typhi
cgcugcagauuuugcu

SEQ ID NO: 1689339 - RNA, 14 nt, Salmonella enterica enterica serovar Typhi
cgcugcacaaucgc

SEQ ID NO: 1689340 - RNA, 19 nt, Salmonella enterica enterica serovar Typhi
cgcugcauccuguaccacc

SEQ ID NO: 1689341 - RNA, 17 nt, Salmonella enterica enterica serovar Typhi
cgcugagaugaccauau

SEQ ID NO: 1689342 - RNA, 12 nt, Salmonella enterica enterica serovar Typhi
cgcugacgccga

SEQ ID NO: 1689343 - RNA, 18 nt, Salmonella enterica enterica serovar Typhi
cgcugaugugcggccugg

SEQ ID NO: 1689344 - RNA, 20 nt, Salmonella enterica enterica serovar Typhi
cgcugauguuuugcgccgcg

SEQ ID NO: 1689345 - RNA, 23 nt, Salmonella enterica enterica serovar Typhi
cgcugauguuuugcgccgcgcgu

SEQ ID NO: 1689346 - RNA, 14 nt, Salmonella enterica enterica serovar Typhi
cgcugauucguuuu

SEQ ID NO: 1689347 - RNA, 15 nt, Salmonella enterica enterica serovar Typhi
cgcugauuugccaaa

SEQ ID NO: 1689348 - RNA, 22 nt, Salmonella enterica enterica serovar Typhi
cgcucgcggaagcgaccggcgu

SEQ ID NO: 1689349 - RNA, 23 nt, Salmonella enterica enterica serovar Typhi
cgcucgcucaucacaucgcgcag

SEQ ID NO: 1689350 - RNA, 20 nt, Salmonella enterica enterica serovar Typhi
cgcucgcuuacgcggcgcgc

SEQ ID NO: 1689351 - RNA, 23 nt, Salmonella enterica enterica serovar Typhi
cgcucgcuggugccaaucuccag

SEQ ID NO: 1689352 - RNA, 18 nt, Salmonella enterica enterica serovar Typhi
cgcucgcuuugccgccau

SEQ ID NO: 1689353 - RNA, 20 nt, Salmonella enterica enterica serovar Typhi
cgcucggcauacaccgccag

SEQ ID NO: 1689354 - RNA, 21 nt, Salmonella enterica enterica serovar Typhi
cgcugacgaucaugccgccca

SEQ ID NO: 1689355 - RNA, 22 nt, Salmonella enterica enterica serovar Typhi
cgcucuuuaaugauguccagaa

SEQ ID NO: 1689356 - RNA, 12 nt, Salmonella enterica enterica serovar Typhi
cgcucuuauugc

SEQ ID NO: 1689357 - RNA, 23 nt, Salmonella enterica enterica serovar Typhi
cgcucuucgccaaucgccgccgc

SEQ ID NO: 1689358 - RNA, 13 nt, Salmonella enterica enterica serovar Typhi
cgcucgccgccuc

SEQ ID NO: 1689359 - RNA, 24 nt, Salmonella enterica enterica serovar Typhi
cgcucgccagcauacgucugcgcu

SEQ ID NO: 1689360 - RNA, 14 nt, Salmonella enterica enterica serovar Typhi
cgcucccgcgcgcu

SEQ ID NO: 1689361 - RNA, 20 nt, Salmonella enterica enterica serovar Typhi
cgcucccuucccccagaaug

SEQ ID NO: 1689362 - RNA, 15 nt, Salmonella enterica enterica serovar Typhi
cgcuccgacaaacuu

SEQ ID NO: 1689363 - RNA, 21 nt, Salmonella enterica enterica serovar Typhi
cgcuccugcgguacggccagc

SEQ ID NO: 1689364 - RNA, 14 nt, Salmonella enterica enterica serovar Typhi
cgcuccugcuccca

SEQ ID NO: 1689365 - RNA, 14 nt, Salmonella enterica enterica serovar Typhi
cgcucaucggcggc

SEQ ID NO: 1689366 - RNA, 15 nt, Salmonella enterica enterica serovar Typhi
cgcucaugcgccugg

SEQ ID NO: 1689367 - RNA, 17 nt, Salmonella enterica enterica serovar Typhi
cgcuccagaccaccagc

SEQ ID NO: 1689368 - RNA, 15 nt, Salmonella enterica enterica serovar Typhi
cgcuccacgcguccu

SEQ ID NO: 1689369 - RNA, 21 nt, Salmonella enterica enterica serovar Typhi
cgcuccaucauaucgcgcagc

SEQ ID NO: 1689370 - RNA, 22 nt, Salmonella enterica enterica serovar Typhi
cgcuccagggauugauggccag

SEQ ID NO: 1689371 - RNA, 16 nt, Salmonella enterica enterica serovar Typhi
cgcuccagcaguucua

SEQ ID NO: 1689372 - RNA, 14 nt, Salmonella enterica enterica serovar Typhi
cgcuccagcuggcu

SEQ ID NO: 1689373 - RNA, 14 nt, Salmonella enterica enterica serovar Typhi
cgcucccuuccccc

SEQ ID NO: 1689374 - RNA, 19 nt, Salmonella enterica enterica serovar Typhi
cgcuccccguuccaccgcc

SEQ ID NO: 1689375 - RNA, 15 nt, Salmonella enterica enterica serovar Typhi
cgccagcaacgccca

SEQ ID NO: 1689376 - RNA, 19 nt, Salmonella enterica enterica serovar Typhi
cgccagcaacagguacccc

SEQ ID NO: 1689377 - RNA, 22 nt, Salmonella enterica enterica serovar Typhi
cgccagaugcuuaaacugcgcg

SEQ ID NO: 1689378 - RNA, 18 nt, Salmonella enterica enterica serovar Typhi
cgccagauuaucggccag

SEQ ID NO: 1689379 - RNA, 14 nt, Salmonella enterica enterica serovar Typhi
cgccagaugcaccg

SEQ ID NO: 1689380 - RNA, 22 nt, Salmonella enterica enterica serovar Typhi
cgccagaucgaacagcggcagg

SEQ ID NO: 1689381 - RNA, 20 nt, Salmonella enterica enterica serovar Typhi
cgccagauaaagcgaauaac

SEQ ID NO: 1689382 - RNA, 20 nt, Salmonella enterica enterica serovar Typhi
cgccagauaaucgccgccag

SEQ ID NO: 1689383 - RNA, 16 nt, Salmonella enterica enterica serovar Typhi
cgccagauacacgccu

SEQ ID NO: 1689384 - RNA, 21 nt, Salmonella enterica enterica serovar Typhi
cgcgccggugaucccaccagc

SEQ ID NO: 1689385 - RNA, 16 nt, Salmonella enterica enterica serovar Typhi
cgcgccggucgccagc

SEQ ID NO: 1689386 - RNA, 21 nt, Salmonella enterica enterica serovar Typhi
cgcgcgccagucaucgccgcu

SEQ ID NO: 1689387 - RNA, 14 nt, Salmonella enterica enterica serovar Typhi
cgcgcgaugcugcu

SEQ ID NO: 1689388 - RNA, 22 nt, Salmonella enterica enterica serovar Typhi
cgcgcgaugguaggccugauaa

SEQ ID NO: 1689389 - RNA, 13 nt, Salmonella enterica enterica serovar Typhi
cgcgcgccgccug

SEQ ID NO: 1689390 - RNA, 12 nt, Salmonella enterica enterica serovar Typhi
cgcgcgccgccu

SEQ ID NO: 1689391 - RNA, 20 nt, Salmonella enterica enterica serovar Typhi
cgcgcgccugaugcgccgcc

SEQ ID NO: 1689392 - RNA, 12 nt, Salmonella enterica enterica serovar Typhi
cgcgcgaaggcg

SEQ ID NO: 1689393 - RNA, 18 nt, Salmonella enterica enterica serovar Typhi
cgcgcgaaacgcacccgc

SEQ ID NO: 1689394 - RNA, 15 nt, Salmonella enterica enterica serovar Typhi
cgcgccugcucccgc

SEQ ID NO: 1689395 - RNA, 21 nt, Salmonella enterica enterica serovar Typhi
cgcgcgaauaucgcugccggu

SEQ ID NO: 1689396 - RNA, 19 nt, Salmonella enterica enterica serovar Typhi
cgcgcgacuuaucuuccac

SEQ ID NO: 1689397 - RNA, 23 nt, Salmonella enterica enterica serovar Typhi
cgcgccugccauagcaucaccag

SEQ ID NO: 1689398 - RNA, 12 nt, Salmonella enterica enterica serovar Typhi
cgcgccugccaa

SEQ ID NO: 1689399 - RNA, 17 nt, Salmonella enterica enterica serovar Typhi
cgcgcggauucuccagg

SEQ ID NO: 1689400 - RNA, 15 nt, Salmonella enterica enterica serovar Typhi
cgcgcggcaggccuu

SEQ ID NO: 1689401 - RNA, 19 nt, Salmonella enterica enterica serovar Typhi
cgcgcgcuuucaccgccuc

SEQ ID NO: 1689402 - RNA, 20 nt, Salmonella enterica enterica serovar Typhi
cgcgcggauauggcggcggc

SEQ ID NO: 1689403 - RNA, 15 nt, Salmonella enterica enterica serovar Typhi
cgcgcugccgcccuu

SEQ ID NO: 1689404 - RNA, 17 nt, Salmonella enterica enterica serovar Typhi
cgcgcucuuccgccagc

SEQ ID NO: 1689405 - RNA, 14 nt, Salmonella enterica enterica serovar Typhi
cgcgcugaucgcca

SEQ ID NO: 1689406 - RNA, 16 nt, Salmonella enterica enterica serovar Typhi
cgcgcucuuccgccag

SEQ ID NO: 1689407 - RNA, 17 nt, Salmonella enterica enterica serovar Typhi
cgcgcucggucacuuca

SEQ ID NO: 1689408 - RNA, 13 nt, Salmonella enterica enterica serovar Typhi
cgcgcucgccagc

SEQ ID NO: 1689409 - RNA, 11 nt, Salmonella enterica enterica serovar Typhi
cgcgcucgcca

SEQ ID NO: 1689410 - RNA, 12 nt, Salmonella enterica enterica serovar Typhi
cgcgcucgccag

SEQ ID NO: 1689411 - RNA, 15 nt, Salmonella enterica enterica serovar Typhi
cgcgcuaucaacgcc

SEQ ID NO: 1689412 - RNA, 18 nt, Salmonella enterica enterica serovar Typhi
cgcgcguucauccaccgc

SEQ ID NO: 1689413 - RNA, 22 nt, Salmonella enterica enterica serovar Typhi
cgcgcguuccaucacuuccugu

SEQ ID NO: 1689414 - RNA, 21 nt, Salmonella enterica enterica serovar Typhi
cgcgcuugcguguuugggcga

SEQ ID NO: 1689415 - RNA, 19 nt, Salmonella enterica enterica serovar Typhi
cgcggaacuggugaaacag

SEQ ID NO: 1689416 - RNA, 22 nt, Salmonella enterica enterica serovar Typhi
cgcgcuguuuauccacaggcga

SEQ ID NO: 1689417 - RNA, 16 nt, Salmonella enterica enterica serovar Typhi
cgcgcugucugccggc

SEQ ID NO: 1689418 - RNA, 12 nt, Salmonella enterica enterica serovar Typhi
cgcgcuggcaag

SEQ ID NO: 1689419 - RNA, 20 nt, Salmonella enterica enterica serovar Typhi
cgcggaaggcgccucgcgcg

SEQ ID NO: 1689420 - RNA, 18 nt, Salmonella enterica enterica serovar Typhi
cgcggauaagcccggcgg

SEQ ID NO: 1689421 - RNA, 22 nt, Salmonella enterica enterica serovar Typhi
cgcggagagaucgacagcgcgc

SEQ ID NO: 1689422 - RNA, 18 nt, Salmonella enterica enterica serovar Typhi
cgcggauaugcagcagcc

SEQ ID NO: 1689423 - RNA, 22 nt, Salmonella enterica enterica serovar Typhi
cgcggcacacuuucaucagccg

SEQ ID NO: 1689424 - RNA, 13 nt, Salmonella enterica enterica serovar Typhi
cgcggcacacagc

SEQ ID NO: 1689425 - RNA, 14 nt, Salmonella enterica enterica serovar Typhi
cgcggcagcgcgca

SEQ ID NO: 1689426 - RNA, 15 nt, Salmonella enterica enterica serovar Typhi
cgcgggaaugcgcgc

SEQ ID NO: 1689427 - RNA, 16 nt, Salmonella enterica enterica serovar Typhi
cgcgggauaucgcugg

SEQ ID NO: 1689428 - RNA, 15 nt, Salmonella enterica enterica serovar Typhi
cgcggcuaccggacu

SEQ ID NO: 1689429 - RNA, 18 nt, Salmonella enterica enterica serovar Typhi
cgcggcguaccgcgcgcc

SEQ ID NO: 1689430 - RNA, 15 nt, Salmonella enterica enterica serovar Typhi
cgcggcgguucaucc

SEQ ID NO: 1689431 - RNA, 19 nt, Salmonella enterica enterica serovar Typhi
cgcggccuuugccuucgcc

SEQ ID NO: 1689432 - RNA, 16 nt, Salmonella enterica enterica serovar Typhi
cgcggccaccgccagu

SEQ ID NO: 1689433 - RNA, 19 nt, Salmonella enterica enterica serovar Typhi
cgcggccagaaugcccagc

SEQ ID NO: 1689434 - RNA, 21 nt, Salmonella enterica enterica serovar Typhi
cgcggcgaaauaggccgcgau

SEQ ID NO: 1689435 - RNA, 16 nt, Salmonella enterica enterica serovar Typhi
cgcggcgaaaaagccg

SEQ ID NO: 1689436 - RNA, 19 nt, Salmonella enterica enterica serovar Typhi
cgcggcgaaaaagccggcg

SEQ ID NO: 1689437 - RNA, 12 nt, Salmonella enterica enterica serovar Typhi
cguccacucuuc

SEQ ID NO: 1689438 - RNA, 15 nt, Salmonella enterica enterica serovar Typhi
cguccagacuccuuu

SEQ ID NO: 1689439 - RNA, 19 nt, Salmonella enterica enterica serovar Typhi
cguacuaaagagcgccuga

SEQ ID NO: 1689440 - RNA, 21 nt, Salmonella enterica enterica serovar Typhi
cguacugaaauaacucuggau

SEQ ID NO: 1689441 - RNA, 11 nt, Salmonella enterica enterica serovar Typhi
cguccagcggc

SEQ ID NO: 1689442 - RNA, 14 nt, Salmonella enterica enterica serovar Typhi
cguccauccgggua

SEQ ID NO: 1689443 - RNA, 23 nt, Salmonella enterica enterica serovar Typhi
cguccaguccugucccugccagc

SEQ ID NO: 1689444 - RNA, 19 nt, Salmonella enterica enterica serovar Typhi
cguccaggccugauaagca

SEQ ID NO: 1689445 - RNA, 23 nt, Salmonella enterica enterica serovar Typhi
cguccaguaaaaucggaccuccg

SEQ ID NO: 1689446 - RNA, 16 nt, Salmonella enterica enterica serovar Typhi
cguccauuacucucau

SEQ ID NO: 1689447 - RNA, 16 nt, Salmonella enterica enterica serovar Typhi
cgucccagcggauguc

SEQ ID NO: 1689448 - RNA, 15 nt, Salmonella enterica enterica serovar Typhi
cgucccacgcgccgc

SEQ ID NO: 1689449 - RNA, 20 nt, Salmonella enterica enterica serovar Typhi
cgucccaccacgcagccaug

SEQ ID NO: 1689450 - RNA, 18 nt, Salmonella enterica enterica serovar Typhi
cguccccagccagagauc

SEQ ID NO: 1689451 - RNA, 17 nt, Salmonella enterica enterica serovar Typhi
cguccccuauacgccau

SEQ ID NO: 1689452 - RNA, 22 nt, Salmonella enterica enterica serovar Typhi
cguccccugcgguuucuaccac

SEQ ID NO: 1689453 - RNA, 18 nt, Salmonella enterica enterica serovar Typhi
cguccccuggacgcgagc

SEQ ID NO: 1689454 - RNA, 17 nt, Salmonella enterica enterica serovar Typhi
cgucccgauauaaaggu

SEQ ID NO: 1689455 - RNA, 16 nt, Salmonella enterica enterica serovar Typhi
cgucccggcauuauaa

SEQ ID NO: 1689456 - RNA, 15 nt, Salmonella enterica enterica serovar Typhi
cgucccuuccgccac

SEQ ID NO: 1689457 - RNA, 14 nt, Salmonella enterica enterica serovar Typhi
cgucccuuucccuu

SEQ ID NO: 1689458 - RNA, 21 nt, Salmonella enterica enterica serovar Typhi
cgucccuuucccuuccagcga

SEQ ID NO: 1689459 - RNA, 17 nt, Salmonella enterica enterica serovar Typhi
cguccgccaggcccaug

SEQ ID NO: 1689460 - RNA, 16 nt, Salmonella enterica enterica serovar Typhi
cguccggaaaauccuc

SEQ ID NO: 1689461 - RNA, 20 nt, Salmonella enterica enterica serovar Typhi
cguccggcgaaaaccgagca

SEQ ID NO: 1689462 - RNA, 17 nt, Salmonella enterica enterica serovar Typhi
cguccgguagagaacga

SEQ ID NO: 1689463 - RNA, 12 nt, Salmonella enterica enterica serovar Typhi
cguccggcugcc

SEQ ID NO: 1689464 - RNA, 19 nt, Salmonella enterica enterica serovar Typhi
cguccuguagccgugccug

SEQ ID NO: 1689465 - RNA, 14 nt, Salmonella enterica enterica serovar Typhi
cgucgacagccccc

SEQ ID NO: 1689466 - RNA, 15 nt, Salmonella enterica enterica serovar Typhi
cgucgaaugacgcgc

SEQ ID NO: 1689467 - RNA, 14 nt, Salmonella enterica enterica serovar Typhi
cgucggccaccauu

SEQ ID NO: 1689468 - RNA, 17 nt, Salmonella enterica enterica serovar Typhi
cgucggcgccagccaca

SEQ ID NO: 1689469 - RNA, 18 nt, Salmonella enterica enterica serovar Typhi
cgucgccuguccggccug

SEQ ID NO: 1689470 - RNA, 21 nt, Salmonella enterica enterica serovar Typhi
cgucgccuguuucugcgccgc

SEQ ID NO: 1689471 - RNA, 22 nt, Salmonella enterica enterica serovar Typhi
cgucgccuguuucugcgccgcu

SEQ ID NO: 1689472 - RNA, 18 nt, Salmonella enterica enterica serovar Typhi
cgucgcgaauaauuauuu

SEQ ID NO: 1689473 - RNA, 12 nt, Salmonella enterica enterica serovar Typhi
cgucgcgcgccg

SEQ ID NO: 1689474 - RNA, 14 nt, Salmonella enterica enterica serovar Typhi
cgucgcgcgccgcc

SEQ ID NO: 1689475 - RNA, 17 nt, Salmonella enterica enterica serovar Typhi
cgucgcgaucgcgccag

SEQ ID NO: 1689476 - RNA, 15 nt, Salmonella enterica enterica serovar Typhi
cgucgcgaucacaga

SEQ ID NO: 1689477 - RNA, 15 nt, Salmonella enterica enterica serovar Typhi
cgucgcgacguccgc

SEQ ID NO: 1689478 - RNA, 16 nt, Salmonella enterica enterica serovar Typhi
cgucgcgcgccgccug

SEQ ID NO: 1689479 - RNA, 14 nt, Salmonella enterica enterica serovar Typhi
cgucgcgcgcugug

SEQ ID NO: 1689480 - RNA, 15 nt, Salmonella enterica enterica serovar Typhi
cgucgacgccuucca

SEQ ID NO: 1689481 - RNA, 14 nt, Salmonella enterica enterica serovar Typhi
cgucgagacggugu

SEQ ID NO: 1689482 - RNA, 21 nt, Salmonella enterica enterica serovar Typhi
cgucgauauguaaaucgguuu

SEQ ID NO: 1689483 - RNA, 22 nt, Salmonella enterica enterica serovar Typhi
cgucgaggaagcugcgcagcac

SEQ ID NO: 1689484 - RNA, 14 nt, Salmonella enterica enterica serovar Typhi
cgucgccaaagcag

SEQ ID NO: 1689485 - RNA, 19 nt, Salmonella enterica enterica serovar Typhi
cgucgccagacccagcgcu

SEQ ID NO: 1689486 - RNA, 14 nt, Salmonella enterica enterica serovar Typhi
cgucgccagcaacg

SEQ ID NO: 1689487 - RNA, 17 nt, Salmonella enterica enterica serovar Typhi
cgucgccggaaugcgaa

SEQ ID NO: 1689488 - RNA, 15 nt, Salmonella enterica enterica serovar Typhi
cgugccuucaaauau

SEQ ID NO: 1689489 - RNA, 18 nt, Salmonella enterica enterica serovar Typhi
cgugccuuccaucggccc

SEQ ID NO: 1689490 - RNA, 16 nt, Salmonella enterica enterica serovar Typhi
cgugccgaccagcggu

SEQ ID NO: 1689491 - RNA, 20 nt, Salmonella enterica enterica serovar Typhi
cgugccagaaacaagaagca

SEQ ID NO: 1689492 - RNA, 20 nt, Salmonella enterica enterica serovar Typhi
cgugccaugaccauucacac

SEQ ID NO: 1689493 - RNA, 20 nt, Salmonella enterica enterica serovar Typhi
cgugcaugggauacgccagc

SEQ ID NO: 1689494 - RNA, 22 nt, Salmonella enterica enterica serovar Typhi
cgugcaguuuugcuucaugcac

SEQ ID NO: 1689495 - RNA, 15 nt, Salmonella enterica enterica serovar Typhi
cgugcagcgccgccu

SEQ ID NO: 1689496 - RNA, 16 nt, Salmonella enterica enterica serovar Typhi
cgugcagcgccgccug

SEQ ID NO: 1689497 - RNA, 18 nt, Salmonella enterica enterica serovar Typhi
cgugcaaugucaugacug

SEQ ID NO: 1689498 - RNA, 19 nt, Salmonella enterica enterica serovar Typhi
cgugcaaugucaugacugg

SEQ ID NO: 1689499 - RNA, 13 nt, Salmonella enterica enterica serovar Typhi
cgugcacgcugcg

SEQ ID NO: 1689500 - RNA, 23 nt, Salmonella enterica enterica serovar Typhi
cgugacgccuuccuccaguaauu

SEQ ID NO: 1689501 - RNA, 20 nt, Salmonella enterica enterica serovar Typhi
cgugaccgauaaaaaagccu

SEQ ID NO: 1689502 - RNA, 14 nt, Salmonella enterica enterica serovar Typhi
cgugacccgccagc

SEQ ID NO: 1689503 - RNA, 20 nt, Salmonella enterica enterica serovar Typhi
cgugaagauuagcagagcgg

SEQ ID NO: 1689504 - RNA, 20 nt, Salmonella enterica enterica serovar Typhi
cgugacaccgguuugcgccu

SEQ ID NO: 1689505 - RNA, 16 nt, Salmonella enterica enterica serovar Typhi
cgugacaguuaccccg

SEQ ID NO: 1689506 - RNA, 19 nt, Salmonella enterica enterica serovar Typhi
cgugaauugcgguuuaucc

SEQ ID NO: 1689507 - RNA, 17 nt, Salmonella enterica enterica serovar Typhi
cgugaauuucugcugcc

SEQ ID NO: 1689508 - RNA, 20 nt, Salmonella enterica enterica serovar Typhi
cgugaauuucugcugccagc

SEQ ID NO: 1689509 - RNA, 14 nt, Salmonella enterica enterica serovar Typhi
cgugauugagcaga

SEQ ID NO: 1689510 - RNA, 21 nt, Salmonella enterica enterica serovar Typhi
cgugauugagcagaucagcac

SEQ ID NO: 1689511 - RNA, 13 nt, Salmonella enterica enterica serovar Typhi
cgugaucacuccc

SEQ ID NO: 1689512 - RNA, 19 nt, Salmonella enterica enterica serovar Typhi
cgugaugcgacgcgcucac

SEQ ID NO: 1689513 - RNA, 22 nt, Salmonella enterica enterica serovar Typhi
cgugagccacuauccagucagc

SEQ ID NO: 1689514 - RNA, 22 nt, Salmonella enterica enterica serovar Typhi
cgugagccgaaauccaccagcg

SEQ ID NO: 1689515 - RNA, 14 nt, Salmonella enterica enterica serovar Typhi
cgugagcgcgccgc

SEQ ID NO: 1689516 - RNA, 21 nt, Salmonella enterica enterica serovar Typhi
cgugagugguagaaacuggca

SEQ ID NO: 1689517 - RNA, 18 nt, Salmonella enterica enterica serovar Typhi
cgugauaaauacgcugcg

SEQ ID NO: 1689518 - RNA, 13 nt, Salmonella enterica enterica serovar Typhi
cgugaguuuuaac

SEQ ID NO: 1689519 - RNA, 19 nt, Salmonella enterica enterica serovar Typhi
cgugauaaagcugacgcgc

SEQ ID NO: 1689520 - RNA, 14 nt, Salmonella enterica enterica serovar Typhi
cgucguugccuuug

SEQ ID NO: 1689521 - RNA, 15 nt, Salmonella enterica enterica serovar Typhi
cgucucccaaaugaa

SEQ ID NO: 1689522 - RNA, 15 nt, Salmonella enterica enterica serovar Typhi
cgucgucggugggcu

SEQ ID NO: 1689523 - RNA, 16 nt, Salmonella enterica enterica serovar Typhi
cgucgucguuuguagg

SEQ ID NO: 1689524 - RNA, 15 nt, Salmonella enterica enterica serovar Typhi
cgucguuccgccagg

SEQ ID NO: 1689525 - RNA, 23 nt, Salmonella enterica enterica serovar Typhi
cgucguuaacaucaucaggccug

SEQ ID NO: 1689526 - RNA, 18 nt, Salmonella enterica enterica serovar Typhi
cgucgugcugggcgcgcc

SEQ ID NO: 1689527 - RNA, 19 nt, Salmonella enterica enterica serovar Typhi
cgucgugcagcgccgccug

SEQ ID NO: 1689528 - RNA, 18 nt, Salmonella enterica enterica serovar Typhi
cgucggcgucugcgcgcu

SEQ ID NO: 1689529 - RNA, 22 nt, Salmonella enterica enterica serovar Typhi
cgucgucccgcgaguacgcaca

SEQ ID NO: 1689530 - RNA, 14 nt, Salmonella enterica enterica serovar Typhi
cgucguaaaaccug

SEQ ID NO: 1689531 - RNA, 15 nt, Salmonella enterica enterica serovar Typhi
cgucguaaaaccugc

SEQ ID NO: 1689532 - RNA, 23 nt, Salmonella enterica enterica serovar Typhi
cgucuuuauucaucaucuugucc

SEQ ID NO: 1689533 - RNA, 14 nt, Salmonella enterica enterica serovar Typhi
cgucuuuuagucac

SEQ ID NO: 1689534 - RNA, 18 nt, Salmonella enterica enterica serovar Typhi
cgugaaauauccuccgcc

SEQ ID NO: 1689535 - RNA, 16 nt, Salmonella enterica enterica serovar Typhi
cgugaacaccacugaa

SEQ ID NO: 1689536 - RNA, 19 nt, Salmonella enterica enterica serovar Typhi
cgugaaccagcaucccacg

SEQ ID NO: 1689537 - RNA, 21 nt, Salmonella enterica enterica serovar Typhi
cgugaaccagcaucccacgaa

SEQ ID NO: 1689538 - RNA, 12 nt, Salmonella enterica enterica serovar Typhi
cgucuugccgug

SEQ ID NO: 1689539 - RNA, 18 nt, Salmonella enterica enterica serovar Typhi
cgucuucaucguucauug

SEQ ID NO: 1689540 - RNA, 17 nt, Salmonella enterica enterica serovar Typhi
cgucuucaucagccagc

SEQ ID NO: 1689541 - RNA, 21 nt, Salmonella enterica enterica serovar Typhi
cgucuuaaugguggucgcggc

SEQ ID NO: 1689542 - RNA, 15 nt, Salmonella enterica enterica serovar Typhi
cgucuuauccggccu

SEQ ID NO: 1689543 - RNA, 16 nt, Salmonella enterica enterica serovar Typhi
cgucuuauccggccuc

SEQ ID NO: 1689544 - RNA, 17 nt, Salmonella enterica enterica serovar Typhi
cgucuuauccggccugc

SEQ ID NO: 1689545 - RNA, 20 nt, Salmonella enterica enterica serovar Typhi
cgucugguaauaggccggag

SEQ ID NO: 1689546 - RNA, 20 nt, Salmonella enterica enterica serovar Typhi
cgucugguacggccaccagg

SEQ ID NO: 1689547 - RNA, 14 nt, Salmonella enterica enterica serovar Typhi
cgucuggugaucca

SEQ ID NO: 1689548 - RNA, 13 nt, Salmonella enterica enterica serovar Typhi
cgucugcucagaa

SEQ ID NO: 1689549 - RNA, 16 nt, Salmonella enterica enterica serovar Typhi
cgucugcccuccugaa

SEQ ID NO: 1689550 - RNA, 18 nt, Salmonella enterica enterica serovar Typhi
cgucucuuucauggaaau

SEQ ID NO: 1689551 - RNA, 14 nt, Salmonella enterica enterica serovar Typhi
cgucucggccuggc

SEQ ID NO: 1689552 - RNA, 17 nt, Salmonella enterica enterica serovar Typhi
cuaaccuguaucugcug

SEQ ID NO: 1689553 - RNA, 20 nt, Salmonella enterica enterica serovar Typhi
cuaaccuguaucugcugaca

SEQ ID NO: 1689554 - RNA, 18 nt, Salmonella enterica enterica serovar Typhi
cuaacgaaaccggcggcg

SEQ ID NO: 1689555 - RNA, 15 nt, Salmonella enterica enterica serovar Typhi
cuaacgaggccacca

SEQ ID NO: 1689556 - RNA, 21 nt, Salmonella enterica enterica serovar Typhi
cuaacgacccgaagugguggg

SEQ ID NO: 1689557 - RNA, 17 nt, Salmonella enterica enterica serovar Typhi
cuaacugguacguccau

SEQ ID NO: 1689558 - RNA, 17 nt, Salmonella enterica enterica serovar Typhi
cuaacgccgugucgacc

SEQ ID NO: 1689559 - RNA, 22 nt, Salmonella enterica enterica serovar Typhi
cuaacgauguaaaaccuggcac

SEQ ID NO: 1689560 - RNA, 18 nt, Salmonella enterica enterica serovar Typhi
cuaacgcgaagauuaacc

SEQ ID NO: 1689561 - RNA, 18 nt, Salmonella enterica enterica serovar Typhi
cuaacgcggcaucaagca

SEQ ID NO: 1689562 - RNA, 15 nt, Salmonella enterica enterica serovar Typhi
cuaacgcucuucucc

SEQ ID NO: 1689563 - RNA, 13 nt, Salmonella enterica enterica serovar Typhi
cuaagaccagcau

SEQ ID NO: 1689564 - RNA, 18 nt, Salmonella enterica enterica serovar Typhi
cuaagcgcccguagcuca

SEQ ID NO: 1689565 - RNA, 19 nt, Salmonella enterica enterica serovar Typhi
cuaagccggacgcccgucc

SEQ ID NO: 1689566 - RNA, 17 nt, Salmonella enterica enterica serovar Typhi
cuaagccaguucucaau

SEQ ID NO: 1689567 - RNA, 18 nt, Salmonella enterica enterica serovar Typhi
cuaaguauucacgugugu

SEQ ID NO: 1689568 - RNA, 15 nt, Salmonella enterica enterica serovar Typhi
cuaagugagcauuac

SEQ ID NO: 1689569 - RNA, 22 nt, Salmonella enterica enterica serovar Typhi
cuaaaugacgcgcgagaacugc

SEQ ID NO: 1689570 - RNA, 23 nt, Salmonella enterica enterica serovar Typhi
cuaaaugacgcgcgagaacugcu

SEQ ID NO: 1689571 - RNA, 17 nt, Salmonella enterica enterica serovar Typhi
cuaaaugggcaggagau

SEQ ID NO: 1689572 - RNA, 11 nt, Salmonella enterica enterica serovar Typhi
cuaaagaaaaa

SEQ ID NO: 1689573 - RNA, 21 nt, Salmonella enterica enterica serovar Typhi
cuaaagacgugccggaagcga

SEQ ID NO: 1689574 - RNA, 13 nt, Salmonella enterica enterica serovar Typhi
cuaacagugaaau

SEQ ID NO: 1689575 - RNA, 11 nt, Salmonella enterica enterica serovar Typhi
cuaacaggaag

SEQ ID NO: 1689576 - RNA, 12 nt, Salmonella enterica enterica serovar Typhi
cuaacagcagca

SEQ ID NO: 1689577 - RNA, 19 nt, Salmonella enterica enterica serovar Typhi
cuaacacaugcaagucgaa

SEQ ID NO: 1689578 - RNA, 18 nt, Salmonella enterica enterica serovar Typhi
cuaaauugggauguugcc

SEQ ID NO: 1689579 - RNA, 17 nt, Salmonella enterica enterica serovar Typhi
cuaaacccaccauaggc

SEQ ID NO: 1689580 - RNA, 14 nt, Salmonella enterica enterica serovar Typhi
cuaaaaaccagaau

SEQ ID NO: 1689581 - RNA, 16 nt, Salmonella enterica enterica serovar Typhi
cguuuccgcaauaagu

SEQ ID NO: 1689582 - RNA, 14 nt, Salmonella enterica enterica serovar Typhi
cguuugcgccgcca

SEQ ID NO: 1689583 - RNA, 20 nt, Salmonella enterica enterica serovar Typhi
cguuuguuugucgauuuccg

SEQ ID NO: 1689584 - RNA, 22 nt, Salmonella enterica enterica serovar Typhi
cguuugcgcgaagucgagcuca

SEQ ID NO: 1689585 - RNA, 17 nt, Salmonella enterica enterica serovar Typhi
cguuugccccucuuccc

SEQ ID NO: 1689586 - RNA, 16 nt, Salmonella enterica enterica serovar Typhi
cguuuggucaacucuu

SEQ ID NO: 1689587 - RNA, 19 nt, Salmonella enterica enterica serovar Typhi
cguuuuuuuguuuuaccug

SEQ ID NO: 1689588 - RNA, 15 nt, Salmonella enterica enterica serovar Typhi
cguuuuuuccagcgc

SEQ ID NO: 1689589 - RNA, 19 nt, Salmonella enterica enterica serovar Typhi
cguuuuuucgcacgccucu

SEQ ID NO: 1689590 - RNA, 15 nt, Salmonella enterica enterica serovar Typhi
cguuuuuguuuaaaa

SEQ ID NO: 1689591 - RNA, 18 nt, Salmonella enterica enterica serovar Typhi
cguuuuagguucuucaau

SEQ ID NO: 1689592 - RNA, 20 nt, Salmonella enterica enterica serovar Typhi
cguuggaauaaaucacaacg

SEQ ID NO: 1689593 - RNA, 11 nt, Salmonella enterica enterica serovar Typhi
cguugaaaacg

SEQ ID NO: 1689594 - RNA, 20 nt, Salmonella enterica enterica serovar Typhi
cguucggcaaaacgccgcag

SEQ ID NO: 1689595 - RNA, 17 nt, Salmonella enterica enterica serovar Typhi
cguucuuuccaguucug

SEQ ID NO: 1689596 - RNA, 12 nt, Salmonella enterica enterica serovar Typhi
cguuuccagacu

SEQ ID NO: 1689597 - RNA, 22 nt, Salmonella enterica enterica serovar Typhi
cguuucauuuuucccaucaauc

SEQ ID NO: 1689598 - RNA, 14 nt, Salmonella enterica enterica serovar Typhi
cguuuagcgccagc

SEQ ID NO: 1689599 - RNA, 16 nt, Salmonella enterica enterica serovar Typhi
cguuuauaccccacca

SEQ ID NO: 1689600 - RNA, 16 nt, Salmonella enterica enterica serovar Typhi
cguuucauguaaauga

SEQ ID NO: 1689601 - RNA, 16 nt, Salmonella enterica enterica serovar Typhi
cguuuaaacucccggc

SEQ ID NO: 1689602 - RNA, 19 nt, Salmonella enterica enterica serovar Typhi
cguuguuucugccuuuaac

SEQ ID NO: 1689603 - RNA, 13 nt, Salmonella enterica enterica serovar Typhi
cguuuaaaaugaa

SEQ ID NO: 1689604 - RNA, 16 nt, Salmonella enterica enterica serovar Typhi
cguuuaaaaagcugca

SEQ ID NO: 1689605 - RNA, 18 nt, Salmonella enterica enterica serovar Typhi
cguugguagacccggcau

SEQ ID NO: 1689606 - RNA, 20 nt, Salmonella enterica enterica serovar Typhi
cguuggcguaaaucaggcca

SEQ ID NO: 1689607 - RNA, 19 nt, Salmonella enterica enterica serovar Typhi
cguuggcuugaucaacgcc

SEQ ID NO: 1689608 - RNA, 23 nt, Salmonella enterica enterica serovar Typhi
cguuaccccgcagcgaaaaucca

SEQ ID NO: 1689609 - RNA, 16 nt, Salmonella enterica enterica serovar Typhi
cguuaccgggcaaacg

SEQ ID NO: 1689610 - RNA, 22 nt, Salmonella enterica enterica serovar Typhi
cguuacgcgccacgccauugcu

SEQ ID NO: 1689611 - RNA, 15 nt, Salmonella enterica enterica serovar Typhi
cguuacgcgcugcaa

SEQ ID NO: 1689612 - RNA, 13 nt, Salmonella enterica enterica serovar Typhi
cguuagccgccau

SEQ ID NO: 1689613 - RNA, 22 nt, Salmonella enterica enterica serovar Typhi
cguuagcgccauccggcauuuc

SEQ ID NO: 1689614 - RNA, 21 nt, Salmonella enterica enterica serovar Typhi
cguuagcgagguucccgccgc

SEQ ID NO: 1689615 - RNA, 19 nt, Salmonella enterica enterica serovar Typhi
cguuagauauagcuuuuca

SEQ ID NO: 1689616 - RNA, 19 nt, Salmonella enterica enterica serovar Typhi
cguuagucaacucgcacag

SEQ ID NO: 1689617 - RNA, 21 nt, Salmonella enterica enterica serovar Typhi
cguuauuuuccugaaaaaauu

SEQ ID NO: 1689618 - RNA, 23 nt, Salmonella enterica enterica serovar Typhi
cguucacuaacgcggcaucaagc

SEQ ID NO: 1689619 - RNA, 19 nt, Salmonella enterica enterica serovar Typhi
cguucaccagccacugcgc

SEQ ID NO: 1689620 - RNA, 17 nt, Salmonella enterica enterica serovar Typhi
cguucaccacaacccac

SEQ ID NO: 1689621 - RNA, 19 nt, Salmonella enterica enterica serovar Typhi
cguuccacgucgcacgcca

SEQ ID NO: 1689622 - RNA, 12 nt, Salmonella enterica enterica serovar Typhi
cguucagccagc

SEQ ID NO: 1689623 - RNA, 21 nt, Salmonella enterica enterica serovar Typhi
cguucagauaggcgcgaaaug

SEQ ID NO: 1689624 - RNA, 21 nt, Salmonella enterica enterica serovar Typhi
cguucgcauauucugcgaaag

SEQ ID NO: 1689625 - RNA, 16 nt, Salmonella enterica enterica serovar Typhi
cguucgcggaacggcg

SEQ ID NO: 1689626 - RNA, 18 nt, Salmonella enterica enterica serovar Typhi
cguucgcgcaauucuucu

SEQ ID NO: 1689627 - RNA, 18 nt, Salmonella enterica enterica serovar Typhi
cguuccaucacuuccugu

SEQ ID NO: 1689628 - RNA, 23 nt, Salmonella enterica enterica serovar Typhi
cguguuacgccgcaaucacuuca

SEQ ID NO: 1689629 - RNA, 18 nt, Salmonella enterica enterica serovar Typhi
cguuaaacaccucaccgg

SEQ ID NO: 1689630 - RNA, 18 nt, Salmonella enterica enterica serovar Typhi
cguuaaauaccagcaccu

SEQ ID NO: 1689631 - RNA, 17 nt, Salmonella enterica enterica serovar Typhi
cguuaccccuuuuucaa

SEQ ID NO: 1689632 - RNA, 20 nt, Salmonella enterica enterica serovar Typhi
cguuacccgauaccgccagc

SEQ ID NO: 1689633 - RNA, 15 nt, Salmonella enterica enterica serovar Typhi
cguuacccggccagc

SEQ ID NO: 1689634 - RNA, 12 nt, Salmonella enterica enterica serovar Typhi
cguuaccagcau

SEQ ID NO: 1689635 - RNA, 15 nt, Salmonella enterica enterica serovar Typhi
cguuaccggcaggcu

SEQ ID NO: 1689636 - RNA, 12 nt, Salmonella enterica enterica serovar Typhi
cguuacccuccu

SEQ ID NO: 1689637 - RNA, 22 nt, Salmonella enterica enterica serovar Typhi
cguuaaugcgcgcuucuucaug

SEQ ID NO: 1689638 - RNA, 17 nt, Salmonella enterica enterica serovar Typhi
cguuaauucauggccau

SEQ ID NO: 1689639 - RNA, 15 nt, Salmonella enterica enterica serovar Typhi
cguuaaccagcggcg

SEQ ID NO: 1689640 - RNA, 20 nt, Salmonella enterica enterica serovar Typhi
cguuaacguaaagccaucca

SEQ ID NO: 1689641 - RNA, 15 nt, Salmonella enterica enterica serovar Typhi
cguuaauaccgugca

SEQ ID NO: 1689642 - RNA, 22 nt, Salmonella enterica enterica serovar Typhi
cgugugcgguauagaucagacg

SEQ ID NO: 1689643 - RNA, 18 nt, Salmonella enterica enterica serovar Typhi
cguguggcggaaugaccu

SEQ ID NO: 1689644 - RNA, 22 nt, Salmonella enterica enterica serovar Typhi
cgugucgcguaacgccuccacc

SEQ ID NO: 1689645 - RNA, 19 nt, Salmonella enterica enterica serovar Typhi
cgugucggauaucagacag

SEQ ID NO: 1689646 - RNA, 16 nt, Salmonella enterica enterica serovar Typhi
cgugucgggaauugcc

SEQ ID NO: 1689647 - RNA, 13 nt, Salmonella enterica enterica serovar Typhi
cguguaauuucau

SEQ ID NO: 1689648 - RNA, 17 nt, Salmonella enterica enterica serovar Typhi
cgugguuuccggcagcu

SEQ ID NO: 1689649 - RNA, 13 nt, Salmonella enterica enterica serovar Typhi
cgugguuuccggc

SEQ ID NO: 1689650 - RNA, 20 nt, Salmonella enterica enterica serovar Typhi
cgugcgguauaucacgccau

SEQ ID NO: 1689651 - RNA, 13 nt, Salmonella enterica enterica serovar Typhi
cgugcggcugacg

SEQ ID NO: 1689652 - RNA, 21 nt, Salmonella enterica enterica serovar Typhi
cgugcggcgaagcaucuuucc

SEQ ID NO: 1689653 - RNA, 15 nt, Salmonella enterica enterica serovar Typhi
cgugcgccguccugc

SEQ ID NO: 1689654 - RNA, 13 nt, Salmonella enterica enterica serovar Typhi
cgugcgcagcgcg

SEQ ID NO: 1689655 - RNA, 18 nt, Salmonella enterica enterica serovar Typhi
cgugcgauagcgucccgu

SEQ ID NO: 1689656 - RNA, 15 nt, Salmonella enterica enterica serovar Typhi
cguggcaaucagcaa

SEQ ID NO: 1689657 - RNA, 17 nt, Salmonella enterica enterica serovar Typhi
cguggcauucgcuugcc

SEQ ID NO: 1689658 - RNA, 11 nt, Salmonella enterica enterica serovar Typhi
cguggcaucuu

SEQ ID NO: 1689659 - RNA, 12 nt, Salmonella enterica enterica serovar Typhi
cgugcuggaugg

SEQ ID NO: 1689660 - RNA, 16 nt, Salmonella enterica enterica serovar Typhi
cgugcugggcgcgccu

SEQ ID NO: 1689661 - RNA, 18 nt, Salmonella enterica enterica serovar Typhi
cgugcugacggagcuggc

SEQ ID NO: 1689662 - RNA, 20 nt, Salmonella enterica enterica serovar Typhi
cguggaccguauagcccaga

SEQ ID NO: 1689663 - RNA, 20 nt, Salmonella enterica enterica serovar Typhi
cguggucguaaaacugcacc

SEQ ID NO: 1689664 - RNA, 21 nt, Salmonella enterica enterica serovar Typhi
cguggucguaaaacugcacca

SEQ ID NO: 1689665 - RNA, 21 nt, Salmonella enterica enterica serovar Typhi
cguggucauuaggcguaauua

SEQ ID NO: 1689666 - RNA, 14 nt, Salmonella enterica enterica serovar Typhi
cgugguaucgaaaa

SEQ ID NO: 1689667 - RNA, 16 nt, Salmonella enterica enterica serovar Typhi
cguggcgcuuuccggc

SEQ ID NO: 1689668 - RNA, 21 nt, Salmonella enterica enterica serovar Typhi
cguggccgauauugccuucac

SEQ ID NO: 1689669 - RNA, 15 nt, Salmonella enterica enterica serovar Typhi
cguggccaaaaaauc

SEQ ID NO: 1689670 - RNA, 18 nt, Salmonella enterica enterica serovar Typhi
cuccaucacgguaaaccu

SEQ ID NO: 1689671 - RNA, 23 nt, Salmonella enterica enterica serovar Typhi
cuccaucagacguuuauacccca

SEQ ID NO: 1689672 - RNA, 23 nt, Salmonella enterica enterica serovar Typhi
cuccauaauuugaaucgccuggc

SEQ ID NO: 1689673 - RNA, 14 nt, Salmonella enterica enterica serovar Typhi
cuccaugcccacac

SEQ ID NO: 1689674 - RNA, 16 nt, Salmonella enterica enterica serovar Typhi
cuccaucauuuccggc

SEQ ID NO: 1689675 - RNA, 22 nt, Salmonella enterica enterica serovar Typhi
cuccaguugauacaggaauaac

SEQ ID NO: 1689676 - RNA, 22 nt, Salmonella enterica enterica serovar Typhi
cuccaguuguuccagcagcuca

SEQ ID NO: 1689677 - RNA, 21 nt, Salmonella enterica enterica serovar Typhi
cuccagggcaacggccagcgc

SEQ ID NO: 1689678 - RNA, 17 nt, Salmonella enterica enterica serovar Typhi
cuccagcgccagcucca

SEQ ID NO: 1689679 - RNA, 17 nt, Salmonella enterica enterica serovar Typhi
cuccagcccgccgcccu

SEQ ID NO: 1689680 - RNA, 16 nt, Salmonella enterica enterica serovar Typhi
cuccagcgccuguuga

SEQ ID NO: 1689681 - RNA, 17 nt, Salmonella enterica enterica serovar Typhi
cuccaggcguuuaugag

SEQ ID NO: 1689682 - RNA, 19 nt, Salmonella enterica enterica serovar Typhi
cuccaggcgaauccccauc

SEQ ID NO: 1689683 - RNA, 16 nt, Salmonella enterica enterica serovar Typhi
cuccagcucagggucc

SEQ ID NO: 1689684 - RNA, 14 nt, Salmonella enterica enterica serovar Typhi
cuccagcguggcag

SEQ ID NO: 1689685 - RNA, 12 nt, Salmonella enterica enterica serovar Typhi
cuccagcuggcu

SEQ ID NO: 1689686 - RNA, 16 nt, Salmonella enterica enterica serovar Typhi
cuccagcuggcuggca

SEQ ID NO: 1689687 - RNA, 23 nt, Salmonella enterica enterica serovar Typhi
cucauuuuugaguuugucaucca

SEQ ID NO: 1689688 - RNA, 16 nt, Salmonella enterica enterica serovar Typhi
cucauuuuugcccagc

SEQ ID NO: 1689689 - RNA, 17 nt, Salmonella enterica enterica serovar Typhi
cuccacgcccagcgccg

SEQ ID NO: 1689690 - RNA, 20 nt, Salmonella enterica enterica serovar Typhi
cuccagcagaccggcaaaaa

SEQ ID NO: 1689691 - RNA, 22 nt, Salmonella enterica enterica serovar Typhi
cuccagacgaugauaauacauu

SEQ ID NO: 1689692 - RNA, 13 nt, Salmonella enterica enterica serovar Typhi
cuccagacaggac

SEQ ID NO: 1689693 - RNA, 22 nt, Salmonella enterica enterica serovar Typhi
cuccagaauauugacaucgccg

SEQ ID NO: 1689694 - RNA, 15 nt, Salmonella enterica enterica serovar Typhi
cuccagaccaccagc

SEQ ID NO: 1689695 - RNA, 18 nt, Salmonella enterica enterica serovar Typhi
cuccagaccgcugcggaa

SEQ ID NO: 1689696 - RNA, 18 nt, Salmonella enterica enterica serovar Typhi
cuccagaccucguucggc

SEQ ID NO: 1689697 - RNA, 19 nt, Salmonella enterica enterica serovar Typhi
cuccagaagcacuucucca

SEQ ID NO: 1689698 - RNA, 14 nt, Salmonella enterica enterica serovar Typhi
cuccgguaaucacc

SEQ ID NO: 1689699 - RNA, 23 nt, Salmonella enterica enterica serovar Typhi
cuccggguaacggacucaggccu

SEQ ID NO: 1689700 - RNA, 14 nt, Salmonella enterica enterica serovar Typhi
cuccggcgcgcgcg

SEQ ID NO: 1689701 - RNA, 19 nt, Salmonella enterica enterica serovar Typhi
cuccgggauagcaaucucg

SEQ ID NO: 1689702 - RNA, 23 nt, Salmonella enterica enterica serovar Typhi
cuccgggauagcaaucucgccaa

SEQ ID NO: 1689703 - RNA, 15 nt, Salmonella enterica enterica serovar Typhi
cuccggcguaaaggc

SEQ ID NO: 1689704 - RNA, 17 nt, Salmonella enterica enterica serovar Typhi
cuccggcuaugccggag

SEQ ID NO: 1689705 - RNA, 21 nt, Salmonella enterica enterica serovar Typhi
cuccgccagcaaugccgccgc

SEQ ID NO: 1689706 - RNA, 17 nt, Salmonella enterica enterica serovar Typhi
cuccggcagaaaugacc

SEQ ID NO: 1689707 - RNA, 12 nt, Salmonella enterica enterica serovar Typhi
cuccggcagcau

SEQ ID NO: 1689708 - RNA, 14 nt, Salmonella enterica enterica serovar Typhi
cuccggcagcgaau

SEQ ID NO: 1689709 - RNA, 14 nt, Salmonella enterica enterica serovar Typhi
cuccggcaguccau

SEQ ID NO: 1689710 - RNA, 23 nt, Salmonella enterica enterica serovar Typhi
cuccggcaucuuaaagcgggcuu

SEQ ID NO: 1689711 - RNA, 21 nt, Salmonella enterica enterica serovar Typhi
cucccaggcgcgcagcugcca

SEQ ID NO: 1689712 - RNA, 18 nt, Salmonella enterica enterica serovar Typhi
cucccaggccgccaccgc

SEQ ID NO: 1689713 - RNA, 23 nt, Salmonella enterica enterica serovar Typhi
cucccaggccgccaccgccucgc

SEQ ID NO: 1689714 - RNA, 14 nt, Salmonella enterica enterica serovar Typhi
cucccacucuucca

SEQ ID NO: 1689715 - RNA, 16 nt, Salmonella enterica enterica serovar Typhi
cuccccaaccgccagc

SEQ ID NO: 1689716 - RNA, 20 nt, Salmonella enterica enterica serovar Typhi
cuccccacaaucccgccaga

SEQ ID NO: 1689717 - RNA, 12 nt, Salmonella enterica enterica serovar Typhi
cuccccagaaug

SEQ ID NO: 1689718 - RNA, 23 nt, Salmonella enterica enterica serovar Typhi
cuccccaggcgcuauucccaggc

SEQ ID NO: 1689719 - RNA, 15 nt, Salmonella enterica enterica serovar Typhi
cucccauacccaggu

SEQ ID NO: 1689720 - RNA, 22 nt, Salmonella enterica enterica serovar Typhi
cuccauggucagacgcucagcc

SEQ ID NO: 1689721 - RNA, 15 nt, Salmonella enterica enterica serovar Typhi
cuccauuaaauuacu

SEQ ID NO: 1689722 - RNA, 13 nt, Salmonella enterica enterica serovar Typhi
cuccauucccagc

SEQ ID NO: 1689723 - RNA, 19 nt, Salmonella enterica enterica serovar Typhi
cucccaaauuuuuuuagca

SEQ ID NO: 1689724 - RNA, 15 nt, Salmonella enterica enterica serovar Typhi
cuccgcaauuuccug

SEQ ID NO: 1689725 - RNA, 13 nt, Salmonella enterica enterica serovar Typhi
cucccuuccccca

SEQ ID NO: 1689726 - RNA, 16 nt, Salmonella enterica enterica serovar Typhi
cucccugagucuugcc

SEQ ID NO: 1689727 - RNA, 20 nt, Salmonella enterica enterica serovar Typhi
cucccugagucuugccuguc

SEQ ID NO: 1689728 - RNA, 12 nt, Salmonella enterica enterica serovar Typhi
cucccuggcagu

SEQ ID NO: 1689729 - RNA, 19 nt, Salmonella enterica enterica serovar Typhi
cucccuguuccuguauuug

SEQ ID NO: 1689730 - RNA, 18 nt, Salmonella enterica enterica serovar Typhi
cucccuggcagugaucca

SEQ ID NO: 1689731 - RNA, 18 nt, Salmonella enterica enterica serovar Typhi
cucccugccuaaagaaaa

SEQ ID NO: 1689732 - RNA, 16 nt, Salmonella enterica enterica serovar Typhi
cucccgcagccacucc

SEQ ID NO: 1689733 - RNA, 18 nt, Salmonella enterica enterica serovar Typhi
cucccccggcaccacgca

SEQ ID NO: 1689734 - RNA, 21 nt, Salmonella enterica enterica serovar Typhi
cucccgcgucacgaccggcga

SEQ ID NO: 1689735 - RNA, 22 nt, Salmonella enterica enterica serovar Typhi
cucccgccagaugcagcggcag

SEQ ID NO: 1689736 - RNA, 16 nt, Salmonella enterica enterica serovar Typhi
cucggauagcuacgau

SEQ ID NO: 1689737 - RNA, 16 nt, Salmonella enterica enterica serovar Typhi
cucgcuuacgcggcgc

SEQ ID NO: 1689738 - RNA, 19 nt, Salmonella enterica enterica serovar Typhi
cucgcuguggccaggcacg

SEQ ID NO: 1689739 - RNA, 22 nt, Salmonella enterica enterica serovar Typhi
cucgggaauaaaaauaaauaaa

SEQ ID NO: 1689740 - RNA, 13 nt, Salmonella enterica enterica serovar Typhi
cucgguccacacc

SEQ ID NO: 1689741 - RNA, 13 nt, Salmonella enterica enterica serovar Typhi
cucuacgcggcgg

SEQ ID NO: 1689742 - RNA, 18 nt, Salmonella enterica enterica serovar Typhi
cucuaaaugggcaggaga

SEQ ID NO: 1689743 - RNA, 12 nt, Salmonella enterica enterica serovar Typhi
cucuacauuucg

SEQ ID NO: 1689744 - RNA, 24 nt, Salmonella enterica enterica serovar Typhi
cucguaagagaggcuuuaugcuga

SEQ ID NO: 1689745 - RNA, 18 nt, Salmonella enterica enterica serovar Typhi
cucguacacgcgcccgcc

SEQ ID NO: 1689746 - RNA, 22 nt, Salmonella enterica enterica serovar Typhi
cucguacacgcgcccgccgcca

SEQ ID NO: 1689747 - RNA, 15 nt, Salmonella enterica enterica serovar Typhi
cucguccugcaauuu

SEQ ID NO: 1689748 - RNA, 17 nt, Salmonella enterica enterica serovar Typhi
cucgugaucgccaaagc

SEQ ID NO: 1689749 - RNA, 15 nt, Salmonella enterica enterica serovar Typhi
cucgucgccagggcg

SEQ ID NO: 1689750 - RNA, 18 nt, Salmonella enterica enterica serovar Typhi
cucgacacacucaucuuc

SEQ ID NO: 1689751 - RNA, 21 nt, Salmonella enterica enterica serovar Typhi
cuccugcaaucguucuugcac

SEQ ID NO: 1689752 - RNA, 21 nt, Salmonella enterica enterica serovar Typhi
cuccugauaaccuauuuugca

SEQ ID NO: 1689753 - RNA, 19 nt, Salmonella enterica enterica serovar Typhi
cucgacauagguucugcga

SEQ ID NO: 1689754 - RNA, 11 nt, Salmonella enterica enterica serovar Typhi
cucgacggugc

SEQ ID NO: 1689755 - RNA, 19 nt, Salmonella enterica enterica serovar Typhi
cucgccaccggcacaucca

SEQ ID NO: 1689756 - RNA, 18 nt, Salmonella enterica enterica serovar Typhi
cucgccaauauccccagc

SEQ ID NO: 1689757 - RNA, 23 nt, Salmonella enterica enterica serovar Typhi
cucgauuugcccuuccagcagcc

SEQ ID NO: 1689758 - RNA, 20 nt, Salmonella enterica enterica serovar Typhi
cucgccaaagcgcugcugcu

SEQ ID NO: 1689759 - RNA, 15 nt, Salmonella enterica enterica serovar Typhi
cucgcaagauuccag

SEQ ID NO: 1689760 - RNA, 13 nt, Salmonella enterica enterica serovar Typhi
cucgauauauuuu

SEQ ID NO: 1689761 - RNA, 18 nt, Salmonella enterica enterica serovar Typhi
cucgcugccgaccuggcu

SEQ ID NO: 1689762 - RNA, 20 nt, Salmonella enterica enterica serovar Typhi
cucgcugauacgcaccagcu

SEQ ID NO: 1689763 - RNA, 14 nt, Salmonella enterica enterica serovar Typhi
cucgcucccuuccc

SEQ ID NO: 1689764 - RNA, 23 nt, Salmonella enterica enterica serovar Typhi
cucgcucaucacaucgcgcagca

SEQ ID NO: 1689765 - RNA, 22 nt, Salmonella enterica enterica serovar Typhi
cucgcucauuugcgagaaaaag

SEQ ID NO: 1689766 - RNA, 13 nt, Salmonella enterica enterica serovar Typhi
cucgcucccuucc

SEQ ID NO: 1689767 - RNA, 23 nt, Salmonella enterica enterica serovar Typhi
cucgcuaugaaaacgcagcccca

SEQ ID NO: 1689768 - RNA, 20 nt, Salmonella enterica enterica serovar Typhi
cucgcuaauuggcuuaccuu

SEQ ID NO: 1689769 - RNA, 13 nt, Salmonella enterica enterica serovar Typhi
cucgcuaaugccc

SEQ ID NO: 1689770 - RNA, 18 nt, Salmonella enterica enterica serovar Typhi
cucgcgguugacgcugcu

SEQ ID NO: 1689771 - RNA, 18 nt, Salmonella enterica enterica serovar Typhi
cucgcguaccagaaacag

SEQ ID NO: 1689772 - RNA, 23 nt, Salmonella enterica enterica serovar Typhi
cucgccggauggcgacgcguagc

SEQ ID NO: 1689773 - RNA, 12 nt, Salmonella enterica enterica serovar Typhi
cucgcccagcac

SEQ ID NO: 1689774 - RNA, 20 nt, Salmonella enterica enterica serovar Typhi
cucgccauaucuucuacaau

SEQ ID NO: 1689775 - RNA, 12 nt, Salmonella enterica enterica serovar Typhi
cucgccagucag

SEQ ID NO: 1689776 - RNA, 19 nt, Salmonella enterica enterica serovar Typhi
cucgcgcagaaucagcgug

SEQ ID NO: 1689777 - RNA, 21 nt, Salmonella enterica enterica serovar Typhi
cucgccgguuuuuuuacucug

SEQ ID NO: 1689778 - RNA, 18 nt, Salmonella enterica enterica serovar Typhi
cuauuuuacuugccauuu

SEQ ID NO: 1689779 - RNA, 17 nt, Salmonella enterica enterica serovar Typhi
cuauuuucgccgacccc

SEQ ID NO: 1689780 - RNA, 16 nt, Salmonella enterica enterica serovar Typhi
cuauuuuuugcuggcg

SEQ ID NO: 1689781 - RNA, 18 nt, Salmonella enterica enterica serovar Typhi
cuauuaccggcuggaagc

SEQ ID NO: 1689782 - RNA, 19 nt, Salmonella enterica enterica serovar Typhi
cuauuacaaaaaucaugcc

SEQ ID NO: 1689783 - RNA, 19 nt, Salmonella enterica enterica serovar Typhi
cuauuuaaaaaccgccccc

SEQ ID NO: 1689784 - RNA, 16 nt, Salmonella enterica enterica serovar Typhi
cuauuucaacccggca

SEQ ID NO: 1689785 - RNA, 15 nt, Salmonella enterica enterica serovar Typhi
cuauuuauugaagau

SEQ ID NO: 1689786 - RNA, 17 nt, Salmonella enterica enterica serovar Typhi
cuauuuauugaagaugu

SEQ ID NO: 1689787 - RNA, 15 nt, Salmonella enterica enterica serovar Typhi
cucaaccgcgcggcg

SEQ ID NO: 1689788 - RNA, 22 nt, Salmonella enterica enterica serovar Typhi
cucaaggcaauagaccagcggc

SEQ ID NO: 1689789 - RNA, 18 nt, Salmonella enterica enterica serovar Typhi
cucaaccaguaccgggcc

SEQ ID NO: 1689790 - RNA, 21 nt, Salmonella enterica enterica serovar Typhi
cucaaccaucaaaaaaaauag

SEQ ID NO: 1689791 - RNA, 12 nt, Salmonella enterica enterica serovar Typhi
cucaaccagccg

SEQ ID NO: 1689792 - RNA, 14 nt, Salmonella enterica enterica serovar Typhi
cucaaccagcaaug

SEQ ID NO: 1689793 - RNA, 18 nt, Salmonella enterica enterica serovar Typhi
cucaaagcguuauuugca

SEQ ID NO: 1689794 - RNA, 22 nt, Salmonella enterica enterica serovar Typhi
cucaacauugccggcaucauuc

SEQ ID NO: 1689795 - RNA, 23 nt, Salmonella enterica enterica serovar Typhi
cucaacauacgccgccagccacu

SEQ ID NO: 1689796 - RNA, 18 nt, Salmonella enterica enterica serovar Typhi
cucaaucauugucauuaa

SEQ ID NO: 1689797 - RNA, 18 nt, Salmonella enterica enterica serovar Typhi
cucaaggcuauuagccaa

SEQ ID NO: 1689798 - RNA, 15 nt, Salmonella enterica enterica serovar Typhi
cucaauuuuacagcc

SEQ ID NO: 1689799 - RNA, 17 nt, Salmonella enterica enterica serovar Typhi
cucaaugguuucacgcu

SEQ ID NO: 1689800 - RNA, 19 nt, Salmonella enterica enterica serovar Typhi
cucacauucauaaaagauc

SEQ ID NO: 1689801 - RNA, 15 nt, Salmonella enterica enterica serovar Typhi
cucacaaaacuauuu

SEQ ID NO: 1689802 - RNA, 17 nt, Salmonella enterica enterica serovar Typhi
cucaauuuuacagccuc

SEQ ID NO: 1689803 - RNA, 18 nt, Salmonella enterica enterica serovar Typhi
cucacaaaacuauuuucc

SEQ ID NO: 1689804 - RNA, 17 nt, Salmonella enterica enterica serovar Typhi
cucaccaccgccgcgag

SEQ ID NO: 1689805 - RNA, 18 nt, Salmonella enterica enterica serovar Typhi
cucaccaguccggcagaa

SEQ ID NO: 1689806 - RNA, 16 nt, Salmonella enterica enterica serovar Typhi
cucaccgccuaggcca

SEQ ID NO: 1689807 - RNA, 13 nt, Salmonella enterica enterica serovar Typhi
cucaggaaaacaa

SEQ ID NO: 1689808 - RNA, 21 nt, Salmonella enterica enterica serovar Typhi
cucaggaagcguccagaugca

SEQ ID NO: 1689809 - RNA, 19 nt, Salmonella enterica enterica serovar Typhi
cucaggaaaacaaauugca

SEQ ID NO: 1689810 - RNA, 11 nt, Salmonella enterica enterica serovar Typhi
cucaggacgcc

SEQ ID NO: 1689811 - RNA, 15 nt, Salmonella enterica enterica serovar Typhi
cucaggacgccagug

SEQ ID NO: 1689812 - RNA, 22 nt, Salmonella enterica enterica serovar Typhi
cucaggcaacacgacaaaagca

SEQ ID NO: 1689813 - RNA, 18 nt, Salmonella enterica enterica serovar Typhi
cucaggcaagacacagcg

SEQ ID NO: 1689814 - RNA, 14 nt, Salmonella enterica enterica serovar Typhi
cucagccccaggcc

SEQ ID NO: 1689815 - RNA, 18 nt, Salmonella enterica enterica serovar Typhi
cucagcauuggugagaga

SEQ ID NO: 1689816 - RNA, 22 nt, Salmonella enterica enterica serovar Typhi
cucagcaggcgggcuuuuuuug

SEQ ID NO: 1689817 - RNA, 13 nt, Salmonella enterica enterica serovar Typhi
cucaccgugguga

SEQ ID NO: 1689818 - RNA, 19 nt, Salmonella enterica enterica serovar Typhi
cucaccguagcuccagacc

SEQ ID NO: 1689819 - RNA, 18 nt, Salmonella enterica enterica serovar Typhi
cucaccguagcuccagac

SEQ ID NO: 1689820 - RNA, 13 nt, Salmonella enterica enterica serovar Typhi
cucacuguugaua

SEQ ID NO: 1689821 - RNA, 22 nt, Salmonella enterica enterica serovar Typhi
cucaucuucggcgggaucucca

SEQ ID NO: 1689822 - RNA, 17 nt, Salmonella enterica enterica serovar Typhi
cucauguucaagcuggu

SEQ ID NO: 1689823 - RNA, 23 nt, Salmonella enterica enterica serovar Typhi
cucauuaccggcugccgauagca

SEQ ID NO: 1689824 - RNA, 18 nt, Salmonella enterica enterica serovar Typhi
cucaucugaugauuaauu

SEQ ID NO: 1689825 - RNA, 14 nt, Salmonella enterica enterica serovar Typhi
cucaucggucgcau

SEQ ID NO: 1689826 - RNA, 20 nt, Salmonella enterica enterica serovar Typhi
cucaucggucgcauccauau

SEQ ID NO: 1689827 - RNA, 19 nt, Salmonella enterica enterica serovar Typhi
cucaucgguuaacacauau

SEQ ID NO: 1689828 - RNA, 21 nt, Salmonella enterica enterica serovar Typhi
cucaucggcaaacauagccuc

SEQ ID NO: 1689829 - RNA, 22 nt, Salmonella enterica enterica serovar Typhi
cucaucagccugaaagauuauu

SEQ ID NO: 1689830 - RNA, 13 nt, Salmonella enterica enterica serovar Typhi
cucaucacagcca

SEQ ID NO: 1689831 - RNA, 21 nt, Salmonella enterica enterica serovar Typhi
cucaucaauggauuuauggca

SEQ ID NO: 1689832 - RNA, 20 nt, Salmonella enterica enterica serovar Typhi
cucaguccagccgccgcgcg

SEQ ID NO: 1689833 - RNA, 22 nt, Salmonella enterica enterica serovar Typhi
cuacgcuauuuccagaaaucag

SEQ ID NO: 1689834 - RNA, 21 nt, Salmonella enterica enterica serovar Typhi
cuacgcugccauccucauuuu

SEQ ID NO: 1689835 - RNA, 19 nt, Salmonella enterica enterica serovar Typhi
cuacgcuauccggcgcgcu

SEQ ID NO: 1689836 - RNA, 13 nt, Salmonella enterica enterica serovar Typhi
cuacgcuauuucc

SEQ ID NO: 1689837 - RNA, 14 nt, Salmonella enterica enterica serovar Typhi
cuacgcuauuucca

SEQ ID NO: 1689838 - RNA, 13 nt, Salmonella enterica enterica serovar Typhi
cuacggcaaacac

SEQ ID NO: 1689839 - RNA, 14 nt, Salmonella enterica enterica serovar Typhi
cuacgcuucucucc

SEQ ID NO: 1689840 - RNA, 13 nt, Salmonella enterica enterica serovar Typhi
cuacgccauggca

SEQ ID NO: 1689841 - RNA, 17 nt, Salmonella enterica enterica serovar Typhi
cuacgcaaaaaaagcca

SEQ ID NO: 1689842 - RNA, 19 nt, Salmonella enterica enterica serovar Typhi
cuacgcgauaaaaaacgcc

SEQ ID NO: 1689843 - RNA, 17 nt, Salmonella enterica enterica serovar Typhi
cuaccuucacccccauc

SEQ ID NO: 1689844 - RNA, 18 nt, Salmonella enterica enterica serovar Typhi
cuaccugcagggugaaga

SEQ ID NO: 1689845 - RNA, 16 nt, Salmonella enterica enterica serovar Typhi
cuaccgggcagcaucu

SEQ ID NO: 1689846 - RNA, 22 nt, Salmonella enterica enterica serovar Typhi
cuaccgucgacgucuuucuuaa

SEQ ID NO: 1689847 - RNA, 17 nt, Salmonella enterica enterica serovar Typhi
cuaccguucacggcgau

SEQ ID NO: 1689848 - RNA, 14 nt, Salmonella enterica enterica serovar Typhi
cuaccggaaaacag

SEQ ID NO: 1689849 - RNA, 17 nt, Salmonella enterica enterica serovar Typhi
cuaccgcuucgcgcgcc

SEQ ID NO: 1689850 - RNA, 18 nt, Salmonella enterica enterica serovar Typhi
cuacguuugaacagcagu

SEQ ID NO: 1689851 - RNA, 16 nt, Salmonella enterica enterica serovar Typhi
cuacuacacacuuacc

SEQ ID NO: 1689852 - RNA, 22 nt, Salmonella enterica enterica serovar Typhi
cuacgugauagaucacuuguuu

SEQ ID NO: 1689853 - RNA, 14 nt, Salmonella enterica enterica serovar Typhi
cuacguuuaucugg

SEQ ID NO: 1689854 - RNA, 18 nt, Salmonella enterica enterica serovar Typhi
cuauccguccucuuuccc

SEQ ID NO: 1689855 - RNA, 12 nt, Salmonella enterica enterica serovar Typhi
cuauccuggccu

SEQ ID NO: 1689856 - RNA, 17 nt, Salmonella enterica enterica serovar Typhi
cuaucgaccagcaccug

SEQ ID NO: 1689857 - RNA, 21 nt, Salmonella enterica enterica serovar Typhi
cuaugcuuauccggccugcac

SEQ ID NO: 1689858 - RNA, 19 nt, Salmonella enterica enterica serovar Typhi
cuauggucugaaagaguuc

SEQ ID NO: 1689859 - RNA, 12 nt, Salmonella enterica enterica serovar Typhi
cuaugacaaguc

SEQ ID NO: 1689860 - RNA, 23 nt, Salmonella enterica enterica serovar Typhi
cuaucuguauaucuuucuuaucc

SEQ ID NO: 1689861 - RNA, 16 nt, Salmonella enterica enterica serovar Typhi
cuauaauugcuuuuuu

SEQ ID NO: 1689862 - RNA, 23 nt, Salmonella enterica enterica serovar Typhi
cuauaauugcuuuuuuccacaga

SEQ ID NO: 1689863 - RNA, 18 nt, Salmonella enterica enterica serovar Typhi
cuauaauaccuccugucu

SEQ ID NO: 1689864 - RNA, 12 nt, Salmonella enterica enterica serovar Typhi
cuauaauaacaa

SEQ ID NO: 1689865 - RNA, 18 nt, Salmonella enterica enterica serovar Typhi
cuauaguggcauuuaccu

SEQ ID NO: 1689866 - RNA, 17 nt, Salmonella enterica enterica serovar Typhi
cuauacccaaaauaauu

SEQ ID NO: 1689867 - RNA, 23 nt, Salmonella enterica enterica serovar Typhi
cuauaaaauugccgauauggaug

SEQ ID NO: 1689868 - RNA, 18 nt, Salmonella enterica enterica serovar Typhi
cuauaaaguucccaugcu

SEQ ID NO: 1689869 - RNA, 21 nt, Salmonella enterica enterica serovar Typhi
cuaggccagugccaagcaaca

SEQ ID NO: 1689870 - RNA, 19 nt, Salmonella enterica enterica serovar Typhi
cugauagcccauccagcac

SEQ ID NO: 1689871 - RNA, 13 nt, Salmonella enterica enterica serovar Typhi
cugauagcgggua

SEQ ID NO: 1689872 - RNA, 20 nt, Salmonella enterica enterica serovar Typhi
cugauagggacacauuucuu

SEQ ID NO: 1689873 - RNA, 14 nt, Salmonella enterica enterica serovar Typhi
cugauacugcuccg

SEQ ID NO: 1689874 - RNA, 20 nt, Salmonella enterica enterica serovar Typhi
cugauaccgcguuugcgcaa

SEQ ID NO: 1689875 - RNA, 18 nt, Salmonella enterica enterica serovar Typhi
cugauaaccuauuuugca

SEQ ID NO: 1689876 - RNA, 20 nt, Salmonella enterica enterica serovar Typhi
cugauaaagcuuucaucuuu

SEQ ID NO: 1689877 - RNA, 11 nt, Salmonella enterica enterica serovar Typhi
cugauaaaauu

SEQ ID NO: 1689878 - RNA, 13 nt, Salmonella enterica enterica serovar Typhi
cugauaaaagccc

SEQ ID NO: 1689879 - RNA, 18 nt, Salmonella enterica enterica serovar Typhi
cugauaaaacgcaggcag

SEQ ID NO: 1689880 - RNA, 19 nt, Salmonella enterica enterica serovar Typhi
cugauaagguaaagccgcc

SEQ ID NO: 1689881 - RNA, 20 nt, Salmonella enterica enterica serovar Typhi
cugauaagacugauauccau

SEQ ID NO: 1689882 - RNA, 18 nt, Salmonella enterica enterica serovar Typhi
cugauaagcgcagcgcca

SEQ ID NO: 1689883 - RNA, 18 nt, Salmonella enterica enterica serovar Typhi
cugauaacgauaagugaa

SEQ ID NO: 1689884 - RNA, 17 nt, Salmonella enterica enterica serovar Typhi
cugaucccacuuaggca

SEQ ID NO: 1689885 - RNA, 17 nt, Salmonella enterica enterica serovar Typhi
cugauccagcucuucuu

SEQ ID NO: 1689886 - RNA, 22 nt, Salmonella enterica enterica serovar Typhi
cugaucgccacgccuaaacuga

SEQ ID NO: 1689887 - RNA, 18 nt, Salmonella enterica enterica serovar Typhi
cugaucaucggcgcgucg

SEQ ID NO: 1689888 - RNA, 21 nt, Salmonella enterica enterica serovar Typhi
cugauauucccguuccagcuu

SEQ ID NO: 1689889 - RNA, 21 nt, Salmonella enterica enterica serovar Typhi
cugauauugcguaagcagcug

SEQ ID NO: 1689890 - RNA, 16 nt, Salmonella enterica enterica serovar Typhi
cugauauuuuuacuga

SEQ ID NO: 1689891 - RNA, 14 nt, Salmonella enterica enterica serovar Typhi
cugauaguuuaaau

SEQ ID NO: 1689892 - RNA, 15 nt, Salmonella enterica enterica serovar Typhi
cucuaucggcaaacc

SEQ ID NO: 1689893 - RNA, 14 nt, Salmonella enterica enterica serovar Typhi
cugagcuaacgacc

SEQ ID NO: 1689894 - RNA, 18 nt, Salmonella enterica enterica serovar Typhi
cugagcuaaucacccacu

SEQ ID NO: 1689895 - RNA, 22 nt, Salmonella enterica enterica serovar Typhi
cucuauguucaguaggacaaaa

SEQ ID NO: 1689896 - RNA, 17 nt, Salmonella enterica enterica serovar Typhi
cugaggcguugcuccag

SEQ ID NO: 1689897 - RNA, 20 nt, Salmonella enterica enterica serovar Typhi
cugaggaguauuauccauug

SEQ ID NO: 1689898 - RNA, 13 nt, Salmonella enterica enterica serovar Typhi
cugagucuugccu

SEQ ID NO: 1689899 - RNA, 14 nt, Salmonella enterica enterica serovar Typhi
cugaguggucugga

SEQ ID NO: 1689900 - RNA, 23 nt, Salmonella enterica enterica serovar Typhi
cugaguuucucccgccagaugca

SEQ ID NO: 1689901 - RNA, 20 nt, Salmonella enterica enterica serovar Typhi
cugaguuaaugccaucauca

SEQ ID NO: 1689902 - RNA, 18 nt, Salmonella enterica enterica serovar Typhi
cugaggcuauugucauug

SEQ ID NO: 1689903 - RNA, 14 nt, Salmonella enterica enterica serovar Typhi
cugaggcgcuggcu

SEQ ID NO: 1689904 - RNA, 23 nt, Salmonella enterica enterica serovar Typhi
cugcagacccacuuucagcuccg

SEQ ID NO: 1689905 - RNA, 20 nt, Salmonella enterica enterica serovar Typhi
cugcagaccuauauggcgca

SEQ ID NO: 1689906 - RNA, 22 nt, Salmonella enterica enterica serovar Typhi
cugcagauuuugcucccuggug

SEQ ID NO: 1689907 - RNA, 23 nt, Salmonella enterica enterica serovar Typhi
cugcaggcgggugcgcagcccca

SEQ ID NO: 1689908 - RNA, 15 nt, Salmonella enterica enterica serovar Typhi
cugcacuaaaccaga

SEQ ID NO: 1689909 - RNA, 17 nt, Salmonella enterica enterica serovar Typhi
cugcacuuccagccacg

SEQ ID NO: 1689910 - RNA, 14 nt, Salmonella enterica enterica serovar Typhi
cugcacucggaugu

SEQ ID NO: 1689911 - RNA, 21 nt, Salmonella enterica enterica serovar Typhi
cugcagaaucccgauaaucaa

SEQ ID NO: 1689912 - RNA, 18 nt, Salmonella enterica enterica serovar Typhi
cugcaaucguucuugcac

SEQ ID NO: 1689913 - RNA, 17 nt, Salmonella enterica enterica serovar Typhi
cugcaauagcagaucgc

SEQ ID NO: 1689914 - RNA, 20 nt, Salmonella enterica enterica serovar Typhi
cugcacaacauuccgcuucc

SEQ ID NO: 1689915 - RNA, 13 nt, Salmonella enterica enterica serovar Typhi
cugcaauucauag

SEQ ID NO: 1689916 - RNA, 22 nt, Salmonella enterica enterica serovar Typhi
cugcaaugguaaaacgcuggcc

SEQ ID NO: 1689917 - RNA, 19 nt, Salmonella enterica enterica serovar Typhi
cugauuucgccccacuggc

SEQ ID NO: 1689918 - RNA, 13 nt, Salmonella enterica enterica serovar Typhi
cugauuugccaaa

SEQ ID NO: 1689919 - RNA, 17 nt, Salmonella enterica enterica serovar Typhi
cugcaacgccugcggau

SEQ ID NO: 1689920 - RNA, 13 nt, Salmonella enterica enterica serovar Typhi
cugauugucagca

SEQ ID NO: 1689921 - RNA, 14 nt, Salmonella enterica enterica serovar Typhi
cugauugucagcag

SEQ ID NO: 1689922 - RNA, 22 nt, Salmonella enterica enterica serovar Typhi
cugauuacguugauuaucaccc

SEQ ID NO: 1689923 - RNA, 21 nt, Salmonella enterica enterica serovar Typhi
cugauuaaugauuugcuuuau

SEQ ID NO: 1689924 - RNA, 22 nt, Salmonella enterica enterica serovar Typhi
cugaucuggcugcguaaaauca

SEQ ID NO: 1689925 - RNA, 20 nt, Salmonella enterica enterica serovar Typhi
cugaucgugauaggccagac

SEQ ID NO: 1689926 - RNA, 22 nt, Salmonella enterica enterica serovar Typhi
cugccgacgcccucaauaucuu

SEQ ID NO: 1689927 - RNA, 14 nt, Salmonella enterica enterica serovar Typhi
cugccgacaggcag

SEQ ID NO: 1689928 - RNA, 17 nt, Salmonella enterica enterica serovar Typhi
cugccgacaacgccucc

SEQ ID NO: 1689929 - RNA, 19 nt, Salmonella enterica enterica serovar Typhi
cugccgacaaagagcuccc

SEQ ID NO: 1689930 - RNA, 13 nt, Salmonella enterica enterica serovar Typhi
cugccgucaucga

SEQ ID NO: 1689931 - RNA, 21 nt, Salmonella enterica enterica serovar Typhi
cugccgucaaugccuggcaga

SEQ ID NO: 1689932 - RNA, 15 nt, Salmonella enterica enterica serovar Typhi
cugccgucaauuuua

SEQ ID NO: 1689933 - RNA, 13 nt, Salmonella enterica enterica serovar Typhi
cugccuacugccc

SEQ ID NO: 1689934 - RNA, 13 nt, Salmonella enterica enterica serovar Typhi
cugccuaaagaaa

SEQ ID NO: 1689935 - RNA, 14 nt, Salmonella enterica enterica serovar Typhi
cugccggucggcgu

SEQ ID NO: 1689936 - RNA, 14 nt, Salmonella enterica enterica serovar Typhi
cugccggugguggu

SEQ ID NO: 1689937 - RNA, 21 nt, Salmonella enterica enterica serovar Typhi
cugccguaaacaggcaggccc

SEQ ID NO: 1689938 - RNA, 13 nt, Salmonella enterica enterica serovar Typhi
cugccgguucggc

SEQ ID NO: 1689939 - RNA, 12 nt, Salmonella enterica enterica serovar Typhi
cugccguaaaca

SEQ ID NO: 1689940 - RNA, 20 nt, Salmonella enterica enterica serovar Typhi
cugccacgcuuuuccuucca

SEQ ID NO: 1689941 - RNA, 16 nt, Salmonella enterica enterica serovar Typhi
cugccaccgucgcggc

SEQ ID NO: 1689942 - RNA, 16 nt, Salmonella enterica enterica serovar Typhi
cugccaccagcguacc

SEQ ID NO: 1689943 - RNA, 18 nt, Salmonella enterica enterica serovar Typhi
cugccaguagauggcgcu

SEQ ID NO: 1689944 - RNA, 24 nt, Salmonella enterica enterica serovar Typhi
cugccaguagcggaauaucuuccc

SEQ ID NO: 1689945 - RNA, 16 nt, Salmonella enterica enterica serovar Typhi
cugccagucugcccgg

SEQ ID NO: 1689946 - RNA, 18 nt, Salmonella enterica enterica serovar Typhi
cugccaguccgcccgccu

SEQ ID NO: 1689947 - RNA, 19 nt, Salmonella enterica enterica serovar Typhi
cugccagggugcaaagaaa

SEQ ID NO: 1689948 - RNA, 22 nt, Salmonella enterica enterica serovar Typhi
cugccagguuauuucgcgcagu

SEQ ID NO: 1689949 - RNA, 22 nt, Salmonella enterica enterica serovar Typhi
cugccagcuuaaaucgcggcgc

SEQ ID NO: 1689950 - RNA, 19 nt, Salmonella enterica enterica serovar Typhi
cugccaugccuuugacucu

SEQ ID NO: 1689951 - RNA, 18 nt, Salmonella enterica enterica serovar Typhi
cugccauagcaucaccag

SEQ ID NO: 1689952 - RNA, 13 nt, Salmonella enterica enterica serovar Typhi
cugccaucaucca

SEQ ID NO: 1689953 - RNA, 15 nt, Salmonella enterica enterica serovar Typhi
cugccaugccugaug

SEQ ID NO: 1689954 - RNA, 20 nt, Salmonella enterica enterica serovar Typhi
cugccaucgcuucuacagcc

SEQ ID NO: 1689955 - RNA, 16 nt, Salmonella enterica enterica serovar Typhi
cugcccggcaaccuga

SEQ ID NO: 1689956 - RNA, 20 nt, Salmonella enterica enterica serovar Typhi
cugcccauguuuaccaucgc

SEQ ID NO: 1689957 - RNA, 18 nt, Salmonella enterica enterica serovar Typhi
cugccccagacgcccuuc

SEQ ID NO: 1689958 - RNA, 22 nt, Salmonella enterica enterica serovar Typhi
cugcgcgucccucuccagggca

SEQ ID NO: 1689959 - RNA, 13 nt, Salmonella enterica enterica serovar Typhi
cugcgcgccgcag

SEQ ID NO: 1689960 - RNA, 22 nt, Salmonella enterica enterica serovar Typhi
cugcgcgccgcccugcaucaug

SEQ ID NO: 1689961 - RNA, 17 nt, Salmonella enterica enterica serovar Typhi
cugcgcgccaaaccguu

SEQ ID NO: 1689962 - RNA, 16 nt, Salmonella enterica enterica serovar Typhi
cugcgcccgccugcug

SEQ ID NO: 1689963 - RNA, 18 nt, Salmonella enterica enterica serovar Typhi
cugccuguagcagcgcca

SEQ ID NO: 1689964 - RNA, 22 nt, Salmonella enterica enterica serovar Typhi
cugccuguuuacggcaggcccg

SEQ ID NO: 1689965 - RNA, 12 nt, Salmonella enterica enterica serovar Typhi
cugccugcagac

SEQ ID NO: 1689966 - RNA, 14 nt, Salmonella enterica enterica serovar Typhi
cugcgccaaaucgg

SEQ ID NO: 1689967 - RNA, 18 nt, Salmonella enterica enterica serovar Typhi
cugcgcauccgcggcgcu

SEQ ID NO: 1689968 - RNA, 15 nt, Salmonella enterica enterica serovar Typhi
cugcgcauccucuuu

SEQ ID NO: 1689969 - RNA, 16 nt, Salmonella enterica enterica serovar Typhi
cugcgcauccucuuuc

SEQ ID NO: 1689970 - RNA, 23 nt, Salmonella enterica enterica serovar Typhi
cugcgcaggucgccagaagccgu

SEQ ID NO: 1689971 - RNA, 11 nt, Salmonella enterica enterica serovar Typhi
cugcgcuuugu

SEQ ID NO: 1689972 - RNA, 14 nt, Salmonella enterica enterica serovar Typhi
cugcgcguucugcu

SEQ ID NO: 1689973 - RNA, 11 nt, Salmonella enterica enterica serovar Typhi
cugcgcuuuga

SEQ ID NO: 1689974 - RNA, 14 nt, Salmonella enterica enterica serovar Typhi
cugcgcuucggcca

SEQ ID NO: 1689975 - RNA, 15 nt, Salmonella enterica enterica serovar Typhi
cugcgguauauuccc

SEQ ID NO: 1689976 - RNA, 20 nt, Salmonella enterica enterica serovar Typhi
cugcguugcuauggcaacaa

SEQ ID NO: 1689977 - RNA, 15 nt, Salmonella enterica enterica serovar Typhi
cugcguugcgcgcgu

SEQ ID NO: 1689978 - RNA, 22 nt, Salmonella enterica enterica serovar Typhi
cugcguggucguaaaacugcac

SEQ ID NO: 1689979 - RNA, 20 nt, Salmonella enterica enterica serovar Typhi
cugcuaaaacagcucacccc

SEQ ID NO: 1689980 - RNA, 20 nt, Salmonella enterica enterica serovar Typhi
cugcuaaacgagccgucauc

SEQ ID NO: 1689981 - RNA, 21 nt, Salmonella enterica enterica serovar Typhi
cugcguaaaccauuucuccug

SEQ ID NO: 1689982 - RNA, 23 nt, Salmonella enterica enterica serovar Typhi
cugcguaaaccauuucuccugca

SEQ ID NO: 1689983 - RNA, 18 nt, Salmonella enterica enterica serovar Typhi
cugcgugaugcaucagaa

SEQ ID NO: 1689984 - RNA, 17 nt, Salmonella enterica enterica serovar Typhi
cugcguaggggcgaccg

SEQ ID NO: 1689985 - RNA, 15 nt, Salmonella enterica enterica serovar Typhi
cugguaggccugaua

SEQ ID NO: 1689986 - RNA, 23 nt, Salmonella enterica enterica serovar Typhi
cugguaggucaacccuauugcca

SEQ ID NO: 1689987 - RNA, 14 nt, Salmonella enterica enterica serovar Typhi
cugguacguccauc

SEQ ID NO: 1689988 - RNA, 18 nt, Salmonella enterica enterica serovar Typhi
cugguagagaucgacaaa

SEQ ID NO: 1689989 - RNA, 17 nt, Salmonella enterica enterica serovar Typhi
cuggucaaguauuucug

SEQ ID NO: 1689990 - RNA, 18 nt, Salmonella enterica enterica serovar Typhi
cuggucauaacgcuuugu

SEQ ID NO: 1689991 - RNA, 17 nt, Salmonella enterica enterica serovar Typhi
cuggucugaaucugcuc

SEQ ID NO: 1689992 - RNA, 22 nt, Salmonella enterica enterica serovar Typhi
cuggucguaagaauuauuacca

SEQ ID NO: 1689993 - RNA, 15 nt, Salmonella enterica enterica serovar Typhi
cuggucgggcaggcu

SEQ ID NO: 1689994 - RNA, 22 nt, Salmonella enterica enterica serovar Typhi
cuggucgcgguuuacuucuuca

SEQ ID NO: 1689995 - RNA, 15 nt, Salmonella enterica enterica serovar Typhi
cuggucgccagcgcc

SEQ ID NO: 1689996 - RNA, 23 nt, Salmonella enterica enterica serovar Typhi
cuggugcagcaagcggcugucau

SEQ ID NO: 1689997 - RNA, 19 nt, Salmonella enterica enterica serovar Typhi
cuggugcccgcaaaaccuu

SEQ ID NO: 1689998 - RNA, 18 nt, Salmonella enterica enterica serovar Typhi
cuggugcagcaagcggcu

SEQ ID NO: 1689999 - RNA, 14 nt, Salmonella enterica enterica serovar Typhi
cuggugaucuggcc

SEQ ID NO: 1690000 - RNA, 18 nt, Salmonella enterica enterica serovar Typhi
cuggugaagacgcugcaa

SEQ ID NO: 1690001 - RNA, 21 nt, Salmonella enterica enterica serovar Typhi
cuggugaaacguguuuauccc

SEQ ID NO: 1690002 - RNA, 17 nt, Salmonella enterica enterica serovar Typhi
cuggugacgaugauaac

SEQ ID NO: 1690003 - RNA, 15 nt, Salmonella enterica enterica serovar Typhi
cuggugauaaagcag

SEQ ID NO: 1690004 - RNA, 23 nt, Salmonella enterica enterica serovar Typhi
cuggcguagucucccuccugcuc

SEQ ID NO: 1690005 - RNA, 23 nt, Salmonella enterica enterica serovar Typhi
cuggcgucccuuucccuuccagc

SEQ ID NO: 1690006 - RNA, 21 nt, Salmonella enterica enterica serovar Typhi
cuggcguaugcuuucagcaug

SEQ ID NO: 1690007 - RNA, 14 nt, Salmonella enterica enterica serovar Typhi
cuggcgucgccaaa

SEQ ID NO: 1690008 - RNA, 18 nt, Salmonella enterica enterica serovar Typhi
cuggcgucgccaaagcag

SEQ ID NO: 1690009 - RNA, 12 nt, Salmonella enterica enterica serovar Typhi
cugggccugcuc

SEQ ID NO: 1690010 - RNA, 16 nt, Salmonella enterica enterica serovar Typhi
cugguaaggcaaauau

SEQ ID NO: 1690011 - RNA, 20 nt, Salmonella enterica enterica serovar Typhi
cugguaaguguuagcucuua

SEQ ID NO: 1690012 - RNA, 22 nt, Salmonella enterica enterica serovar Typhi
cuggguuagcuguauccacccg

SEQ ID NO: 1690013 - RNA, 13 nt, Salmonella enterica enterica serovar Typhi
cugguaagagagc

SEQ ID NO: 1690014 - RNA, 18 nt, Salmonella enterica enterica serovar Typhi
cugggucugcugggcgau

SEQ ID NO: 1690015 - RNA, 13 nt, Salmonella enterica enterica serovar Typhi
cuguaauuuauaa

SEQ ID NO: 1690016 - RNA, 16 nt, Salmonella enterica enterica serovar Typhi
cuguaauuucgcuggc

SEQ ID NO: 1690017 - RNA, 22 nt, Salmonella enterica enterica serovar Typhi
cuguaccaccagaaucgccagc

SEQ ID NO: 1690018 - RNA, 12 nt, Salmonella enterica enterica serovar Typhi
cuguaccaccag

SEQ ID NO: 1690019 - RNA, 13 nt, Salmonella enterica enterica serovar Typhi
cuguaccaccaga

SEQ ID NO: 1690020 - RNA, 17 nt, Salmonella enterica enterica serovar Typhi
cuguaguuagagauaua

SEQ ID NO: 1690021 - RNA, 23 nt, Salmonella enterica enterica serovar Typhi
cuguauaaauaaccgguaacugu

SEQ ID NO: 1690022 - RNA, 20 nt, Salmonella enterica enterica serovar Typhi
cuguagguucgguaugccuu

SEQ ID NO: 1690023 - RNA, 15 nt, Salmonella enterica enterica serovar Typhi
cuguacgccacggcu

SEQ ID NO: 1690024 - RNA, 21 nt, Salmonella enterica enterica serovar Typhi
cuguacgccacggcuuaaauc

SEQ ID NO: 1690025 - RNA, 14 nt, Salmonella enterica enterica serovar Typhi
cuguacgcccagcc

SEQ ID NO: 1690026 - RNA, 16 nt, Salmonella enterica enterica serovar Typhi
cuguacgcccagccgu

SEQ ID NO: 1690027 - RNA, 18 nt, Salmonella enterica enterica serovar Typhi
cuguaauuauaaauauua

SEQ ID NO: 1690028 - RNA, 20 nt, Salmonella enterica enterica serovar Typhi
cuguaauuauaaauauuaau

SEQ ID NO: 1690029 - RNA, 23 nt, Salmonella enterica enterica serovar Typhi
cuguaauucucccaaauuuuuuu

SEQ ID NO: 1690030 - RNA, 20 nt, Salmonella enterica enterica serovar Typhi
cuguaaacguuccugccagc

SEQ ID NO: 1690031 - RNA, 14 nt, Salmonella enterica enterica serovar Typhi
cuguaaaucugccg

SEQ ID NO: 1690032 - RNA, 15 nt, Salmonella enterica enterica serovar Typhi
cuguaacacacuggu

SEQ ID NO: 1690033 - RNA, 18 nt, Salmonella enterica enterica serovar Typhi
cuguaacaacuguuuuuc

SEQ ID NO: 1690034 - RNA, 12 nt, Salmonella enterica enterica serovar Typhi
cuggugcccggu

SEQ ID NO: 1690035 - RNA, 15 nt, Salmonella enterica enterica serovar Typhi
cuggugcgaauaagc

SEQ ID NO: 1690036 - RNA, 19 nt, Salmonella enterica enterica serovar Typhi
cuggugcgacaccacgcag

SEQ ID NO: 1690037 - RNA, 22 nt, Salmonella enterica enterica serovar Typhi
cuggugcgacaccacgcaggcg

SEQ ID NO: 1690038 - RNA, 18 nt, Salmonella enterica enterica serovar Typhi
cugguuuugcguaaucca

SEQ ID NO: 1690039 - RNA, 15 nt, Salmonella enterica enterica serovar Typhi
cugguuuuuccauuc

SEQ ID NO: 1690040 - RNA, 18 nt, Salmonella enterica enterica serovar Typhi
cugguuuuagcuuauccc

SEQ ID NO: 1690041 - RNA, 14 nt, Salmonella enterica enterica serovar Typhi
cuguaaaccgccuc

SEQ ID NO: 1690042 - RNA, 20 nt, Salmonella enterica enterica serovar Typhi
cuguaaaccgccuccaggcc

SEQ ID NO: 1690043 - RNA, 18 nt, Salmonella enterica enterica serovar Typhi
cuguauacauacauacca

SEQ ID NO: 1690044 - RNA, 16 nt, Salmonella enterica enterica serovar Typhi
cuguauacacuuucca

SEQ ID NO: 1690045 - RNA, 17 nt, Salmonella enterica enterica serovar Typhi
cuguauucgguggaaac

SEQ ID NO: 1690046 - RNA, 17 nt, Salmonella enterica enterica serovar Typhi
cuguauuuucguuugca

SEQ ID NO: 1690047 - RNA, 18 nt, Salmonella enterica enterica serovar Typhi
cugucaaaacccagccca

SEQ ID NO: 1690048 - RNA, 14 nt, Salmonella enterica enterica serovar Typhi
cugucaccagcagc

SEQ ID NO: 1690049 - RNA, 14 nt, Salmonella enterica enterica serovar Typhi
cugucaaaaauaac

SEQ ID NO: 1690050 - RNA, 13 nt, Salmonella enterica enterica serovar Typhi
cugucagccgcac

SEQ ID NO: 1690051 - RNA, 20 nt, Salmonella enterica enterica serovar Typhi
cugucacuccggcugcacca

SEQ ID NO: 1690052 - RNA, 18 nt, Salmonella enterica enterica serovar Typhi
cugucauaggcgacaggc

SEQ ID NO: 1690053 - RNA, 15 nt, Salmonella enterica enterica serovar Typhi
cugucggucuuuuuc

SEQ ID NO: 1690054 - RNA, 16 nt, Salmonella enterica enterica serovar Typhi
cugucgucaccagcag

SEQ ID NO: 1690055 - RNA, 22 nt, Salmonella enterica enterica serovar Typhi
cugucggcgagguacugcauaa

SEQ ID NO: 1690056 - RNA, 21 nt, Salmonella enterica enterica serovar Typhi
cugucccuucgcccggcgcgc

SEQ ID NO: 1690057 - RNA, 16 nt, Salmonella enterica enterica serovar Typhi
cugucccugccagcgu

SEQ ID NO: 1690058 - RNA, 21 nt, Salmonella enterica enterica serovar Typhi
cugucgcaauuuaccuauuuc

SEQ ID NO: 1690059 - RNA, 17 nt, Salmonella enterica enterica serovar Typhi
cugucgcccgcaaccac

SEQ ID NO: 1690060 - RNA, 14 nt, Salmonella enterica enterica serovar Typhi
cugucgccgcccgu

SEQ ID NO: 1690061 - RNA, 13 nt, Salmonella enterica enterica serovar Typhi
cugucgccgcgca

SEQ ID NO: 1690062 - RNA, 18 nt, Salmonella enterica enterica serovar Typhi
cugucgccgucugcaaaa

SEQ ID NO: 1690063 - RNA, 16 nt, Salmonella enterica enterica serovar Typhi
cugcuugccugugccc

SEQ ID NO: 1690064 - RNA, 17 nt, Salmonella enterica enterica serovar Typhi
cuggaaaauuucaguga

SEQ ID NO: 1690065 - RNA, 20 nt, Salmonella enterica enterica serovar Typhi
cuggaaaauuucagugaaaa

SEQ ID NO: 1690066 - RNA, 15 nt, Salmonella enterica enterica serovar Typhi
cugcuuuuugauaca

SEQ ID NO: 1690067 - RNA, 21 nt, Salmonella enterica enterica serovar Typhi
cugcuaucaggauucgacggc

SEQ ID NO: 1690068 - RNA, 20 nt, Salmonella enterica enterica serovar Typhi
cugcuagaacauuucccgaa

SEQ ID NO: 1690069 - RNA, 14 nt, Salmonella enterica enterica serovar Typhi
cugcuauccccauu

SEQ ID NO: 1690070 - RNA, 23 nt, Salmonella enterica enterica serovar Typhi
cugcucaauacuuuccgggccgg

SEQ ID NO: 1690071 - RNA, 21 nt, Salmonella enterica enterica serovar Typhi
cugcucacgguuuagcucugu

SEQ ID NO: 1690072 - RNA, 21 nt, Salmonella enterica enterica serovar Typhi
cugcucauuuaugcgcugggc

SEQ ID NO: 1690073 - RNA, 22 nt, Salmonella enterica enterica serovar Typhi
cugcucauuuaugcgcugggca

SEQ ID NO: 1690074 - RNA, 15 nt, Salmonella enterica enterica serovar Typhi
cuggagaucagcaug

SEQ ID NO: 1690075 - RNA, 14 nt, Salmonella enterica enterica serovar Typhi
cuggagcaggaaau

SEQ ID NO: 1690076 - RNA, 13 nt, Salmonella enterica enterica serovar Typhi
cuggagccacauc

SEQ ID NO: 1690077 - RNA, 15 nt, Salmonella enterica enterica serovar Typhi
cuggaauuuuuccag

SEQ ID NO: 1690078 - RNA, 22 nt, Salmonella enterica enterica serovar Typhi
cuggaauuuuuccagcucagaa

SEQ ID NO: 1690079 - RNA, 16 nt, Salmonella enterica enterica serovar Typhi
cuggacauguccgacg

SEQ ID NO: 1690080 - RNA, 22 nt, Salmonella enterica enterica serovar Typhi
cuggacauguuccgccccgccu

SEQ ID NO: 1690081 - RNA, 14 nt, Salmonella enterica enterica serovar Typhi
cuggaagaacugga

SEQ ID NO: 1690082 - RNA, 22 nt, Salmonella enterica enterica serovar Typhi
cuggaaaucuuucuccugguuu

SEQ ID NO: 1690083 - RNA, 16 nt, Salmonella enterica enterica serovar Typhi
cuggaacaaaccgacu

SEQ ID NO: 1690084 - RNA, 14 nt, Salmonella enterica enterica serovar Typhi
cuggaagccuucaa

SEQ ID NO: 1690085 - RNA, 19 nt, Salmonella enterica enterica serovar Typhi
cuggaagccccucuuauug

SEQ ID NO: 1690086 - RNA, 22 nt, Salmonella enterica enterica serovar Typhi
cuggaagcgcccaggccgggcg

SEQ ID NO: 1690087 - RNA, 14 nt, Salmonella enterica enterica serovar Typhi
cuggcaaucaugcg

SEQ ID NO: 1690088 - RNA, 21 nt, Salmonella enterica enterica serovar Typhi
cuggcaagcgccagcauggcg

SEQ ID NO: 1690089 - RNA, 19 nt, Salmonella enterica enterica serovar Typhi
cuggcaauaaagcagggcg

SEQ ID NO: 1690090 - RNA, 16 nt, Salmonella enterica enterica serovar Typhi
cuggaggcggaagugc

SEQ ID NO: 1690091 - RNA, 21 nt, Salmonella enterica enterica serovar Typhi
cuggaguuuaaacacucucca

SEQ ID NO: 1690092 - RNA, 22 nt, Salmonella enterica enterica serovar Typhi
cuggaguuuaaacacucuccac

SEQ ID NO: 1690093 - RNA, 22 nt, Salmonella enterica enterica serovar Typhi
cuggccccgcauuuuaccucac

SEQ ID NO: 1690094 - RNA, 22 nt, Salmonella enterica enterica serovar Typhi
cuggccaauuuuucacaugcaa

SEQ ID NO: 1690095 - RNA, 23 nt, Salmonella enterica enterica serovar Typhi
cuggcaguucaucuucccgcaga

SEQ ID NO: 1690096 - RNA, 19 nt, Salmonella enterica enterica serovar Typhi
cuggcauaaccgcagcgcg

SEQ ID NO: 1690097 - RNA, 14 nt, Salmonella enterica enterica serovar Typhi
cuggcaguucaucu

SEQ ID NO: 1690098 - RNA, 15 nt, Salmonella enterica enterica serovar Typhi
cuggcgcuggguaac

SEQ ID NO: 1690099 - RNA, 15 nt, Salmonella enterica enterica serovar Typhi
cuggcgcuggcugcc

SEQ ID NO: 1690100 - RNA, 23 nt, Salmonella enterica enterica serovar Typhi
cuggcgcgcgcgccuaccgccau

SEQ ID NO: 1690101 - RNA, 17 nt, Salmonella enterica enterica serovar Typhi
cuggcgcggggaacacg

SEQ ID NO: 1690102 - RNA, 22 nt, Salmonella enterica enterica serovar Typhi
cuggcgcggggaacacggacag

SEQ ID NO: 1690103 - RNA, 17 nt, Salmonella enterica enterica serovar Typhi
cuggcgcggggaacaca

SEQ ID NO: 1690104 - RNA, 18 nt, Salmonella enterica enterica serovar Typhi
cuggcgcggggaacacag

SEQ ID NO: 1690105 - RNA, 19 nt, Salmonella enterica enterica serovar Typhi
cuggcgcggggaacacaga

SEQ ID NO: 1690106 - RNA, 20 nt, Salmonella enterica enterica serovar Typhi
cuggcggaauggcgggcgca

SEQ ID NO: 1690107 - RNA, 13 nt, Salmonella enterica enterica serovar Typhi
cuggcggccccuc

SEQ ID NO: 1690108 - RNA, 14 nt, Salmonella enterica enterica serovar Typhi
cuggcggcaaaaac

SEQ ID NO: 1690109 - RNA, 20 nt, Salmonella enterica enterica serovar Typhi
cuggccguuuucccggcaau

SEQ ID NO: 1690110 - RNA, 23 nt, Salmonella enterica enterica serovar Typhi
cuggccugauaagcgcagcgcca

SEQ ID NO: 1690111 - RNA, 16 nt, Salmonella enterica enterica serovar Typhi
cuggccucccaguucc

SEQ ID NO: 1690112 - RNA, 17 nt, Salmonella enterica enterica serovar Typhi
cuggccucccaguuccc

SEQ ID NO: 1690113 - RNA, 18 nt, Salmonella enterica enterica serovar Typhi
cuggcgagaaaguggugg

SEQ ID NO: 1690114 - RNA, 19 nt, Salmonella enterica enterica serovar Typhi
cuggcgauuuucauagcug

SEQ ID NO: 1690115 - RNA, 21 nt, Salmonella enterica enterica serovar Typhi
cuggcgaugugcccgagugac

SEQ ID NO: 1690116 - RNA, 16 nt, Salmonella enterica enterica serovar Typhi
cuucuggcgcaucaac

SEQ ID NO: 1690117 - RNA, 13 nt, Salmonella enterica enterica serovar Typhi
cuucuggcucaga

SEQ ID NO: 1690118 - RNA, 18 nt, Salmonella enterica enterica serovar Typhi
cuucugguagccagacau

SEQ ID NO: 1690119 - RNA, 14 nt, Salmonella enterica enterica serovar Typhi
cuucuucaggcuug

SEQ ID NO: 1690120 - RNA, 18 nt, Salmonella enterica enterica serovar Typhi
cuucuucaguuccgccag

SEQ ID NO: 1690121 - RNA, 21 nt, Salmonella enterica enterica serovar Typhi
cuucuucggcagcuuccagca

SEQ ID NO: 1690122 - RNA, 13 nt, Salmonella enterica enterica serovar Typhi
cuucuucccccug

SEQ ID NO: 1690123 - RNA, 14 nt, Salmonella enterica enterica serovar Typhi
cuucuuccagcccg

SEQ ID NO: 1690124 - RNA, 15 nt, Salmonella enterica enterica serovar Typhi
cuucugauggcuuug

SEQ ID NO: 1690125 - RNA, 19 nt, Salmonella enterica enterica serovar Typhi
cuucugauggcuuugcugu

SEQ ID NO: 1690126 - RNA, 23 nt, Salmonella enterica enterica serovar Typhi
cuucugcgucaugcuuuuuuucu

SEQ ID NO: 1690127 - RNA, 15 nt, Salmonella enterica enterica serovar Typhi
cuucgcgguuagaaa

SEQ ID NO: 1690128 - RNA, 18 nt, Salmonella enterica enterica serovar Typhi
cuucucgaaguucucaau

SEQ ID NO: 1690129 - RNA, 16 nt, Salmonella enterica enterica serovar Typhi
cuucuccucaacagac

SEQ ID NO: 1690130 - RNA, 17 nt, Salmonella enterica enterica serovar Typhi
cuucuccucaacagaca

SEQ ID NO: 1690131 - RNA, 13 nt, Salmonella enterica enterica serovar Typhi
cuucuccgccauc

SEQ ID NO: 1690132 - RNA, 13 nt, Salmonella enterica enterica serovar Typhi
cuucuccgccugc

SEQ ID NO: 1690133 - RNA, 19 nt, Salmonella enterica enterica serovar Typhi
cuucucgccuucggccuga

SEQ ID NO: 1690134 - RNA, 23 nt, Salmonella enterica enterica serovar Typhi
cuucuccuucaaucacaaaaugg

SEQ ID NO: 1690135 - RNA, 14 nt, Salmonella enterica enterica serovar Typhi
cuucucgcaagagc

SEQ ID NO: 1690136 - RNA, 19 nt, Salmonella enterica enterica serovar Typhi
cuugauaaugucaacuuaa

SEQ ID NO: 1690137 - RNA, 20 nt, Salmonella enterica enterica serovar Typhi
cuugauacgccaucuuucuu

SEQ ID NO: 1690138 - RNA, 11 nt, Salmonella enterica enterica serovar Typhi
cuugauaaaua

SEQ ID NO: 1690139 - RNA, 13 nt, Salmonella enterica enterica serovar Typhi
cuugaugugucua

SEQ ID NO: 1690140 - RNA, 18 nt, Salmonella enterica enterica serovar Typhi
cuugauggaaaacgcauc

SEQ ID NO: 1690141 - RNA, 20 nt, Salmonella enterica enterica serovar Typhi
cuugaugauacccccagaga

SEQ ID NO: 1690142 - RNA, 20 nt, Salmonella enterica enterica serovar Typhi
cuugauggcgaucagcgcca

SEQ ID NO: 1690143 - RNA, 14 nt, Salmonella enterica enterica serovar Typhi
cuucuuuauccuga

SEQ ID NO: 1690144 - RNA, 15 nt, Salmonella enterica enterica serovar Typhi
cuugccggcgcagcg

SEQ ID NO: 1690145 - RNA, 23 nt, Salmonella enterica enterica serovar Typhi
cuugccgucaacacgcagaccca

SEQ ID NO: 1690146 - RNA, 15 nt, Salmonella enterica enterica serovar Typhi
cuugcgccaucaucc

SEQ ID NO: 1690147 - RNA, 17 nt, Salmonella enterica enterica serovar Typhi
cuugccgugaaaacgaa

SEQ ID NO: 1690148 - RNA, 15 nt, Salmonella enterica enterica serovar Typhi
cuugccguuuuucuc

SEQ ID NO: 1690149 - RNA, 18 nt, Salmonella enterica enterica serovar Typhi
cuugccguuuuucucauc

SEQ ID NO: 1690150 - RNA, 19 nt, Salmonella enterica enterica serovar Typhi
cuugccguuuuucucauca

SEQ ID NO: 1690151 - RNA, 16 nt, Salmonella enterica enterica serovar Typhi
cuugcggugagaaacg

SEQ ID NO: 1690152 - RNA, 21 nt, Salmonella enterica enterica serovar Typhi
cuugcggaaagaagaauaagc

SEQ ID NO: 1690153 - RNA, 15 nt, Salmonella enterica enterica serovar Typhi
cuugcggcgccagga

SEQ ID NO: 1690154 - RNA, 21 nt, Salmonella enterica enterica serovar Typhi
cuuuaaagcgcugcguggcgg

SEQ ID NO: 1690155 - RNA, 16 nt, Salmonella enterica enterica serovar Typhi
cuuuaaaugccuguuu

SEQ ID NO: 1690156 - RNA, 16 nt, Salmonella enterica enterica serovar Typhi
cuuuaaccacagccuu

SEQ ID NO: 1690157 - RNA, 14 nt, Salmonella enterica enterica serovar Typhi
cuuuaaccacagcc

SEQ ID NO: 1690158 - RNA, 14 nt, Salmonella enterica enterica serovar Typhi
cuuuaaccgccugc

SEQ ID NO: 1690159 - RNA, 14 nt, Salmonella enterica enterica serovar Typhi
cuuguugcggauga

SEQ ID NO: 1690160 - RNA, 16 nt, Salmonella enterica enterica serovar Typhi
cuuguucgcaggucaa

SEQ ID NO: 1690161 - RNA, 19 nt, Salmonella enterica enterica serovar Typhi
cuuguuucaucgucagcuc

SEQ ID NO: 1690162 - RNA, 15 nt, Salmonella enterica enterica serovar Typhi
cuuguuguaaagaaa

SEQ ID NO: 1690163 - RNA, 16 nt, Salmonella enterica enterica serovar Typhi
cuuguuacucaauaaa

SEQ ID NO: 1690164 - RNA, 24 nt, Salmonella enterica enterica serovar Typhi
cuuguuauccuaaaucugccauca

SEQ ID NO: 1690165 - RNA, 22 nt, Salmonella enterica enterica serovar Typhi
cuuguguggagguuucuucauc

SEQ ID NO: 1690166 - RNA, 23 nt, Salmonella enterica enterica serovar Typhi
cuuguguggagguuucuucauca

SEQ ID NO: 1690167 - RNA, 22 nt, Salmonella enterica enterica serovar Typhi
cuugugauaucugacuuauucg

SEQ ID NO: 1690168 - RNA, 15 nt, Salmonella enterica enterica serovar Typhi
cuugugaugagcuca

SEQ ID NO: 1690169 - RNA, 13 nt, Salmonella enterica enterica serovar Typhi
cuugugacugaua

SEQ ID NO: 1690170 - RNA, 24 nt, Salmonella enterica enterica serovar Typhi
cuugugcuuccagcuccauccacc

SEQ ID NO: 1690171 - RNA, 15 nt, Salmonella enterica enterica serovar Typhi
cuugugcuuccagcu

SEQ ID NO: 1690172 - RNA, 16 nt, Salmonella enterica enterica serovar Typhi
cuugugcuuccagcuc

SEQ ID NO: 1690173 - RNA, 22 nt, Salmonella enterica enterica serovar Typhi
cuugugcuuccagcuccaucca

SEQ ID NO: 1690174 - RNA, 21 nt, Salmonella enterica enterica serovar Typhi
cuuggagagcaucaucugcca

SEQ ID NO: 1690175 - RNA, 23 nt, Salmonella enterica enterica serovar Typhi
cuuguaagggaggugcucuccca

SEQ ID NO: 1690176 - RNA, 14 nt, Salmonella enterica enterica serovar Typhi
cuuguaagggaggu

SEQ ID NO: 1690177 - RNA, 16 nt, Salmonella enterica enterica serovar Typhi
cuuguccgaugcagac

SEQ ID NO: 1690178 - RNA, 24 nt, Salmonella enterica enterica serovar Typhi
cuuucaccagugauuggcuggaca

SEQ ID NO: 1690179 - RNA, 14 nt, Salmonella enterica enterica serovar Typhi
cuuucacccauuga

SEQ ID NO: 1690180 - RNA, 21 nt, Salmonella enterica enterica serovar Typhi
cuuuauccagcggcgcgcggu

SEQ ID NO: 1690181 - RNA, 14 nt, Salmonella enterica enterica serovar Typhi
cuuuaugucaguaa

SEQ ID NO: 1690182 - RNA, 21 nt, Salmonella enterica enterica serovar Typhi
cuuuaugucaguaauauauua

SEQ ID NO: 1690183 - RNA, 13 nt, Salmonella enterica enterica serovar Typhi
cuuuauucauuuc

SEQ ID NO: 1690184 - RNA, 18 nt, Salmonella enterica enterica serovar Typhi
cuuuaaugauguccagaa

SEQ ID NO: 1690185 - RNA, 16 nt, Salmonella enterica enterica serovar Typhi
cuuuauauaaaaaaug

SEQ ID NO: 1690186 - RNA, 17 nt, Salmonella enterica enterica serovar Typhi
cuuuauauaaaaaaugg

SEQ ID NO: 1690187 - RNA, 20 nt, Salmonella enterica enterica serovar Typhi
cuuuaucaaacaaaccaaac

SEQ ID NO: 1690188 - RNA, 17 nt, Salmonella enterica enterica serovar Typhi
cuuuacccuuacggcca

SEQ ID NO: 1690189 - RNA, 15 nt, Salmonella enterica enterica serovar Typhi
cuuuacgcagcaaga

SEQ ID NO: 1690190 - RNA, 19 nt, Salmonella enterica enterica serovar Typhi
cuuucucggcuuuccagcu

SEQ ID NO: 1690191 - RNA, 23 nt, Salmonella enterica enterica serovar Typhi
cuuucggcaaagcacugcugcug

SEQ ID NO: 1690192 - RNA, 18 nt, Salmonella enterica enterica serovar Typhi
cuuucggaauauugguac

SEQ ID NO: 1690193 - RNA, 15 nt, Salmonella enterica enterica serovar Typhi
cuuucgccagcggcg

SEQ ID NO: 1690194 - RNA, 17 nt, Salmonella enterica enterica serovar Typhi
cuuucccguuucagccc

SEQ ID NO: 1690195 - RNA, 18 nt, Salmonella enterica enterica serovar Typhi
cuuucccuuuuuaaaaug

SEQ ID NO: 1690196 - RNA, 17 nt, Salmonella enterica enterica serovar Typhi
cuuuccgccaugaaaaa

SEQ ID NO: 1690197 - RNA, 19 nt, Salmonella enterica enterica serovar Typhi
cuuuccgccaugaaaaaaa

SEQ ID NO: 1690198 - RNA, 18 nt, Salmonella enterica enterica serovar Typhi
cuuuccccaaagguguua

SEQ ID NO: 1690199 - RNA, 21 nt, Salmonella enterica enterica serovar Typhi
cuuuccaguucuggcugcgcu

SEQ ID NO: 1690200 - RNA, 17 nt, Salmonella enterica enterica serovar Typhi
cuuucauuccuuuagcu

SEQ ID NO: 1690201 - RNA, 14 nt, Salmonella enterica enterica serovar Typhi
cuuucauuccuuua

SEQ ID NO: 1690202 - RNA, 14 nt, Salmonella enterica enterica serovar Typhi
cuuccaguugcguc

SEQ ID NO: 1690203 - RNA, 16 nt, Salmonella enterica enterica serovar Typhi
cuuccaguuuugccag

SEQ ID NO: 1690204 - RNA, 16 nt, Salmonella enterica enterica serovar Typhi
cuuccaguccagcgcg

SEQ ID NO: 1690205 - RNA, 24 nt, Salmonella enterica enterica serovar Typhi
cuucauuuauggguuccaguugca

SEQ ID NO: 1690206 - RNA, 21 nt, Salmonella enterica enterica serovar Typhi
cuuccgccaggcgggugguga

SEQ ID NO: 1690207 - RNA, 19 nt, Salmonella enterica enterica serovar Typhi
cuuccgccauacccggcuc

SEQ ID NO: 1690208 - RNA, 20 nt, Salmonella enterica enterica serovar Typhi
cuuccgcacgcgcgcccugc

SEQ ID NO: 1690209 - RNA, 18 nt, Salmonella enterica enterica serovar Typhi
cuuccgccacggcuuuca

SEQ ID NO: 1690210 - RNA, 17 nt, Salmonella enterica enterica serovar Typhi
cuuccgccaccacgccc

SEQ ID NO: 1690211 - RNA, 15 nt, Salmonella enterica enterica serovar Typhi
cuuccauccauguga

SEQ ID NO: 1690212 - RNA, 16 nt, Salmonella enterica enterica serovar Typhi
cuucccagguuucaau

SEQ ID NO: 1690213 - RNA, 19 nt, Salmonella enterica enterica serovar Typhi
cuucccagguuucaaugcc

SEQ ID NO: 1690214 - RNA, 13 nt, Salmonella enterica enterica serovar Typhi
cuucgcaaccggu

SEQ ID NO: 1690215 - RNA, 19 nt, Salmonella enterica enterica serovar Typhi
cuuccugcacgccugcuuc

SEQ ID NO: 1690216 - RNA, 20 nt, Salmonella enterica enterica serovar Typhi
cuuccggcaucacaucgccg

SEQ ID NO: 1690217 - RNA, 20 nt, Salmonella enterica enterica serovar Typhi
cuuccggauaacgcgcuggc

SEQ ID NO: 1690218 - RNA, 18 nt, Salmonella enterica enterica serovar Typhi
cuuccggauuaaagacgc

SEQ ID NO: 1690219 - RNA, 15 nt, Salmonella enterica enterica serovar Typhi
cuucgcgggaccaaa

SEQ ID NO: 1690220 - RNA, 19 nt, Salmonella enterica enterica serovar Typhi
cuucgccguuaucggccug

SEQ ID NO: 1690221 - RNA, 20 nt, Salmonella enterica enterica serovar Typhi
cuucgccguuaucggccugc

SEQ ID NO: 1690222 - RNA, 21 nt, Salmonella enterica enterica serovar Typhi
cuucgccuucgcccauaucca

SEQ ID NO: 1690223 - RNA, 23 nt, Salmonella enterica enterica serovar Typhi
cuucgcccauugccacccauuua

SEQ ID NO: 1690224 - RNA, 19 nt, Salmonella enterica enterica serovar Typhi
cuucgccauuacaggacag

SEQ ID NO: 1690225 - RNA, 13 nt, Salmonella enterica enterica serovar Typhi
cuucgcacugccc

SEQ ID NO: 1690226 - RNA, 19 nt, Salmonella enterica enterica serovar Typhi
cuucgcagcgauauuucuc

SEQ ID NO: 1690227 - RNA, 23 nt, Salmonella enterica enterica serovar Typhi
cuucagcguccggaaaauccuca

SEQ ID NO: 1690228 - RNA, 16 nt, Salmonella enterica enterica serovar Typhi
cuucagcguugucccg

SEQ ID NO: 1690229 - RNA, 20 nt, Salmonella enterica enterica serovar Typhi
cuucaggcucaucagcgcca

SEQ ID NO: 1690230 - RNA, 14 nt, Salmonella enterica enterica serovar Typhi
cuucagguuaagug

SEQ ID NO: 1690231 - RNA, 22 nt, Salmonella enterica enterica serovar Typhi
cuucagguuuuuaagcugccca

SEQ ID NO: 1690232 - RNA, 17 nt, Salmonella enterica enterica serovar Typhi
cuucauccgcucccgcu

SEQ ID NO: 1690233 - RNA, 19 nt, Salmonella enterica enterica serovar Typhi
cuucaugugguaggcuuca

SEQ ID NO: 1690234 - RNA, 22 nt, Salmonella enterica enterica serovar Typhi
cuucaugugguaggcuucaacc

SEQ ID NO: 1690235 - RNA, 14 nt, Salmonella enterica enterica serovar Typhi
cuucaugcagcccg

SEQ ID NO: 1690236 - RNA, 20 nt, Salmonella enterica enterica serovar Typhi
cuucaugguaaaauccuuuu

SEQ ID NO: 1690237 - RNA, 19 nt, Salmonella enterica enterica serovar Typhi
cuucaucaguaacugacga

SEQ ID NO: 1690238 - RNA, 19 nt, Salmonella enterica enterica serovar Typhi
cuucaucaaagaaauaccc

SEQ ID NO: 1690239 - RNA, 23 nt, Salmonella enterica enterica serovar Typhi
cuucauauuaaauuccggcucgc

SEQ ID NO: 1690240 - RNA, 17 nt, Salmonella enterica enterica serovar Typhi
cuucauacuccgaaugu

SEQ ID NO: 1690241 - RNA, 17 nt, Salmonella enterica enterica serovar Typhi
cuucauaggugaacaug

SEQ ID NO: 1690242 - RNA, 12 nt, Salmonella enterica enterica serovar Typhi
cuucauaaauac

SEQ ID NO: 1690243 - RNA, 20 nt, Salmonella enterica enterica serovar Typhi
cuucauaaauagccagcauc

SEQ ID NO: 1690244 - RNA, 18 nt, Salmonella enterica enterica serovar Typhi
cuucagcauacaggucuu

SEQ ID NO: 1690245 - RNA, 13 nt, Salmonella enterica enterica serovar Typhi
cuucagcgcgccc

SEQ ID NO: 1690246 - RNA, 17 nt, Salmonella enterica enterica serovar Typhi
cuucagccagacguaaa

SEQ ID NO: 1690247 - RNA, 21 nt, Salmonella enterica enterica serovar Typhi
cuucacgccgugaauuucugc

SEQ ID NO: 1690248 - RNA, 16 nt, Salmonella enterica enterica serovar Typhi
cuucacggaaggggcc

SEQ ID NO: 1690249 - RNA, 15 nt, Salmonella enterica enterica serovar Typhi
cuucacuaaaaacag

SEQ ID NO: 1690250 - RNA, 18 nt, Salmonella enterica enterica serovar Typhi
cuucacguugacgcaaac

SEQ ID NO: 1690251 - RNA, 23 nt, Salmonella enterica enterica serovar Typhi
cuucacguugacgcaaacugcca

SEQ ID NO: 1690252 - RNA, 19 nt, Salmonella enterica enterica serovar Typhi
cuucacauuuuuaucagcu

SEQ ID NO: 1690253 - RNA, 23 nt, Salmonella enterica enterica serovar Typhi
cuucaauuugccggaacucagcu

SEQ ID NO: 1690254 - RNA, 16 nt, Salmonella enterica enterica serovar Typhi
cuuauuaaagccccuu

SEQ ID NO: 1690255 - RNA, 21 nt, Salmonella enterica enterica serovar Typhi
cuuauuagaggcguaaguaaa

SEQ ID NO: 1690256 - RNA, 15 nt, Salmonella enterica enterica serovar Typhi
cuuaucugcaauaaa

SEQ ID NO: 1690257 - RNA, 14 nt, Salmonella enterica enterica serovar Typhi
cuuaucugcugcug

SEQ ID NO: 1690258 - RNA, 17 nt, Salmonella enterica enterica serovar Typhi
cuuagcaacugccggcu

SEQ ID NO: 1690259 - RNA, 19 nt, Salmonella enterica enterica serovar Typhi
cuuagaucguaucggcugg

SEQ ID NO: 1690260 - RNA, 17 nt, Salmonella enterica enterica serovar Typhi
cuuagcagcauaaacau

SEQ ID NO: 1690261 - RNA, 17 nt, Salmonella enterica enterica serovar Typhi
cuuauacugauaaacua

SEQ ID NO: 1690262 - RNA, 21 nt, Salmonella enterica enterica serovar Typhi
cuuauccggccuacagaacug

SEQ ID NO: 1690263 - RNA, 19 nt, Salmonella enterica enterica serovar Typhi
cuuaucccacaacuguucu

SEQ ID NO: 1690264 - RNA, 14 nt, Salmonella enterica enterica serovar Typhi
cuuaucccauugcg

SEQ ID NO: 1690265 - RNA, 15 nt, Salmonella enterica enterica serovar Typhi
cuuaucgccaaagau

SEQ ID NO: 1690266 - RNA, 17 nt, Salmonella enterica enterica serovar Typhi
cuuaucgccaaagauau

SEQ ID NO: 1690267 - RNA, 15 nt, Salmonella enterica enterica serovar Typhi
cuuaucgccccagcc

SEQ ID NO: 1690268 - RNA, 20 nt, Salmonella enterica enterica serovar Typhi
cuuauccggccugcaggcaa

SEQ ID NO: 1690269 - RNA, 15 nt, Salmonella enterica enterica serovar Typhi
cuuauccggcugccg

SEQ ID NO: 1690270 - RNA, 20 nt, Salmonella enterica enterica serovar Typhi
cuuauauuuauuuauugucu

SEQ ID NO: 1690271 - RNA, 22 nt, Salmonella enterica enterica serovar Typhi
cuuaucaggccgacaaaugacg

SEQ ID NO: 1690272 - RNA, 19 nt, Salmonella enterica enterica serovar Typhi
cuuaucaggccuaccagcc

SEQ ID NO: 1690273 - RNA, 13 nt, Salmonella enterica enterica serovar Typhi
cuuaucaggccua

SEQ ID NO: 1690274 - RNA, 23 nt, Salmonella enterica enterica serovar Typhi
cuuaauaugcugccuacugcccu

SEQ ID NO: 1690275 - RNA, 20 nt, Salmonella enterica enterica serovar Typhi
cuuaaucaguucggcaucca

SEQ ID NO: 1690276 - RNA, 13 nt, Salmonella enterica enterica serovar Typhi
cuuaaauaugaaa

SEQ ID NO: 1690277 - RNA, 19 nt, Salmonella enterica enterica serovar Typhi
cuuaaauaugaaagagaaa

SEQ ID NO: 1690278 - RNA, 20 nt, Salmonella enterica enterica serovar Typhi
cuuacgaagaucgucgauca

SEQ ID NO: 1690279 - RNA, 16 nt, Salmonella enterica enterica serovar Typhi
cuuacgagaggcuuua

SEQ ID NO: 1690280 - RNA, 18 nt, Salmonella enterica enterica serovar Typhi
cuuacgaauuuuaucuuc

SEQ ID NO: 1690281 - RNA, 23 nt, Salmonella enterica enterica serovar Typhi
cuuacgcaguugggcgcgcgacu

SEQ ID NO: 1690282 - RNA, 19 nt, Salmonella enterica enterica serovar Typhi
cuuaccuuguucuuccauu

SEQ ID NO: 1690283 - RNA, 22 nt, Salmonella enterica enterica serovar Typhi
cuuacggacugcggccugcaaa

SEQ ID NO: 1690284 - RNA, 13 nt, Salmonella enterica enterica serovar Typhi
cuuacuaauaaau

SEQ ID NO: 1690285 - RNA, 18 nt, Salmonella enterica enterica serovar Typhi
cuuacguugcauuuauca

SEQ ID NO: 1690286 - RNA, 24 nt, Salmonella enterica enterica serovar Typhi
cuuacgguaaagcguaucgcccag

SEQ ID NO: 1690287 - RNA, 23 nt, Salmonella enterica enterica serovar Typhi
cuuaccggugcgauucagcgcag

SEQ ID NO: 1690288 - RNA, 13 nt, Salmonella enterica enterica serovar Typhi
cuuacaggcgcau

SEQ ID NO: 1690289 - RNA, 17 nt, Salmonella enterica enterica serovar Typhi
cuuacaggcuggaaaua

SEQ ID NO: 1690290 - RNA, 19 nt, Salmonella enterica enterica serovar Typhi
cuguuuacccacuucuucc

SEQ ID NO: 1690291 - RNA, 18 nt, Salmonella enterica enterica serovar Typhi
cuguugcgcauucaggcg

SEQ ID NO: 1690292 - RNA, 14 nt, Salmonella enterica enterica serovar Typhi
cuguugcugugcau

SEQ ID NO: 1690293 - RNA, 18 nt, Salmonella enterica enterica serovar Typhi
cuguugcgggccagcagc

SEQ ID NO: 1690294 - RNA, 21 nt, Salmonella enterica enterica serovar Typhi
cuguugaugauaaccgccgcc

SEQ ID NO: 1690295 - RNA, 20 nt, Salmonella enterica enterica serovar Typhi
cuguugauacaguaccuuua

SEQ ID NO: 1690296 - RNA, 19 nt, Salmonella enterica enterica serovar Typhi
cuguugaguucccuucucc

SEQ ID NO: 1690297 - RNA, 15 nt, Salmonella enterica enterica serovar Typhi
cuguucgcuuauucc

SEQ ID NO: 1690298 - RNA, 18 nt, Salmonella enterica enterica serovar Typhi
cugucugucgcgggcgaa

SEQ ID NO: 1690299 - RNA, 20 nt, Salmonella enterica enterica serovar Typhi
cugucucuuuagaaaaagaa

SEQ ID NO: 1690300 - RNA, 14 nt, Salmonella enterica enterica serovar Typhi
cugucuccagcgcc

SEQ ID NO: 1690301 - RNA, 23 nt, Salmonella enterica enterica serovar Typhi
cugucguuucauguaaaugacgc

SEQ ID NO: 1690302 - RNA, 11 nt, Salmonella enterica enterica serovar Typhi
cuguucugucc

SEQ ID NO: 1690303 - RNA, 16 nt, Salmonella enterica enterica serovar Typhi
cuguugaaagccccgg

SEQ ID NO: 1690304 - RNA, 22 nt, Salmonella enterica enterica serovar Typhi
cugucuuacacugauaccccag

SEQ ID NO: 1690305 - RNA, 23 nt, Salmonella enterica enterica serovar Typhi
cuguucuggauagucuucaagcc

SEQ ID NO: 1690306 - RNA, 12 nt, Salmonella enterica enterica serovar Typhi
cuguucuggcuc

SEQ ID NO: 1690307 - RNA, 20 nt, Salmonella enterica enterica serovar Typhi
cuguucuggcucggccuguc

SEQ ID NO: 1690308 - RNA, 18 nt, Salmonella enterica enterica serovar Typhi
cuguuuuauuuccucaga

SEQ ID NO: 1690309 - RNA, 12 nt, Salmonella enterica enterica serovar Typhi
cuguuuuccgcu

SEQ ID NO: 1690310 - RNA, 13 nt, Salmonella enterica enterica serovar Typhi
cuguuuuaauucc

SEQ ID NO: 1690311 - RNA, 15 nt, Salmonella enterica enterica serovar Typhi
cuguuugugguccaa

SEQ ID NO: 1690312 - RNA, 23 nt, Salmonella enterica enterica serovar Typhi
cuguuuauucuucgucagaugcg

SEQ ID NO: 1690313 - RNA, 16 nt, Salmonella enterica enterica serovar Typhi
cuguuucugcuggccu

SEQ ID NO: 1690314 - RNA, 19 nt, Salmonella enterica enterica serovar Typhi
cuguuuuuuguugauuuua

SEQ ID NO: 1690315 - RNA, 15 nt, Salmonella enterica enterica serovar Typhi
cuguuuuuugccaca

SEQ ID NO: 1690316 - RNA, 16 nt, Salmonella enterica enterica serovar Typhi
cuguuuuugcuuuaau

SEQ ID NO: 1690317 - RNA, 13 nt, Salmonella enterica enterica serovar Typhi
cuuaaaaaauccu

SEQ ID NO: 1690318 - RNA, 14 nt, Salmonella enterica enterica serovar Typhi
cuuaaaauugaauu

SEQ ID NO: 1690319 - RNA, 19 nt, Salmonella enterica enterica serovar Typhi
cuuaaaagggaguauuuac

SEQ ID NO: 1690320 - RNA, 21 nt, Salmonella enterica enterica serovar Typhi
cuuaaaagggaguauuuaccu

SEQ ID NO: 1690321 - RNA, 20 nt, Salmonella enterica enterica serovar Typhi
cuuaaacgccggauuccaga

SEQ ID NO: 1690322 - RNA, 21 nt, Salmonella enterica enterica serovar Typhi
cuuaaacgccggauuccagaa

SEQ ID NO: 1690323 - RNA, 16 nt, Salmonella enterica enterica serovar Typhi
cuuaaacaguauuuau

SEQ ID NO: 1690324 - RNA, 20 nt, Salmonella enterica enterica serovar Typhi
gaauagccagcccccugcca

SEQ ID NO: 1690325 - RNA, 17 nt, Salmonella enterica enterica serovar Typhi
gaauagcuuacuuucag

SEQ ID NO: 1690326 - RNA, 20 nt, Salmonella enterica enterica serovar Typhi
gaauagcggcuaaucaccac

SEQ ID NO: 1690327 - RNA, 17 nt, Salmonella enterica enterica serovar Typhi
gaauagaggcgcuggcg

SEQ ID NO: 1690328 - RNA, 22 nt, Salmonella enterica enterica serovar Typhi
gaauagacggccugcaaacgaa

SEQ ID NO: 1690329 - RNA, 15 nt, Salmonella enterica enterica serovar Typhi
gaauagacuggcgcc

SEQ ID NO: 1690330 - RNA, 19 nt, Salmonella enterica enterica serovar Typhi
gaauaguuacggacaugcg

SEQ ID NO: 1690331 - RNA, 13 nt, Salmonella enterica enterica serovar Typhi
gaauauaccauca

SEQ ID NO: 1690332 - RNA, 13 nt, Salmonella enterica enterica serovar Typhi
gaauauuuugcug

SEQ ID NO: 1690333 - RNA, 15 nt, Salmonella enterica enterica serovar Typhi
gaauauuaaaguuca

SEQ ID NO: 1690334 - RNA, 16 nt, Salmonella enterica enterica serovar Typhi
gaauaugauuuaaaaa

SEQ ID NO: 1690335 - RNA, 13 nt, Salmonella enterica enterica serovar Typhi
gaauaugcagugc

SEQ ID NO: 1690336 - RNA, 18 nt, Salmonella enterica enterica serovar Typhi
gaauauaguuagaaaaua

SEQ ID NO: 1690337 - RNA, 15 nt, Salmonella enterica enterica serovar Typhi
gaauauccgccgccc

SEQ ID NO: 1690338 - RNA, 17 nt, Salmonella enterica enterica serovar Typhi
gaauauccgguacacca

SEQ ID NO: 1690339 - RNA, 20 nt, Salmonella enterica enterica serovar Typhi
gaauauccgguacaccaacu

SEQ ID NO: 1690340 - RNA, 15 nt, Salmonella enterica enterica serovar Typhi
gaauaucuuuguccu

SEQ ID NO: 1690341 - RNA, 15 nt, Salmonella enterica enterica serovar Typhi
gaauaugauuuaaaa

SEQ ID NO: 1690342 - RNA, 16 nt, Salmonella enterica enterica serovar Typhi
gaauaauguaaaaaaa

SEQ ID NO: 1690343 - RNA, 17 nt, Salmonella enterica enterica serovar Typhi
gaauaauguaaaaaaau

SEQ ID NO: 1690344 - RNA, 23 nt, Salmonella enterica enterica serovar Typhi
gaauaccacuucggcagaaaaag

SEQ ID NO: 1690345 - RNA, 19 nt, Salmonella enterica enterica serovar Typhi
gaauacugggcgcaugagg

SEQ ID NO: 1690346 - RNA, 22 nt, Salmonella enterica enterica serovar Typhi
gaauacgcuccagcuggcuggc

SEQ ID NO: 1690347 - RNA, 13 nt, Salmonella enterica enterica serovar Typhi
gaauaccuucccg

SEQ ID NO: 1690348 - RNA, 23 nt, Salmonella enterica enterica serovar Typhi
gaauaacuccagugcagaaagug

SEQ ID NO: 1690349 - RNA, 13 nt, Salmonella enterica enterica serovar Typhi
gaauaaccucccg

SEQ ID NO: 1690350 - RNA, 17 nt, Salmonella enterica enterica serovar Typhi
gaauaacaucguaaauc

SEQ ID NO: 1690351 - RNA, 19 nt, Salmonella enterica enterica serovar Typhi
gaauaacaucguaaaucaa

SEQ ID NO: 1690352 - RNA, 12 nt, Salmonella enterica enterica serovar Typhi
gaauaacagcac

SEQ ID NO: 1690353 - RNA, 11 nt, Salmonella enterica enterica serovar Typhi
gaauaaauccu

SEQ ID NO: 1690354 - RNA, 15 nt, Salmonella enterica enterica serovar Typhi
gaauaaaggccggga

SEQ ID NO: 1690355 - RNA, 15 nt, Salmonella enterica enterica serovar Typhi
gaauaaucgccgccg

SEQ ID NO: 1690356 - RNA, 18 nt, Salmonella enterica enterica serovar Typhi
gaauaaucgccgggcggc

SEQ ID NO: 1690357 - RNA, 19 nt, Salmonella enterica enterica serovar Typhi
gaauaagggugagagggga

SEQ ID NO: 1690358 - RNA, 19 nt, Salmonella enterica enterica serovar Typhi
gaagggugacgugccgcag

SEQ ID NO: 1690359 - RNA, 19 nt, Salmonella enterica enterica serovar Typhi
gaaggggcgggcagcagca

SEQ ID NO: 1690360 - RNA, 15 nt, Salmonella enterica enterica serovar Typhi
gaagggauucccauc

SEQ ID NO: 1690361 - RNA, 21 nt, Salmonella enterica enterica serovar Typhi
gaagggcauauuaugcugcuc

SEQ ID NO: 1690362 - RNA, 16 nt, Salmonella enterica enterica serovar Typhi
gaagggauucccaucc

SEQ ID NO: 1690363 - RNA, 13 nt, Salmonella enterica enterica serovar Typhi
gaaggcuuuugcu

SEQ ID NO: 1690364 - RNA, 14 nt, Salmonella enterica enterica serovar Typhi
gaaggcgugcagcg

SEQ ID NO: 1690365 - RNA, 16 nt, Salmonella enterica enterica serovar Typhi
gaaggcuaacagcugg

SEQ ID NO: 1690366 - RNA, 17 nt, Salmonella enterica enterica serovar Typhi
gaaggcuaacagcuggc

SEQ ID NO: 1690367 - RNA, 11 nt, Salmonella enterica enterica serovar Typhi
gaaggcggcgg

SEQ ID NO: 1690368 - RNA, 14 nt, Salmonella enterica enterica serovar Typhi
gaagguuuuucccg

SEQ ID NO: 1690369 - RNA, 20 nt, Salmonella enterica enterica serovar Typhi
gaagguuucgauagcaggca

SEQ ID NO: 1690370 - RNA, 14 nt, Salmonella enterica enterica serovar Typhi
gaaggucaggccac

SEQ ID NO: 1690371 - RNA, 21 nt, Salmonella enterica enterica serovar Typhi
gaaggucaggccacugcccug

SEQ ID NO: 1690372 - RNA, 18 nt, Salmonella enterica enterica serovar Typhi
gaaguauccuggaacaaa

SEQ ID NO: 1690373 - RNA, 17 nt, Salmonella enterica enterica serovar Typhi
gaaguagcagagaaaag

SEQ ID NO: 1690374 - RNA, 21 nt, Salmonella enterica enterica serovar Typhi
gaaguagcagagaaaagguug

SEQ ID NO: 1690375 - RNA, 14 nt, Salmonella enterica enterica serovar Typhi
gaaguacuggauca

SEQ ID NO: 1690376 - RNA, 12 nt, Salmonella enterica enterica serovar Typhi
gaaguaaaaaaa

SEQ ID NO: 1690377 - RNA, 22 nt, Salmonella enterica enterica serovar Typhi
gaaguaaaggccguuaaaccaa

SEQ ID NO: 1690378 - RNA, 23 nt, Salmonella enterica enterica serovar Typhi
gaaguaaucguuagcgagguucc

SEQ ID NO: 1690379 - RNA, 20 nt, Salmonella enterica enterica serovar Typhi
gaagugguggcgaacaggcu

SEQ ID NO: 1690380 - RNA, 15 nt, Salmonella enterica enterica serovar Typhi
gaaguggugggugau

SEQ ID NO: 1690381 - RNA, 20 nt, Salmonella enterica enterica serovar Typhi
gaaguggugggugaugacgg

SEQ ID NO: 1690382 - RNA, 15 nt, Salmonella enterica enterica serovar Typhi
gaagugccaguaacu

SEQ ID NO: 1690383 - RNA, 14 nt, Salmonella enterica enterica serovar Typhi
gaagucggaaaucu

SEQ ID NO: 1690384 - RNA, 15 nt, Salmonella enterica enterica serovar Typhi
gaagucauucgcagc

SEQ ID NO: 1690385 - RNA, 14 nt, Salmonella enterica enterica serovar Typhi
gaaguccuucacaa

SEQ ID NO: 1690386 - RNA, 16 nt, Salmonella enterica enterica serovar Typhi
gaauaaagacacugcu

SEQ ID NO: 1690387 - RNA, 11 nt, Salmonella enterica enterica serovar Typhi
gaauaaacaca

SEQ ID NO: 1690388 - RNA, 14 nt, Salmonella enterica enterica serovar Typhi
gaauaaaacugccg

SEQ ID NO: 1690389 - RNA, 17 nt, Salmonella enterica enterica serovar Typhi
gaaguucuucuggcgca

SEQ ID NO: 1690390 - RNA, 19 nt, Salmonella enterica enterica serovar Typhi
gaauccguugaucguccau

SEQ ID NO: 1690391 - RNA, 12 nt, Salmonella enterica enterica serovar Typhi
gaaucgccagca

SEQ ID NO: 1690392 - RNA, 16 nt, Salmonella enterica enterica serovar Typhi
gaauccccaucuccag

SEQ ID NO: 1690393 - RNA, 21 nt, Salmonella enterica enterica serovar Typhi
gaaucccccugccacaaccgc

SEQ ID NO: 1690394 - RNA, 18 nt, Salmonella enterica enterica serovar Typhi
gaauccccggcuuccagc

SEQ ID NO: 1690395 - RNA, 20 nt, Salmonella enterica enterica serovar Typhi
gaaucccgucguagccacca

SEQ ID NO: 1690396 - RNA, 11 nt, Salmonella enterica enterica serovar Typhi
gaauccaggua

SEQ ID NO: 1690397 - RNA, 14 nt, Salmonella enterica enterica serovar Typhi
gaauccccaucucc

SEQ ID NO: 1690398 - RNA, 20 nt, Salmonella enterica enterica serovar Typhi
gaaucagugcaucuucacug

SEQ ID NO: 1690399 - RNA, 14 nt, Salmonella enterica enterica serovar Typhi
gaaucaucacaauu

SEQ ID NO: 1690400 - RNA, 14 nt, Salmonella enterica enterica serovar Typhi
gaaucagaugcuca

SEQ ID NO: 1690401 - RNA, 15 nt, Salmonella enterica enterica serovar Typhi
gaaucaccgacagca

SEQ ID NO: 1690402 - RNA, 20 nt, Salmonella enterica enterica serovar Typhi
gaaucacauccgccagcgcc

SEQ ID NO: 1690403 - RNA, 14 nt, Salmonella enterica enterica serovar Typhi
gaaucguccagauu

SEQ ID NO: 1690404 - RNA, 15 nt, Salmonella enterica enterica serovar Typhi
gaaucguucgccagu

SEQ ID NO: 1690405 - RNA, 19 nt, Salmonella enterica enterica serovar Typhi
gaaucguucgccagugaca

SEQ ID NO: 1690406 - RNA, 14 nt, Salmonella enterica enterica serovar Typhi
gaaucgcuuccugg

SEQ ID NO: 1690407 - RNA, 23 nt, Salmonella enterica enterica serovar Typhi
gaaucgccagcaucggcagcgcc

SEQ ID NO: 1690408 - RNA, 19 nt, Salmonella enterica enterica serovar Typhi
gaaucgccagucgcagcaa

SEQ ID NO: 1690409 - RNA, 16 nt, Salmonella enterica enterica serovar Typhi
gaaucgccagcaucgg

SEQ ID NO: 1690410 - RNA, 15 nt, Salmonella enterica enterica serovar Typhi
gaaucgccagucgca

SEQ ID NO: 1690411 - RNA, 16 nt, Salmonella enterica enterica serovar Typhi
gaaucucaucagacug

SEQ ID NO: 1690412 - RNA, 22 nt, Salmonella enterica enterica serovar Typhi
gaaucgugcaagcccaacuauu

SEQ ID NO: 1690413 - RNA, 20 nt, Salmonella enterica enterica serovar Typhi
gaaucucgugaucgccaaag

SEQ ID NO: 1690414 - RNA, 21 nt, Salmonella enterica enterica serovar Typhi
gaaucuggauagucaggcgau

SEQ ID NO: 1690415 - RNA, 18 nt, Salmonella enterica enterica serovar Typhi
gaaugaccgaggaaauca

SEQ ID NO: 1690416 - RNA, 23 nt, Salmonella enterica enterica serovar Typhi
gaaugacacauuucuauagagag

SEQ ID NO: 1690417 - RNA, 23 nt, Salmonella enterica enterica serovar Typhi
gaaucugcggcugcgugauuuug

SEQ ID NO: 1690418 - RNA, 14 nt, Salmonella enterica enterica serovar Typhi
gaaugaggugcggu

SEQ ID NO: 1690419 - RNA, 15 nt, Salmonella enterica enterica serovar Typhi
gaaugaugugcuauu

SEQ ID NO: 1690420 - RNA, 20 nt, Salmonella enterica enterica serovar Typhi
gaaugagggcgcgaauacuc

SEQ ID NO: 1690421 - RNA, 14 nt, Salmonella enterica enterica serovar Typhi
gaaugagcaucuac

SEQ ID NO: 1690422 - RNA, 20 nt, Salmonella enterica enterica serovar Typhi
gaauguaggccggguaagcg

SEQ ID NO: 1690423 - RNA, 19 nt, Salmonella enterica enterica serovar Typhi
gaauguccccauaucccgc

SEQ ID NO: 1690424 - RNA, 13 nt, Salmonella enterica enterica serovar Typhi
gaauguguucuuu

SEQ ID NO: 1690425 - RNA, 11 nt, Salmonella enterica enterica serovar Typhi
gaaugcgaaua

SEQ ID NO: 1690426 - RNA, 19 nt, Salmonella enterica enterica serovar Typhi
gaaugccuuuuacaauaac

SEQ ID NO: 1690427 - RNA, 22 nt, Salmonella enterica enterica serovar Typhi
gaaugccgcccauccagagcag

SEQ ID NO: 1690428 - RNA, 13 nt, Salmonella enterica enterica serovar Typhi
gaaugcaagcagc

SEQ ID NO: 1690429 - RNA, 17 nt, Salmonella enterica enterica serovar Typhi
gaaugcagaccucugcu

SEQ ID NO: 1690430 - RNA, 13 nt, Salmonella enterica enterica serovar Typhi
gaaugccagcgcc

SEQ ID NO: 1690431 - RNA, 24 nt, Salmonella enterica enterica serovar Typhi
gaaugccccagguuauagaccugc

SEQ ID NO: 1690432 - RNA, 20 nt, Salmonella enterica enterica serovar Typhi
gaaugcugacgcguuuuuuc

SEQ ID NO: 1690433 - RNA, 12 nt, Salmonella enterica enterica serovar Typhi
gaauggagaagc

SEQ ID NO: 1690434 - RNA, 15 nt, Salmonella enterica enterica serovar Typhi
gaauugaacuaaaaa

SEQ ID NO: 1690435 - RNA, 13 nt, Salmonella enterica enterica serovar Typhi
gaauugauaaaga

SEQ ID NO: 1690436 - RNA, 17 nt, Salmonella enterica enterica serovar Typhi
gaauuucaaucaucaua

SEQ ID NO: 1690437 - RNA, 13 nt, Salmonella enterica enterica serovar Typhi
gaauuucaggaag

SEQ ID NO: 1690438 - RNA, 22 nt, Salmonella enterica enterica serovar Typhi
gaauuucaggguagcauugccg

SEQ ID NO: 1690439 - RNA, 19 nt, Salmonella enterica enterica serovar Typhi
gaauuuaucccgugguggg

SEQ ID NO: 1690440 - RNA, 15 nt, Salmonella enterica enterica serovar Typhi
gaauuccaguccuuu

SEQ ID NO: 1690441 - RNA, 19 nt, Salmonella enterica enterica serovar Typhi
gaauucaccgcaugacaau

SEQ ID NO: 1690442 - RNA, 20 nt, Salmonella enterica enterica serovar Typhi
gaauuauuuaggguuaagag

SEQ ID NO: 1690443 - RNA, 22 nt, Salmonella enterica enterica serovar Typhi
gaauucaaagaacagggggcgc

SEQ ID NO: 1690444 - RNA, 19 nt, Salmonella enterica enterica serovar Typhi
gaauuauucguguuucgac

SEQ ID NO: 1690445 - RNA, 23 nt, Salmonella enterica enterica serovar Typhi
gaauuacgggcgauacaccuuca

SEQ ID NO: 1690446 - RNA, 13 nt, Salmonella enterica enterica serovar Typhi
gaaccgccgaccc

SEQ ID NO: 1690447 - RNA, 20 nt, Salmonella enterica enterica serovar Typhi
gaaccgcccaucaacaccag

SEQ ID NO: 1690448 - RNA, 19 nt, Salmonella enterica enterica serovar Typhi
gaaccgaauaacgccaggu

SEQ ID NO: 1690449 - RNA, 16 nt, Salmonella enterica enterica serovar Typhi
gaacccgaccgucuuu

SEQ ID NO: 1690450 - RNA, 17 nt, Salmonella enterica enterica serovar Typhi
gaacccucgaaugugaa

SEQ ID NO: 1690451 - RNA, 15 nt, Salmonella enterica enterica serovar Typhi
gaaccggcaucggca

SEQ ID NO: 1690452 - RNA, 22 nt, Salmonella enterica enterica serovar Typhi
gaaccaucauuaauauaauccu

SEQ ID NO: 1690453 - RNA, 12 nt, Salmonella enterica enterica serovar Typhi
gaaccaucggca

SEQ ID NO: 1690454 - RNA, 16 nt, Salmonella enterica enterica serovar Typhi
gaaccauuuuccccag

SEQ ID NO: 1690455 - RNA, 23 nt, Salmonella enterica enterica serovar Typhi
gaaccauuuccucugcggacggc

SEQ ID NO: 1690456 - RNA, 13 nt, Salmonella enterica enterica serovar Typhi
gaaccauugagau

SEQ ID NO: 1690457 - RNA, 16 nt, Salmonella enterica enterica serovar Typhi
gaaccacauagaguga

SEQ ID NO: 1690458 - RNA, 13 nt, Salmonella enterica enterica serovar Typhi
gaaccauaauaaa

SEQ ID NO: 1690459 - RNA, 15 nt, Salmonella enterica enterica serovar Typhi
gaacgagaggaggag

SEQ ID NO: 1690460 - RNA, 19 nt, Salmonella enterica enterica serovar Typhi
gaacgcacuuaaugcaaug

SEQ ID NO: 1690461 - RNA, 15 nt, Salmonella enterica enterica serovar Typhi
gaacgcgagaagccc

SEQ ID NO: 1690462 - RNA, 17 nt, Salmonella enterica enterica serovar Typhi
gaacgccuuauccggcc

SEQ ID NO: 1690463 - RNA, 17 nt, Salmonella enterica enterica serovar Typhi
gaaccguucucaauccg

SEQ ID NO: 1690464 - RNA, 15 nt, Salmonella enterica enterica serovar Typhi
gaaccguggccuccg

SEQ ID NO: 1690465 - RNA, 20 nt, Salmonella enterica enterica serovar Typhi
gaaccguaaacgccugcacc

SEQ ID NO: 1690466 - RNA, 15 nt, Salmonella enterica enterica serovar Typhi
gaaccuuacggcuca

SEQ ID NO: 1690467 - RNA, 17 nt, Salmonella enterica enterica serovar Typhi
gaacguucaaaaucaaa

SEQ ID NO: 1690468 - RNA, 22 nt, Salmonella enterica enterica serovar Typhi
gaacguccagcggccaguguac

SEQ ID NO: 1690469 - RNA, 18 nt, Salmonella enterica enterica serovar Typhi
gaacuacugauuccugcc

SEQ ID NO: 1690470 - RNA, 15 nt, Salmonella enterica enterica serovar Typhi
gaacguuggcugggu

SEQ ID NO: 1690471 - RNA, 14 nt, Salmonella enterica enterica serovar Typhi
gaacgggugguuuc

SEQ ID NO: 1690472 - RNA, 20 nt, Salmonella enterica enterica serovar Typhi
gaacgguucauccagcagca

SEQ ID NO: 1690473 - RNA, 20 nt, Salmonella enterica enterica serovar Typhi
gaacggcaccggaaccggca

SEQ ID NO: 1690474 - RNA, 19 nt, Salmonella enterica enterica serovar Typhi
gaacggaucaugguugaaa

SEQ ID NO: 1690475 - RNA, 15 nt, Salmonella enterica enterica serovar Typhi
gaacgcuuccgggcu

SEQ ID NO: 1690476 - RNA, 20 nt, Salmonella enterica enterica serovar Typhi
gaacgcggcgccgaagcagg

SEQ ID NO: 1690477 - RNA, 20 nt, Salmonella enterica enterica serovar Typhi
gaacugauguugggcaugga

SEQ ID NO: 1690478 - RNA, 21 nt, Salmonella enterica enterica serovar Typhi
gaacugcaaauaccacaucag

SEQ ID NO: 1690479 - RNA, 19 nt, Salmonella enterica enterica serovar Typhi
gaacugcagcgcgucgacc

SEQ ID NO: 1690480 - RNA, 15 nt, Salmonella enterica enterica serovar Typhi
gaacuggaugacgaa

SEQ ID NO: 1690481 - RNA, 17 nt, Salmonella enterica enterica serovar Typhi
gaacuuaggauaauucc

SEQ ID NO: 1690482 - RNA, 17 nt, Salmonella enterica enterica serovar Typhi
gaacuguucagccagca

SEQ ID NO: 1690483 - RNA, 23 nt, Salmonella enterica enterica serovar Typhi
gaacuuacacuuaccugauuaua

SEQ ID NO: 1690484 - RNA, 18 nt, Salmonella enterica enterica serovar Typhi
gaacuggguaugcagugg

SEQ ID NO: 1690485 - RNA, 13 nt, Salmonella enterica enterica serovar Typhi
gaacugggugccg

SEQ ID NO: 1690486 - RNA, 14 nt, Salmonella enterica enterica serovar Typhi
gaacuuaaauuaau

SEQ ID NO: 1690487 - RNA, 14 nt, Salmonella enterica enterica serovar Typhi
gaacuguucagcca

SEQ ID NO: 1690488 - RNA, 15 nt, Salmonella enterica enterica serovar Typhi
gaacuccaaauaccg

SEQ ID NO: 1690489 - RNA, 19 nt, Salmonella enterica enterica serovar Typhi
gaacucccuguuccuguau

SEQ ID NO: 1690490 - RNA, 13 nt, Salmonella enterica enterica serovar Typhi
gaacuccagcgcg

SEQ ID NO: 1690491 - RNA, 16 nt, Salmonella enterica enterica serovar Typhi
gaacugauaaaagaga

SEQ ID NO: 1690492 - RNA, 15 nt, Salmonella enterica enterica serovar Typhi
gaacucuuucagacc

SEQ ID NO: 1690493 - RNA, 20 nt, Salmonella enterica enterica serovar Typhi
gaacucugcgacgccaggcg

SEQ ID NO: 1690494 - RNA, 21 nt, Salmonella enterica enterica serovar Typhi
gaacucuaugcaaaagaaaaa

SEQ ID NO: 1690495 - RNA, 19 nt, Salmonella enterica enterica serovar Typhi
gaagcggcgcuauccggca

SEQ ID NO: 1690496 - RNA, 16 nt, Salmonella enterica enterica serovar Typhi
gaagcgguaaaaccgg

SEQ ID NO: 1690497 - RNA, 14 nt, Salmonella enterica enterica serovar Typhi
gaagcguaacagcg

SEQ ID NO: 1690498 - RNA, 20 nt, Salmonella enterica enterica serovar Typhi
gaagcugcagggauaugcug

SEQ ID NO: 1690499 - RNA, 17 nt, Salmonella enterica enterica serovar Typhi
gaagcuggagccacauc

SEQ ID NO: 1690500 - RNA, 14 nt, Salmonella enterica enterica serovar Typhi
gaaggagaaaacgg

SEQ ID NO: 1690501 - RNA, 20 nt, Salmonella enterica enterica serovar Typhi
gaaggagcaaugagauccac

SEQ ID NO: 1690502 - RNA, 21 nt, Salmonella enterica enterica serovar Typhi
gaaggagcaaugagauccacu

SEQ ID NO: 1690503 - RNA, 13 nt, Salmonella enterica enterica serovar Typhi
gaagcuuaccacc

SEQ ID NO: 1690504 - RNA, 13 nt, Salmonella enterica enterica serovar Typhi
gaaggcaucuuca

SEQ ID NO: 1690505 - RNA, 17 nt, Salmonella enterica enterica serovar Typhi
gaaggcaggcuggguuu

SEQ ID NO: 1690506 - RNA, 14 nt, Salmonella enterica enterica serovar Typhi
gaaggcaacugauc

SEQ ID NO: 1690507 - RNA, 19 nt, Salmonella enterica enterica serovar Typhi
gaaggauuauuggcaucau

SEQ ID NO: 1690508 - RNA, 14 nt, Salmonella enterica enterica serovar Typhi
gaagcggacgggcg

SEQ ID NO: 1690509 - RNA, 21 nt, Salmonella enterica enterica serovar Typhi
gaagcggaaaggacguucuuc

SEQ ID NO: 1690510 - RNA, 14 nt, Salmonella enterica enterica serovar Typhi
gaagccuuucuguu

SEQ ID NO: 1690511 - RNA, 13 nt, Salmonella enterica enterica serovar Typhi
gaagccugcuuca

SEQ ID NO: 1690512 - RNA, 18 nt, Salmonella enterica enterica serovar Typhi
gaagccuggugcccaacc

SEQ ID NO: 1690513 - RNA, 20 nt, Salmonella enterica enterica serovar Typhi
gaagcgauguauuuauccac

SEQ ID NO: 1690514 - RNA, 22 nt, Salmonella enterica enterica serovar Typhi
gaagcgcaaacggaucuuccac

SEQ ID NO: 1690515 - RNA, 17 nt, Salmonella enterica enterica serovar Typhi
gaagcgacgacacggcg

SEQ ID NO: 1690516 - RNA, 17 nt, Salmonella enterica enterica serovar Typhi
gaagcgaucaagacaaa

SEQ ID NO: 1690517 - RNA, 13 nt, Salmonella enterica enterica serovar Typhi
gaagcgaccggcg

SEQ ID NO: 1690518 - RNA, 12 nt, Salmonella enterica enterica serovar Typhi
gaagcccaacua

SEQ ID NO: 1690519 - RNA, 20 nt, Salmonella enterica enterica serovar Typhi
gaagccacaaucugauaauc

SEQ ID NO: 1690520 - RNA, 15 nt, Salmonella enterica enterica serovar Typhi
gaagcacgacacaaa

SEQ ID NO: 1690521 - RNA, 18 nt, Salmonella enterica enterica serovar Typhi
gaagcacgacacaaaagc

SEQ ID NO: 1690522 - RNA, 17 nt, Salmonella enterica enterica serovar Typhi
gaagcaggcggagaagg

SEQ ID NO: 1690523 - RNA, 22 nt, Salmonella enterica enterica serovar Typhi
gaagauuaacccggucauccag

SEQ ID NO: 1690524 - RNA, 18 nt, Salmonella enterica enterica serovar Typhi
gaagauuucuuaauuccu

SEQ ID NO: 1690525 - RNA, 22 nt, Salmonella enterica enterica serovar Typhi
gaagauuucuuaauuccucaga

SEQ ID NO: 1690526 - RNA, 14 nt, Salmonella enterica enterica serovar Typhi
gaagagaccugugu

SEQ ID NO: 1690527 - RNA, 18 nt, Salmonella enterica enterica serovar Typhi
gaagauccgcucacgcca

SEQ ID NO: 1690528 - RNA, 14 nt, Salmonella enterica enterica serovar Typhi
gaagauaagaaaaa

SEQ ID NO: 1690529 - RNA, 16 nt, Salmonella enterica enterica serovar Typhi
gaagauaaagauauuc

SEQ ID NO: 1690530 - RNA, 17 nt, Salmonella enterica enterica serovar Typhi
gaagaauucgcaaugug

SEQ ID NO: 1690531 - RNA, 17 nt, Salmonella enterica enterica serovar Typhi
gaagacacaacgugcca

SEQ ID NO: 1690532 - RNA, 14 nt, Salmonella enterica enterica serovar Typhi
gaagaauccaggga

SEQ ID NO: 1690533 - RNA, 22 nt, Salmonella enterica enterica serovar Typhi
gaagaauccagggaugaacagc

SEQ ID NO: 1690534 - RNA, 20 nt, Salmonella enterica enterica serovar Typhi
gaagaaucuguauaaaauau

SEQ ID NO: 1690535 - RNA, 17 nt, Salmonella enterica enterica serovar Typhi
gaagaaggcuccggcac

SEQ ID NO: 1690536 - RNA, 19 nt, Salmonella enterica enterica serovar Typhi
gaagacguuuacaccgcca

SEQ ID NO: 1690537 - RNA, 20 nt, Salmonella enterica enterica serovar Typhi
gaagacauucacauauauuu

SEQ ID NO: 1690538 - RNA, 18 nt, Salmonella enterica enterica serovar Typhi
gaagaacacgccgccuau

SEQ ID NO: 1690539 - RNA, 17 nt, Salmonella enterica enterica serovar Typhi
gaacuuguaaaaaugcc

SEQ ID NO: 1690540 - RNA, 20 nt, Salmonella enterica enterica serovar Typhi
gaagaaaaaggcaauaaagu

SEQ ID NO: 1690541 - RNA, 21 nt, Salmonella enterica enterica serovar Typhi
gaaaucgccgggcuauccggc

SEQ ID NO: 1690542 - RNA, 17 nt, Salmonella enterica enterica serovar Typhi
gaaauccgcgucccagc

SEQ ID NO: 1690543 - RNA, 14 nt, Salmonella enterica enterica serovar Typhi
gaaauccagcagaa

SEQ ID NO: 1690544 - RNA, 23 nt, Salmonella enterica enterica serovar Typhi
gaaauccaccagcggacggcuaa

SEQ ID NO: 1690545 - RNA, 22 nt, Salmonella enterica enterica serovar Typhi
gaaaucacgcucaucggcggca

SEQ ID NO: 1690546 - RNA, 19 nt, Salmonella enterica enterica serovar Typhi
gaaaucacaaacaccacca

SEQ ID NO: 1690547 - RNA, 18 nt, Salmonella enterica enterica serovar Typhi
gaaaugccuuauccggcc

SEQ ID NO: 1690548 - RNA, 15 nt, Salmonella enterica enterica serovar Typhi
gaaaugucuggcgcu

SEQ ID NO: 1690549 - RNA, 22 nt, Salmonella enterica enterica serovar Typhi
gaaaugcgacaucucaggcaag

SEQ ID NO: 1690550 - RNA, 19 nt, Salmonella enterica enterica serovar Typhi
gaaaugcgaauccggcggc

SEQ ID NO: 1690551 - RNA, 20 nt, Salmonella enterica enterica serovar Typhi
gaaaugcccauaaagaaaua

SEQ ID NO: 1690552 - RNA, 24 nt, Salmonella enterica enterica serovar Typhi
gaaaugcccgauagugcaagcuca

SEQ ID NO: 1690553 - RNA, 22 nt, Salmonella enterica enterica serovar Typhi
gaaaucuguuccagcgagcagg

SEQ ID NO: 1690554 - RNA, 16 nt, Salmonella enterica enterica serovar Typhi
gaaaugaaaaagauag

SEQ ID NO: 1690555 - RNA, 14 nt, Salmonella enterica enterica serovar Typhi
gaaaugaaaacucg

SEQ ID NO: 1690556 - RNA, 11 nt, Salmonella enterica enterica serovar Typhi
gaaaugagaaa

SEQ ID NO: 1690557 - RNA, 20 nt, Salmonella enterica enterica serovar Typhi
gaaaugcaggcguuuuauug

SEQ ID NO: 1690558 - RNA, 16 nt, Salmonella enterica enterica serovar Typhi
gaaaugauaagugaua

SEQ ID NO: 1690559 - RNA, 18 nt, Salmonella enterica enterica serovar Typhi
gaaauuaaacugccuucg

SEQ ID NO: 1690560 - RNA, 16 nt, Salmonella enterica enterica serovar Typhi
gaaauuagagccgaua

SEQ ID NO: 1690561 - RNA, 20 nt, Salmonella enterica enterica serovar Typhi
gaaauuauuccuuaucacau

SEQ ID NO: 1690562 - RNA, 14 nt, Salmonella enterica enterica serovar Typhi
gaaauucucagaaa

SEQ ID NO: 1690563 - RNA, 17 nt, Salmonella enterica enterica serovar Typhi
gaaauucucagaaacaa

SEQ ID NO: 1690564 - RNA, 19 nt, Salmonella enterica enterica serovar Typhi
gaacaaacagaccgccaug

SEQ ID NO: 1690565 - RNA, 20 nt, Salmonella enterica enterica serovar Typhi
gaacaaaagaaagcaauagc

SEQ ID NO: 1690566 - RNA, 16 nt, Salmonella enterica enterica serovar Typhi
gaaauuucuuuuccag

SEQ ID NO: 1690567 - RNA, 13 nt, Salmonella enterica enterica serovar Typhi
gaaauugcagggu

SEQ ID NO: 1690568 - RNA, 22 nt, Salmonella enterica enterica serovar Typhi
gaaauugcagggugcagcaaau

SEQ ID NO: 1690569 - RNA, 22 nt, Salmonella enterica enterica serovar Typhi
gaaauuuaggucaaaaaagcga

SEQ ID NO: 1690570 - RNA, 14 nt, Salmonella enterica enterica serovar Typhi
gaaauuuaaagaua

SEQ ID NO: 1690571 - RNA, 16 nt, Salmonella enterica enterica serovar Typhi
gaacacucuaaaucua

SEQ ID NO: 1690572 - RNA, 16 nt, Salmonella enterica enterica serovar Typhi
gaacagaaaaaaugca

SEQ ID NO: 1690573 - RNA, 17 nt, Salmonella enterica enterica serovar Typhi
gaacacucuaaaucuac

SEQ ID NO: 1690574 - RNA, 14 nt, Salmonella enterica enterica serovar Typhi
gaacagaagcgccg

SEQ ID NO: 1690575 - RNA, 14 nt, Salmonella enterica enterica serovar Typhi
gaacagacggcggc

SEQ ID NO: 1690576 - RNA, 15 nt, Salmonella enterica enterica serovar Typhi
gaacagauaaauguc

SEQ ID NO: 1690577 - RNA, 23 nt, Salmonella enterica enterica serovar Typhi
gaacacggacucgccuuucucca

SEQ ID NO: 1690578 - RNA, 12 nt, Salmonella enterica enterica serovar Typhi
gaacagcaucac

SEQ ID NO: 1690579 - RNA, 18 nt, Salmonella enterica enterica serovar Typhi
gaacacagcaugaauaac

SEQ ID NO: 1690580 - RNA, 21 nt, Salmonella enterica enterica serovar Typhi
gaacaaguucuucgaagcacu

SEQ ID NO: 1690581 - RNA, 20 nt, Salmonella enterica enterica serovar Typhi
gaacaacgagauucaauaau

SEQ ID NO: 1690582 - RNA, 20 nt, Salmonella enterica enterica serovar Typhi
gaacaaugccauuauugcau

SEQ ID NO: 1690583 - RNA, 19 nt, Salmonella enterica enterica serovar Typhi
gaacauugccccucccuga

SEQ ID NO: 1690584 - RNA, 21 nt, Salmonella enterica enterica serovar Typhi
gaacaugacgccgaaauaaau

SEQ ID NO: 1690585 - RNA, 21 nt, Salmonella enterica enterica serovar Typhi
gaaccaauaguauggagcagg

SEQ ID NO: 1690586 - RNA, 21 nt, Salmonella enterica enterica serovar Typhi
gaaccaaucgagaagccauca

SEQ ID NO: 1690587 - RNA, 16 nt, Salmonella enterica enterica serovar Typhi
gaacauuucaucuauc

SEQ ID NO: 1690588 - RNA, 18 nt, Salmonella enterica enterica serovar Typhi
gaacaucgcgacggaggc

SEQ ID NO: 1690589 - RNA, 15 nt, Salmonella enterica enterica serovar Typhi
gaacaucuuccaggu

SEQ ID NO: 1690590 - RNA, 23 nt, Salmonella enterica enterica serovar Typhi
gaacaucgacauucgauguuacu

SEQ ID NO: 1690591 - RNA, 18 nt, Salmonella enterica enterica serovar Typhi
gaacaucagccagcagcu

SEQ ID NO: 1690592 - RNA, 20 nt, Salmonella enterica enterica serovar Typhi
gaacaucagccagcagcuca

SEQ ID NO: 1690593 - RNA, 22 nt, Salmonella enterica enterica serovar Typhi
gaacauaccggagccugggauu

SEQ ID NO: 1690594 - RNA, 23 nt, Salmonella enterica enterica serovar Typhi
gaacauacuuucucuccuucacg

SEQ ID NO: 1690595 - RNA, 17 nt, Salmonella enterica enterica serovar Typhi
gaacaucacgaugaaag

SEQ ID NO: 1690596 - RNA, 22 nt, Salmonella enterica enterica serovar Typhi
gaacagugacaaacucacguuc

SEQ ID NO: 1690597 - RNA, 13 nt, Salmonella enterica enterica serovar Typhi
gaacaguuucucg

SEQ ID NO: 1690598 - RNA, 14 nt, Salmonella enterica enterica serovar Typhi
gaacaguuucucgc

SEQ ID NO: 1690599 - RNA, 18 nt, Salmonella enterica enterica serovar Typhi
gaacaggcuuuucaggcu

SEQ ID NO: 1690600 - RNA, 20 nt, Salmonella enterica enterica serovar Typhi
gaacagcuggugcggcauau

SEQ ID NO: 1690601 - RNA, 22 nt, Salmonella enterica enterica serovar Typhi
gaaauaaauauguuauuuacaa

SEQ ID NO: 1690602 - RNA, 21 nt, Salmonella enterica enterica serovar Typhi
gaaagugggcgcuuuguuacu

SEQ ID NO: 1690603 - RNA, 18 nt, Salmonella enterica enterica serovar Typhi
gaaagugcugaaauuucc

SEQ ID NO: 1690604 - RNA, 16 nt, Salmonella enterica enterica serovar Typhi
gaaaguggugggugau

SEQ ID NO: 1690605 - RNA, 21 nt, Salmonella enterica enterica serovar Typhi
gaaagucuucccgcaaacugg

SEQ ID NO: 1690606 - RNA, 22 nt, Salmonella enterica enterica serovar Typhi
gaaagugaauccccaggagcau

SEQ ID NO: 1690607 - RNA, 19 nt, Salmonella enterica enterica serovar Typhi
gaaaguuacuuuccauaua

SEQ ID NO: 1690608 - RNA, 23 nt, Salmonella enterica enterica serovar Typhi
gaaauaccaggcggcuuuuucau

SEQ ID NO: 1690609 - RNA, 23 nt, Salmonella enterica enterica serovar Typhi
gaaauagacgagcgaaaaacugu

SEQ ID NO: 1690610 - RNA, 13 nt, Salmonella enterica enterica serovar Typhi
gaaauauuugauc

SEQ ID NO: 1690611 - RNA, 15 nt, Salmonella enterica enterica serovar Typhi
gaaauauucucagcc

SEQ ID NO: 1690612 - RNA, 16 nt, Salmonella enterica enterica serovar Typhi
gaaauaugacgaggau

SEQ ID NO: 1690613 - RNA, 20 nt, Salmonella enterica enterica serovar Typhi
gaaauaucgcgcggcaugga

SEQ ID NO: 1690614 - RNA, 23 nt, Salmonella enterica enterica serovar Typhi
gaaaggggagggcaacaaacaua

SEQ ID NO: 1690615 - RNA, 16 nt, Salmonella enterica enterica serovar Typhi
gaaagggaucaaugua

SEQ ID NO: 1690616 - RNA, 13 nt, Salmonella enterica enterica serovar Typhi
gaaaggcuugcag

SEQ ID NO: 1690617 - RNA, 15 nt, Salmonella enterica enterica serovar Typhi
gaaaggcuugcagga

SEQ ID NO: 1690618 - RNA, 19 nt, Salmonella enterica enterica serovar Typhi
gaaaggcuugcaggauguc

SEQ ID NO: 1690619 - RNA, 17 nt, Salmonella enterica enterica serovar Typhi
gaaagggugcccgccug

SEQ ID NO: 1690620 - RNA, 15 nt, Salmonella enterica enterica serovar Typhi
gaaagguaaaugcca

SEQ ID NO: 1690621 - RNA, 15 nt, Salmonella enterica enterica serovar Typhi
gaaagguauguacug

SEQ ID NO: 1690622 - RNA, 18 nt, Salmonella enterica enterica serovar Typhi
gaaagguccggcccgcua

SEQ ID NO: 1690623 - RNA, 20 nt, Salmonella enterica enterica serovar Typhi
gaaagucaaaauaaaauuau

SEQ ID NO: 1690624 - RNA, 21 nt, Salmonella enterica enterica serovar Typhi
gaaaguaggcgguuucaucga

SEQ ID NO: 1690625 - RNA, 23 nt, Salmonella enterica enterica serovar Typhi
gaaaguaccaaaacagaaaagau

SEQ ID NO: 1690626 - RNA, 20 nt, Salmonella enterica enterica serovar Typhi
gaaagcgaccuucuccccgu

SEQ ID NO: 1690627 - RNA, 15 nt, Salmonella enterica enterica serovar Typhi
gaaagccucuuccgc

SEQ ID NO: 1690628 - RNA, 21 nt, Salmonella enterica enterica serovar Typhi
gaaagccauaaaacuggcgcu

SEQ ID NO: 1690629 - RNA, 17 nt, Salmonella enterica enterica serovar Typhi
gaaagccauaaaacugg

SEQ ID NO: 1690630 - RNA, 17 nt, Salmonella enterica enterica serovar Typhi
gaaagcggcgaauauag

SEQ ID NO: 1690631 - RNA, 21 nt, Salmonella enterica enterica serovar Typhi
gaaagauuucaucaggcugac

SEQ ID NO: 1690632 - RNA, 15 nt, Salmonella enterica enterica serovar Typhi
gaaagcaauacugua

SEQ ID NO: 1690633 - RNA, 14 nt, Salmonella enterica enterica serovar Typhi
gaaagcaauacugu

SEQ ID NO: 1690634 - RNA, 23 nt, Salmonella enterica enterica serovar Typhi
gaaagaucagcagaacaaaggcu

SEQ ID NO: 1690635 - RNA, 14 nt, Salmonella enterica enterica serovar Typhi
gaaagcagguuuug

SEQ ID NO: 1690636 - RNA, 18 nt, Salmonella enterica enterica serovar Typhi
gaaagcauucgcagcaga

SEQ ID NO: 1690637 - RNA, 14 nt, Salmonella enterica enterica serovar Typhi
gaaacucagcggcc

SEQ ID NO: 1690638 - RNA, 18 nt, Salmonella enterica enterica serovar Typhi
gaaacuccagcggcagga

SEQ ID NO: 1690639 - RNA, 12 nt, Salmonella enterica enterica serovar Typhi
gaaacugauauu

SEQ ID NO: 1690640 - RNA, 19 nt, Salmonella enterica enterica serovar Typhi
gaaacuccuccgggaaaac

SEQ ID NO: 1690641 - RNA, 22 nt, Salmonella enterica enterica serovar Typhi
gaaacucgccaugccaucggcc

SEQ ID NO: 1690642 - RNA, 22 nt, Salmonella enterica enterica serovar Typhi
gaaacgguccugauccggaaua

SEQ ID NO: 1690643 - RNA, 16 nt, Salmonella enterica enterica serovar Typhi
gaaacggaucaaaaag

SEQ ID NO: 1690644 - RNA, 16 nt, Salmonella enterica enterica serovar Typhi
gaaacguguuuauccc

SEQ ID NO: 1690645 - RNA, 16 nt, Salmonella enterica enterica serovar Typhi
gaaacguccccugcgg

SEQ ID NO: 1690646 - RNA, 19 nt, Salmonella enterica enterica serovar Typhi
gaaacguucggugaagaaa

SEQ ID NO: 1690647 - RNA, 20 nt, Salmonella enterica enterica serovar Typhi
gaaacguucggugaagaaaa

SEQ ID NO: 1690648 - RNA, 19 nt, Salmonella enterica enterica serovar Typhi
gaaacgugcauuauuuuag

SEQ ID NO: 1690649 - RNA, 23 nt, Salmonella enterica enterica serovar Typhi
gaaacugauaguuuaaauccagc

SEQ ID NO: 1690650 - RNA, 15 nt, Salmonella enterica enterica serovar Typhi
gaaacugcugccgca

SEQ ID NO: 1690651 - RNA, 17 nt, Salmonella enterica enterica serovar Typhi
gaaacuggcgucauguu

SEQ ID NO: 1690652 - RNA, 11 nt, Salmonella enterica enterica serovar Typhi
gaaagaaaauu

SEQ ID NO: 1690653 - RNA, 13 nt, Salmonella enterica enterica serovar Typhi
gaaagagcaaaua

SEQ ID NO: 1690654 - RNA, 15 nt, Salmonella enterica enterica serovar Typhi
gaaagagcgugcggc

SEQ ID NO: 1690655 - RNA, 16 nt, Salmonella enterica enterica serovar Typhi
gaaacccgccaccgcc

SEQ ID NO: 1690656 - RNA, 21 nt, Salmonella enterica enterica serovar Typhi
gaaacccgccaccgccagcca

SEQ ID NO: 1690657 - RNA, 19 nt, Salmonella enterica enterica serovar Typhi
gaaaccgagguucaccagc

SEQ ID NO: 1690658 - RNA, 14 nt, Salmonella enterica enterica serovar Typhi
gaaaccgauuuccu

SEQ ID NO: 1690659 - RNA, 17 nt, Salmonella enterica enterica serovar Typhi
gaaaccgcuacccggca

SEQ ID NO: 1690660 - RNA, 18 nt, Salmonella enterica enterica serovar Typhi
gaaaccgcucgccgccuc

SEQ ID NO: 1690661 - RNA, 19 nt, Salmonella enterica enterica serovar Typhi
gaaaccgcucgccgccucc

SEQ ID NO: 1690662 - RNA, 13 nt, Salmonella enterica enterica serovar Typhi
gaaaccggcggcg

SEQ ID NO: 1690663 - RNA, 21 nt, Salmonella enterica enterica serovar Typhi
gaaaccggcgucuuuugcugc

SEQ ID NO: 1690664 - RNA, 20 nt, Salmonella enterica enterica serovar Typhi
gaaacgcauacgcaggacuu

SEQ ID NO: 1690665 - RNA, 17 nt, Salmonella enterica enterica serovar Typhi
gaaacgcggcguagccg

SEQ ID NO: 1690666 - RNA, 18 nt, Salmonella enterica enterica serovar Typhi
gaaacgcacccgcgcagg

SEQ ID NO: 1690667 - RNA, 18 nt, Salmonella enterica enterica serovar Typhi
gaaacgacugguaauguc

SEQ ID NO: 1690668 - RNA, 19 nt, Salmonella enterica enterica serovar Typhi
gaaaccagauacccuuuau

SEQ ID NO: 1690669 - RNA, 11 nt, Salmonella enterica enterica serovar Typhi
gaaaccagcau

SEQ ID NO: 1690670 - RNA, 19 nt, Salmonella enterica enterica serovar Typhi
gaaaccagcauaauauuca

SEQ ID NO: 1690671 - RNA, 13 nt, Salmonella enterica enterica serovar Typhi
gaaaccaggcacu

SEQ ID NO: 1690672 - RNA, 22 nt, Salmonella enterica enterica serovar Typhi
gaaaccccaaaucagcaaaaac

SEQ ID NO: 1690673 - RNA, 18 nt, Salmonella enterica enterica serovar Typhi
gaaacaggucggcaugca

SEQ ID NO: 1690674 - RNA, 14 nt, Salmonella enterica enterica serovar Typhi
gaaacaucaucguu

SEQ ID NO: 1690675 - RNA, 14 nt, Salmonella enterica enterica serovar Typhi
gaaacauauauauc

SEQ ID NO: 1690676 - RNA, 16 nt, Salmonella enterica enterica serovar Typhi
gaaacaggaaaaacau

SEQ ID NO: 1690677 - RNA, 16 nt, Salmonella enterica enterica serovar Typhi
cuuuuuuggucagaaa

SEQ ID NO: 1690678 - RNA, 21 nt, Salmonella enterica enterica serovar Typhi
cuuuuuuaccggaugggcaga

SEQ ID NO: 1690679 - RNA, 14 nt, Salmonella enterica enterica serovar Typhi
cuuuuuuaugcugu

SEQ ID NO: 1690680 - RNA, 15 nt, Salmonella enterica enterica serovar Typhi
cuuuuuuauugccug

SEQ ID NO: 1690681 - RNA, 13 nt, Salmonella enterica enterica serovar Typhi
cuuuuuuaacgau

SEQ ID NO: 1690682 - RNA, 19 nt, Salmonella enterica enterica serovar Typhi
cuuuuuuaacgauuucccc

SEQ ID NO: 1690683 - RNA, 22 nt, Salmonella enterica enterica serovar Typhi
gaaaaaacgggcccgcggcgac

SEQ ID NO: 1690684 - RNA, 14 nt, Salmonella enterica enterica serovar Typhi
gaaaaaaauccagu

SEQ ID NO: 1690685 - RNA, 16 nt, Salmonella enterica enterica serovar Typhi
cuuuuuuuccagcguc

SEQ ID NO: 1690686 - RNA, 21 nt, Salmonella enterica enterica serovar Typhi
gaaaaacgcuaccgucgccga

SEQ ID NO: 1690687 - RNA, 17 nt, Salmonella enterica enterica serovar Typhi
gaaaaaccaaaaaauau

SEQ ID NO: 1690688 - RNA, 12 nt, Salmonella enterica enterica serovar Typhi
gaaaaaauuccc

SEQ ID NO: 1690689 - RNA, 21 nt, Salmonella enterica enterica serovar Typhi
gaaaaaauucccggcaugcca

SEQ ID NO: 1690690 - RNA, 18 nt, Salmonella enterica enterica serovar Typhi
gaaaaaauuacagccgcg

SEQ ID NO: 1690691 - RNA, 17 nt, Salmonella enterica enterica serovar Typhi
gaaaaaacucaggaaau

SEQ ID NO: 1690692 - RNA, 13 nt, Salmonella enterica enterica serovar Typhi
gaaaaaauacuga

SEQ ID NO: 1690693 - RNA, 19 nt, Salmonella enterica enterica serovar Typhi
gaaaaaauacugauaaaaa

SEQ ID NO: 1690694 - RNA, 23 nt, Salmonella enterica enterica serovar Typhi
gaaaaaauacugauaaaaaacag

SEQ ID NO: 1690695 - RNA, 16 nt, Salmonella enterica enterica serovar Typhi
gaaaacagcgccggca

SEQ ID NO: 1690696 - RNA, 15 nt, Salmonella enterica enterica serovar Typhi
gaaaacagcgccggc

SEQ ID NO: 1690697 - RNA, 14 nt, Salmonella enterica enterica serovar Typhi
gaaaacaaauugca

SEQ ID NO: 1690698 - RNA, 17 nt, Salmonella enterica enterica serovar Typhi
gaaaacaagugcagaag

SEQ ID NO: 1690699 - RNA, 23 nt, Salmonella enterica enterica serovar Typhi
gaaaaauuuaagccagauguaau

SEQ ID NO: 1690700 - RNA, 11 nt, Salmonella enterica enterica serovar Typhi
gaaaacaucac

SEQ ID NO: 1690701 - RNA, 12 nt, Salmonella enterica enterica serovar Typhi
gaaaaagaagcc

SEQ ID NO: 1690702 - RNA, 22 nt, Salmonella enterica enterica serovar Typhi
gaaaaagcgcacuuuccauaau

SEQ ID NO: 1690703 - RNA, 14 nt, Salmonella enterica enterica serovar Typhi
gaaaaagcaauaau

SEQ ID NO: 1690704 - RNA, 16 nt, Salmonella enterica enterica serovar Typhi
gaaaaagggaauaaua

SEQ ID NO: 1690705 - RNA, 14 nt, Salmonella enterica enterica serovar Typhi
gaaaaagggaaaag

SEQ ID NO: 1690706 - RNA, 19 nt, Salmonella enterica enterica serovar Typhi
gaaaaaucagucauuugca

SEQ ID NO: 1690707 - RNA, 15 nt, Salmonella enterica enterica serovar Typhi
gaaacaagcggcggc

SEQ ID NO: 1690708 - RNA, 23 nt, Salmonella enterica enterica serovar Typhi
gaaacaauccguuauuucacagc

SEQ ID NO: 1690709 - RNA, 14 nt, Salmonella enterica enterica serovar Typhi
gaaacaagaagcac

SEQ ID NO: 1690710 - RNA, 22 nt, Salmonella enterica enterica serovar Typhi
gaaacaacacgaucgaugcccu

SEQ ID NO: 1690711 - RNA, 17 nt, Salmonella enterica enterica serovar Typhi
gaaaauuccuggauuaa

SEQ ID NO: 1690712 - RNA, 22 nt, Salmonella enterica enterica serovar Typhi
gaaaauuguccacggggcggca

SEQ ID NO: 1690713 - RNA, 16 nt, Salmonella enterica enterica serovar Typhi
gaaaaugugcaaagag

SEQ ID NO: 1690714 - RNA, 17 nt, Salmonella enterica enterica serovar Typhi
gaaaaugugcaaagaga

SEQ ID NO: 1690715 - RNA, 16 nt, Salmonella enterica enterica serovar Typhi
gaaaaugguuuugccc

SEQ ID NO: 1690716 - RNA, 23 nt, Salmonella enterica enterica serovar Typhi
gaaaauuaaucccaacccgacca

SEQ ID NO: 1690717 - RNA, 13 nt, Salmonella enterica enterica serovar Typhi
gaaaaucggcggc

SEQ ID NO: 1690718 - RNA, 14 nt, Salmonella enterica enterica serovar Typhi
gaaaaugcgcuggg

SEQ ID NO: 1690719 - RNA, 22 nt, Salmonella enterica enterica serovar Typhi
gaaaaucagugaacacccugcc

SEQ ID NO: 1690720 - RNA, 18 nt, Salmonella enterica enterica serovar Typhi
gaaaaucacaucgccgga

SEQ ID NO: 1690721 - RNA, 16 nt, Salmonella enterica enterica serovar Typhi
gaaaauauaugacaac

SEQ ID NO: 1690722 - RNA, 16 nt, Salmonella enterica enterica serovar Typhi
gaaaagucauuuucau

SEQ ID NO: 1690723 - RNA, 12 nt, Salmonella enterica enterica serovar Typhi
gaaaagugaacg

SEQ ID NO: 1690724 - RNA, 22 nt, Salmonella enterica enterica serovar Typhi
gaaaaguuacaggcuccaagua

SEQ ID NO: 1690725 - RNA, 22 nt, Salmonella enterica enterica serovar Typhi
gaaaaggccuggcugagaaaaa

SEQ ID NO: 1690726 - RNA, 22 nt, Salmonella enterica enterica serovar Typhi
gaaaagggaugcugaagccgcu

SEQ ID NO: 1690727 - RNA, 21 nt, Salmonella enterica enterica serovar Typhi
gaaaagguuucggcgaucacc

SEQ ID NO: 1690728 - RNA, 22 nt, Salmonella enterica enterica serovar Typhi
gaaaagguuucggcgaucacca

SEQ ID NO: 1690729 - RNA, 14 nt, Salmonella enterica enterica serovar Typhi
gaaaauagaggaaa

SEQ ID NO: 1690730 - RNA, 12 nt, Salmonella enterica enterica serovar Typhi
gaaaagaaccga

SEQ ID NO: 1690731 - RNA, 14 nt, Salmonella enterica enterica serovar Typhi
gaaaacuuuccaac

SEQ ID NO: 1690732 - RNA, 20 nt, Salmonella enterica enterica serovar Typhi
gaaaacuuuccaaccuguua

SEQ ID NO: 1690733 - RNA, 19 nt, Salmonella enterica enterica serovar Typhi
gaaaagccggaauauugag

SEQ ID NO: 1690734 - RNA, 16 nt, Salmonella enterica enterica serovar Typhi
gaaaagcgucuucuua

SEQ ID NO: 1690735 - RNA, 21 nt, Salmonella enterica enterica serovar Typhi
gaaaagcugguauugaauauu

SEQ ID NO: 1690736 - RNA, 20 nt, Salmonella enterica enterica serovar Typhi
gaaaagcuguagcauaaaug

SEQ ID NO: 1690737 - RNA, 20 nt, Salmonella enterica enterica serovar Typhi
gaaaagcgcgucgaaugacg

SEQ ID NO: 1690738 - RNA, 21 nt, Salmonella enterica enterica serovar Typhi
cuuuuuccgccugaucuuucu

SEQ ID NO: 1690739 - RNA, 24 nt, Salmonella enterica enterica serovar Typhi
cuuuuuccuccugcggagagagca

SEQ ID NO: 1690740 - RNA, 16 nt, Salmonella enterica enterica serovar Typhi
cuuuuuccugccauug

SEQ ID NO: 1690741 - RNA, 17 nt, Salmonella enterica enterica serovar Typhi
cuuuuucauauuuuccu

SEQ ID NO: 1690742 - RNA, 13 nt, Salmonella enterica enterica serovar Typhi
cuuuuucagaucu

SEQ ID NO: 1690743 - RNA, 16 nt, Salmonella enterica enterica serovar Typhi
cuuuuucaauuuccag

SEQ ID NO: 1690744 - RNA, 19 nt, Salmonella enterica enterica serovar Typhi
cuuuuugcgccacuuuucc

SEQ ID NO: 1690745 - RNA, 20 nt, Salmonella enterica enterica serovar Typhi
cuuuuugcgacacgcugcau

SEQ ID NO: 1690746 - RNA, 13 nt, Salmonella enterica enterica serovar Typhi
cuuuuuaaaauga

SEQ ID NO: 1690747 - RNA, 22 nt, Salmonella enterica enterica serovar Typhi
cuuuuucaacagcacccaggca

SEQ ID NO: 1690748 - RNA, 15 nt, Salmonella enterica enterica serovar Typhi
cuuuuuauuuuucug

SEQ ID NO: 1690749 - RNA, 14 nt, Salmonella enterica enterica serovar Typhi
cuuuucuuucagcu

SEQ ID NO: 1690750 - RNA, 18 nt, Salmonella enterica enterica serovar Typhi
cuuuucuuucagcucuuc

SEQ ID NO: 1690751 - RNA, 15 nt, Salmonella enterica enterica serovar Typhi
cuuuucuuuccugca

SEQ ID NO: 1690752 - RNA, 23 nt, Salmonella enterica enterica serovar Typhi
cuuuucucucucguucccgccug

SEQ ID NO: 1690753 - RNA, 15 nt, Salmonella enterica enterica serovar Typhi
cuuuucuggcuucag

SEQ ID NO: 1690754 - RNA, 14 nt, Salmonella enterica enterica serovar Typhi
cuuuuccugcugcc

SEQ ID NO: 1690755 - RNA, 14 nt, Salmonella enterica enterica serovar Typhi
cuuuuccugccagc

SEQ ID NO: 1690756 - RNA, 15 nt, Salmonella enterica enterica serovar Typhi
cuuuuccugcugcca

SEQ ID NO: 1690757 - RNA, 12 nt, Salmonella enterica enterica serovar Typhi
cuuuuccuucca

SEQ ID NO: 1690758 - RNA, 22 nt, Salmonella enterica enterica serovar Typhi
cuuuucgcaauagggggugaca

SEQ ID NO: 1690759 - RNA, 17 nt, Salmonella enterica enterica serovar Typhi
cuuuucggguguccacu

SEQ ID NO: 1690760 - RNA, 18 nt, Salmonella enterica enterica serovar Typhi
cuuuucggcgcuuaucca

SEQ ID NO: 1690761 - RNA, 18 nt, Salmonella enterica enterica serovar Typhi
cuuuugcuuucuggauga

SEQ ID NO: 1690762 - RNA, 20 nt, Salmonella enterica enterica serovar Typhi
cuuuugcuuccaguuucuca

SEQ ID NO: 1690763 - RNA, 14 nt, Salmonella enterica enterica serovar Typhi
cuuuugguggcaac

SEQ ID NO: 1690764 - RNA, 11 nt, Salmonella enterica enterica serovar Typhi
cuuuugcagcg

SEQ ID NO: 1690765 - RNA, 19 nt, Salmonella enterica enterica serovar Typhi
cuuuugcuaacagugaaau

SEQ ID NO: 1690766 - RNA, 19 nt, Salmonella enterica enterica serovar Typhi
cuuuugcgcguuccccaac

SEQ ID NO: 1690767 - RNA, 19 nt, Salmonella enterica enterica serovar Typhi
cuuuugcgccuuccaguuc

SEQ ID NO: 1690768 - RNA, 14 nt, Salmonella enterica enterica serovar Typhi
cuuugaaaaucaca

SEQ ID NO: 1690769 - RNA, 14 nt, Salmonella enterica enterica serovar Typhi
cuuucuuuuuuugu

SEQ ID NO: 1690770 - RNA, 11 nt, Salmonella enterica enterica serovar Typhi
cuuucuuucuc

SEQ ID NO: 1690771 - RNA, 16 nt, Salmonella enterica enterica serovar Typhi
cuuucuuuacaugacc

SEQ ID NO: 1690772 - RNA, 15 nt, Salmonella enterica enterica serovar Typhi
cuuugucgccaauaa

SEQ ID NO: 1690773 - RNA, 14 nt, Salmonella enterica enterica serovar Typhi
cuuuguccugaagg

SEQ ID NO: 1690774 - RNA, 14 nt, Salmonella enterica enterica serovar Typhi
cuuugucaccggag

SEQ ID NO: 1690775 - RNA, 18 nt, Salmonella enterica enterica serovar Typhi
cuuugucauccaccagaa

SEQ ID NO: 1690776 - RNA, 19 nt, Salmonella enterica enterica serovar Typhi
cuuugugggacugcuucaa

SEQ ID NO: 1690777 - RNA, 15 nt, Salmonella enterica enterica serovar Typhi
cuuuuaaaaaucagu

SEQ ID NO: 1690778 - RNA, 23 nt, Salmonella enterica enterica serovar Typhi
cuuuuaaccaugcaaucucuucc

SEQ ID NO: 1690779 - RNA, 19 nt, Salmonella enterica enterica serovar Typhi
cuuuuaaggcggcaaagau

SEQ ID NO: 1690780 - RNA, 21 nt, Salmonella enterica enterica serovar Typhi
cuuuuaauagcguagccugca

SEQ ID NO: 1690781 - RNA, 21 nt, Salmonella enterica enterica serovar Typhi
cuuuuaaggcggcaaagauaa

SEQ ID NO: 1690782 - RNA, 15 nt, Salmonella enterica enterica serovar Typhi
cuuuuaauuuuuaug

SEQ ID NO: 1690783 - RNA, 18 nt, Salmonella enterica enterica serovar Typhi
cuuuuaauuuuuauguca

SEQ ID NO: 1690784 - RNA, 17 nt, Salmonella enterica enterica serovar Typhi
cuuuuccaggcgaccag

SEQ ID NO: 1690785 - RNA, 22 nt, Salmonella enterica enterica serovar Typhi
cuuuucccguaaugcccaggcg

SEQ ID NO: 1690786 - RNA, 19 nt, Salmonella enterica enterica serovar Typhi
cuuuucauccacagcgcca

SEQ ID NO: 1690787 - RNA, 21 nt, Salmonella enterica enterica serovar Typhi
cuuuucacccaacauuuuuag

SEQ ID NO: 1690788 - RNA, 19 nt, Salmonella enterica enterica serovar Typhi
cuuuuaguucaaccugcgc

SEQ ID NO: 1690789 - RNA, 19 nt, Salmonella enterica enterica serovar Typhi
cuuuuaccuuacggacugc

SEQ ID NO: 1690790 - RNA, 22 nt, Salmonella enterica enterica serovar Typhi
cuuuuacaagaauaugcagugc

SEQ ID NO: 1690791 - RNA, 14 nt, Salmonella enterica enterica serovar Typhi
cuuuuagcgcgccg

SEQ ID NO: 1690792 - RNA, 14 nt, Salmonella enterica enterica serovar Typhi
cuuuuagcaccaga

SEQ ID NO: 1690793 - RNA, 21 nt, Salmonella enterica enterica serovar Typhi
cuuuuacucuuccugcugcgc

SEQ ID NO: 1690794 - RNA, 12 nt, Salmonella enterica enterica serovar Typhi
cuuuuacugccc

SEQ ID NO: 1690795 - RNA, 13 nt, Salmonella enterica enterica serovar Typhi
aaaaaaacgccgc

SEQ ID NO: 1690796 - RNA, 17 nt, Salmonella enterica enterica serovar Typhi
aaaaaacggaaccaaaa

SEQ ID NO: 1690797 - RNA, 13 nt, Salmonella enterica enterica serovar Typhi
aaaaaagagaagc

SEQ ID NO: 1690798 - RNA, 20 nt, Salmonella enterica enterica serovar Typhi
aaaaaacgcccagaucgacc

SEQ ID NO: 1690799 - RNA, 11 nt, Salmonella enterica enterica serovar Typhi
aaaaaagagaa

SEQ ID NO: 1690800 - RNA, 21 nt, Salmonella enterica enterica serovar Typhi
aaaaaacauauaauuaacauu

SEQ ID NO: 1690801 - RNA, 15 nt, Salmonella enterica enterica serovar Typhi
aaaaaacauauaauu

SEQ ID NO: 1690802 - RNA, 11 nt, Salmonella enterica enterica serovar Typhi
aaaaaagaggg

SEQ ID NO: 1690803 - RNA, 20 nt, Salmonella enterica enterica serovar Typhi
aaaaaagccguauuuuauuu

SEQ ID NO: 1690804 - RNA, 22 nt, Salmonella enterica enterica serovar Typhi
aaaaaagcugcgaucaaguuuu

SEQ ID NO: 1690805 - RNA, 11 nt, Salmonella enterica enterica serovar Typhi
aaaaaagccau

SEQ ID NO: 1690806 - RNA, 12 nt, Salmonella enterica enterica serovar Typhi
aaaaaauuacga

SEQ ID NO: 1690807 - RNA, 11 nt, Salmonella enterica enterica serovar Typhi
aaaaaucagcc

SEQ ID NO: 1690808 - RNA, 13 nt, Salmonella enterica enterica serovar Typhi
aaaaaucagcaau

SEQ ID NO: 1690809 - RNA, 18 nt, Salmonella enterica enterica serovar Typhi
aaaacagccgccauggcg

SEQ ID NO: 1690810 - RNA, 23 nt, Salmonella enterica enterica serovar Typhi
aaaaccggcauacacgccgggca

SEQ ID NO: 1690811 - RNA, 14 nt, Salmonella enterica enterica serovar Typhi
aaaaccggcccagc

SEQ ID NO: 1690812 - RNA, 18 nt, Salmonella enterica enterica serovar Typhi
aaaaccgucggcaauaca

SEQ ID NO: 1690813 - RNA, 18 nt, Salmonella enterica enterica serovar Typhi
aaaaccuccggcuaugcc

SEQ ID NO: 1690814 - RNA, 12 nt, Salmonella enterica enterica serovar Typhi
aaaaccagcgcc

SEQ ID NO: 1690815 - RNA, 21 nt, Salmonella enterica enterica serovar Typhi
aaaaccagcgcggauaaaaaa

SEQ ID NO: 1690816 - RNA, 19 nt, Salmonella enterica enterica serovar Typhi
aaaacccgcagccggauag

SEQ ID NO: 1690817 - RNA, 16 nt, Salmonella enterica enterica serovar Typhi
aaaaccgagcaacaga

SEQ ID NO: 1690818 - RNA, 15 nt, Salmonella enterica enterica serovar Typhi
aaaaccgaucuccca

SEQ ID NO: 1690819 - RNA, 13 nt, Salmonella enterica enterica serovar Typhi
aaaaaccugcucu

SEQ ID NO: 1690820 - RNA, 18 nt, Salmonella enterica enterica serovar Typhi
aaaaacugcuaaaagaag

SEQ ID NO: 1690821 - RNA, 16 nt, Salmonella enterica enterica serovar Typhi
aaaaacucaaagcguu

SEQ ID NO: 1690822 - RNA, 20 nt, Salmonella enterica enterica serovar Typhi
aaaaacgcgcucgccagcgc

SEQ ID NO: 1690823 - RNA, 16 nt, Salmonella enterica enterica serovar Typhi
aaaaaccuccggcuau

SEQ ID NO: 1690824 - RNA, 14 nt, Salmonella enterica enterica serovar Typhi
aaaaaccgggaaau

SEQ ID NO: 1690825 - RNA, 21 nt, Salmonella enterica enterica serovar Typhi
aaaaaccucuaccuacacauu

SEQ ID NO: 1690826 - RNA, 14 nt, Salmonella enterica enterica serovar Typhi
aaaaacccaccagc

SEQ ID NO: 1690827 - RNA, 15 nt, Salmonella enterica enterica serovar Typhi
aaaaacucaggaaau

SEQ ID NO: 1690828 - RNA, 18 nt, Salmonella enterica enterica serovar Typhi
aaaaacucaggaaaucgu

SEQ ID NO: 1690829 - RNA, 20 nt, Salmonella enterica enterica serovar Typhi
aaaaagccggcggaaaaaag

SEQ ID NO: 1690830 - RNA, 16 nt, Salmonella enterica enterica serovar Typhi
aaaaagccucugauuu

SEQ ID NO: 1690831 - RNA, 17 nt, Salmonella enterica enterica serovar Typhi
aaaaagccucugauuuc

SEQ ID NO: 1690832 - RNA, 19 nt, Salmonella enterica enterica serovar Typhi
aaaaagcgucaguaaaagc

SEQ ID NO: 1690833 - RNA, 15 nt, Salmonella enterica enterica serovar Typhi
aaaaagguaacuauu

SEQ ID NO: 1690834 - RNA, 15 nt, Salmonella enterica enterica serovar Typhi
aaaaaggcagaagaa

SEQ ID NO: 1690835 - RNA, 21 nt, Salmonella enterica enterica serovar Typhi
aaaaaggccgcuuaauaauaa

SEQ ID NO: 1690836 - RNA, 15 nt, Salmonella enterica enterica serovar Typhi
aaaaagauaaccauu

SEQ ID NO: 1690837 - RNA, 21 nt, Salmonella enterica enterica serovar Typhi
aaaaagccacgcaagcagcac

SEQ ID NO: 1690838 - RNA, 23 nt, Salmonella enterica enterica serovar Typhi
aaaaucuggcgagagcauugccu

SEQ ID NO: 1690839 - RNA, 22 nt, Salmonella enterica enterica serovar Typhi
aaaaucagcccggacaucaucc

SEQ ID NO: 1690840 - RNA, 20 nt, Salmonella enterica enterica serovar Typhi
aaaauaucauuaaaucaaaa

SEQ ID NO: 1690841 - RNA, 20 nt, Salmonella enterica enterica serovar Typhi
aaaaugugcaaagagaccgg

SEQ ID NO: 1690842 - RNA, 21 nt, Salmonella enterica enterica serovar Typhi
aaaaugugagccauaacaacu

SEQ ID NO: 1690843 - RNA, 13 nt, Salmonella enterica enterica serovar Typhi
aaaauguucaugu

SEQ ID NO: 1690844 - RNA, 20 nt, Salmonella enterica enterica serovar Typhi
aaaaugaggacacaguaaug

SEQ ID NO: 1690845 - RNA, 14 nt, Salmonella enterica enterica serovar Typhi
aaaaugaauaccaa

SEQ ID NO: 1690846 - RNA, 23 nt, Salmonella enterica enterica serovar Typhi
aaaauggggaucgucugcaaaac

SEQ ID NO: 1690847 - RNA, 16 nt, Salmonella enterica enterica serovar Typhi
aaaaugggcuggaaau

SEQ ID NO: 1690848 - RNA, 19 nt, Salmonella enterica enterica serovar Typhi
aaaauggucugccaguagc

SEQ ID NO: 1690849 - RNA, 17 nt, Salmonella enterica enterica serovar Typhi
aaaauggcaaguaaaau

SEQ ID NO: 1690850 - RNA, 21 nt, Salmonella enterica enterica serovar Typhi
aaaauggcugauaaauccggu

SEQ ID NO: 1690851 - RNA, 19 nt, Salmonella enterica enterica serovar Typhi
aaaagguggguuccagcgc

SEQ ID NO: 1690852 - RNA, 15 nt, Salmonella enterica enterica serovar Typhi
aaaagucauuuucau

SEQ ID NO: 1690853 - RNA, 18 nt, Salmonella enterica enterica serovar Typhi
aaaaggcgguucccgggc

SEQ ID NO: 1690854 - RNA, 16 nt, Salmonella enterica enterica serovar Typhi
aaaagggaaaagccau

SEQ ID NO: 1690855 - RNA, 20 nt, Salmonella enterica enterica serovar Typhi
aaaaggcgacgaugugcaua

SEQ ID NO: 1690856 - RNA, 19 nt, Salmonella enterica enterica serovar Typhi
aaaaggccuggcugagaaa

SEQ ID NO: 1690857 - RNA, 22 nt, Salmonella enterica enterica serovar Typhi
aaaaggcagagcgcgcucugcc

SEQ ID NO: 1690858 - RNA, 16 nt, Salmonella enterica enterica serovar Typhi
aaaaggauacagcgcc

SEQ ID NO: 1690859 - RNA, 20 nt, Salmonella enterica enterica serovar Typhi
aaaagguuagguuaaauagu

SEQ ID NO: 1690860 - RNA, 11 nt, Salmonella enterica enterica serovar Typhi
aaaauaaaaaa

SEQ ID NO: 1690861 - RNA, 13 nt, Salmonella enterica enterica serovar Typhi
aaaacgccuguaa

SEQ ID NO: 1690862 - RNA, 12 nt, Salmonella enterica enterica serovar Typhi
aaaacgccugcc

SEQ ID NO: 1690863 - RNA, 21 nt, Salmonella enterica enterica serovar Typhi
aaaacgcucucuuuucuuacu

SEQ ID NO: 1690864 - RNA, 22 nt, Salmonella enterica enterica serovar Typhi
aaaacgcgcucgccagcgcugu

SEQ ID NO: 1690865 - RNA, 18 nt, Salmonella enterica enterica serovar Typhi
aaaacgcgcucgccagcg

SEQ ID NO: 1690866 - RNA, 19 nt, Salmonella enterica enterica serovar Typhi
aaaacgcgcucgccagcgc

SEQ ID NO: 1690867 - RNA, 15 nt, Salmonella enterica enterica serovar Typhi
aaaagcgcccagcgc

SEQ ID NO: 1690868 - RNA, 15 nt, Salmonella enterica enterica serovar Typhi
aaaagcgccccuggg

SEQ ID NO: 1690869 - RNA, 21 nt, Salmonella enterica enterica serovar Typhi
aaaacgccgccuugcggcggc

SEQ ID NO: 1690870 - RNA, 12 nt, Salmonella enterica enterica serovar Typhi
aaaaagaaaaaa

SEQ ID NO: 1690871 - RNA, 20 nt, Salmonella enterica enterica serovar Typhi
aaaaagaacggcaaauugag

SEQ ID NO: 1690872 - RNA, 22 nt, Salmonella enterica enterica serovar Typhi
aaaaacuuauuucuaucgcuau

SEQ ID NO: 1690873 - RNA, 19 nt, Salmonella enterica enterica serovar Typhi
aaaagcuguagcauaaaug

SEQ ID NO: 1690874 - RNA, 20 nt, Salmonella enterica enterica serovar Typhi
aaaagcuguagcauaaaugc

SEQ ID NO: 1690875 - RNA, 17 nt, Salmonella enterica enterica serovar Typhi
aaacagcacgcucaaau

SEQ ID NO: 1690876 - RNA, 20 nt, Salmonella enterica enterica serovar Typhi
aaacagauaagcgucugcaa

SEQ ID NO: 1690877 - RNA, 14 nt, Salmonella enterica enterica serovar Typhi
aaacagacaauuag

SEQ ID NO: 1690878 - RNA, 18 nt, Salmonella enterica enterica serovar Typhi
aaacacuuccccugccag

SEQ ID NO: 1690879 - RNA, 16 nt, Salmonella enterica enterica serovar Typhi
aaacagccaaucauaa

SEQ ID NO: 1690880 - RNA, 17 nt, Salmonella enterica enterica serovar Typhi
aaacagccaaucauaaa

SEQ ID NO: 1690881 - RNA, 23 nt, Salmonella enterica enterica serovar Typhi
aaacagcgccaguuuuuccuguu

SEQ ID NO: 1690882 - RNA, 15 nt, Salmonella enterica enterica serovar Typhi
aaacaggaaaaacau

SEQ ID NO: 1690883 - RNA, 14 nt, Salmonella enterica enterica serovar Typhi
aaacagcuguaaau

SEQ ID NO: 1690884 - RNA, 16 nt, Salmonella enterica enterica serovar Typhi
aaacagcuguaaaucg

SEQ ID NO: 1690885 - RNA, 16 nt, Salmonella enterica enterica serovar Typhi
aaacauauagcaguuu

SEQ ID NO: 1690886 - RNA, 16 nt, Salmonella enterica enterica serovar Typhi
aaacauauaauuaaca

SEQ ID NO: 1690887 - RNA, 19 nt, Salmonella enterica enterica serovar Typhi
aaacagguaaaacaaaaaa

SEQ ID NO: 1690888 - RNA, 19 nt, Salmonella enterica enterica serovar Typhi
aaacaguccggcgaaaaaa

SEQ ID NO: 1690889 - RNA, 16 nt, Salmonella enterica enterica serovar Typhi
aaacagugauuacaaa

SEQ ID NO: 1690890 - RNA, 19 nt, Salmonella enterica enterica serovar Typhi
aaacaccgcucaauaucau

SEQ ID NO: 1690891 - RNA, 17 nt, Salmonella enterica enterica serovar Typhi
aaacaccggggcauuuc

SEQ ID NO: 1690892 - RNA, 19 nt, Salmonella enterica enterica serovar Typhi
aaacaccggggcauuucca

SEQ ID NO: 1690893 - RNA, 23 nt, Salmonella enterica enterica serovar Typhi
aaacaccugucugucaaaaccca

SEQ ID NO: 1690894 - RNA, 15 nt, Salmonella enterica enterica serovar Typhi
aaacacgucuggaaa

SEQ ID NO: 1690895 - RNA, 16 nt, Salmonella enterica enterica serovar Typhi
aaacacgccgcgcugg

SEQ ID NO: 1690896 - RNA, 17 nt, Salmonella enterica enterica serovar Typhi
aaacacgccuccauaca

SEQ ID NO: 1690897 - RNA, 14 nt, Salmonella enterica enterica serovar Typhi
aaacacuaaaucau

SEQ ID NO: 1690898 - RNA, 14 nt, Salmonella enterica enterica serovar Typhi
aaacaccagaaugc

SEQ ID NO: 1690899 - RNA, 12 nt, Salmonella enterica enterica serovar Typhi
aaacaccaacaa

SEQ ID NO: 1690900 - RNA, 11 nt, Salmonella enterica enterica serovar Typhi
aaacaccagaa

SEQ ID NO: 1690901 - RNA, 22 nt, Salmonella enterica enterica serovar Typhi
aaacacaaucacaacgucaucc

SEQ ID NO: 1690902 - RNA, 17 nt, Salmonella enterica enterica serovar Typhi
aaacaauuuacgcagcc

SEQ ID NO: 1690903 - RNA, 14 nt, Salmonella enterica enterica serovar Typhi
aaaauugaauuaag

SEQ ID NO: 1690904 - RNA, 12 nt, Salmonella enterica enterica serovar Typhi
aaacaauauccc

SEQ ID NO: 1690905 - RNA, 18 nt, Salmonella enterica enterica serovar Typhi
aaacaucagcgcaugccc

SEQ ID NO: 1690906 - RNA, 14 nt, Salmonella enterica enterica serovar Typhi
aaacaucccgauaa

SEQ ID NO: 1690907 - RNA, 24 nt, Salmonella enterica enterica serovar Typhi
aaacaucauggcuuaaaacgauuu

SEQ ID NO: 1690908 - RNA, 22 nt, Salmonella enterica enterica serovar Typhi
aaacaucgcugauauuguugaa

SEQ ID NO: 1690909 - RNA, 17 nt, Salmonella enterica enterica serovar Typhi
aaacaugucaaaauccu

SEQ ID NO: 1690910 - RNA, 14 nt, Salmonella enterica enterica serovar Typhi
aaaccacaaucaca

SEQ ID NO: 1690911 - RNA, 16 nt, Salmonella enterica enterica serovar Typhi
aaaccacgcugaggcg

SEQ ID NO: 1690912 - RNA, 14 nt, Salmonella enterica enterica serovar Typhi
aaaccaaacaccag

SEQ ID NO: 1690913 - RNA, 18 nt, Salmonella enterica enterica serovar Typhi
aaaccaaagguauugccu

SEQ ID NO: 1690914 - RNA, 15 nt, Salmonella enterica enterica serovar Typhi
aaaccaaacuuaucu

SEQ ID NO: 1690915 - RNA, 20 nt, Salmonella enterica enterica serovar Typhi
aaaccaaccacggggcaugc

SEQ ID NO: 1690916 - RNA, 22 nt, Salmonella enterica enterica serovar Typhi
aaaccgcucgccgccucccccu

SEQ ID NO: 1690917 - RNA, 19 nt, Salmonella enterica enterica serovar Typhi
aaaccgcagaaggucacgc

SEQ ID NO: 1690918 - RNA, 19 nt, Salmonella enterica enterica serovar Typhi
aaaccgccgcuuugauuug

SEQ ID NO: 1690919 - RNA, 17 nt, Salmonella enterica enterica serovar Typhi
aaaccgccucaauugcc

SEQ ID NO: 1690920 - RNA, 23 nt, Salmonella enterica enterica serovar Typhi
aaaccggcgcgccuuccagcaau

SEQ ID NO: 1690921 - RNA, 15 nt, Salmonella enterica enterica serovar Typhi
aaaccggggagcuau

SEQ ID NO: 1690922 - RNA, 15 nt, Salmonella enterica enterica serovar Typhi
aaaccguagauuuuc

SEQ ID NO: 1690923 - RNA, 18 nt, Salmonella enterica enterica serovar Typhi
aaacccguuaaauaccag

SEQ ID NO: 1690924 - RNA, 15 nt, Salmonella enterica enterica serovar Typhi
aaaccgaauucgucc

SEQ ID NO: 1690925 - RNA, 15 nt, Salmonella enterica enterica serovar Typhi
aaaccgcagaaaaag

SEQ ID NO: 1690926 - RNA, 16 nt, Salmonella enterica enterica serovar Typhi
aaaccgaucucccagc

SEQ ID NO: 1690927 - RNA, 16 nt, Salmonella enterica enterica serovar Typhi
aaaccgacagcaauau

SEQ ID NO: 1690928 - RNA, 16 nt, Salmonella enterica enterica serovar Typhi
aaaccgacccaaaaau

SEQ ID NO: 1690929 - RNA, 16 nt, Salmonella enterica enterica serovar Typhi
aaaccagcauaauauu

SEQ ID NO: 1690930 - RNA, 12 nt, Salmonella enterica enterica serovar Typhi
aaaccaguucac

SEQ ID NO: 1690931 - RNA, 18 nt, Salmonella enterica enterica serovar Typhi
aaaccaggcacugcaggc

SEQ ID NO: 1690932 - RNA, 18 nt, Salmonella enterica enterica serovar Typhi
aaaccauaaacaaaacaa

SEQ ID NO: 1690933 - RNA, 15 nt, Salmonella enterica enterica serovar Typhi
aaacccauauuccug

SEQ ID NO: 1690934 - RNA, 15 nt, Salmonella enterica enterica serovar Typhi
aacaaccagaauaau

SEQ ID NO: 1690935 - RNA, 18 nt, Salmonella enterica enterica serovar Typhi
aacaaauaaauccaugag

SEQ ID NO: 1690936 - RNA, 17 nt, Salmonella enterica enterica serovar Typhi
aacaaauaaauccauga

SEQ ID NO: 1690937 - RNA, 11 nt, Salmonella enterica enterica serovar Typhi
aacaaaugaag

SEQ ID NO: 1690938 - RNA, 14 nt, Salmonella enterica enterica serovar Typhi
aacaacggcacaca

SEQ ID NO: 1690939 - RNA, 14 nt, Salmonella enterica enterica serovar Typhi
aacaaaagaaagca

SEQ ID NO: 1690940 - RNA, 16 nt, Salmonella enterica enterica serovar Typhi
aacaaaacggaauguu

SEQ ID NO: 1690941 - RNA, 14 nt, Salmonella enterica enterica serovar Typhi
aacaaaccaaacug

SEQ ID NO: 1690942 - RNA, 23 nt, Salmonella enterica enterica serovar Typhi
aacaaagguuuguuuaauuuugu

SEQ ID NO: 1690943 - RNA, 14 nt, Salmonella enterica enterica serovar Typhi
aacaaaaccagcau

SEQ ID NO: 1690944 - RNA, 19 nt, Salmonella enterica enterica serovar Typhi
aacaaaaaccugcucucgg

SEQ ID NO: 1690945 - RNA, 23 nt, Salmonella enterica enterica serovar Typhi
aacaaaaaccugcucucgggcag

SEQ ID NO: 1690946 - RNA, 22 nt, Salmonella enterica enterica serovar Typhi
aaauuuucaauacgucauauca

SEQ ID NO: 1690947 - RNA, 22 nt, Salmonella enterica enterica serovar Typhi
aaauugaauuaagcaauccauu

SEQ ID NO: 1690948 - RNA, 14 nt, Salmonella enterica enterica serovar Typhi
aaauugaauuauaa

SEQ ID NO: 1690949 - RNA, 15 nt, Salmonella enterica enterica serovar Typhi
aaauugaucacaaaa

SEQ ID NO: 1690950 - RNA, 16 nt, Salmonella enterica enterica serovar Typhi
aaauuccaauauuuau

SEQ ID NO: 1690951 - RNA, 12 nt, Salmonella enterica enterica serovar Typhi
aaauugcagggu

SEQ ID NO: 1690952 - RNA, 20 nt, Salmonella enterica enterica serovar Typhi
aaauugccgcgcccugcgga

SEQ ID NO: 1690953 - RNA, 16 nt, Salmonella enterica enterica serovar Typhi
aaauugccugauggcg

SEQ ID NO: 1690954 - RNA, 15 nt, Salmonella enterica enterica serovar Typhi
aaauuggugauauaa

SEQ ID NO: 1690955 - RNA, 22 nt, Salmonella enterica enterica serovar Typhi
aaauuggguaguaauauuaaaa

SEQ ID NO: 1690956 - RNA, 17 nt, Salmonella enterica enterica serovar Typhi
aaauuggcucagaauuu

SEQ ID NO: 1690957 - RNA, 17 nt, Salmonella enterica enterica serovar Typhi
aaauuggaguuaucauu

SEQ ID NO: 1690958 - RNA, 13 nt, Salmonella enterica enterica serovar Typhi
aaauugcugaugu

SEQ ID NO: 1690959 - RNA, 20 nt, Salmonella enterica enterica serovar Typhi
aaauuuccgcagccagaauc

SEQ ID NO: 1690960 - RNA, 21 nt, Salmonella enterica enterica serovar Typhi
aaauuucgaaacaggaaaaac

SEQ ID NO: 1690961 - RNA, 22 nt, Salmonella enterica enterica serovar Typhi
aaauuucaacccgaucgccauc

SEQ ID NO: 1690962 - RNA, 20 nt, Salmonella enterica enterica serovar Typhi
aaauuuauuuuuugcuggga

SEQ ID NO: 1690963 - RNA, 13 nt, Salmonella enterica enterica serovar Typhi
aaauuuagcuauu

SEQ ID NO: 1690964 - RNA, 19 nt, Salmonella enterica enterica serovar Typhi
aaauuuagcuauuccaaaa

SEQ ID NO: 1690965 - RNA, 22 nt, Salmonella enterica enterica serovar Typhi
aaauuuagcuauuccaaaauaa

SEQ ID NO: 1690966 - RNA, 19 nt, Salmonella enterica enterica serovar Typhi
aaauccggcugccugccgg

SEQ ID NO: 1690967 - RNA, 17 nt, Salmonella enterica enterica serovar Typhi
aaauccucauuaguuca

SEQ ID NO: 1690968 - RNA, 18 nt, Salmonella enterica enterica serovar Typhi
aaauccucccaucgagcc

SEQ ID NO: 1690969 - RNA, 16 nt, Salmonella enterica enterica serovar Typhi
aaauccucuauuuuuu

SEQ ID NO: 1690970 - RNA, 12 nt, Salmonella enterica enterica serovar Typhi
aaaucccugauc

SEQ ID NO: 1690971 - RNA, 16 nt, Salmonella enterica enterica serovar Typhi
aaaucccgguuuuuuu

SEQ ID NO: 1690972 - RNA, 21 nt, Salmonella enterica enterica serovar Typhi
aaauccgcgcucggucacuuc

SEQ ID NO: 1690973 - RNA, 18 nt, Salmonella enterica enterica serovar Typhi
aaauccgccggaaacugg

SEQ ID NO: 1690974 - RNA, 16 nt, Salmonella enterica enterica serovar Typhi
aaaucggaccuccgcg

SEQ ID NO: 1690975 - RNA, 17 nt, Salmonella enterica enterica serovar Typhi
aaauccacaaccggcug

SEQ ID NO: 1690976 - RNA, 12 nt, Salmonella enterica enterica serovar Typhi
aaauccaauaga

SEQ ID NO: 1690977 - RNA, 20 nt, Salmonella enterica enterica serovar Typhi
aaauauuaaugaauaaauga

SEQ ID NO: 1690978 - RNA, 14 nt, Salmonella enterica enterica serovar Typhi
aaauauuaauuaag

SEQ ID NO: 1690979 - RNA, 19 nt, Salmonella enterica enterica serovar Typhi
aaauauuacaacauguccu

SEQ ID NO: 1690980 - RNA, 22 nt, Salmonella enterica enterica serovar Typhi
aaaucccggcgauuaauaaaau

SEQ ID NO: 1690981 - RNA, 23 nt, Salmonella enterica enterica serovar Typhi
aaaucccccaacgucaccaucaa

SEQ ID NO: 1690982 - RNA, 20 nt, Salmonella enterica enterica serovar Typhi
aaauccagcagaauaacauc

SEQ ID NO: 1690983 - RNA, 17 nt, Salmonella enterica enterica serovar Typhi
aaauccagggaaaccau

SEQ ID NO: 1690984 - RNA, 15 nt, Salmonella enterica enterica serovar Typhi
aaauccagcucaguu

SEQ ID NO: 1690985 - RNA, 19 nt, Salmonella enterica enterica serovar Typhi
aaauccagggaaaccaugu

SEQ ID NO: 1690986 - RNA, 13 nt, Salmonella enterica enterica serovar Typhi
aaaugaggugaaa

SEQ ID NO: 1690987 - RNA, 13 nt, Salmonella enterica enterica serovar Typhi
aaaugacgccugu

SEQ ID NO: 1690988 - RNA, 23 nt, Salmonella enterica enterica serovar Typhi
aaaucuuucuccugguuuuucca

SEQ ID NO: 1690989 - RNA, 19 nt, Salmonella enterica enterica serovar Typhi
aaaucugccgucaucgacu

SEQ ID NO: 1690990 - RNA, 15 nt, Salmonella enterica enterica serovar Typhi
aaaucgucaucagau

SEQ ID NO: 1690991 - RNA, 22 nt, Salmonella enterica enterica serovar Typhi
aaaucguauuggggaucgggca

SEQ ID NO: 1690992 - RNA, 12 nt, Salmonella enterica enterica serovar Typhi
aaaugauauuua

SEQ ID NO: 1690993 - RNA, 21 nt, Salmonella enterica enterica serovar Typhi
aaaugcacugcaauuucugcu

SEQ ID NO: 1690994 - RNA, 10 nt, Salmonella enterica enterica serovar Typhi
aaaugauaag

SEQ ID NO: 1690995 - RNA, 19 nt, Salmonella enterica enterica serovar Typhi
aaaugcccauaaagaaaua

SEQ ID NO: 1690996 - RNA, 20 nt, Salmonella enterica enterica serovar Typhi
aaaugcccauaaagaaauau

SEQ ID NO: 1690997 - RNA, 18 nt, Salmonella enterica enterica serovar Typhi
aaaugucccgauauuggu

SEQ ID NO: 1690998 - RNA, 23 nt, Salmonella enterica enterica serovar Typhi
aaauggucagccauaaccuccuu

SEQ ID NO: 1690999 - RNA, 14 nt, Salmonella enterica enterica serovar Typhi
aaaugguuuugccc

SEQ ID NO: 1691000 - RNA, 15 nt, Salmonella enterica enterica serovar Typhi
aaaaagcaaagaggu

SEQ ID NO: 1691001 - RNA, 12 nt, Salmonella enterica enterica serovar Typhi
aaauuaaucagg

SEQ ID NO: 1691002 - RNA, 13 nt, Salmonella enterica enterica serovar Typhi
aaauuaaucgcca

SEQ ID NO: 1691003 - RNA, 18 nt, Salmonella enterica enterica serovar Typhi
aaauuaaucgccagcagc

SEQ ID NO: 1691004 - RNA, 15 nt, Salmonella enterica enterica serovar Typhi
aaauuaaugauuaaa

SEQ ID NO: 1691005 - RNA, 18 nt, Salmonella enterica enterica serovar Typhi
aaauuaaugauuaaaaua

SEQ ID NO: 1691006 - RNA, 19 nt, Salmonella enterica enterica serovar Typhi
aaauuaaugauuaaaauaa

SEQ ID NO: 1691007 - RNA, 20 nt, Salmonella enterica enterica serovar Typhi
aaauuaaugauuaaaauaaa

SEQ ID NO: 1691008 - RNA, 14 nt, Salmonella enterica enterica serovar Typhi
aaauuaaaaauacc

SEQ ID NO: 1691009 - RNA, 13 nt, Salmonella enterica enterica serovar Typhi
aaauuaaaaauac

SEQ ID NO: 1691010 - RNA, 11 nt, Salmonella enterica enterica serovar Typhi
aaaaagagaag

SEQ ID NO: 1691011 - RNA, 17 nt, Salmonella enterica enterica serovar Typhi
aaauuacuuaugauaua

SEQ ID NO: 1691012 - RNA, 22 nt, Salmonella enterica enterica serovar Typhi
aaauuagcucccgcgauagguu

SEQ ID NO: 1691013 - RNA, 19 nt, Salmonella enterica enterica serovar Typhi
aaauuauuuuuacuuaaaa

SEQ ID NO: 1691014 - RNA, 21 nt, Salmonella enterica enterica serovar Typhi
aaauuauuuuuacuuaaaauu

SEQ ID NO: 1691015 - RNA, 15 nt, Salmonella enterica enterica serovar Typhi
aaauuauuuuaaauu

SEQ ID NO: 1691016 - RNA, 19 nt, Salmonella enterica enterica serovar Typhi
aaaguauaaagcugguuga

SEQ ID NO: 1691017 - RNA, 22 nt, Salmonella enterica enterica serovar Typhi
aaaguacuucacaaucagcgca

SEQ ID NO: 1691018 - RNA, 15 nt, Salmonella enterica enterica serovar Typhi
aaaguggugggugau

SEQ ID NO: 1691019 - RNA, 19 nt, Salmonella enterica enterica serovar Typhi
aaaguggcauccgaagaac

SEQ ID NO: 1691020 - RNA, 12 nt, Salmonella enterica enterica serovar Typhi
aaauaaaaccag

SEQ ID NO: 1691021 - RNA, 13 nt, Salmonella enterica enterica serovar Typhi
aaauaaaaauucc

SEQ ID NO: 1691022 - RNA, 19 nt, Salmonella enterica enterica serovar Typhi
aaauaaagugcugaacaau

SEQ ID NO: 1691023 - RNA, 11 nt, Salmonella enterica enterica serovar Typhi
aaauaaauaaa

SEQ ID NO: 1691024 - RNA, 16 nt, Salmonella enterica enterica serovar Typhi
aaauaaauaaaaccag

SEQ ID NO: 1691025 - RNA, 13 nt, Salmonella enterica enterica serovar Typhi
aaaguuuuucaua

SEQ ID NO: 1691026 - RNA, 12 nt, Salmonella enterica enterica serovar Typhi
aaaguuugaagu

SEQ ID NO: 1691027 - RNA, 13 nt, Salmonella enterica enterica serovar Typhi
aaaguuauucacg

SEQ ID NO: 1691028 - RNA, 19 nt, Salmonella enterica enterica serovar Typhi
aaaguuagccccuuaucaa

SEQ ID NO: 1691029 - RNA, 16 nt, Salmonella enterica enterica serovar Typhi
aaaguuacuuuccaua

SEQ ID NO: 1691030 - RNA, 14 nt, Salmonella enterica enterica serovar Typhi
aaaguuaaucagcg

SEQ ID NO: 1691031 - RNA, 12 nt, Salmonella enterica enterica serovar Typhi
aaaguuucagga

SEQ ID NO: 1691032 - RNA, 16 nt, Salmonella enterica enterica serovar Typhi
aaaguuuauuugaaua

SEQ ID NO: 1691033 - RNA, 18 nt, Salmonella enterica enterica serovar Typhi
aaauaaauauguuauuua

SEQ ID NO: 1691034 - RNA, 20 nt, Salmonella enterica enterica serovar Typhi
aaauaaauauguuauuuaca

SEQ ID NO: 1691035 - RNA, 17 nt, Salmonella enterica enterica serovar Typhi
aaauaauuuuguuaaag

SEQ ID NO: 1691036 - RNA, 12 nt, Salmonella enterica enterica serovar Typhi
aaauaauuuuua

SEQ ID NO: 1691037 - RNA, 22 nt, Salmonella enterica enterica serovar Typhi
aaauacaccaaacgaauuuaaa

SEQ ID NO: 1691038 - RNA, 15 nt, Salmonella enterica enterica serovar Typhi
aaauacccucaguuc

SEQ ID NO: 1691039 - RNA, 14 nt, Salmonella enterica enterica serovar Typhi
aaauaccaaauauu

SEQ ID NO: 1691040 - RNA, 14 nt, Salmonella enterica enterica serovar Typhi
aaauagaaaauaau

SEQ ID NO: 1691041 - RNA, 13 nt, Salmonella enterica enterica serovar Typhi
aaauagaaaauaa

SEQ ID NO: 1691042 - RNA, 13 nt, Salmonella enterica enterica serovar Typhi
aaauaucucuccc

SEQ ID NO: 1691043 - RNA, 17 nt, Salmonella enterica enterica serovar Typhi
aaauaucgcugcccaga

SEQ ID NO: 1691044 - RNA, 10 nt, Salmonella enterica enterica serovar Typhi
aaauauccua

SEQ ID NO: 1691045 - RNA, 19 nt, Salmonella enterica enterica serovar Typhi
aaauauccuccgccgauaa

SEQ ID NO: 1691046 - RNA, 16 nt, Salmonella enterica enterica serovar Typhi
aaauauauaauuuaua

SEQ ID NO: 1691047 - RNA, 16 nt, Salmonella enterica enterica serovar Typhi
aaauauagcuuuucau

SEQ ID NO: 1691048 - RNA, 20 nt, Salmonella enterica enterica serovar Typhi
aaauauagccauuuaaugau

SEQ ID NO: 1691049 - RNA, 21 nt, Salmonella enterica enterica serovar Typhi
aaauauagccauuuaaugaug

SEQ ID NO: 1691050 - RNA, 15 nt, Salmonella enterica enterica serovar Typhi
aaauagcaauuauau

SEQ ID NO: 1691051 - RNA, 13 nt, Salmonella enterica enterica serovar Typhi
aaauagagaaaau

SEQ ID NO: 1691052 - RNA, 15 nt, Salmonella enterica enterica serovar Typhi
aaauagagaaaauaa

SEQ ID NO: 1691053 - RNA, 23 nt, Salmonella enterica enterica serovar Typhi
aaauagaucaucuauaauaccuc

SEQ ID NO: 1691054 - RNA, 22 nt, Salmonella enterica enterica serovar Typhi
aaagagguugacgcuucaaggc

SEQ ID NO: 1691055 - RNA, 18 nt, Salmonella enterica enterica serovar Typhi
aaagacaugaucuuaccu

SEQ ID NO: 1691056 - RNA, 17 nt, Salmonella enterica enterica serovar Typhi
aaagacauaggccggcg

SEQ ID NO: 1691057 - RNA, 18 nt, Salmonella enterica enterica serovar Typhi
aaagcacagccccagcac

SEQ ID NO: 1691058 - RNA, 13 nt, Salmonella enterica enterica serovar Typhi
aaagcagcugcug

SEQ ID NO: 1691059 - RNA, 14 nt, Salmonella enterica enterica serovar Typhi
aaagcagcugcugg

SEQ ID NO: 1691060 - RNA, 17 nt, Salmonella enterica enterica serovar Typhi
aaagcaaucgccagcgc

SEQ ID NO: 1691061 - RNA, 14 nt, Salmonella enterica enterica serovar Typhi
aaagauuggcaucu

SEQ ID NO: 1691062 - RNA, 16 nt, Salmonella enterica enterica serovar Typhi
aaagcaaucgccagcg

SEQ ID NO: 1691063 - RNA, 16 nt, Salmonella enterica enterica serovar Typhi
aaagauuagccccagc

SEQ ID NO: 1691064 - RNA, 15 nt, Salmonella enterica enterica serovar Typhi
aaaccguuaugaauc

SEQ ID NO: 1691065 - RNA, 20 nt, Salmonella enterica enterica serovar Typhi
aaaccggucagguagcagac

SEQ ID NO: 1691066 - RNA, 14 nt, Salmonella enterica enterica serovar Typhi
aaagaaagcauuaa

SEQ ID NO: 1691067 - RNA, 18 nt, Salmonella enterica enterica serovar Typhi
aaagaaaguagaucacca

SEQ ID NO: 1691068 - RNA, 10 nt, Salmonella enterica enterica serovar Typhi
aaagaaaaac

SEQ ID NO: 1691069 - RNA, 14 nt, Salmonella enterica enterica serovar Typhi
aaagaaaacaucag

SEQ ID NO: 1691070 - RNA, 23 nt, Salmonella enterica enterica serovar Typhi
aaagaacguguuuuuccagcaac

SEQ ID NO: 1691071 - RNA, 22 nt, Salmonella enterica enterica serovar Typhi
aaagaacgacgaauaagcugaa

SEQ ID NO: 1691072 - RNA, 16 nt, Salmonella enterica enterica serovar Typhi
aaagaaucgccagucg

SEQ ID NO: 1691073 - RNA, 18 nt, Salmonella enterica enterica serovar Typhi
aaagaaugaaaaaaaaau

SEQ ID NO: 1691074 - RNA, 22 nt, Salmonella enterica enterica serovar Typhi
aaaggucuuucuguguugcuca

SEQ ID NO: 1691075 - RNA, 12 nt, Salmonella enterica enterica serovar Typhi
aaaggcuuuaaa

SEQ ID NO: 1691076 - RNA, 12 nt, Salmonella enterica enterica serovar Typhi
aaagcugccuuu

SEQ ID NO: 1691077 - RNA, 15 nt, Salmonella enterica enterica serovar Typhi
aaaggaaagggacga

SEQ ID NO: 1691078 - RNA, 23 nt, Salmonella enterica enterica serovar Typhi
aaaggccuggcugagaaaaauac

SEQ ID NO: 1691079 - RNA, 12 nt, Salmonella enterica enterica serovar Typhi
aaaggaucgauu

SEQ ID NO: 1691080 - RNA, 16 nt, Salmonella enterica enterica serovar Typhi
aaaggagccuuacggc

SEQ ID NO: 1691081 - RNA, 19 nt, Salmonella enterica enterica serovar Typhi
aaagccuguuuaccaagca

SEQ ID NO: 1691082 - RNA, 23 nt, Salmonella enterica enterica serovar Typhi
aaagcgaccggcacucaccucuu

SEQ ID NO: 1691083 - RNA, 14 nt, Salmonella enterica enterica serovar Typhi
aaagcgaccucuug

SEQ ID NO: 1691084 - RNA, 19 nt, Salmonella enterica enterica serovar Typhi
aaagcgacucauccacaua

SEQ ID NO: 1691085 - RNA, 12 nt, Salmonella enterica enterica serovar Typhi
aaagcagugcag

SEQ ID NO: 1691086 - RNA, 14 nt, Salmonella enterica enterica serovar Typhi
aaagcauaaccaaa

SEQ ID NO: 1691087 - RNA, 20 nt, Salmonella enterica enterica serovar Typhi
aaagccguauuuuauuuuuc

SEQ ID NO: 1691088 - RNA, 17 nt, Salmonella enterica enterica serovar Typhi
aaagcuauucacaccuu

SEQ ID NO: 1691089 - RNA, 15 nt, Salmonella enterica enterica serovar Typhi
aaagcggccuuuuuu

SEQ ID NO: 1691090 - RNA, 13 nt, Salmonella enterica enterica serovar Typhi
aaagcggcgaaua

SEQ ID NO: 1691091 - RNA, 14 nt, Salmonella enterica enterica serovar Typhi
aaagcggcuguagc

SEQ ID NO: 1691092 - RNA, 22 nt, Salmonella enterica enterica serovar Typhi
aaagcgcucguuauaauugccc

SEQ ID NO: 1691093 - RNA, 22 nt, Salmonella enterica enterica serovar Typhi
aaagcgcgagggauuaucuuua

SEQ ID NO: 1691094 - RNA, 21 nt, Salmonella enterica enterica serovar Typhi
aaagcgcgccgaaaauauaca

SEQ ID NO: 1691095 - RNA, 15 nt, Salmonella enterica enterica serovar Typhi
aacaggccugcggaa

SEQ ID NO: 1691096 - RNA, 13 nt, Salmonella enterica enterica serovar Typhi
aacaggcgaaaac

SEQ ID NO: 1691097 - RNA, 20 nt, Salmonella enterica enterica serovar Typhi
aacaggccaaacccugcgcc

SEQ ID NO: 1691098 - RNA, 19 nt, Salmonella enterica enterica serovar Typhi
aacaggcuuuauacaguaa

SEQ ID NO: 1691099 - RNA, 23 nt, Salmonella enterica enterica serovar Typhi
aacaggcugcguaacgcgccgga

SEQ ID NO: 1691100 - RNA, 18 nt, Salmonella enterica enterica serovar Typhi
aacagggggcgcaucacu

SEQ ID NO: 1691101 - RNA, 13 nt, Salmonella enterica enterica serovar Typhi
aacaggucacaug

SEQ ID NO: 1691102 - RNA, 19 nt, Salmonella enterica enterica serovar Typhi
aacagguuaaucagcacau

SEQ ID NO: 1691103 - RNA, 18 nt, Salmonella enterica enterica serovar Typhi
aacaguaccugauaaaau

SEQ ID NO: 1691104 - RNA, 15 nt, Salmonella enterica enterica serovar Typhi
aacaguacggucagg

SEQ ID NO: 1691105 - RNA, 22 nt, Salmonella enterica enterica serovar Typhi
aacagcgugaacacgccccaca

SEQ ID NO: 1691106 - RNA, 14 nt, Salmonella enterica enterica serovar Typhi
aacagcuugaucau

SEQ ID NO: 1691107 - RNA, 15 nt, Salmonella enterica enterica serovar Typhi
aacagcgccggcagc

SEQ ID NO: 1691108 - RNA, 20 nt, Salmonella enterica enterica serovar Typhi
aacagcgccggcagcaguuc

SEQ ID NO: 1691109 - RNA, 13 nt, Salmonella enterica enterica serovar Typhi
aacaagggcauaa

SEQ ID NO: 1691110 - RNA, 18 nt, Salmonella enterica enterica serovar Typhi
aacaagggcauaaugauu

SEQ ID NO: 1691111 - RNA, 18 nt, Salmonella enterica enterica serovar Typhi
aacagcgcugguagcacc

SEQ ID NO: 1691112 - RNA, 19 nt, Salmonella enterica enterica serovar Typhi
aacagcgcuaucaggaaga

SEQ ID NO: 1691113 - RNA, 12 nt, Salmonella enterica enterica serovar Typhi
aacaucauaaua

SEQ ID NO: 1691114 - RNA, 15 nt, Salmonella enterica enterica serovar Typhi
aacaucaaguacagc

SEQ ID NO: 1691115 - RNA, 16 nt, Salmonella enterica enterica serovar Typhi
aacaucaccuuucauu

SEQ ID NO: 1691116 - RNA, 16 nt, Salmonella enterica enterica serovar Typhi
aacaucagccagcagc

SEQ ID NO: 1691117 - RNA, 19 nt, Salmonella enterica enterica serovar Typhi
aacaucagaaaaaagccaa

SEQ ID NO: 1691118 - RNA, 20 nt, Salmonella enterica enterica serovar Typhi
aacauauagcagcagucucu

SEQ ID NO: 1691119 - RNA, 19 nt, Salmonella enterica enterica serovar Typhi
aacauagcggcaaggaaaa

SEQ ID NO: 1691120 - RNA, 17 nt, Salmonella enterica enterica serovar Typhi
aacauagcuaaauaaaa

SEQ ID NO: 1691121 - RNA, 21 nt, Salmonella enterica enterica serovar Typhi
aacauagcuaaauaaaaauaa

SEQ ID NO: 1691122 - RNA, 23 nt, Salmonella enterica enterica serovar Typhi
aacauagcggcaaggaaaaccag

SEQ ID NO: 1691123 - RNA, 13 nt, Salmonella enterica enterica serovar Typhi
aacauaaacaaug

SEQ ID NO: 1691124 - RNA, 17 nt, Salmonella enterica enterica serovar Typhi
aacaguuuuuccuuucu

SEQ ID NO: 1691125 - RNA, 17 nt, Salmonella enterica enterica serovar Typhi
aacagucgcgccgugcc

SEQ ID NO: 1691126 - RNA, 13 nt, Salmonella enterica enterica serovar Typhi
aacaguucagaca

SEQ ID NO: 1691127 - RNA, 19 nt, Salmonella enterica enterica serovar Typhi
aacaguucaaacggcccgg

SEQ ID NO: 1691128 - RNA, 22 nt, Salmonella enterica enterica serovar Typhi
aaccacuuugggccgaaggaag

SEQ ID NO: 1691129 - RNA, 13 nt, Salmonella enterica enterica serovar Typhi
aaccaccagcagu

SEQ ID NO: 1691130 - RNA, 19 nt, Salmonella enterica enterica serovar Typhi
aaccaccagcggaaucccc

SEQ ID NO: 1691131 - RNA, 14 nt, Salmonella enterica enterica serovar Typhi
aacauggggagcag

SEQ ID NO: 1691132 - RNA, 16 nt, Salmonella enterica enterica serovar Typhi
aacauggggagcagca

SEQ ID NO: 1691133 - RNA, 16 nt, Salmonella enterica enterica serovar Typhi
aacauggguuucuugc

SEQ ID NO: 1691134 - RNA, 19 nt, Salmonella enterica enterica serovar Typhi
aacaucgguuuguucauau

SEQ ID NO: 1691135 - RNA, 16 nt, Salmonella enterica enterica serovar Typhi
aacaucguaaaucaaa

SEQ ID NO: 1691136 - RNA, 19 nt, Salmonella enterica enterica serovar Typhi
aacaucguaaaucaaauga

SEQ ID NO: 1691137 - RNA, 20 nt, Salmonella enterica enterica serovar Typhi
aaccagucguuaucugacau

SEQ ID NO: 1691138 - RNA, 18 nt, Salmonella enterica enterica serovar Typhi
aaccaguugccaggguuc

SEQ ID NO: 1691139 - RNA, 17 nt, Salmonella enterica enterica serovar Typhi
aaccauacauccugauu

SEQ ID NO: 1691140 - RNA, 16 nt, Salmonella enterica enterica serovar Typhi
aacccgaucgccaucc

SEQ ID NO: 1691141 - RNA, 22 nt, Salmonella enterica enterica serovar Typhi
aaccccaggucagcaguuuuuc

SEQ ID NO: 1691142 - RNA, 15 nt, Salmonella enterica enterica serovar Typhi
aaccccaucccggca

SEQ ID NO: 1691143 - RNA, 22 nt, Salmonella enterica enterica serovar Typhi
aaccccggaaugugaaauacag

SEQ ID NO: 1691144 - RNA, 22 nt, Salmonella enterica enterica serovar Typhi
aaccccggcaaaccuaccggca

SEQ ID NO: 1691145 - RNA, 15 nt, Salmonella enterica enterica serovar Typhi
aaccagcuauccagu

SEQ ID NO: 1691146 - RNA, 14 nt, Salmonella enterica enterica serovar Typhi
aaccagcuuuucau

SEQ ID NO: 1691147 - RNA, 21 nt, Salmonella enterica enterica serovar Typhi
aaccagcgcuucgccugccgg

SEQ ID NO: 1691148 - RNA, 23 nt, Salmonella enterica enterica serovar Typhi
aaccagcggcgacacaacggcac

SEQ ID NO: 1691149 - RNA, 13 nt, Salmonella enterica enterica serovar Typhi
aaccagguaaucc

SEQ ID NO: 1691150 - RNA, 16 nt, Salmonella enterica enterica serovar Typhi
aaccagggaggacgca

SEQ ID NO: 1691151 - RNA, 14 nt, Salmonella enterica enterica serovar Typhi
aaccaggcauuuua

SEQ ID NO: 1691152 - RNA, 15 nt, Salmonella enterica enterica serovar Typhi
aaccagcaguccugc

SEQ ID NO: 1691153 - RNA, 18 nt, Salmonella enterica enterica serovar Typhi
aaccagcccaugaaggag

SEQ ID NO: 1691154 - RNA, 17 nt, Salmonella enterica enterica serovar Typhi
aaccagcauaauauuca

SEQ ID NO: 1691155 - RNA, 16 nt, Salmonella enterica enterica serovar Typhi
aaccagcgaaaugacg

SEQ ID NO: 1691156 - RNA, 20 nt, Salmonella enterica enterica serovar Typhi
aacgaaagcucaggcgggga

SEQ ID NO: 1691157 - RNA, 20 nt, Salmonella enterica enterica serovar Typhi
aacgaacgcggaucagacgg

SEQ ID NO: 1691158 - RNA, 20 nt, Salmonella enterica enterica serovar Typhi
aaccuuccaucgcauccucg

SEQ ID NO: 1691159 - RNA, 17 nt, Salmonella enterica enterica serovar Typhi
aaccuucauaaauacgu

SEQ ID NO: 1691160 - RNA, 14 nt, Salmonella enterica enterica serovar Typhi
aaccuuccgccagg

SEQ ID NO: 1691161 - RNA, 15 nt, Salmonella enterica enterica serovar Typhi
aaccuguaucugcug

SEQ ID NO: 1691162 - RNA, 13 nt, Salmonella enterica enterica serovar Typhi
aaccugucaguac

SEQ ID NO: 1691163 - RNA, 13 nt, Salmonella enterica enterica serovar Typhi
aaccuguccuuua

SEQ ID NO: 1691164 - RNA, 14 nt, Salmonella enterica enterica serovar Typhi
aaccugguaugaua

SEQ ID NO: 1691165 - RNA, 21 nt, Salmonella enterica enterica serovar Typhi
aaccuggcagaaaggugaaaa

SEQ ID NO: 1691166 - RNA, 13 nt, Salmonella enterica enterica serovar Typhi
aaccugccacagg

SEQ ID NO: 1691167 - RNA, 14 nt, Salmonella enterica enterica serovar Typhi
aaccuuacggcuca

SEQ ID NO: 1691168 - RNA, 12 nt, Salmonella enterica enterica serovar Typhi
aaccugaacaau

SEQ ID NO: 1691169 - RNA, 17 nt, Salmonella enterica enterica serovar Typhi
aaccucuauaguaaauu

SEQ ID NO: 1691170 - RNA, 13 nt, Salmonella enterica enterica serovar Typhi
aaccugcgaaaag

SEQ ID NO: 1691171 - RNA, 14 nt, Salmonella enterica enterica serovar Typhi
aaccugagaauauu

SEQ ID NO: 1691172 - RNA, 21 nt, Salmonella enterica enterica serovar Typhi
aaccugagcgcgaacgcucca

SEQ ID NO: 1691173 - RNA, 14 nt, Salmonella enterica enterica serovar Typhi
aaccugauauugcg

SEQ ID NO: 1691174 - RNA, 19 nt, Salmonella enterica enterica serovar Typhi
aaccucaauagguguaucc

SEQ ID NO: 1691175 - RNA, 17 nt, Salmonella enterica enterica serovar Typhi
aaccucggcuugcuuca

SEQ ID NO: 1691176 - RNA, 20 nt, Salmonella enterica enterica serovar Typhi
aaccuccggcuaugccggag

SEQ ID NO: 1691177 - RNA, 19 nt, Salmonella enterica enterica serovar Typhi
aaccuccggcuaugccgga

SEQ ID NO: 1691178 - RNA, 19 nt, Salmonella enterica enterica serovar Typhi
aaccucaucccggcuuaaa

SEQ ID NO: 1691179 - RNA, 17 nt, Salmonella enterica enterica serovar Typhi
aaccguuggggaaaaua

SEQ ID NO: 1691180 - RNA, 12 nt, Salmonella enterica enterica serovar Typhi
aaccuaaaaacc

SEQ ID NO: 1691181 - RNA, 13 nt, Salmonella enterica enterica serovar Typhi
aaccuaaccaaac

SEQ ID NO: 1691182 - RNA, 14 nt, Salmonella enterica enterica serovar Typhi
aaccuauuuuacaa

SEQ ID NO: 1691183 - RNA, 15 nt, Salmonella enterica enterica serovar Typhi
aaccuauugaaaaua

SEQ ID NO: 1691184 - RNA, 16 nt, Salmonella enterica enterica serovar Typhi
aaccuauuuugcaaaa

SEQ ID NO: 1691185 - RNA, 17 nt, Salmonella enterica enterica serovar Typhi
aaccguagauuuucauc

SEQ ID NO: 1691186 - RNA, 22 nt, Salmonella enterica enterica serovar Typhi
aaccggucucuuaaugccagcg

SEQ ID NO: 1691187 - RNA, 16 nt, Salmonella enterica enterica serovar Typhi
aaccggguugcggaag

SEQ ID NO: 1691188 - RNA, 16 nt, Salmonella enterica enterica serovar Typhi
aacccgauucugccag

SEQ ID NO: 1691189 - RNA, 22 nt, Salmonella enterica enterica serovar Typhi
aaccguucaucuaucgccagcg

SEQ ID NO: 1691190 - RNA, 21 nt, Salmonella enterica enterica serovar Typhi
aaccgucgggcgucgccugcc

SEQ ID NO: 1691191 - RNA, 17 nt, Salmonella enterica enterica serovar Typhi
aaccguggcaccccucu

SEQ ID NO: 1691192 - RNA, 18 nt, Salmonella enterica enterica serovar Typhi
aaccgucucaccaggcgu

SEQ ID NO: 1691193 - RNA, 16 nt, Salmonella enterica enterica serovar Typhi
aaccguccacauccag

SEQ ID NO: 1691194 - RNA, 15 nt, Salmonella enterica enterica serovar Typhi
aaccguccacaucca

SEQ ID NO: 1691195 - RNA, 11 nt, Salmonella enterica enterica serovar Typhi
aacgcauucac

SEQ ID NO: 1691196 - RNA, 20 nt, Salmonella enterica enterica serovar Typhi
aacgcaucugggcugagaaa

SEQ ID NO: 1691197 - RNA, 18 nt, Salmonella enterica enterica serovar Typhi
aacgcauccagccacgua

SEQ ID NO: 1691198 - RNA, 14 nt, Salmonella enterica enterica serovar Typhi
aacgcauccagcgc

SEQ ID NO: 1691199 - RNA, 15 nt, Salmonella enterica enterica serovar Typhi
aacgcauccagcgca

SEQ ID NO: 1691200 - RNA, 15 nt, Salmonella enterica enterica serovar Typhi
aacgcauauccagca

SEQ ID NO: 1691201 - RNA, 18 nt, Salmonella enterica enterica serovar Typhi
aacgcagcgcgcguagca

SEQ ID NO: 1691202 - RNA, 14 nt, Salmonella enterica enterica serovar Typhi
aacgcagcaucgcc

SEQ ID NO: 1691203 - RNA, 21 nt, Salmonella enterica enterica serovar Typhi
aacgaguugcggcaacgugaa

SEQ ID NO: 1691204 - RNA, 17 nt, Salmonella enterica enterica serovar Typhi
aacgaggccaccaucac

SEQ ID NO: 1691205 - RNA, 16 nt, Salmonella enterica enterica serovar Typhi
aacgcacuuuuccagc

SEQ ID NO: 1691206 - RNA, 19 nt, Salmonella enterica enterica serovar Typhi
aacgcagaagacagaagcu

SEQ ID NO: 1691207 - RNA, 14 nt, Salmonella enterica enterica serovar Typhi
aacgcacuaccaga

SEQ ID NO: 1691208 - RNA, 19 nt, Salmonella enterica enterica serovar Typhi
aacgcacguacggaaggua

SEQ ID NO: 1691209 - RNA, 19 nt, Salmonella enterica enterica serovar Typhi
aacgauacagcacggcagu

SEQ ID NO: 1691210 - RNA, 22 nt, Salmonella enterica enterica serovar Typhi
aacgagaauggaugugaauaaa

SEQ ID NO: 1691211 - RNA, 13 nt, Salmonella enterica enterica serovar Typhi
aacgagauucaau

SEQ ID NO: 1691212 - RNA, 14 nt, Salmonella enterica enterica serovar Typhi
aacgaccagauacu

SEQ ID NO: 1691213 - RNA, 17 nt, Salmonella enterica enterica serovar Typhi
aacgacgcauaaaaaau

SEQ ID NO: 1691214 - RNA, 17 nt, Salmonella enterica enterica serovar Typhi
aacgacaaaucugccgg

SEQ ID NO: 1691215 - RNA, 17 nt, Salmonella enterica enterica serovar Typhi
aacgacaaaaauaccac

SEQ ID NO: 1691216 - RNA, 13 nt, Salmonella enterica enterica serovar Typhi
aacgaauuuaaau

SEQ ID NO: 1691217 - RNA, 19 nt, Salmonella enterica enterica serovar Typhi
aacgaaucaccucgcuucc

SEQ ID NO: 1691218 - RNA, 17 nt, Salmonella enterica enterica serovar Typhi
aacgcgcgacuuaucuu

SEQ ID NO: 1691219 - RNA, 14 nt, Salmonella enterica enterica serovar Typhi
aacgcgcaaaacuc

SEQ ID NO: 1691220 - RNA, 20 nt, Salmonella enterica enterica serovar Typhi
aacgcgcauuuuauuuaaaa

SEQ ID NO: 1691221 - RNA, 21 nt, Salmonella enterica enterica serovar Typhi
aacgcgccaaguaaauuugcu

SEQ ID NO: 1691222 - RNA, 21 nt, Salmonella enterica enterica serovar Typhi
aacgcggcguagccgccgagc

SEQ ID NO: 1691223 - RNA, 12 nt, Salmonella enterica enterica serovar Typhi
aacgcggccugg

SEQ ID NO: 1691224 - RNA, 21 nt, Salmonella enterica enterica serovar Typhi
aacgcgaaaauaccccagcgc

SEQ ID NO: 1691225 - RNA, 23 nt, Salmonella enterica enterica serovar Typhi
aacgcgagaagaagaauuauuau

SEQ ID NO: 1691226 - RNA, 14 nt, Salmonella enterica enterica serovar Typhi
aacgcgaccagcgc

SEQ ID NO: 1691227 - RNA, 21 nt, Salmonella enterica enterica serovar Typhi
aacgccaccgccaccugcccu

SEQ ID NO: 1691228 - RNA, 12 nt, Salmonella enterica enterica serovar Typhi
aacgccuggcgc

SEQ ID NO: 1691229 - RNA, 18 nt, Salmonella enterica enterica serovar Typhi
aacgccaaucacuuuacu

SEQ ID NO: 1691230 - RNA, 21 nt, Salmonella enterica enterica serovar Typhi
aacgccaagcgcggcagcagc

SEQ ID NO: 1691231 - RNA, 23 nt, Salmonella enterica enterica serovar Typhi
aacgccaagcgcggcagcagcuu

SEQ ID NO: 1691232 - RNA, 22 nt, Salmonella enterica enterica serovar Typhi
aacggcaacaguaccugauaaa

SEQ ID NO: 1691233 - RNA, 23 nt, Salmonella enterica enterica serovar Typhi
aacggcaaaucgcgguaaaaagc

SEQ ID NO: 1691234 - RNA, 20 nt, Salmonella enterica enterica serovar Typhi
aacggcaauuuuuacaaauu

SEQ ID NO: 1691235 - RNA, 20 nt, Salmonella enterica enterica serovar Typhi
aacggcagccgccaccacaa

SEQ ID NO: 1691236 - RNA, 20 nt, Salmonella enterica enterica serovar Typhi
aacggcgcaaagacagguga

SEQ ID NO: 1691237 - RNA, 17 nt, Salmonella enterica enterica serovar Typhi
aacggcgacaagaauau

SEQ ID NO: 1691238 - RNA, 18 nt, Salmonella enterica enterica serovar Typhi
aacggcgagcuuuaauga

SEQ ID NO: 1691239 - RNA, 19 nt, Salmonella enterica enterica serovar Typhi
aacggccagugaaauaaau

SEQ ID NO: 1691240 - RNA, 23 nt, Salmonella enterica enterica serovar Typhi
aacgcucuuaccgcuaaaauacc

SEQ ID NO: 1691241 - RNA, 20 nt, Salmonella enterica enterica serovar Typhi
aacgcucuuaccgcuaaaau

SEQ ID NO: 1691242 - RNA, 22 nt, Salmonella enterica enterica serovar Typhi
aacggaucaugguugaaaaaag

SEQ ID NO: 1691243 - RNA, 20 nt, Salmonella enterica enterica serovar Typhi
aacggaugcgccaucccaug

SEQ ID NO: 1691244 - RNA, 20 nt, Salmonella enterica enterica serovar Typhi
aacuuccgguagguuaaaua

SEQ ID NO: 1691245 - RNA, 18 nt, Salmonella enterica enterica serovar Typhi
aacuucaucguuacgcca

SEQ ID NO: 1691246 - RNA, 21 nt, Salmonella enterica enterica serovar Typhi
aacuuccaccaccuccugcug

SEQ ID NO: 1691247 - RNA, 16 nt, Salmonella enterica enterica serovar Typhi
aacuguucagccagca

SEQ ID NO: 1691248 - RNA, 22 nt, Salmonella enterica enterica serovar Typhi
aacuucacgccaucgacaaagg

SEQ ID NO: 1691249 - RNA, 14 nt, Salmonella enterica enterica serovar Typhi
aacuguuuacccac

SEQ ID NO: 1691250 - RNA, 14 nt, Salmonella enterica enterica serovar Typhi
aacugccaaaccac

SEQ ID NO: 1691251 - RNA, 20 nt, Salmonella enterica enterica serovar Typhi
aacugauaguuuaaauccag

SEQ ID NO: 1691252 - RNA, 19 nt, Salmonella enterica enterica serovar Typhi
aacugccccuugucguaau

SEQ ID NO: 1691253 - RNA, 17 nt, Salmonella enterica enterica serovar Typhi
aacugcgaaaucaccga

SEQ ID NO: 1691254 - RNA, 23 nt, Salmonella enterica enterica serovar Typhi
aacuguauccguaauaugaugca

SEQ ID NO: 1691255 - RNA, 21 nt, Salmonella enterica enterica serovar Typhi
aacuguagaaugcuauaugca

SEQ ID NO: 1691256 - RNA, 18 nt, Salmonella enterica enterica serovar Typhi
aacugugcgacaaccugc

SEQ ID NO: 1691257 - RNA, 23 nt, Salmonella enterica enterica serovar Typhi
aacugucguauuuauuuucugaa

SEQ ID NO: 1691258 - RNA, 17 nt, Salmonella enterica enterica serovar Typhi
aacuucucgcaggccaa

SEQ ID NO: 1691259 - RNA, 15 nt, Salmonella enterica enterica serovar Typhi
aacuuuaucaccagc

SEQ ID NO: 1691260 - RNA, 19 nt, Salmonella enterica enterica serovar Typhi
aacuuuccugccuucugaa

SEQ ID NO: 1691261 - RNA, 11 nt, Salmonella enterica enterica serovar Typhi
aacuuuccaac

SEQ ID NO: 1691262 - RNA, 21 nt, Salmonella enterica enterica serovar Typhi
aagaaacaauccguuauuuca

SEQ ID NO: 1691263 - RNA, 19 nt, Salmonella enterica enterica serovar Typhi
aacuuuuccuaauuuuuaa

SEQ ID NO: 1691264 - RNA, 12 nt, Salmonella enterica enterica serovar Typhi
aacucagcaaua

SEQ ID NO: 1691265 - RNA, 20 nt, Salmonella enterica enterica serovar Typhi
aacucagcaauauuuuguag

SEQ ID NO: 1691266 - RNA, 22 nt, Salmonella enterica enterica serovar Typhi
aacucaugccguagaacagcau

SEQ ID NO: 1691267 - RNA, 18 nt, Salmonella enterica enterica serovar Typhi
aacuccaaauaccggauu

SEQ ID NO: 1691268 - RNA, 23 nt, Salmonella enterica enterica serovar Typhi
aacucaugacuucacacuguggu

SEQ ID NO: 1691269 - RNA, 23 nt, Salmonella enterica enterica serovar Typhi
aacucauccaccuuauccuggca

SEQ ID NO: 1691270 - RNA, 14 nt, Salmonella enterica enterica serovar Typhi
aacucaucgccagc

SEQ ID NO: 1691271 - RNA, 13 nt, Salmonella enterica enterica serovar Typhi
aacucaucacagc

SEQ ID NO: 1691272 - RNA, 21 nt, Salmonella enterica enterica serovar Typhi
aacuauaauugcuuuuuucca

SEQ ID NO: 1691273 - RNA, 19 nt, Salmonella enterica enterica serovar Typhi
aacgggcguugcucaaugg

SEQ ID NO: 1691274 - RNA, 19 nt, Salmonella enterica enterica serovar Typhi
aacuauuaauucuuuuaac

SEQ ID NO: 1691275 - RNA, 21 nt, Salmonella enterica enterica serovar Typhi
aacuaugccagaauacaccgc

SEQ ID NO: 1691276 - RNA, 15 nt, Salmonella enterica enterica serovar Typhi
aacuaugcaaaacgu

SEQ ID NO: 1691277 - RNA, 12 nt, Salmonella enterica enterica serovar Typhi
aacucaagguag

SEQ ID NO: 1691278 - RNA, 22 nt, Salmonella enterica enterica serovar Typhi
aacgggacggcggccagcauuu

SEQ ID NO: 1691279 - RNA, 14 nt, Salmonella enterica enterica serovar Typhi
aacgggccacugcu

SEQ ID NO: 1691280 - RNA, 21 nt, Salmonella enterica enterica serovar Typhi
aacggcuuuccagcagccaga

SEQ ID NO: 1691281 - RNA, 18 nt, Salmonella enterica enterica serovar Typhi
aacggcuuuccagcagcc

SEQ ID NO: 1691282 - RNA, 18 nt, Salmonella enterica enterica serovar Typhi
aacggcugacgcccauca

SEQ ID NO: 1691283 - RNA, 20 nt, Salmonella enterica enterica serovar Typhi
aacucucaccgaccugccuu

SEQ ID NO: 1691284 - RNA, 14 nt, Salmonella enterica enterica serovar Typhi
aacucuaugcaaaa

SEQ ID NO: 1691285 - RNA, 23 nt, Salmonella enterica enterica serovar Typhi
aacucuaugcaaaagaaaaaacu

SEQ ID NO: 1691286 - RNA, 15 nt, Salmonella enterica enterica serovar Typhi
aacugagcgccaauu

SEQ ID NO: 1691287 - RNA, 13 nt, Salmonella enterica enterica serovar Typhi
aacugaauuucau

SEQ ID NO: 1691288 - RNA, 13 nt, Salmonella enterica enterica serovar Typhi
aacugacaauuuc

SEQ ID NO: 1691289 - RNA, 16 nt, Salmonella enterica enterica serovar Typhi
aacucgcacaguacac

SEQ ID NO: 1691290 - RNA, 20 nt, Salmonella enterica enterica serovar Typhi
aacucgccaugccaucggcc

SEQ ID NO: 1691291 - RNA, 21 nt, Salmonella enterica enterica serovar Typhi
aacuccuccgggaaaacauca

SEQ ID NO: 1691292 - RNA, 21 nt, Salmonella enterica enterica serovar Typhi
aacuccucacugcguaaaauc

SEQ ID NO: 1691293 - RNA, 17 nt, Salmonella enterica enterica serovar Typhi
aagagaacguucguugu

SEQ ID NO: 1691294 - RNA, 13 nt, Salmonella enterica enterica serovar Typhi
aagagaaaauacc

SEQ ID NO: 1691295 - RNA, 18 nt, Salmonella enterica enterica serovar Typhi
aagacuggcccugccgga

SEQ ID NO: 1691296 - RNA, 15 nt, Salmonella enterica enterica serovar Typhi
aagacgugccggaag

SEQ ID NO: 1691297 - RNA, 15 nt, Salmonella enterica enterica serovar Typhi
aagacuacgcaaaaa

SEQ ID NO: 1691298 - RNA, 19 nt, Salmonella enterica enterica serovar Typhi
aagacugauuuaucaccca

SEQ ID NO: 1691299 - RNA, 22 nt, Salmonella enterica enterica serovar Typhi
aagaccugcuucagguuaagug

SEQ ID NO: 1691300 - RNA, 17 nt, Salmonella enterica enterica serovar Typhi
aagacgguuauuuuuca

SEQ ID NO: 1691301 - RNA, 20 nt, Salmonella enterica enterica serovar Typhi
aagacgguuauuuuucagau

SEQ ID NO: 1691302 - RNA, 16 nt, Salmonella enterica enterica serovar Typhi
aagacgguaaucagac

SEQ ID NO: 1691303 - RNA, 17 nt, Salmonella enterica enterica serovar Typhi
aagaccgauagagacug

SEQ ID NO: 1691304 - RNA, 15 nt, Salmonella enterica enterica serovar Typhi
aagaccuccgcccgg

SEQ ID NO: 1691305 - RNA, 16 nt, Salmonella enterica enterica serovar Typhi
aagaccugcuucaggu

SEQ ID NO: 1691306 - RNA, 11 nt, Salmonella enterica enterica serovar Typhi
aagaccagcau

SEQ ID NO: 1691307 - RNA, 18 nt, Salmonella enterica enterica serovar Typhi
aagaccaugaacaccuca

SEQ ID NO: 1691308 - RNA, 13 nt, Salmonella enterica enterica serovar Typhi
aagaccagauuaa

SEQ ID NO: 1691309 - RNA, 16 nt, Salmonella enterica enterica serovar Typhi
aagacauggaguucca

SEQ ID NO: 1691310 - RNA, 23 nt, Salmonella enterica enterica serovar Typhi
aagacauucacauauauuucugu

SEQ ID NO: 1691311 - RNA, 20 nt, Salmonella enterica enterica serovar Typhi
aagaauuugaacucuuucag

SEQ ID NO: 1691312 - RNA, 16 nt, Salmonella enterica enterica serovar Typhi
aagacaacguaaacgg

SEQ ID NO: 1691313 - RNA, 12 nt, Salmonella enterica enterica serovar Typhi
aagaaaccauua

SEQ ID NO: 1691314 - RNA, 22 nt, Salmonella enterica enterica serovar Typhi
aagaaacgccgcgcaaagcaau

SEQ ID NO: 1691315 - RNA, 19 nt, Salmonella enterica enterica serovar Typhi
aagaaucgauguaguuguu

SEQ ID NO: 1691316 - RNA, 17 nt, Salmonella enterica enterica serovar Typhi
aagaaucgccagucgca

SEQ ID NO: 1691317 - RNA, 19 nt, Salmonella enterica enterica serovar Typhi
aagaaucuguauaaaauau

SEQ ID NO: 1691318 - RNA, 11 nt, Salmonella enterica enterica serovar Typhi
aagaguuaacu

SEQ ID NO: 1691319 - RNA, 12 nt, Salmonella enterica enterica serovar Typhi
aagauaaaauac

SEQ ID NO: 1691320 - RNA, 20 nt, Salmonella enterica enterica serovar Typhi
aagaguccauucggccugcg

SEQ ID NO: 1691321 - RNA, 17 nt, Salmonella enterica enterica serovar Typhi
aagauaaccauuucaaa

SEQ ID NO: 1691322 - RNA, 14 nt, Salmonella enterica enterica serovar Typhi
aagauaagaaguaa

SEQ ID NO: 1691323 - RNA, 18 nt, Salmonella enterica enterica serovar Typhi
aagauaagcacaugacgg

SEQ ID NO: 1691324 - RNA, 23 nt, Salmonella enterica enterica serovar Typhi
aagauaauguccccuaaauaauu

SEQ ID NO: 1691325 - RNA, 14 nt, Salmonella enterica enterica serovar Typhi
aagauaaaaagaca

SEQ ID NO: 1691326 - RNA, 14 nt, Salmonella enterica enterica serovar Typhi
aagauaaagauauu

SEQ ID NO: 1691327 - RNA, 12 nt, Salmonella enterica enterica serovar Typhi
aagaggcagcaa

SEQ ID NO: 1691328 - RNA, 21 nt, Salmonella enterica enterica serovar Typhi
aagaguaucucucuggcgcau

SEQ ID NO: 1691329 - RNA, 23 nt, Salmonella enterica enterica serovar Typhi
aagagcggcgaguuguuucaaca

SEQ ID NO: 1691330 - RNA, 21 nt, Salmonella enterica enterica serovar Typhi
aagagcguccaguccuguccc

SEQ ID NO: 1691331 - RNA, 15 nt, Salmonella enterica enterica serovar Typhi
aagagcguuacccag

SEQ ID NO: 1691332 - RNA, 20 nt, Salmonella enterica enterica serovar Typhi
aagagcguuacccagacagc

SEQ ID NO: 1691333 - RNA, 21 nt, Salmonella enterica enterica serovar Typhi
aagagcguuacccagacagca

SEQ ID NO: 1691334 - RNA, 14 nt, Salmonella enterica enterica serovar Typhi
aagagauuagaacg

SEQ ID NO: 1691335 - RNA, 19 nt, Salmonella enterica enterica serovar Typhi
aagagauggaaugagcauc

SEQ ID NO: 1691336 - RNA, 21 nt, Salmonella enterica enterica serovar Typhi
aagagagccuuacaggcgcau

SEQ ID NO: 1691337 - RNA, 22 nt, Salmonella enterica enterica serovar Typhi
aagagaggcuuuaugcugacaa

SEQ ID NO: 1691338 - RNA, 17 nt, Salmonella enterica enterica serovar Typhi
aagagaauggccagcac

SEQ ID NO: 1691339 - RNA, 17 nt, Salmonella enterica enterica serovar Typhi
aagagacacgcugaccu

SEQ ID NO: 1691340 - RNA, 15 nt, Salmonella enterica enterica serovar Typhi
aaguugaucauccuu

SEQ ID NO: 1691341 - RNA, 22 nt, Salmonella enterica enterica serovar Typhi
aauaaaucacaacguaaucauc

SEQ ID NO: 1691342 - RNA, 20 nt, Salmonella enterica enterica serovar Typhi
aauaaauccaugagaagaaa

SEQ ID NO: 1691343 - RNA, 14 nt, Salmonella enterica enterica serovar Typhi
aauaaccccagcug

SEQ ID NO: 1691344 - RNA, 15 nt, Salmonella enterica enterica serovar Typhi
aauaaccaccuguuc

SEQ ID NO: 1691345 - RNA, 15 nt, Salmonella enterica enterica serovar Typhi
aauaacugacagacu

SEQ ID NO: 1691346 - RNA, 19 nt, Salmonella enterica enterica serovar Typhi
aauaaccccagcugcggca

SEQ ID NO: 1691347 - RNA, 21 nt, Salmonella enterica enterica serovar Typhi
aauaaguuagcuuuuuuaugc

SEQ ID NO: 1691348 - RNA, 12 nt, Salmonella enterica enterica serovar Typhi
aauaaggcuggc

SEQ ID NO: 1691349 - RNA, 17 nt, Salmonella enterica enterica serovar Typhi
aauaagguggcuaaccc

SEQ ID NO: 1691350 - RNA, 23 nt, Salmonella enterica enterica serovar Typhi
aauaagcgccgaguagcugagcg

SEQ ID NO: 1691351 - RNA, 12 nt, Salmonella enterica enterica serovar Typhi
aauaagcgaauu

SEQ ID NO: 1691352 - RNA, 22 nt, Salmonella enterica enterica serovar Typhi
aauaagcagaacguagcccauu

SEQ ID NO: 1691353 - RNA, 14 nt, Salmonella enterica enterica serovar Typhi
aauaagccagacuc

SEQ ID NO: 1691354 - RNA, 11 nt, Salmonella enterica enterica serovar Typhi
aaaaauaaaaa

SEQ ID NO: 1691355 - RNA, 13 nt, Salmonella enterica enterica serovar Typhi
aaaaauaaaaaaa

SEQ ID NO: 1691356 - RNA, 14 nt, Salmonella enterica enterica serovar Typhi
aaaaauaaaaaaac

SEQ ID NO: 1691357 - RNA, 15 nt, Salmonella enterica enterica serovar Typhi
aaaaauccccccucc

SEQ ID NO: 1691358 - RNA, 14 nt, Salmonella enterica enterica serovar Typhi
aaaaauccggauca

SEQ ID NO: 1691359 - RNA, 15 nt, Salmonella enterica enterica serovar Typhi
aauaauuucuucuuu

SEQ ID NO: 1691360 - RNA, 16 nt, Salmonella enterica enterica serovar Typhi
aauaauuuuagaaaua

SEQ ID NO: 1691361 - RNA, 17 nt, Salmonella enterica enterica serovar Typhi
aauaauuuuagaaauag

SEQ ID NO: 1691362 - RNA, 14 nt, Salmonella enterica enterica serovar Typhi
aauaauuuuguuaa

SEQ ID NO: 1691363 - RNA, 18 nt, Salmonella enterica enterica serovar Typhi
aauaauggcgcgaaaaca

SEQ ID NO: 1691364 - RNA, 20 nt, Salmonella enterica enterica serovar Typhi
aauaauggcgcgaaaacagc

SEQ ID NO: 1691365 - RNA, 22 nt, Salmonella enterica enterica serovar Typhi
aauaauggcgcgaaaacagcug

SEQ ID NO: 1691366 - RNA, 17 nt, Salmonella enterica enterica serovar Typhi
aauaauguaaaaaaaua

SEQ ID NO: 1691367 - RNA, 14 nt, Salmonella enterica enterica serovar Typhi
aauaaugcaaugcc

SEQ ID NO: 1691368 - RNA, 19 nt, Salmonella enterica enterica serovar Typhi
aauaaugaacgagcaauaa

SEQ ID NO: 1691369 - RNA, 13 nt, Salmonella enterica enterica serovar Typhi
aaaaauauaaaaa

SEQ ID NO: 1691370 - RNA, 13 nt, Salmonella enterica enterica serovar Typhi
aaaaauaggcuuu

SEQ ID NO: 1691371 - RNA, 14 nt, Salmonella enterica enterica serovar Typhi
aaaaauagcauuaa

SEQ ID NO: 1691372 - RNA, 22 nt, Salmonella enterica enterica serovar Typhi
aauaccaaagcccgcaaacaga

SEQ ID NO: 1691373 - RNA, 13 nt, Salmonella enterica enterica serovar Typhi
aauaccaauaaga

SEQ ID NO: 1691374 - RNA, 15 nt, Salmonella enterica enterica serovar Typhi
aauacacaaugcuuc

SEQ ID NO: 1691375 - RNA, 20 nt, Salmonella enterica enterica serovar Typhi
aauacaccgccauauauuua

SEQ ID NO: 1691376 - RNA, 20 nt, Salmonella enterica enterica serovar Typhi
aauacacgguaaauucuuua

SEQ ID NO: 1691377 - RNA, 18 nt, Salmonella enterica enterica serovar Typhi
aauaccagcguaauccuc

SEQ ID NO: 1691378 - RNA, 15 nt, Salmonella enterica enterica serovar Typhi
aaaaaugauguguuu

SEQ ID NO: 1691379 - RNA, 22 nt, Salmonella enterica enterica serovar Typhi
aaaaaugauguguuucagcagc

SEQ ID NO: 1691380 - RNA, 22 nt, Salmonella enterica enterica serovar Typhi
aauaccccaggggcauauauua

SEQ ID NO: 1691381 - RNA, 21 nt, Salmonella enterica enterica serovar Typhi
aauaccguggucuccgccugg

SEQ ID NO: 1691382 - RNA, 16 nt, Salmonella enterica enterica serovar Typhi
aaaaauggaccagcca

SEQ ID NO: 1691383 - RNA, 22 nt, Salmonella enterica enterica serovar Typhi
aaaaauggguaugcgacugaaa

SEQ ID NO: 1691384 - RNA, 21 nt, Salmonella enterica enterica serovar Typhi
aauagcgcugaggcgcuggcu

SEQ ID NO: 1691385 - RNA, 15 nt, Salmonella enterica enterica serovar Typhi
aauagcggcuaauca

SEQ ID NO: 1691386 - RNA, 22 nt, Salmonella enterica enterica serovar Typhi
aauagcgaacaguccaugauga

SEQ ID NO: 1691387 - RNA, 19 nt, Salmonella enterica enterica serovar Typhi
aauagccugggcaaggcug

SEQ ID NO: 1691388 - RNA, 14 nt, Salmonella enterica enterica serovar Typhi
aauagccggauaaa

SEQ ID NO: 1691389 - RNA, 13 nt, Salmonella enterica enterica serovar Typhi
aauagccugggca

SEQ ID NO: 1691390 - RNA, 18 nt, Salmonella enterica enterica serovar Typhi
aauagcaauuauauugcg

SEQ ID NO: 1691391 - RNA, 18 nt, Salmonella enterica enterica serovar Typhi
aauagcacaucagccaac

SEQ ID NO: 1691392 - RNA, 12 nt, Salmonella enterica enterica serovar Typhi
aauagcugaaaa

SEQ ID NO: 1691393 - RNA, 17 nt, Salmonella enterica enterica serovar Typhi
aauagcuggcugucuuc

SEQ ID NO: 1691394 - RNA, 18 nt, Salmonella enterica enterica serovar Typhi
aauagauaugaaagaagg

SEQ ID NO: 1691395 - RNA, 14 nt, Salmonella enterica enterica serovar Typhi
aauagacagugauu

SEQ ID NO: 1691396 - RNA, 13 nt, Salmonella enterica enterica serovar Typhi
aauagagaaaaua

SEQ ID NO: 1691397 - RNA, 18 nt, Salmonella enterica enterica serovar Typhi
aauagaauaggaaauaau

SEQ ID NO: 1691398 - RNA, 18 nt, Salmonella enterica enterica serovar Typhi
aauaccucaaaugcugaa

SEQ ID NO: 1691399 - RNA, 15 nt, Salmonella enterica enterica serovar Typhi
aauaccuggaauauc

SEQ ID NO: 1691400 - RNA, 19 nt, Salmonella enterica enterica serovar Typhi
aauaccuuaguaaaaccga

SEQ ID NO: 1691401 - RNA, 18 nt, Salmonella enterica enterica serovar Typhi
aauaguaaauagaaaaua

SEQ ID NO: 1691402 - RNA, 13 nt, Salmonella enterica enterica serovar Typhi
aauagguugaaag

SEQ ID NO: 1691403 - RNA, 14 nt, Salmonella enterica enterica serovar Typhi
aauaguaaauagaa

SEQ ID NO: 1691404 - RNA, 22 nt, Salmonella enterica enterica serovar Typhi
aauaggccaggcucgccagacc

SEQ ID NO: 1691405 - RNA, 13 nt, Salmonella enterica enterica serovar Typhi
aauaggauggcgc

SEQ ID NO: 1691406 - RNA, 16 nt, Salmonella enterica enterica serovar Typhi
aauagugacuucugcu

SEQ ID NO: 1691407 - RNA, 22 nt, Salmonella enterica enterica serovar Typhi
aauaguauggagcaggaaaaga

SEQ ID NO: 1691408 - RNA, 16 nt, Salmonella enterica enterica serovar Typhi
aauaguggugcgcauc

SEQ ID NO: 1691409 - RNA, 22 nt, Salmonella enterica enterica serovar Typhi
aauagugcggccaaauugcucg

SEQ ID NO: 1691410 - RNA, 15 nt, Salmonella enterica enterica serovar Typhi
aauaguucagcgcag

SEQ ID NO: 1691411 - RNA, 15 nt, Salmonella enterica enterica serovar Typhi
aauaguuacuguuuc

SEQ ID NO: 1691412 - RNA, 23 nt, Salmonella enterica enterica serovar Typhi
aauaguuuauugagauaauuuau

SEQ ID NO: 1691413 - RNA, 15 nt, Salmonella enterica enterica serovar Typhi
aauauaguuagaaaa

SEQ ID NO: 1691414 - RNA, 19 nt, Salmonella enterica enterica serovar Typhi
aauauaguuagaaaauacu

SEQ ID NO: 1691415 - RNA, 17 nt, Salmonella enterica enterica serovar Typhi
aauauaucaggcugagc

SEQ ID NO: 1691416 - RNA, 23 nt, Salmonella enterica enterica serovar Typhi
aauauaucuguuccacagaucua

SEQ ID NO: 1691417 - RNA, 17 nt, Salmonella enterica enterica serovar Typhi
aauauaucuguuccaca

SEQ ID NO: 1691418 - RNA, 22 nt, Salmonella enterica enterica serovar Typhi
aauauaucgcaggaugcgcugc

SEQ ID NO: 1691419 - RNA, 20 nt, Salmonella enterica enterica serovar Typhi
aauauacaccugacggcagc

SEQ ID NO: 1691420 - RNA, 18 nt, Salmonella enterica enterica serovar Typhi
aauauacauucauuuuau

SEQ ID NO: 1691421 - RNA, 16 nt, Salmonella enterica enterica serovar Typhi
aauauagcuaaugcaa

SEQ ID NO: 1691422 - RNA, 19 nt, Salmonella enterica enterica serovar Typhi
aauauagcuaaugcaauaa

SEQ ID NO: 1691423 - RNA, 19 nt, Salmonella enterica enterica serovar Typhi
aauauaauccuuguccaug

SEQ ID NO: 1691424 - RNA, 14 nt, Salmonella enterica enterica serovar Typhi
aauauaaccaauuu

SEQ ID NO: 1691425 - RNA, 21 nt, Salmonella enterica enterica serovar Typhi
aauaucuguuucauggagauc

SEQ ID NO: 1691426 - RNA, 14 nt, Salmonella enterica enterica serovar Typhi
aauaucgucaguau

SEQ ID NO: 1691427 - RNA, 14 nt, Salmonella enterica enterica serovar Typhi
aauaucggcaaagu

SEQ ID NO: 1691428 - RNA, 17 nt, Salmonella enterica enterica serovar Typhi
aauaucggguauccauu

SEQ ID NO: 1691429 - RNA, 21 nt, Salmonella enterica enterica serovar Typhi
aauaucgcggaaauucacuuc

SEQ ID NO: 1691430 - RNA, 18 nt, Salmonella enterica enterica serovar Typhi
aauaucgauagcauuuuu

SEQ ID NO: 1691431 - RNA, 23 nt, Salmonella enterica enterica serovar Typhi
aauaucaauucaacacuuagaac

SEQ ID NO: 1691432 - RNA, 14 nt, Salmonella enterica enterica serovar Typhi
aauaucaauauaau

SEQ ID NO: 1691433 - RNA, 13 nt, Salmonella enterica enterica serovar Typhi
aauaucaaucagc

SEQ ID NO: 1691434 - RNA, 21 nt, Salmonella enterica enterica serovar Typhi
aauaucauccgguaucaugcu

SEQ ID NO: 1691435 - RNA, 13 nt, Salmonella enterica enterica serovar Typhi
aauauccccugac

SEQ ID NO: 1691436 - RNA, 16 nt, Salmonella enterica enterica serovar Typhi
aauaucaugaauaauc

SEQ ID NO: 1691437 - RNA, 18 nt, Salmonella enterica enterica serovar Typhi
aauaucauuaauuauacu

SEQ ID NO: 1691438 - RNA, 15 nt, Salmonella enterica enterica serovar Typhi
aauauccgcugcggu

SEQ ID NO: 1691439 - RNA, 19 nt, Salmonella enterica enterica serovar Typhi
aauauccgguacaccaacu

SEQ ID NO: 1691440 - RNA, 19 nt, Salmonella enterica enterica serovar Typhi
aauauccgccccgcuggcu

SEQ ID NO: 1691441 - RNA, 14 nt, Salmonella enterica enterica serovar Typhi
aauaucccgaugac

SEQ ID NO: 1691442 - RNA, 14 nt, Salmonella enterica enterica serovar Typhi
aauauccccugaca

SEQ ID NO: 1691443 - RNA, 19 nt, Salmonella enterica enterica serovar Typhi
aaguaauuuccauauuuau

SEQ ID NO: 1691444 - RNA, 18 nt, Salmonella enterica enterica serovar Typhi
aaguaccaaaacagaaaa

SEQ ID NO: 1691445 - RNA, 15 nt, Salmonella enterica enterica serovar Typhi
aaggggccguagaaa

SEQ ID NO: 1691446 - RNA, 22 nt, Salmonella enterica enterica serovar Typhi
aaggggcaggcgucaaaacagg

SEQ ID NO: 1691447 - RNA, 14 nt, Salmonella enterica enterica serovar Typhi
aagggcgcugccag

SEQ ID NO: 1691448 - RNA, 14 nt, Salmonella enterica enterica serovar Typhi
aagggaccgcgaag

SEQ ID NO: 1691449 - RNA, 14 nt, Salmonella enterica enterica serovar Typhi
aagggaaaagccau

SEQ ID NO: 1691450 - RNA, 21 nt, Salmonella enterica enterica serovar Typhi
aagggaaaagccauugccgcg

SEQ ID NO: 1691451 - RNA, 22 nt, Salmonella enterica enterica serovar Typhi
aagggaaaagccauugccgcga

SEQ ID NO: 1691452 - RNA, 13 nt, Salmonella enterica enterica serovar Typhi
aagguuuuucccg

SEQ ID NO: 1691453 - RNA, 18 nt, Salmonella enterica enterica serovar Typhi
aaguauucgaugguguua

SEQ ID NO: 1691454 - RNA, 16 nt, Salmonella enterica enterica serovar Typhi
aagucaaaauaaaauu

SEQ ID NO: 1691455 - RNA, 21 nt, Salmonella enterica enterica serovar Typhi
aagucaacugcucuaccaacu

SEQ ID NO: 1691456 - RNA, 16 nt, Salmonella enterica enterica serovar Typhi
aagucacuuacuuucu

SEQ ID NO: 1691457 - RNA, 12 nt, Salmonella enterica enterica serovar Typhi
aaguauaaagcu

SEQ ID NO: 1691458 - RNA, 19 nt, Salmonella enterica enterica serovar Typhi
aaguaugccgcacaaaauu

SEQ ID NO: 1691459 - RNA, 17 nt, Salmonella enterica enterica serovar Typhi
aaguauaguggcgacaa

SEQ ID NO: 1691460 - RNA, 15 nt, Salmonella enterica enterica serovar Typhi
aagucccagaaagua

SEQ ID NO: 1691461 - RNA, 16 nt, Salmonella enterica enterica serovar Typhi
aagucccuggcgcgcc

SEQ ID NO: 1691462 - RNA, 17 nt, Salmonella enterica enterica serovar Typhi
aaguccguauuauccac

SEQ ID NO: 1691463 - RNA, 13 nt, Salmonella enterica enterica serovar Typhi
aaguccuucuccu

SEQ ID NO: 1691464 - RNA, 16 nt, Salmonella enterica enterica serovar Typhi
aaguccuucuuccccc

SEQ ID NO: 1691465 - RNA, 18 nt, Salmonella enterica enterica serovar Typhi
aagucauaccuguuccuc

SEQ ID NO: 1691466 - RNA, 19 nt, Salmonella enterica enterica serovar Typhi
aagucaucuguucaacuuu

SEQ ID NO: 1691467 - RNA, 15 nt, Salmonella enterica enterica serovar Typhi
aagucaucaauugcu

SEQ ID NO: 1691468 - RNA, 17 nt, Salmonella enterica enterica serovar Typhi
aagucauccagacuaac

SEQ ID NO: 1691469 - RNA, 18 nt, Salmonella enterica enterica serovar Typhi
aagucggggcguaaaaau

SEQ ID NO: 1691470 - RNA, 21 nt, Salmonella enterica enterica serovar Typhi
aagugaagaaucuguauaaaa

SEQ ID NO: 1691471 - RNA, 18 nt, Salmonella enterica enterica serovar Typhi
aagugcgaaauuuaauau

SEQ ID NO: 1691472 - RNA, 17 nt, Salmonella enterica enterica serovar Typhi
aagugcgcacucagaaa

SEQ ID NO: 1691473 - RNA, 15 nt, Salmonella enterica enterica serovar Typhi
aaguucauaaaugua

SEQ ID NO: 1691474 - RNA, 18 nt, Salmonella enterica enterica serovar Typhi
aaguugacuuuuacgcca

SEQ ID NO: 1691475 - RNA, 12 nt, Salmonella enterica enterica serovar Typhi
aaguuaugcauc

SEQ ID NO: 1691476 - RNA, 15 nt, Salmonella enterica enterica serovar Typhi
aaguucaaacucauu

SEQ ID NO: 1691477 - RNA, 21 nt, Salmonella enterica enterica serovar Typhi
aaguuacaggcuccaaguauu

SEQ ID NO: 1691478 - RNA, 20 nt, Salmonella enterica enterica serovar Typhi
aaggauuauuggcaucauaa

SEQ ID NO: 1691479 - RNA, 18 nt, Salmonella enterica enterica serovar Typhi
aaggcagaagaaucugcc

SEQ ID NO: 1691480 - RNA, 20 nt, Salmonella enterica enterica serovar Typhi
aaggcaucguugagaaaacc

SEQ ID NO: 1691481 - RNA, 14 nt, Salmonella enterica enterica serovar Typhi
aaggcaucuucaga

SEQ ID NO: 1691482 - RNA, 15 nt, Salmonella enterica enterica serovar Typhi
aaggcaucuucagac

SEQ ID NO: 1691483 - RNA, 20 nt, Salmonella enterica enterica serovar Typhi
aaggcaucuucagacaguuu

SEQ ID NO: 1691484 - RNA, 18 nt, Salmonella enterica enterica serovar Typhi
aaggcagcgaaagcugcc

SEQ ID NO: 1691485 - RNA, 14 nt, Salmonella enterica enterica serovar Typhi
aaggcuccauauca

SEQ ID NO: 1691486 - RNA, 20 nt, Salmonella enterica enterica serovar Typhi
aaggcuaccgggcaaacauu

SEQ ID NO: 1691487 - RNA, 18 nt, Salmonella enterica enterica serovar Typhi
aaggccgauaaagcguuu

SEQ ID NO: 1691488 - RNA, 13 nt, Salmonella enterica enterica serovar Typhi
aaggaagggcgcu

SEQ ID NO: 1691489 - RNA, 20 nt, Salmonella enterica enterica serovar Typhi
aaggacaagcugauuuuucg

SEQ ID NO: 1691490 - RNA, 14 nt, Salmonella enterica enterica serovar Typhi
aaggacaagcugcg

SEQ ID NO: 1691491 - RNA, 17 nt, Salmonella enterica enterica serovar Typhi
aaggaugacuaaucaau

SEQ ID NO: 1691492 - RNA, 19 nt, Salmonella enterica enterica serovar Typhi
aagcuggucgagauacugc

SEQ ID NO: 1691493 - RNA, 18 nt, Salmonella enterica enterica serovar Typhi
aagcugggcguuacuggc

SEQ ID NO: 1691494 - RNA, 17 nt, Salmonella enterica enterica serovar Typhi
aagcugguaauccucuu

SEQ ID NO: 1691495 - RNA, 18 nt, Salmonella enterica enterica serovar Typhi
aagcugguagucgagggu

SEQ ID NO: 1691496 - RNA, 21 nt, Salmonella enterica enterica serovar Typhi
aagcugggaaacuuaucagua

SEQ ID NO: 1691497 - RNA, 18 nt, Salmonella enterica enterica serovar Typhi
aagcuggccuucagguuu

SEQ ID NO: 1691498 - RNA, 17 nt, Salmonella enterica enterica serovar Typhi
aagcuggagccacaucg

SEQ ID NO: 1691499 - RNA, 13 nt, Salmonella enterica enterica serovar Typhi
aagcucauuuccc

SEQ ID NO: 1691500 - RNA, 22 nt, Salmonella enterica enterica serovar Typhi
aagcucauuucccaauaguuua

SEQ ID NO: 1691501 - RNA, 13 nt, Salmonella enterica enterica serovar Typhi
aaggaaauauuaa

SEQ ID NO: 1691502 - RNA, 15 nt, Salmonella enterica enterica serovar Typhi
aaggaaauauuaauu

SEQ ID NO: 1691503 - RNA, 18 nt, Salmonella enterica enterica serovar Typhi
aagcuuucaucuuuaaaa

SEQ ID NO: 1691504 - RNA, 19 nt, Salmonella enterica enterica serovar Typhi
aagcuguaacacugccgaa

SEQ ID NO: 1691505 - RNA, 20 nt, Salmonella enterica enterica serovar Typhi
aagcuugaaagcagucccgc

SEQ ID NO: 1691506 - RNA, 18 nt, Salmonella enterica enterica serovar Typhi
aagcgguguaaaagccag

SEQ ID NO: 1691507 - RNA, 19 nt, Salmonella enterica enterica serovar Typhi
aagcgguaaggcaccgguu

SEQ ID NO: 1691508 - RNA, 13 nt, Salmonella enterica enterica serovar Typhi
aagcgguaaaucg

SEQ ID NO: 1691509 - RNA, 16 nt, Salmonella enterica enterica serovar Typhi
aagcggcugucaucaa

SEQ ID NO: 1691510 - RNA, 17 nt, Salmonella enterica enterica serovar Typhi
aagcuauuccuguauaa

SEQ ID NO: 1691511 - RNA, 16 nt, Salmonella enterica enterica serovar Typhi
aagcuauuacaaaaau

SEQ ID NO: 1691512 - RNA, 17 nt, Salmonella enterica enterica serovar Typhi
aagcucaacgcaggcug

SEQ ID NO: 1691513 - RNA, 18 nt, Salmonella enterica enterica serovar Typhi
aagcucaacgcaggcugg

SEQ ID NO: 1691514 - RNA, 23 nt, Salmonella enterica enterica serovar Typhi
aagcggcagacgugauuuuggca

SEQ ID NO: 1691515 - RNA, 14 nt, Salmonella enterica enterica serovar Typhi
aagcgcggcagcag

SEQ ID NO: 1691516 - RNA, 13 nt, Salmonella enterica enterica serovar Typhi
aagcgcggacagc

SEQ ID NO: 1691517 - RNA, 18 nt, Salmonella enterica enterica serovar Typhi
aagcgccuguucaacaug

SEQ ID NO: 1691518 - RNA, 19 nt, Salmonella enterica enterica serovar Typhi
aagcgcgcccaccgaugac

SEQ ID NO: 1691519 - RNA, 15 nt, Salmonella enterica enterica serovar Typhi
aagcgcgccgaaaau

SEQ ID NO: 1691520 - RNA, 18 nt, Salmonella enterica enterica serovar Typhi
aagcgcccaggccgggcg

SEQ ID NO: 1691521 - RNA, 20 nt, Salmonella enterica enterica serovar Typhi
aagcgcccaugaagauguag

SEQ ID NO: 1691522 - RNA, 15 nt, Salmonella enterica enterica serovar Typhi
aagcgcccgauaaua

SEQ ID NO: 1691523 - RNA, 14 nt, Salmonella enterica enterica serovar Typhi
aagcgccugcugcg

SEQ ID NO: 1691524 - RNA, 22 nt, Salmonella enterica enterica serovar Typhi
aagcgcaggugcgauacggcuu

SEQ ID NO: 1691525 - RNA, 19 nt, Salmonella enterica enterica serovar Typhi
aagcgccagauaugaucga

SEQ ID NO: 1691526 - RNA, 17 nt, Salmonella enterica enterica serovar Typhi
aagcgcaaaauagcagc

SEQ ID NO: 1691527 - RNA, 21 nt, Salmonella enterica enterica serovar Typhi
aagcgcaaacggaucuuccac

SEQ ID NO: 1691528 - RNA, 17 nt, Salmonella enterica enterica serovar Typhi
aagcgcaaacuuccaca

SEQ ID NO: 1691529 - RNA, 20 nt, Salmonella enterica enterica serovar Typhi
aagccguauuuuauuuuuca

SEQ ID NO: 1691530 - RNA, 22 nt, Salmonella enterica enterica serovar Typhi
aagccguauuuuauuuuucaau

SEQ ID NO: 1691531 - RNA, 16 nt, Salmonella enterica enterica serovar Typhi
aagccggcggaaaaaa

SEQ ID NO: 1691532 - RNA, 22 nt, Salmonella enterica enterica serovar Typhi
aagccggucguaaugagcacuu

SEQ ID NO: 1691533 - RNA, 12 nt, Salmonella enterica enterica serovar Typhi
aagaucccaggg

SEQ ID NO: 1691534 - RNA, 21 nt, Salmonella enterica enterica serovar Typhi
aagaucccgaccaguuuuugc

SEQ ID NO: 1691535 - RNA, 20 nt, Salmonella enterica enterica serovar Typhi
aagaucgcguacagcgccau

SEQ ID NO: 1691536 - RNA, 19 nt, Salmonella enterica enterica serovar Typhi
aagaucgcggggcaacaga

SEQ ID NO: 1691537 - RNA, 15 nt, Salmonella enterica enterica serovar Typhi
aagaucgcguacagc

SEQ ID NO: 1691538 - RNA, 12 nt, Salmonella enterica enterica serovar Typhi
aagccuuucugu

SEQ ID NO: 1691539 - RNA, 22 nt, Salmonella enterica enterica serovar Typhi
aagcgaagcgucauccggcaau

SEQ ID NO: 1691540 - RNA, 18 nt, Salmonella enterica enterica serovar Typhi
aagcgauacgucagcggu

SEQ ID NO: 1691541 - RNA, 18 nt, Salmonella enterica enterica serovar Typhi
aagcgaucaagacaaaag

SEQ ID NO: 1691542 - RNA, 16 nt, Salmonella enterica enterica serovar Typhi
aagcgaauacucacuu

SEQ ID NO: 1691543 - RNA, 23 nt, Salmonella enterica enterica serovar Typhi
aagcgaauacuccugcaacagaa

SEQ ID NO: 1691544 - RNA, 14 nt, Salmonella enterica enterica serovar Typhi
aagcgaaugcuguc

SEQ ID NO: 1691545 - RNA, 22 nt, Salmonella enterica enterica serovar Typhi
aagccugauggcgcuucgcuua

SEQ ID NO: 1691546 - RNA, 16 nt, Salmonella enterica enterica serovar Typhi
aagccuugcugaauca

SEQ ID NO: 1691547 - RNA, 19 nt, Salmonella enterica enterica serovar Typhi
acaacguaauauuaagcag

SEQ ID NO: 1691548 - RNA, 19 nt, Salmonella enterica enterica serovar Typhi
acaacggcaauuuuuacaa

SEQ ID NO: 1691549 - RNA, 21 nt, Salmonella enterica enterica serovar Typhi
acaacgucaguggaaaacagc

SEQ ID NO: 1691550 - RNA, 23 nt, Salmonella enterica enterica serovar Typhi
acaagccgccaacgccagcagcg

SEQ ID NO: 1691551 - RNA, 16 nt, Salmonella enterica enterica serovar Typhi
acaagcagugcuggca

SEQ ID NO: 1691552 - RNA, 21 nt, Salmonella enterica enterica serovar Typhi
acaagcaaaccuauuucagua

SEQ ID NO: 1691553 - RNA, 20 nt, Salmonella enterica enterica serovar Typhi
acaagcagaaauacugugcc

SEQ ID NO: 1691554 - RNA, 23 nt, Salmonella enterica enterica serovar Typhi
acaagcaguaucguguuauuuuc

SEQ ID NO: 1691555 - RNA, 19 nt, Salmonella enterica enterica serovar Typhi
acaagaacuuaaauuaaug

SEQ ID NO: 1691556 - RNA, 23 nt, Salmonella enterica enterica serovar Typhi
acaagaacuuaaauuaaugauua

SEQ ID NO: 1691557 - RNA, 13 nt, Salmonella enterica enterica serovar Typhi
acaagaauaugca

SEQ ID NO: 1691558 - RNA, 19 nt, Salmonella enterica enterica serovar Typhi
acaagaaggguauagagca

SEQ ID NO: 1691559 - RNA, 12 nt, Salmonella enterica enterica serovar Typhi
acaagaauuuau

SEQ ID NO: 1691560 - RNA, 18 nt, Salmonella enterica enterica serovar Typhi
acaaguagccugccagca

SEQ ID NO: 1691561 - RNA, 20 nt, Salmonella enterica enterica serovar Typhi
acaaguagccugccagcaac

SEQ ID NO: 1691562 - RNA, 22 nt, Salmonella enterica enterica serovar Typhi
acaauaaucgcgagaaaauaga

SEQ ID NO: 1691563 - RNA, 23 nt, Salmonella enterica enterica serovar Typhi
acaauagcgcuaaacagcgccgc

SEQ ID NO: 1691564 - RNA, 19 nt, Salmonella enterica enterica serovar Typhi
acaauaacaccacaacaca

SEQ ID NO: 1691565 - RNA, 14 nt, Salmonella enterica enterica serovar Typhi
acaauguacagaau

SEQ ID NO: 1691566 - RNA, 15 nt, Salmonella enterica enterica serovar Typhi
acaauggcccgauac

SEQ ID NO: 1691567 - RNA, 18 nt, Salmonella enterica enterica serovar Typhi
acaaugggauaaaaugga

SEQ ID NO: 1691568 - RNA, 13 nt, Salmonella enterica enterica serovar Typhi
acaaugaaccagc

SEQ ID NO: 1691569 - RNA, 20 nt, Salmonella enterica enterica serovar Typhi
acaaucucaauaccacgccg

SEQ ID NO: 1691570 - RNA, 23 nt, Salmonella enterica enterica serovar Typhi
acaaucuccagaccgcugcggaa

SEQ ID NO: 1691571 - RNA, 21 nt, Salmonella enterica enterica serovar Typhi
acaaucugugugggcacucga

SEQ ID NO: 1691572 - RNA, 20 nt, Salmonella enterica enterica serovar Typhi
acaauaugguuauccagcag

SEQ ID NO: 1691573 - RNA, 14 nt, Salmonella enterica enterica serovar Typhi
acaauaucaucguc

SEQ ID NO: 1691574 - RNA, 15 nt, Salmonella enterica enterica serovar Typhi
acaauuacgcaagag

SEQ ID NO: 1691575 - RNA, 21 nt, Salmonella enterica enterica serovar Typhi
acaauugcugcguaacugcca

SEQ ID NO: 1691576 - RNA, 20 nt, Salmonella enterica enterica serovar Typhi
acacaauaucgccaucguag

SEQ ID NO: 1691577 - RNA, 13 nt, Salmonella enterica enterica serovar Typhi
acacaauuuucuu

SEQ ID NO: 1691578 - RNA, 19 nt, Salmonella enterica enterica serovar Typhi
acaauuucaccuuuggcuu

SEQ ID NO: 1691579 - RNA, 13 nt, Salmonella enterica enterica serovar Typhi
acaauuuaucugc

SEQ ID NO: 1691580 - RNA, 13 nt, Salmonella enterica enterica serovar Typhi
acacagaucgaau

SEQ ID NO: 1691581 - RNA, 13 nt, Salmonella enterica enterica serovar Typhi
acacagcagaaag

SEQ ID NO: 1691582 - RNA, 22 nt, Salmonella enterica enterica serovar Typhi
acacagaaaaaccaaaaaauau

SEQ ID NO: 1691583 - RNA, 20 nt, Salmonella enterica enterica serovar Typhi
acacagacugcuuguuuaau

SEQ ID NO: 1691584 - RNA, 21 nt, Salmonella enterica enterica serovar Typhi
acacacucggugcauuugucg

SEQ ID NO: 1691585 - RNA, 15 nt, Salmonella enterica enterica serovar Typhi
acacacucaucuucg

SEQ ID NO: 1691586 - RNA, 13 nt, Salmonella enterica enterica serovar Typhi
acacaguaaaaaa

SEQ ID NO: 1691587 - RNA, 22 nt, Salmonella enterica enterica serovar Typhi
acacagggucgucaaacuuuua

SEQ ID NO: 1691588 - RNA, 19 nt, Salmonella enterica enterica serovar Typhi
acacagucucauugaucag

SEQ ID NO: 1691589 - RNA, 15 nt, Salmonella enterica enterica serovar Typhi
acacaguaaaaaaac

SEQ ID NO: 1691590 - RNA, 15 nt, Salmonella enterica enterica serovar Typhi
acacagcagaaagca

SEQ ID NO: 1691591 - RNA, 14 nt, Salmonella enterica enterica serovar Typhi
acacagccagcacg

SEQ ID NO: 1691592 - RNA, 22 nt, Salmonella enterica enterica serovar Typhi
acacaggcgugguggauaucca

SEQ ID NO: 1691593 - RNA, 19 nt, Salmonella enterica enterica serovar Typhi
acacauaucgccagccaug

SEQ ID NO: 1691594 - RNA, 15 nt, Salmonella enterica enterica serovar Typhi
acacaucacaaucuc

SEQ ID NO: 1691595 - RNA, 17 nt, Salmonella enterica enterica serovar Typhi
acacauaacgcccgaca

SEQ ID NO: 1691596 - RNA, 21 nt, Salmonella enterica enterica serovar Typhi
acaccagcccuggcuguccuu

SEQ ID NO: 1691597 - RNA, 14 nt, Salmonella enterica enterica serovar Typhi
acaccagccguuca

SEQ ID NO: 1691598 - RNA, 18 nt, Salmonella enterica enterica serovar Typhi
acaccaggaguuaaaccu

SEQ ID NO: 1691599 - RNA, 15 nt, Salmonella enterica enterica serovar Typhi
acaccaucccgcucu

SEQ ID NO: 1691600 - RNA, 12 nt, Salmonella enterica enterica serovar Typhi
acagcggagaga

SEQ ID NO: 1691601 - RNA, 13 nt, Salmonella enterica enterica serovar Typhi
acagcggaaaauc

SEQ ID NO: 1691602 - RNA, 14 nt, Salmonella enterica enterica serovar Typhi
acagcggcgcgcca

SEQ ID NO: 1691603 - RNA, 23 nt, Salmonella enterica enterica serovar Typhi
acagcgggguaaagccuuuaugc

SEQ ID NO: 1691604 - RNA, 20 nt, Salmonella enterica enterica serovar Typhi
acagcggcucgaacuguucu

SEQ ID NO: 1691605 - RNA, 20 nt, Salmonella enterica enterica serovar Typhi
acagcgcgccaauccaugcc

SEQ ID NO: 1691606 - RNA, 16 nt, Salmonella enterica enterica serovar Typhi
acagcccuuucaggaa

SEQ ID NO: 1691607 - RNA, 12 nt, Salmonella enterica enterica serovar Typhi
acagccaaaaau

SEQ ID NO: 1691608 - RNA, 22 nt, Salmonella enterica enterica serovar Typhi
acagcuucaugcgccgcgacaa

SEQ ID NO: 1691609 - RNA, 16 nt, Salmonella enterica enterica serovar Typhi
acaggaguucaucaug

SEQ ID NO: 1691610 - RNA, 15 nt, Salmonella enterica enterica serovar Typhi
acaggacaagcagug

SEQ ID NO: 1691611 - RNA, 21 nt, Salmonella enterica enterica serovar Typhi
acagcucggcaaagcccauca

SEQ ID NO: 1691612 - RNA, 12 nt, Salmonella enterica enterica serovar Typhi
acagcgugaaca

SEQ ID NO: 1691613 - RNA, 21 nt, Salmonella enterica enterica serovar Typhi
acagcguaguuuauucaucuc

SEQ ID NO: 1691614 - RNA, 17 nt, Salmonella enterica enterica serovar Typhi
acagcguaggccaggca

SEQ ID NO: 1691615 - RNA, 22 nt, Salmonella enterica enterica serovar Typhi
acagcguaaugcgccaggcagc

SEQ ID NO: 1691616 - RNA, 15 nt, Salmonella enterica enterica serovar Typhi
acagcguacaauggc

SEQ ID NO: 1691617 - RNA, 20 nt, Salmonella enterica enterica serovar Typhi
acagcguacaauggcaggca

SEQ ID NO: 1691618 - RNA, 18 nt, Salmonella enterica enterica serovar Typhi
acagaggaaugaaaacga

SEQ ID NO: 1691619 - RNA, 18 nt, Salmonella enterica enterica serovar Typhi
acagagagggaaaaaaau

SEQ ID NO: 1691620 - RNA, 17 nt, Salmonella enterica enterica serovar Typhi
acagauaagcgucugca

SEQ ID NO: 1691621 - RNA, 14 nt, Salmonella enterica enterica serovar Typhi
acagauaacaccag

SEQ ID NO: 1691622 - RNA, 23 nt, Salmonella enterica enterica serovar Typhi
acagauagcccugagcccacagc

SEQ ID NO: 1691623 - RNA, 16 nt, Salmonella enterica enterica serovar Typhi
acagauaugaaaugag

SEQ ID NO: 1691624 - RNA, 16 nt, Salmonella enterica enterica serovar Typhi
acagauaagcgucugc

SEQ ID NO: 1691625 - RNA, 14 nt, Salmonella enterica enterica serovar Typhi
acagauaauuaaua

SEQ ID NO: 1691626 - RNA, 15 nt, Salmonella enterica enterica serovar Typhi
acagaugccuuguaa

SEQ ID NO: 1691627 - RNA, 21 nt, Salmonella enterica enterica serovar Typhi
acagaugccuuguaagccgga

SEQ ID NO: 1691628 - RNA, 20 nt, Salmonella enterica enterica serovar Typhi
acagauggcgcugcguuucc

SEQ ID NO: 1691629 - RNA, 12 nt, Salmonella enterica enterica serovar Typhi
acagauuaucag

SEQ ID NO: 1691630 - RNA, 17 nt, Salmonella enterica enterica serovar Typhi
acagauuggucagcagc

SEQ ID NO: 1691631 - RNA, 22 nt, Salmonella enterica enterica serovar Typhi
acagauuuugcacuuuugccag

SEQ ID NO: 1691632 - RNA, 13 nt, Salmonella enterica enterica serovar Typhi
acagcaccaucau

SEQ ID NO: 1691633 - RNA, 14 nt, Salmonella enterica enterica serovar Typhi
acagcaccagcagg

SEQ ID NO: 1691634 - RNA, 15 nt, Salmonella enterica enterica serovar Typhi
acacugccaccgcuc

SEQ ID NO: 1691635 - RNA, 22 nt, Salmonella enterica enterica serovar Typhi
acacuguugccgacagcggaaa

SEQ ID NO: 1691636 - RNA, 15 nt, Salmonella enterica enterica serovar Typhi
acacuccgcgcaugu

SEQ ID NO: 1691637 - RNA, 18 nt, Salmonella enterica enterica serovar Typhi
acacucacaaaacuauuu

SEQ ID NO: 1691638 - RNA, 15 nt, Salmonella enterica enterica serovar Typhi
acacugaagccuggu

SEQ ID NO: 1691639 - RNA, 22 nt, Salmonella enterica enterica serovar Typhi
acacccggcuuuugcuuucugg

SEQ ID NO: 1691640 - RNA, 14 nt, Salmonella enterica enterica serovar Typhi
acaccauuucacaa

SEQ ID NO: 1691641 - RNA, 12 nt, Salmonella enterica enterica serovar Typhi
acacccugcccc

SEQ ID NO: 1691642 - RNA, 15 nt, Salmonella enterica enterica serovar Typhi
acacccucugcgccu

SEQ ID NO: 1691643 - RNA, 13 nt, Salmonella enterica enterica serovar Typhi
acaccgagacaga

SEQ ID NO: 1691644 - RNA, 14 nt, Salmonella enterica enterica serovar Typhi
acacguugcgacaa

SEQ ID NO: 1691645 - RNA, 21 nt, Salmonella enterica enterica serovar Typhi
acacguuugcccgaugucgcu

SEQ ID NO: 1691646 - RNA, 13 nt, Salmonella enterica enterica serovar Typhi
acacuauauugcg

SEQ ID NO: 1691647 - RNA, 14 nt, Salmonella enterica enterica serovar Typhi
acagacaaggugga

SEQ ID NO: 1691648 - RNA, 12 nt, Salmonella enterica enterica serovar Typhi
acagaccgccau

SEQ ID NO: 1691649 - RNA, 23 nt, Salmonella enterica enterica serovar Typhi
acagaccccgcaucgcccgcucc

SEQ ID NO: 1691650 - RNA, 17 nt, Salmonella enterica enterica serovar Typhi
acagacuucauuuucca

SEQ ID NO: 1691651 - RNA, 18 nt, Salmonella enterica enterica serovar Typhi
acagaauuaacgcagaau

SEQ ID NO: 1691652 - RNA, 20 nt, Salmonella enterica enterica serovar Typhi
acagaaugcugaacagccgu

SEQ ID NO: 1691653 - RNA, 13 nt, Salmonella enterica enterica serovar Typhi
acagaagcggccu

SEQ ID NO: 1691654 - RNA, 16 nt, Salmonella enterica enterica serovar Typhi
acacuuucgcccggcg

SEQ ID NO: 1691655 - RNA, 17 nt, Salmonella enterica enterica serovar Typhi
acacuuucgcccggcgc

SEQ ID NO: 1691656 - RNA, 18 nt, Salmonella enterica enterica serovar Typhi
acacuucucaacauugac

SEQ ID NO: 1691657 - RNA, 21 nt, Salmonella enterica enterica serovar Typhi
acacuugcaacucgcacugau

SEQ ID NO: 1691658 - RNA, 16 nt, Salmonella enterica enterica serovar Typhi
acagaaaccauaaaca

SEQ ID NO: 1691659 - RNA, 14 nt, Salmonella enterica enterica serovar Typhi
acauccagacagcc

SEQ ID NO: 1691660 - RNA, 12 nt, Salmonella enterica enterica serovar Typhi
acauccacuggu

SEQ ID NO: 1691661 - RNA, 17 nt, Salmonella enterica enterica serovar Typhi
acauccaucacuccuua

SEQ ID NO: 1691662 - RNA, 15 nt, Salmonella enterica enterica serovar Typhi
acaucccagacaaaa

SEQ ID NO: 1691663 - RNA, 15 nt, Salmonella enterica enterica serovar Typhi
acaucagcaaaugaa

SEQ ID NO: 1691664 - RNA, 18 nt, Salmonella enterica enterica serovar Typhi
acaucagccagcagcuca

SEQ ID NO: 1691665 - RNA, 19 nt, Salmonella enterica enterica serovar Typhi
acauauuuuuguugaaaua

SEQ ID NO: 1691666 - RNA, 16 nt, Salmonella enterica enterica serovar Typhi
acauauuuuucacaca

SEQ ID NO: 1691667 - RNA, 12 nt, Salmonella enterica enterica serovar Typhi
acauauuuuuau

SEQ ID NO: 1691668 - RNA, 22 nt, Salmonella enterica enterica serovar Typhi
acaucaacaaagggcaccuggg

SEQ ID NO: 1691669 - RNA, 19 nt, Salmonella enterica enterica serovar Typhi
acaucagaaaaaagccaag

SEQ ID NO: 1691670 - RNA, 13 nt, Salmonella enterica enterica serovar Typhi
acaucagauaaac

SEQ ID NO: 1691671 - RNA, 16 nt, Salmonella enterica enterica serovar Typhi
acaucagagguaauua

SEQ ID NO: 1691672 - RNA, 14 nt, Salmonella enterica enterica serovar Typhi
acauauuccagaag

SEQ ID NO: 1691673 - RNA, 14 nt, Salmonella enterica enterica serovar Typhi
acauauucaauaau

SEQ ID NO: 1691674 - RNA, 14 nt, Salmonella enterica enterica serovar Typhi
acauauuugcgugu

SEQ ID NO: 1691675 - RNA, 23 nt, Salmonella enterica enterica serovar Typhi
acauauuugcgugucaucaaaau

SEQ ID NO: 1691676 - RNA, 15 nt, Salmonella enterica enterica serovar Typhi
acauauuguuuucua

SEQ ID NO: 1691677 - RNA, 19 nt, Salmonella enterica enterica serovar Typhi
acauauuguuuucuauuuu

SEQ ID NO: 1691678 - RNA, 17 nt, Salmonella enterica enterica serovar Typhi
acauaucccauacguuu

SEQ ID NO: 1691679 - RNA, 22 nt, Salmonella enterica enterica serovar Typhi
acauaucgcaauugauacauuu

SEQ ID NO: 1691680 - RNA, 20 nt, Salmonella enterica enterica serovar Typhi
acauaucgacauaaguaaau

SEQ ID NO: 1691681 - RNA, 18 nt, Salmonella enterica enterica serovar Typhi
acauauagcaguuuucac

SEQ ID NO: 1691682 - RNA, 19 nt, Salmonella enterica enterica serovar Typhi
acauaggcaauauccuccg

SEQ ID NO: 1691683 - RNA, 17 nt, Salmonella enterica enterica serovar Typhi
acauagcuaaauaaaaa

SEQ ID NO: 1691684 - RNA, 15 nt, Salmonella enterica enterica serovar Typhi
acauagcauaauaau

SEQ ID NO: 1691685 - RNA, 12 nt, Salmonella enterica enterica serovar Typhi
acauagcaucca

SEQ ID NO: 1691686 - RNA, 14 nt, Salmonella enterica enterica serovar Typhi
acauagcuaaauaa

SEQ ID NO: 1691687 - RNA, 19 nt, Salmonella enterica enterica serovar Typhi
acauagcuaaauaaaaaua

SEQ ID NO: 1691688 - RNA, 19 nt, Salmonella enterica enterica serovar Typhi
acauacguuuaaagcgcuc

SEQ ID NO: 1691689 - RNA, 20 nt, Salmonella enterica enterica serovar Typhi
acauacugaaauuucuuuuc

SEQ ID NO: 1691690 - RNA, 21 nt, Salmonella enterica enterica serovar Typhi
acauacguuuaaagcgcucgu

SEQ ID NO: 1691691 - RNA, 20 nt, Salmonella enterica enterica serovar Typhi
acauacugcuuuuucggcuc

SEQ ID NO: 1691692 - RNA, 20 nt, Salmonella enterica enterica serovar Typhi
acaggcaccagcguauaauu

SEQ ID NO: 1691693 - RNA, 11 nt, Salmonella enterica enterica serovar Typhi
acaggaugcuu

SEQ ID NO: 1691694 - RNA, 16 nt, Salmonella enterica enterica serovar Typhi
acaggcauggccuuca

SEQ ID NO: 1691695 - RNA, 20 nt, Salmonella enterica enterica serovar Typhi
acaggccaacauagcggcaa

SEQ ID NO: 1691696 - RNA, 17 nt, Salmonella enterica enterica serovar Typhi
acauacaaagagaaaau

SEQ ID NO: 1691697 - RNA, 23 nt, Salmonella enterica enterica serovar Typhi
acauacaccggcgccagcucugc

SEQ ID NO: 1691698 - RNA, 18 nt, Salmonella enterica enterica serovar Typhi
acauugcuguggaaaauc

SEQ ID NO: 1691699 - RNA, 14 nt, Salmonella enterica enterica serovar Typhi
acauuggcgcggca

SEQ ID NO: 1691700 - RNA, 21 nt, Salmonella enterica enterica serovar Typhi
acauuggcgcggcaggaaugu

SEQ ID NO: 1691701 - RNA, 19 nt, Salmonella enterica enterica serovar Typhi
acauuucagcgcagaauuu

SEQ ID NO: 1691702 - RNA, 17 nt, Salmonella enterica enterica serovar Typhi
acauuuaucuuccggca

SEQ ID NO: 1691703 - RNA, 15 nt, Salmonella enterica enterica serovar Typhi
acauucguaacaugc

SEQ ID NO: 1691704 - RNA, 19 nt, Salmonella enterica enterica serovar Typhi
acauugccggauggcggcg

SEQ ID NO: 1691705 - RNA, 14 nt, Salmonella enterica enterica serovar Typhi
acauugccggcauc

SEQ ID NO: 1691706 - RNA, 17 nt, Salmonella enterica enterica serovar Typhi
acauuccugacauuuau

SEQ ID NO: 1691707 - RNA, 20 nt, Salmonella enterica enterica serovar Typhi
acauuccugacauuuauauu

SEQ ID NO: 1691708 - RNA, 21 nt, Salmonella enterica enterica serovar Typhi
acauuccauuuuucgaucuuc

SEQ ID NO: 1691709 - RNA, 23 nt, Salmonella enterica enterica serovar Typhi
acauuauucacgcuauguuugcu

SEQ ID NO: 1691710 - RNA, 16 nt, Salmonella enterica enterica serovar Typhi
acauuauugcacauaa

SEQ ID NO: 1691711 - RNA, 19 nt, Salmonella enterica enterica serovar Typhi
acaugauaaguuucucuuc

SEQ ID NO: 1691712 - RNA, 21 nt, Salmonella enterica enterica serovar Typhi
acauggcggucgccauauguu

SEQ ID NO: 1691713 - RNA, 14 nt, Salmonella enterica enterica serovar Typhi
acaugggcaggaac

SEQ ID NO: 1691714 - RNA, 16 nt, Salmonella enterica enterica serovar Typhi
acauguugugucggcc

SEQ ID NO: 1691715 - RNA, 21 nt, Salmonella enterica enterica serovar Typhi
acauggacaccggaagugaau

SEQ ID NO: 1691716 - RNA, 22 nt, Salmonella enterica enterica serovar Typhi
acauggcgaaaaucggcaggcc

SEQ ID NO: 1691717 - RNA, 22 nt, Salmonella enterica enterica serovar Typhi
acauggacaccggaagugaauu

SEQ ID NO: 1691718 - RNA, 16 nt, Salmonella enterica enterica serovar Typhi
acauggcaauggcuuc

SEQ ID NO: 1691719 - RNA, 16 nt, Salmonella enterica enterica serovar Typhi
acaucuuccaugccuu

SEQ ID NO: 1691720 - RNA, 13 nt, Salmonella enterica enterica serovar Typhi
acaucuuugccaa

SEQ ID NO: 1691721 - RNA, 22 nt, Salmonella enterica enterica serovar Typhi
acaugaaagaagaaucgcccca

SEQ ID NO: 1691722 - RNA, 21 nt, Salmonella enterica enterica serovar Typhi
acauccgauuucauggucauc

SEQ ID NO: 1691723 - RNA, 21 nt, Salmonella enterica enterica serovar Typhi
acauccccgcguuaagccccu

SEQ ID NO: 1691724 - RNA, 22 nt, Salmonella enterica enterica serovar Typhi
accaacgucgugccagugaugc

SEQ ID NO: 1691725 - RNA, 16 nt, Salmonella enterica enterica serovar Typhi
accaacgcauaaaaac

SEQ ID NO: 1691726 - RNA, 15 nt, Salmonella enterica enterica serovar Typhi
accaacguuuuuccu

SEQ ID NO: 1691727 - RNA, 18 nt, Salmonella enterica enterica serovar Typhi
accaacguuuuuccuuga

SEQ ID NO: 1691728 - RNA, 17 nt, Salmonella enterica enterica serovar Typhi
accaaugccaaaaaaac

SEQ ID NO: 1691729 - RNA, 13 nt, Salmonella enterica enterica serovar Typhi
accaauagccuug

SEQ ID NO: 1691730 - RNA, 16 nt, Salmonella enterica enterica serovar Typhi
accaauacccagcgcc

SEQ ID NO: 1691731 - RNA, 14 nt, Salmonella enterica enterica serovar Typhi
accaauaagaacuu

SEQ ID NO: 1691732 - RNA, 21 nt, Salmonella enterica enterica serovar Typhi
accaauaauugccgaauauug

SEQ ID NO: 1691733 - RNA, 16 nt, Salmonella enterica enterica serovar Typhi
accaauaguauccaua

SEQ ID NO: 1691734 - RNA, 16 nt, Salmonella enterica enterica serovar Typhi
accaauuccaccaccu

SEQ ID NO: 1691735 - RNA, 13 nt, Salmonella enterica enterica serovar Typhi
accaaugugcaaa

SEQ ID NO: 1691736 - RNA, 15 nt, Salmonella enterica enterica serovar Typhi
accacaaaggcgcgu

SEQ ID NO: 1691737 - RNA, 20 nt, Salmonella enterica enterica serovar Typhi
accacaucagaccgccaagc

SEQ ID NO: 1691738 - RNA, 20 nt, Salmonella enterica enterica serovar Typhi
accacaguugcgacugauaa

SEQ ID NO: 1691739 - RNA, 14 nt, Salmonella enterica enterica serovar Typhi
accacauuauagau

SEQ ID NO: 1691740 - RNA, 16 nt, Salmonella enterica enterica serovar Typhi
accacaugaccagcgc

SEQ ID NO: 1691741 - RNA, 12 nt, Salmonella enterica enterica serovar Typhi
accaccacgccc

SEQ ID NO: 1691742 - RNA, 18 nt, Salmonella enterica enterica serovar Typhi
accacaccugaugguuau

SEQ ID NO: 1691743 - RNA, 17 nt, Salmonella enterica enterica serovar Typhi
accacaggcggaaaaca

SEQ ID NO: 1691744 - RNA, 21 nt, Salmonella enterica enterica serovar Typhi
accacacggaauccccggcuu

SEQ ID NO: 1691745 - RNA, 18 nt, Salmonella enterica enterica serovar Typhi
accacagucaucgcgcca

SEQ ID NO: 1691746 - RNA, 21 nt, Salmonella enterica enterica serovar Typhi
accacagccuuauaagaacca

SEQ ID NO: 1691747 - RNA, 22 nt, Salmonella enterica enterica serovar Typhi
accacagccuuauaagaaccau

SEQ ID NO: 1691748 - RNA, 15 nt, Salmonella enterica enterica serovar Typhi
accacagccgugucc

SEQ ID NO: 1691749 - RNA, 14 nt, Salmonella enterica enterica serovar Typhi
accacggcuucagc

SEQ ID NO: 1691750 - RNA, 15 nt, Salmonella enterica enterica serovar Typhi
accacggcuucagcg

SEQ ID NO: 1691751 - RNA, 15 nt, Salmonella enterica enterica serovar Typhi
accacgggguuggcc

SEQ ID NO: 1691752 - RNA, 17 nt, Salmonella enterica enterica serovar Typhi
accacggccacagccau

SEQ ID NO: 1691753 - RNA, 21 nt, Salmonella enterica enterica serovar Typhi
accacgguauuaacaggcgcc

SEQ ID NO: 1691754 - RNA, 15 nt, Salmonella enterica enterica serovar Typhi
accacgguagagauu

SEQ ID NO: 1691755 - RNA, 14 nt, Salmonella enterica enterica serovar Typhi
accacguuaucuuc

SEQ ID NO: 1691756 - RNA, 16 nt, Salmonella enterica enterica serovar Typhi
accacgucauccggca

SEQ ID NO: 1691757 - RNA, 19 nt, Salmonella enterica enterica serovar Typhi
accacgucauccggcaagc

SEQ ID NO: 1691758 - RNA, 18 nt, Salmonella enterica enterica serovar Typhi
accacggauaagccagcc

SEQ ID NO: 1691759 - RNA, 19 nt, Salmonella enterica enterica serovar Typhi
accacgcccggaucaaaca

SEQ ID NO: 1691760 - RNA, 15 nt, Salmonella enterica enterica serovar Typhi
accacgccaccgccg

SEQ ID NO: 1691761 - RNA, 14 nt, Salmonella enterica enterica serovar Typhi
accacgaucuuguc

SEQ ID NO: 1691762 - RNA, 22 nt, Salmonella enterica enterica serovar Typhi
accacgaucuugucacaauaac

SEQ ID NO: 1691763 - RNA, 18 nt, Salmonella enterica enterica serovar Typhi
accacugacacggaacaa

SEQ ID NO: 1691764 - RNA, 21 nt, Salmonella enterica enterica serovar Typhi
accacuccggcauaauaugca

SEQ ID NO: 1691765 - RNA, 17 nt, Salmonella enterica enterica serovar Typhi
accacccgggaaaaaug

SEQ ID NO: 1691766 - RNA, 17 nt, Salmonella enterica enterica serovar Typhi
accaccccacaguaaug

SEQ ID NO: 1691767 - RNA, 23 nt, Salmonella enterica enterica serovar Typhi
accaccgaauuccgcuaaucuuu

SEQ ID NO: 1691768 - RNA, 12 nt, Salmonella enterica enterica serovar Typhi
accacccagcca

SEQ ID NO: 1691769 - RNA, 13 nt, Salmonella enterica enterica serovar Typhi
accacccagccag

SEQ ID NO: 1691770 - RNA, 21 nt, Salmonella enterica enterica serovar Typhi
accaccaguaaccgccacagc

SEQ ID NO: 1691771 - RNA, 16 nt, Salmonella enterica enterica serovar Typhi
accacgaaaauuauuu

SEQ ID NO: 1691772 - RNA, 15 nt, Salmonella enterica enterica serovar Typhi
accaccgcccugucc

SEQ ID NO: 1691773 - RNA, 18 nt, Salmonella enterica enterica serovar Typhi
aauuucagggcuuauuca

SEQ ID NO: 1691774 - RNA, 19 nt, Salmonella enterica enterica serovar Typhi
aauuucaccaccgguauaa

SEQ ID NO: 1691775 - RNA, 17 nt, Salmonella enterica enterica serovar Typhi
aauuucuuccauuagcu

SEQ ID NO: 1691776 - RNA, 18 nt, Salmonella enterica enterica serovar Typhi
aauuucugguaccagauc

SEQ ID NO: 1691777 - RNA, 14 nt, Salmonella enterica enterica serovar Typhi
aauuucucgcccgc

SEQ ID NO: 1691778 - RNA, 19 nt, Salmonella enterica enterica serovar Typhi
aauuucccccacuucugac

SEQ ID NO: 1691779 - RNA, 20 nt, Salmonella enterica enterica serovar Typhi
aauuucccccacuucugaca

SEQ ID NO: 1691780 - RNA, 21 nt, Salmonella enterica enterica serovar Typhi
aauuucgaaacaggaaaaaca

SEQ ID NO: 1691781 - RNA, 14 nt, Salmonella enterica enterica serovar Typhi
aauugcucugccag

SEQ ID NO: 1691782 - RNA, 13 nt, Salmonella enterica enterica serovar Typhi
aauuuaaauagca

SEQ ID NO: 1691783 - RNA, 24 nt, Salmonella enterica enterica serovar Typhi
aauugcgccaggcccagccgcucc

SEQ ID NO: 1691784 - RNA, 23 nt, Salmonella enterica enterica serovar Typhi
aauugcgguagaugaaaauuugu

SEQ ID NO: 1691785 - RNA, 14 nt, Salmonella enterica enterica serovar Typhi
aauuuauccaguaa

SEQ ID NO: 1691786 - RNA, 14 nt, Salmonella enterica enterica serovar Typhi
aauuuaucagacaa

SEQ ID NO: 1691787 - RNA, 22 nt, Salmonella enterica enterica serovar Typhi
aauuuagcuauuccaaaauaau

SEQ ID NO: 1691788 - RNA, 13 nt, Salmonella enterica enterica serovar Typhi
aauuuauuucugc

SEQ ID NO: 1691789 - RNA, 16 nt, Salmonella enterica enterica serovar Typhi
aauuuauuaacccuuc

SEQ ID NO: 1691790 - RNA, 22 nt, Salmonella enterica enterica serovar Typhi
aauuuaugauuuuaacaucacc

SEQ ID NO: 1691791 - RNA, 11 nt, Salmonella enterica enterica serovar Typhi
aauuuugauaa

SEQ ID NO: 1691792 - RNA, 19 nt, Salmonella enterica enterica serovar Typhi
aauuuugcaccaucaacgc

SEQ ID NO: 1691793 - RNA, 15 nt, Salmonella enterica enterica serovar Typhi
aauuuugcauaaaua

SEQ ID NO: 1691794 - RNA, 19 nt, Salmonella enterica enterica serovar Typhi
aauuuucagacacugcacc

SEQ ID NO: 1691795 - RNA, 13 nt, Salmonella enterica enterica serovar Typhi
aauuuuagaaaua

SEQ ID NO: 1691796 - RNA, 13 nt, Salmonella enterica enterica serovar Typhi
aauuuuaugacgu

SEQ ID NO: 1691797 - RNA, 18 nt, Salmonella enterica enterica serovar Typhi
aauuuuaugacguaagcg

SEQ ID NO: 1691798 - RNA, 16 nt, Salmonella enterica enterica serovar Typhi
aauuucuugaucaauc

SEQ ID NO: 1691799 - RNA, 17 nt, Salmonella enterica enterica serovar Typhi
aauuugucagacaugau

SEQ ID NO: 1691800 - RNA, 14 nt, Salmonella enterica enterica serovar Typhi
aauuugugagauaa

SEQ ID NO: 1691801 - RNA, 21 nt, Salmonella enterica enterica serovar Typhi
aauuuguacuucagagcugaa

SEQ ID NO: 1691802 - RNA, 18 nt, Salmonella enterica enterica serovar Typhi
aauuaugccugucaucau

SEQ ID NO: 1691803 - RNA, 17 nt, Salmonella enterica enterica serovar Typhi
aauuauguauuucucgc

SEQ ID NO: 1691804 - RNA, 14 nt, Salmonella enterica enterica serovar Typhi
aauuauuacagaca

SEQ ID NO: 1691805 - RNA, 14 nt, Salmonella enterica enterica serovar Typhi
aauuauuaccaaug

SEQ ID NO: 1691806 - RNA, 12 nt, Salmonella enterica enterica serovar Typhi
aauuauuuuuca

SEQ ID NO: 1691807 - RNA, 19 nt, Salmonella enterica enterica serovar Typhi
aauuacuaucuucaaagcc

SEQ ID NO: 1691808 - RNA, 16 nt, Salmonella enterica enterica serovar Typhi
aauuacuuaugauaua

SEQ ID NO: 1691809 - RNA, 17 nt, Salmonella enterica enterica serovar Typhi
aauuacuuaugauauau

SEQ ID NO: 1691810 - RNA, 12 nt, Salmonella enterica enterica serovar Typhi
aauuacuuauga

SEQ ID NO: 1691811 - RNA, 13 nt, Salmonella enterica enterica serovar Typhi
aauuacuuaugau

SEQ ID NO: 1691812 - RNA, 18 nt, Salmonella enterica enterica serovar Typhi
aauuagcucgggaauaaa

SEQ ID NO: 1691813 - RNA, 23 nt, Salmonella enterica enterica serovar Typhi
aauuagcucgggaauaaaaauaa

SEQ ID NO: 1691814 - RNA, 20 nt, Salmonella enterica enterica serovar Typhi
aauuagcgacauacauaacg

SEQ ID NO: 1691815 - RNA, 16 nt, Salmonella enterica enterica serovar Typhi
aauuaauauuuaacac

SEQ ID NO: 1691816 - RNA, 14 nt, Salmonella enterica enterica serovar Typhi
aauuaauaaacaau

SEQ ID NO: 1691817 - RNA, 23 nt, Salmonella enterica enterica serovar Typhi
aaugguauuaugcggaccgauag

SEQ ID NO: 1691818 - RNA, 14 nt, Salmonella enterica enterica serovar Typhi
aauggucgcgccag

SEQ ID NO: 1691819 - RNA, 21 nt, Salmonella enterica enterica serovar Typhi
aauggucuuaaaugccgccgg

SEQ ID NO: 1691820 - RNA, 22 nt, Salmonella enterica enterica serovar Typhi
aauguauaauccaacauuauca

SEQ ID NO: 1691821 - RNA, 16 nt, Salmonella enterica enterica serovar Typhi
aauguacgccuaaaaa

SEQ ID NO: 1691822 - RNA, 16 nt, Salmonella enterica enterica serovar Typhi
aauuacagcucauaaa

SEQ ID NO: 1691823 - RNA, 17 nt, Salmonella enterica enterica serovar Typhi
aauuacaucaauaaaca

SEQ ID NO: 1691824 - RNA, 17 nt, Salmonella enterica enterica serovar Typhi
aauuacgcccaucagcc

SEQ ID NO: 1691825 - RNA, 12 nt, Salmonella enterica enterica serovar Typhi
aauuaaucaggc

SEQ ID NO: 1691826 - RNA, 16 nt, Salmonella enterica enterica serovar Typhi
aauuaaugauuaaaau

SEQ ID NO: 1691827 - RNA, 17 nt, Salmonella enterica enterica serovar Typhi
aauuaaugauuaaaaua

SEQ ID NO: 1691828 - RNA, 18 nt, Salmonella enterica enterica serovar Typhi
aauugaucacaaaaucau

SEQ ID NO: 1691829 - RNA, 12 nt, Salmonella enterica enterica serovar Typhi
aauugaggccgu

SEQ ID NO: 1691830 - RNA, 14 nt, Salmonella enterica enterica serovar Typhi
aauugacuggauuu

SEQ ID NO: 1691831 - RNA, 20 nt, Salmonella enterica enterica serovar Typhi
aauugacuggauuuuugacu

SEQ ID NO: 1691832 - RNA, 14 nt, Salmonella enterica enterica serovar Typhi
aauugacgcugccu

SEQ ID NO: 1691833 - RNA, 20 nt, Salmonella enterica enterica serovar Typhi
aauugacgcuugacucugug

SEQ ID NO: 1691834 - RNA, 18 nt, Salmonella enterica enterica serovar Typhi
aauucuucugugauuauc

SEQ ID NO: 1691835 - RNA, 17 nt, Salmonella enterica enterica serovar Typhi
aauucguuaccugcgca

SEQ ID NO: 1691836 - RNA, 14 nt, Salmonella enterica enterica serovar Typhi
aauucguccacacg

SEQ ID NO: 1691837 - RNA, 19 nt, Salmonella enterica enterica serovar Typhi
aauucgcguucagaaaugu

SEQ ID NO: 1691838 - RNA, 23 nt, Salmonella enterica enterica serovar Typhi
aauucugucucaauaaaaugucu

SEQ ID NO: 1691839 - RNA, 19 nt, Salmonella enterica enterica serovar Typhi
aauucuuaacccacaagaa

SEQ ID NO: 1691840 - RNA, 19 nt, Salmonella enterica enterica serovar Typhi
aauuauuuuucaaaugauc

SEQ ID NO: 1691841 - RNA, 21 nt, Salmonella enterica enterica serovar Typhi
aauucccgccucggucaguau

SEQ ID NO: 1691842 - RNA, 16 nt, Salmonella enterica enterica serovar Typhi
aauucccggcggaaau

SEQ ID NO: 1691843 - RNA, 19 nt, Salmonella enterica enterica serovar Typhi
aauuccggcacaaccuggc

SEQ ID NO: 1691844 - RNA, 20 nt, Salmonella enterica enterica serovar Typhi
aauuccgaugaaaaacugga

SEQ ID NO: 1691845 - RNA, 19 nt, Salmonella enterica enterica serovar Typhi
aauuccgcaggagagccag

SEQ ID NO: 1691846 - RNA, 21 nt, Salmonella enterica enterica serovar Typhi
aauuccgcaggagagccagaa

SEQ ID NO: 1691847 - RNA, 22 nt, Salmonella enterica enterica serovar Typhi
aaugaaaucgucgccaacaccg

SEQ ID NO: 1691848 - RNA, 22 nt, Salmonella enterica enterica serovar Typhi
aaugaaaugcccauaaagaaau

SEQ ID NO: 1691849 - RNA, 15 nt, Salmonella enterica enterica serovar Typhi
aaugaagcauaaaaa

SEQ ID NO: 1691850 - RNA, 18 nt, Salmonella enterica enterica serovar Typhi
aaugaagcauaaaaagac

SEQ ID NO: 1691851 - RNA, 22 nt, Salmonella enterica enterica serovar Typhi
aaugaaucaucgguaaaugcuu

SEQ ID NO: 1691852 - RNA, 20 nt, Salmonella enterica enterica serovar Typhi
aaucuuuuugugcaaucaca

SEQ ID NO: 1691853 - RNA, 23 nt, Salmonella enterica enterica serovar Typhi
aaucuuucuguaagagacugaca

SEQ ID NO: 1691854 - RNA, 20 nt, Salmonella enterica enterica serovar Typhi
aaucuuuuauauguugaaua

SEQ ID NO: 1691855 - RNA, 18 nt, Salmonella enterica enterica serovar Typhi
aaugagaaaaggaagaau

SEQ ID NO: 1691856 - RNA, 18 nt, Salmonella enterica enterica serovar Typhi
aaugauaccaauuugagc

SEQ ID NO: 1691857 - RNA, 15 nt, Salmonella enterica enterica serovar Typhi
aaugauaaugccgcu

SEQ ID NO: 1691858 - RNA, 18 nt, Salmonella enterica enterica serovar Typhi
aaugacgagcagguuacu

SEQ ID NO: 1691859 - RNA, 16 nt, Salmonella enterica enterica serovar Typhi
aaugaccucaagaaua

SEQ ID NO: 1691860 - RNA, 13 nt, Salmonella enterica enterica serovar Typhi
aaugaccucaaga

SEQ ID NO: 1691861 - RNA, 21 nt, Salmonella enterica enterica serovar Typhi
aaugaccacaccgucaacauc

SEQ ID NO: 1691862 - RNA, 15 nt, Salmonella enterica enterica serovar Typhi
aaugaccagaucaac

SEQ ID NO: 1691863 - RNA, 13 nt, Salmonella enterica enterica serovar Typhi
aaugacaaaaauu

SEQ ID NO: 1691864 - RNA, 19 nt, Salmonella enterica enterica serovar Typhi
aaugaucagcaaaauagug

SEQ ID NO: 1691865 - RNA, 20 nt, Salmonella enterica enterica serovar Typhi
aaugaucagaacucacauau

SEQ ID NO: 1691866 - RNA, 14 nt, Salmonella enterica enterica serovar Typhi
aaugaugacucauu

SEQ ID NO: 1691867 - RNA, 12 nt, Salmonella enterica enterica serovar Typhi
aaugauuaaaau

SEQ ID NO: 1691868 - RNA, 14 nt, Salmonella enterica enterica serovar Typhi
aaugauuaaaauaa

SEQ ID NO: 1691869 - RNA, 14 nt, Salmonella enterica enterica serovar Typhi
aaugauuaucuuuu

SEQ ID NO: 1691870 - RNA, 17 nt, Salmonella enterica enterica serovar Typhi
aaugauuacggaacaaa

SEQ ID NO: 1691871 - RNA, 16 nt, Salmonella enterica enterica serovar Typhi
aaugcccaggcggcgg

SEQ ID NO: 1691872 - RNA, 19 nt, Salmonella enterica enterica serovar Typhi
aaugcccagcgcaaucacg

SEQ ID NO: 1691873 - RNA, 16 nt, Salmonella enterica enterica serovar Typhi
aaugccaaaaaaacua

SEQ ID NO: 1691874 - RNA, 15 nt, Salmonella enterica enterica serovar Typhi
aaugcccccucggca

SEQ ID NO: 1691875 - RNA, 20 nt, Salmonella enterica enterica serovar Typhi
aaugccgccguacaaacccu

SEQ ID NO: 1691876 - RNA, 14 nt, Salmonella enterica enterica serovar Typhi
aaugccgccgauac

SEQ ID NO: 1691877 - RNA, 20 nt, Salmonella enterica enterica serovar Typhi
aaugccgcgggaaauaccaa

SEQ ID NO: 1691878 - RNA, 19 nt, Salmonella enterica enterica serovar Typhi
aaugccgcgcuuucaguaa

SEQ ID NO: 1691879 - RNA, 15 nt, Salmonella enterica enterica serovar Typhi
aaugccgacccaccu

SEQ ID NO: 1691880 - RNA, 19 nt, Salmonella enterica enterica serovar Typhi
aaugcauggcagauaaacc

SEQ ID NO: 1691881 - RNA, 18 nt, Salmonella enterica enterica serovar Typhi
aaugcauagccccagcgc

SEQ ID NO: 1691882 - RNA, 14 nt, Salmonella enterica enterica serovar Typhi
aaugcauuggccag

SEQ ID NO: 1691883 - RNA, 23 nt, Salmonella enterica enterica serovar Typhi
aauggauucaugguacucaacau

SEQ ID NO: 1691884 - RNA, 16 nt, Salmonella enterica enterica serovar Typhi
aauggcaauggcggcg

SEQ ID NO: 1691885 - RNA, 15 nt, Salmonella enterica enterica serovar Typhi
aauggcgcguuuuau

SEQ ID NO: 1691886 - RNA, 18 nt, Salmonella enterica enterica serovar Typhi
aauggcaggcagcagaua

SEQ ID NO: 1691887 - RNA, 20 nt, Salmonella enterica enterica serovar Typhi
aaugcugcuuugaugcggca

SEQ ID NO: 1691888 - RNA, 16 nt, Salmonella enterica enterica serovar Typhi
aaugcuggugcaucug

SEQ ID NO: 1691889 - RNA, 21 nt, Salmonella enterica enterica serovar Typhi
aaugggaucuucaaugaacaa

SEQ ID NO: 1691890 - RNA, 20 nt, Salmonella enterica enterica serovar Typhi
aauggcggagaucuccagau

SEQ ID NO: 1691891 - RNA, 15 nt, Salmonella enterica enterica serovar Typhi
aauggcguugcuggc

SEQ ID NO: 1691892 - RNA, 23 nt, Salmonella enterica enterica serovar Typhi
aaugcugacgcguuuuuucauga

SEQ ID NO: 1691893 - RNA, 18 nt, Salmonella enterica enterica serovar Typhi
aaugcuccaauaaauauu

SEQ ID NO: 1691894 - RNA, 21 nt, Salmonella enterica enterica serovar Typhi
aaugcguccgccagaugcacc

SEQ ID NO: 1691895 - RNA, 22 nt, Salmonella enterica enterica serovar Typhi
aaugccggacgccaccacgccg

SEQ ID NO: 1691896 - RNA, 18 nt, Salmonella enterica enterica serovar Typhi
aauccacaaccggcuggc

SEQ ID NO: 1691897 - RNA, 16 nt, Salmonella enterica enterica serovar Typhi
aauccacauuccagac

SEQ ID NO: 1691898 - RNA, 15 nt, Salmonella enterica enterica serovar Typhi
aauccagcuacuggc

SEQ ID NO: 1691899 - RNA, 17 nt, Salmonella enterica enterica serovar Typhi
aauccagcuacuggcca

SEQ ID NO: 1691900 - RNA, 12 nt, Salmonella enterica enterica serovar Typhi
aauccaggugga

SEQ ID NO: 1691901 - RNA, 17 nt, Salmonella enterica enterica serovar Typhi
aauccaggaauuuuccc

SEQ ID NO: 1691902 - RNA, 14 nt, Salmonella enterica enterica serovar Typhi
aauccaggaauuuu

SEQ ID NO: 1691903 - RNA, 16 nt, Salmonella enterica enterica serovar Typhi
aauccaggaauuuucc

SEQ ID NO: 1691904 - RNA, 15 nt, Salmonella enterica enterica serovar Typhi
aaucauugcguucag

SEQ ID NO: 1691905 - RNA, 22 nt, Salmonella enterica enterica serovar Typhi
aauccaacgaaacucagcggcc

SEQ ID NO: 1691906 - RNA, 16 nt, Salmonella enterica enterica serovar Typhi
aaucauuaauacacug

SEQ ID NO: 1691907 - RNA, 20 nt, Salmonella enterica enterica serovar Typhi
aaucauugcgcuaaaaucca

SEQ ID NO: 1691908 - RNA, 15 nt, Salmonella enterica enterica serovar Typhi
aaucauguuuuucuc

SEQ ID NO: 1691909 - RNA, 17 nt, Salmonella enterica enterica serovar Typhi
aaucauccugauuuuac

SEQ ID NO: 1691910 - RNA, 23 nt, Salmonella enterica enterica serovar Typhi
aaucaucgcgcugauauuuuuac

SEQ ID NO: 1691911 - RNA, 22 nt, Salmonella enterica enterica serovar Typhi
aaucaucgaggccaccaaaaau

SEQ ID NO: 1691912 - RNA, 23 nt, Salmonella enterica enterica serovar Typhi
aaucaucgaggccaccaaaaauu

SEQ ID NO: 1691913 - RNA, 18 nt, Salmonella enterica enterica serovar Typhi
aaucaucaccguuuucca

SEQ ID NO: 1691914 - RNA, 14 nt, Salmonella enterica enterica serovar Typhi
aaucaucauauccc

SEQ ID NO: 1691915 - RNA, 14 nt, Salmonella enterica enterica serovar Typhi
aaucaucaucaucc

SEQ ID NO: 1691916 - RNA, 23 nt, Salmonella enterica enterica serovar Typhi
aaucagccaaagcgagguaaaaa

SEQ ID NO: 1691917 - RNA, 17 nt, Salmonella enterica enterica serovar Typhi
aaucagcgauaaccaga

SEQ ID NO: 1691918 - RNA, 20 nt, Salmonella enterica enterica serovar Typhi
aaucagcgcggcaaggauaa

SEQ ID NO: 1691919 - RNA, 22 nt, Salmonella enterica enterica serovar Typhi
aaucaggcaucccguuuucguc

SEQ ID NO: 1691920 - RNA, 18 nt, Salmonella enterica enterica serovar Typhi
aaucaguacugcgcccgc

SEQ ID NO: 1691921 - RNA, 16 nt, Salmonella enterica enterica serovar Typhi
aaucauauaagaaaua

SEQ ID NO: 1691922 - RNA, 12 nt, Salmonella enterica enterica serovar Typhi
aaaaauuaaaaa

SEQ ID NO: 1691923 - RNA, 14 nt, Salmonella enterica enterica serovar Typhi
aaaaauuaaaaaua

SEQ ID NO: 1691924 - RNA, 14 nt, Salmonella enterica enterica serovar Typhi
aaucagugcugaaa

SEQ ID NO: 1691925 - RNA, 22 nt, Salmonella enterica enterica serovar Typhi
aaucauagcccugauuaaagau

SEQ ID NO: 1691926 - RNA, 22 nt, Salmonella enterica enterica serovar Typhi
aaucuccuccggcuucagcaac

SEQ ID NO: 1691927 - RNA, 18 nt, Salmonella enterica enterica serovar Typhi
aaucggcgucuggagcgu

SEQ ID NO: 1691928 - RNA, 19 nt, Salmonella enterica enterica serovar Typhi
aaucggcuaguaauaccag

SEQ ID NO: 1691929 - RNA, 19 nt, Salmonella enterica enterica serovar Typhi
aaucguucgccagugacaa

SEQ ID NO: 1691930 - RNA, 21 nt, Salmonella enterica enterica serovar Typhi
aaucguucuugcacaauacuu

SEQ ID NO: 1691931 - RNA, 13 nt, Salmonella enterica enterica serovar Typhi
aaucgcuucacgg

SEQ ID NO: 1691932 - RNA, 19 nt, Salmonella enterica enterica serovar Typhi
aaucgcuaaacauauaccg

SEQ ID NO: 1691933 - RNA, 17 nt, Salmonella enterica enterica serovar Typhi
aaucggccagcgaaaac

SEQ ID NO: 1691934 - RNA, 20 nt, Salmonella enterica enterica serovar Typhi
aaucggccagcgaaaaccag

SEQ ID NO: 1691935 - RNA, 19 nt, Salmonella enterica enterica serovar Typhi
aaucggaugccauguuucu

SEQ ID NO: 1691936 - RNA, 21 nt, Salmonella enterica enterica serovar Typhi
aaucccgcaucacccgcauau

SEQ ID NO: 1691937 - RNA, 19 nt, Salmonella enterica enterica serovar Typhi
aauccccccuuuuuugcug

SEQ ID NO: 1691938 - RNA, 20 nt, Salmonella enterica enterica serovar Typhi
aauccccggcgaaagaaaau

SEQ ID NO: 1691939 - RNA, 19 nt, Salmonella enterica enterica serovar Typhi
aauccccagcgcuccacca

SEQ ID NO: 1691940 - RNA, 15 nt, Salmonella enterica enterica serovar Typhi
aaucccauuagccac

SEQ ID NO: 1691941 - RNA, 18 nt, Salmonella enterica enterica serovar Typhi
aauccauagccaacacau

SEQ ID NO: 1691942 - RNA, 21 nt, Salmonella enterica enterica serovar Typhi
aauccucuaccggaaaacagc

SEQ ID NO: 1691943 - RNA, 18 nt, Salmonella enterica enterica serovar Typhi
aauccugcacuuccagcc

SEQ ID NO: 1691944 - RNA, 21 nt, Salmonella enterica enterica serovar Typhi
aauccuuuuucaugcaauaau

SEQ ID NO: 1691945 - RNA, 19 nt, Salmonella enterica enterica serovar Typhi
aauccuuuauuuaauugcu

SEQ ID NO: 1691946 - RNA, 23 nt, Salmonella enterica enterica serovar Typhi
aauccugcuccaucguauagcga

SEQ ID NO: 1691947 - RNA, 21 nt, Salmonella enterica enterica serovar Typhi
aaucgccaucagcgcgaaaau

SEQ ID NO: 1691948 - RNA, 17 nt, Salmonella enterica enterica serovar Typhi
aaucgccgugaucccaa

SEQ ID NO: 1691949 - RNA, 11 nt, Salmonella enterica enterica serovar Typhi
aaucgccgcuu

SEQ ID NO: 1691950 - RNA, 21 nt, Salmonella enterica enterica serovar Typhi
aaucgcgagaaaauagaggaa

SEQ ID NO: 1691951 - RNA, 19 nt, Salmonella enterica enterica serovar Typhi
aaucgcgguaaaaagcuga

SEQ ID NO: 1691952 - RNA, 23 nt, Salmonella enterica enterica serovar Typhi
acugagcgguuuuuuuguggccu

SEQ ID NO: 1691953 - RNA, 16 nt, Salmonella enterica enterica serovar Typhi
acugagcgccaauuga

SEQ ID NO: 1691954 - RNA, 21 nt, Salmonella enterica enterica serovar Typhi
acugaguauuggcaagaauca

SEQ ID NO: 1691955 - RNA, 16 nt, Salmonella enterica enterica serovar Typhi
acugagcuaacgaccc

SEQ ID NO: 1691956 - RNA, 13 nt, Salmonella enterica enterica serovar Typhi
acugaaaccaggc

SEQ ID NO: 1691957 - RNA, 15 nt, Salmonella enterica enterica serovar Typhi
acucuuugugggacu

SEQ ID NO: 1691958 - RNA, 15 nt, Salmonella enterica enterica serovar Typhi
acugaaaaucaaaua

SEQ ID NO: 1691959 - RNA, 16 nt, Salmonella enterica enterica serovar Typhi
acucuuuuuucagaau

SEQ ID NO: 1691960 - RNA, 17 nt, Salmonella enterica enterica serovar Typhi
acucuuuuuucagaaua

SEQ ID NO: 1691961 - RNA, 21 nt, Salmonella enterica enterica serovar Typhi
acugauuucgccccacuggcc

SEQ ID NO: 1691962 - RNA, 19 nt, Salmonella enterica enterica serovar Typhi
acugcaaauaccacaucag

SEQ ID NO: 1691963 - RNA, 13 nt, Salmonella enterica enterica serovar Typhi
acugcaacgccag

SEQ ID NO: 1691964 - RNA, 14 nt, Salmonella enterica enterica serovar Typhi
acugcaaaucugcc

SEQ ID NO: 1691965 - RNA, 20 nt, Salmonella enterica enterica serovar Typhi
acugcaaaucugccgucauc

SEQ ID NO: 1691966 - RNA, 20 nt, Salmonella enterica enterica serovar Typhi
acugaucgcuggugcccggu

SEQ ID NO: 1691967 - RNA, 22 nt, Salmonella enterica enterica serovar Typhi
acugaucgccuaagaucgggug

SEQ ID NO: 1691968 - RNA, 17 nt, Salmonella enterica enterica serovar Typhi
acugaucgccuaagauc

SEQ ID NO: 1691969 - RNA, 19 nt, Salmonella enterica enterica serovar Typhi
acugaucaauuugccuuua

SEQ ID NO: 1691970 - RNA, 15 nt, Salmonella enterica enterica serovar Typhi
acugauaguuuaaau

SEQ ID NO: 1691971 - RNA, 17 nt, Salmonella enterica enterica serovar Typhi
acugauagcgaggcagc

SEQ ID NO: 1691972 - RNA, 18 nt, Salmonella enterica enterica serovar Typhi
acugauaagggccuucau

SEQ ID NO: 1691973 - RNA, 14 nt, Salmonella enterica enterica serovar Typhi
acugccaaccauua

SEQ ID NO: 1691974 - RNA, 13 nt, Salmonella enterica enterica serovar Typhi
acugccaaaccac

SEQ ID NO: 1691975 - RNA, 22 nt, Salmonella enterica enterica serovar Typhi
acugcgaacgcaucaaagccac

SEQ ID NO: 1691976 - RNA, 23 nt, Salmonella enterica enterica serovar Typhi
acugcgaacgcaucaaagccacc

SEQ ID NO: 1691977 - RNA, 15 nt, Salmonella enterica enterica serovar Typhi
acugcgcgcccgccu

SEQ ID NO: 1691978 - RNA, 16 nt, Salmonella enterica enterica serovar Typhi
acugcgcgcccgccuc

SEQ ID NO: 1691979 - RNA, 12 nt, Salmonella enterica enterica serovar Typhi
acugcgccugcu

SEQ ID NO: 1691980 - RNA, 20 nt, Salmonella enterica enterica serovar Typhi
acugcgcucuaucaccgccc

SEQ ID NO: 1691981 - RNA, 19 nt, Salmonella enterica enterica serovar Typhi
acugcggagguuucuuuuu

SEQ ID NO: 1691982 - RNA, 15 nt, Salmonella enterica enterica serovar Typhi
acugcgccaucuucc

SEQ ID NO: 1691983 - RNA, 15 nt, Salmonella enterica enterica serovar Typhi
acuggaaacagccaa

SEQ ID NO: 1691984 - RNA, 23 nt, Salmonella enterica enterica serovar Typhi
acugcuuuuccggcagcgcauaa

SEQ ID NO: 1691985 - RNA, 21 nt, Salmonella enterica enterica serovar Typhi
acuggaagcgaucaagacaaa

SEQ ID NO: 1691986 - RNA, 22 nt, Salmonella enterica enterica serovar Typhi
acugcucuaccaacugagcuaa

SEQ ID NO: 1691987 - RNA, 20 nt, Salmonella enterica enterica serovar Typhi
acugcuuuuccggcagcgca

SEQ ID NO: 1691988 - RNA, 18 nt, Salmonella enterica enterica serovar Typhi
acugcugcgcuuuaucaa

SEQ ID NO: 1691989 - RNA, 23 nt, Salmonella enterica enterica serovar Typhi
acugcugcugaaagaagacgaaa

SEQ ID NO: 1691990 - RNA, 12 nt, Salmonella enterica enterica serovar Typhi
acugcugacucu

SEQ ID NO: 1691991 - RNA, 22 nt, Salmonella enterica enterica serovar Typhi
acugcugccgcagcacccgcuc

SEQ ID NO: 1691992 - RNA, 21 nt, Salmonella enterica enterica serovar Typhi
acucccaggugugacguccca

SEQ ID NO: 1691993 - RNA, 18 nt, Salmonella enterica enterica serovar Typhi
acucccgucgccuguuuc

SEQ ID NO: 1691994 - RNA, 14 nt, Salmonella enterica enterica serovar Typhi
acuccccuuuuuuc

SEQ ID NO: 1691995 - RNA, 14 nt, Salmonella enterica enterica serovar Typhi
acuccggugcccau

SEQ ID NO: 1691996 - RNA, 12 nt, Salmonella enterica enterica serovar Typhi
acuccuuuuacc

SEQ ID NO: 1691997 - RNA, 22 nt, Salmonella enterica enterica serovar Typhi
acucgaccuucaucucuuugcc

SEQ ID NO: 1691998 - RNA, 14 nt, Salmonella enterica enterica serovar Typhi
acucgaauuguuaa

SEQ ID NO: 1691999 - RNA, 13 nt, Salmonella enterica enterica serovar Typhi
acucgaauuauuu

SEQ ID NO: 1692000 - RNA, 19 nt, Salmonella enterica enterica serovar Typhi
acucgcuguggccaggcac

SEQ ID NO: 1692001 - RNA, 19 nt, Salmonella enterica enterica serovar Typhi
acucgcuguauuucccucu

SEQ ID NO: 1692002 - RNA, 15 nt, Salmonella enterica enterica serovar Typhi
acucgcuguggccag

SEQ ID NO: 1692003 - RNA, 16 nt, Salmonella enterica enterica serovar Typhi
acucucauguucaagc

SEQ ID NO: 1692004 - RNA, 16 nt, Salmonella enterica enterica serovar Typhi
acucucgcagcgaaua

SEQ ID NO: 1692005 - RNA, 17 nt, Salmonella enterica enterica serovar Typhi
acucugaaaaaauuucg

SEQ ID NO: 1692006 - RNA, 18 nt, Salmonella enterica enterica serovar Typhi
acucugcgacgccaggcg

SEQ ID NO: 1692007 - RNA, 20 nt, Salmonella enterica enterica serovar Typhi
acucugacgccgguauucau

SEQ ID NO: 1692008 - RNA, 15 nt, Salmonella enterica enterica serovar Typhi
acucuucacccuucu

SEQ ID NO: 1692009 - RNA, 15 nt, Salmonella enterica enterica serovar Typhi
acucuguuauauauu

SEQ ID NO: 1692010 - RNA, 18 nt, Salmonella enterica enterica serovar Typhi
acucuuaauuauaaagca

SEQ ID NO: 1692011 - RNA, 19 nt, Salmonella enterica enterica serovar Typhi
acucuuaauuauaaagcau

SEQ ID NO: 1692012 - RNA, 12 nt, Salmonella enterica enterica serovar Typhi
acucuuccagca

SEQ ID NO: 1692013 - RNA, 13 nt, Salmonella enterica enterica serovar Typhi
acucuuccaccac

SEQ ID NO: 1692014 - RNA, 22 nt, Salmonella enterica enterica serovar Typhi
acucuuccgggcgcgaucuguu

SEQ ID NO: 1692015 - RNA, 17 nt, Salmonella enterica enterica serovar Typhi
acucuucgacauauuua

SEQ ID NO: 1692016 - RNA, 20 nt, Salmonella enterica enterica serovar Typhi
acucuuccccgaucagaaaa

SEQ ID NO: 1692017 - RNA, 21 nt, Salmonella enterica enterica serovar Typhi
acucuuccccgaucagaaaac

SEQ ID NO: 1692018 - RNA, 17 nt, Salmonella enterica enterica serovar Typhi
acucuuccgcaaucaca

SEQ ID NO: 1692019 - RNA, 21 nt, Salmonella enterica enterica serovar Typhi
acucuucugaccaucuuaccu

SEQ ID NO: 1692020 - RNA, 11 nt, Salmonella enterica enterica serovar Typhi
acucuucugac

SEQ ID NO: 1692021 - RNA, 16 nt, Salmonella enterica enterica serovar Typhi
acucuucgccauuaca

SEQ ID NO: 1692022 - RNA, 18 nt, Salmonella enterica enterica serovar Typhi
acuucgcgguuagaaagu

SEQ ID NO: 1692023 - RNA, 20 nt, Salmonella enterica enterica serovar Typhi
acuucgcgguugcgcccuuc

SEQ ID NO: 1692024 - RNA, 18 nt, Salmonella enterica enterica serovar Typhi
acuucggcaaauucuuuu

SEQ ID NO: 1692025 - RNA, 21 nt, Salmonella enterica enterica serovar Typhi
acuucgcuuuguuuuccagau

SEQ ID NO: 1692026 - RNA, 15 nt, Salmonella enterica enterica serovar Typhi
acuucgcuuccugca

SEQ ID NO: 1692027 - RNA, 19 nt, Salmonella enterica enterica serovar Typhi
acuucggcaaauucuuuuc

SEQ ID NO: 1692028 - RNA, 19 nt, Salmonella enterica enterica serovar Typhi
acuuccugcgucaggcugu

SEQ ID NO: 1692029 - RNA, 15 nt, Salmonella enterica enterica serovar Typhi
acuuccggaucgcua

SEQ ID NO: 1692030 - RNA, 20 nt, Salmonella enterica enterica serovar Typhi
acuuccgguugaccgcauaa

SEQ ID NO: 1692031 - RNA, 21 nt, Salmonella enterica enterica serovar Typhi
acuuccgguugaccgcauaau

SEQ ID NO: 1692032 - RNA, 15 nt, Salmonella enterica enterica serovar Typhi
acuuccugcgucagg

SEQ ID NO: 1692033 - RNA, 13 nt, Salmonella enterica enterica serovar Typhi
acuuccccugcca

SEQ ID NO: 1692034 - RNA, 20 nt, Salmonella enterica enterica serovar Typhi
acuuccauucggcgaaagaa

SEQ ID NO: 1692035 - RNA, 10 nt, Salmonella enterica enterica serovar Typhi
acuuccagcg

SEQ ID NO: 1692036 - RNA, 16 nt, Salmonella enterica enterica serovar Typhi
acuucauuuuccacaa

SEQ ID NO: 1692037 - RNA, 12 nt, Salmonella enterica enterica serovar Typhi
acuucuaauuuu

SEQ ID NO: 1692038 - RNA, 16 nt, Salmonella enterica enterica serovar Typhi
acuucugacccaauca

SEQ ID NO: 1692039 - RNA, 18 nt, Salmonella enterica enterica serovar Typhi
acuucugacccaaucaga

SEQ ID NO: 1692040 - RNA, 14 nt, Salmonella enterica enterica serovar Typhi
acuugaccagcacu

SEQ ID NO: 1692041 - RNA, 17 nt, Salmonella enterica enterica serovar Typhi
acuugacgcuuugcauu

SEQ ID NO: 1692042 - RNA, 20 nt, Salmonella enterica enterica serovar Typhi
acuugagaaauuauuuuaaa

SEQ ID NO: 1692043 - RNA, 10 nt, Salmonella enterica enterica serovar Typhi
acuucuucca

SEQ ID NO: 1692044 - RNA, 22 nt, Salmonella enterica enterica serovar Typhi
acuucuugguaccaaacagcag

SEQ ID NO: 1692045 - RNA, 16 nt, Salmonella enterica enterica serovar Typhi
acuucaccucagccaa

SEQ ID NO: 1692046 - RNA, 18 nt, Salmonella enterica enterica serovar Typhi
acuucaccauaaaucauu

SEQ ID NO: 1692047 - RNA, 15 nt, Salmonella enterica enterica serovar Typhi
acuucacacgaacuu

SEQ ID NO: 1692048 - RNA, 23 nt, Salmonella enterica enterica serovar Typhi
acuucaagguucgacucgagcaa

SEQ ID NO: 1692049 - RNA, 12 nt, Salmonella enterica enterica serovar Typhi
acuucacuuucc

SEQ ID NO: 1692050 - RNA, 23 nt, Salmonella enterica enterica serovar Typhi
acuucagcauacaggucuuuccg

SEQ ID NO: 1692051 - RNA, 11 nt, Salmonella enterica enterica serovar Typhi
acuuauuucua

SEQ ID NO: 1692052 - RNA, 17 nt, Salmonella enterica enterica serovar Typhi
acuucaaaaauggcuuc

SEQ ID NO: 1692053 - RNA, 16 nt, Salmonella enterica enterica serovar Typhi
acuuauugcaagaaau

SEQ ID NO: 1692054 - RNA, 13 nt, Salmonella enterica enterica serovar Typhi
acuuacugcuguc

SEQ ID NO: 1692055 - RNA, 11 nt, Salmonella enterica enterica serovar Typhi
acuuaucucuu

SEQ ID NO: 1692056 - RNA, 18 nt, Salmonella enterica enterica serovar Typhi
acuuaucucuuuuucucg

SEQ ID NO: 1692057 - RNA, 20 nt, Salmonella enterica enterica serovar Typhi
acuguugaaagccccggcuc

SEQ ID NO: 1692058 - RNA, 17 nt, Salmonella enterica enterica serovar Typhi
acuguucggcggggauc

SEQ ID NO: 1692059 - RNA, 15 nt, Salmonella enterica enterica serovar Typhi
acuguucggggauua

SEQ ID NO: 1692060 - RNA, 15 nt, Salmonella enterica enterica serovar Typhi
acuguugcaguuuac

SEQ ID NO: 1692061 - RNA, 23 nt, Salmonella enterica enterica serovar Typhi
acuguugccgacagcggaaaauc

SEQ ID NO: 1692062 - RNA, 21 nt, Salmonella enterica enterica serovar Typhi
acugugaggcgucuuccagca

SEQ ID NO: 1692063 - RNA, 16 nt, Salmonella enterica enterica serovar Typhi
acuggauggacuguuu

SEQ ID NO: 1692064 - RNA, 13 nt, Salmonella enterica enterica serovar Typhi
acuggaugacgaa

SEQ ID NO: 1692065 - RNA, 12 nt, Salmonella enterica enterica serovar Typhi
acuggaugacga

SEQ ID NO: 1692066 - RNA, 12 nt, Salmonella enterica enterica serovar Typhi
acuggauuaucg

SEQ ID NO: 1692067 - RNA, 14 nt, Salmonella enterica enterica serovar Typhi
acuggcaaauaaaa

SEQ ID NO: 1692068 - RNA, 22 nt, Salmonella enterica enterica serovar Typhi
acuggcaaccagauaauucagg

SEQ ID NO: 1692069 - RNA, 23 nt, Salmonella enterica enterica serovar Typhi
acugucggcgauauagcgcugaa

SEQ ID NO: 1692070 - RNA, 20 nt, Salmonella enterica enterica serovar Typhi
acuuaaaguacuucacaauc

SEQ ID NO: 1692071 - RNA, 20 nt, Salmonella enterica enterica serovar Typhi
acuuaaauuaaugauuaaaa

SEQ ID NO: 1692072 - RNA, 16 nt, Salmonella enterica enterica serovar Typhi
acuuaccgggcaucug

SEQ ID NO: 1692073 - RNA, 22 nt, Salmonella enterica enterica serovar Typhi
acuuacgcccuauccggccgac

SEQ ID NO: 1692074 - RNA, 13 nt, Salmonella enterica enterica serovar Typhi
acuuacccagcaa

SEQ ID NO: 1692075 - RNA, 14 nt, Salmonella enterica enterica serovar Typhi
acuaacagcagcag

SEQ ID NO: 1692076 - RNA, 15 nt, Salmonella enterica enterica serovar Typhi
acuaacgaggccacc

SEQ ID NO: 1692077 - RNA, 16 nt, Salmonella enterica enterica serovar Typhi
acuaacugaccauaua

SEQ ID NO: 1692078 - RNA, 11 nt, Salmonella enterica enterica serovar Typhi
acuaacugccg

SEQ ID NO: 1692079 - RNA, 16 nt, Salmonella enterica enterica serovar Typhi
acuaaguaaggaggaa

SEQ ID NO: 1692080 - RNA, 20 nt, Salmonella enterica enterica serovar Typhi
acuaagaccagcaucagaau

SEQ ID NO: 1692081 - RNA, 15 nt, Salmonella enterica enterica serovar Typhi
acuaagaccagcauc

SEQ ID NO: 1692082 - RNA, 17 nt, Salmonella enterica enterica serovar Typhi
acuaagaccagcaucag

SEQ ID NO: 1692083 - RNA, 18 nt, Salmonella enterica enterica serovar Typhi
acuaauuauuuuucaaau

SEQ ID NO: 1692084 - RNA, 21 nt, Salmonella enterica enterica serovar Typhi
acuacagaaagccauaaaacu

SEQ ID NO: 1692085 - RNA, 22 nt, Salmonella enterica enterica serovar Typhi
acuacaauacucacuaucacac

SEQ ID NO: 1692086 - RNA, 22 nt, Salmonella enterica enterica serovar Typhi
acuaauccaguccucgcccacu

SEQ ID NO: 1692087 - RNA, 17 nt, Salmonella enterica enterica serovar Typhi
acuaauccucuucucug

SEQ ID NO: 1692088 - RNA, 21 nt, Salmonella enterica enterica serovar Typhi
acuaaucugucgcuaaagcac

SEQ ID NO: 1692089 - RNA, 13 nt, Salmonella enterica enterica serovar Typhi
acuaccaacugau

SEQ ID NO: 1692090 - RNA, 14 nt, Salmonella enterica enterica serovar Typhi
acuaccacuuucuu

SEQ ID NO: 1692091 - RNA, 16 nt, Salmonella enterica enterica serovar Typhi
acuaccggcaccagca

SEQ ID NO: 1692092 - RNA, 14 nt, Salmonella enterica enterica serovar Typhi
acuagaauuuucac

SEQ ID NO: 1692093 - RNA, 15 nt, Salmonella enterica enterica serovar Typhi
acuagacagccucuc

SEQ ID NO: 1692094 - RNA, 20 nt, Salmonella enterica enterica serovar Typhi
acuauaaaaauaccggcauc

SEQ ID NO: 1692095 - RNA, 16 nt, Salmonella enterica enterica serovar Typhi
acuagcgcgauuuucu

SEQ ID NO: 1692096 - RNA, 13 nt, Salmonella enterica enterica serovar Typhi
acuauucuucccc

SEQ ID NO: 1692097 - RNA, 22 nt, Salmonella enterica enterica serovar Typhi
acuauucuuccccuucacucuu

SEQ ID NO: 1692098 - RNA, 18 nt, Salmonella enterica enterica serovar Typhi
acuauuucggcacugacu

SEQ ID NO: 1692099 - RNA, 22 nt, Salmonella enterica enterica serovar Typhi
acgugccgccguuuuaucuaca

SEQ ID NO: 1692100 - RNA, 20 nt, Salmonella enterica enterica serovar Typhi
acgucugcgcuguugauaac

SEQ ID NO: 1692101 - RNA, 19 nt, Salmonella enterica enterica serovar Typhi
acguagcuuauaaaucagc

SEQ ID NO: 1692102 - RNA, 15 nt, Salmonella enterica enterica serovar Typhi
acguaggccugauaa

SEQ ID NO: 1692103 - RNA, 16 nt, Salmonella enterica enterica serovar Typhi
acguaggccugauaag

SEQ ID NO: 1692104 - RNA, 23 nt, Salmonella enterica enterica serovar Typhi
acguagcccauugucaucaguau

SEQ ID NO: 1692105 - RNA, 16 nt, Salmonella enterica enterica serovar Typhi
acguagcccauuguca

SEQ ID NO: 1692106 - RNA, 14 nt, Salmonella enterica enterica serovar Typhi
acguagauucugau

SEQ ID NO: 1692107 - RNA, 12 nt, Salmonella enterica enterica serovar Typhi
acguagcaaaua

SEQ ID NO: 1692108 - RNA, 19 nt, Salmonella enterica enterica serovar Typhi
acguucuucgauaaaggga

SEQ ID NO: 1692109 - RNA, 12 nt, Salmonella enterica enterica serovar Typhi
acguucuucucc

SEQ ID NO: 1692110 - RNA, 14 nt, Salmonella enterica enterica serovar Typhi
acguucuucuccca

SEQ ID NO: 1692111 - RNA, 16 nt, Salmonella enterica enterica serovar Typhi
acguucuuccagaacg

SEQ ID NO: 1692112 - RNA, 21 nt, Salmonella enterica enterica serovar Typhi
acguucaccccgucauauuac

SEQ ID NO: 1692113 - RNA, 23 nt, Salmonella enterica enterica serovar Typhi
acguucagcauauccagcgccug

SEQ ID NO: 1692114 - RNA, 23 nt, Salmonella enterica enterica serovar Typhi
acguuaucuucggucgagcuuuu

SEQ ID NO: 1692115 - RNA, 15 nt, Salmonella enterica enterica serovar Typhi
acguucaaaaucaaa

SEQ ID NO: 1692116 - RNA, 23 nt, Salmonella enterica enterica serovar Typhi
acguuaucgccgacaaacaguga

SEQ ID NO: 1692117 - RNA, 18 nt, Salmonella enterica enterica serovar Typhi
acguuaucucgccaggaa

SEQ ID NO: 1692118 - RNA, 19 nt, Salmonella enterica enterica serovar Typhi
acgugcggcggccucuuug

SEQ ID NO: 1692119 - RNA, 21 nt, Salmonella enterica enterica serovar Typhi
acgugcugaucccgcgcgccu

SEQ ID NO: 1692120 - RNA, 17 nt, Salmonella enterica enterica serovar Typhi
acguuucuuucaucaga

SEQ ID NO: 1692121 - RNA, 18 nt, Salmonella enterica enterica serovar Typhi
acguuugaccugcagcuc

SEQ ID NO: 1692122 - RNA, 16 nt, Salmonella enterica enterica serovar Typhi
acguugcuggcgcgcg

SEQ ID NO: 1692123 - RNA, 18 nt, Salmonella enterica enterica serovar Typhi
acguuggggauaaccaga

SEQ ID NO: 1692124 - RNA, 19 nt, Salmonella enterica enterica serovar Typhi
acguuggggauaaccagaa

SEQ ID NO: 1692125 - RNA, 17 nt, Salmonella enterica enterica serovar Typhi
acguugugauaaaucgu

SEQ ID NO: 1692126 - RNA, 14 nt, Salmonella enterica enterica serovar Typhi
acguuuucugagcg

SEQ ID NO: 1692127 - RNA, 23 nt, Salmonella enterica enterica serovar Typhi
acguuuugggaaaaccaguugca

SEQ ID NO: 1692128 - RNA, 16 nt, Salmonella enterica enterica serovar Typhi
acuaaaaauucaaaaa

SEQ ID NO: 1692129 - RNA, 23 nt, Salmonella enterica enterica serovar Typhi
acuaaaaauucaaaaaagcagua

SEQ ID NO: 1692130 - RNA, 14 nt, Salmonella enterica enterica serovar Typhi
acgccaucaacagc

SEQ ID NO: 1692131 - RNA, 14 nt, Salmonella enterica enterica serovar Typhi
acgccaucgacaaa

SEQ ID NO: 1692132 - RNA, 16 nt, Salmonella enterica enterica serovar Typhi
acgccaguucccacag

SEQ ID NO: 1692133 - RNA, 19 nt, Salmonella enterica enterica serovar Typhi
acgccauagcaucgacccu

SEQ ID NO: 1692134 - RNA, 15 nt, Salmonella enterica enterica serovar Typhi
acgcucaaccgguuu

SEQ ID NO: 1692135 - RNA, 15 nt, Salmonella enterica enterica serovar Typhi
acgcuauuuaaaaac

SEQ ID NO: 1692136 - RNA, 23 nt, Salmonella enterica enterica serovar Typhi
acgcucacgcagauauucauuga

SEQ ID NO: 1692137 - RNA, 12 nt, Salmonella enterica enterica serovar Typhi
acgcucacuuuu

SEQ ID NO: 1692138 - RNA, 13 nt, Salmonella enterica enterica serovar Typhi
acgcucuucgcca

SEQ ID NO: 1692139 - RNA, 15 nt, Salmonella enterica enterica serovar Typhi
acgcugaccacgccg

SEQ ID NO: 1692140 - RNA, 19 nt, Salmonella enterica enterica serovar Typhi
acgcugaccacgccgccgc

SEQ ID NO: 1692141 - RNA, 16 nt, Salmonella enterica enterica serovar Typhi
acgcugagucagaaac

SEQ ID NO: 1692142 - RNA, 15 nt, Salmonella enterica enterica serovar Typhi
acgcuucagagcagg

SEQ ID NO: 1692143 - RNA, 22 nt, Salmonella enterica enterica serovar Typhi
acgcuucauugguuaauucaaa

SEQ ID NO: 1692144 - RNA, 14 nt, Salmonella enterica enterica serovar Typhi
acgcuuauccggcu

SEQ ID NO: 1692145 - RNA, 20 nt, Salmonella enterica enterica serovar Typhi
acgcuuccggcgaggcguaa

SEQ ID NO: 1692146 - RNA, 15 nt, Salmonella enterica enterica serovar Typhi
acgcuucuucgauuu

SEQ ID NO: 1692147 - RNA, 18 nt, Salmonella enterica enterica serovar Typhi
acgcuucguugccccgug

SEQ ID NO: 1692148 - RNA, 16 nt, Salmonella enterica enterica serovar Typhi
acgcuuaucccagccg

SEQ ID NO: 1692149 - RNA, 19 nt, Salmonella enterica enterica serovar Typhi
acggauacgcugcgucagg

SEQ ID NO: 1692150 - RNA, 12 nt, Salmonella enterica enterica serovar Typhi
acggauaaaaac

SEQ ID NO: 1692151 - RNA, 15 nt, Salmonella enterica enterica serovar Typhi
acggauccagaacug

SEQ ID NO: 1692152 - RNA, 13 nt, Salmonella enterica enterica serovar Typhi
acggcaaacgcug

SEQ ID NO: 1692153 - RNA, 22 nt, Salmonella enterica enterica serovar Typhi
acggcaaaauaaauauccuccg

SEQ ID NO: 1692154 - RNA, 12 nt, Salmonella enterica enterica serovar Typhi
acggaucuucca

SEQ ID NO: 1692155 - RNA, 22 nt, Salmonella enterica enterica serovar Typhi
acggacuugaucgugccguccg

SEQ ID NO: 1692156 - RNA, 21 nt, Salmonella enterica enterica serovar Typhi
acggagauuaacagcgcgacc

SEQ ID NO: 1692157 - RNA, 17 nt, Salmonella enterica enterica serovar Typhi
acggagagacaguucag

SEQ ID NO: 1692158 - RNA, 23 nt, Salmonella enterica enterica serovar Typhi
acggagcauaauuuuccugucgu

SEQ ID NO: 1692159 - RNA, 19 nt, Salmonella enterica enterica serovar Typhi
acggagcauaauuuuccug

SEQ ID NO: 1692160 - RNA, 22 nt, Salmonella enterica enterica serovar Typhi
acggagugcgcggcgaaaaagc

SEQ ID NO: 1692161 - RNA, 17 nt, Salmonella enterica enterica serovar Typhi
acggaggcgggcgcgca

SEQ ID NO: 1692162 - RNA, 21 nt, Salmonella enterica enterica serovar Typhi
acggaggugccagagauaauu

SEQ ID NO: 1692163 - RNA, 19 nt, Salmonella enterica enterica serovar Typhi
acggacauaaaggaaaugc

SEQ ID NO: 1692164 - RNA, 23 nt, Salmonella enterica enterica serovar Typhi
acggaacaacggcacacaggccg

SEQ ID NO: 1692165 - RNA, 23 nt, Salmonella enterica enterica serovar Typhi
acggaacaacggcauacaggccg

SEQ ID NO: 1692166 - RNA, 15 nt, Salmonella enterica enterica serovar Typhi
acggaacaaaacgga

SEQ ID NO: 1692167 - RNA, 17 nt, Salmonella enterica enterica serovar Typhi
acggaaaagcauugcuu

SEQ ID NO: 1692168 - RNA, 19 nt, Salmonella enterica enterica serovar Typhi
acggaauaucccgcaagaa

SEQ ID NO: 1692169 - RNA, 12 nt, Salmonella enterica enterica serovar Typhi
acggaaggggcc

SEQ ID NO: 1692170 - RNA, 22 nt, Salmonella enterica enterica serovar Typhi
acgcuuuaggguaucauuucca

SEQ ID NO: 1692171 - RNA, 23 nt, Salmonella enterica enterica serovar Typhi
acgcuuuggcaggccucuaucuu

SEQ ID NO: 1692172 - RNA, 21 nt, Salmonella enterica enterica serovar Typhi
acgcuuugcgauagcccggca

SEQ ID NO: 1692173 - RNA, 23 nt, Salmonella enterica enterica serovar Typhi
acgcuuugcgauagcccggcaug

SEQ ID NO: 1692174 - RNA, 23 nt, Salmonella enterica enterica serovar Typhi
acgcuuuuaaauucgcuccacug

SEQ ID NO: 1692175 - RNA, 13 nt, Salmonella enterica enterica serovar Typhi
acgguuucaacuu

SEQ ID NO: 1692176 - RNA, 23 nt, Salmonella enterica enterica serovar Typhi
acgguuuuauccccuucaggaau

SEQ ID NO: 1692177 - RNA, 15 nt, Salmonella enterica enterica serovar Typhi
acguaaagacgacgu

SEQ ID NO: 1692178 - RNA, 13 nt, Salmonella enterica enterica serovar Typhi
acguaaagcuggc

SEQ ID NO: 1692179 - RNA, 15 nt, Salmonella enterica enterica serovar Typhi
acguaaauauauaca

SEQ ID NO: 1692180 - RNA, 17 nt, Salmonella enterica enterica serovar Typhi
acguaaauuacuuauga

SEQ ID NO: 1692181 - RNA, 20 nt, Salmonella enterica enterica serovar Typhi
acguaacggaaaagcauugc

SEQ ID NO: 1692182 - RNA, 22 nt, Salmonella enterica enterica serovar Typhi
acguacagguugugcaucuccu

SEQ ID NO: 1692183 - RNA, 16 nt, Salmonella enterica enterica serovar Typhi
acguaaugugaaaaac

SEQ ID NO: 1692184 - RNA, 13 nt, Salmonella enterica enterica serovar Typhi
acguaauaccuga

SEQ ID NO: 1692185 - RNA, 22 nt, Salmonella enterica enterica serovar Typhi
acguaauaaccaccggcgcgcc

SEQ ID NO: 1692186 - RNA, 19 nt, Salmonella enterica enterica serovar Typhi
acguaacugacaauuucca

SEQ ID NO: 1692187 - RNA, 20 nt, Salmonella enterica enterica serovar Typhi
acguaacugcgguaaauaau

SEQ ID NO: 1692188 - RNA, 21 nt, Salmonella enterica enterica serovar Typhi
acguaacugcgguaaauaaug

SEQ ID NO: 1692189 - RNA, 14 nt, Salmonella enterica enterica serovar Typhi
acguaacagacgca

SEQ ID NO: 1692190 - RNA, 16 nt, Salmonella enterica enterica serovar Typhi
acggugcugaauauua

SEQ ID NO: 1692191 - RNA, 14 nt, Salmonella enterica enterica serovar Typhi
acgguaccugaagc

SEQ ID NO: 1692192 - RNA, 20 nt, Salmonella enterica enterica serovar Typhi
acgguaauugccgggaaaac

SEQ ID NO: 1692193 - RNA, 20 nt, Salmonella enterica enterica serovar Typhi
acgguaaccauuuccggauc

SEQ ID NO: 1692194 - RNA, 23 nt, Salmonella enterica enterica serovar Typhi
acgguaacgauacccaccagcgu

SEQ ID NO: 1692195 - RNA, 21 nt, Salmonella enterica enterica serovar Typhi
acgggcgggguaguuaucacg

SEQ ID NO: 1692196 - RNA, 20 nt, Salmonella enterica enterica serovar Typhi
acggcuuucuuucuccagcg

SEQ ID NO: 1692197 - RNA, 17 nt, Salmonella enterica enterica serovar Typhi
acgggaaguaaggcaug

SEQ ID NO: 1692198 - RNA, 20 nt, Salmonella enterica enterica serovar Typhi
acgggcgcugucgccgcgca

SEQ ID NO: 1692199 - RNA, 22 nt, Salmonella enterica enterica serovar Typhi
acgggcgauggcucgcccggua

SEQ ID NO: 1692200 - RNA, 20 nt, Salmonella enterica enterica serovar Typhi
acggcuuuccagcagccaga

SEQ ID NO: 1692201 - RNA, 16 nt, Salmonella enterica enterica serovar Typhi
acggcuuuccagcagc

SEQ ID NO: 1692202 - RNA, 13 nt, Salmonella enterica enterica serovar Typhi
acggcugaagcug

SEQ ID NO: 1692203 - RNA, 23 nt, Salmonella enterica enterica serovar Typhi
acggcuauuccucgaucgccugg

SEQ ID NO: 1692204 - RNA, 16 nt, Salmonella enterica enterica serovar Typhi
acggcuaauaugccag

SEQ ID NO: 1692205 - RNA, 13 nt, Salmonella enterica enterica serovar Typhi
acggcuccuuuuu

SEQ ID NO: 1692206 - RNA, 15 nt, Salmonella enterica enterica serovar Typhi
acggcuccagcgcca

SEQ ID NO: 1692207 - RNA, 20 nt, Salmonella enterica enterica serovar Typhi
acggcugucaggagccaccg

SEQ ID NO: 1692208 - RNA, 15 nt, Salmonella enterica enterica serovar Typhi
acggcuggcaaugcg

SEQ ID NO: 1692209 - RNA, 14 nt, Salmonella enterica enterica serovar Typhi
acggcaacugaaaa

SEQ ID NO: 1692210 - RNA, 22 nt, Salmonella enterica enterica serovar Typhi
acggcaacggcgacaagaauau

SEQ ID NO: 1692211 - RNA, 18 nt, Salmonella enterica enterica serovar Typhi
acggcgcaggcaaaucaa

SEQ ID NO: 1692212 - RNA, 19 nt, Salmonella enterica enterica serovar Typhi
acggcgcagguaaaaucca

SEQ ID NO: 1692213 - RNA, 11 nt, Salmonella enterica enterica serovar Typhi
acggcgcgcca

SEQ ID NO: 1692214 - RNA, 21 nt, Salmonella enterica enterica serovar Typhi
acggcgcgaaucccgcguucg

SEQ ID NO: 1692215 - RNA, 14 nt, Salmonella enterica enterica serovar Typhi
acggcgcgaaaggg

SEQ ID NO: 1692216 - RNA, 14 nt, Salmonella enterica enterica serovar Typhi
acggcuacccauga

SEQ ID NO: 1692217 - RNA, 22 nt, Salmonella enterica enterica serovar Typhi
acggcgcuccugucaggcgagc

SEQ ID NO: 1692218 - RNA, 16 nt, Salmonella enterica enterica serovar Typhi
accucguccagauggg

SEQ ID NO: 1692219 - RNA, 18 nt, Salmonella enterica enterica serovar Typhi
accucggguaaagguuug

SEQ ID NO: 1692220 - RNA, 18 nt, Salmonella enterica enterica serovar Typhi
accucgguauguccugcc

SEQ ID NO: 1692221 - RNA, 22 nt, Salmonella enterica enterica serovar Typhi
accucggguaaagguuugcugc

SEQ ID NO: 1692222 - RNA, 20 nt, Salmonella enterica enterica serovar Typhi
accucgguauguccugccgc

SEQ ID NO: 1692223 - RNA, 18 nt, Salmonella enterica enterica serovar Typhi
accucuauaacuugcaaa

SEQ ID NO: 1692224 - RNA, 16 nt, Salmonella enterica enterica serovar Typhi
accucucaccgccuag

SEQ ID NO: 1692225 - RNA, 13 nt, Salmonella enterica enterica serovar Typhi
accucuaaaugga

SEQ ID NO: 1692226 - RNA, 22 nt, Salmonella enterica enterica serovar Typhi
accugaagcccuuuagugaauu

SEQ ID NO: 1692227 - RNA, 21 nt, Salmonella enterica enterica serovar Typhi
accugaaugcaaagaagggca

SEQ ID NO: 1692228 - RNA, 14 nt, Salmonella enterica enterica serovar Typhi
accugaaaucagcc

SEQ ID NO: 1692229 - RNA, 16 nt, Salmonella enterica enterica serovar Typhi
accugaaaucagccug

SEQ ID NO: 1692230 - RNA, 13 nt, Salmonella enterica enterica serovar Typhi
accugaaugcaaa

SEQ ID NO: 1692231 - RNA, 17 nt, Salmonella enterica enterica serovar Typhi
accugacuauacccaaa

SEQ ID NO: 1692232 - RNA, 13 nt, Salmonella enterica enterica serovar Typhi
accucugcaaaca

SEQ ID NO: 1692233 - RNA, 13 nt, Salmonella enterica enterica serovar Typhi
accggugcgcccc

SEQ ID NO: 1692234 - RNA, 16 nt, Salmonella enterica enterica serovar Typhi
accggugcgccccagc

SEQ ID NO: 1692235 - RNA, 19 nt, Salmonella enterica enterica serovar Typhi
accggugcgccccagcaug

SEQ ID NO: 1692236 - RNA, 18 nt, Salmonella enterica enterica serovar Typhi
accggucuggcucacuga

SEQ ID NO: 1692237 - RNA, 20 nt, Salmonella enterica enterica serovar Typhi
accgggcucacgcuggugcu

SEQ ID NO: 1692238 - RNA, 12 nt, Salmonella enterica enterica serovar Typhi
accuccgcccgg

SEQ ID NO: 1692239 - RNA, 19 nt, Salmonella enterica enterica serovar Typhi
accuccggcuaugccggag

SEQ ID NO: 1692240 - RNA, 16 nt, Salmonella enterica enterica serovar Typhi
accucaccguccgcca

SEQ ID NO: 1692241 - RNA, 21 nt, Salmonella enterica enterica serovar Typhi
accucaccguccgccaggccc

SEQ ID NO: 1692242 - RNA, 19 nt, Salmonella enterica enterica serovar Typhi
accucccgccggggcuccc

SEQ ID NO: 1692243 - RNA, 13 nt, Salmonella enterica enterica serovar Typhi
accucaucaaaca

SEQ ID NO: 1692244 - RNA, 20 nt, Salmonella enterica enterica serovar Typhi
accuuuuuuuccagcgucug

SEQ ID NO: 1692245 - RNA, 12 nt, Salmonella enterica enterica serovar Typhi
acgaaaaauaaa

SEQ ID NO: 1692246 - RNA, 13 nt, Salmonella enterica enterica serovar Typhi
acgaaaaauaaaa

SEQ ID NO: 1692247 - RNA, 14 nt, Salmonella enterica enterica serovar Typhi
acgaaaaauaaaaa

SEQ ID NO: 1692248 - RNA, 17 nt, Salmonella enterica enterica serovar Typhi
acgaaaaccguccacau

SEQ ID NO: 1692249 - RNA, 21 nt, Salmonella enterica enterica serovar Typhi
acgaacaacaucagacaguac

SEQ ID NO: 1692250 - RNA, 21 nt, Salmonella enterica enterica serovar Typhi
acgaaaucagagacaaauaca

SEQ ID NO: 1692251 - RNA, 21 nt, Salmonella enterica enterica serovar Typhi
acgaaauggugugcauggugu

SEQ ID NO: 1692252 - RNA, 19 nt, Salmonella enterica enterica serovar Typhi
acgaaccugauuguuuuac

SEQ ID NO: 1692253 - RNA, 16 nt, Salmonella enterica enterica serovar Typhi
acgaaccguggccucc

SEQ ID NO: 1692254 - RNA, 14 nt, Salmonella enterica enterica serovar Typhi
acgaaccgagcggu

SEQ ID NO: 1692255 - RNA, 17 nt, Salmonella enterica enterica serovar Typhi
accuucggucccaucgc

SEQ ID NO: 1692256 - RNA, 15 nt, Salmonella enterica enterica serovar Typhi
accuucgacgagguu

SEQ ID NO: 1692257 - RNA, 13 nt, Salmonella enterica enterica serovar Typhi
accuucggccucc

SEQ ID NO: 1692258 - RNA, 22 nt, Salmonella enterica enterica serovar Typhi
accuucggccuccgcuuccugc

SEQ ID NO: 1692259 - RNA, 20 nt, Salmonella enterica enterica serovar Typhi
accuuuaaccucuuuuucau

SEQ ID NO: 1692260 - RNA, 17 nt, Salmonella enterica enterica serovar Typhi
accuuaucgagaauacu

SEQ ID NO: 1692261 - RNA, 20 nt, Salmonella enterica enterica serovar Typhi
accuucaacccagcagcaga

SEQ ID NO: 1692262 - RNA, 20 nt, Salmonella enterica enterica serovar Typhi
accuuacguuucucacuaau

SEQ ID NO: 1692263 - RNA, 20 nt, Salmonella enterica enterica serovar Typhi
accuuaaccgucugcucaga

SEQ ID NO: 1692264 - RNA, 21 nt, Salmonella enterica enterica serovar Typhi
accuuaauuugugauugcaga

SEQ ID NO: 1692265 - RNA, 11 nt, Salmonella enterica enterica serovar Typhi
accuuaaugau

SEQ ID NO: 1692266 - RNA, 17 nt, Salmonella enterica enterica serovar Typhi
accuguuucgccaggcc

SEQ ID NO: 1692267 - RNA, 23 nt, Salmonella enterica enterica serovar Typhi
accugauauugcguaagcagcug

SEQ ID NO: 1692268 - RNA, 19 nt, Salmonella enterica enterica serovar Typhi
accugagcgugcaauguca

SEQ ID NO: 1692269 - RNA, 17 nt, Salmonella enterica enterica serovar Typhi
acgauguaaaaccuggc

SEQ ID NO: 1692270 - RNA, 17 nt, Salmonella enterica enterica serovar Typhi
acgauguucgucccugc

SEQ ID NO: 1692271 - RNA, 13 nt, Salmonella enterica enterica serovar Typhi
acgauuuccccug

SEQ ID NO: 1692272 - RNA, 19 nt, Salmonella enterica enterica serovar Typhi
acgcaaagacaccccagcc

SEQ ID NO: 1692273 - RNA, 17 nt, Salmonella enterica enterica serovar Typhi
acgaucccuaauaaaau

SEQ ID NO: 1692274 - RNA, 17 nt, Salmonella enterica enterica serovar Typhi
acgaucgcgcacaugcu

SEQ ID NO: 1692275 - RNA, 15 nt, Salmonella enterica enterica serovar Typhi
acgaugaugaaaaag

SEQ ID NO: 1692276 - RNA, 17 nt, Salmonella enterica enterica serovar Typhi
acgaugaugaaaaagaa

SEQ ID NO: 1692277 - RNA, 22 nt, Salmonella enterica enterica serovar Typhi
acgaucugacauuugcaucaaa

SEQ ID NO: 1692278 - RNA, 20 nt, Salmonella enterica enterica serovar Typhi
acgaacgcuggcacuuuccg

SEQ ID NO: 1692279 - RNA, 17 nt, Salmonella enterica enterica serovar Typhi
acgaagagaccugugua

SEQ ID NO: 1692280 - RNA, 21 nt, Salmonella enterica enterica serovar Typhi
acgaacuccccgacugcugcg

SEQ ID NO: 1692281 - RNA, 17 nt, Salmonella enterica enterica serovar Typhi
acgaaguuuaauucuuu

SEQ ID NO: 1692282 - RNA, 21 nt, Salmonella enterica enterica serovar Typhi
acgaaguuuaauucuuugagc

SEQ ID NO: 1692283 - RNA, 16 nt, Salmonella enterica enterica serovar Typhi
acgacuucguuaguga

SEQ ID NO: 1692284 - RNA, 18 nt, Salmonella enterica enterica serovar Typhi
acgagaagcgauuagcug

SEQ ID NO: 1692285 - RNA, 16 nt, Salmonella enterica enterica serovar Typhi
acgagaauaagaccaa

SEQ ID NO: 1692286 - RNA, 19 nt, Salmonella enterica enterica serovar Typhi
acgagaacccacuuugcuu

SEQ ID NO: 1692287 - RNA, 19 nt, Salmonella enterica enterica serovar Typhi
acgagaacucggaggcggc

SEQ ID NO: 1692288 - RNA, 20 nt, Salmonella enterica enterica serovar Typhi
acgauaccgacacaucaucg

SEQ ID NO: 1692289 - RNA, 22 nt, Salmonella enterica enterica serovar Typhi
acgauacagcacggcaguacac

SEQ ID NO: 1692290 - RNA, 13 nt, Salmonella enterica enterica serovar Typhi
acgauacccacca

SEQ ID NO: 1692291 - RNA, 16 nt, Salmonella enterica enterica serovar Typhi
acgauacucagcccca

SEQ ID NO: 1692292 - RNA, 21 nt, Salmonella enterica enterica serovar Typhi
acgauagcaauuaauaaacaa

SEQ ID NO: 1692293 - RNA, 13 nt, Salmonella enterica enterica serovar Typhi
acgcagaccaaag

SEQ ID NO: 1692294 - RNA, 15 nt, Salmonella enterica enterica serovar Typhi
acgcagaagacagaa

SEQ ID NO: 1692295 - RNA, 19 nt, Salmonella enterica enterica serovar Typhi
acgcagcacguccagauac

SEQ ID NO: 1692296 - RNA, 17 nt, Salmonella enterica enterica serovar Typhi
acgcagcaagaacagag

SEQ ID NO: 1692297 - RNA, 15 nt, Salmonella enterica enterica serovar Typhi
acgcagauauucauu

SEQ ID NO: 1692298 - RNA, 15 nt, Salmonella enterica enterica serovar Typhi
acgcagcaagaacag

SEQ ID NO: 1692299 - RNA, 11 nt, Salmonella enterica enterica serovar Typhi
acgcagcccca

SEQ ID NO: 1692300 - RNA, 16 nt, Salmonella enterica enterica serovar Typhi
acgcaggcuaacgcgc

SEQ ID NO: 1692301 - RNA, 17 nt, Salmonella enterica enterica serovar Typhi
acgcagcuuaaagccaa

SEQ ID NO: 1692302 - RNA, 14 nt, Salmonella enterica enterica serovar Typhi
acgcagcuucgccg

SEQ ID NO: 1692303 - RNA, 19 nt, Salmonella enterica enterica serovar Typhi
acgcaacucacgccauucc

SEQ ID NO: 1692304 - RNA, 17 nt, Salmonella enterica enterica serovar Typhi
acgcaaggaaauauuaa

SEQ ID NO: 1692305 - RNA, 22 nt, Salmonella enterica enterica serovar Typhi
acgcaaggaaauauuaauuaag

SEQ ID NO: 1692306 - RNA, 16 nt, Salmonella enterica enterica serovar Typhi
acgcaccagccaggcg

SEQ ID NO: 1692307 - RNA, 17 nt, Salmonella enterica enterica serovar Typhi
acgcaccguagugacac

SEQ ID NO: 1692308 - RNA, 21 nt, Salmonella enterica enterica serovar Typhi
acgcaccgccaaacgcgguca

SEQ ID NO: 1692309 - RNA, 20 nt, Salmonella enterica enterica serovar Typhi
acgcagugcgcgaccgcauc

SEQ ID NO: 1692310 - RNA, 20 nt, Salmonella enterica enterica serovar Typhi
acgcagggccgcgagaacuu

SEQ ID NO: 1692311 - RNA, 19 nt, Salmonella enterica enterica serovar Typhi
acgcauaaaaaaugagaaa

SEQ ID NO: 1692312 - RNA, 15 nt, Salmonella enterica enterica serovar Typhi
acgcauaccagccau

SEQ ID NO: 1692313 - RNA, 12 nt, Salmonella enterica enterica serovar Typhi
acgcaucaaaua

SEQ ID NO: 1692314 - RNA, 15 nt, Salmonella enterica enterica serovar Typhi
acgcaucaaagccac

SEQ ID NO: 1692315 - RNA, 15 nt, Salmonella enterica enterica serovar Typhi
acgcauaguccugcc

SEQ ID NO: 1692316 - RNA, 24 nt, Salmonella enterica enterica serovar Typhi
acgcauaucccacugcacgccagg

SEQ ID NO: 1692317 - RNA, 18 nt, Salmonella enterica enterica serovar Typhi
acgcaucccgccaaccag

SEQ ID NO: 1692318 - RNA, 14 nt, Salmonella enterica enterica serovar Typhi
acgcauccugcacu

SEQ ID NO: 1692319 - RNA, 22 nt, Salmonella enterica enterica serovar Typhi
acgcauccagcgcaaagggaca

SEQ ID NO: 1692320 - RNA, 23 nt, Salmonella enterica enterica serovar Typhi
acgcaucaaauaccuuuucauug

SEQ ID NO: 1692321 - RNA, 13 nt, Salmonella enterica enterica serovar Typhi
acgcaugaagcgu

SEQ ID NO: 1692322 - RNA, 15 nt, Salmonella enterica enterica serovar Typhi
acgcaucuuuuuccc

SEQ ID NO: 1692323 - RNA, 16 nt, Salmonella enterica enterica serovar Typhi
acgcaucuuuuucccg

SEQ ID NO: 1692324 - RNA, 22 nt, Salmonella enterica enterica serovar Typhi
acgcauugagacaugccgccag

SEQ ID NO: 1692325 - RNA, 24 nt, Salmonella enterica enterica serovar Typhi
acgccagacuauccguccucuuuc

SEQ ID NO: 1692326 - RNA, 14 nt, Salmonella enterica enterica serovar Typhi
acgccagcagcucg

SEQ ID NO: 1692327 - RNA, 11 nt, Salmonella enterica enterica serovar Typhi
acgccagcaga

SEQ ID NO: 1692328 - RNA, 19 nt, Salmonella enterica enterica serovar Typhi
acgccagccagaauauuag

SEQ ID NO: 1692329 - RNA, 11 nt, Salmonella enterica enterica serovar Typhi
acgccagccag

SEQ ID NO: 1692330 - RNA, 18 nt, Salmonella enterica enterica serovar Typhi
acgccaggguaauacugg

SEQ ID NO: 1692331 - RNA, 14 nt, Salmonella enterica enterica serovar Typhi
acgccagugcgcau

SEQ ID NO: 1692332 - RNA, 19 nt, Salmonella enterica enterica serovar Typhi
acgccagucuuugcaggag

SEQ ID NO: 1692333 - RNA, 17 nt, Salmonella enterica enterica serovar Typhi
acgccaccgccaccugc

SEQ ID NO: 1692334 - RNA, 14 nt, Salmonella enterica enterica serovar Typhi
acgccaccacgccg

SEQ ID NO: 1692335 - RNA, 22 nt, Salmonella enterica enterica serovar Typhi
acgccaccggguuaaagcccug

SEQ ID NO: 1692336 - RNA, 19 nt, Salmonella enterica enterica serovar Typhi
acgccaccuuugaaaauca

SEQ ID NO: 1692337 - RNA, 14 nt, Salmonella enterica enterica serovar Typhi
acgccaagcugcaa

SEQ ID NO: 1692338 - RNA, 15 nt, Salmonella enterica enterica serovar Typhi
acgccaagcugcaau

SEQ ID NO: 1692339 - RNA, 13 nt, Salmonella enterica enterica serovar Typhi
acgccaagcagcg

SEQ ID NO: 1692340 - RNA, 21 nt, Salmonella enterica enterica serovar Typhi
acgccaagcgcggcagcagcu

SEQ ID NO: 1692341 - RNA, 16 nt, Salmonella enterica enterica serovar Typhi
acgcauuucaagcagg

SEQ ID NO: 1692342 - RNA, 18 nt, Salmonella enterica enterica serovar Typhi
acgcauuggcaauuaaac

SEQ ID NO: 1692343 - RNA, 12 nt, Salmonella enterica enterica serovar Typhi
acgccaacgcgc

SEQ ID NO: 1692344 - RNA, 13 nt, Salmonella enterica enterica serovar Typhi
acgccaaaaagug

SEQ ID NO: 1692345 - RNA, 15 nt, Salmonella enterica enterica serovar Typhi
accgcccgccgggcg

SEQ ID NO: 1692346 - RNA, 20 nt, Salmonella enterica enterica serovar Typhi
accgcccagagaauauuggc

SEQ ID NO: 1692347 - RNA, 16 nt, Salmonella enterica enterica serovar Typhi
accgccgacaccggcc

SEQ ID NO: 1692348 - RNA, 21 nt, Salmonella enterica enterica serovar Typhi
accgccgacaccggccugccu

SEQ ID NO: 1692349 - RNA, 15 nt, Salmonella enterica enterica serovar Typhi
accgccaucaaacgc

SEQ ID NO: 1692350 - RNA, 13 nt, Salmonella enterica enterica serovar Typhi
accgcagaaaaag

SEQ ID NO: 1692351 - RNA, 16 nt, Salmonella enterica enterica serovar Typhi
accgccaauaauuuua

SEQ ID NO: 1692352 - RNA, 13 nt, Salmonella enterica enterica serovar Typhi
accgcauuuucag

SEQ ID NO: 1692353 - RNA, 14 nt, Salmonella enterica enterica serovar Typhi
accgccaagcgcgg

SEQ ID NO: 1692354 - RNA, 13 nt, Salmonella enterica enterica serovar Typhi
accgcaugacaau

SEQ ID NO: 1692355 - RNA, 15 nt, Salmonella enterica enterica serovar Typhi
accgcauggaaucga

SEQ ID NO: 1692356 - RNA, 19 nt, Salmonella enterica enterica serovar Typhi
accgaugccgugaggcuga

SEQ ID NO: 1692357 - RNA, 22 nt, Salmonella enterica enterica serovar Typhi
accgaugcaaccgcucuccgca

SEQ ID NO: 1692358 - RNA, 18 nt, Salmonella enterica enterica serovar Typhi
accgauauuuugcugcac

SEQ ID NO: 1692359 - RNA, 18 nt, Salmonella enterica enterica serovar Typhi
accgauagcuaucacaca

SEQ ID NO: 1692360 - RNA, 16 nt, Salmonella enterica enterica serovar Typhi
acccugaaauccggcu

SEQ ID NO: 1692361 - RNA, 16 nt, Salmonella enterica enterica serovar Typhi
acccucgaaugugaau

SEQ ID NO: 1692362 - RNA, 14 nt, Salmonella enterica enterica serovar Typhi
accgacuuucaaau

SEQ ID NO: 1692363 - RNA, 22 nt, Salmonella enterica enterica serovar Typhi
accgagaauguguucucccugc

SEQ ID NO: 1692364 - RNA, 13 nt, Salmonella enterica enterica serovar Typhi
accgagacagaga

SEQ ID NO: 1692365 - RNA, 14 nt, Salmonella enterica enterica serovar Typhi
accgagauacgcug

SEQ ID NO: 1692366 - RNA, 22 nt, Salmonella enterica enterica serovar Typhi
acccguuuucuccuucauccag

SEQ ID NO: 1692367 - RNA, 19 nt, Salmonella enterica enterica serovar Typhi
acccguuaaauaccagcac

SEQ ID NO: 1692368 - RNA, 17 nt, Salmonella enterica enterica serovar Typhi
accggccagcgucauca

SEQ ID NO: 1692369 - RNA, 20 nt, Salmonella enterica enterica serovar Typhi
accggauuggucugauucag

SEQ ID NO: 1692370 - RNA, 21 nt, Salmonella enterica enterica serovar Typhi
accggauuugacguuauccag

SEQ ID NO: 1692371 - RNA, 15 nt, Salmonella enterica enterica serovar Typhi
accggccgcccggac

SEQ ID NO: 1692372 - RNA, 12 nt, Salmonella enterica enterica serovar Typhi
accggcccagcu

SEQ ID NO: 1692373 - RNA, 15 nt, Salmonella enterica enterica serovar Typhi
accggcccacgcagu

SEQ ID NO: 1692374 - RNA, 22 nt, Salmonella enterica enterica serovar Typhi
accgcugggaugaccugaaauc

SEQ ID NO: 1692375 - RNA, 17 nt, Salmonella enterica enterica serovar Typhi
accggauauggcaaaaa

SEQ ID NO: 1692376 - RNA, 14 nt, Salmonella enterica enterica serovar Typhi
accgcugcgauaau

SEQ ID NO: 1692377 - RNA, 18 nt, Salmonella enterica enterica serovar Typhi
accgcugcggaacaccag

SEQ ID NO: 1692378 - RNA, 17 nt, Salmonella enterica enterica serovar Typhi
accgcugggaugaccug

SEQ ID NO: 1692379 - RNA, 21 nt, Salmonella enterica enterica serovar Typhi
accggcuguauacacuuucca

SEQ ID NO: 1692380 - RNA, 20 nt, Salmonella enterica enterica serovar Typhi
accgggcgaaagcacuucuc

SEQ ID NO: 1692381 - RNA, 22 nt, Salmonella enterica enterica serovar Typhi
accgggccuccuuuccugugcu

SEQ ID NO: 1692382 - RNA, 15 nt, Salmonella enterica enterica serovar Typhi
accggcgucaucauu

SEQ ID NO: 1692383 - RNA, 19 nt, Salmonella enterica enterica serovar Typhi
accggcggccuaccaguug

SEQ ID NO: 1692384 - RNA, 12 nt, Salmonella enterica enterica serovar Typhi
accggcgcgccu

SEQ ID NO: 1692385 - RNA, 22 nt, Salmonella enterica enterica serovar Typhi
accggcgguugagauuggcccg

SEQ ID NO: 1692386 - RNA, 19 nt, Salmonella enterica enterica serovar Typhi
accggcguaauugcgccug

SEQ ID NO: 1692387 - RNA, 17 nt, Salmonella enterica enterica serovar Typhi
accggcgauguuggcgc

SEQ ID NO: 1692388 - RNA, 21 nt, Salmonella enterica enterica serovar Typhi
accggcgaacguuggcugggu

SEQ ID NO: 1692389 - RNA, 15 nt, Salmonella enterica enterica serovar Typhi
accgcgcuccuggaa

SEQ ID NO: 1692390 - RNA, 21 nt, Salmonella enterica enterica serovar Typhi
accgcugauggaccuuuuggu

SEQ ID NO: 1692391 - RNA, 13 nt, Salmonella enterica enterica serovar Typhi
accgcgcccgguu

SEQ ID NO: 1692392 - RNA, 14 nt, Salmonella enterica enterica serovar Typhi
accgcgcaaucaaa

SEQ ID NO: 1692393 - RNA, 21 nt, Salmonella enterica enterica serovar Typhi
accgcgaucgaugugauaaau

SEQ ID NO: 1692394 - RNA, 20 nt, Salmonella enterica enterica serovar Typhi
accgcgaugaccaucaaaua

SEQ ID NO: 1692395 - RNA, 14 nt, Salmonella enterica enterica serovar Typhi
accgcgcggcguuc

SEQ ID NO: 1692396 - RNA, 19 nt, Salmonella enterica enterica serovar Typhi
accgcgcggcguucugcgc

SEQ ID NO: 1692397 - RNA, 19 nt, Salmonella enterica enterica serovar Typhi
accgcgaauuucaccaccg

SEQ ID NO: 1692398 - RNA, 20 nt, Salmonella enterica enterica serovar Typhi
accgccuacacaaaaucauu

SEQ ID NO: 1692399 - RNA, 14 nt, Salmonella enterica enterica serovar Typhi
accgccuccaggcc

SEQ ID NO: 1692400 - RNA, 19 nt, Salmonella enterica enterica serovar Typhi
accgccucgccaaagcgcu

SEQ ID NO: 1692401 - RNA, 22 nt, Salmonella enterica enterica serovar Typhi
accgccgcgauagaccacgcca

SEQ ID NO: 1692402 - RNA, 21 nt, Salmonella enterica enterica serovar Typhi
accauaccgcuuaacagcgua

SEQ ID NO: 1692403 - RNA, 22 nt, Salmonella enterica enterica serovar Typhi
accauaccggugcgccccagca

SEQ ID NO: 1692404 - RNA, 20 nt, Salmonella enterica enterica serovar Typhi
accaucaaaaaaaauagcca

SEQ ID NO: 1692405 - RNA, 17 nt, Salmonella enterica enterica serovar Typhi
accauacugacuuaaua

SEQ ID NO: 1692406 - RNA, 13 nt, Salmonella enterica enterica serovar Typhi
accagaaccucac

SEQ ID NO: 1692407 - RNA, 21 nt, Salmonella enterica enterica serovar Typhi
accagaaaaccgacagcaaua

SEQ ID NO: 1692408 - RNA, 22 nt, Salmonella enterica enterica serovar Typhi
accagaaaaccgacagcaauau

SEQ ID NO: 1692409 - RNA, 16 nt, Salmonella enterica enterica serovar Typhi
accacuuuguuuuugu

SEQ ID NO: 1692410 - RNA, 13 nt, Salmonella enterica enterica serovar Typhi
accauaaugaucg

SEQ ID NO: 1692411 - RNA, 20 nt, Salmonella enterica enterica serovar Typhi
accaugcucagcggcggcgg

SEQ ID NO: 1692412 - RNA, 16 nt, Salmonella enterica enterica serovar Typhi
accaugccacaacaga

SEQ ID NO: 1692413 - RNA, 12 nt, Salmonella enterica enterica serovar Typhi
accaucacugaa

SEQ ID NO: 1692414 - RNA, 14 nt, Salmonella enterica enterica serovar Typhi
accaucaguucagg

SEQ ID NO: 1692415 - RNA, 20 nt, Salmonella enterica enterica serovar Typhi
accaucccagguuauucagg

SEQ ID NO: 1692416 - RNA, 21 nt, Salmonella enterica enterica serovar Typhi
accaucccagguuauucaggu

SEQ ID NO: 1692417 - RNA, 13 nt, Salmonella enterica enterica serovar Typhi
accaucccggcgu

SEQ ID NO: 1692418 - RNA, 14 nt, Salmonella enterica enterica serovar Typhi
accaucaugcaaga

SEQ ID NO: 1692419 - RNA, 14 nt, Salmonella enterica enterica serovar Typhi
accauuuccucugc

SEQ ID NO: 1692420 - RNA, 22 nt, Salmonella enterica enterica serovar Typhi
accauuguuguaagggcuggaa

SEQ ID NO: 1692421 - RNA, 18 nt, Salmonella enterica enterica serovar Typhi
accauugcguauuucacc

SEQ ID NO: 1692422 - RNA, 17 nt, Salmonella enterica enterica serovar Typhi
accauuggcaccaccag

SEQ ID NO: 1692423 - RNA, 14 nt, Salmonella enterica enterica serovar Typhi
accauugauaccaa

SEQ ID NO: 1692424 - RNA, 18 nt, Salmonella enterica enterica serovar Typhi
accauuccgauagcgaaa

SEQ ID NO: 1692425 - RNA, 16 nt, Salmonella enterica enterica serovar Typhi
accauuaucgcuccgg

SEQ ID NO: 1692426 - RNA, 14 nt, Salmonella enterica enterica serovar Typhi
accauuaacaucag

SEQ ID NO: 1692427 - RNA, 19 nt, Salmonella enterica enterica serovar Typhi
accauuaagacagguaacu

SEQ ID NO: 1692428 - RNA, 15 nt, Salmonella enterica enterica serovar Typhi
acccaacaccagacu

SEQ ID NO: 1692429 - RNA, 16 nt, Salmonella enterica enterica serovar Typhi
acccaaauaucaaaua

SEQ ID NO: 1692430 - RNA, 14 nt, Salmonella enterica enterica serovar Typhi
acccaacguuauaa

SEQ ID NO: 1692431 - RNA, 15 nt, Salmonella enterica enterica serovar Typhi
acccaaugauccgga

SEQ ID NO: 1692432 - RNA, 13 nt, Salmonella enterica enterica serovar Typhi
acccacaagaaau

SEQ ID NO: 1692433 - RNA, 17 nt, Salmonella enterica enterica serovar Typhi
acccacaucagcggcac

SEQ ID NO: 1692434 - RNA, 15 nt, Salmonella enterica enterica serovar Typhi
accccaguagcccug

SEQ ID NO: 1692435 - RNA, 18 nt, Salmonella enterica enterica serovar Typhi
accccaggcauagaaaaa

SEQ ID NO: 1692436 - RNA, 22 nt, Salmonella enterica enterica serovar Typhi
accccaggcgauaccgcgcugg

SEQ ID NO: 1692437 - RNA, 18 nt, Salmonella enterica enterica serovar Typhi
accccagggagacggcca

SEQ ID NO: 1692438 - RNA, 22 nt, Salmonella enterica enterica serovar Typhi
accccagggagacggccaccca

SEQ ID NO: 1692439 - RNA, 12 nt, Salmonella enterica enterica serovar Typhi
acccccagccau

SEQ ID NO: 1692440 - RNA, 17 nt, Salmonella enterica enterica serovar Typhi
acccccagcacauuaca

SEQ ID NO: 1692441 - RNA, 15 nt, Salmonella enterica enterica serovar Typhi
accccaucccggcaa

SEQ ID NO: 1692442 - RNA, 18 nt, Salmonella enterica enterica serovar Typhi
accccaugccgauaauaa

SEQ ID NO: 1692443 - RNA, 11 nt, Salmonella enterica enterica serovar Typhi
accccaucccg

SEQ ID NO: 1692444 - RNA, 16 nt, Salmonella enterica enterica serovar Typhi
accccgccaccgccgc

SEQ ID NO: 1692445 - RNA, 23 nt, Salmonella enterica enterica serovar Typhi
accccgccagcagguuaaacaga

SEQ ID NO: 1692446 - RNA, 19 nt, Salmonella enterica enterica serovar Typhi
accccgccgucagacaggc

SEQ ID NO: 1692447 - RNA, 19 nt, Salmonella enterica enterica serovar Typhi
acccaugccgcgacgaagu

SEQ ID NO: 1692448 - RNA, 15 nt, Salmonella enterica enterica serovar Typhi
acccaugacgguagc

SEQ ID NO: 1692449 - RNA, 13 nt, Salmonella enterica enterica serovar Typhi
acccaccagcgcc

SEQ ID NO: 1692450 - RNA, 14 nt, Salmonella enterica enterica serovar Typhi
acccaccagcgcca

SEQ ID NO: 1692451 - RNA, 15 nt, Salmonella enterica enterica serovar Typhi
acccaccaacuuuuc

SEQ ID NO: 1692452 - RNA, 21 nt, Salmonella enterica enterica serovar Typhi
acccauauuccugcggcccca

SEQ ID NO: 1692453 - RNA, 13 nt, Salmonella enterica enterica serovar Typhi
accccugcggcug

SEQ ID NO: 1692454 - RNA, 20 nt, Salmonella enterica enterica serovar Typhi
accccuucuggagaauaucc

SEQ ID NO: 1692455 - RNA, 13 nt, Salmonella enterica enterica serovar Typhi
acccgcuaugaag

SEQ ID NO: 1692456 - RNA, 15 nt, Salmonella enterica enterica serovar Typhi
acccgcuaugaagac

SEQ ID NO: 1692457 - RNA, 13 nt, Salmonella enterica enterica serovar Typhi
acccgcuccagaa

SEQ ID NO: 1692458 - RNA, 16 nt, Salmonella enterica enterica serovar Typhi
acccgcuccagaagca

SEQ ID NO: 1692459 - RNA, 18 nt, Salmonella enterica enterica serovar Typhi
acccgcgcucuccggcac

SEQ ID NO: 1692460 - RNA, 18 nt, Salmonella enterica enterica serovar Typhi
acccgcuuuuccuguucu

SEQ ID NO: 1692461 - RNA, 18 nt, Salmonella enterica enterica serovar Typhi
acccgcuuucgcguagcc

SEQ ID NO: 1692462 - RNA, 23 nt, Salmonella enterica enterica serovar Typhi
acccggcaaaggaauuacgggcg

SEQ ID NO: 1692463 - RNA, 22 nt, Salmonella enterica enterica serovar Typhi
acccggcugccauuaucaccau

SEQ ID NO: 1692464 - RNA, 16 nt, Salmonella enterica enterica serovar Typhi
acccggcuuuugcuuu

SEQ ID NO: 1692465 - RNA, 22 nt, Salmonella enterica enterica serovar Typhi
agaaagauaaaauacgugcgga

SEQ ID NO: 1692466 - RNA, 16 nt, Salmonella enterica enterica serovar Typhi
agaaaccgcagaaaaa

SEQ ID NO: 1692467 - RNA, 17 nt, Salmonella enterica enterica serovar Typhi
agaaacugcuguagcac

SEQ ID NO: 1692468 - RNA, 23 nt, Salmonella enterica enterica serovar Typhi
agaaagcuacguuugaacagcag

SEQ ID NO: 1692469 - RNA, 17 nt, Salmonella enterica enterica serovar Typhi
agaaaguggcauaucau

SEQ ID NO: 1692470 - RNA, 23 nt, Salmonella enterica enterica serovar Typhi
agaaaguaggcgguuucaucgag

SEQ ID NO: 1692471 - RNA, 12 nt, Salmonella enterica enterica serovar Typhi
agaaaaagaagc

SEQ ID NO: 1692472 - RNA, 12 nt, Salmonella enterica enterica serovar Typhi
agaaaaacgcgc

SEQ ID NO: 1692473 - RNA, 15 nt, Salmonella enterica enterica serovar Typhi
agaaaauaacaauau

SEQ ID NO: 1692474 - RNA, 20 nt, Salmonella enterica enterica serovar Typhi
agaaaauaauucuuaaccca

SEQ ID NO: 1692475 - RNA, 13 nt, Salmonella enterica enterica serovar Typhi
agaaaauaauuca

SEQ ID NO: 1692476 - RNA, 11 nt, Salmonella enterica enterica serovar Typhi
agaaacaucau

SEQ ID NO: 1692477 - RNA, 16 nt, Salmonella enterica enterica serovar Typhi
agaaaaccccguacag

SEQ ID NO: 1692478 - RNA, 19 nt, Salmonella enterica enterica serovar Typhi
agaaaaccgacagcaauau

SEQ ID NO: 1692479 - RNA, 20 nt, Salmonella enterica enterica serovar Typhi
agaagcacgacacaaaagca

SEQ ID NO: 1692480 - RNA, 15 nt, Salmonella enterica enterica serovar Typhi
agaagauuucuuaau

SEQ ID NO: 1692481 - RNA, 16 nt, Salmonella enterica enterica serovar Typhi
agaaggcgaacauaag

SEQ ID NO: 1692482 - RNA, 22 nt, Salmonella enterica enterica serovar Typhi
agaagcucaugugcagcaucca

SEQ ID NO: 1692483 - RNA, 13 nt, Salmonella enterica enterica serovar Typhi
agaagcuuaccac

SEQ ID NO: 1692484 - RNA, 15 nt, Salmonella enterica enterica serovar Typhi
agaagcuuaccaccu

SEQ ID NO: 1692485 - RNA, 16 nt, Salmonella enterica enterica serovar Typhi
agaagcuguaacacug

SEQ ID NO: 1692486 - RNA, 12 nt, Salmonella enterica enterica serovar Typhi
agaacucaucuu

SEQ ID NO: 1692487 - RNA, 18 nt, Salmonella enterica enterica serovar Typhi
agaacucacgcucaagau

SEQ ID NO: 1692488 - RNA, 23 nt, Salmonella enterica enterica serovar Typhi
agaaccguugcgcccaucaucau

SEQ ID NO: 1692489 - RNA, 21 nt, Salmonella enterica enterica serovar Typhi
agaacguugccgcaggcaacg

SEQ ID NO: 1692490 - RNA, 23 nt, Salmonella enterica enterica serovar Typhi
agaacguugacguuucagucacc

SEQ ID NO: 1692491 - RNA, 18 nt, Salmonella enterica enterica serovar Typhi
agaacugcaaauaccaca

SEQ ID NO: 1692492 - RNA, 21 nt, Salmonella enterica enterica serovar Typhi
agaacccacuuugcuuuucug

SEQ ID NO: 1692493 - RNA, 16 nt, Salmonella enterica enterica serovar Typhi
agaaccccugccacaa

SEQ ID NO: 1692494 - RNA, 18 nt, Salmonella enterica enterica serovar Typhi
agaacauaaacagcguga

SEQ ID NO: 1692495 - RNA, 14 nt, Salmonella enterica enterica serovar Typhi
agaacagcaucacc

SEQ ID NO: 1692496 - RNA, 16 nt, Salmonella enterica enterica serovar Typhi
agaaauuauuuuaaau

SEQ ID NO: 1692497 - RNA, 23 nt, Salmonella enterica enterica serovar Typhi
agaaauugcagggugcagcaaau

SEQ ID NO: 1692498 - RNA, 16 nt, Salmonella enterica enterica serovar Typhi
agaaauugaauuauaa

SEQ ID NO: 1692499 - RNA, 18 nt, Salmonella enterica enterica serovar Typhi
agaaauucgcagcgcagg

SEQ ID NO: 1692500 - RNA, 21 nt, Salmonella enterica enterica serovar Typhi
agaaauucggcagcgucuucc

SEQ ID NO: 1692501 - RNA, 13 nt, Salmonella enterica enterica serovar Typhi
agaaauauuucac

SEQ ID NO: 1692502 - RNA, 12 nt, Salmonella enterica enterica serovar Typhi
agaaauauucag

SEQ ID NO: 1692503 - RNA, 19 nt, Salmonella enterica enterica serovar Typhi
agaaauagccgguaacuuu

SEQ ID NO: 1692504 - RNA, 18 nt, Salmonella enterica enterica serovar Typhi
agaaauacugugcccaga

SEQ ID NO: 1692505 - RNA, 22 nt, Salmonella enterica enterica serovar Typhi
agaaauagccgguaacuuuccc

SEQ ID NO: 1692506 - RNA, 18 nt, Salmonella enterica enterica serovar Typhi
agacagaacaggaugcuu

SEQ ID NO: 1692507 - RNA, 19 nt, Salmonella enterica enterica serovar Typhi
agacacuggaaacagccaa

SEQ ID NO: 1692508 - RNA, 13 nt, Salmonella enterica enterica serovar Typhi
agacacugcacca

SEQ ID NO: 1692509 - RNA, 14 nt, Salmonella enterica enterica serovar Typhi
agacagaucgguuu

SEQ ID NO: 1692510 - RNA, 16 nt, Salmonella enterica enterica serovar Typhi
agacagauaacaccag

SEQ ID NO: 1692511 - RNA, 18 nt, Salmonella enterica enterica serovar Typhi
agacacaauauugcugug

SEQ ID NO: 1692512 - RNA, 15 nt, Salmonella enterica enterica serovar Typhi
agacaccccagccua

SEQ ID NO: 1692513 - RNA, 21 nt, Salmonella enterica enterica serovar Typhi
agacacaacgugccagaaaca

SEQ ID NO: 1692514 - RNA, 14 nt, Salmonella enterica enterica serovar Typhi
agacaauuuucuuc

SEQ ID NO: 1692515 - RNA, 16 nt, Salmonella enterica enterica serovar Typhi
agacacaauauugcug

SEQ ID NO: 1692516 - RNA, 22 nt, Salmonella enterica enterica serovar Typhi
agacaaucugugugggcacucg

SEQ ID NO: 1692517 - RNA, 10 nt, Salmonella enterica enterica serovar Typhi
agacaacauc

SEQ ID NO: 1692518 - RNA, 15 nt, Salmonella enterica enterica serovar Typhi
agacaaaagcuggug

SEQ ID NO: 1692519 - RNA, 11 nt, Salmonella enterica enterica serovar Typhi
agacaaacagc

SEQ ID NO: 1692520 - RNA, 14 nt, Salmonella enterica enterica serovar Typhi
agaauuucaaucau

SEQ ID NO: 1692521 - RNA, 14 nt, Salmonella enterica enterica serovar Typhi
agaauguccccaua

SEQ ID NO: 1692522 - RNA, 15 nt, Salmonella enterica enterica serovar Typhi
agaaugaccagccga

SEQ ID NO: 1692523 - RNA, 13 nt, Salmonella enterica enterica serovar Typhi
agaaugcccagca

SEQ ID NO: 1692524 - RNA, 18 nt, Salmonella enterica enterica serovar Typhi
agaauguccaucucuuua

SEQ ID NO: 1692525 - RNA, 21 nt, Salmonella enterica enterica serovar Typhi
agaauccggcgcucaucagac

SEQ ID NO: 1692526 - RNA, 21 nt, Salmonella enterica enterica serovar Typhi
agaaucgauguaguuguucuu

SEQ ID NO: 1692527 - RNA, 17 nt, Salmonella enterica enterica serovar Typhi
agaaguagcagagaaaa

SEQ ID NO: 1692528 - RNA, 19 nt, Salmonella enterica enterica serovar Typhi
agaagggcaggggaaagcu

SEQ ID NO: 1692529 - RNA, 17 nt, Salmonella enterica enterica serovar Typhi
agaaguaaacagaauca

SEQ ID NO: 1692530 - RNA, 16 nt, Salmonella enterica enterica serovar Typhi
agaaguagcagagaaa

SEQ ID NO: 1692531 - RNA, 13 nt, Salmonella enterica enterica serovar Typhi
agacccaauaugc

SEQ ID NO: 1692532 - RNA, 21 nt, Salmonella enterica enterica serovar Typhi
agacccacauauugcgcuuca

SEQ ID NO: 1692533 - RNA, 14 nt, Salmonella enterica enterica serovar Typhi
agaccgacaaaacu

SEQ ID NO: 1692534 - RNA, 17 nt, Salmonella enterica enterica serovar Typhi
agaccgacaucgccagu

SEQ ID NO: 1692535 - RNA, 18 nt, Salmonella enterica enterica serovar Typhi
agaccggaugauggccug

SEQ ID NO: 1692536 - RNA, 13 nt, Salmonella enterica enterica serovar Typhi
aaaacagcauaau

SEQ ID NO: 1692537 - RNA, 11 nt, Salmonella enterica enterica serovar Typhi
aaaacagccag

SEQ ID NO: 1692538 - RNA, 20 nt, Salmonella enterica enterica serovar Typhi
agaccuucaacccagcagca

SEQ ID NO: 1692539 - RNA, 16 nt, Salmonella enterica enterica serovar Typhi
agaccuguaaaaaaac

SEQ ID NO: 1692540 - RNA, 12 nt, Salmonella enterica enterica serovar Typhi
agaccggcacaa

SEQ ID NO: 1692541 - RNA, 18 nt, Salmonella enterica enterica serovar Typhi
agaccggcaaucaauaca

SEQ ID NO: 1692542 - RNA, 15 nt, Salmonella enterica enterica serovar Typhi
agacgguaagaauaa

SEQ ID NO: 1692543 - RNA, 15 nt, Salmonella enterica enterica serovar Typhi
agacgguaaucagac

SEQ ID NO: 1692544 - RNA, 16 nt, Salmonella enterica enterica serovar Typhi
agacgccgccgcaucc

SEQ ID NO: 1692545 - RNA, 17 nt, Salmonella enterica enterica serovar Typhi
agacgccgcgcugcggc

SEQ ID NO: 1692546 - RNA, 14 nt, Salmonella enterica enterica serovar Typhi
agacgggccaggcg

SEQ ID NO: 1692547 - RNA, 18 nt, Salmonella enterica enterica serovar Typhi
agacgcccugcaaagcaa

SEQ ID NO: 1692548 - RNA, 22 nt, Salmonella enterica enterica serovar Typhi
agacgcccugcaaagcaaaaau

SEQ ID NO: 1692549 - RNA, 19 nt, Salmonella enterica enterica serovar Typhi
aaaacagugauuacaaaau

SEQ ID NO: 1692550 - RNA, 20 nt, Salmonella enterica enterica serovar Typhi
aaaacaguuuugucaucaga

SEQ ID NO: 1692551 - RNA, 12 nt, Salmonella enterica enterica serovar Typhi
agacaugaccgc

SEQ ID NO: 1692552 - RNA, 19 nt, Salmonella enterica enterica serovar Typhi
agacaugaccgcacagcag

SEQ ID NO: 1692553 - RNA, 15 nt, Salmonella enterica enterica serovar Typhi
agacauuauugucuu

SEQ ID NO: 1692554 - RNA, 19 nt, Salmonella enterica enterica serovar Typhi
agacaguacggaugaugua

SEQ ID NO: 1692555 - RNA, 23 nt, Salmonella enterica enterica serovar Typhi
agaccagaaucccacggagaaaa

SEQ ID NO: 1692556 - RNA, 21 nt, Salmonella enterica enterica serovar Typhi
agaccagauuaaucagcagau

SEQ ID NO: 1692557 - RNA, 15 nt, Salmonella enterica enterica serovar Typhi
agaccauccaugaaa

SEQ ID NO: 1692558 - RNA, 15 nt, Salmonella enterica enterica serovar Typhi
agaccaccagcgaca

SEQ ID NO: 1692559 - RNA, 12 nt, Salmonella enterica enterica serovar Typhi
agaccaauacga

SEQ ID NO: 1692560 - RNA, 16 nt, Salmonella enterica enterica serovar Typhi
agacauuuugaguugc

SEQ ID NO: 1692561 - RNA, 14 nt, Salmonella enterica enterica serovar Typhi
agagcgacaaugaa

SEQ ID NO: 1692562 - RNA, 22 nt, Salmonella enterica enterica serovar Typhi
agagcgaacaguacggucaggc

SEQ ID NO: 1692563 - RNA, 15 nt, Salmonella enterica enterica serovar Typhi
agagcgcgcucugcc

SEQ ID NO: 1692564 - RNA, 16 nt, Salmonella enterica enterica serovar Typhi
agagcuuauuuugacu

SEQ ID NO: 1692565 - RNA, 14 nt, Salmonella enterica enterica serovar Typhi
agagcaucaucugc

SEQ ID NO: 1692566 - RNA, 18 nt, Salmonella enterica enterica serovar Typhi
agagcauaugcgcugcga

SEQ ID NO: 1692567 - RNA, 17 nt, Salmonella enterica enterica serovar Typhi
agagcaucaauggugaa

SEQ ID NO: 1692568 - RNA, 18 nt, Salmonella enterica enterica serovar Typhi
agagcaguuuuacgugga

SEQ ID NO: 1692569 - RNA, 21 nt, Salmonella enterica enterica serovar Typhi
agagccuaucccauuagggcu

SEQ ID NO: 1692570 - RNA, 16 nt, Salmonella enterica enterica serovar Typhi
agagccuuacaggcgc

SEQ ID NO: 1692571 - RNA, 17 nt, Salmonella enterica enterica serovar Typhi
agagaucgacagcgcgc

SEQ ID NO: 1692572 - RNA, 18 nt, Salmonella enterica enterica serovar Typhi
agagaucaggaguaaaua

SEQ ID NO: 1692573 - RNA, 22 nt, Salmonella enterica enterica serovar Typhi
agagcaacgccaucagcaaaau

SEQ ID NO: 1692574 - RNA, 17 nt, Salmonella enterica enterica serovar Typhi
agacgucggcaccgaau

SEQ ID NO: 1692575 - RNA, 15 nt, Salmonella enterica enterica serovar Typhi
agacgucauaccugg

SEQ ID NO: 1692576 - RNA, 13 nt, Salmonella enterica enterica serovar Typhi
agacgucauaccu

SEQ ID NO: 1692577 - RNA, 17 nt, Salmonella enterica enterica serovar Typhi
agacuaaaacgugcuga

SEQ ID NO: 1692578 - RNA, 20 nt, Salmonella enterica enterica serovar Typhi
agagguuccccagccgcuuu

SEQ ID NO: 1692579 - RNA, 22 nt, Salmonella enterica enterica serovar Typhi
agagguuaccgggcuaaaccac

SEQ ID NO: 1692580 - RNA, 18 nt, Salmonella enterica enterica serovar Typhi
agagguuagcgcaggggg

SEQ ID NO: 1692581 - RNA, 22 nt, Salmonella enterica enterica serovar Typhi
agaggucugcauucaggccucu

SEQ ID NO: 1692582 - RNA, 18 nt, Salmonella enterica enterica serovar Typhi
agagguguuauggcaggc

SEQ ID NO: 1692583 - RNA, 20 nt, Salmonella enterica enterica serovar Typhi
agagguguuauggcaggcga

SEQ ID NO: 1692584 - RNA, 18 nt, Salmonella enterica enterica serovar Typhi
agaguaaaaccggcacau

SEQ ID NO: 1692585 - RNA, 13 nt, Salmonella enterica enterica serovar Typhi
agaguaacccuuu

SEQ ID NO: 1692586 - RNA, 15 nt, Salmonella enterica enterica serovar Typhi
agaguaacccuuuag

SEQ ID NO: 1692587 - RNA, 20 nt, Salmonella enterica enterica serovar Typhi
agaggguuggacaaaauuuu

SEQ ID NO: 1692588 - RNA, 17 nt, Salmonella enterica enterica serovar Typhi
aaaacauuccugacauu

SEQ ID NO: 1692589 - RNA, 16 nt, Salmonella enterica enterica serovar Typhi
agaggacacguuaauu

SEQ ID NO: 1692590 - RNA, 23 nt, Salmonella enterica enterica serovar Typhi
agagcuuuuccuguucgcuuauu

SEQ ID NO: 1692591 - RNA, 11 nt, Salmonella enterica enterica serovar Typhi
agaggcagcaa

SEQ ID NO: 1692592 - RNA, 15 nt, Salmonella enterica enterica serovar Typhi
agaggcagcaaagcu

SEQ ID NO: 1692593 - RNA, 23 nt, Salmonella enterica enterica serovar Typhi
agaggaucuggacgccaauuccu

SEQ ID NO: 1692594 - RNA, 16 nt, Salmonella enterica enterica serovar Typhi
agauauuauaaaauaa

SEQ ID NO: 1692595 - RNA, 12 nt, Salmonella enterica enterica serovar Typhi
agauauucccgg

SEQ ID NO: 1692596 - RNA, 20 nt, Salmonella enterica enterica serovar Typhi
agauaugaaaugagaccaau

SEQ ID NO: 1692597 - RNA, 15 nt, Salmonella enterica enterica serovar Typhi
agauauuaauaucga

SEQ ID NO: 1692598 - RNA, 18 nt, Salmonella enterica enterica serovar Typhi
agauaucaaacacaaauu

SEQ ID NO: 1692599 - RNA, 17 nt, Salmonella enterica enterica serovar Typhi
agauaucaccaucuuuu

SEQ ID NO: 1692600 - RNA, 16 nt, Salmonella enterica enterica serovar Typhi
agauaucagucugcaa

SEQ ID NO: 1692601 - RNA, 15 nt, Salmonella enterica enterica serovar Typhi
agauaucaaacacaa

SEQ ID NO: 1692602 - RNA, 23 nt, Salmonella enterica enterica serovar Typhi
agauagcgcugcgccagaucagg

SEQ ID NO: 1692603 - RNA, 20 nt, Salmonella enterica enterica serovar Typhi
agaucagcagaacaaaggcu

SEQ ID NO: 1692604 - RNA, 14 nt, Salmonella enterica enterica serovar Typhi
agaucagcauggua

SEQ ID NO: 1692605 - RNA, 19 nt, Salmonella enterica enterica serovar Typhi
agaucaggccgauuucauu

SEQ ID NO: 1692606 - RNA, 22 nt, Salmonella enterica enterica serovar Typhi
agauccugcgagcuuuccacca

SEQ ID NO: 1692607 - RNA, 18 nt, Salmonella enterica enterica serovar Typhi
agauccuggcgaaagcga

SEQ ID NO: 1692608 - RNA, 23 nt, Salmonella enterica enterica serovar Typhi
agaucauuuacggcgauuugccc

SEQ ID NO: 1692609 - RNA, 18 nt, Salmonella enterica enterica serovar Typhi
agaucauuccugaauacc

SEQ ID NO: 1692610 - RNA, 18 nt, Salmonella enterica enterica serovar Typhi
agauaauagcugaaaaga

SEQ ID NO: 1692611 - RNA, 20 nt, Salmonella enterica enterica serovar Typhi
agauaccuacuuuauuuuuc

SEQ ID NO: 1692612 - RNA, 14 nt, Salmonella enterica enterica serovar Typhi
agauaaguguugga

SEQ ID NO: 1692613 - RNA, 17 nt, Salmonella enterica enterica serovar Typhi
agauaagcgucugcaau

SEQ ID NO: 1692614 - RNA, 16 nt, Salmonella enterica enterica serovar Typhi
agauaaguccuaacac

SEQ ID NO: 1692615 - RNA, 19 nt, Salmonella enterica enterica serovar Typhi
agauaaggagaaagaccuu

SEQ ID NO: 1692616 - RNA, 18 nt, Salmonella enterica enterica serovar Typhi
agauaagccuccggauga

SEQ ID NO: 1692617 - RNA, 24 nt, Salmonella enterica enterica serovar Typhi
agaguucauaacgcacaacgucag

SEQ ID NO: 1692618 - RNA, 16 nt, Salmonella enterica enterica serovar Typhi
agaguguccauaaagu

SEQ ID NO: 1692619 - RNA, 21 nt, Salmonella enterica enterica serovar Typhi
agaguaaucguauucauugcc

SEQ ID NO: 1692620 - RNA, 17 nt, Salmonella enterica enterica serovar Typhi
agauaaacagcagcgcg

SEQ ID NO: 1692621 - RNA, 13 nt, Salmonella enterica enterica serovar Typhi
agauaaaucagcc

SEQ ID NO: 1692622 - RNA, 12 nt, Salmonella enterica enterica serovar Typhi
agauaagaucuu

SEQ ID NO: 1692623 - RNA, 15 nt, Salmonella enterica enterica serovar Typhi
agaugcaggccaagc

SEQ ID NO: 1692624 - RNA, 18 nt, Salmonella enterica enterica serovar Typhi
aaaacccguuaaauacca

SEQ ID NO: 1692625 - RNA, 16 nt, Salmonella enterica enterica serovar Typhi
aaaaccgacagcaaua

SEQ ID NO: 1692626 - RNA, 21 nt, Salmonella enterica enterica serovar Typhi
aaaaccgacgaaagauaaaaa

SEQ ID NO: 1692627 - RNA, 16 nt, Salmonella enterica enterica serovar Typhi
aaaaccccaucccggc

SEQ ID NO: 1692628 - RNA, 21 nt, Salmonella enterica enterica serovar Typhi
aaaaccauagcccguacgauc

SEQ ID NO: 1692629 - RNA, 12 nt, Salmonella enterica enterica serovar Typhi
aaaaccauauaa

SEQ ID NO: 1692630 - RNA, 16 nt, Salmonella enterica enterica serovar Typhi
agauguaccagcggca

SEQ ID NO: 1692631 - RNA, 20 nt, Salmonella enterica enterica serovar Typhi
agaugucagauccuucauuc

SEQ ID NO: 1692632 - RNA, 23 nt, Salmonella enterica enterica serovar Typhi
agauggcgccauuggcucggcgu

SEQ ID NO: 1692633 - RNA, 16 nt, Salmonella enterica enterica serovar Typhi
agauggcaagauuaac

SEQ ID NO: 1692634 - RNA, 19 nt, Salmonella enterica enterica serovar Typhi
agauguucuaucuuucaga

SEQ ID NO: 1692635 - RNA, 20 nt, Salmonella enterica enterica serovar Typhi
agauuaauaauugagcgcaa

SEQ ID NO: 1692636 - RNA, 17 nt, Salmonella enterica enterica serovar Typhi
agauguuaaaguuuuuc

SEQ ID NO: 1692637 - RNA, 21 nt, Salmonella enterica enterica serovar Typhi
agauuacucucuugccagcgc

SEQ ID NO: 1692638 - RNA, 17 nt, Salmonella enterica enterica serovar Typhi
agauuagccaggugacu

SEQ ID NO: 1692639 - RNA, 19 nt, Salmonella enterica enterica serovar Typhi
agauucaccaccacccgau

SEQ ID NO: 1692640 - RNA, 18 nt, Salmonella enterica enterica serovar Typhi
agauucaggccgccagca

SEQ ID NO: 1692641 - RNA, 21 nt, Salmonella enterica enterica serovar Typhi
agauugauuuauucacuggca

SEQ ID NO: 1692642 - RNA, 14 nt, Salmonella enterica enterica serovar Typhi
agauugaacgcugg

SEQ ID NO: 1692643 - RNA, 23 nt, Salmonella enterica enterica serovar Typhi
agauucugcgguaaucugccagc

SEQ ID NO: 1692644 - RNA, 14 nt, Salmonella enterica enterica serovar Typhi
agauucuucugccu

SEQ ID NO: 1692645 - RNA, 18 nt, Salmonella enterica enterica serovar Typhi
agauugaaacgaaaacug

SEQ ID NO: 1692646 - RNA, 16 nt, Salmonella enterica enterica serovar Typhi
agauuggcaucugcaa

SEQ ID NO: 1692647 - RNA, 18 nt, Salmonella enterica enterica serovar Typhi
agauuggcccgcccagca

SEQ ID NO: 1692648 - RNA, 23 nt, Salmonella enterica enterica serovar Typhi
agauuguuucggauaauucugac

SEQ ID NO: 1692649 - RNA, 19 nt, Salmonella enterica enterica serovar Typhi
agauugucaccguaauaua

SEQ ID NO: 1692650 - RNA, 15 nt, Salmonella enterica enterica serovar Typhi
agauugucaccguaa

SEQ ID NO: 1692651 - RNA, 17 nt, Salmonella enterica enterica serovar Typhi
agauugucaccguaaua

SEQ ID NO: 1692652 - RNA, 24 nt, Salmonella enterica enterica serovar Typhi
agauuucaucaggcugacgaagaa

SEQ ID NO: 1692653 - RNA, 20 nt, Salmonella enterica enterica serovar Typhi
agauuucacaauguuuuugu

SEQ ID NO: 1692654 - RNA, 17 nt, Salmonella enterica enterica serovar Typhi
agauuuaucaauuuuua

SEQ ID NO: 1692655 - RNA, 15 nt, Salmonella enterica enterica serovar Typhi
agauuuaucuucucu

SEQ ID NO: 1692656 - RNA, 15 nt, Salmonella enterica enterica serovar Typhi
agauuuaaaacaagc

SEQ ID NO: 1692657 - RNA, 19 nt, Salmonella enterica enterica serovar Typhi
agauuucuuaauuccucag

SEQ ID NO: 1692658 - RNA, 19 nt, Salmonella enterica enterica serovar Typhi
agauuuuucugcgccacca

SEQ ID NO: 1692659 - RNA, 21 nt, Salmonella enterica enterica serovar Typhi
agcaaaucgcccaucacaugu

SEQ ID NO: 1692660 - RNA, 14 nt, Salmonella enterica enterica serovar Typhi
agcaaaucagcuac

SEQ ID NO: 1692661 - RNA, 22 nt, Salmonella enterica enterica serovar Typhi
agcaacacuuugcgcugcgcau

SEQ ID NO: 1692662 - RNA, 15 nt, Salmonella enterica enterica serovar Typhi
agcaaauuuaaucau

SEQ ID NO: 1692663 - RNA, 13 nt, Salmonella enterica enterica serovar Typhi
agcaaauugcuga

SEQ ID NO: 1692664 - RNA, 21 nt, Salmonella enterica enterica serovar Typhi
agcaaauucaggguugucuca

SEQ ID NO: 1692665 - RNA, 21 nt, Salmonella enterica enterica serovar Typhi
agcaaagcguacaugaauaau

SEQ ID NO: 1692666 - RNA, 20 nt, Salmonella enterica enterica serovar Typhi
agcaaacauccccgcuugca

SEQ ID NO: 1692667 - RNA, 18 nt, Salmonella enterica enterica serovar Typhi
agcaaaccgacccaaaaa

SEQ ID NO: 1692668 - RNA, 19 nt, Salmonella enterica enterica serovar Typhi
agcaaaaaagcgccuuuag

SEQ ID NO: 1692669 - RNA, 15 nt, Salmonella enterica enterica serovar Typhi
agcaaaaacauuacc

SEQ ID NO: 1692670 - RNA, 15 nt, Salmonella enterica enterica serovar Typhi
agcccgcccagcauu

SEQ ID NO: 1692671 - RNA, 16 nt, Salmonella enterica enterica serovar Typhi
agcccgcccagcauua

SEQ ID NO: 1692672 - RNA, 14 nt, Salmonella enterica enterica serovar Typhi
agcccgccagcacc

SEQ ID NO: 1692673 - RNA, 15 nt, Salmonella enterica enterica serovar Typhi
agcccggcuucccau

SEQ ID NO: 1692674 - RNA, 21 nt, Salmonella enterica enterica serovar Typhi
agcccgccuccaccuuaucaa

SEQ ID NO: 1692675 - RNA, 13 nt, Salmonella enterica enterica serovar Typhi
agccgaccgccga

SEQ ID NO: 1692676 - RNA, 22 nt, Salmonella enterica enterica serovar Typhi
agcccuugaucggguuuuccug

SEQ ID NO: 1692677 - RNA, 15 nt, Salmonella enterica enterica serovar Typhi
agcccuguuauucag

SEQ ID NO: 1692678 - RNA, 19 nt, Salmonella enterica enterica serovar Typhi
agccgcagaaccauuuccu

SEQ ID NO: 1692679 - RNA, 23 nt, Salmonella enterica enterica serovar Typhi
agccgcagaaccauuuccucugc

SEQ ID NO: 1692680 - RNA, 19 nt, Salmonella enterica enterica serovar Typhi
agccgauaagaacuccaaa

SEQ ID NO: 1692681 - RNA, 22 nt, Salmonella enterica enterica serovar Typhi
agccgaggcuuaauacggcaac

SEQ ID NO: 1692682 - RNA, 13 nt, Salmonella enterica enterica serovar Typhi
agccgacgcucuu

SEQ ID NO: 1692683 - RNA, 12 nt, Salmonella enterica enterica serovar Typhi
agcccagcgccg

SEQ ID NO: 1692684 - RNA, 14 nt, Salmonella enterica enterica serovar Typhi
agcccagcgccgca

SEQ ID NO: 1692685 - RNA, 18 nt, Salmonella enterica enterica serovar Typhi
agcccacgcccugcaaug

SEQ ID NO: 1692686 - RNA, 17 nt, Salmonella enterica enterica serovar Typhi
agcccaugauggugaac

SEQ ID NO: 1692687 - RNA, 20 nt, Salmonella enterica enterica serovar Typhi
agcccaugauggugaacaga

SEQ ID NO: 1692688 - RNA, 14 nt, Salmonella enterica enterica serovar Typhi
agcccauggcaggc

SEQ ID NO: 1692689 - RNA, 23 nt, Salmonella enterica enterica serovar Typhi
agcccaugauggugaacagaauc

SEQ ID NO: 1692690 - RNA, 17 nt, Salmonella enterica enterica serovar Typhi
agcccauggcaggcagc

SEQ ID NO: 1692691 - RNA, 20 nt, Salmonella enterica enterica serovar Typhi
agcccaucagcgccagcccu

SEQ ID NO: 1692692 - RNA, 14 nt, Salmonella enterica enterica serovar Typhi
agcccaucagcgcc

SEQ ID NO: 1692693 - RNA, 16 nt, Salmonella enterica enterica serovar Typhi
agcccaucaccgccag

SEQ ID NO: 1692694 - RNA, 12 nt, Salmonella enterica enterica serovar Typhi
agccccacgccc

SEQ ID NO: 1692695 - RNA, 12 nt, Salmonella enterica enterica serovar Typhi
agccccagcgcc

SEQ ID NO: 1692696 - RNA, 13 nt, Salmonella enterica enterica serovar Typhi
agccccccgcaca

SEQ ID NO: 1692697 - RNA, 23 nt, Salmonella enterica enterica serovar Typhi
agccccccgcacagcacauagaa

SEQ ID NO: 1692698 - RNA, 22 nt, Salmonella enterica enterica serovar Typhi
agccccgaaagucaucugccag

SEQ ID NO: 1692699 - RNA, 16 nt, Salmonella enterica enterica serovar Typhi
agccccugaaauaaca

SEQ ID NO: 1692700 - RNA, 13 nt, Salmonella enterica enterica serovar Typhi
agccagaacagaa

SEQ ID NO: 1692701 - RNA, 20 nt, Salmonella enterica enterica serovar Typhi
agccagaacgagaggaggag

SEQ ID NO: 1692702 - RNA, 15 nt, Salmonella enterica enterica serovar Typhi
agccagaacucaucu

SEQ ID NO: 1692703 - RNA, 15 nt, Salmonella enterica enterica serovar Typhi
agccacgcaagcagc

SEQ ID NO: 1692704 - RNA, 18 nt, Salmonella enterica enterica serovar Typhi
agccacgcaagcagcaca

SEQ ID NO: 1692705 - RNA, 18 nt, Salmonella enterica enterica serovar Typhi
agccaccgcccagagaau

SEQ ID NO: 1692706 - RNA, 20 nt, Salmonella enterica enterica serovar Typhi
agccagcguaaauagcccgg

SEQ ID NO: 1692707 - RNA, 18 nt, Salmonella enterica enterica serovar Typhi
agccagauguaaucugac

SEQ ID NO: 1692708 - RNA, 21 nt, Salmonella enterica enterica serovar Typhi
agccagauguaaucugacaga

SEQ ID NO: 1692709 - RNA, 13 nt, Salmonella enterica enterica serovar Typhi
agccagacgccag

SEQ ID NO: 1692710 - RNA, 19 nt, Salmonella enterica enterica serovar Typhi
agccagagauccacauugg

SEQ ID NO: 1692711 - RNA, 18 nt, Salmonella enterica enterica serovar Typhi
agccagacgccagccacu

SEQ ID NO: 1692712 - RNA, 16 nt, Salmonella enterica enterica serovar Typhi
agccagacgcgcagca

SEQ ID NO: 1692713 - RNA, 22 nt, Salmonella enterica enterica serovar Typhi
agccagacgcuccgcaguaauc

SEQ ID NO: 1692714 - RNA, 20 nt, Salmonella enterica enterica serovar Typhi
agccagacggcgcccagccu

SEQ ID NO: 1692715 - RNA, 14 nt, Salmonella enterica enterica serovar Typhi
agccagauaaagca

SEQ ID NO: 1692716 - RNA, 12 nt, Salmonella enterica enterica serovar Typhi
agccacccacgg

SEQ ID NO: 1692717 - RNA, 17 nt, Salmonella enterica enterica serovar Typhi
agccacccacugacgaa

SEQ ID NO: 1692718 - RNA, 16 nt, Salmonella enterica enterica serovar Typhi
agcccaauaucccuau

SEQ ID NO: 1692719 - RNA, 15 nt, Salmonella enterica enterica serovar Typhi
agcccaauacgccag

SEQ ID NO: 1692720 - RNA, 23 nt, Salmonella enterica enterica serovar Typhi
agccauugcugcuauauaacaua

SEQ ID NO: 1692721 - RNA, 17 nt, Salmonella enterica enterica serovar Typhi
agccauuuuaaaaauau

SEQ ID NO: 1692722 - RNA, 22 nt, Salmonella enterica enterica serovar Typhi
agccaugcuauucagcaguuca

SEQ ID NO: 1692723 - RNA, 19 nt, Salmonella enterica enterica serovar Typhi
agccaugcauaaugcagcc

SEQ ID NO: 1692724 - RNA, 14 nt, Salmonella enterica enterica serovar Typhi
agccauuaaccaga

SEQ ID NO: 1692725 - RNA, 14 nt, Salmonella enterica enterica serovar Typhi
agccauucggcugc

SEQ ID NO: 1692726 - RNA, 18 nt, Salmonella enterica enterica serovar Typhi
agccauucauuaaaauug

SEQ ID NO: 1692727 - RNA, 16 nt, Salmonella enterica enterica serovar Typhi
agccauuaaugcaggc

SEQ ID NO: 1692728 - RNA, 19 nt, Salmonella enterica enterica serovar Typhi
agccauaaugcaaucaguu

SEQ ID NO: 1692729 - RNA, 15 nt, Salmonella enterica enterica serovar Typhi
agccaucauuaccaa

SEQ ID NO: 1692730 - RNA, 18 nt, Salmonella enterica enterica serovar Typhi
agccauccucacgcaacc

SEQ ID NO: 1692731 - RNA, 14 nt, Salmonella enterica enterica serovar Typhi
agccaucaauccau

SEQ ID NO: 1692732 - RNA, 15 nt, Salmonella enterica enterica serovar Typhi
agccaggcaaagccc

SEQ ID NO: 1692733 - RNA, 17 nt, Salmonella enterica enterica serovar Typhi
agccagucgccaggcaa

SEQ ID NO: 1692734 - RNA, 18 nt, Salmonella enterica enterica serovar Typhi
agccagucgccaggcaag

SEQ ID NO: 1692735 - RNA, 14 nt, Salmonella enterica enterica serovar Typhi
agccagucgccagg

SEQ ID NO: 1692736 - RNA, 15 nt, Salmonella enterica enterica serovar Typhi
agccaggccagcgcu

SEQ ID NO: 1692737 - RNA, 20 nt, Salmonella enterica enterica serovar Typhi
agccagugggcgucaaaauc

SEQ ID NO: 1692738 - RNA, 16 nt, Salmonella enterica enterica serovar Typhi
agccaguucucuucuu

SEQ ID NO: 1692739 - RNA, 20 nt, Salmonella enterica enterica serovar Typhi
agcaccucaucgcuaccuuc

SEQ ID NO: 1692740 - RNA, 16 nt, Salmonella enterica enterica serovar Typhi
agcaacccaccugcca

SEQ ID NO: 1692741 - RNA, 22 nt, Salmonella enterica enterica serovar Typhi
agcaacccugccgucucaacca

SEQ ID NO: 1692742 - RNA, 12 nt, Salmonella enterica enterica serovar Typhi
agcaacccuuuu

SEQ ID NO: 1692743 - RNA, 22 nt, Salmonella enterica enterica serovar Typhi
agcaccuuugaacgucgcugau

SEQ ID NO: 1692744 - RNA, 13 nt, Salmonella enterica enterica serovar Typhi
agcacgacacaaa

SEQ ID NO: 1692745 - RNA, 24 nt, Salmonella enterica enterica serovar Typhi
agcacguagcuuauaaaucagcuu

SEQ ID NO: 1692746 - RNA, 15 nt, Salmonella enterica enterica serovar Typhi
agcacucggcgccuu

SEQ ID NO: 1692747 - RNA, 18 nt, Salmonella enterica enterica serovar Typhi
agcacuacggcaaacaca

SEQ ID NO: 1692748 - RNA, 21 nt, Salmonella enterica enterica serovar Typhi
agcacuacggauggcccugcc

SEQ ID NO: 1692749 - RNA, 16 nt, Salmonella enterica enterica serovar Typhi
agcacuaacagcagca

SEQ ID NO: 1692750 - RNA, 20 nt, Salmonella enterica enterica serovar Typhi
agcagauagcccgccagcac

SEQ ID NO: 1692751 - RNA, 22 nt, Salmonella enterica enterica serovar Typhi
agcagcaaaccgauaaucacca

SEQ ID NO: 1692752 - RNA, 20 nt, Salmonella enterica enterica serovar Typhi
agcagauaccagccuucgga

SEQ ID NO: 1692753 - RNA, 15 nt, Salmonella enterica enterica serovar Typhi
agcagauacugcgcg

SEQ ID NO: 1692754 - RNA, 15 nt, Salmonella enterica enterica serovar Typhi
agcagagaucaggag

SEQ ID NO: 1692755 - RNA, 16 nt, Salmonella enterica enterica serovar Typhi
agcacuuugguaaaac

SEQ ID NO: 1692756 - RNA, 14 nt, Salmonella enterica enterica serovar Typhi
agcagaaagcaaca

SEQ ID NO: 1692757 - RNA, 18 nt, Salmonella enterica enterica serovar Typhi
agcagaaagcaacagcaa

SEQ ID NO: 1692758 - RNA, 19 nt, Salmonella enterica enterica serovar Typhi
agcagaaagcaacagcaag

SEQ ID NO: 1692759 - RNA, 19 nt, Salmonella enterica enterica serovar Typhi
agcagaaauacugugccca

SEQ ID NO: 1692760 - RNA, 21 nt, Salmonella enterica enterica serovar Typhi
agcagaaauacugugcccaga

SEQ ID NO: 1692761 - RNA, 16 nt, Salmonella enterica enterica serovar Typhi
agcagcaucccggcaa

SEQ ID NO: 1692762 - RNA, 20 nt, Salmonella enterica enterica serovar Typhi
agcagcauacgacaucgcca

SEQ ID NO: 1692763 - RNA, 16 nt, Salmonella enterica enterica serovar Typhi
agcagcauaaaaccgc

SEQ ID NO: 1692764 - RNA, 23 nt, Salmonella enterica enterica serovar Typhi
agcagcauaaacaucagcgcgga

SEQ ID NO: 1692765 - RNA, 14 nt, Salmonella enterica enterica serovar Typhi
agcagcaggcugga

SEQ ID NO: 1692766 - RNA, 16 nt, Salmonella enterica enterica serovar Typhi
agcagcaggcuggaga

SEQ ID NO: 1692767 - RNA, 17 nt, Salmonella enterica enterica serovar Typhi
agcagcagugaggauaa

SEQ ID NO: 1692768 - RNA, 18 nt, Salmonella enterica enterica serovar Typhi
agcagccagaaaaaggga

SEQ ID NO: 1692769 - RNA, 15 nt, Salmonella enterica enterica serovar Typhi
agcagccagaaaaag

SEQ ID NO: 1692770 - RNA, 14 nt, Salmonella enterica enterica serovar Typhi
agcagcaccggcug

SEQ ID NO: 1692771 - RNA, 15 nt, Salmonella enterica enterica serovar Typhi
agcagcagauaagcg

SEQ ID NO: 1692772 - RNA, 10 nt, Salmonella enterica enterica serovar Typhi
agcagcagaa

SEQ ID NO: 1692773 - RNA, 15 nt, Salmonella enterica enterica serovar Typhi
agcaguaacgcacuu

SEQ ID NO: 1692774 - RNA, 15 nt, Salmonella enterica enterica serovar Typhi
agcaggcacuguggu

SEQ ID NO: 1692775 - RNA, 21 nt, Salmonella enterica enterica serovar Typhi
agcaggcacuguggugugccu

SEQ ID NO: 1692776 - RNA, 16 nt, Salmonella enterica enterica serovar Typhi
agcagcucaacggcag

SEQ ID NO: 1692777 - RNA, 17 nt, Salmonella enterica enterica serovar Typhi
agcagcggcguaucuuc

SEQ ID NO: 1692778 - RNA, 16 nt, Salmonella enterica enterica serovar Typhi
agcagcgccagcgaca

SEQ ID NO: 1692779 - RNA, 15 nt, Salmonella enterica enterica serovar Typhi
agcaugacaauaacg

SEQ ID NO: 1692780 - RNA, 22 nt, Salmonella enterica enterica serovar Typhi
agcaucgcuuuuaggcugaaag

SEQ ID NO: 1692781 - RNA, 23 nt, Salmonella enterica enterica serovar Typhi
agcaucguaagccgcauuacaaa

SEQ ID NO: 1692782 - RNA, 21 nt, Salmonella enterica enterica serovar Typhi
agcaucgcuuuuaggcugaaa

SEQ ID NO: 1692783 - RNA, 18 nt, Salmonella enterica enterica serovar Typhi
agcaucgccgguagcuuc

SEQ ID NO: 1692784 - RNA, 15 nt, Salmonella enterica enterica serovar Typhi
agcaucaucugccau

SEQ ID NO: 1692785 - RNA, 16 nt, Salmonella enterica enterica serovar Typhi
agcaucaucugccauu

SEQ ID NO: 1692786 - RNA, 15 nt, Salmonella enterica enterica serovar Typhi
agcauacugcgucgg

SEQ ID NO: 1692787 - RNA, 21 nt, Salmonella enterica enterica serovar Typhi
agcauaccgugugcagugaca

SEQ ID NO: 1692788 - RNA, 14 nt, Salmonella enterica enterica serovar Typhi
agcauacgcugcac

SEQ ID NO: 1692789 - RNA, 20 nt, Salmonella enterica enterica serovar Typhi
agcagucccgccgggaucug

SEQ ID NO: 1692790 - RNA, 18 nt, Salmonella enterica enterica serovar Typhi
agcaguccugcgggaaca

SEQ ID NO: 1692791 - RNA, 15 nt, Salmonella enterica enterica serovar Typhi
agccuuuuucuuuca

SEQ ID NO: 1692792 - RNA, 19 nt, Salmonella enterica enterica serovar Typhi
agcgaauccagaucgcccu

SEQ ID NO: 1692793 - RNA, 20 nt, Salmonella enterica enterica serovar Typhi
agcgaauaaucccggcgcca

SEQ ID NO: 1692794 - RNA, 15 nt, Salmonella enterica enterica serovar Typhi
agcgaauaacauaau

SEQ ID NO: 1692795 - RNA, 17 nt, Salmonella enterica enterica serovar Typhi
agccugugaucggagaa

SEQ ID NO: 1692796 - RNA, 16 nt, Salmonella enterica enterica serovar Typhi
agccugugcaaccagc

SEQ ID NO: 1692797 - RNA, 14 nt, Salmonella enterica enterica serovar Typhi
agccugggcaaggc

SEQ ID NO: 1692798 - RNA, 14 nt, Salmonella enterica enterica serovar Typhi
agccuggugcccaa

SEQ ID NO: 1692799 - RNA, 20 nt, Salmonella enterica enterica serovar Typhi
agccugugcaaccagcucuu

SEQ ID NO: 1692800 - RNA, 15 nt, Salmonella enterica enterica serovar Typhi
agccugugcgccugc

SEQ ID NO: 1692801 - RNA, 18 nt, Salmonella enterica enterica serovar Typhi
agccugugcgccugcugc

SEQ ID NO: 1692802 - RNA, 17 nt, Salmonella enterica enterica serovar Typhi
agccuguuccagcugcg

SEQ ID NO: 1692803 - RNA, 18 nt, Salmonella enterica enterica serovar Typhi
agccuuaaucaacugcgc

SEQ ID NO: 1692804 - RNA, 23 nt, Salmonella enterica enterica serovar Typhi
agccugcuggucugaaucugcuc

SEQ ID NO: 1692805 - RNA, 22 nt, Salmonella enterica enterica serovar Typhi
agccugccagcaacccaccugc

SEQ ID NO: 1692806 - RNA, 15 nt, Salmonella enterica enterica serovar Typhi
agccugccagcaacc

SEQ ID NO: 1692807 - RNA, 22 nt, Salmonella enterica enterica serovar Typhi
agccugaagccagcaaucagcc

SEQ ID NO: 1692808 - RNA, 19 nt, Salmonella enterica enterica serovar Typhi
agcgagauaaccgggaaua

SEQ ID NO: 1692809 - RNA, 13 nt, Salmonella enterica enterica serovar Typhi
agcgagaugaaaa

SEQ ID NO: 1692810 - RNA, 22 nt, Salmonella enterica enterica serovar Typhi
agcgagcgauagagaguuccuc

SEQ ID NO: 1692811 - RNA, 17 nt, Salmonella enterica enterica serovar Typhi
agcgagcugguuucaau

SEQ ID NO: 1692812 - RNA, 19 nt, Salmonella enterica enterica serovar Typhi
agcgagcgccugaugccgc

SEQ ID NO: 1692813 - RNA, 13 nt, Salmonella enterica enterica serovar Typhi
agcgagcgccuga

SEQ ID NO: 1692814 - RNA, 15 nt, Salmonella enterica enterica serovar Typhi
agcgagacuuuugcc

SEQ ID NO: 1692815 - RNA, 17 nt, Salmonella enterica enterica serovar Typhi
agcgagauaaccgggaa

SEQ ID NO: 1692816 - RNA, 18 nt, Salmonella enterica enterica serovar Typhi
agcgagauaaccgggaau

SEQ ID NO: 1692817 - RNA, 23 nt, Salmonella enterica enterica serovar Typhi
agcgacucuguauuuaauaccug

SEQ ID NO: 1692818 - RNA, 13 nt, Salmonella enterica enterica serovar Typhi
agcgacaaaugaa

SEQ ID NO: 1692819 - RNA, 15 nt, Salmonella enterica enterica serovar Typhi
agcgacggcgcgcca

SEQ ID NO: 1692820 - RNA, 19 nt, Salmonella enterica enterica serovar Typhi
agcgacucauucagcaacu

SEQ ID NO: 1692821 - RNA, 15 nt, Salmonella enterica enterica serovar Typhi
agcgacggcgcgccg

SEQ ID NO: 1692822 - RNA, 20 nt, Salmonella enterica enterica serovar Typhi
agcgaauuccggccaucaga

SEQ ID NO: 1692823 - RNA, 23 nt, Salmonella enterica enterica serovar Typhi
agcgaauguauuaacgcuuugcc

SEQ ID NO: 1692824 - RNA, 18 nt, Salmonella enterica enterica serovar Typhi
agcgaaucgaucuggcgc

SEQ ID NO: 1692825 - RNA, 12 nt, Salmonella enterica enterica serovar Typhi
agcgagguaaaa

SEQ ID NO: 1692826 - RNA, 19 nt, Salmonella enterica enterica serovar Typhi
agcgagguucccgccgcca

SEQ ID NO: 1692827 - RNA, 20 nt, Salmonella enterica enterica serovar Typhi
agcgaugagcgccagcaaca

SEQ ID NO: 1692828 - RNA, 16 nt, Salmonella enterica enterica serovar Typhi
agcgaugacagcagga

SEQ ID NO: 1692829 - RNA, 18 nt, Salmonella enterica enterica serovar Typhi
agcgaucgagauaagauc

SEQ ID NO: 1692830 - RNA, 17 nt, Salmonella enterica enterica serovar Typhi
agcgaugagcgccagca

SEQ ID NO: 1692831 - RNA, 23 nt, Salmonella enterica enterica serovar Typhi
agcgaugcgguucaacgcgcugc

SEQ ID NO: 1692832 - RNA, 18 nt, Salmonella enterica enterica serovar Typhi
agcgaugggagagaggac

SEQ ID NO: 1692833 - RNA, 17 nt, Salmonella enterica enterica serovar Typhi
agcgcaaaagcgcgccc

SEQ ID NO: 1692834 - RNA, 19 nt, Salmonella enterica enterica serovar Typhi
agcgauuuuugaucucuuu

SEQ ID NO: 1692835 - RNA, 17 nt, Salmonella enterica enterica serovar Typhi
agcgauugcgccagacc

SEQ ID NO: 1692836 - RNA, 14 nt, Salmonella enterica enterica serovar Typhi
agcgauuauuucau

SEQ ID NO: 1692837 - RNA, 19 nt, Salmonella enterica enterica serovar Typhi
agcgcaaauauccuaccac

SEQ ID NO: 1692838 - RNA, 15 nt, Salmonella enterica enterica serovar Typhi
agcgcaaacaacccg

SEQ ID NO: 1692839 - RNA, 13 nt, Salmonella enterica enterica serovar Typhi
agcgcauagcugc

SEQ ID NO: 1692840 - RNA, 17 nt, Salmonella enterica enterica serovar Typhi
agcgcauccggccagcg

SEQ ID NO: 1692841 - RNA, 16 nt, Salmonella enterica enterica serovar Typhi
agcgcauccaccagac

SEQ ID NO: 1692842 - RNA, 16 nt, Salmonella enterica enterica serovar Typhi
agcgcauccagcucuu

SEQ ID NO: 1692843 - RNA, 16 nt, Salmonella enterica enterica serovar Typhi
agcgccagauagucac

SEQ ID NO: 1692844 - RNA, 16 nt, Salmonella enterica enterica serovar Typhi
agcgccagacacugga

SEQ ID NO: 1692845 - RNA, 22 nt, Salmonella enterica enterica serovar Typhi
agcgccagacagauaacaccag

SEQ ID NO: 1692846 - RNA, 16 nt, Salmonella enterica enterica serovar Typhi
agcgccagcgccaccu

SEQ ID NO: 1692847 - RNA, 23 nt, Salmonella enterica enterica serovar Typhi
agcgccagcagcagcgcaaugcg

SEQ ID NO: 1692848 - RNA, 16 nt, Salmonella enterica enterica serovar Typhi
agcgcaucgcucccca

SEQ ID NO: 1692849 - RNA, 15 nt, Salmonella enterica enterica serovar Typhi
agcgcaugcccggua

SEQ ID NO: 1692850 - RNA, 14 nt, Salmonella enterica enterica serovar Typhi
agcgccaucgggca

SEQ ID NO: 1692851 - RNA, 18 nt, Salmonella enterica enterica serovar Typhi
agcgccaucgggcauuua

SEQ ID NO: 1692852 - RNA, 16 nt, Salmonella enterica enterica serovar Typhi
agcgcccguccaugag

SEQ ID NO: 1692853 - RNA, 19 nt, Salmonella enterica enterica serovar Typhi
agcgccaucaggcaugcca

SEQ ID NO: 1692854 - RNA, 20 nt, Salmonella enterica enterica serovar Typhi
agcgccauaucggcacugcu

SEQ ID NO: 1692855 - RNA, 14 nt, Salmonella enterica enterica serovar Typhi
agcgccaguuuuuc

SEQ ID NO: 1692856 - RNA, 18 nt, Salmonella enterica enterica serovar Typhi
agcgccagcgccaccugc

SEQ ID NO: 1692857 - RNA, 23 nt, Salmonella enterica enterica serovar Typhi
agcgccagcgguguuugccagac

SEQ ID NO: 1692858 - RNA, 19 nt, Salmonella enterica enterica serovar Typhi
agcgcgcccgccaccagca

SEQ ID NO: 1692859 - RNA, 19 nt, Salmonella enterica enterica serovar Typhi
agcgcgcgacaugcgucuu

SEQ ID NO: 1692860 - RNA, 18 nt, Salmonella enterica enterica serovar Typhi
agcgcgcgacccagcgca

SEQ ID NO: 1692861 - RNA, 16 nt, Salmonella enterica enterica serovar Typhi
agcgcgaaugauuuua

SEQ ID NO: 1692862 - RNA, 13 nt, Salmonella enterica enterica serovar Typhi
agcgcgaaauuua

SEQ ID NO: 1692863 - RNA, 17 nt, Salmonella enterica enterica serovar Typhi
agcgcgccauccugagu

SEQ ID NO: 1692864 - RNA, 15 nt, Salmonella enterica enterica serovar Typhi
agcgcggccagaaug

SEQ ID NO: 1692865 - RNA, 13 nt, Salmonella enterica enterica serovar Typhi
agcgcgcgcgccu

SEQ ID NO: 1692866 - RNA, 13 nt, Salmonella enterica enterica serovar Typhi
agcgcggcgccca

SEQ ID NO: 1692867 - RNA, 23 nt, Salmonella enterica enterica serovar Typhi
agcgccuucaggcaucagauaaa

SEQ ID NO: 1692868 - RNA, 20 nt, Salmonella enterica enterica serovar Typhi
agcgccuguaaacguuccug

SEQ ID NO: 1692869 - RNA, 20 nt, Salmonella enterica enterica serovar Typhi
agcgccgccagaaucaccuc

SEQ ID NO: 1692870 - RNA, 14 nt, Salmonella enterica enterica serovar Typhi
agcgccucgcaaaa

SEQ ID NO: 1692871 - RNA, 14 nt, Salmonella enterica enterica serovar Typhi
agcgccgcagggcg

SEQ ID NO: 1692872 - RNA, 19 nt, Salmonella enterica enterica serovar Typhi
agcgcccuggucagcauca

SEQ ID NO: 1692873 - RNA, 23 nt, Salmonella enterica enterica serovar Typhi
agcgugcuguugcuaaauccaua

SEQ ID NO: 1692874 - RNA, 20 nt, Salmonella enterica enterica serovar Typhi
agcgugccgagcaacagaaa

SEQ ID NO: 1692875 - RNA, 12 nt, Salmonella enterica enterica serovar Typhi
agcgugauaauu

SEQ ID NO: 1692876 - RNA, 18 nt, Salmonella enterica enterica serovar Typhi
agcgugccgguaaagggc

SEQ ID NO: 1692877 - RNA, 15 nt, Salmonella enterica enterica serovar Typhi
agcguuacgcgcugc

SEQ ID NO: 1692878 - RNA, 23 nt, Salmonella enterica enterica serovar Typhi
agcguuaacgacgcuccagaauc

SEQ ID NO: 1692879 - RNA, 17 nt, Salmonella enterica enterica serovar Typhi
agcgugucgcagauacg

SEQ ID NO: 1692880 - RNA, 21 nt, Salmonella enterica enterica serovar Typhi
agcguuacgggaacagaauua

SEQ ID NO: 1692881 - RNA, 14 nt, Salmonella enterica enterica serovar Typhi
agcguuacugcaac

SEQ ID NO: 1692882 - RNA, 18 nt, Salmonella enterica enterica serovar Typhi
agcguaaugcgccaggca

SEQ ID NO: 1692883 - RNA, 15 nt, Salmonella enterica enterica serovar Typhi
agcguaauacaggcg

SEQ ID NO: 1692884 - RNA, 12 nt, Salmonella enterica enterica serovar Typhi
agcguccagcag

SEQ ID NO: 1692885 - RNA, 22 nt, Salmonella enterica enterica serovar Typhi
agcguccagcagacucauggac

SEQ ID NO: 1692886 - RNA, 22 nt, Salmonella enterica enterica serovar Typhi
agcgguuuuuuuguggccugcu

SEQ ID NO: 1692887 - RNA, 18 nt, Salmonella enterica enterica serovar Typhi
agcgugacaguuaccccg

SEQ ID NO: 1692888 - RNA, 20 nt, Salmonella enterica enterica serovar Typhi
agcgucuucuuaccgugucu

SEQ ID NO: 1692889 - RNA, 19 nt, Salmonella enterica enterica serovar Typhi
agcguccggaaaauccuca

SEQ ID NO: 1692890 - RNA, 16 nt, Salmonella enterica enterica serovar Typhi
agcguccggagcagcu

SEQ ID NO: 1692891 - RNA, 18 nt, Salmonella enterica enterica serovar Typhi
agcgcucaaucagcgcuu

SEQ ID NO: 1692892 - RNA, 13 nt, Salmonella enterica enterica serovar Typhi
agcggccagggca

SEQ ID NO: 1692893 - RNA, 17 nt, Salmonella enterica enterica serovar Typhi
agcgcucaaauaaugca

SEQ ID NO: 1692894 - RNA, 14 nt, Salmonella enterica enterica serovar Typhi
agcgcuacgccugu

SEQ ID NO: 1692895 - RNA, 20 nt, Salmonella enterica enterica serovar Typhi
agcgcgucguucacgccaaa

SEQ ID NO: 1692896 - RNA, 16 nt, Salmonella enterica enterica serovar Typhi
agcgcuaauugugcgg

SEQ ID NO: 1692897 - RNA, 16 nt, Salmonella enterica enterica serovar Typhi
agcgcuaagcaacagu

SEQ ID NO: 1692898 - RNA, 15 nt, Salmonella enterica enterica serovar Typhi
agcggcccgcgcuga

SEQ ID NO: 1692899 - RNA, 14 nt, Salmonella enterica enterica serovar Typhi
agcggcggaaugcu

SEQ ID NO: 1692900 - RNA, 20 nt, Salmonella enterica enterica serovar Typhi
agcggcggucugcgccugcu

SEQ ID NO: 1692901 - RNA, 18 nt, Salmonella enterica enterica serovar Typhi
agcggcggcuugccuuca

SEQ ID NO: 1692902 - RNA, 19 nt, Salmonella enterica enterica serovar Typhi
agcgggcgcaguccagaug

SEQ ID NO: 1692903 - RNA, 13 nt, Salmonella enterica enterica serovar Typhi
agcgggggcgccu

SEQ ID NO: 1692904 - RNA, 14 nt, Salmonella enterica enterica serovar Typhi
agcggcugcgccug

SEQ ID NO: 1692905 - RNA, 15 nt, Salmonella enterica enterica serovar Typhi
agcggcugcgccugu

SEQ ID NO: 1692906 - RNA, 17 nt, Salmonella enterica enterica serovar Typhi
agcggcuaaucaccacc

SEQ ID NO: 1692907 - RNA, 19 nt, Salmonella enterica enterica serovar Typhi
agcggcucauccagcaaca

SEQ ID NO: 1692908 - RNA, 18 nt, Salmonella enterica enterica serovar Typhi
agcggcugacacucaucc

SEQ ID NO: 1692909 - RNA, 17 nt, Salmonella enterica enterica serovar Typhi
agcucauacccuuccag

SEQ ID NO: 1692910 - RNA, 17 nt, Salmonella enterica enterica serovar Typhi
agcucaguugguagagc

SEQ ID NO: 1692911 - RNA, 21 nt, Salmonella enterica enterica serovar Typhi
agcucauguagucauauugcg

SEQ ID NO: 1692912 - RNA, 14 nt, Salmonella enterica enterica serovar Typhi
agcucaggcgggga

SEQ ID NO: 1692913 - RNA, 21 nt, Salmonella enterica enterica serovar Typhi
agcucaggguccccauauccc

SEQ ID NO: 1692914 - RNA, 16 nt, Salmonella enterica enterica serovar Typhi
agcuauuccaaaauaa

SEQ ID NO: 1692915 - RNA, 19 nt, Salmonella enterica enterica serovar Typhi
agcuaucgcgccggacagc

SEQ ID NO: 1692916 - RNA, 19 nt, Salmonella enterica enterica serovar Typhi
agcuauccacgcagacgcc

SEQ ID NO: 1692917 - RNA, 18 nt, Salmonella enterica enterica serovar Typhi
agcuauccaguuucugac

SEQ ID NO: 1692918 - RNA, 22 nt, Salmonella enterica enterica serovar Typhi
agcguuuguuugucgauuuccg

SEQ ID NO: 1692919 - RNA, 14 nt, Salmonella enterica enterica serovar Typhi
agcguuucacgcgc

SEQ ID NO: 1692920 - RNA, 18 nt, Salmonella enterica enterica serovar Typhi
agcguucugcacgccggu

SEQ ID NO: 1692921 - RNA, 19 nt, Salmonella enterica enterica serovar Typhi
agcguugcagccacguugc

SEQ ID NO: 1692922 - RNA, 18 nt, Salmonella enterica enterica serovar Typhi
agcguuuuuaccggcucg

SEQ ID NO: 1692923 - RNA, 22 nt, Salmonella enterica enterica serovar Typhi
agcguuuugauguccagaugcu

SEQ ID NO: 1692924 - RNA, 20 nt, Salmonella enterica enterica serovar Typhi
agcguuuugauguccagaug

SEQ ID NO: 1692925 - RNA, 23 nt, Salmonella enterica enterica serovar Typhi
agcuaacgacccgaagugguggg

SEQ ID NO: 1692926 - RNA, 14 nt, Salmonella enterica enterica serovar Typhi
agcuagccaauaau

SEQ ID NO: 1692927 - RNA, 22 nt, Salmonella enterica enterica serovar Typhi
agcuacuugaucggcuggcgca

SEQ ID NO: 1692928 - RNA, 16 nt, Salmonella enterica enterica serovar Typhi
agcuaauccccagcgc

SEQ ID NO: 1692929 - RNA, 15 nt, Salmonella enterica enterica serovar Typhi
agcuaaucacccacu

SEQ ID NO: 1692930 - RNA, 18 nt, Salmonella enterica enterica serovar Typhi
agcuaaugcaauaaacua

SEQ ID NO: 1692931 - RNA, 22 nt, Salmonella enterica enterica serovar Typhi
agcuaaugauuaucuuuuuuag

SEQ ID NO: 1692932 - RNA, 15 nt, Salmonella enterica enterica serovar Typhi
agguuuaaaccacuc

SEQ ID NO: 1692933 - RNA, 20 nt, Salmonella enterica enterica serovar Typhi
agguuugaccagauaaucaa

SEQ ID NO: 1692934 - RNA, 15 nt, Salmonella enterica enterica serovar Typhi
agguuucuucaucaa

SEQ ID NO: 1692935 - RNA, 16 nt, Salmonella enterica enterica serovar Typhi
agguuucuucaucaaa

SEQ ID NO: 1692936 - RNA, 16 nt, Salmonella enterica enterica serovar Typhi
aguaaaauuuuuuuca

SEQ ID NO: 1692937 - RNA, 15 nt, Salmonella enterica enterica serovar Typhi
aguaaacagaaucaa

SEQ ID NO: 1692938 - RNA, 17 nt, Salmonella enterica enterica serovar Typhi
aguaaacgcucaagcaa

SEQ ID NO: 1692939 - RNA, 21 nt, Salmonella enterica enterica serovar Typhi
agguugcucagguuauacugu

SEQ ID NO: 1692940 - RNA, 16 nt, Salmonella enterica enterica serovar Typhi
agguuguuuuauuacc

SEQ ID NO: 1692941 - RNA, 19 nt, Salmonella enterica enterica serovar Typhi
agguugccugauggcgcug

SEQ ID NO: 1692942 - RNA, 16 nt, Salmonella enterica enterica serovar Typhi
agguugcgcccggcgc

SEQ ID NO: 1692943 - RNA, 17 nt, Salmonella enterica enterica serovar Typhi
agguggccgagaggcug

SEQ ID NO: 1692944 - RNA, 21 nt, Salmonella enterica enterica serovar Typhi
agguggcccauuuuggccgcu

SEQ ID NO: 1692945 - RNA, 15 nt, Salmonella enterica enterica serovar Typhi
agguggcaauauccu

SEQ ID NO: 1692946 - RNA, 18 nt, Salmonella enterica enterica serovar Typhi
aguaaacuuucagaccuu

SEQ ID NO: 1692947 - RNA, 15 nt, Salmonella enterica enterica serovar Typhi
aguaaauuuacucag

SEQ ID NO: 1692948 - RNA, 14 nt, Salmonella enterica enterica serovar Typhi
aguaacauaaugcc

SEQ ID NO: 1692949 - RNA, 18 nt, Salmonella enterica enterica serovar Typhi
aguaauaaaauaauaggu

SEQ ID NO: 1692950 - RNA, 14 nt, Salmonella enterica enterica serovar Typhi
aguaauaaucacau

SEQ ID NO: 1692951 - RNA, 22 nt, Salmonella enterica enterica serovar Typhi
aguaacccgauacccugagccc

SEQ ID NO: 1692952 - RNA, 15 nt, Salmonella enterica enterica serovar Typhi
aguaaccccagggag

SEQ ID NO: 1692953 - RNA, 20 nt, Salmonella enterica enterica serovar Typhi
aguaaccccauacaguaguu

SEQ ID NO: 1692954 - RNA, 15 nt, Salmonella enterica enterica serovar Typhi
aguacaaacaaauaa

SEQ ID NO: 1692955 - RNA, 21 nt, Salmonella enterica enterica serovar Typhi
aguacaaacaaauaaauccau

SEQ ID NO: 1692956 - RNA, 14 nt, Salmonella enterica enterica serovar Typhi
aguaauuuuucucc

SEQ ID NO: 1692957 - RNA, 21 nt, Salmonella enterica enterica serovar Typhi
aguaauuuuucucccagcaga

SEQ ID NO: 1692958 - RNA, 17 nt, Salmonella enterica enterica serovar Typhi
aguaauuuuuccgccuc

SEQ ID NO: 1692959 - RNA, 12 nt, Salmonella enterica enterica serovar Typhi
aguaauauuaaa

SEQ ID NO: 1692960 - RNA, 21 nt, Salmonella enterica enterica serovar Typhi
aguaauauaaccaauuuaaaa

SEQ ID NO: 1692961 - RNA, 12 nt, Salmonella enterica enterica serovar Typhi
aguaauccauag

SEQ ID NO: 1692962 - RNA, 17 nt, Salmonella enterica enterica serovar Typhi
aguaauccguagccaac

SEQ ID NO: 1692963 - RNA, 20 nt, Salmonella enterica enterica serovar Typhi
aguauuucgacuuucuucgg

SEQ ID NO: 1692964 - RNA, 19 nt, Salmonella enterica enterica serovar Typhi
aguauuuaccuacuguggu

SEQ ID NO: 1692965 - RNA, 14 nt, Salmonella enterica enterica serovar Typhi
aguauuggcaagaa

SEQ ID NO: 1692966 - RNA, 16 nt, Salmonella enterica enterica serovar Typhi
aguauguuaggguaga

SEQ ID NO: 1692967 - RNA, 19 nt, Salmonella enterica enterica serovar Typhi
aguauggcgaccaggaauu

SEQ ID NO: 1692968 - RNA, 20 nt, Salmonella enterica enterica serovar Typhi
aguaucgcucuauauccugc

SEQ ID NO: 1692969 - RNA, 21 nt, Salmonella enterica enterica serovar Typhi
aguaucccuuucaaaaaagag

SEQ ID NO: 1692970 - RNA, 21 nt, Salmonella enterica enterica serovar Typhi
aguauaaauaccuuauucagc

SEQ ID NO: 1692971 - RNA, 15 nt, Salmonella enterica enterica serovar Typhi
aguaccgaacagcca

SEQ ID NO: 1692972 - RNA, 11 nt, Salmonella enterica enterica serovar Typhi
aguagauggcg

SEQ ID NO: 1692973 - RNA, 18 nt, Salmonella enterica enterica serovar Typhi
aguagaugucaucaacau

SEQ ID NO: 1692974 - RNA, 22 nt, Salmonella enterica enterica serovar Typhi
aguaccauaccggugcgcccca

SEQ ID NO: 1692975 - RNA, 22 nt, Salmonella enterica enterica serovar Typhi
aguaccauugagcuuucuucca

SEQ ID NO: 1692976 - RNA, 13 nt, Salmonella enterica enterica serovar Typhi
aguacccucugca

SEQ ID NO: 1692977 - RNA, 16 nt, Salmonella enterica enterica serovar Typhi
aguagccugccagcaa

SEQ ID NO: 1692978 - RNA, 21 nt, Salmonella enterica enterica serovar Typhi
aguagcguucuuuccaguucu

SEQ ID NO: 1692979 - RNA, 15 nt, Salmonella enterica enterica serovar Typhi
aguagcagacagccg

SEQ ID NO: 1692980 - RNA, 14 nt, Salmonella enterica enterica serovar Typhi
aguagcagagaaaa

SEQ ID NO: 1692981 - RNA, 17 nt, Salmonella enterica enterica serovar Typhi
aguagccaugcauaaug

SEQ ID NO: 1692982 - RNA, 17 nt, Salmonella enterica enterica serovar Typhi
aguagcuaaugauuauc

SEQ ID NO: 1692983 - RNA, 18 nt, Salmonella enterica enterica serovar Typhi
aguaguugaauaaccuca

SEQ ID NO: 1692984 - RNA, 12 nt, Salmonella enterica enterica serovar Typhi
aguauaaaacuc

SEQ ID NO: 1692985 - RNA, 12 nt, Salmonella enterica enterica serovar Typhi
aguauaaagcug

SEQ ID NO: 1692986 - RNA, 13 nt, Salmonella enterica enterica serovar Typhi
aguaguuaaaaaa

SEQ ID NO: 1692987 - RNA, 15 nt, Salmonella enterica enterica serovar Typhi
aguaguuccagcaua

SEQ ID NO: 1692988 - RNA, 22 nt, Salmonella enterica enterica serovar Typhi
aguaguauccccggcaaccuua

SEQ ID NO: 1692989 - RNA, 14 nt, Salmonella enterica enterica serovar Typhi
aggcggagccgcca

SEQ ID NO: 1692990 - RNA, 16 nt, Salmonella enterica enterica serovar Typhi
aggcgcuugugauauc

SEQ ID NO: 1692991 - RNA, 20 nt, Salmonella enterica enterica serovar Typhi
aggcggauacagcggcgcgc

SEQ ID NO: 1692992 - RNA, 23 nt, Salmonella enterica enterica serovar Typhi
aggcuuggcagccccugaaauaa

SEQ ID NO: 1692993 - RNA, 16 nt, Salmonella enterica enterica serovar Typhi
aggcuuuucaggcugu

SEQ ID NO: 1692994 - RNA, 13 nt, Salmonella enterica enterica serovar Typhi
agggaaaagaagu

SEQ ID NO: 1692995 - RNA, 17 nt, Salmonella enterica enterica serovar Typhi
agggaaaagccauugcc

SEQ ID NO: 1692996 - RNA, 16 nt, Salmonella enterica enterica serovar Typhi
agggaaaaauagcgau

SEQ ID NO: 1692997 - RNA, 16 nt, Salmonella enterica enterica serovar Typhi
agggacacucaaggcu

SEQ ID NO: 1692998 - RNA, 18 nt, Salmonella enterica enterica serovar Typhi
agggacgcauccugcacu

SEQ ID NO: 1692999 - RNA, 19 nt, Salmonella enterica enterica serovar Typhi
agggacuauaggcaaugau

SEQ ID NO: 1693000 - RNA, 17 nt, Salmonella enterica enterica serovar Typhi
agggacuuauuaaaaau

SEQ ID NO: 1693001 - RNA, 23 nt, Salmonella enterica enterica serovar Typhi
agggacuaucgaaagagcaaaua

SEQ ID NO: 1693002 - RNA, 20 nt, Salmonella enterica enterica serovar Typhi
agggcaaaguuaucccugcu

SEQ ID NO: 1693003 - RNA, 13 nt, Salmonella enterica enterica serovar Typhi
agggauuuugcuu

SEQ ID NO: 1693004 - RNA, 16 nt, Salmonella enterica enterica serovar Typhi
agggagugagucccca

SEQ ID NO: 1693005 - RNA, 17 nt, Salmonella enterica enterica serovar Typhi
agggagcugacugcaaa

SEQ ID NO: 1693006 - RNA, 12 nt, Salmonella enterica enterica serovar Typhi
agggagggccaa

SEQ ID NO: 1693007 - RNA, 19 nt, Salmonella enterica enterica serovar Typhi
agggaggugcucucccagc

SEQ ID NO: 1693008 - RNA, 21 nt, Salmonella enterica enterica serovar Typhi
agggaggugcucucccagcug

SEQ ID NO: 1693009 - RNA, 17 nt, Salmonella enterica enterica serovar Typhi
agggcuggaaaaucacg

SEQ ID NO: 1693010 - RNA, 14 nt, Salmonella enterica enterica serovar Typhi
agggcuuacucccu

SEQ ID NO: 1693011 - RNA, 22 nt, Salmonella enterica enterica serovar Typhi
agggguuuucgccagcaacgcc

SEQ ID NO: 1693012 - RNA, 18 nt, Salmonella enterica enterica serovar Typhi
aggguaacaucgcccgca

SEQ ID NO: 1693013 - RNA, 16 nt, Salmonella enterica enterica serovar Typhi
agggguguuacgccau

SEQ ID NO: 1693014 - RNA, 15 nt, Salmonella enterica enterica serovar Typhi
aggggcuccugcgcc

SEQ ID NO: 1693015 - RNA, 20 nt, Salmonella enterica enterica serovar Typhi
aggggcuccugcgccggacg

SEQ ID NO: 1693016 - RNA, 18 nt, Salmonella enterica enterica serovar Typhi
aggggcucuaaaaaggaa

SEQ ID NO: 1693017 - RNA, 16 nt, Salmonella enterica enterica serovar Typhi
agggcaacaaacauaa

SEQ ID NO: 1693018 - RNA, 20 nt, Salmonella enterica enterica serovar Typhi
agggcaccugggcaauaacg

SEQ ID NO: 1693019 - RNA, 22 nt, Salmonella enterica enterica serovar Typhi
agggcgucuuauccggccuacc

SEQ ID NO: 1693020 - RNA, 16 nt, Salmonella enterica enterica serovar Typhi
agggcguuuuauaagc

SEQ ID NO: 1693021 - RNA, 17 nt, Salmonella enterica enterica serovar Typhi
agggcgggcgauagaga

SEQ ID NO: 1693022 - RNA, 13 nt, Salmonella enterica enterica serovar Typhi
agggcggcuggau

SEQ ID NO: 1693023 - RNA, 22 nt, Salmonella enterica enterica serovar Typhi
aggucguuaggccacuucacac

SEQ ID NO: 1693024 - RNA, 21 nt, Salmonella enterica enterica serovar Typhi
aggucuauugccuaaauaacu

SEQ ID NO: 1693025 - RNA, 14 nt, Salmonella enterica enterica serovar Typhi
aggucggcugcccu

SEQ ID NO: 1693026 - RNA, 22 nt, Salmonella enterica enterica serovar Typhi
aggucguaaggauacucagcga

SEQ ID NO: 1693027 - RNA, 21 nt, Salmonella enterica enterica serovar Typhi
aggucggccaaccgccacaau

SEQ ID NO: 1693028 - RNA, 14 nt, Salmonella enterica enterica serovar Typhi
aggucggacguugc

SEQ ID NO: 1693029 - RNA, 16 nt, Salmonella enterica enterica serovar Typhi
aggucgccaaauuuag

SEQ ID NO: 1693030 - RNA, 19 nt, Salmonella enterica enterica serovar Typhi
aggucaucuuucagaugca

SEQ ID NO: 1693031 - RNA, 16 nt, Salmonella enterica enterica serovar Typhi
aggucauuauucaggc

SEQ ID NO: 1693032 - RNA, 14 nt, Salmonella enterica enterica serovar Typhi
aggucauuccugcg

SEQ ID NO: 1693033 - RNA, 14 nt, Salmonella enterica enterica serovar Typhi
agguauccgccaua

SEQ ID NO: 1693034 - RNA, 18 nt, Salmonella enterica enterica serovar Typhi
agguauccgccauauccc

SEQ ID NO: 1693035 - RNA, 13 nt, Salmonella enterica enterica serovar Typhi
agguauccagcag

SEQ ID NO: 1693036 - RNA, 17 nt, Salmonella enterica enterica serovar Typhi
agguaugcuucagcguu

SEQ ID NO: 1693037 - RNA, 16 nt, Salmonella enterica enterica serovar Typhi
agguauguaguaaaua

SEQ ID NO: 1693038 - RNA, 16 nt, Salmonella enterica enterica serovar Typhi
agguauccuaaugcca

SEQ ID NO: 1693039 - RNA, 16 nt, Salmonella enterica enterica serovar Typhi
agguauccuccugcca

SEQ ID NO: 1693040 - RNA, 22 nt, Salmonella enterica enterica serovar Typhi
agguacggggcaucuauuuaac

SEQ ID NO: 1693041 - RNA, 13 nt, Salmonella enterica enterica serovar Typhi
aggguauaugagc

SEQ ID NO: 1693042 - RNA, 13 nt, Salmonella enterica enterica serovar Typhi
aggguagaaaaag

SEQ ID NO: 1693043 - RNA, 14 nt, Salmonella enterica enterica serovar Typhi
aggguagaaaaagg

SEQ ID NO: 1693044 - RNA, 16 nt, Salmonella enterica enterica serovar Typhi
aggguagggauagcau

SEQ ID NO: 1693045 - RNA, 17 nt, Salmonella enterica enterica serovar Typhi
agggugcagcaaauaau

SEQ ID NO: 1693046 - RNA, 18 nt, Salmonella enterica enterica serovar Typhi
agggugcaaagaaacguu

SEQ ID NO: 1693047 - RNA, 14 nt, Salmonella enterica enterica serovar Typhi
agggugagagggga

SEQ ID NO: 1693048 - RNA, 22 nt, Salmonella enterica enterica serovar Typhi
agguaacugcacaagccccacg

SEQ ID NO: 1693049 - RNA, 20 nt, Salmonella enterica enterica serovar Typhi
aggccguuauugucaugcua

SEQ ID NO: 1693050 - RNA, 21 nt, Salmonella enterica enterica serovar Typhi
aggccgguuguuuacacggca

SEQ ID NO: 1693051 - RNA, 15 nt, Salmonella enterica enterica serovar Typhi
aggccgccagcaaac

SEQ ID NO: 1693052 - RNA, 16 nt, Salmonella enterica enterica serovar Typhi
aggccgcaaacagcac

SEQ ID NO: 1693053 - RNA, 17 nt, Salmonella enterica enterica serovar Typhi
aggccuuuucguacaug

SEQ ID NO: 1693054 - RNA, 18 nt, Salmonella enterica enterica serovar Typhi
aggccuuuugcagcagcg

SEQ ID NO: 1693055 - RNA, 18 nt, Salmonella enterica enterica serovar Typhi
aggccugccggguuuaau

SEQ ID NO: 1693056 - RNA, 12 nt, Salmonella enterica enterica serovar Typhi
aggccuggcugg

SEQ ID NO: 1693057 - RNA, 18 nt, Salmonella enterica enterica serovar Typhi
aggccugcaaaccucucc

SEQ ID NO: 1693058 - RNA, 16 nt, Salmonella enterica enterica serovar Typhi
aggccugguuaacaau

SEQ ID NO: 1693059 - RNA, 18 nt, Salmonella enterica enterica serovar Typhi
aggccugguuaacaauau

SEQ ID NO: 1693060 - RNA, 22 nt, Salmonella enterica enterica serovar Typhi
aggccucuuucaugcggucuuc

SEQ ID NO: 1693061 - RNA, 18 nt, Salmonella enterica enterica serovar Typhi
aggccugauaagcacagg

SEQ ID NO: 1693062 - RNA, 22 nt, Salmonella enterica enterica serovar Typhi
aggccugauaagcgcagcgcca

SEQ ID NO: 1693063 - RNA, 21 nt, Salmonella enterica enterica serovar Typhi
aggccucgaccaguuuuuccg

SEQ ID NO: 1693064 - RNA, 20 nt, Salmonella enterica enterica serovar Typhi
aggccguucauucgccccag

SEQ ID NO: 1693065 - RNA, 16 nt, Salmonella enterica enterica serovar Typhi
aggccuacaaucgugu

SEQ ID NO: 1693066 - RNA, 22 nt, Salmonella enterica enterica serovar Typhi
aggccuacaaucgugugaugca

SEQ ID NO: 1693067 - RNA, 14 nt, Salmonella enterica enterica serovar Typhi
aggcgacccauaac

SEQ ID NO: 1693068 - RNA, 15 nt, Salmonella enterica enterica serovar Typhi
aggcgacaaucucac

SEQ ID NO: 1693069 - RNA, 21 nt, Salmonella enterica enterica serovar Typhi
aggcgagcacaccauaucuuu

SEQ ID NO: 1693070 - RNA, 13 nt, Salmonella enterica enterica serovar Typhi
aggcgcagccgcc

SEQ ID NO: 1693071 - RNA, 22 nt, Salmonella enterica enterica serovar Typhi
aggcgaucggcgugaauaaaau

SEQ ID NO: 1693072 - RNA, 17 nt, Salmonella enterica enterica serovar Typhi
aggcgauucaacagggc

SEQ ID NO: 1693073 - RNA, 18 nt, Salmonella enterica enterica serovar Typhi
aggcgcaaaaccauacug

SEQ ID NO: 1693074 - RNA, 17 nt, Salmonella enterica enterica serovar Typhi
aggcgcggucuggccug

SEQ ID NO: 1693075 - RNA, 18 nt, Salmonella enterica enterica serovar Typhi
aggcgcuaauuaauucua

SEQ ID NO: 1693076 - RNA, 19 nt, Salmonella enterica enterica serovar Typhi
aggcgcaucagaaaaaccu

SEQ ID NO: 1693077 - RNA, 15 nt, Salmonella enterica enterica serovar Typhi
aggcgcgcagcugcc

SEQ ID NO: 1693078 - RNA, 23 nt, Salmonella enterica enterica serovar Typhi
aggcgccggggcagcaauaguug

SEQ ID NO: 1693079 - RNA, 22 nt, Salmonella enterica enterica serovar Typhi
aggcgccgcucaucaccagcag

SEQ ID NO: 1693080 - RNA, 21 nt, Salmonella enterica enterica serovar Typhi
aggcccauuuucggcaucagc

SEQ ID NO: 1693081 - RNA, 23 nt, Salmonella enterica enterica serovar Typhi
aggcccauuuucggcaucagcag

SEQ ID NO: 1693082 - RNA, 13 nt, Salmonella enterica enterica serovar Typhi
aggccacuucaca

SEQ ID NO: 1693083 - RNA, 16 nt, Salmonella enterica enterica serovar Typhi
aggccacugcccugga

SEQ ID NO: 1693084 - RNA, 15 nt, Salmonella enterica enterica serovar Typhi
aggccacgcagcgca

SEQ ID NO: 1693085 - RNA, 19 nt, Salmonella enterica enterica serovar Typhi
aggccaaguuuagaaaaua

SEQ ID NO: 1693086 - RNA, 12 nt, Salmonella enterica enterica serovar Typhi
aggccaaacccu

SEQ ID NO: 1693087 - RNA, 18 nt, Salmonella enterica enterica serovar Typhi
aggcauuucaaucgccac

SEQ ID NO: 1693088 - RNA, 18 nt, Salmonella enterica enterica serovar Typhi
aggcauuucgccgccauc

SEQ ID NO: 1693089 - RNA, 20 nt, Salmonella enterica enterica serovar Typhi
aggccaaaaccacagugacc

SEQ ID NO: 1693090 - RNA, 22 nt, Salmonella enterica enterica serovar Typhi
aggccaacauagcggcaaggaa

SEQ ID NO: 1693091 - RNA, 14 nt, Salmonella enterica enterica serovar Typhi
aggcauuaaaaaaa

SEQ ID NO: 1693092 - RNA, 15 nt, Salmonella enterica enterica serovar Typhi
aggcaugcacuccaa

SEQ ID NO: 1693093 - RNA, 20 nt, Salmonella enterica enterica serovar Typhi
aggcaugccaaaccagacuc

SEQ ID NO: 1693094 - RNA, 19 nt, Salmonella enterica enterica serovar Typhi
aggcauggccuucaaucag

SEQ ID NO: 1693095 - RNA, 16 nt, Salmonella enterica enterica serovar Typhi
aggcaugaugccacga

SEQ ID NO: 1693096 - RNA, 19 nt, Salmonella enterica enterica serovar Typhi
aggcaucugcgcaacugga

SEQ ID NO: 1693097 - RNA, 13 nt, Salmonella enterica enterica serovar Typhi
aggagcuggagca

SEQ ID NO: 1693098 - RNA, 22 nt, Salmonella enterica enterica serovar Typhi
aggauucgacggccagcgcgcg

SEQ ID NO: 1693099 - RNA, 20 nt, Salmonella enterica enterica serovar Typhi
aggauuauuggcaucauaaa

SEQ ID NO: 1693100 - RNA, 15 nt, Salmonella enterica enterica serovar Typhi
aggauucgccauucc

SEQ ID NO: 1693101 - RNA, 23 nt, Salmonella enterica enterica serovar Typhi
aggcaagauccggacugauaguc

SEQ ID NO: 1693102 - RNA, 18 nt, Salmonella enterica enterica serovar Typhi
aggauuugucucaucuga

SEQ ID NO: 1693103 - RNA, 16 nt, Salmonella enterica enterica serovar Typhi
aggcaaccugucagua

SEQ ID NO: 1693104 - RNA, 17 nt, Salmonella enterica enterica serovar Typhi
aggcaaaaugccagccc

SEQ ID NO: 1693105 - RNA, 15 nt, Salmonella enterica enterica serovar Typhi
aggcaaaaugccagc

SEQ ID NO: 1693106 - RNA, 21 nt, Salmonella enterica enterica serovar Typhi
aggcaaaaaucgucaucagau

SEQ ID NO: 1693107 - RNA, 19 nt, Salmonella enterica enterica serovar Typhi
agcuccauagaaaucagca

SEQ ID NO: 1693108 - RNA, 21 nt, Salmonella enterica enterica serovar Typhi
agcucauuuuuacagacacga

SEQ ID NO: 1693109 - RNA, 16 nt, Salmonella enterica enterica serovar Typhi
agcuccagcucagggu

SEQ ID NO: 1693110 - RNA, 17 nt, Salmonella enterica enterica serovar Typhi
agcuccagccgcugccu

SEQ ID NO: 1693111 - RNA, 22 nt, Salmonella enterica enterica serovar Typhi
agcugcugacguagauucugau

SEQ ID NO: 1693112 - RNA, 13 nt, Salmonella enterica enterica serovar Typhi
agcuguaacacug

SEQ ID NO: 1693113 - RNA, 20 nt, Salmonella enterica enterica serovar Typhi
agcugguguaauugcgccag

SEQ ID NO: 1693114 - RNA, 18 nt, Salmonella enterica enterica serovar Typhi
agcuggaccgcagcuuau

SEQ ID NO: 1693115 - RNA, 18 nt, Salmonella enterica enterica serovar Typhi
agcugguauaggccaggc

SEQ ID NO: 1693116 - RNA, 19 nt, Salmonella enterica enterica serovar Typhi
agcugguauaggccaggcu

SEQ ID NO: 1693117 - RNA, 13 nt, Salmonella enterica enterica serovar Typhi
agcuguagcauaa

SEQ ID NO: 1693118 - RNA, 17 nt, Salmonella enterica enterica serovar Typhi
agcugugcguugucuac

SEQ ID NO: 1693119 - RNA, 14 nt, Salmonella enterica enterica serovar Typhi
agcuuccagcaaac

SEQ ID NO: 1693120 - RNA, 22 nt, Salmonella enterica enterica serovar Typhi
agcuuccagcaaaccuuccgcc

SEQ ID NO: 1693121 - RNA, 21 nt, Salmonella enterica enterica serovar Typhi
agcuucgccgcguaaucuucg

SEQ ID NO: 1693122 - RNA, 13 nt, Salmonella enterica enterica serovar Typhi
agcuuauccugcc

SEQ ID NO: 1693123 - RNA, 15 nt, Salmonella enterica enterica serovar Typhi
agcuuacuuugcgcc

SEQ ID NO: 1693124 - RNA, 20 nt, Salmonella enterica enterica serovar Typhi
agcuuaggauaagaauaggu

SEQ ID NO: 1693125 - RNA, 18 nt, Salmonella enterica enterica serovar Typhi
agcuuaggauucgccauu

SEQ ID NO: 1693126 - RNA, 16 nt, Salmonella enterica enterica serovar Typhi
agcuuaauuuuauagc

SEQ ID NO: 1693127 - RNA, 22 nt, Salmonella enterica enterica serovar Typhi
agcuugcauggccggucuuaug

SEQ ID NO: 1693128 - RNA, 15 nt, Salmonella enterica enterica serovar Typhi
aggacaagcagugcu

SEQ ID NO: 1693129 - RNA, 22 nt, Salmonella enterica enterica serovar Typhi
aggaauuuucccauaaaagagc

SEQ ID NO: 1693130 - RNA, 19 nt, Salmonella enterica enterica serovar Typhi
aggaagcugcgcagcacuu

SEQ ID NO: 1693131 - RNA, 18 nt, Salmonella enterica enterica serovar Typhi
aggaaggcgguaagagag

SEQ ID NO: 1693132 - RNA, 20 nt, Salmonella enterica enterica serovar Typhi
aggaaggucgcauccgcguu

SEQ ID NO: 1693133 - RNA, 13 nt, Salmonella enterica enterica serovar Typhi
aggaagucagcuu

SEQ ID NO: 1693134 - RNA, 22 nt, Salmonella enterica enterica serovar Typhi
aggaauuacgggcgauacaccu

SEQ ID NO: 1693135 - RNA, 12 nt, Salmonella enterica enterica serovar Typhi
aggacaucaaag

SEQ ID NO: 1693136 - RNA, 14 nt, Salmonella enterica enterica serovar Typhi
aggagacgccgccc

SEQ ID NO: 1693137 - RNA, 14 nt, Salmonella enterica enterica serovar Typhi
aggaaauucugacg

SEQ ID NO: 1693138 - RNA, 19 nt, Salmonella enterica enterica serovar Typhi
aggaaauucagauccgagg

SEQ ID NO: 1693139 - RNA, 16 nt, Salmonella enterica enterica serovar Typhi
aggaaaucuuccaguu

SEQ ID NO: 1693140 - RNA, 12 nt, Salmonella enterica enterica serovar Typhi
aggaaauccagc

SEQ ID NO: 1693141 - RNA, 21 nt, Salmonella enterica enterica serovar Typhi
aggaaauccagcagaauaaca

SEQ ID NO: 1693142 - RNA, 14 nt, Salmonella enterica enterica serovar Typhi
aggaaauauuaauu

SEQ ID NO: 1693143 - RNA, 22 nt, Salmonella enterica enterica serovar Typhi
aggaaauauuaauuaaggauga

SEQ ID NO: 1693144 - RNA, 21 nt, Salmonella enterica enterica serovar Typhi
agcuuugcguaaaaaacauca

SEQ ID NO: 1693145 - RNA, 16 nt, Salmonella enterica enterica serovar Typhi
agcuuugccacuggcu

SEQ ID NO: 1693146 - RNA, 20 nt, Salmonella enterica enterica serovar Typhi
aggaaagauuacuucaggcu

SEQ ID NO: 1693147 - RNA, 17 nt, Salmonella enterica enterica serovar Typhi
aggaacaucagccagca

SEQ ID NO: 1693148 - RNA, 14 nt, Salmonella enterica enterica serovar Typhi
aggaaccacaucca

SEQ ID NO: 1693149 - RNA, 18 nt, Salmonella enterica enterica serovar Typhi
aggaacaucgacccccac

SEQ ID NO: 1693150 - RNA, 20 nt, Salmonella enterica enterica serovar Typhi
aggaacaucgacccccaccu

SEQ ID NO: 1693151 - RNA, 13 nt, Salmonella enterica enterica serovar Typhi
aggaacagugaca

SEQ ID NO: 1693152 - RNA, 18 nt, Salmonella enterica enterica serovar Typhi
aggaacagugacaaacuc

SEQ ID NO: 1693153 - RNA, 23 nt, Salmonella enterica enterica serovar Typhi
aggaacgcgcagaccguuuucaa

SEQ ID NO: 1693154 - RNA, 18 nt, Salmonella enterica enterica serovar Typhi
aggaacgcgcagaccguu

SEQ ID NO: 1693155 - RNA, 19 nt, Salmonella enterica enterica serovar Typhi
aggaacgcgcagaccguuu

SEQ ID NO: 1693156 - RNA, 14 nt, Salmonella enterica enterica serovar Typhi
auaacaggaaucau

SEQ ID NO: 1693157 - RNA, 18 nt, Salmonella enterica enterica serovar Typhi
auaacauuucagucuaau

SEQ ID NO: 1693158 - RNA, 12 nt, Salmonella enterica enterica serovar Typhi
auaacaucaucc

SEQ ID NO: 1693159 - RNA, 20 nt, Salmonella enterica enterica serovar Typhi
auaacaucguaaaucaaaug

SEQ ID NO: 1693160 - RNA, 20 nt, Salmonella enterica enterica serovar Typhi
auaaaucgucggcaggguuu

SEQ ID NO: 1693161 - RNA, 21 nt, Salmonella enterica enterica serovar Typhi
auaaaucccggcgauuaauaa

SEQ ID NO: 1693162 - RNA, 15 nt, Salmonella enterica enterica serovar Typhi
auaacaaaagcgguu

SEQ ID NO: 1693163 - RNA, 18 nt, Salmonella enterica enterica serovar Typhi
auaacaauauuaaauaaa

SEQ ID NO: 1693164 - RNA, 21 nt, Salmonella enterica enterica serovar Typhi
auaacggguuugauugccauc

SEQ ID NO: 1693165 - RNA, 15 nt, Salmonella enterica enterica serovar Typhi
auaacguguuaugcg

SEQ ID NO: 1693166 - RNA, 16 nt, Salmonella enterica enterica serovar Typhi
auaagaaagauaaaau

SEQ ID NO: 1693167 - RNA, 17 nt, Salmonella enterica enterica serovar Typhi
auaacguuacauuuucc

SEQ ID NO: 1693168 - RNA, 22 nt, Salmonella enterica enterica serovar Typhi
auaacguuacauuuuccaugcc

SEQ ID NO: 1693169 - RNA, 14 nt, Salmonella enterica enterica serovar Typhi
auaacguucuuuug

SEQ ID NO: 1693170 - RNA, 17 nt, Salmonella enterica enterica serovar Typhi
auaacucuuaauuauaa

SEQ ID NO: 1693171 - RNA, 12 nt, Salmonella enterica enterica serovar Typhi
auaacucuucau

SEQ ID NO: 1693172 - RNA, 13 nt, Salmonella enterica enterica serovar Typhi
auaacccgccugg

SEQ ID NO: 1693173 - RNA, 16 nt, Salmonella enterica enterica serovar Typhi
auaaccagaaaaccga

SEQ ID NO: 1693174 - RNA, 21 nt, Salmonella enterica enterica serovar Typhi
auaaccacgaaaauuauuuuc

SEQ ID NO: 1693175 - RNA, 22 nt, Salmonella enterica enterica serovar Typhi
auaaccagaaaaccgacagcaa

SEQ ID NO: 1693176 - RNA, 16 nt, Salmonella enterica enterica serovar Typhi
auaaccagauggggcu

SEQ ID NO: 1693177 - RNA, 22 nt, Salmonella enterica enterica serovar Typhi
auaaccagauggggcuuccauu

SEQ ID NO: 1693178 - RNA, 23 nt, Salmonella enterica enterica serovar Typhi
auaacccggauugucuuaaauau

SEQ ID NO: 1693179 - RNA, 23 nt, Salmonella enterica enterica serovar Typhi
auaaccucaacgucgcucagaau

SEQ ID NO: 1693180 - RNA, 21 nt, Salmonella enterica enterica serovar Typhi
auaaaccgccgcuuugauuug

SEQ ID NO: 1693181 - RNA, 15 nt, Salmonella enterica enterica serovar Typhi
auaaaccggcggccu

SEQ ID NO: 1693182 - RNA, 17 nt, Salmonella enterica enterica serovar Typhi
auaaagcacagccccag

SEQ ID NO: 1693183 - RNA, 17 nt, Salmonella enterica enterica serovar Typhi
auaaagcagcgacaaua

SEQ ID NO: 1693184 - RNA, 21 nt, Salmonella enterica enterica serovar Typhi
auaaagauuggcaucugcaau

SEQ ID NO: 1693185 - RNA, 22 nt, Salmonella enterica enterica serovar Typhi
auaaagauuggcaucugcaauu

SEQ ID NO: 1693186 - RNA, 17 nt, Salmonella enterica enterica serovar Typhi
auaaagcgaauaauuaa

SEQ ID NO: 1693187 - RNA, 14 nt, Salmonella enterica enterica serovar Typhi
auaaaggucacauc

SEQ ID NO: 1693188 - RNA, 15 nt, Salmonella enterica enterica serovar Typhi
auaaaggucggcugc

SEQ ID NO: 1693189 - RNA, 14 nt, Salmonella enterica enterica serovar Typhi
auaaauauccuccg

SEQ ID NO: 1693190 - RNA, 16 nt, Salmonella enterica enterica serovar Typhi
auaaauauguuauuua

SEQ ID NO: 1693191 - RNA, 17 nt, Salmonella enterica enterica serovar Typhi
auaaauaccguaaugcc

SEQ ID NO: 1693192 - RNA, 14 nt, Salmonella enterica enterica serovar Typhi
auaaauaguaaaua

SEQ ID NO: 1693193 - RNA, 23 nt, Salmonella enterica enterica serovar Typhi
auaaauaguaaauagaaaauaau

SEQ ID NO: 1693194 - RNA, 14 nt, Salmonella enterica enterica serovar Typhi
auaaauagcgcugg

SEQ ID NO: 1693195 - RNA, 15 nt, Salmonella enterica enterica serovar Typhi
auaaauauaagaucu

SEQ ID NO: 1693196 - RNA, 19 nt, Salmonella enterica enterica serovar Typhi
auaaauaaccgguaacugu

SEQ ID NO: 1693197 - RNA, 13 nt, Salmonella enterica enterica serovar Typhi
auaaauaauaucg

SEQ ID NO: 1693198 - RNA, 23 nt, Salmonella enterica enterica serovar Typhi
auaaauaaccgguaacugucaga

SEQ ID NO: 1693199 - RNA, 14 nt, Salmonella enterica enterica serovar Typhi
auaaacacagcaaa

SEQ ID NO: 1693200 - RNA, 17 nt, Salmonella enterica enterica serovar Typhi
auaaaauuauuggcuuu

SEQ ID NO: 1693201 - RNA, 14 nt, Salmonella enterica enterica serovar Typhi
auaaaaugucuguu

SEQ ID NO: 1693202 - RNA, 23 nt, Salmonella enterica enterica serovar Typhi
auaaaaucaucgcgcugauauuu

SEQ ID NO: 1693203 - RNA, 14 nt, Salmonella enterica enterica serovar Typhi
auaaaauaaacacu

SEQ ID NO: 1693204 - RNA, 12 nt, Salmonella enterica enterica serovar Typhi
auaaaauaacua

SEQ ID NO: 1693205 - RNA, 13 nt, Salmonella enterica enterica serovar Typhi
auaaaauaaacac

SEQ ID NO: 1693206 - RNA, 23 nt, Salmonella enterica enterica serovar Typhi
auaauacgaaauugagaauuauu

SEQ ID NO: 1693207 - RNA, 12 nt, Salmonella enterica enterica serovar Typhi
auaauaccucaa

SEQ ID NO: 1693208 - RNA, 21 nt, Salmonella enterica enterica serovar Typhi
auaauacaccgccauauauuu

SEQ ID NO: 1693209 - RNA, 20 nt, Salmonella enterica enterica serovar Typhi
auaauacacgguaaauucuu

SEQ ID NO: 1693210 - RNA, 16 nt, Salmonella enterica enterica serovar Typhi
auaauaagaucaaagc

SEQ ID NO: 1693211 - RNA, 22 nt, Salmonella enterica enterica serovar Typhi
auaaguuucucuucguuauuuu

SEQ ID NO: 1693212 - RNA, 13 nt, Salmonella enterica enterica serovar Typhi
auaagaaucagau

SEQ ID NO: 1693213 - RNA, 17 nt, Salmonella enterica enterica serovar Typhi
auaagaaguaaacagaa

SEQ ID NO: 1693214 - RNA, 24 nt, Salmonella enterica enterica serovar Typhi
auaagaaauaguucaucgugaaau

SEQ ID NO: 1693215 - RNA, 19 nt, Salmonella enterica enterica serovar Typhi
auaaugaagcauaaaaaga

SEQ ID NO: 1693216 - RNA, 14 nt, Salmonella enterica enterica serovar Typhi
auaaugaauacaca

SEQ ID NO: 1693217 - RNA, 19 nt, Salmonella enterica enterica serovar Typhi
auaauggagaugaaaauaa

SEQ ID NO: 1693218 - RNA, 21 nt, Salmonella enterica enterica serovar Typhi
auaauggagaugaaaauaauu

SEQ ID NO: 1693219 - RNA, 18 nt, Salmonella enterica enterica serovar Typhi
auaaucgacaguggcuuu

SEQ ID NO: 1693220 - RNA, 14 nt, Salmonella enterica enterica serovar Typhi
auaaucgauauaau

SEQ ID NO: 1693221 - RNA, 12 nt, Salmonella enterica enterica serovar Typhi
auaauccuuccu

SEQ ID NO: 1693222 - RNA, 18 nt, Salmonella enterica enterica serovar Typhi
auaauccuuguccaugua

SEQ ID NO: 1693223 - RNA, 19 nt, Salmonella enterica enterica serovar Typhi
auaaucagcgcuccgacaa

SEQ ID NO: 1693224 - RNA, 23 nt, Salmonella enterica enterica serovar Typhi
auaaucauccgggcauaaaaaaa

SEQ ID NO: 1693225 - RNA, 20 nt, Salmonella enterica enterica serovar Typhi
auaaucacauuaugcugggu

SEQ ID NO: 1693226 - RNA, 12 nt, Salmonella enterica enterica serovar Typhi
auaaucaccacg

SEQ ID NO: 1693227 - RNA, 20 nt, Salmonella enterica enterica serovar Typhi
auaauggggauuaucaggau

SEQ ID NO: 1693228 - RNA, 19 nt, Salmonella enterica enterica serovar Typhi
auaauggcgccgauaacac

SEQ ID NO: 1693229 - RNA, 19 nt, Salmonella enterica enterica serovar Typhi
auaauggcgacggccacgc

SEQ ID NO: 1693230 - RNA, 19 nt, Salmonella enterica enterica serovar Typhi
auaaugguggaaugcccca

SEQ ID NO: 1693231 - RNA, 16 nt, Salmonella enterica enterica serovar Typhi
auaauugcucugccag

SEQ ID NO: 1693232 - RNA, 12 nt, Salmonella enterica enterica serovar Typhi
auaauugcugcc

SEQ ID NO: 1693233 - RNA, 15 nt, Salmonella enterica enterica serovar Typhi
auaauugauaauaac

SEQ ID NO: 1693234 - RNA, 20 nt, Salmonella enterica enterica serovar Typhi
auaauugcucacccauuuua

SEQ ID NO: 1693235 - RNA, 15 nt, Salmonella enterica enterica serovar Typhi
auaauuuuugccuuu

SEQ ID NO: 1693236 - RNA, 19 nt, Salmonella enterica enterica serovar Typhi
auaauuuuauuauauuuaa

SEQ ID NO: 1693237 - RNA, 14 nt, Salmonella enterica enterica serovar Typhi
auacacgaacacag

SEQ ID NO: 1693238 - RNA, 15 nt, Salmonella enterica enterica serovar Typhi
auacaccuuugcccg

SEQ ID NO: 1693239 - RNA, 17 nt, Salmonella enterica enterica serovar Typhi
auacacucaaccaacca

SEQ ID NO: 1693240 - RNA, 22 nt, Salmonella enterica enterica serovar Typhi
auacacucaaccaucaaaaaaa

SEQ ID NO: 1693241 - RNA, 19 nt, Salmonella enterica enterica serovar Typhi
auacacgccuuccuccagc

SEQ ID NO: 1693242 - RNA, 21 nt, Salmonella enterica enterica serovar Typhi
auacacgccuuccuccagcau

SEQ ID NO: 1693243 - RNA, 12 nt, Salmonella enterica enterica serovar Typhi
auacagcagcac

SEQ ID NO: 1693244 - RNA, 19 nt, Salmonella enterica enterica serovar Typhi
auacagaugcugucuuagu

SEQ ID NO: 1693245 - RNA, 19 nt, Salmonella enterica enterica serovar Typhi
auacacuuuccauucgaca

SEQ ID NO: 1693246 - RNA, 21 nt, Salmonella enterica enterica serovar Typhi
auacacuuuccauucgacagu

SEQ ID NO: 1693247 - RNA, 17 nt, Salmonella enterica enterica serovar Typhi
agucugagcgcaaacau

SEQ ID NO: 1693248 - RNA, 15 nt, Salmonella enterica enterica serovar Typhi
agucuggauauaaac

SEQ ID NO: 1693249 - RNA, 18 nt, Salmonella enterica enterica serovar Typhi
agucuggauauaaaccgg

SEQ ID NO: 1693250 - RNA, 16 nt, Salmonella enterica enterica serovar Typhi
agucuuuuguuuuucu

SEQ ID NO: 1693251 - RNA, 17 nt, Salmonella enterica enterica serovar Typhi
agucuuuuguuuuucuc

SEQ ID NO: 1693252 - RNA, 19 nt, Salmonella enterica enterica serovar Typhi
agucuccugccaaugaaau

SEQ ID NO: 1693253 - RNA, 20 nt, Salmonella enterica enterica serovar Typhi
agucuccugccaaugaaaua

SEQ ID NO: 1693254 - RNA, 20 nt, Salmonella enterica enterica serovar Typhi
agucucccuccugcuccaug

SEQ ID NO: 1693255 - RNA, 23 nt, Salmonella enterica enterica serovar Typhi
agucucccuccugcuccaugcug

SEQ ID NO: 1693256 - RNA, 14 nt, Salmonella enterica enterica serovar Typhi
agucucccuccugc

SEQ ID NO: 1693257 - RNA, 18 nt, Salmonella enterica enterica serovar Typhi
agucggaucaugaaaaau

SEQ ID NO: 1693258 - RNA, 17 nt, Salmonella enterica enterica serovar Typhi
agucgggaaagggcggc

SEQ ID NO: 1693259 - RNA, 22 nt, Salmonella enterica enterica serovar Typhi
agucggggcguaaaaauuuucc

SEQ ID NO: 1693260 - RNA, 22 nt, Salmonella enterica enterica serovar Typhi
aguccugccauucgacaagcgg

SEQ ID NO: 1693261 - RNA, 20 nt, Salmonella enterica enterica serovar Typhi
aguccugcgucgcuucgcca

SEQ ID NO: 1693262 - RNA, 14 nt, Salmonella enterica enterica serovar Typhi
aguccucagcgaau

SEQ ID NO: 1693263 - RNA, 15 nt, Salmonella enterica enterica serovar Typhi
aguccuaacaccugc

SEQ ID NO: 1693264 - RNA, 16 nt, Salmonella enterica enterica serovar Typhi
aguccucgcccacuuc

SEQ ID NO: 1693265 - RNA, 20 nt, Salmonella enterica enterica serovar Typhi
agucgcgcgcgccagucauc

SEQ ID NO: 1693266 - RNA, 18 nt, Salmonella enterica enterica serovar Typhi
agucgcaauauaaauauc

SEQ ID NO: 1693267 - RNA, 20 nt, Salmonella enterica enterica serovar Typhi
agucgcuuaucugcugcugg

SEQ ID NO: 1693268 - RNA, 16 nt, Salmonella enterica enterica serovar Typhi
agucgacucaucuuuu

SEQ ID NO: 1693269 - RNA, 21 nt, Salmonella enterica enterica serovar Typhi
agucaaacacgaccagcgaca

SEQ ID NO: 1693270 - RNA, 22 nt, Salmonella enterica enterica serovar Typhi
agucaaaagauugauuuauuca

SEQ ID NO: 1693271 - RNA, 22 nt, Salmonella enterica enterica serovar Typhi
agucaaaauaaaauuauauucu

SEQ ID NO: 1693272 - RNA, 22 nt, Salmonella enterica enterica serovar Typhi
aguccgggcauaaccucuccuu

SEQ ID NO: 1693273 - RNA, 17 nt, Salmonella enterica enterica serovar Typhi
agucaaauuccagcaau

SEQ ID NO: 1693274 - RNA, 18 nt, Salmonella enterica enterica serovar Typhi
agucaaauuccagcaaug

SEQ ID NO: 1693275 - RNA, 12 nt, Salmonella enterica enterica serovar Typhi
agucaaauucca

SEQ ID NO: 1693276 - RNA, 15 nt, Salmonella enterica enterica serovar Typhi
agucaaauuccagca

SEQ ID NO: 1693277 - RNA, 22 nt, Salmonella enterica enterica serovar Typhi
agugauagcgccauggagaaac

SEQ ID NO: 1693278 - RNA, 23 nt, Salmonella enterica enterica serovar Typhi
agugaaucgacggcaauauuaaa

SEQ ID NO: 1693279 - RNA, 14 nt, Salmonella enterica enterica serovar Typhi
agugaauaacaacc

SEQ ID NO: 1693280 - RNA, 17 nt, Salmonella enterica enterica serovar Typhi
agugauucggguaaaca

SEQ ID NO: 1693281 - RNA, 23 nt, Salmonella enterica enterica serovar Typhi
agugauuuacuccaaaaauaaac

SEQ ID NO: 1693282 - RNA, 15 nt, Salmonella enterica enterica serovar Typhi
agugcaaaggccucu

SEQ ID NO: 1693283 - RNA, 19 nt, Salmonella enterica enterica serovar Typhi
agugcccagcgcgaccugc

SEQ ID NO: 1693284 - RNA, 15 nt, Salmonella enterica enterica serovar Typhi
agugcccgaaagcaa

SEQ ID NO: 1693285 - RNA, 12 nt, Salmonella enterica enterica serovar Typhi
agugcagaaagu

SEQ ID NO: 1693286 - RNA, 19 nt, Salmonella enterica enterica serovar Typhi
agugguaaaaaagucacuu

SEQ ID NO: 1693287 - RNA, 16 nt, Salmonella enterica enterica serovar Typhi
agugggucacaucgcc

SEQ ID NO: 1693288 - RNA, 20 nt, Salmonella enterica enterica serovar Typhi
aguggccaucuuccagcauc

SEQ ID NO: 1693289 - RNA, 17 nt, Salmonella enterica enterica serovar Typhi
aguggugggugaugacg

SEQ ID NO: 1693290 - RNA, 13 nt, Salmonella enterica enterica serovar Typhi
aguggugggugau

SEQ ID NO: 1693291 - RNA, 17 nt, Salmonella enterica enterica serovar Typhi
agugcgaaguagcugaa

SEQ ID NO: 1693292 - RNA, 15 nt, Salmonella enterica enterica serovar Typhi
agugcgcacucagaa

SEQ ID NO: 1693293 - RNA, 19 nt, Salmonella enterica enterica serovar Typhi
aguuguuccgcgcugaugg

SEQ ID NO: 1693294 - RNA, 18 nt, Salmonella enterica enterica serovar Typhi
aguuguucuuucaccauu

SEQ ID NO: 1693295 - RNA, 14 nt, Salmonella enterica enterica serovar Typhi
aguuguuccagcag

SEQ ID NO: 1693296 - RNA, 21 nt, Salmonella enterica enterica serovar Typhi
aguuguugucgagguuauaaa

SEQ ID NO: 1693297 - RNA, 16 nt, Salmonella enterica enterica serovar Typhi
aguugcccauuuuccu

SEQ ID NO: 1693298 - RNA, 18 nt, Salmonella enterica enterica serovar Typhi
aguugcccgacgccugca

SEQ ID NO: 1693299 - RNA, 19 nt, Salmonella enterica enterica serovar Typhi
aguugcacccgaacaacaa

SEQ ID NO: 1693300 - RNA, 15 nt, Salmonella enterica enterica serovar Typhi
aguugcgacugauaa

SEQ ID NO: 1693301 - RNA, 13 nt, Salmonella enterica enterica serovar Typhi
aguugcgcagggu

SEQ ID NO: 1693302 - RNA, 16 nt, Salmonella enterica enterica serovar Typhi
aguugcgcaggguauc

SEQ ID NO: 1693303 - RNA, 16 nt, Salmonella enterica enterica serovar Typhi
aguuuauugagauaau

SEQ ID NO: 1693304 - RNA, 17 nt, Salmonella enterica enterica serovar Typhi
aguuuauucaucuccuc

SEQ ID NO: 1693305 - RNA, 15 nt, Salmonella enterica enterica serovar Typhi
aguuuauugagauaa

SEQ ID NO: 1693306 - RNA, 15 nt, Salmonella enterica enterica serovar Typhi
aguuuagccagcagc

SEQ ID NO: 1693307 - RNA, 20 nt, Salmonella enterica enterica serovar Typhi
aguuuagcgagcguucugca

SEQ ID NO: 1693308 - RNA, 22 nt, Salmonella enterica enterica serovar Typhi
aguuguuuauuccauucaucga

SEQ ID NO: 1693309 - RNA, 13 nt, Salmonella enterica enterica serovar Typhi
aguuguuucaaca

SEQ ID NO: 1693310 - RNA, 17 nt, Salmonella enterica enterica serovar Typhi
aguuuaaaucacagggg

SEQ ID NO: 1693311 - RNA, 14 nt, Salmonella enterica enterica serovar Typhi
aguuuaauucuuug

SEQ ID NO: 1693312 - RNA, 15 nt, Salmonella enterica enterica serovar Typhi
aguuugugccgccac

SEQ ID NO: 1693313 - RNA, 22 nt, Salmonella enterica enterica serovar Typhi
aguuugucuucgaugcgcucau

SEQ ID NO: 1693314 - RNA, 20 nt, Salmonella enterica enterica serovar Typhi
aguuuuaccguaaaaugcug

SEQ ID NO: 1693315 - RNA, 21 nt, Salmonella enterica enterica serovar Typhi
aguuucuuuuuccaaauaguu

SEQ ID NO: 1693316 - RNA, 18 nt, Salmonella enterica enterica serovar Typhi
aguuugaugcaaauguca

SEQ ID NO: 1693317 - RNA, 22 nt, Salmonella enterica enterica serovar Typhi
aguuugaugcaaaugucagauc

SEQ ID NO: 1693318 - RNA, 17 nt, Salmonella enterica enterica serovar Typhi
aguuucaucagcacaaa

SEQ ID NO: 1693319 - RNA, 14 nt, Salmonella enterica enterica serovar Typhi
aguuucaguaucau

SEQ ID NO: 1693320 - RNA, 15 nt, Salmonella enterica enterica serovar Typhi
aguuucagugguggc

SEQ ID NO: 1693321 - RNA, 14 nt, Salmonella enterica enterica serovar Typhi
aguuucaccuucug

SEQ ID NO: 1693322 - RNA, 22 nt, Salmonella enterica enterica serovar Typhi
aguuucgacuuucauuucuuua

SEQ ID NO: 1693323 - RNA, 15 nt, Salmonella enterica enterica serovar Typhi
aguuucguuaccccg

SEQ ID NO: 1693324 - RNA, 16 nt, Salmonella enterica enterica serovar Typhi
aguuucucuucguuau

SEQ ID NO: 1693325 - RNA, 19 nt, Salmonella enterica enterica serovar Typhi
aguuucucccgccagaugc

SEQ ID NO: 1693326 - RNA, 19 nt, Salmonella enterica enterica serovar Typhi
aguuucugcucgaccguca

SEQ ID NO: 1693327 - RNA, 21 nt, Salmonella enterica enterica serovar Typhi
aguuucuucggcuucaccgau

SEQ ID NO: 1693328 - RNA, 14 nt, Salmonella enterica enterica serovar Typhi
aguucuugcaggca

SEQ ID NO: 1693329 - RNA, 23 nt, Salmonella enterica enterica serovar Typhi
aguugcaagucaccaucaguagc

SEQ ID NO: 1693330 - RNA, 13 nt, Salmonella enterica enterica serovar Typhi
aguucucaaugaa

SEQ ID NO: 1693331 - RNA, 17 nt, Salmonella enterica enterica serovar Typhi
aguucucgcgccgccug

SEQ ID NO: 1693332 - RNA, 16 nt, Salmonella enterica enterica serovar Typhi
aguucuacgcugccau

SEQ ID NO: 1693333 - RNA, 15 nt, Salmonella enterica enterica serovar Typhi
aguucuaacaggaag

SEQ ID NO: 1693334 - RNA, 17 nt, Salmonella enterica enterica serovar Typhi
aguucauuucaggcaaa

SEQ ID NO: 1693335 - RNA, 20 nt, Salmonella enterica enterica serovar Typhi
aguuccacauaaaguagcca

SEQ ID NO: 1693336 - RNA, 17 nt, Salmonella enterica enterica serovar Typhi
aguuccaggacggacau

SEQ ID NO: 1693337 - RNA, 23 nt, Salmonella enterica enterica serovar Typhi
aguuccaguaagguccagggaaa

SEQ ID NO: 1693338 - RNA, 13 nt, Salmonella enterica enterica serovar Typhi
agugucaacugcg

SEQ ID NO: 1693339 - RNA, 21 nt, Salmonella enterica enterica serovar Typhi
aguguccacucgcucauuugc

SEQ ID NO: 1693340 - RNA, 23 nt, Salmonella enterica enterica serovar Typhi
aguuaaugccaucaucaguaaca

SEQ ID NO: 1693341 - RNA, 16 nt, Salmonella enterica enterica serovar Typhi
aguuaauuaaaugcuu

SEQ ID NO: 1693342 - RNA, 16 nt, Salmonella enterica enterica serovar Typhi
aguuacuuuccauaua

SEQ ID NO: 1693343 - RNA, 15 nt, Salmonella enterica enterica serovar Typhi
aguuacgcucucagc

SEQ ID NO: 1693344 - RNA, 19 nt, Salmonella enterica enterica serovar Typhi
aguuacgcacgccagauaa

SEQ ID NO: 1693345 - RNA, 21 nt, Salmonella enterica enterica serovar Typhi
aguuaucauuauauagucuua

SEQ ID NO: 1693346 - RNA, 15 nt, Salmonella enterica enterica serovar Typhi
aguuauccagcgccc

SEQ ID NO: 1693347 - RNA, 16 nt, Salmonella enterica enterica serovar Typhi
aguucaccaguuuuuc

SEQ ID NO: 1693348 - RNA, 19 nt, Salmonella enterica enterica serovar Typhi
aguucacgacugauagguu

SEQ ID NO: 1693349 - RNA, 20 nt, Salmonella enterica enterica serovar Typhi
aguucacuccuaagagaaaa

SEQ ID NO: 1693350 - RNA, 16 nt, Salmonella enterica enterica serovar Typhi
aguucagcagcaccac

SEQ ID NO: 1693351 - RNA, 13 nt, Salmonella enterica enterica serovar Typhi
aguucagcagcac

SEQ ID NO: 1693352 - RNA, 22 nt, Salmonella enterica enterica serovar Typhi
aucuucgcaguagauucuaucu

SEQ ID NO: 1693353 - RNA, 15 nt, Salmonella enterica enterica serovar Typhi
aucuuuuaaaaucag

SEQ ID NO: 1693354 - RNA, 14 nt, Salmonella enterica enterica serovar Typhi
aucuuuccggaacg

SEQ ID NO: 1693355 - RNA, 17 nt, Salmonella enterica enterica serovar Typhi
aucuuuaugucaguaau

SEQ ID NO: 1693356 - RNA, 20 nt, Salmonella enterica enterica serovar Typhi
augaaaauaauuuuuaucau

SEQ ID NO: 1693357 - RNA, 22 nt, Salmonella enterica enterica serovar Typhi
augaaaucgccuguuaauggua

SEQ ID NO: 1693358 - RNA, 21 nt, Salmonella enterica enterica serovar Typhi
augaaauucuugcccgcugag

SEQ ID NO: 1693359 - RNA, 14 nt, Salmonella enterica enterica serovar Typhi
augaaaucacccag

SEQ ID NO: 1693360 - RNA, 17 nt, Salmonella enterica enterica serovar Typhi
aucuuuucaaucagguu

SEQ ID NO: 1693361 - RNA, 19 nt, Salmonella enterica enterica serovar Typhi
augaacccucgaaugugaa

SEQ ID NO: 1693362 - RNA, 22 nt, Salmonella enterica enterica serovar Typhi
augaacccucgaaugugaauuc

SEQ ID NO: 1693363 - RNA, 22 nt, Salmonella enterica enterica serovar Typhi
augaaaucgucgccaacaccga

SEQ ID NO: 1693364 - RNA, 18 nt, Salmonella enterica enterica serovar Typhi
augaaccugaugugcuuu

SEQ ID NO: 1693365 - RNA, 15 nt, Salmonella enterica enterica serovar Typhi
augaacucaauccau

SEQ ID NO: 1693366 - RNA, 22 nt, Salmonella enterica enterica serovar Typhi
augaacguuuugugucaaaaag

SEQ ID NO: 1693367 - RNA, 16 nt, Salmonella enterica enterica serovar Typhi
augaagcauaaaaaga

SEQ ID NO: 1693368 - RNA, 20 nt, Salmonella enterica enterica serovar Typhi
augaacucuaugcaaaagaa

SEQ ID NO: 1693369 - RNA, 21 nt, Salmonella enterica enterica serovar Typhi
augaacucuaugcaaaagaaa

SEQ ID NO: 1693370 - RNA, 22 nt, Salmonella enterica enterica serovar Typhi
augaacucuaugcaaaagaaaa

SEQ ID NO: 1693371 - RNA, 16 nt, Salmonella enterica enterica serovar Typhi
augaacugcaucagaa

SEQ ID NO: 1693372 - RNA, 16 nt, Salmonella enterica enterica serovar Typhi
augaagcggaaaggac

SEQ ID NO: 1693373 - RNA, 23 nt, Salmonella enterica enterica serovar Typhi
augaauuuauggagucaugaaug

SEQ ID NO: 1693374 - RNA, 20 nt, Salmonella enterica enterica serovar Typhi
augaaugacaguucccugcu

SEQ ID NO: 1693375 - RNA, 14 nt, Salmonella enterica enterica serovar Typhi
augacugguuuuuc

SEQ ID NO: 1693376 - RNA, 18 nt, Salmonella enterica enterica serovar Typhi
augacucauuaaaaaaac

SEQ ID NO: 1693377 - RNA, 19 nt, Salmonella enterica enterica serovar Typhi
augacucauuaaaaaaaca

SEQ ID NO: 1693378 - RNA, 14 nt, Salmonella enterica enterica serovar Typhi
augacucaaacaga

SEQ ID NO: 1693379 - RNA, 15 nt, Salmonella enterica enterica serovar Typhi
augacguggccagca

SEQ ID NO: 1693380 - RNA, 14 nt, Salmonella enterica enterica serovar Typhi
augacauccagagg

SEQ ID NO: 1693381 - RNA, 12 nt, Salmonella enterica enterica serovar Typhi
augaguaaaauu

SEQ ID NO: 1693382 - RNA, 20 nt, Salmonella enterica enterica serovar Typhi
augaguagaacguauuauua

SEQ ID NO: 1693383 - RNA, 23 nt, Salmonella enterica enterica serovar Typhi
augaggccagaaggcgaacauaa

SEQ ID NO: 1693384 - RNA, 16 nt, Salmonella enterica enterica serovar Typhi
augagcgcaggcgagc

SEQ ID NO: 1693385 - RNA, 13 nt, Salmonella enterica enterica serovar Typhi
augaggagcugga

SEQ ID NO: 1693386 - RNA, 17 nt, Salmonella enterica enterica serovar Typhi
augagcucaaauaugau

SEQ ID NO: 1693387 - RNA, 20 nt, Salmonella enterica enterica serovar Typhi
augauaaccgccgccaaacu

SEQ ID NO: 1693388 - RNA, 23 nt, Salmonella enterica enterica serovar Typhi
augauaaccgccgccaaacugcg

SEQ ID NO: 1693389 - RNA, 17 nt, Salmonella enterica enterica serovar Typhi
augauaagccugacuac

SEQ ID NO: 1693390 - RNA, 16 nt, Salmonella enterica enterica serovar Typhi
augauauccagcacgc

SEQ ID NO: 1693391 - RNA, 16 nt, Salmonella enterica enterica serovar Typhi
augauauauucaugau

SEQ ID NO: 1693392 - RNA, 20 nt, Salmonella enterica enterica serovar Typhi
augauagcgccauauaaaua

SEQ ID NO: 1693393 - RNA, 22 nt, Salmonella enterica enterica serovar Typhi
aucuccugcgauagcugcugac

SEQ ID NO: 1693394 - RNA, 16 nt, Salmonella enterica enterica serovar Typhi
aucuccuuuaaugaag

SEQ ID NO: 1693395 - RNA, 20 nt, Salmonella enterica enterica serovar Typhi
aucuccagaccgcugcggaa

SEQ ID NO: 1693396 - RNA, 16 nt, Salmonella enterica enterica serovar Typhi
aucuccggcaucucaa

SEQ ID NO: 1693397 - RNA, 19 nt, Salmonella enterica enterica serovar Typhi
aucucaucugcaaaauaua

SEQ ID NO: 1693398 - RNA, 15 nt, Salmonella enterica enterica serovar Typhi
aucucuuuugcuuca

SEQ ID NO: 1693399 - RNA, 22 nt, Salmonella enterica enterica serovar Typhi
aucucuuuuaauuuucuguaau

SEQ ID NO: 1693400 - RNA, 13 nt, Salmonella enterica enterica serovar Typhi
aucucuuuuucuc

SEQ ID NO: 1693401 - RNA, 22 nt, Salmonella enterica enterica serovar Typhi
aucucgcacaucaugaugaucu

SEQ ID NO: 1693402 - RNA, 23 nt, Salmonella enterica enterica serovar Typhi
aucucgaccuggcgcucaaucag

SEQ ID NO: 1693403 - RNA, 19 nt, Salmonella enterica enterica serovar Typhi
aucucgcgguugacgcugc

SEQ ID NO: 1693404 - RNA, 22 nt, Salmonella enterica enterica serovar Typhi
aucgucauugaccggaaaaaaa

SEQ ID NO: 1693405 - RNA, 14 nt, Salmonella enterica enterica serovar Typhi
aucguaugcgccug

SEQ ID NO: 1693406 - RNA, 17 nt, Salmonella enterica enterica serovar Typhi
aucuacaaacgcggaca

SEQ ID NO: 1693407 - RNA, 18 nt, Salmonella enterica enterica serovar Typhi
aucucauaaaugcugucg

SEQ ID NO: 1693408 - RNA, 17 nt, Salmonella enterica enterica serovar Typhi
aucuauauauucuucuu

SEQ ID NO: 1693409 - RNA, 23 nt, Salmonella enterica enterica serovar Typhi
aucuuccacccgcgcgcuuucca

SEQ ID NO: 1693410 - RNA, 17 nt, Salmonella enterica enterica serovar Typhi
aucuuccacgguaaaac

SEQ ID NO: 1693411 - RNA, 22 nt, Salmonella enterica enterica serovar Typhi
aucuuccagcgucgggccgcgc

SEQ ID NO: 1693412 - RNA, 15 nt, Salmonella enterica enterica serovar Typhi
aucuuccagguagug

SEQ ID NO: 1693413 - RNA, 14 nt, Salmonella enterica enterica serovar Typhi
aucuuccaguugcu

SEQ ID NO: 1693414 - RNA, 20 nt, Salmonella enterica enterica serovar Typhi
aucuuccgggucaguuuuuu

SEQ ID NO: 1693415 - RNA, 14 nt, Salmonella enterica enterica serovar Typhi
aucuucaucccauc

SEQ ID NO: 1693416 - RNA, 21 nt, Salmonella enterica enterica serovar Typhi
aucuucacuguuaucgccauu

SEQ ID NO: 1693417 - RNA, 22 nt, Salmonella enterica enterica serovar Typhi
aucuucaccgaugcccagcuug

SEQ ID NO: 1693418 - RNA, 17 nt, Salmonella enterica enterica serovar Typhi
aucuucacgcagcguga

SEQ ID NO: 1693419 - RNA, 21 nt, Salmonella enterica enterica serovar Typhi
aucuucaaucgugaccaccgc

SEQ ID NO: 1693420 - RNA, 15 nt, Salmonella enterica enterica serovar Typhi
aucuuauuagcgauu

SEQ ID NO: 1693421 - RNA, 23 nt, Salmonella enterica enterica serovar Typhi
aucuuauuuuccguuagccaaug

SEQ ID NO: 1693422 - RNA, 21 nt, Salmonella enterica enterica serovar Typhi
aucuucaagguuaugcgcaca

SEQ ID NO: 1693423 - RNA, 21 nt, Salmonella enterica enterica serovar Typhi
aucuucaaagccacacugcau

SEQ ID NO: 1693424 - RNA, 18 nt, Salmonella enterica enterica serovar Typhi
aucuggaugaaggagaaa

SEQ ID NO: 1693425 - RNA, 22 nt, Salmonella enterica enterica serovar Typhi
aucugcuaccgccacuuugcuu

SEQ ID NO: 1693426 - RNA, 23 nt, Salmonella enterica enterica serovar Typhi
aucugcuaccgccacuuugcuuu

SEQ ID NO: 1693427 - RNA, 22 nt, Salmonella enterica enterica serovar Typhi
aucugcgccggcugcgcugcca

SEQ ID NO: 1693428 - RNA, 18 nt, Salmonella enterica enterica serovar Typhi
aucugcgucaguaccuga

SEQ ID NO: 1693429 - RNA, 19 nt, Salmonella enterica enterica serovar Typhi
aucugcgcaacauucugcu

SEQ ID NO: 1693430 - RNA, 17 nt, Salmonella enterica enterica serovar Typhi
aucugcgcaacuggaag

SEQ ID NO: 1693431 - RNA, 21 nt, Salmonella enterica enterica serovar Typhi
aucugcgccgacauucccugc

SEQ ID NO: 1693432 - RNA, 14 nt, Salmonella enterica enterica serovar Typhi
aucugacauauaca

SEQ ID NO: 1693433 - RNA, 18 nt, Salmonella enterica enterica serovar Typhi
aucugacaucagaaaaua

SEQ ID NO: 1693434 - RNA, 14 nt, Salmonella enterica enterica serovar Typhi
aucugacagccaaa

SEQ ID NO: 1693435 - RNA, 15 nt, Salmonella enterica enterica serovar Typhi
aucugacagauaucu

SEQ ID NO: 1693436 - RNA, 18 nt, Salmonella enterica enterica serovar Typhi
aucugacugcgugagugu

SEQ ID NO: 1693437 - RNA, 19 nt, Salmonella enterica enterica serovar Typhi
aucugacagccaaacugcu

SEQ ID NO: 1693438 - RNA, 22 nt, Salmonella enterica enterica serovar Typhi
aucugacagccaaacugcugua

SEQ ID NO: 1693439 - RNA, 21 nt, Salmonella enterica enterica serovar Typhi
aucugaacucuuccagauacg

SEQ ID NO: 1693440 - RNA, 12 nt, Salmonella enterica enterica serovar Typhi
aucucuuuuucu

SEQ ID NO: 1693441 - RNA, 13 nt, Salmonella enterica enterica serovar Typhi
aucugaaaugcuc

SEQ ID NO: 1693442 - RNA, 13 nt, Salmonella enterica enterica serovar Typhi
aucugaauaccuu

SEQ ID NO: 1693443 - RNA, 13 nt, Salmonella enterica enterica serovar Typhi
aucuguauaaaau

SEQ ID NO: 1693444 - RNA, 14 nt, Salmonella enterica enterica serovar Typhi
aucuguuugagaaa

SEQ ID NO: 1693445 - RNA, 14 nt, Salmonella enterica enterica serovar Typhi
aucuguuucaugga

SEQ ID NO: 1693446 - RNA, 15 nt, Salmonella enterica enterica serovar Typhi
aucuguuugagaaaa

SEQ ID NO: 1693447 - RNA, 18 nt, Salmonella enterica enterica serovar Typhi
aucuguuugagaaaaaca

SEQ ID NO: 1693448 - RNA, 15 nt, Salmonella enterica enterica serovar Typhi
aucugucccagccuu

SEQ ID NO: 1693449 - RNA, 20 nt, Salmonella enterica enterica serovar Typhi
aucugucccagccuuccugg

SEQ ID NO: 1693450 - RNA, 12 nt, Salmonella enterica enterica serovar Typhi
aaaagaaaaaac

SEQ ID NO: 1693451 - RNA, 11 nt, Salmonella enterica enterica serovar Typhi
aaaagaaacug

SEQ ID NO: 1693452 - RNA, 13 nt, Salmonella enterica enterica serovar Typhi
aucauuauucccc

SEQ ID NO: 1693453 - RNA, 15 nt, Salmonella enterica enterica serovar Typhi
aucauuauuccccuc

SEQ ID NO: 1693454 - RNA, 16 nt, Salmonella enterica enterica serovar Typhi
aucauuauuccccucc

SEQ ID NO: 1693455 - RNA, 17 nt, Salmonella enterica enterica serovar Typhi
aucauucaacgcaucaa

SEQ ID NO: 1693456 - RNA, 19 nt, Salmonella enterica enterica serovar Typhi
aucauuauauagucuuaau

SEQ ID NO: 1693457 - RNA, 23 nt, Salmonella enterica enterica serovar Typhi
aucauuauauagucuuaauuugc

SEQ ID NO: 1693458 - RNA, 11 nt, Salmonella enterica enterica serovar Typhi
aucauuuccac

SEQ ID NO: 1693459 - RNA, 18 nt, Salmonella enterica enterica serovar Typhi
aucauuuguacaaaaaau

SEQ ID NO: 1693460 - RNA, 20 nt, Salmonella enterica enterica serovar Typhi
aucauucaacgcaucaaaua

SEQ ID NO: 1693461 - RNA, 12 nt, Salmonella enterica enterica serovar Typhi
aucauucaucuc

SEQ ID NO: 1693462 - RNA, 22 nt, Salmonella enterica enterica serovar Typhi
aucauucccguaucuucauguu

SEQ ID NO: 1693463 - RNA, 18 nt, Salmonella enterica enterica serovar Typhi
aaaacuuuaacacuaacu

SEQ ID NO: 1693464 - RNA, 14 nt, Salmonella enterica enterica serovar Typhi
aaaacuuauuuuau

SEQ ID NO: 1693465 - RNA, 22 nt, Salmonella enterica enterica serovar Typhi
aaaacuuauuuuauuuuuauau

SEQ ID NO: 1693466 - RNA, 13 nt, Salmonella enterica enterica serovar Typhi
aucauuacaggcg

SEQ ID NO: 1693467 - RNA, 17 nt, Salmonella enterica enterica serovar Typhi
auccaccaccagcauca

SEQ ID NO: 1693468 - RNA, 19 nt, Salmonella enterica enterica serovar Typhi
auccaccaccagcaucacg

SEQ ID NO: 1693469 - RNA, 16 nt, Salmonella enterica enterica serovar Typhi
auccaccaggcaugca

SEQ ID NO: 1693470 - RNA, 17 nt, Salmonella enterica enterica serovar Typhi
auccaccacguaaugcg

SEQ ID NO: 1693471 - RNA, 14 nt, Salmonella enterica enterica serovar Typhi
auccaccagcccca

SEQ ID NO: 1693472 - RNA, 19 nt, Salmonella enterica enterica serovar Typhi
auccaauagacuucacuuu

SEQ ID NO: 1693473 - RNA, 12 nt, Salmonella enterica enterica serovar Typhi
aucauuuucuuu

SEQ ID NO: 1693474 - RNA, 16 nt, Salmonella enterica enterica serovar Typhi
auccagcaguugccau

SEQ ID NO: 1693475 - RNA, 14 nt, Salmonella enterica enterica serovar Typhi
auccagacccacag

SEQ ID NO: 1693476 - RNA, 23 nt, Salmonella enterica enterica serovar Typhi
auccagaacugcgaaaucaccga

SEQ ID NO: 1693477 - RNA, 19 nt, Salmonella enterica enterica serovar Typhi
auccagcgaaccuuccauc

SEQ ID NO: 1693478 - RNA, 22 nt, Salmonella enterica enterica serovar Typhi
auccagcgauugacgguuuguc

SEQ ID NO: 1693479 - RNA, 14 nt, Salmonella enterica enterica serovar Typhi
auccagccucuccc

SEQ ID NO: 1693480 - RNA, 23 nt, Salmonella enterica enterica serovar Typhi
auccaccccuugcgcguuucuga

SEQ ID NO: 1693481 - RNA, 15 nt, Salmonella enterica enterica serovar Typhi
auccaccgcccgcgu

SEQ ID NO: 1693482 - RNA, 18 nt, Salmonella enterica enterica serovar Typhi
auccauucucaucagacc

SEQ ID NO: 1693483 - RNA, 18 nt, Salmonella enterica enterica serovar Typhi
aucccacuuaggcagcca

SEQ ID NO: 1693484 - RNA, 14 nt, Salmonella enterica enterica serovar Typhi
aucccacugcacgc

SEQ ID NO: 1693485 - RNA, 14 nt, Salmonella enterica enterica serovar Typhi
auccauuaaaaucu

SEQ ID NO: 1693486 - RNA, 16 nt, Salmonella enterica enterica serovar Typhi
auccauguugccauga

SEQ ID NO: 1693487 - RNA, 18 nt, Salmonella enterica enterica serovar Typhi
auccaggacgucuugcaa

SEQ ID NO: 1693488 - RNA, 16 nt, Salmonella enterica enterica serovar Typhi
auccaggaaguaaauu

SEQ ID NO: 1693489 - RNA, 19 nt, Salmonella enterica enterica serovar Typhi
auccagcgcguaaauaccu

SEQ ID NO: 1693490 - RNA, 21 nt, Salmonella enterica enterica serovar Typhi
auccagcgcguaaauaccuuc

SEQ ID NO: 1693491 - RNA, 14 nt, Salmonella enterica enterica serovar Typhi
auccagguggaucg

SEQ ID NO: 1693492 - RNA, 13 nt, Salmonella enterica enterica serovar Typhi
auccccggcaacc

SEQ ID NO: 1693493 - RNA, 17 nt, Salmonella enterica enterica serovar Typhi
aucccgcgccaauaacg

SEQ ID NO: 1693494 - RNA, 16 nt, Salmonella enterica enterica serovar Typhi
aucccgcgcgccucgc

SEQ ID NO: 1693495 - RNA, 23 nt, Salmonella enterica enterica serovar Typhi
aucccgcugugauccauguugcc

SEQ ID NO: 1693496 - RNA, 15 nt, Salmonella enterica enterica serovar Typhi
aucccccugccacaa

SEQ ID NO: 1693497 - RNA, 12 nt, Salmonella enterica enterica serovar Typhi
auccccgcuggc

SEQ ID NO: 1693498 - RNA, 14 nt, Salmonella enterica enterica serovar Typhi
auccccccuuuuuu

SEQ ID NO: 1693499 - RNA, 20 nt, Salmonella enterica enterica serovar Typhi
aucccagggcggcgucgcca

SEQ ID NO: 1693500 - RNA, 23 nt, Salmonella enterica enterica serovar Typhi
aucccaguugaucggccagcaag

SEQ ID NO: 1693501 - RNA, 20 nt, Salmonella enterica enterica serovar Typhi
aucccauccgggccacucuc

SEQ ID NO: 1693502 - RNA, 13 nt, Salmonella enterica enterica serovar Typhi
auccgccgccgca

SEQ ID NO: 1693503 - RNA, 16 nt, Salmonella enterica enterica serovar Typhi
auccgccgccagccau

SEQ ID NO: 1693504 - RNA, 16 nt, Salmonella enterica enterica serovar Typhi
auccgccgagggcauu

SEQ ID NO: 1693505 - RNA, 15 nt, Salmonella enterica enterica serovar Typhi
auccgcagcaguugg

SEQ ID NO: 1693506 - RNA, 17 nt, Salmonella enterica enterica serovar Typhi
auccgcagauccagcac

SEQ ID NO: 1693507 - RNA, 15 nt, Salmonella enterica enterica serovar Typhi
auccgcauacaccuu

SEQ ID NO: 1693508 - RNA, 20 nt, Salmonella enterica enterica serovar Typhi
auccgcaaauuacugugccc

SEQ ID NO: 1693509 - RNA, 22 nt, Salmonella enterica enterica serovar Typhi
auccgcagacuuuaaccauucc

SEQ ID NO: 1693510 - RNA, 12 nt, Salmonella enterica enterica serovar Typhi
auccgacaugau

SEQ ID NO: 1693511 - RNA, 18 nt, Salmonella enterica enterica serovar Typhi
aucccucaccucccccgc

SEQ ID NO: 1693512 - RNA, 14 nt, Salmonella enterica enterica serovar Typhi
aucccuaauaaaau

SEQ ID NO: 1693513 - RNA, 15 nt, Salmonella enterica enterica serovar Typhi
aucccguagccgcuu

SEQ ID NO: 1693514 - RNA, 19 nt, Salmonella enterica enterica serovar Typhi
aucccgggcgauaaaccag

SEQ ID NO: 1693515 - RNA, 14 nt, Salmonella enterica enterica serovar Typhi
aucccgucccacca

SEQ ID NO: 1693516 - RNA, 21 nt, Salmonella enterica enterica serovar Typhi
aucccuuucaaaaaagagaag

SEQ ID NO: 1693517 - RNA, 13 nt, Salmonella enterica enterica serovar Typhi
auccgaagaacca

SEQ ID NO: 1693518 - RNA, 14 nt, Salmonella enterica enterica serovar Typhi
aucccugcaaacua

SEQ ID NO: 1693519 - RNA, 16 nt, Salmonella enterica enterica serovar Typhi
aucgcgcgcaaaugca

SEQ ID NO: 1693520 - RNA, 23 nt, Salmonella enterica enterica serovar Typhi
aucgcgcccgccaucaugcccac

SEQ ID NO: 1693521 - RNA, 21 nt, Salmonella enterica enterica serovar Typhi
aucgcuaaccaaaccagaugc

SEQ ID NO: 1693522 - RNA, 13 nt, Salmonella enterica enterica serovar Typhi
aucgcuaaucagg

SEQ ID NO: 1693523 - RNA, 24 nt, Salmonella enterica enterica serovar Typhi
aucgcccgguugcaauuccgccau

SEQ ID NO: 1693524 - RNA, 19 nt, Salmonella enterica enterica serovar Typhi
aucgccgaaagcgaucaca

SEQ ID NO: 1693525 - RNA, 16 nt, Salmonella enterica enterica serovar Typhi
aucgccgaagcggcag

SEQ ID NO: 1693526 - RNA, 13 nt, Salmonella enterica enterica serovar Typhi
aucgccgaucaca

SEQ ID NO: 1693527 - RNA, 15 nt, Salmonella enterica enterica serovar Typhi
aucgccgaucacaaa

SEQ ID NO: 1693528 - RNA, 15 nt, Salmonella enterica enterica serovar Typhi
aucgccgccagcuca

SEQ ID NO: 1693529 - RNA, 18 nt, Salmonella enterica enterica serovar Typhi
aucggccagcgaaaacca

SEQ ID NO: 1693530 - RNA, 20 nt, Salmonella enterica enterica serovar Typhi
aucggccauauccagccagu

SEQ ID NO: 1693531 - RNA, 12 nt, Salmonella enterica enterica serovar Typhi
aucgcuccuccc

SEQ ID NO: 1693532 - RNA, 17 nt, Salmonella enterica enterica serovar Typhi
aucgcuuugcagaaaau

SEQ ID NO: 1693533 - RNA, 22 nt, Salmonella enterica enterica serovar Typhi
aucgcuuugcagaaaauccuuc

SEQ ID NO: 1693534 - RNA, 18 nt, Salmonella enterica enterica serovar Typhi
aucgguuugagcaccacg

SEQ ID NO: 1693535 - RNA, 13 nt, Salmonella enterica enterica serovar Typhi
aucguaaaucaaa

SEQ ID NO: 1693536 - RNA, 14 nt, Salmonella enterica enterica serovar Typhi
aucgguucucugcc

SEQ ID NO: 1693537 - RNA, 14 nt, Salmonella enterica enterica serovar Typhi
aucgguuaauugcc

SEQ ID NO: 1693538 - RNA, 14 nt, Salmonella enterica enterica serovar Typhi
aucguaagccaccg

SEQ ID NO: 1693539 - RNA, 22 nt, Salmonella enterica enterica serovar Typhi
aucguagcgugcgcaauauggu

SEQ ID NO: 1693540 - RNA, 23 nt, Salmonella enterica enterica serovar Typhi
aucgggugacgagggaaggggau

SEQ ID NO: 1693541 - RNA, 17 nt, Salmonella enterica enterica serovar Typhi
aucgggugauaaaauaa

SEQ ID NO: 1693542 - RNA, 20 nt, Salmonella enterica enterica serovar Typhi
aucgguaagcgccugcugcg

SEQ ID NO: 1693543 - RNA, 19 nt, Salmonella enterica enterica serovar Typhi
aucggugauccagcaaucg

SEQ ID NO: 1693544 - RNA, 21 nt, Salmonella enterica enterica serovar Typhi
aucgggaucagaaauucgcag

SEQ ID NO: 1693545 - RNA, 16 nt, Salmonella enterica enterica serovar Typhi
aucggcgggguuuaac

SEQ ID NO: 1693546 - RNA, 16 nt, Salmonella enterica enterica serovar Typhi
aucggcguguuucauc

SEQ ID NO: 1693547 - RNA, 20 nt, Salmonella enterica enterica serovar Typhi
aucggcguugccuggccucc

SEQ ID NO: 1693548 - RNA, 22 nt, Salmonella enterica enterica serovar Typhi
aucggcgccggggugcuguucu

SEQ ID NO: 1693549 - RNA, 16 nt, Salmonella enterica enterica serovar Typhi
aucggcgcgcuggcgu

SEQ ID NO: 1693550 - RNA, 22 nt, Salmonella enterica enterica serovar Typhi
aucggcgcuacggcguuucacu

SEQ ID NO: 1693551 - RNA, 21 nt, Salmonella enterica enterica serovar Typhi
aucgaacgcuuccgggcucau

SEQ ID NO: 1693552 - RNA, 16 nt, Salmonella enterica enterica serovar Typhi
aucgaacugugagccu

SEQ ID NO: 1693553 - RNA, 19 nt, Salmonella enterica enterica serovar Typhi
aucgaacauucuuaugcaa

SEQ ID NO: 1693554 - RNA, 24 nt, Salmonella enterica enterica serovar Typhi
auccuguaacaacuguuuuucacu

SEQ ID NO: 1693555 - RNA, 23 nt, Salmonella enterica enterica serovar Typhi
auccugugaaguaaaaaaaccgu

SEQ ID NO: 1693556 - RNA, 16 nt, Salmonella enterica enterica serovar Typhi
auccuucuuccauucc

SEQ ID NO: 1693557 - RNA, 14 nt, Salmonella enterica enterica serovar Typhi
auccuucuaccuuc

SEQ ID NO: 1693558 - RNA, 12 nt, Salmonella enterica enterica serovar Typhi
auccuucuucca

SEQ ID NO: 1693559 - RNA, 15 nt, Salmonella enterica enterica serovar Typhi
auccuucuuccauuc

SEQ ID NO: 1693560 - RNA, 22 nt, Salmonella enterica enterica serovar Typhi
auccgcgcauacucuuccguca

SEQ ID NO: 1693561 - RNA, 14 nt, Salmonella enterica enterica serovar Typhi
auccugcacuucca

SEQ ID NO: 1693562 - RNA, 15 nt, Salmonella enterica enterica serovar Typhi
auccggaauaagaau

SEQ ID NO: 1693563 - RNA, 20 nt, Salmonella enterica enterica serovar Typhi
auccugcgggaugcguaauc

SEQ ID NO: 1693564 - RNA, 14 nt, Salmonella enterica enterica serovar Typhi
auccugccgcacca

SEQ ID NO: 1693565 - RNA, 17 nt, Salmonella enterica enterica serovar Typhi
auccugcuugccugugc

SEQ ID NO: 1693566 - RNA, 20 nt, Salmonella enterica enterica serovar Typhi
auccuggauacguuccagca

SEQ ID NO: 1693567 - RNA, 22 nt, Salmonella enterica enterica serovar Typhi
aucgcauugagcaggggcuccu

SEQ ID NO: 1693568 - RNA, 12 nt, Salmonella enterica enterica serovar Typhi
aucgccaaacca

SEQ ID NO: 1693569 - RNA, 19 nt, Salmonella enterica enterica serovar Typhi
aucgccaaagcguaaacag

SEQ ID NO: 1693570 - RNA, 22 nt, Salmonella enterica enterica serovar Typhi
aucgccaaagucauugcugcca

SEQ ID NO: 1693571 - RNA, 13 nt, Salmonella enterica enterica serovar Typhi
aucgccaaaccag

SEQ ID NO: 1693572 - RNA, 12 nt, Salmonella enterica enterica serovar Typhi
aucgccaaagcg

SEQ ID NO: 1693573 - RNA, 21 nt, Salmonella enterica enterica serovar Typhi
aucgauccacuucccauucuc

SEQ ID NO: 1693574 - RNA, 12 nt, Salmonella enterica enterica serovar Typhi
aucgccagcgcg

SEQ ID NO: 1693575 - RNA, 15 nt, Salmonella enterica enterica serovar Typhi
aucgccagcacguuu

SEQ ID NO: 1693576 - RNA, 14 nt, Salmonella enterica enterica serovar Typhi
aucgccagauaaau

SEQ ID NO: 1693577 - RNA, 16 nt, Salmonella enterica enterica serovar Typhi
aucgccacaugcggca

SEQ ID NO: 1693578 - RNA, 17 nt, Salmonella enterica enterica serovar Typhi
aucgccaacgaccggcg

SEQ ID NO: 1693579 - RNA, 13 nt, Salmonella enterica enterica serovar Typhi
aucgacgaaaugg

SEQ ID NO: 1693580 - RNA, 17 nt, Salmonella enterica enterica serovar Typhi
aucgaaggcaucuucag

SEQ ID NO: 1693581 - RNA, 16 nt, Salmonella enterica enterica serovar Typhi
aucgaauccagcaggc

SEQ ID NO: 1693582 - RNA, 22 nt, Salmonella enterica enterica serovar Typhi
aucgaaucguucgccagugaca

SEQ ID NO: 1693583 - RNA, 15 nt, Salmonella enterica enterica serovar Typhi
aucgacaaaccacug

SEQ ID NO: 1693584 - RNA, 17 nt, Salmonella enterica enterica serovar Typhi
auacgcaccagcucuac

SEQ ID NO: 1693585 - RNA, 22 nt, Salmonella enterica enterica serovar Typhi
auacgcagaucuuuuugcuccu

SEQ ID NO: 1693586 - RNA, 15 nt, Salmonella enterica enterica serovar Typhi
auacgaucgcgcaca

SEQ ID NO: 1693587 - RNA, 13 nt, Salmonella enterica enterica serovar Typhi
auacgcgauaaaa

SEQ ID NO: 1693588 - RNA, 14 nt, Salmonella enterica enterica serovar Typhi
auacgccaucuuuc

SEQ ID NO: 1693589 - RNA, 15 nt, Salmonella enterica enterica serovar Typhi
auacgauguaaaaau

SEQ ID NO: 1693590 - RNA, 13 nt, Salmonella enterica enterica serovar Typhi
auacgccagcaga

SEQ ID NO: 1693591 - RNA, 21 nt, Salmonella enterica enterica serovar Typhi
auaccuucccgcgauaaaaac

SEQ ID NO: 1693592 - RNA, 20 nt, Salmonella enterica enterica serovar Typhi
auaccuucuucacuaaaaac

SEQ ID NO: 1693593 - RNA, 21 nt, Salmonella enterica enterica serovar Typhi
auaccuucuucacuaaaaaca

SEQ ID NO: 1693594 - RNA, 14 nt, Salmonella enterica enterica serovar Typhi
auacgaaauugaga

SEQ ID NO: 1693595 - RNA, 13 nt, Salmonella enterica enterica serovar Typhi
auaccucauuuca

SEQ ID NO: 1693596 - RNA, 15 nt, Salmonella enterica enterica serovar Typhi
auaccggaggagugc

SEQ ID NO: 1693597 - RNA, 20 nt, Salmonella enterica enterica serovar Typhi
auaccgcuuuguaaaacauu

SEQ ID NO: 1693598 - RNA, 13 nt, Salmonella enterica enterica serovar Typhi
auaccuauuuaau

SEQ ID NO: 1693599 - RNA, 17 nt, Salmonella enterica enterica serovar Typhi
auaccucaaaugcugaa

SEQ ID NO: 1693600 - RNA, 16 nt, Salmonella enterica enterica serovar Typhi
auaccgcuuuguaaaa

SEQ ID NO: 1693601 - RNA, 17 nt, Salmonella enterica enterica serovar Typhi
auaccgcguuugcgcaa

SEQ ID NO: 1693602 - RNA, 18 nt, Salmonella enterica enterica serovar Typhi
auaccgccugaugagguu

SEQ ID NO: 1693603 - RNA, 15 nt, Salmonella enterica enterica serovar Typhi
auaccgccagcccca

SEQ ID NO: 1693604 - RNA, 14 nt, Salmonella enterica enterica serovar Typhi
auacaggcuuaaca

SEQ ID NO: 1693605 - RNA, 14 nt, Salmonella enterica enterica serovar Typhi
auacuggaaaaaac

SEQ ID NO: 1693606 - RNA, 13 nt, Salmonella enterica enterica serovar Typhi
auacugccgccgu

SEQ ID NO: 1693607 - RNA, 16 nt, Salmonella enterica enterica serovar Typhi
auacugccgcccaucg

SEQ ID NO: 1693608 - RNA, 14 nt, Salmonella enterica enterica serovar Typhi
auacucugcuuuuu

SEQ ID NO: 1693609 - RNA, 20 nt, Salmonella enterica enterica serovar Typhi
auacucugcuuuuucacccu

SEQ ID NO: 1693610 - RNA, 23 nt, Salmonella enterica enterica serovar Typhi
auacucagcgacguaaucuauuc

SEQ ID NO: 1693611 - RNA, 18 nt, Salmonella enterica enterica serovar Typhi
auacucacgaauaagaau

SEQ ID NO: 1693612 - RNA, 19 nt, Salmonella enterica enterica serovar Typhi
auacucagcgacguaaucu

SEQ ID NO: 1693613 - RNA, 15 nt, Salmonella enterica enterica serovar Typhi
auacuccacaguuca

SEQ ID NO: 1693614 - RNA, 16 nt, Salmonella enterica enterica serovar Typhi
auacgcgucagccuac

SEQ ID NO: 1693615 - RNA, 17 nt, Salmonella enterica enterica serovar Typhi
auacgcugcaccauuuu

SEQ ID NO: 1693616 - RNA, 13 nt, Salmonella enterica enterica serovar Typhi
auacgcugaagcu

SEQ ID NO: 1693617 - RNA, 15 nt, Salmonella enterica enterica serovar Typhi
auacgcugaagcuug

SEQ ID NO: 1693618 - RNA, 13 nt, Salmonella enterica enterica serovar Typhi
auacgcuuucuga

SEQ ID NO: 1693619 - RNA, 23 nt, Salmonella enterica enterica serovar Typhi
auacuacugguggaauaaauaua

SEQ ID NO: 1693620 - RNA, 15 nt, Salmonella enterica enterica serovar Typhi
auagcaaucauccug

SEQ ID NO: 1693621 - RNA, 18 nt, Salmonella enterica enterica serovar Typhi
auagcaacguccgcagcc

SEQ ID NO: 1693622 - RNA, 13 nt, Salmonella enterica enterica serovar Typhi
auagcaauuaaua

SEQ ID NO: 1693623 - RNA, 13 nt, Salmonella enterica enterica serovar Typhi
auagcaauuucag

SEQ ID NO: 1693624 - RNA, 14 nt, Salmonella enterica enterica serovar Typhi
auagcacacaaacg

SEQ ID NO: 1693625 - RNA, 16 nt, Salmonella enterica enterica serovar Typhi
auagcaucuuccucug

SEQ ID NO: 1693626 - RNA, 15 nt, Salmonella enterica enterica serovar Typhi
auagcauuaagcuga

SEQ ID NO: 1693627 - RNA, 22 nt, Salmonella enterica enterica serovar Typhi
auagcauggcguguaguaaugc

SEQ ID NO: 1693628 - RNA, 19 nt, Salmonella enterica enterica serovar Typhi
auagcauuaagcugauauu

SEQ ID NO: 1693629 - RNA, 16 nt, Salmonella enterica enterica serovar Typhi
auagcaggagauauag

SEQ ID NO: 1693630 - RNA, 13 nt, Salmonella enterica enterica serovar Typhi
auagcagcaaauu

SEQ ID NO: 1693631 - RNA, 15 nt, Salmonella enterica enterica serovar Typhi
auagcagcaaauuua

SEQ ID NO: 1693632 - RNA, 21 nt, Salmonella enterica enterica serovar Typhi
auagcgggcuuccuucuaccg

SEQ ID NO: 1693633 - RNA, 13 nt, Salmonella enterica enterica serovar Typhi
auagcgagaggca

SEQ ID NO: 1693634 - RNA, 13 nt, Salmonella enterica enterica serovar Typhi
auagcguuuucca

SEQ ID NO: 1693635 - RNA, 14 nt, Salmonella enterica enterica serovar Typhi
auagcuaaauaaaa

SEQ ID NO: 1693636 - RNA, 16 nt, Salmonella enterica enterica serovar Typhi
auagcuaaauaaaaau

SEQ ID NO: 1693637 - RNA, 16 nt, Salmonella enterica enterica serovar Typhi
auagcguugauaugcu

SEQ ID NO: 1693638 - RNA, 14 nt, Salmonella enterica enterica serovar Typhi
auagccagaaugcc

SEQ ID NO: 1693639 - RNA, 18 nt, Salmonella enterica enterica serovar Typhi
auagccagcccccugcca

SEQ ID NO: 1693640 - RNA, 20 nt, Salmonella enterica enterica serovar Typhi
auagccaacacauaagccac

SEQ ID NO: 1693641 - RNA, 13 nt, Salmonella enterica enterica serovar Typhi
auagccaaaagcu

SEQ ID NO: 1693642 - RNA, 19 nt, Salmonella enterica enterica serovar Typhi
auagccaguaauauaacca

SEQ ID NO: 1693643 - RNA, 22 nt, Salmonella enterica enterica serovar Typhi
auagccagccccagaaaauuaa

SEQ ID NO: 1693644 - RNA, 11 nt, Salmonella enterica enterica serovar Typhi
auagccaggca

SEQ ID NO: 1693645 - RNA, 21 nt, Salmonella enterica enterica serovar Typhi
auagccgguaacuuucccgcu

SEQ ID NO: 1693646 - RNA, 15 nt, Salmonella enterica enterica serovar Typhi
auagaugauaaucau

SEQ ID NO: 1693647 - RNA, 13 nt, Salmonella enterica enterica serovar Typhi
auagauuugauuc

SEQ ID NO: 1693648 - RNA, 20 nt, Salmonella enterica enterica serovar Typhi
auagauauaacccaguucaa

SEQ ID NO: 1693649 - RNA, 15 nt, Salmonella enterica enterica serovar Typhi
auagauaaguccuaa

SEQ ID NO: 1693650 - RNA, 17 nt, Salmonella enterica enterica serovar Typhi
auagaaaauauaugaca

SEQ ID NO: 1693651 - RNA, 18 nt, Salmonella enterica enterica serovar Typhi
auagacgccggucaugcc

SEQ ID NO: 1693652 - RNA, 16 nt, Salmonella enterica enterica serovar Typhi
auaguugagcagcgcg

SEQ ID NO: 1693653 - RNA, 21 nt, Salmonella enterica enterica serovar Typhi
auaguuucgacuuucauuucu

SEQ ID NO: 1693654 - RNA, 19 nt, Salmonella enterica enterica serovar Typhi
auaguuucgucgugaauua

SEQ ID NO: 1693655 - RNA, 15 nt, Salmonella enterica enterica serovar Typhi
auaguuugccagaga

SEQ ID NO: 1693656 - RNA, 18 nt, Salmonella enterica enterica serovar Typhi
auauaaaaagccagggaa

SEQ ID NO: 1693657 - RNA, 16 nt, Salmonella enterica enterica serovar Typhi
auaguuuuuaauucca

SEQ ID NO: 1693658 - RNA, 18 nt, Salmonella enterica enterica serovar Typhi
auaguuuuuaauuccacc

SEQ ID NO: 1693659 - RNA, 23 nt, Salmonella enterica enterica serovar Typhi
auaguggcgcgacgcgucaguga

SEQ ID NO: 1693660 - RNA, 19 nt, Salmonella enterica enterica serovar Typhi
auagucuuaauuugcuguu

SEQ ID NO: 1693661 - RNA, 23 nt, Salmonella enterica enterica serovar Typhi
auagucuuguuacucaauaaaag

SEQ ID NO: 1693662 - RNA, 20 nt, Salmonella enterica enterica serovar Typhi
auagugccggugacaugaaa

SEQ ID NO: 1693663 - RNA, 18 nt, Salmonella enterica enterica serovar Typhi
auagugagcgacuucaaa

SEQ ID NO: 1693664 - RNA, 14 nt, Salmonella enterica enterica serovar Typhi
auagugacuucugc

SEQ ID NO: 1693665 - RNA, 14 nt, Salmonella enterica enterica serovar Typhi
auagcugaacauac

SEQ ID NO: 1693666 - RNA, 14 nt, Salmonella enterica enterica serovar Typhi
auauaaucuaccau

SEQ ID NO: 1693667 - RNA, 15 nt, Salmonella enterica enterica serovar Typhi
auauaaggugucuau

SEQ ID NO: 1693668 - RNA, 16 nt, Salmonella enterica enterica serovar Typhi
auauaaggugucuaua

SEQ ID NO: 1693669 - RNA, 18 nt, Salmonella enterica enterica serovar Typhi
auauaaggaucggaagac

SEQ ID NO: 1693670 - RNA, 19 nt, Salmonella enterica enterica serovar Typhi
auauaagcgguauucaggu

SEQ ID NO: 1693671 - RNA, 12 nt, Salmonella enterica enterica serovar Typhi
auauagacuccg

SEQ ID NO: 1693672 - RNA, 21 nt, Salmonella enterica enterica serovar Typhi
auauauauuuucucaauuuua

SEQ ID NO: 1693673 - RNA, 21 nt, Salmonella enterica enterica serovar Typhi
auauaucgcaggaugcgcugc

SEQ ID NO: 1693674 - RNA, 18 nt, Salmonella enterica enterica serovar Typhi
auauaucgcgucaucaaa

SEQ ID NO: 1693675 - RNA, 19 nt, Salmonella enterica enterica serovar Typhi
auauaucgcgucaucaaac

SEQ ID NO: 1693676 - RNA, 20 nt, Salmonella enterica enterica serovar Typhi
auauaugaaccaagauaaga

SEQ ID NO: 1693677 - RNA, 12 nt, Salmonella enterica enterica serovar Typhi
auauacugucuu

SEQ ID NO: 1693678 - RNA, 19 nt, Salmonella enterica enterica serovar Typhi
auaucaggcaaaaaucguc

SEQ ID NO: 1693679 - RNA, 21 nt, Salmonella enterica enterica serovar Typhi
auauauuucacuucaucauca

SEQ ID NO: 1693680 - RNA, 21 nt, Salmonella enterica enterica serovar Typhi
auauaugacaacacucacaaa

SEQ ID NO: 1693681 - RNA, 13 nt, Salmonella enterica enterica serovar Typhi
auauccaguugcg

SEQ ID NO: 1693682 - RNA, 22 nt, Salmonella enterica enterica serovar Typhi
auaucaucgucauuaaugccua

SEQ ID NO: 1693683 - RNA, 17 nt, Salmonella enterica enterica serovar Typhi
auaucgauagcauuuuu

SEQ ID NO: 1693684 - RNA, 19 nt, Salmonella enterica enterica serovar Typhi
auaucccggcugacauaau

SEQ ID NO: 1693685 - RNA, 20 nt, Salmonella enterica enterica serovar Typhi
auaucccuauuagcacgccc

SEQ ID NO: 1693686 - RNA, 16 nt, Salmonella enterica enterica serovar Typhi
auauccccaucccaga

SEQ ID NO: 1693687 - RNA, 14 nt, Salmonella enterica enterica serovar Typhi
auaucggcugcugu

SEQ ID NO: 1693688 - RNA, 19 nt, Salmonella enterica enterica serovar Typhi
auaucgguaagcgccugcu

SEQ ID NO: 1693689 - RNA, 20 nt, Salmonella enterica enterica serovar Typhi
auaucgguucaauacccuuu

SEQ ID NO: 1693690 - RNA, 15 nt, Salmonella enterica enterica serovar Typhi
auaucgcuaaaccaa

SEQ ID NO: 1693691 - RNA, 15 nt, Salmonella enterica enterica serovar Typhi
auaucgccugcggca

SEQ ID NO: 1693692 - RNA, 17 nt, Salmonella enterica enterica serovar Typhi
auaucgccuggugugaa

SEQ ID NO: 1693693 - RNA, 19 nt, Salmonella enterica enterica serovar Typhi
auaucgccuugcugcggca

SEQ ID NO: 1693694 - RNA, 17 nt, Salmonella enterica enterica serovar Typhi
auaucgcgauaaacuga

SEQ ID NO: 1693695 - RNA, 11 nt, Salmonella enterica enterica serovar Typhi
auaucucuauu

SEQ ID NO: 1693696 - RNA, 20 nt, Salmonella enterica enterica serovar Typhi
auaucuguuucauggagauc

SEQ ID NO: 1693697 - RNA, 22 nt, Salmonella enterica enterica serovar Typhi
auaucuuccaggcuauccaaca

SEQ ID NO: 1693698 - RNA, 13 nt, Salmonella enterica enterica serovar Typhi
auaugaaccaaga

SEQ ID NO: 1693699 - RNA, 19 nt, Salmonella enterica enterica serovar Typhi
auaugauagaaguuaugca

SEQ ID NO: 1693700 - RNA, 21 nt, Salmonella enterica enterica serovar Typhi
auaugaucgaaaaugcgcaug

SEQ ID NO: 1693701 - RNA, 19 nt, Salmonella enterica enterica serovar Typhi
auaugaucugcgcaacauu

SEQ ID NO: 1693702 - RNA, 18 nt, Salmonella enterica enterica serovar Typhi
auaugacaacacucacaa

SEQ ID NO: 1693703 - RNA, 17 nt, Salmonella enterica enterica serovar Typhi
auaugaaucaucagaau

SEQ ID NO: 1693704 - RNA, 18 nt, Salmonella enterica enterica serovar Typhi
auaugaaucaucagaauc

SEQ ID NO: 1693705 - RNA, 14 nt, Salmonella enterica enterica serovar Typhi
auaugaauauacga

SEQ ID NO: 1693706 - RNA, 15 nt, Salmonella enterica enterica serovar Typhi
aucaucagggcgaaa

SEQ ID NO: 1693707 - RNA, 16 nt, Salmonella enterica enterica serovar Typhi
aucaucauaucccggc

SEQ ID NO: 1693708 - RNA, 23 nt, Salmonella enterica enterica serovar Typhi
aucaucaggguuauccuccagcc

SEQ ID NO: 1693709 - RNA, 14 nt, Salmonella enterica enterica serovar Typhi
aucaucaucggcac

SEQ ID NO: 1693710 - RNA, 18 nt, Salmonella enterica enterica serovar Typhi
aucaucaccguuuuccag

SEQ ID NO: 1693711 - RNA, 11 nt, Salmonella enterica enterica serovar Typhi
aucauauccuc

SEQ ID NO: 1693712 - RNA, 18 nt, Salmonella enterica enterica serovar Typhi
aucauauucgcagcucug

SEQ ID NO: 1693713 - RNA, 18 nt, Salmonella enterica enterica serovar Typhi
aucaucaaguaccgugaa

SEQ ID NO: 1693714 - RNA, 20 nt, Salmonella enterica enterica serovar Typhi
aaaacguugacuuaaaaagc

SEQ ID NO: 1693715 - RNA, 21 nt, Salmonella enterica enterica serovar Typhi
aaaacguuugcaaauagguuu

SEQ ID NO: 1693716 - RNA, 19 nt, Salmonella enterica enterica serovar Typhi
aucauccgggcauaaaaaa

SEQ ID NO: 1693717 - RNA, 20 nt, Salmonella enterica enterica serovar Typhi
aucauccgggcauaaaaaaa

SEQ ID NO: 1693718 - RNA, 23 nt, Salmonella enterica enterica serovar Typhi
aucauccuucgggcgauuuuugc

SEQ ID NO: 1693719 - RNA, 16 nt, Salmonella enterica enterica serovar Typhi
aucauccugauuuuac

SEQ ID NO: 1693720 - RNA, 22 nt, Salmonella enterica enterica serovar Typhi
aucaucgaggccaccaaaaauu

SEQ ID NO: 1693721 - RNA, 20 nt, Salmonella enterica enterica serovar Typhi
aucauccagucagcaauuaa

SEQ ID NO: 1693722 - RNA, 20 nt, Salmonella enterica enterica serovar Typhi
aucaucccgcccagcaacac

SEQ ID NO: 1693723 - RNA, 21 nt, Salmonella enterica enterica serovar Typhi
aucauccccguuuucgccgga

SEQ ID NO: 1693724 - RNA, 19 nt, Salmonella enterica enterica serovar Typhi
aucauccccaccgcugaug

SEQ ID NO: 1693725 - RNA, 20 nt, Salmonella enterica enterica serovar Typhi
aucauccccaccgcugaugg

SEQ ID NO: 1693726 - RNA, 17 nt, Salmonella enterica enterica serovar Typhi
aucaggcauguugcgca

SEQ ID NO: 1693727 - RNA, 13 nt, Salmonella enterica enterica serovar Typhi
aucaggacaucaa

SEQ ID NO: 1693728 - RNA, 22 nt, Salmonella enterica enterica serovar Typhi
aucaggaaauucucagaaacaa

SEQ ID NO: 1693729 - RNA, 13 nt, Salmonella enterica enterica serovar Typhi
aucaggcccagua

SEQ ID NO: 1693730 - RNA, 13 nt, Salmonella enterica enterica serovar Typhi
aucaggccugccu

SEQ ID NO: 1693731 - RNA, 14 nt, Salmonella enterica enterica serovar Typhi
aucaggccugccug

SEQ ID NO: 1693732 - RNA, 16 nt, Salmonella enterica enterica serovar Typhi
aucaggccuacaaggc

SEQ ID NO: 1693733 - RNA, 17 nt, Salmonella enterica enterica serovar Typhi
aucaggccuaccagccg

SEQ ID NO: 1693734 - RNA, 20 nt, Salmonella enterica enterica serovar Typhi
aucaggcgucagcauggugu

SEQ ID NO: 1693735 - RNA, 16 nt, Salmonella enterica enterica serovar Typhi
aucaggcgugaugacu

SEQ ID NO: 1693736 - RNA, 15 nt, Salmonella enterica enterica serovar Typhi
aucaggcguuacaga

SEQ ID NO: 1693737 - RNA, 21 nt, Salmonella enterica enterica serovar Typhi
aucaggcguugaccgcuucgc

SEQ ID NO: 1693738 - RNA, 20 nt, Salmonella enterica enterica serovar Typhi
aaaacgcccccugccagcgc

SEQ ID NO: 1693739 - RNA, 23 nt, Salmonella enterica enterica serovar Typhi
aaaacgcccccugccagcgcuga

SEQ ID NO: 1693740 - RNA, 15 nt, Salmonella enterica enterica serovar Typhi
aaaacgcgcaaaacu

SEQ ID NO: 1693741 - RNA, 21 nt, Salmonella enterica enterica serovar Typhi
aaaacgcguuagcguuuugaa

SEQ ID NO: 1693742 - RNA, 20 nt, Salmonella enterica enterica serovar Typhi
aucaguggggccuuuuuaau

SEQ ID NO: 1693743 - RNA, 14 nt, Salmonella enterica enterica serovar Typhi
aucauaaaaggcau

SEQ ID NO: 1693744 - RNA, 17 nt, Salmonella enterica enterica serovar Typhi
aucagugagaagggcag

SEQ ID NO: 1693745 - RNA, 19 nt, Salmonella enterica enterica serovar Typhi
aucagugcaucuucacugu

SEQ ID NO: 1693746 - RNA, 20 nt, Salmonella enterica enterica serovar Typhi
aucaguggcgccgcaaugcc

SEQ ID NO: 1693747 - RNA, 19 nt, Salmonella enterica enterica serovar Typhi
aucaguggcggcaaaaaau

SEQ ID NO: 1693748 - RNA, 19 nt, Salmonella enterica enterica serovar Typhi
aucauaguuuuuccccauc

SEQ ID NO: 1693749 - RNA, 14 nt, Salmonella enterica enterica serovar Typhi
aucauagcccugau

SEQ ID NO: 1693750 - RNA, 23 nt, Salmonella enterica enterica serovar Typhi
aucauagcccugauuaaagauaa

SEQ ID NO: 1693751 - RNA, 12 nt, Salmonella enterica enterica serovar Typhi
aucauaaaucga

SEQ ID NO: 1693752 - RNA, 14 nt, Salmonella enterica enterica serovar Typhi
aucagcaaaugaac

SEQ ID NO: 1693753 - RNA, 20 nt, Salmonella enterica enterica serovar Typhi
aucagcaaacgaccuuucgc

SEQ ID NO: 1693754 - RNA, 20 nt, Salmonella enterica enterica serovar Typhi
aucagcaaaauaccggcagc

SEQ ID NO: 1693755 - RNA, 22 nt, Salmonella enterica enterica serovar Typhi
aucagacgccgggccugcgccu

SEQ ID NO: 1693756 - RNA, 17 nt, Salmonella enterica enterica serovar Typhi
aucagaccuguaaaaaa

SEQ ID NO: 1693757 - RNA, 15 nt, Salmonella enterica enterica serovar Typhi
aucagacuaucuucg

SEQ ID NO: 1693758 - RNA, 14 nt, Salmonella enterica enterica serovar Typhi
aucagagacaaaua

SEQ ID NO: 1693759 - RNA, 18 nt, Salmonella enterica enterica serovar Typhi
aucagcgcguuuuccauc

SEQ ID NO: 1693760 - RNA, 14 nt, Salmonella enterica enterica serovar Typhi
aucagcgcgggaua

SEQ ID NO: 1693761 - RNA, 22 nt, Salmonella enterica enterica serovar Typhi
aucagcgcggcgugaucaaauu

SEQ ID NO: 1693762 - RNA, 14 nt, Salmonella enterica enterica serovar Typhi
aucagcgcgcucca

SEQ ID NO: 1693763 - RNA, 17 nt, Salmonella enterica enterica serovar Typhi
aucagcgcgcuccagac

SEQ ID NO: 1693764 - RNA, 18 nt, Salmonella enterica enterica serovar Typhi
aucagcgccaccacaaac

SEQ ID NO: 1693765 - RNA, 22 nt, Salmonella enterica enterica serovar Typhi
aucagcaucuuaugcgcaaaaa

SEQ ID NO: 1693766 - RNA, 15 nt, Salmonella enterica enterica serovar Typhi
aucagcaucccaccg

SEQ ID NO: 1693767 - RNA, 15 nt, Salmonella enterica enterica serovar Typhi
aucagcgccaccaca

SEQ ID NO: 1693768 - RNA, 17 nt, Salmonella enterica enterica serovar Typhi
aucagccauuaaccaga

SEQ ID NO: 1693769 - RNA, 13 nt, Salmonella enterica enterica serovar Typhi
aucagccauuaac

SEQ ID NO: 1693770 - RNA, 13 nt, Salmonella enterica enterica serovar Typhi
aucagccaggagu

SEQ ID NO: 1693771 - RNA, 19 nt, Salmonella enterica enterica serovar Typhi
aucagaaaaaagccaagca

SEQ ID NO: 1693772 - RNA, 14 nt, Salmonella enterica enterica serovar Typhi
aucagaaaaaauua

SEQ ID NO: 1693773 - RNA, 17 nt, Salmonella enterica enterica serovar Typhi
aucagaauuucgcccug

SEQ ID NO: 1693774 - RNA, 13 nt, Salmonella enterica enterica serovar Typhi
aucagaaaaaccu

SEQ ID NO: 1693775 - RNA, 23 nt, Salmonella enterica enterica serovar Typhi
aucagaauuucgcccuguauaca

SEQ ID NO: 1693776 - RNA, 13 nt, Salmonella enterica enterica serovar Typhi
aucagaccgacaa

SEQ ID NO: 1693777 - RNA, 16 nt, Salmonella enterica enterica serovar Typhi
aucagaccgacaaaac

SEQ ID NO: 1693778 - RNA, 20 nt, Salmonella enterica enterica serovar Typhi
aucagaccgagacccagcgc

SEQ ID NO: 1693779 - RNA, 16 nt, Salmonella enterica enterica serovar Typhi
aucagaccgauaaaua

SEQ ID NO: 1693780 - RNA, 18 nt, Salmonella enterica enterica serovar Typhi
aucacgcuggauaagacg

SEQ ID NO: 1693781 - RNA, 23 nt, Salmonella enterica enterica serovar Typhi
aucacgcccgcagcaauagaaua

SEQ ID NO: 1693782 - RNA, 19 nt, Salmonella enterica enterica serovar Typhi
aucacgcguaucuggucau

SEQ ID NO: 1693783 - RNA, 13 nt, Salmonella enterica enterica serovar Typhi
aucacgguaaacc

SEQ ID NO: 1693784 - RNA, 16 nt, Salmonella enterica enterica serovar Typhi
aucacgguaaaccugu

SEQ ID NO: 1693785 - RNA, 12 nt, Salmonella enterica enterica serovar Typhi
aucacuuccugu

SEQ ID NO: 1693786 - RNA, 15 nt, Salmonella enterica enterica serovar Typhi
aucacguccugauag

SEQ ID NO: 1693787 - RNA, 15 nt, Salmonella enterica enterica serovar Typhi
aucacguagccagag

SEQ ID NO: 1693788 - RNA, 17 nt, Salmonella enterica enterica serovar Typhi
aucacgcauaucccacu

SEQ ID NO: 1693789 - RNA, 17 nt, Salmonella enterica enterica serovar Typhi
aucacgccguccagcac

SEQ ID NO: 1693790 - RNA, 15 nt, Salmonella enterica enterica serovar Typhi
aucacgcccagcgcg

SEQ ID NO: 1693791 - RNA, 19 nt, Salmonella enterica enterica serovar Typhi
aucaauggugaauuugcug

SEQ ID NO: 1693792 - RNA, 21 nt, Salmonella enterica enterica serovar Typhi
aucaccgcggcaaccagccca

SEQ ID NO: 1693793 - RNA, 18 nt, Salmonella enterica enterica serovar Typhi
aucaccgccagucccagc

SEQ ID NO: 1693794 - RNA, 15 nt, Salmonella enterica enterica serovar Typhi
aucaccggcauuuca

SEQ ID NO: 1693795 - RNA, 17 nt, Salmonella enterica enterica serovar Typhi
aucaccggcauuucacc

SEQ ID NO: 1693796 - RNA, 14 nt, Salmonella enterica enterica serovar Typhi
aucaaacuucguua

SEQ ID NO: 1693797 - RNA, 19 nt, Salmonella enterica enterica serovar Typhi
aucaaacuuuuaaauugaa

SEQ ID NO: 1693798 - RNA, 23 nt, Salmonella enterica enterica serovar Typhi
aucaacagcggagagacauuggu

SEQ ID NO: 1693799 - RNA, 24 nt, Salmonella enterica enterica serovar Typhi
aucaaaccgauagcuaucacacau

SEQ ID NO: 1693800 - RNA, 20 nt, Salmonella enterica enterica serovar Typhi
aucaaacaggacuucucccu

SEQ ID NO: 1693801 - RNA, 15 nt, Salmonella enterica enterica serovar Typhi
aucaaaaucaucgcc

SEQ ID NO: 1693802 - RNA, 16 nt, Salmonella enterica enterica serovar Typhi
aucaaccggguaaacg

SEQ ID NO: 1693803 - RNA, 13 nt, Salmonella enterica enterica serovar Typhi
aucaagaugcuac

SEQ ID NO: 1693804 - RNA, 18 nt, Salmonella enterica enterica serovar Typhi
aucaaucaccucuucccc

SEQ ID NO: 1693805 - RNA, 13 nt, Salmonella enterica enterica serovar Typhi
aucaaucaccuua

SEQ ID NO: 1693806 - RNA, 20 nt, Salmonella enterica enterica serovar Typhi
aucaaugcgcguaauuugcg

SEQ ID NO: 1693807 - RNA, 12 nt, Salmonella enterica enterica serovar Typhi
aucaaugcccag

SEQ ID NO: 1693808 - RNA, 17 nt, Salmonella enterica enterica serovar Typhi
aucaaucgcuaucugac

SEQ ID NO: 1693809 - RNA, 15 nt, Salmonella enterica enterica serovar Typhi
aucaaucugcuuuuu

SEQ ID NO: 1693810 - RNA, 14 nt, Salmonella enterica enterica serovar Typhi
aucaauaaaauuau

SEQ ID NO: 1693811 - RNA, 20 nt, Salmonella enterica enterica serovar Typhi
aucaauaacgauaauuuuac

SEQ ID NO: 1693812 - RNA, 18 nt, Salmonella enterica enterica serovar Typhi
aucaauaagcgaauugcc

SEQ ID NO: 1693813 - RNA, 19 nt, Salmonella enterica enterica serovar Typhi
aucaauaaccgccagcagu

SEQ ID NO: 1693814 - RNA, 22 nt, Salmonella enterica enterica serovar Typhi
aucaagcgguagcguuauccag

SEQ ID NO: 1693815 - RNA, 15 nt, Salmonella enterica enterica serovar Typhi
aucaagcccauguuc

SEQ ID NO: 1693816 - RNA, 21 nt, Salmonella enterica enterica serovar Typhi
aucaagcagugacguggcuuc

SEQ ID NO: 1693817 - RNA, 20 nt, Salmonella enterica enterica serovar Typhi
aucaagcuuugcguaaaaaa

SEQ ID NO: 1693818 - RNA, 14 nt, Salmonella enterica enterica serovar Typhi
aucaaguacagcuu

SEQ ID NO: 1693819 - RNA, 18 nt, Salmonella enterica enterica serovar Typhi
auauuuauuugcauugua

SEQ ID NO: 1693820 - RNA, 22 nt, Salmonella enterica enterica serovar Typhi
auauuuauuugcauuguacuuu

SEQ ID NO: 1693821 - RNA, 15 nt, Salmonella enterica enterica serovar Typhi
auauuuaaaauucca

SEQ ID NO: 1693822 - RNA, 21 nt, Salmonella enterica enterica serovar Typhi
auauuguuuucuauuuucucc

SEQ ID NO: 1693823 - RNA, 23 nt, Salmonella enterica enterica serovar Typhi
auauugugccucuuuuuucgcca

SEQ ID NO: 1693824 - RNA, 16 nt, Salmonella enterica enterica serovar Typhi
auauugucgcccugca

SEQ ID NO: 1693825 - RNA, 13 nt, Salmonella enterica enterica serovar Typhi
auauugguagcau

SEQ ID NO: 1693826 - RNA, 20 nt, Salmonella enterica enterica serovar Typhi
auauuggcuucuuuaacuaa

SEQ ID NO: 1693827 - RNA, 20 nt, Salmonella enterica enterica serovar Typhi
auauuggcgaggaacaucag

SEQ ID NO: 1693828 - RNA, 21 nt, Salmonella enterica enterica serovar Typhi
auauuuuuaagguauugauuu

SEQ ID NO: 1693829 - RNA, 19 nt, Salmonella enterica enterica serovar Typhi
auauuuuguuuuaaauuca

SEQ ID NO: 1693830 - RNA, 11 nt, Salmonella enterica enterica serovar Typhi
auauuuugcug

SEQ ID NO: 1693831 - RNA, 12 nt, Salmonella enterica enterica serovar Typhi
auauuuucucaa

SEQ ID NO: 1693832 - RNA, 19 nt, Salmonella enterica enterica serovar Typhi
auauuuucucaauuuuaca

SEQ ID NO: 1693833 - RNA, 19 nt, Salmonella enterica enterica serovar Typhi
auauuuguuggaaaugcgu

SEQ ID NO: 1693834 - RNA, 22 nt, Salmonella enterica enterica serovar Typhi
auauucaacgaaugccugcaua

SEQ ID NO: 1693835 - RNA, 18 nt, Salmonella enterica enterica serovar Typhi
auaugcaggcauaaaaaa

SEQ ID NO: 1693836 - RNA, 14 nt, Salmonella enterica enterica serovar Typhi
auaugcaggcauaa

SEQ ID NO: 1693837 - RNA, 16 nt, Salmonella enterica enterica serovar Typhi
auaugauuuaaaaaag

SEQ ID NO: 1693838 - RNA, 16 nt, Salmonella enterica enterica serovar Typhi
auaugcagcagccagu

SEQ ID NO: 1693839 - RNA, 12 nt, Salmonella enterica enterica serovar Typhi
auaugaugcagg

SEQ ID NO: 1693840 - RNA, 14 nt, Salmonella enterica enterica serovar Typhi
auaugauuuaaaaa

SEQ ID NO: 1693841 - RNA, 22 nt, Salmonella enterica enterica serovar Typhi
auauucacuauaugccugccaa

SEQ ID NO: 1693842 - RNA, 14 nt, Salmonella enterica enterica serovar Typhi
auauucaccuguaa

SEQ ID NO: 1693843 - RNA, 11 nt, Salmonella enterica enterica serovar Typhi
auauuccagaa

SEQ ID NO: 1693844 - RNA, 21 nt, Salmonella enterica enterica serovar Typhi
auauucaugccagaagcaaau

SEQ ID NO: 1693845 - RNA, 18 nt, Salmonella enterica enterica serovar Typhi
auauugauggccacaucg

SEQ ID NO: 1693846 - RNA, 22 nt, Salmonella enterica enterica serovar Typhi
auauugcgacaacuagaauuuu

SEQ ID NO: 1693847 - RNA, 15 nt, Salmonella enterica enterica serovar Typhi
auauugcgccgcagc

SEQ ID NO: 1693848 - RNA, 22 nt, Salmonella enterica enterica serovar Typhi
auauucccguuccagcuugaau

SEQ ID NO: 1693849 - RNA, 19 nt, Salmonella enterica enterica serovar Typhi
auauugaccgcuuuuucca

SEQ ID NO: 1693850 - RNA, 15 nt, Salmonella enterica enterica serovar Typhi
auuaccauuccucac

SEQ ID NO: 1693851 - RNA, 15 nt, Salmonella enterica enterica serovar Typhi
auuacccaauaauga

SEQ ID NO: 1693852 - RNA, 17 nt, Salmonella enterica enterica serovar Typhi
auuacccaauaaugaac

SEQ ID NO: 1693853 - RNA, 20 nt, Salmonella enterica enterica serovar Typhi
auuacccaacaccagacuga

SEQ ID NO: 1693854 - RNA, 16 nt, Salmonella enterica enterica serovar Typhi
auuacagcguguucau

SEQ ID NO: 1693855 - RNA, 20 nt, Salmonella enterica enterica serovar Typhi
auuacaaaauaagucauauc

SEQ ID NO: 1693856 - RNA, 16 nt, Salmonella enterica enterica serovar Typhi
auuacaaaaugugcaa

SEQ ID NO: 1693857 - RNA, 21 nt, Salmonella enterica enterica serovar Typhi
auuacaaagggcaauauauua

SEQ ID NO: 1693858 - RNA, 21 nt, Salmonella enterica enterica serovar Typhi
auuacaaacaggcuuuauaca

SEQ ID NO: 1693859 - RNA, 14 nt, Salmonella enterica enterica serovar Typhi
auuacaaaaauaga

SEQ ID NO: 1693860 - RNA, 14 nt, Salmonella enterica enterica serovar Typhi
auuacaaaaaucau

SEQ ID NO: 1693861 - RNA, 13 nt, Salmonella enterica enterica serovar Typhi
auuacaagaaagu

SEQ ID NO: 1693862 - RNA, 23 nt, Salmonella enterica enterica serovar Typhi
auuacaacguucggucauggaua

SEQ ID NO: 1693863 - RNA, 16 nt, Salmonella enterica enterica serovar Typhi
auuacaaguaauaaaa

SEQ ID NO: 1693864 - RNA, 17 nt, Salmonella enterica enterica serovar Typhi
auuaauuuacugauaaa

SEQ ID NO: 1693865 - RNA, 18 nt, Salmonella enterica enterica serovar Typhi
auuaaugcuccaauaaau

SEQ ID NO: 1693866 - RNA, 19 nt, Salmonella enterica enterica serovar Typhi
auuaaugcuccaauaaaua

SEQ ID NO: 1693867 - RNA, 21 nt, Salmonella enterica enterica serovar Typhi
auuaaugcuccaauaaauauu

SEQ ID NO: 1693868 - RNA, 19 nt, Salmonella enterica enterica serovar Typhi
auuaauggcgcaauguccc

SEQ ID NO: 1693869 - RNA, 18 nt, Salmonella enterica enterica serovar Typhi
auuaaucccaacccgacc

SEQ ID NO: 1693870 - RNA, 18 nt, Salmonella enterica enterica serovar Typhi
auuaaucugugagcacag

SEQ ID NO: 1693871 - RNA, 15 nt, Salmonella enterica enterica serovar Typhi
auuaaugauuaaaau

SEQ ID NO: 1693872 - RNA, 17 nt, Salmonella enterica enterica serovar Typhi
auuaaugauuaaaauaa

SEQ ID NO: 1693873 - RNA, 18 nt, Salmonella enterica enterica serovar Typhi
auuaaugauuaaaauaaa

SEQ ID NO: 1693874 - RNA, 15 nt, Salmonella enterica enterica serovar Typhi
auuaaugauuugcuu

SEQ ID NO: 1693875 - RNA, 16 nt, Salmonella enterica enterica serovar Typhi
auuaaugauuugcuuu

SEQ ID NO: 1693876 - RNA, 18 nt, Salmonella enterica enterica serovar Typhi
aaaagcaucguaccuuca

SEQ ID NO: 1693877 - RNA, 18 nt, Salmonella enterica enterica serovar Typhi
aaaagccaagcacaaaaa

SEQ ID NO: 1693878 - RNA, 17 nt, Salmonella enterica enterica serovar Typhi
aaaagcagaggccugaa

SEQ ID NO: 1693879 - RNA, 21 nt, Salmonella enterica enterica serovar Typhi
aaaagcacaucagcaaaugaa

SEQ ID NO: 1693880 - RNA, 18 nt, Salmonella enterica enterica serovar Typhi
auuaauauuuaacacauu

SEQ ID NO: 1693881 - RNA, 16 nt, Salmonella enterica enterica serovar Typhi
auuaauauuuaacaca

SEQ ID NO: 1693882 - RNA, 14 nt, Salmonella enterica enterica serovar Typhi
auuaauaugcgcaa

SEQ ID NO: 1693883 - RNA, 12 nt, Salmonella enterica enterica serovar Typhi
auuaaguuuuuu

SEQ ID NO: 1693884 - RNA, 16 nt, Salmonella enterica enterica serovar Typhi
auuaaguuuuuuuaaa

SEQ ID NO: 1693885 - RNA, 23 nt, Salmonella enterica enterica serovar Typhi
auuaacacacaaucgguuaugcg

SEQ ID NO: 1693886 - RNA, 16 nt, Salmonella enterica enterica serovar Typhi
auuaacagucuaucgc

SEQ ID NO: 1693887 - RNA, 19 nt, Salmonella enterica enterica serovar Typhi
auuaacagucuaucgcugc

SEQ ID NO: 1693888 - RNA, 15 nt, Salmonella enterica enterica serovar Typhi
auuaacauuuaagaa

SEQ ID NO: 1693889 - RNA, 20 nt, Salmonella enterica enterica serovar Typhi
auuaacauuuaagaaacaau

SEQ ID NO: 1693890 - RNA, 22 nt, Salmonella enterica enterica serovar Typhi
auuaaauaaauaguaaauagaa

SEQ ID NO: 1693891 - RNA, 18 nt, Salmonella enterica enterica serovar Typhi
auuaaauaacaaaugaag

SEQ ID NO: 1693892 - RNA, 22 nt, Salmonella enterica enterica serovar Typhi
auuaaacagacaauaccagggc

SEQ ID NO: 1693893 - RNA, 17 nt, Salmonella enterica enterica serovar Typhi
auuaaaauaaaugaggc

SEQ ID NO: 1693894 - RNA, 18 nt, Salmonella enterica enterica serovar Typhi
auguuuuuaucagcuugc

SEQ ID NO: 1693895 - RNA, 14 nt, Salmonella enterica enterica serovar Typhi
auguuuuuguuguu

SEQ ID NO: 1693896 - RNA, 15 nt, Salmonella enterica enterica serovar Typhi
auguuuuuucaucuc

SEQ ID NO: 1693897 - RNA, 19 nt, Salmonella enterica enterica serovar Typhi
auuaaaaaaggcagaagaa

SEQ ID NO: 1693898 - RNA, 22 nt, Salmonella enterica enterica serovar Typhi
auguucaacgucagcuggaaug

SEQ ID NO: 1693899 - RNA, 19 nt, Salmonella enterica enterica serovar Typhi
auguucaguaggacaaaaa

SEQ ID NO: 1693900 - RNA, 20 nt, Salmonella enterica enterica serovar Typhi
auguccgccuaccagcacau

SEQ ID NO: 1693901 - RNA, 17 nt, Salmonella enterica enterica serovar Typhi
augucccgauauugguc

SEQ ID NO: 1693902 - RNA, 17 nt, Salmonella enterica enterica serovar Typhi
auguccaucucuuuacc

SEQ ID NO: 1693903 - RNA, 17 nt, Salmonella enterica enterica serovar Typhi
auguuggauuauacauu

SEQ ID NO: 1693904 - RNA, 17 nt, Salmonella enterica enterica serovar Typhi
auguugccggauagcuc

SEQ ID NO: 1693905 - RNA, 13 nt, Salmonella enterica enterica serovar Typhi
auguugcugcauc

SEQ ID NO: 1693906 - RNA, 14 nt, Salmonella enterica enterica serovar Typhi
auguugcugcugcg

SEQ ID NO: 1693907 - RNA, 18 nt, Salmonella enterica enterica serovar Typhi
auguuucgacaguuucuu

SEQ ID NO: 1693908 - RNA, 14 nt, Salmonella enterica enterica serovar Typhi
auguuguuugaaaa

SEQ ID NO: 1693909 - RNA, 21 nt, Salmonella enterica enterica serovar Typhi
auuacgcuauaaaguucccau

SEQ ID NO: 1693910 - RNA, 22 nt, Salmonella enterica enterica serovar Typhi
auuacgacugcacccaucuuua

SEQ ID NO: 1693911 - RNA, 16 nt, Salmonella enterica enterica serovar Typhi
auuacgcuauaaaguu

SEQ ID NO: 1693912 - RNA, 19 nt, Salmonella enterica enterica serovar Typhi
auuacgcuauaaaguuccc

SEQ ID NO: 1693913 - RNA, 18 nt, Salmonella enterica enterica serovar Typhi
auuacgaaaaggucuuuc

SEQ ID NO: 1693914 - RNA, 16 nt, Salmonella enterica enterica serovar Typhi
auuaccccgugguggg

SEQ ID NO: 1693915 - RNA, 13 nt, Salmonella enterica enterica serovar Typhi
aaaagcugauuaa

SEQ ID NO: 1693916 - RNA, 12 nt, Salmonella enterica enterica serovar Typhi
aaaagcugguau

SEQ ID NO: 1693917 - RNA, 22 nt, Salmonella enterica enterica serovar Typhi
aaaagcugguauugaauauuug

SEQ ID NO: 1693918 - RNA, 18 nt, Salmonella enterica enterica serovar Typhi
aaaagcuggugaaacguu

SEQ ID NO: 1693919 - RNA, 22 nt, Salmonella enterica enterica serovar Typhi
auuagcgacgcauacucuugga

SEQ ID NO: 1693920 - RNA, 13 nt, Salmonella enterica enterica serovar Typhi
auuagcuggcugc

SEQ ID NO: 1693921 - RNA, 16 nt, Salmonella enterica enterica serovar Typhi
auuauacauucgcuca

SEQ ID NO: 1693922 - RNA, 19 nt, Salmonella enterica enterica serovar Typhi
auuaggcguaauuauuaca

SEQ ID NO: 1693923 - RNA, 19 nt, Salmonella enterica enterica serovar Typhi
aaaagcugcgaucaaguuu

SEQ ID NO: 1693924 - RNA, 20 nt, Salmonella enterica enterica serovar Typhi
auuaucauaaugucccugcc

SEQ ID NO: 1693925 - RNA, 13 nt, Salmonella enterica enterica serovar Typhi
auuaucaggauga

SEQ ID NO: 1693926 - RNA, 12 nt, Salmonella enterica enterica serovar Typhi
auuaucaccauu

SEQ ID NO: 1693927 - RNA, 15 nt, Salmonella enterica enterica serovar Typhi
auuauauuuaaaauu

SEQ ID NO: 1693928 - RNA, 14 nt, Salmonella enterica enterica serovar Typhi
auuaucaaaaguga

SEQ ID NO: 1693929 - RNA, 15 nt, Salmonella enterica enterica serovar Typhi
auuaucaaaagugau

SEQ ID NO: 1693930 - RNA, 18 nt, Salmonella enterica enterica serovar Typhi
auuaucugauucaauuaa

SEQ ID NO: 1693931 - RNA, 23 nt, Salmonella enterica enterica serovar Typhi
auuauccagccgaaguucauaaa

SEQ ID NO: 1693932 - RNA, 13 nt, Salmonella enterica enterica serovar Typhi
auuaugccgacca

SEQ ID NO: 1693933 - RNA, 20 nt, Salmonella enterica enterica serovar Typhi
auuaugccgcacuccccaga

SEQ ID NO: 1693934 - RNA, 12 nt, Salmonella enterica enterica serovar Typhi
auuauuccccuc

SEQ ID NO: 1693935 - RNA, 17 nt, Salmonella enterica enterica serovar Typhi
auuaugaucgguuuuuu

SEQ ID NO: 1693936 - RNA, 18 nt, Salmonella enterica enterica serovar Typhi
auuaucuuuauugaaaag

SEQ ID NO: 1693937 - RNA, 19 nt, Salmonella enterica enterica serovar Typhi
auucacccaauaaauaaua

SEQ ID NO: 1693938 - RNA, 21 nt, Salmonella enterica enterica serovar Typhi
auucacccaauaaauaauauc

SEQ ID NO: 1693939 - RNA, 16 nt, Salmonella enterica enterica serovar Typhi
auucaccaaaaggcag

SEQ ID NO: 1693940 - RNA, 22 nt, Salmonella enterica enterica serovar Typhi
auucacacgcucacccaguuuu

SEQ ID NO: 1693941 - RNA, 18 nt, Salmonella enterica enterica serovar Typhi
auucacauauauuucugu

SEQ ID NO: 1693942 - RNA, 14 nt, Salmonella enterica enterica serovar Typhi
auucaccaaauccu

SEQ ID NO: 1693943 - RNA, 15 nt, Salmonella enterica enterica serovar Typhi
auucacaccuuuaua

SEQ ID NO: 1693944 - RNA, 18 nt, Salmonella enterica enterica serovar Typhi
auucacaccuuuauauuu

SEQ ID NO: 1693945 - RNA, 22 nt, Salmonella enterica enterica serovar Typhi
aaaaggcagauucuucugccuu

SEQ ID NO: 1693946 - RNA, 17 nt, Salmonella enterica enterica serovar Typhi
auucaaucuggugacga

SEQ ID NO: 1693947 - RNA, 18 nt, Salmonella enterica enterica serovar Typhi
auucaauucuggaaucaa

SEQ ID NO: 1693948 - RNA, 21 nt, Salmonella enterica enterica serovar Typhi
auucaauuagcgccuccccua

SEQ ID NO: 1693949 - RNA, 14 nt, Salmonella enterica enterica serovar Typhi
auuauugacauuca

SEQ ID NO: 1693950 - RNA, 13 nt, Salmonella enterica enterica serovar Typhi
auuauucugcuga

SEQ ID NO: 1693951 - RNA, 22 nt, Salmonella enterica enterica serovar Typhi
auucaacacauuccauuuuucg

SEQ ID NO: 1693952 - RNA, 15 nt, Salmonella enterica enterica serovar Typhi
auucaacgcaucaaa

SEQ ID NO: 1693953 - RNA, 17 nt, Salmonella enterica enterica serovar Typhi
auucaaccaguuaauuu

SEQ ID NO: 1693954 - RNA, 14 nt, Salmonella enterica enterica serovar Typhi
auucauaaaagauc

SEQ ID NO: 1693955 - RNA, 16 nt, Salmonella enterica enterica serovar Typhi
auucaggccgccagca

SEQ ID NO: 1693956 - RNA, 17 nt, Salmonella enterica enterica serovar Typhi
auucaggccgccagcaa

SEQ ID NO: 1693957 - RNA, 21 nt, Salmonella enterica enterica serovar Typhi
auucagggcuuuauuuuacaa

SEQ ID NO: 1693958 - RNA, 16 nt, Salmonella enterica enterica serovar Typhi
auucaguaagagggug

SEQ ID NO: 1693959 - RNA, 17 nt, Salmonella enterica enterica serovar Typhi
auucagguuaauaacug

SEQ ID NO: 1693960 - RNA, 20 nt, Salmonella enterica enterica serovar Typhi
auucagggcuuuauuuuaca

SEQ ID NO: 1693961 - RNA, 15 nt, Salmonella enterica enterica serovar Typhi
auucagggugcugau

SEQ ID NO: 1693962 - RNA, 17 nt, Salmonella enterica enterica serovar Typhi
auucagcacccagcgaa

SEQ ID NO: 1693963 - RNA, 15 nt, Salmonella enterica enterica serovar Typhi
auucagcaguucauu

SEQ ID NO: 1693964 - RNA, 16 nt, Salmonella enterica enterica serovar Typhi
auucagcaggaggcuu

SEQ ID NO: 1693965 - RNA, 12 nt, Salmonella enterica enterica serovar Typhi
auucagaaaguu

SEQ ID NO: 1693966 - RNA, 13 nt, Salmonella enterica enterica serovar Typhi
auucagagcgucc

SEQ ID NO: 1693967 - RNA, 23 nt, Salmonella enterica enterica serovar Typhi
auucagaccccugugauuuaugu

SEQ ID NO: 1693968 - RNA, 15 nt, Salmonella enterica enterica serovar Typhi
auucacguuccauuu

SEQ ID NO: 1693969 - RNA, 21 nt, Salmonella enterica enterica serovar Typhi
auucaccucccugcaacagca

SEQ ID NO: 1693970 - RNA, 18 nt, Salmonella enterica enterica serovar Typhi
auggcgacgacgcuguuu

SEQ ID NO: 1693971 - RNA, 15 nt, Salmonella enterica enterica serovar Typhi
auggcgacgaucagc

SEQ ID NO: 1693972 - RNA, 22 nt, Salmonella enterica enterica serovar Typhi
auggcgaucagcgccaccacaa

SEQ ID NO: 1693973 - RNA, 22 nt, Salmonella enterica enterica serovar Typhi
auggcgccagccauagcagcaa

SEQ ID NO: 1693974 - RNA, 19 nt, Salmonella enterica enterica serovar Typhi
auggcgcgaaaacagcugg

SEQ ID NO: 1693975 - RNA, 18 nt, Salmonella enterica enterica serovar Typhi
auggcgcgccacuucuuu

SEQ ID NO: 1693976 - RNA, 22 nt, Salmonella enterica enterica serovar Typhi
auggccaauguacguaaaacca

SEQ ID NO: 1693977 - RNA, 16 nt, Salmonella enterica enterica serovar Typhi
auggccagcaccagca

SEQ ID NO: 1693978 - RNA, 21 nt, Salmonella enterica enterica serovar Typhi
auggcaaaagacauccccgcc

SEQ ID NO: 1693979 - RNA, 22 nt, Salmonella enterica enterica serovar Typhi
auggauucaugguacucaacau

SEQ ID NO: 1693980 - RNA, 18 nt, Salmonella enterica enterica serovar Typhi
auggcaacaaagccugcu

SEQ ID NO: 1693981 - RNA, 21 nt, Salmonella enterica enterica serovar Typhi
auggcaaagucgaacgacuga

SEQ ID NO: 1693982 - RNA, 21 nt, Salmonella enterica enterica serovar Typhi
augcuggugaagacgcugcaa

SEQ ID NO: 1693983 - RNA, 21 nt, Salmonella enterica enterica serovar Typhi
augcugacggauucuuccucu

SEQ ID NO: 1693984 - RNA, 19 nt, Salmonella enterica enterica serovar Typhi
augcugacgcguuuuuuca

SEQ ID NO: 1693985 - RNA, 22 nt, Salmonella enterica enterica serovar Typhi
auggcggauuccaguagcgcgc

SEQ ID NO: 1693986 - RNA, 22 nt, Salmonella enterica enterica serovar Typhi
auggcgcugucggcgcccagcu

SEQ ID NO: 1693987 - RNA, 20 nt, Salmonella enterica enterica serovar Typhi
auggcggcggacaugguaau

SEQ ID NO: 1693988 - RNA, 16 nt, Salmonella enterica enterica serovar Typhi
auggcggcugcgccuu

SEQ ID NO: 1693989 - RNA, 20 nt, Salmonella enterica enterica serovar Typhi
auggcggucgccauauguuc

SEQ ID NO: 1693990 - RNA, 20 nt, Salmonella enterica enterica serovar Typhi
auggcgguauaacugccuua

SEQ ID NO: 1693991 - RNA, 21 nt, Salmonella enterica enterica serovar Typhi
auggcggcuuggcuguagaua

SEQ ID NO: 1693992 - RNA, 15 nt, Salmonella enterica enterica serovar Typhi
auggcgguauaacug

SEQ ID NO: 1693993 - RNA, 17 nt, Salmonella enterica enterica serovar Typhi
auggcgguuccggggaa

SEQ ID NO: 1693994 - RNA, 20 nt, Salmonella enterica enterica serovar Typhi
auggcuuucagauuagccag

SEQ ID NO: 1693995 - RNA, 18 nt, Salmonella enterica enterica serovar Typhi
auggcuuucagauuagcc

SEQ ID NO: 1693996 - RNA, 17 nt, Salmonella enterica enterica serovar Typhi
augggaggauacuguuu

SEQ ID NO: 1693997 - RNA, 18 nt, Salmonella enterica enterica serovar Typhi
augggauacgccagcaga

SEQ ID NO: 1693998 - RNA, 22 nt, Salmonella enterica enterica serovar Typhi
augggauaacgcagaagacaga

SEQ ID NO: 1693999 - RNA, 18 nt, Salmonella enterica enterica serovar Typhi
augggauagugccugccg

SEQ ID NO: 1694000 - RNA, 23 nt, Salmonella enterica enterica serovar Typhi
auggguaucgccuucgacuuccg

SEQ ID NO: 1694001 - RNA, 23 nt, Salmonella enterica enterica serovar Typhi
auggguaaaaauauggcgggccu

SEQ ID NO: 1694002 - RNA, 22 nt, Salmonella enterica enterica serovar Typhi
augggguuuguccugcagcgcc

SEQ ID NO: 1694003 - RNA, 12 nt, Salmonella enterica enterica serovar Typhi
augguauuuauu

SEQ ID NO: 1694004 - RNA, 13 nt, Salmonella enterica enterica serovar Typhi
auggucuuaaaug

SEQ ID NO: 1694005 - RNA, 16 nt, Salmonella enterica enterica serovar Typhi
auguaaaaaaauaaaa

SEQ ID NO: 1694006 - RNA, 13 nt, Salmonella enterica enterica serovar Typhi
auguaaaacaaga

SEQ ID NO: 1694007 - RNA, 22 nt, Salmonella enterica enterica serovar Typhi
augguuuugcccauuuccugca

SEQ ID NO: 1694008 - RNA, 15 nt, Salmonella enterica enterica serovar Typhi
auggucgguauuauc

SEQ ID NO: 1694009 - RNA, 20 nt, Salmonella enterica enterica serovar Typhi
auggucucguugccauuggu

SEQ ID NO: 1694010 - RNA, 21 nt, Salmonella enterica enterica serovar Typhi
auggucucguugccauugguu

SEQ ID NO: 1694011 - RNA, 21 nt, Salmonella enterica enterica serovar Typhi
auggucgcauggcuaaaagaa

SEQ ID NO: 1694012 - RNA, 16 nt, Salmonella enterica enterica serovar Typhi
auguaauucaccaaau

SEQ ID NO: 1694013 - RNA, 16 nt, Salmonella enterica enterica serovar Typhi
auguaaucugacagau

SEQ ID NO: 1694014 - RNA, 24 nt, Salmonella enterica enterica serovar Typhi
auguaagcgucuauuacacgauca

SEQ ID NO: 1694015 - RNA, 15 nt, Salmonella enterica enterica serovar Typhi
auguagcaaauuuca

SEQ ID NO: 1694016 - RNA, 13 nt, Salmonella enterica enterica serovar Typhi
auguagccagcca

SEQ ID NO: 1694017 - RNA, 20 nt, Salmonella enterica enterica serovar Typhi
auguaucgcgcuuacacaga

SEQ ID NO: 1694018 - RNA, 21 nt, Salmonella enterica enterica serovar Typhi
auguaguuguucuuuuuaugg

SEQ ID NO: 1694019 - RNA, 17 nt, Salmonella enterica enterica serovar Typhi
auguaucgcgcggauuc

SEQ ID NO: 1694020 - RNA, 14 nt, Salmonella enterica enterica serovar Typhi
aaaagauaaccauu

SEQ ID NO: 1694021 - RNA, 16 nt, Salmonella enterica enterica serovar Typhi
augucauauuugugag

SEQ ID NO: 1694022 - RNA, 16 nt, Salmonella enterica enterica serovar Typhi
augucauagcaaugau

SEQ ID NO: 1694023 - RNA, 14 nt, Salmonella enterica enterica serovar Typhi
augucauaauugcc

SEQ ID NO: 1694024 - RNA, 17 nt, Salmonella enterica enterica serovar Typhi
augucaggaucagauau

SEQ ID NO: 1694025 - RNA, 16 nt, Salmonella enterica enterica serovar Typhi
augucaguaauauauu

SEQ ID NO: 1694026 - RNA, 17 nt, Salmonella enterica enterica serovar Typhi
augucauucaggucuau

SEQ ID NO: 1694027 - RNA, 21 nt, Salmonella enterica enterica serovar Typhi
augucauucaggucuauugcc

SEQ ID NO: 1694028 - RNA, 17 nt, Salmonella enterica enterica serovar Typhi
augucaugacugguuuu

SEQ ID NO: 1694029 - RNA, 20 nt, Salmonella enterica enterica serovar Typhi
augucauccgguucacccac

SEQ ID NO: 1694030 - RNA, 15 nt, Salmonella enterica enterica serovar Typhi
auguauuucagacuu

SEQ ID NO: 1694031 - RNA, 14 nt, Salmonella enterica enterica serovar Typhi
augucaacuuaaac

SEQ ID NO: 1694032 - RNA, 21 nt, Salmonella enterica enterica serovar Typhi
augcgucggcaccauucccac

SEQ ID NO: 1694033 - RNA, 15 nt, Salmonella enterica enterica serovar Typhi
augcgguuaaaccag

SEQ ID NO: 1694034 - RNA, 21 nt, Salmonella enterica enterica serovar Typhi
augcggucguauuaccaaccc

SEQ ID NO: 1694035 - RNA, 20 nt, Salmonella enterica enterica serovar Typhi
augcguaauccggccuggcg

SEQ ID NO: 1694036 - RNA, 22 nt, Salmonella enterica enterica serovar Typhi
augcguauuuccaccuucucuu

SEQ ID NO: 1694037 - RNA, 15 nt, Salmonella enterica enterica serovar Typhi
augcguccgcccaga

SEQ ID NO: 1694038 - RNA, 18 nt, Salmonella enterica enterica serovar Typhi
augcgggcgaucggcugu

SEQ ID NO: 1694039 - RNA, 18 nt, Salmonella enterica enterica serovar Typhi
augcgggggcaguaaauu

SEQ ID NO: 1694040 - RNA, 17 nt, Salmonella enterica enterica serovar Typhi
augcgggguuugcagau

SEQ ID NO: 1694041 - RNA, 16 nt, Salmonella enterica enterica serovar Typhi
augcggcuuugcgccg

SEQ ID NO: 1694042 - RNA, 19 nt, Salmonella enterica enterica serovar Typhi
augcggcuuugcgccggca

SEQ ID NO: 1694043 - RNA, 20 nt, Salmonella enterica enterica serovar Typhi
augccgugaggcugaagcgc

SEQ ID NO: 1694044 - RNA, 18 nt, Salmonella enterica enterica serovar Typhi
augccguuuuaacgucau

SEQ ID NO: 1694045 - RNA, 24 nt, Salmonella enterica enterica serovar Typhi
augccuaaaccgacaauauucgcc

SEQ ID NO: 1694046 - RNA, 18 nt, Salmonella enterica enterica serovar Typhi
augcgcaguaggcaugca

SEQ ID NO: 1694047 - RNA, 16 nt, Salmonella enterica enterica serovar Typhi
augcgcuagcuggcag

SEQ ID NO: 1694048 - RNA, 15 nt, Salmonella enterica enterica serovar Typhi
augcgcugaauagcg

SEQ ID NO: 1694049 - RNA, 13 nt, Salmonella enterica enterica serovar Typhi
augcgcugggcac

SEQ ID NO: 1694050 - RNA, 17 nt, Salmonella enterica enterica serovar Typhi
augcgcugcacaaucgc

SEQ ID NO: 1694051 - RNA, 17 nt, Salmonella enterica enterica serovar Typhi
augcguuguaccguuuu

SEQ ID NO: 1694052 - RNA, 19 nt, Salmonella enterica enterica serovar Typhi
augcguuuuuaucuuucuu

SEQ ID NO: 1694053 - RNA, 13 nt, Salmonella enterica enterica serovar Typhi
augcuaaaacaga

SEQ ID NO: 1694054 - RNA, 16 nt, Salmonella enterica enterica serovar Typhi
aaaagagagcgccaaa

SEQ ID NO: 1694055 - RNA, 14 nt, Salmonella enterica enterica serovar Typhi
augcuauucagcag

SEQ ID NO: 1694056 - RNA, 19 nt, Salmonella enterica enterica serovar Typhi
augcuaucgcggauaagcc

SEQ ID NO: 1694057 - RNA, 22 nt, Salmonella enterica enterica serovar Typhi
augcuaucgguaguguuaucgc

SEQ ID NO: 1694058 - RNA, 23 nt, Salmonella enterica enterica serovar Typhi
augcuaucgguaguguuaucgcc

SEQ ID NO: 1694059 - RNA, 15 nt, Salmonella enterica enterica serovar Typhi
aaaagauaaaaaaau

SEQ ID NO: 1694060 - RNA, 13 nt, Salmonella enterica enterica serovar Typhi
augcuaucccagg

SEQ ID NO: 1694061 - RNA, 17 nt, Salmonella enterica enterica serovar Typhi
augcucauuuugauaaa

SEQ ID NO: 1694062 - RNA, 15 nt, Salmonella enterica enterica serovar Typhi
augcucauuauuugg

SEQ ID NO: 1694063 - RNA, 19 nt, Salmonella enterica enterica serovar Typhi
augcucaccgcgaauauac

SEQ ID NO: 1694064 - RNA, 15 nt, Salmonella enterica enterica serovar Typhi
augcucaggcaacac

SEQ ID NO: 1694065 - RNA, 17 nt, Salmonella enterica enterica serovar Typhi
augcacuacgaaaagag

SEQ ID NO: 1694066 - RNA, 18 nt, Salmonella enterica enterica serovar Typhi
augcacguuaaagccgac

SEQ ID NO: 1694067 - RNA, 13 nt, Salmonella enterica enterica serovar Typhi
augcacugcugau

SEQ ID NO: 1694068 - RNA, 23 nt, Salmonella enterica enterica serovar Typhi
augcagggauccuguaacaacug

SEQ ID NO: 1694069 - RNA, 18 nt, Salmonella enterica enterica serovar Typhi
augcaggcauaaaaaaga

SEQ ID NO: 1694070 - RNA, 16 nt, Salmonella enterica enterica serovar Typhi
augcaggcauaaaaaa

SEQ ID NO: 1694071 - RNA, 21 nt, Salmonella enterica enterica serovar Typhi
augaucguaugcagccaggcc

SEQ ID NO: 1694072 - RNA, 19 nt, Salmonella enterica enterica serovar Typhi
augaucguuuuuuguugau

SEQ ID NO: 1694073 - RNA, 17 nt, Salmonella enterica enterica serovar Typhi
augaucguuuccagcau

SEQ ID NO: 1694074 - RNA, 15 nt, Salmonella enterica enterica serovar Typhi
augaucgccucuucg

SEQ ID NO: 1694075 - RNA, 16 nt, Salmonella enterica enterica serovar Typhi
augcaccucuuuaugc

SEQ ID NO: 1694076 - RNA, 12 nt, Salmonella enterica enterica serovar Typhi
augcaccgccuu

SEQ ID NO: 1694077 - RNA, 16 nt, Salmonella enterica enterica serovar Typhi
augcaccgccuugccc

SEQ ID NO: 1694078 - RNA, 13 nt, Salmonella enterica enterica serovar Typhi
augcaucaugcua

SEQ ID NO: 1694079 - RNA, 15 nt, Salmonella enterica enterica serovar Typhi
augcauaugaaugau

SEQ ID NO: 1694080 - RNA, 15 nt, Salmonella enterica enterica serovar Typhi
augcauaugcacagc

SEQ ID NO: 1694081 - RNA, 16 nt, Salmonella enterica enterica serovar Typhi
augcaucuugaaugau

SEQ ID NO: 1694082 - RNA, 12 nt, Salmonella enterica enterica serovar Typhi
augcauugcuga

SEQ ID NO: 1694083 - RNA, 13 nt, Salmonella enterica enterica serovar Typhi
augcauaaaaaaa

SEQ ID NO: 1694084 - RNA, 23 nt, Salmonella enterica enterica serovar Typhi
augcaguucuucgccguuaucgg

SEQ ID NO: 1694085 - RNA, 17 nt, Salmonella enterica enterica serovar Typhi
augcaguucaucauccu

SEQ ID NO: 1694086 - RNA, 14 nt, Salmonella enterica enterica serovar Typhi
augcauaaaaaaac

SEQ ID NO: 1694087 - RNA, 15 nt, Salmonella enterica enterica serovar Typhi
augcagguucccgcc

SEQ ID NO: 1694088 - RNA, 16 nt, Salmonella enterica enterica serovar Typhi
augccacggcugaggc

SEQ ID NO: 1694089 - RNA, 16 nt, Salmonella enterica enterica serovar Typhi
augccagaagcaaauu

SEQ ID NO: 1694090 - RNA, 17 nt, Salmonella enterica enterica serovar Typhi
augccagaauugcacgc

SEQ ID NO: 1694091 - RNA, 13 nt, Salmonella enterica enterica serovar Typhi
augccacuguuca

SEQ ID NO: 1694092 - RNA, 12 nt, Salmonella enterica enterica serovar Typhi
augcauuugauu

SEQ ID NO: 1694093 - RNA, 14 nt, Salmonella enterica enterica serovar Typhi
augcauuugauuug

SEQ ID NO: 1694094 - RNA, 19 nt, Salmonella enterica enterica serovar Typhi
augccaaauagcacgugca

SEQ ID NO: 1694095 - RNA, 14 nt, Salmonella enterica enterica serovar Typhi
augcccauaaagaa

SEQ ID NO: 1694096 - RNA, 21 nt, Salmonella enterica enterica serovar Typhi
augcccaccugaaaaagggua

SEQ ID NO: 1694097 - RNA, 23 nt, Salmonella enterica enterica serovar Typhi
augcccaccggaccuaauagcca

SEQ ID NO: 1694098 - RNA, 17 nt, Salmonella enterica enterica serovar Typhi
augccccgacaucagau

SEQ ID NO: 1694099 - RNA, 17 nt, Salmonella enterica enterica serovar Typhi
augcccggaugauuauc

SEQ ID NO: 1694100 - RNA, 23 nt, Salmonella enterica enterica serovar Typhi
augcccggaugauuaucaucuau

SEQ ID NO: 1694101 - RNA, 19 nt, Salmonella enterica enterica serovar Typhi
augccgguuuuagcaauga

SEQ ID NO: 1694102 - RNA, 17 nt, Salmonella enterica enterica serovar Typhi
augccgggugcggcgcu

SEQ ID NO: 1694103 - RNA, 22 nt, Salmonella enterica enterica serovar Typhi
auuuagcuauuccaaaauaaua

SEQ ID NO: 1694104 - RNA, 23 nt, Salmonella enterica enterica serovar Typhi
auuuagcuauuccaaaauaauaa

SEQ ID NO: 1694105 - RNA, 15 nt, Salmonella enterica enterica serovar Typhi
auuuacgcagcccca

SEQ ID NO: 1694106 - RNA, 21 nt, Salmonella enterica enterica serovar Typhi
auuuacgccaacgagaauaag

SEQ ID NO: 1694107 - RNA, 15 nt, Salmonella enterica enterica serovar Typhi
auuuacuccaaaaau

SEQ ID NO: 1694108 - RNA, 14 nt, Salmonella enterica enterica serovar Typhi
auuuacugaauaaa

SEQ ID NO: 1694109 - RNA, 16 nt, Salmonella enterica enterica serovar Typhi
auuuacugaauaaaua

SEQ ID NO: 1694110 - RNA, 22 nt, Salmonella enterica enterica serovar Typhi
auuuacaaaaaagauaaccauu

SEQ ID NO: 1694111 - RNA, 21 nt, Salmonella enterica enterica serovar Typhi
auuguggaucagacgccgcgc

SEQ ID NO: 1694112 - RNA, 15 nt, Salmonella enterica enterica serovar Typhi
auuguuuggugcuga

SEQ ID NO: 1694113 - RNA, 18 nt, Salmonella enterica enterica serovar Typhi
auugugagaaaagcagag

SEQ ID NO: 1694114 - RNA, 16 nt, Salmonella enterica enterica serovar Typhi
auugugagaaaagcag

SEQ ID NO: 1694115 - RNA, 15 nt, Salmonella enterica enterica serovar Typhi
auugugaaccauggc

SEQ ID NO: 1694116 - RNA, 17 nt, Salmonella enterica enterica serovar Typhi
auugucuuaaauaugaa

SEQ ID NO: 1694117 - RNA, 15 nt, Salmonella enterica enterica serovar Typhi
auugucuuauuauua

SEQ ID NO: 1694118 - RNA, 13 nt, Salmonella enterica enterica serovar Typhi
auuguuuuacuuu

SEQ ID NO: 1694119 - RNA, 19 nt, Salmonella enterica enterica serovar Typhi
auuguuuuacuuuuuuaaa

SEQ ID NO: 1694120 - RNA, 13 nt, Salmonella enterica enterica serovar Typhi
auuguuuucuauu

SEQ ID NO: 1694121 - RNA, 19 nt, Salmonella enterica enterica serovar Typhi
auuuaagccagauguaauc

SEQ ID NO: 1694122 - RNA, 21 nt, Salmonella enterica enterica serovar Typhi
auuuaagccagacgcgcagca

SEQ ID NO: 1694123 - RNA, 13 nt, Salmonella enterica enterica serovar Typhi
auuuaauguuuca

SEQ ID NO: 1694124 - RNA, 17 nt, Salmonella enterica enterica serovar Typhi
auuuaauggucuuaaau

SEQ ID NO: 1694125 - RNA, 13 nt, Salmonella enterica enterica serovar Typhi
auuggcaccacca

SEQ ID NO: 1694126 - RNA, 20 nt, Salmonella enterica enterica serovar Typhi
auuggcacgaaaguguggca

SEQ ID NO: 1694127 - RNA, 20 nt, Salmonella enterica enterica serovar Typhi
auuggcaaaccccugcucgc

SEQ ID NO: 1694128 - RNA, 11 nt, Salmonella enterica enterica serovar Typhi
auuggcaucug

SEQ ID NO: 1694129 - RNA, 14 nt, Salmonella enterica enterica serovar Typhi
auuggcaucauaaa

SEQ ID NO: 1694130 - RNA, 13 nt, Salmonella enterica enterica serovar Typhi
auuggccccuggc

SEQ ID NO: 1694131 - RNA, 15 nt, Salmonella enterica enterica serovar Typhi
auuggccccuggccg

SEQ ID NO: 1694132 - RNA, 14 nt, Salmonella enterica enterica serovar Typhi
auugucaaaaauag

SEQ ID NO: 1694133 - RNA, 21 nt, Salmonella enterica enterica serovar Typhi
auugucagcucuuuguuuagc

SEQ ID NO: 1694134 - RNA, 18 nt, Salmonella enterica enterica serovar Typhi
auugucaccguaauauaa

SEQ ID NO: 1694135 - RNA, 21 nt, Salmonella enterica enterica serovar Typhi
aaaaggucgacauuuaaugag

SEQ ID NO: 1694136 - RNA, 14 nt, Salmonella enterica enterica serovar Typhi
auugcuuuuuucca

SEQ ID NO: 1694137 - RNA, 17 nt, Salmonella enterica enterica serovar Typhi
auuggaaaaccccaucc

SEQ ID NO: 1694138 - RNA, 22 nt, Salmonella enterica enterica serovar Typhi
auugcuucguggcaaucagcaa

SEQ ID NO: 1694139 - RNA, 19 nt, Salmonella enterica enterica serovar Typhi
auugcugacgcgcuuuuuc

SEQ ID NO: 1694140 - RNA, 22 nt, Salmonella enterica enterica serovar Typhi
auugcucuuccggcauaaaaag

SEQ ID NO: 1694141 - RNA, 15 nt, Salmonella enterica enterica serovar Typhi
auugcugaagauaaa

SEQ ID NO: 1694142 - RNA, 16 nt, Salmonella enterica enterica serovar Typhi
auugcugaagauaaaa

SEQ ID NO: 1694143 - RNA, 22 nt, Salmonella enterica enterica serovar Typhi
auugcugacaaaauaaagugaa

SEQ ID NO: 1694144 - RNA, 20 nt, Salmonella enterica enterica serovar Typhi
auugauauagaguccagcca

SEQ ID NO: 1694145 - RNA, 16 nt, Salmonella enterica enterica serovar Typhi
auugauaauaaccguc

SEQ ID NO: 1694146 - RNA, 15 nt, Salmonella enterica enterica serovar Typhi
auugcgagaaaaaac

SEQ ID NO: 1694147 - RNA, 14 nt, Salmonella enterica enterica serovar Typhi
auugcgccaccuua

SEQ ID NO: 1694148 - RNA, 12 nt, Salmonella enterica enterica serovar Typhi
auugauucugug

SEQ ID NO: 1694149 - RNA, 14 nt, Salmonella enterica enterica serovar Typhi
auugauucugugau

SEQ ID NO: 1694150 - RNA, 16 nt, Salmonella enterica enterica serovar Typhi
auugacccucccugcg

SEQ ID NO: 1694151 - RNA, 17 nt, Salmonella enterica enterica serovar Typhi
auugaccgcuuuuucca

SEQ ID NO: 1694152 - RNA, 20 nt, Salmonella enterica enterica serovar Typhi
auugaccguccccagccaga

SEQ ID NO: 1694153 - RNA, 13 nt, Salmonella enterica enterica serovar Typhi
auugaccuucaug

SEQ ID NO: 1694154 - RNA, 18 nt, Salmonella enterica enterica serovar Typhi
auugacgggaaaucuccc

SEQ ID NO: 1694155 - RNA, 16 nt, Salmonella enterica enterica serovar Typhi
auugacgguaaaguaa

SEQ ID NO: 1694156 - RNA, 14 nt, Salmonella enterica enterica serovar Typhi
auugaccaggagca

SEQ ID NO: 1694157 - RNA, 23 nt, Salmonella enterica enterica serovar Typhi
auugaauauuugcgcaguuuaaa

SEQ ID NO: 1694158 - RNA, 22 nt, Salmonella enterica enterica serovar Typhi
auugaauaugguggucggcaau

SEQ ID NO: 1694159 - RNA, 15 nt, Salmonella enterica enterica serovar Typhi
auugacuuucagagc

SEQ ID NO: 1694160 - RNA, 20 nt, Salmonella enterica enterica serovar Typhi
auugagguauaggaaaauga

SEQ ID NO: 1694161 - RNA, 15 nt, Salmonella enterica enterica serovar Typhi
auugaggcuacccag

SEQ ID NO: 1694162 - RNA, 16 nt, Salmonella enterica enterica serovar Typhi
auugaggcuacccaga

SEQ ID NO: 1694163 - RNA, 19 nt, Salmonella enterica enterica serovar Typhi
auugaggcggguaauuugc

SEQ ID NO: 1694164 - RNA, 20 nt, Salmonella enterica enterica serovar Typhi
auugaggcggguaauuugcg

SEQ ID NO: 1694165 - RNA, 17 nt, Salmonella enterica enterica serovar Typhi
auucucccaaauuuuuu

SEQ ID NO: 1694166 - RNA, 20 nt, Salmonella enterica enterica serovar Typhi
auucucagccagguauuuag

SEQ ID NO: 1694167 - RNA, 20 nt, Salmonella enterica enterica serovar Typhi
auucuuaacccacaagaaau

SEQ ID NO: 1694168 - RNA, 17 nt, Salmonella enterica enterica serovar Typhi
auucuguuugucuuuau

SEQ ID NO: 1694169 - RNA, 22 nt, Salmonella enterica enterica serovar Typhi
auucugugaugaugcguuuguu

SEQ ID NO: 1694170 - RNA, 21 nt, Salmonella enterica enterica serovar Typhi
auucucccuacugcuuagcuc

SEQ ID NO: 1694171 - RNA, 21 nt, Salmonella enterica enterica serovar Typhi
auugaacgcuggcggcaggcc

SEQ ID NO: 1694172 - RNA, 14 nt, Salmonella enterica enterica serovar Typhi
auugaacauuuuuu

SEQ ID NO: 1694173 - RNA, 18 nt, Salmonella enterica enterica serovar Typhi
auugaaauuaaucaggca

SEQ ID NO: 1694174 - RNA, 19 nt, Salmonella enterica enterica serovar Typhi
auucuuuuacgaucgccac

SEQ ID NO: 1694175 - RNA, 23 nt, Salmonella enterica enterica serovar Typhi
auucgggacaaacccccagccau

SEQ ID NO: 1694176 - RNA, 22 nt, Salmonella enterica enterica serovar Typhi
auucuacaguuugucaucaguc

SEQ ID NO: 1694177 - RNA, 15 nt, Salmonella enterica enterica serovar Typhi
auucgccguucuguu

SEQ ID NO: 1694178 - RNA, 14 nt, Salmonella enterica enterica serovar Typhi
auucggcccugcgc

SEQ ID NO: 1694179 - RNA, 22 nt, Salmonella enterica enterica serovar Typhi
auucggcgcuucgcagcgauau

SEQ ID NO: 1694180 - RNA, 17 nt, Salmonella enterica enterica serovar Typhi
auucgguaguuccagaa

SEQ ID NO: 1694181 - RNA, 13 nt, Salmonella enterica enterica serovar Typhi
auucgcccggcag

SEQ ID NO: 1694182 - RNA, 19 nt, Salmonella enterica enterica serovar Typhi
auucgcagcagacguucgc

SEQ ID NO: 1694183 - RNA, 16 nt, Salmonella enterica enterica serovar Typhi
auucgccaccaggcuc

SEQ ID NO: 1694184 - RNA, 18 nt, Salmonella enterica enterica serovar Typhi
auucgaucuguguacuuu

SEQ ID NO: 1694185 - RNA, 19 nt, Salmonella enterica enterica serovar Typhi
auucgacaguucccggcaa

SEQ ID NO: 1694186 - RNA, 20 nt, Salmonella enterica enterica serovar Typhi
auuccuggcguaugcuuuca

SEQ ID NO: 1694187 - RNA, 14 nt, Salmonella enterica enterica serovar Typhi
auuccugccgccgc

SEQ ID NO: 1694188 - RNA, 14 nt, Salmonella enterica enterica serovar Typhi
auuccugacugcgc

SEQ ID NO: 1694189 - RNA, 14 nt, Salmonella enterica enterica serovar Typhi
auuccugaguuuau

SEQ ID NO: 1694190 - RNA, 15 nt, Salmonella enterica enterica serovar Typhi
auuccgcagaagccg

SEQ ID NO: 1694191 - RNA, 15 nt, Salmonella enterica enterica serovar Typhi
auuccgaugaaaaac

SEQ ID NO: 1694192 - RNA, 23 nt, Salmonella enterica enterica serovar Typhi
auuccgcguguuuguaaaaauag

SEQ ID NO: 1694193 - RNA, 14 nt, Salmonella enterica enterica serovar Typhi
auuccgccugcugu

SEQ ID NO: 1694194 - RNA, 16 nt, Salmonella enterica enterica serovar Typhi
auuccccguccugaau

SEQ ID NO: 1694195 - RNA, 13 nt, Salmonella enterica enterica serovar Typhi
auucccccugcgu

SEQ ID NO: 1694196 - RNA, 22 nt, Salmonella enterica enterica serovar Typhi
auuccgaaagaaagacgcugaa

SEQ ID NO: 1694197 - RNA, 16 nt, Salmonella enterica enterica serovar Typhi
auuccgcuuccagaau

SEQ ID NO: 1694198 - RNA, 22 nt, Salmonella enterica enterica serovar Typhi
auuccgcuuccagaauucguac

SEQ ID NO: 1694199 - RNA, 16 nt, Salmonella enterica enterica serovar Typhi
auuccgcuucuuccau

SEQ ID NO: 1694200 - RNA, 23 nt, Salmonella enterica enterica serovar Typhi
auuccggcacucugcgccagguu

SEQ ID NO: 1694201 - RNA, 13 nt, Salmonella enterica enterica serovar Typhi
auuccggcacaac

SEQ ID NO: 1694202 - RNA, 14 nt, Salmonella enterica enterica serovar Typhi
auuccggcgcuggc

SEQ ID NO: 1694203 - RNA, 20 nt, Salmonella enterica enterica serovar Typhi
auuccggcaucguacgggca

SEQ ID NO: 1694204 - RNA, 16 nt, Salmonella enterica enterica serovar Typhi
auuccugacgcacagu

SEQ ID NO: 1694205 - RNA, 19 nt, Salmonella enterica enterica serovar Typhi
auuccugacauuuauauua

SEQ ID NO: 1694206 - RNA, 17 nt, Salmonella enterica enterica serovar Typhi
auucauaacaccaauac

SEQ ID NO: 1694207 - RNA, 14 nt, Salmonella enterica enterica serovar Typhi
auuccagaaaggau

SEQ ID NO: 1694208 - RNA, 21 nt, Salmonella enterica enterica serovar Typhi
auuccagaagcgcuuugccaa

SEQ ID NO: 1694209 - RNA, 15 nt, Salmonella enterica enterica serovar Typhi
auuccagaaucuggc

SEQ ID NO: 1694210 - RNA, 24 nt, Salmonella enterica enterica serovar Typhi
auucauagagcgcguccagacguu

SEQ ID NO: 1694211 - RNA, 22 nt, Salmonella enterica enterica serovar Typhi
auuccagccgguguuaaccaga

SEQ ID NO: 1694212 - RNA, 17 nt, Salmonella enterica enterica serovar Typhi
auuccccaccaggaaug

SEQ ID NO: 1694213 - RNA, 22 nt, Salmonella enterica enterica serovar Typhi
auucccaguaaccuauuuuaca

SEQ ID NO: 1694214 - RNA, 16 nt, Salmonella enterica enterica serovar Typhi
auucccauuccugcaa

SEQ ID NO: 1694215 - RNA, 12 nt, Salmonella enterica enterica serovar Typhi
auucccaggcaa

SEQ ID NO: 1694216 - RNA, 18 nt, Salmonella enterica enterica serovar Typhi
auuccagggcauuuuuuc

SEQ ID NO: 1694217 - RNA, 12 nt, Salmonella enterica enterica serovar Typhi
auuccagucauu

SEQ ID NO: 1694218 - RNA, 17 nt, Salmonella enterica enterica serovar Typhi
auuuucuucuggccauu

SEQ ID NO: 1694219 - RNA, 15 nt, Salmonella enterica enterica serovar Typhi
auuuucuuucaucaa

SEQ ID NO: 1694220 - RNA, 17 nt, Salmonella enterica enterica serovar Typhi
auuuucuuucaucaaac

SEQ ID NO: 1694221 - RNA, 20 nt, Salmonella enterica enterica serovar Typhi
auuuucuuucaucaaacgga

SEQ ID NO: 1694222 - RNA, 16 nt, Salmonella enterica enterica serovar Typhi
auuuugauacucauca

SEQ ID NO: 1694223 - RNA, 21 nt, Salmonella enterica enterica serovar Typhi
auuuugcacuuuugccaggcg

SEQ ID NO: 1694224 - RNA, 19 nt, Salmonella enterica enterica serovar Typhi
auuuuuaccgcauuauaaa

SEQ ID NO: 1694225 - RNA, 14 nt, Salmonella enterica enterica serovar Typhi
auuuuuaauugcug

SEQ ID NO: 1694226 - RNA, 15 nt, Salmonella enterica enterica serovar Typhi
auuuugcgguuuuaa

SEQ ID NO: 1694227 - RNA, 17 nt, Salmonella enterica enterica serovar Typhi
auuuugcgguuuuaauu

SEQ ID NO: 1694228 - RNA, 20 nt, Salmonella enterica enterica serovar Typhi
auuuugguuacuauuuuuca

SEQ ID NO: 1694229 - RNA, 21 nt, Salmonella enterica enterica serovar Typhi
auuuuguaguuguuuuaugug

SEQ ID NO: 1694230 - RNA, 21 nt, Salmonella enterica enterica serovar Typhi
auuuuauggaggauauaaaaa

SEQ ID NO: 1694231 - RNA, 16 nt, Salmonella enterica enterica serovar Typhi
auuuuaugaugcauuu

SEQ ID NO: 1694232 - RNA, 14 nt, Salmonella enterica enterica serovar Typhi
auuuuauuuaaaaa

SEQ ID NO: 1694233 - RNA, 14 nt, Salmonella enterica enterica serovar Typhi
auuuucaccuggau

SEQ ID NO: 1694234 - RNA, 21 nt, Salmonella enterica enterica serovar Typhi
auuuucaccuggaugcugccu

SEQ ID NO: 1694235 - RNA, 22 nt, Salmonella enterica enterica serovar Typhi
auuuucacgccauugccaggac

SEQ ID NO: 1694236 - RNA, 16 nt, Salmonella enterica enterica serovar Typhi
auuuuccugaaaaaau

SEQ ID NO: 1694237 - RNA, 18 nt, Salmonella enterica enterica serovar Typhi
auuuucuuauuacaagaa

SEQ ID NO: 1694238 - RNA, 16 nt, Salmonella enterica enterica serovar Typhi
auuuucuguaauucuc

SEQ ID NO: 1694239 - RNA, 20 nt, Salmonella enterica enterica serovar Typhi
auuuucucguguagccagua

SEQ ID NO: 1694240 - RNA, 22 nt, Salmonella enterica enterica serovar Typhi
auuuuccaugccuuuauuucaa

SEQ ID NO: 1694241 - RNA, 20 nt, Salmonella enterica enterica serovar Typhi
auuuucagcuucagucauaa

SEQ ID NO: 1694242 - RNA, 20 nt, Salmonella enterica enterica serovar Typhi
caaaaauauggucgaaaaua

SEQ ID NO: 1694243 - RNA, 18 nt, Salmonella enterica enterica serovar Typhi
caaaaauagcauuaagcu

SEQ ID NO: 1694244 - RNA, 14 nt, Salmonella enterica enterica serovar Typhi
caaaaaucaccaca

SEQ ID NO: 1694245 - RNA, 12 nt, Salmonella enterica enterica serovar Typhi
caaaaauaauuc

SEQ ID NO: 1694246 - RNA, 23 nt, Salmonella enterica enterica serovar Typhi
caaaaauggcuucggcaauuucc

SEQ ID NO: 1694247 - RNA, 21 nt, Salmonella enterica enterica serovar Typhi
caaaaauuucgaccucuucgu

SEQ ID NO: 1694248 - RNA, 21 nt, Salmonella enterica enterica serovar Typhi
caaaaauauggucgaaaauau

SEQ ID NO: 1694249 - RNA, 14 nt, Salmonella enterica enterica serovar Typhi
caaaaauccuucuu

SEQ ID NO: 1694250 - RNA, 16 nt, Salmonella enterica enterica serovar Typhi
caaaaaucgucaucag

SEQ ID NO: 1694251 - RNA, 20 nt, Salmonella enterica enterica serovar Typhi
caaaaaucgucaucagauag

SEQ ID NO: 1694252 - RNA, 21 nt, Salmonella enterica enterica serovar Typhi
caaaacaccgcucaauaucau

SEQ ID NO: 1694253 - RNA, 15 nt, Salmonella enterica enterica serovar Typhi
caaaacaacaaagua

SEQ ID NO: 1694254 - RNA, 15 nt, Salmonella enterica enterica serovar Typhi
auuuuuugucuguau

SEQ ID NO: 1694255 - RNA, 13 nt, Salmonella enterica enterica serovar Typhi
auuuuuuuacauu

SEQ ID NO: 1694256 - RNA, 15 nt, Salmonella enterica enterica serovar Typhi
auuuuuuucagccuu

SEQ ID NO: 1694257 - RNA, 13 nt, Salmonella enterica enterica serovar Typhi
caaaaaagagaag

SEQ ID NO: 1694258 - RNA, 16 nt, Salmonella enterica enterica serovar Typhi
caaaaaagcaguauau

SEQ ID NO: 1694259 - RNA, 21 nt, Salmonella enterica enterica serovar Typhi
auuuuuugacaacaaaaagau

SEQ ID NO: 1694260 - RNA, 17 nt, Salmonella enterica enterica serovar Typhi
auuuuuauucccgccgc

SEQ ID NO: 1694261 - RNA, 14 nt, Salmonella enterica enterica serovar Typhi
auuuuugccauuau

SEQ ID NO: 1694262 - RNA, 17 nt, Salmonella enterica enterica serovar Typhi
auuuuuaugucauuuau

SEQ ID NO: 1694263 - RNA, 16 nt, Salmonella enterica enterica serovar Typhi
auuuguacuucagagc

SEQ ID NO: 1694264 - RNA, 16 nt, Salmonella enterica enterica serovar Typhi
auuugugagauaaaaa

SEQ ID NO: 1694265 - RNA, 19 nt, Salmonella enterica enterica serovar Typhi
auuugugauugcagauaau

SEQ ID NO: 1694266 - RNA, 22 nt, Salmonella enterica enterica serovar Typhi
auuugugagcuauacgguaaau

SEQ ID NO: 1694267 - RNA, 13 nt, Salmonella enterica enterica serovar Typhi
auuugugauaaag

SEQ ID NO: 1694268 - RNA, 14 nt, Salmonella enterica enterica serovar Typhi
auuuguuaguccgc

SEQ ID NO: 1694269 - RNA, 15 nt, Salmonella enterica enterica serovar Typhi
auuuguuaucuacag

SEQ ID NO: 1694270 - RNA, 22 nt, Salmonella enterica enterica serovar Typhi
auuuggcguaaucgauaagcuc

SEQ ID NO: 1694271 - RNA, 23 nt, Salmonella enterica enterica serovar Typhi
auuugcuguuuuuuguugauuuu

SEQ ID NO: 1694272 - RNA, 13 nt, Salmonella enterica enterica serovar Typhi
auuugcuguuuuu

SEQ ID NO: 1694273 - RNA, 20 nt, Salmonella enterica enterica serovar Typhi
auuugcuguuuuuuguugau

SEQ ID NO: 1694274 - RNA, 21 nt, Salmonella enterica enterica serovar Typhi
auuugcuguuuuuuguugauu

SEQ ID NO: 1694275 - RNA, 16 nt, Salmonella enterica enterica serovar Typhi
auuugcugcugcucgc

SEQ ID NO: 1694276 - RNA, 22 nt, Salmonella enterica enterica serovar Typhi
auuugcugcauuucuuguugac

SEQ ID NO: 1694277 - RNA, 11 nt, Salmonella enterica enterica serovar Typhi
auuugcucagu

SEQ ID NO: 1694278 - RNA, 15 nt, Salmonella enterica enterica serovar Typhi
auuugcugcauuucu

SEQ ID NO: 1694279 - RNA, 13 nt, Salmonella enterica enterica serovar Typhi
auuugcugcaacg

SEQ ID NO: 1694280 - RNA, 16 nt, Salmonella enterica enterica serovar Typhi
auuuggcuuaaauaau

SEQ ID NO: 1694281 - RNA, 23 nt, Salmonella enterica enterica serovar Typhi
auuugguuagggaucaucuucac

SEQ ID NO: 1694282 - RNA, 23 nt, Salmonella enterica enterica serovar Typhi
auuucuuuaaugcccgguauuuu

SEQ ID NO: 1694283 - RNA, 18 nt, Salmonella enterica enterica serovar Typhi
auuucuccugcgccagcc

SEQ ID NO: 1694284 - RNA, 17 nt, Salmonella enterica enterica serovar Typhi
auuucuccgcccaucca

SEQ ID NO: 1694285 - RNA, 23 nt, Salmonella enterica enterica serovar Typhi
auuugacgagucggaucaugaaa

SEQ ID NO: 1694286 - RNA, 17 nt, Salmonella enterica enterica serovar Typhi
auuugauuuauuuugaa

SEQ ID NO: 1694287 - RNA, 10 nt, Salmonella enterica enterica serovar Typhi
auuugauuua

SEQ ID NO: 1694288 - RNA, 22 nt, Salmonella enterica enterica serovar Typhi
auuugcgacaucagccagccgc

SEQ ID NO: 1694289 - RNA, 17 nt, Salmonella enterica enterica serovar Typhi
auuugcggcgucgccug

SEQ ID NO: 1694290 - RNA, 15 nt, Salmonella enterica enterica serovar Typhi
auuugcgugucauca

SEQ ID NO: 1694291 - RNA, 16 nt, Salmonella enterica enterica serovar Typhi
auuugcgugucaucaa

SEQ ID NO: 1694292 - RNA, 16 nt, Salmonella enterica enterica serovar Typhi
auuucacuuaucccug

SEQ ID NO: 1694293 - RNA, 22 nt, Salmonella enterica enterica serovar Typhi
auuucaauaauauguuccacaa

SEQ ID NO: 1694294 - RNA, 17 nt, Salmonella enterica enterica serovar Typhi
auuucaauaaucccuuc

SEQ ID NO: 1694295 - RNA, 15 nt, Salmonella enterica enterica serovar Typhi
auuucagaccgugcu

SEQ ID NO: 1694296 - RNA, 18 nt, Salmonella enterica enterica serovar Typhi
auuucagaccgugcuuuu

SEQ ID NO: 1694297 - RNA, 15 nt, Salmonella enterica enterica serovar Typhi
auuucaucuaucugc

SEQ ID NO: 1694298 - RNA, 21 nt, Salmonella enterica enterica serovar Typhi
auuuccagugccaguuaagca

SEQ ID NO: 1694299 - RNA, 16 nt, Salmonella enterica enterica serovar Typhi
auuuccaccuucucuu

SEQ ID NO: 1694300 - RNA, 17 nt, Salmonella enterica enterica serovar Typhi
auuuccagugccaguua

SEQ ID NO: 1694301 - RNA, 12 nt, Salmonella enterica enterica serovar Typhi
auuucgauggua

SEQ ID NO: 1694302 - RNA, 17 nt, Salmonella enterica enterica serovar Typhi
auuucgccccacuggcc

SEQ ID NO: 1694303 - RNA, 13 nt, Salmonella enterica enterica serovar Typhi
auuucgccgccgc

SEQ ID NO: 1694304 - RNA, 21 nt, Salmonella enterica enterica serovar Typhi
auuucgccccacuggcccccu

SEQ ID NO: 1694305 - RNA, 23 nt, Salmonella enterica enterica serovar Typhi
cacagaauuacauaugcgcggcg

SEQ ID NO: 1694306 - RNA, 14 nt, Salmonella enterica enterica serovar Typhi
cacacugcgccgcc

SEQ ID NO: 1694307 - RNA, 14 nt, Salmonella enterica enterica serovar Typhi
cacacucucuccag

SEQ ID NO: 1694308 - RNA, 20 nt, Salmonella enterica enterica serovar Typhi
cacacuaguaaucaggcgag

SEQ ID NO: 1694309 - RNA, 13 nt, Salmonella enterica enterica serovar Typhi
cacacccauagca

SEQ ID NO: 1694310 - RNA, 17 nt, Salmonella enterica enterica serovar Typhi
cacacccgcacgccugg

SEQ ID NO: 1694311 - RNA, 20 nt, Salmonella enterica enterica serovar Typhi
cacaccauuucacaaauuaa

SEQ ID NO: 1694312 - RNA, 18 nt, Salmonella enterica enterica serovar Typhi
cacaccauuucacaaauu

SEQ ID NO: 1694313 - RNA, 21 nt, Salmonella enterica enterica serovar Typhi
cacaccggguucguaauaagg

SEQ ID NO: 1694314 - RNA, 19 nt, Salmonella enterica enterica serovar Typhi
cacaccgucaacaucaucc

SEQ ID NO: 1694315 - RNA, 22 nt, Salmonella enterica enterica serovar Typhi
cacaaugcgacuuaucagaacu

SEQ ID NO: 1694316 - RNA, 17 nt, Salmonella enterica enterica serovar Typhi
cacaacagaagcggccu

SEQ ID NO: 1694317 - RNA, 17 nt, Salmonella enterica enterica serovar Typhi
cacaaauuuugauaaaa

SEQ ID NO: 1694318 - RNA, 19 nt, Salmonella enterica enterica serovar Typhi
cacaaauuucgagcagaac

SEQ ID NO: 1694319 - RNA, 22 nt, Salmonella enterica enterica serovar Typhi
cacaauguuuuuguaccaggcc

SEQ ID NO: 1694320 - RNA, 21 nt, Salmonella enterica enterica serovar Typhi
cacaaugguugccuggugucc

SEQ ID NO: 1694321 - RNA, 18 nt, Salmonella enterica enterica serovar Typhi
cacaccacaugcgagcag

SEQ ID NO: 1694322 - RNA, 19 nt, Salmonella enterica enterica serovar Typhi
cacacaaucgguuaugcga

SEQ ID NO: 1694323 - RNA, 19 nt, Salmonella enterica enterica serovar Typhi
cacagccgcauuuuuucuu

SEQ ID NO: 1694324 - RNA, 21 nt, Salmonella enterica enterica serovar Typhi
cacagcggacacccgcagcca

SEQ ID NO: 1694325 - RNA, 13 nt, Salmonella enterica enterica serovar Typhi
cacaggaaccggu

SEQ ID NO: 1694326 - RNA, 13 nt, Salmonella enterica enterica serovar Typhi
cacaggccaacau

SEQ ID NO: 1694327 - RNA, 14 nt, Salmonella enterica enterica serovar Typhi
cacagccguguccg

SEQ ID NO: 1694328 - RNA, 19 nt, Salmonella enterica enterica serovar Typhi
cacagccuuauaagaacca

SEQ ID NO: 1694329 - RNA, 19 nt, Salmonella enterica enterica serovar Typhi
cacagcgcuuuaguacgcg

SEQ ID NO: 1694330 - RNA, 15 nt, Salmonella enterica enterica serovar Typhi
cacaguacgcccggc

SEQ ID NO: 1694331 - RNA, 18 nt, Salmonella enterica enterica serovar Typhi
cacagugacccgccgcca

SEQ ID NO: 1694332 - RNA, 22 nt, Salmonella enterica enterica serovar Typhi
cacagugacccgccgccagcac

SEQ ID NO: 1694333 - RNA, 16 nt, Salmonella enterica enterica serovar Typhi
cacagucaucgcgcca

SEQ ID NO: 1694334 - RNA, 21 nt, Salmonella enterica enterica serovar Typhi
cacagguacaggccgccgccu

SEQ ID NO: 1694335 - RNA, 16 nt, Salmonella enterica enterica serovar Typhi
cacaggccuucaugau

SEQ ID NO: 1694336 - RNA, 13 nt, Salmonella enterica enterica serovar Typhi
cacaggcuuauac

SEQ ID NO: 1694337 - RNA, 13 nt, Salmonella enterica enterica serovar Typhi
cacaaaacaggau

SEQ ID NO: 1694338 - RNA, 21 nt, Salmonella enterica enterica serovar Typhi
cacaaacaauuuacgcagccc

SEQ ID NO: 1694339 - RNA, 22 nt, Salmonella enterica enterica serovar Typhi
cacaaaacuauuuuccccuucu

SEQ ID NO: 1694340 - RNA, 16 nt, Salmonella enterica enterica serovar Typhi
cacaaaggccagcagc

SEQ ID NO: 1694341 - RNA, 18 nt, Salmonella enterica enterica serovar Typhi
cacaaacggcaucgauau

SEQ ID NO: 1694342 - RNA, 21 nt, Salmonella enterica enterica serovar Typhi
cacaaacuccagacgaugaua

SEQ ID NO: 1694343 - RNA, 21 nt, Salmonella enterica enterica serovar Typhi
caauuugguuagggaucaucu

SEQ ID NO: 1694344 - RNA, 22 nt, Salmonella enterica enterica serovar Typhi
caauuugguuagggaucaucuu

SEQ ID NO: 1694345 - RNA, 16 nt, Salmonella enterica enterica serovar Typhi
caauuuaccuauuucg

SEQ ID NO: 1694346 - RNA, 21 nt, Salmonella enterica enterica serovar Typhi
caauuuuuacaaauuuaaaca

SEQ ID NO: 1694347 - RNA, 19 nt, Salmonella enterica enterica serovar Typhi
caauuuugauaagagaaaa

SEQ ID NO: 1694348 - RNA, 13 nt, Salmonella enterica enterica serovar Typhi
caauuuucuucau

SEQ ID NO: 1694349 - RNA, 22 nt, Salmonella enterica enterica serovar Typhi
caauuuucuuaauaugcugccu

SEQ ID NO: 1694350 - RNA, 20 nt, Salmonella enterica enterica serovar Typhi
caauguucugggaauaggcc

SEQ ID NO: 1694351 - RNA, 17 nt, Salmonella enterica enterica serovar Typhi
caauguugagcaucgcu

SEQ ID NO: 1694352 - RNA, 12 nt, Salmonella enterica enterica serovar Typhi
caauuaacauuu

SEQ ID NO: 1694353 - RNA, 14 nt, Salmonella enterica enterica serovar Typhi
caauucaaucacuu

SEQ ID NO: 1694354 - RNA, 23 nt, Salmonella enterica enterica serovar Typhi
caauuauguauuucucgccgccg

SEQ ID NO: 1694355 - RNA, 15 nt, Salmonella enterica enterica serovar Typhi
cacaguuuuuccccg

SEQ ID NO: 1694356 - RNA, 18 nt, Salmonella enterica enterica serovar Typhi
cacaucguuaucuaugcu

SEQ ID NO: 1694357 - RNA, 15 nt, Salmonella enterica enterica serovar Typhi
cacauaacaaaacca

SEQ ID NO: 1694358 - RNA, 18 nt, Salmonella enterica enterica serovar Typhi
cacauaacaaaaccagca

SEQ ID NO: 1694359 - RNA, 18 nt, Salmonella enterica enterica serovar Typhi
cacauaagcaacuugaag

SEQ ID NO: 1694360 - RNA, 17 nt, Salmonella enterica enterica serovar Typhi
cacauaagcacaccauu

SEQ ID NO: 1694361 - RNA, 15 nt, Salmonella enterica enterica serovar Typhi
cacaugaccagcgcc

SEQ ID NO: 1694362 - RNA, 23 nt, Salmonella enterica enterica serovar Typhi
cacaucuguuugagaaaaacauc

SEQ ID NO: 1694363 - RNA, 17 nt, Salmonella enterica enterica serovar Typhi
cacaugauguuuuaaca

SEQ ID NO: 1694364 - RNA, 19 nt, Salmonella enterica enterica serovar Typhi
cacaugcaagucgaacggu

SEQ ID NO: 1694365 - RNA, 16 nt, Salmonella enterica enterica serovar Typhi
caccaaguagacagag

SEQ ID NO: 1694366 - RNA, 13 nt, Salmonella enterica enterica serovar Typhi
caccaacugcuga

SEQ ID NO: 1694367 - RNA, 20 nt, Salmonella enterica enterica serovar Typhi
cacauuggcugcgcuucuga

SEQ ID NO: 1694368 - RNA, 17 nt, Salmonella enterica enterica serovar Typhi
cacauuucagcgcagaa

SEQ ID NO: 1694369 - RNA, 14 nt, Salmonella enterica enterica serovar Typhi
cacauugagcgaga

SEQ ID NO: 1694370 - RNA, 14 nt, Salmonella enterica enterica serovar Typhi
cacauugcgcgccg

SEQ ID NO: 1694371 - RNA, 16 nt, Salmonella enterica enterica serovar Typhi
cacauugcgguucauu

SEQ ID NO: 1694372 - RNA, 12 nt, Salmonella enterica enterica serovar Typhi
cacauuggcaaa

SEQ ID NO: 1694373 - RNA, 12 nt, Salmonella enterica enterica serovar Typhi
cacaugggcagg

SEQ ID NO: 1694374 - RNA, 12 nt, Salmonella enterica enterica serovar Typhi
caccaccauggg

SEQ ID NO: 1694375 - RNA, 12 nt, Salmonella enterica enterica serovar Typhi
caccaauugcca

SEQ ID NO: 1694376 - RNA, 16 nt, Salmonella enterica enterica serovar Typhi
caccaccgccacuucc

SEQ ID NO: 1694377 - RNA, 22 nt, Salmonella enterica enterica serovar Typhi
caccacccguucgaaugagaac

SEQ ID NO: 1694378 - RNA, 14 nt, Salmonella enterica enterica serovar Typhi
caccaccucaaacg

SEQ ID NO: 1694379 - RNA, 15 nt, Salmonella enterica enterica serovar Typhi
caccaccuccugcug

SEQ ID NO: 1694380 - RNA, 14 nt, Salmonella enterica enterica serovar Typhi
caccaccuccugcu

SEQ ID NO: 1694381 - RNA, 12 nt, Salmonella enterica enterica serovar Typhi
caccaccgccgc

SEQ ID NO: 1694382 - RNA, 16 nt, Salmonella enterica enterica serovar Typhi
caccacgguguacccc

SEQ ID NO: 1694383 - RNA, 19 nt, Salmonella enterica enterica serovar Typhi
caccacgguguaccccgcc

SEQ ID NO: 1694384 - RNA, 22 nt, Salmonella enterica enterica serovar Typhi
caccacguaacucggcagcgcg

SEQ ID NO: 1694385 - RNA, 18 nt, Salmonella enterica enterica serovar Typhi
caccacguaaugcgcccc

SEQ ID NO: 1694386 - RNA, 21 nt, Salmonella enterica enterica serovar Typhi
caccaucguugccagcggcca

SEQ ID NO: 1694387 - RNA, 16 nt, Salmonella enterica enterica serovar Typhi
caccaucuuuuccggc

SEQ ID NO: 1694388 - RNA, 15 nt, Salmonella enterica enterica serovar Typhi
caccaucuuuuugcu

SEQ ID NO: 1694389 - RNA, 16 nt, Salmonella enterica enterica serovar Typhi
caccaugcaaaaugcu

SEQ ID NO: 1694390 - RNA, 16 nt, Salmonella enterica enterica serovar Typhi
caccaucguugccagc

SEQ ID NO: 1694391 - RNA, 14 nt, Salmonella enterica enterica serovar Typhi
caccauccgcgcau

SEQ ID NO: 1694392 - RNA, 14 nt, Salmonella enterica enterica serovar Typhi
caccauccggcgcu

SEQ ID NO: 1694393 - RNA, 23 nt, Salmonella enterica enterica serovar Typhi
caccauccggcgcugcgcggcgu

SEQ ID NO: 1694394 - RNA, 13 nt, Salmonella enterica enterica serovar Typhi
caccaucacuucc

SEQ ID NO: 1694395 - RNA, 16 nt, Salmonella enterica enterica serovar Typhi
caccaguucauauuug

SEQ ID NO: 1694396 - RNA, 17 nt, Salmonella enterica enterica serovar Typhi
caccagguucagcaacg

SEQ ID NO: 1694397 - RNA, 14 nt, Salmonella enterica enterica serovar Typhi
caccauaucuucca

SEQ ID NO: 1694398 - RNA, 20 nt, Salmonella enterica enterica serovar Typhi
caccauaaagcgaauaauua

SEQ ID NO: 1694399 - RNA, 22 nt, Salmonella enterica enterica serovar Typhi
caccauaauuaccggcacaccg

SEQ ID NO: 1694400 - RNA, 15 nt, Salmonella enterica enterica serovar Typhi
aaaauaaaaaaggca

SEQ ID NO: 1694401 - RNA, 13 nt, Salmonella enterica enterica serovar Typhi
caccaggaacgcc

SEQ ID NO: 1694402 - RNA, 15 nt, Salmonella enterica enterica serovar Typhi
caccagcuuaucuga

SEQ ID NO: 1694403 - RNA, 18 nt, Salmonella enterica enterica serovar Typhi
aaaaguuguugaccaaca

SEQ ID NO: 1694404 - RNA, 19 nt, Salmonella enterica enterica serovar Typhi
aaaaguuguugaccaacaa

SEQ ID NO: 1694405 - RNA, 16 nt, Salmonella enterica enterica serovar Typhi
caccagacccgggacu

SEQ ID NO: 1694406 - RNA, 21 nt, Salmonella enterica enterica serovar Typhi
caccagacccgggacuucagg

SEQ ID NO: 1694407 - RNA, 21 nt, Salmonella enterica enterica serovar Typhi
caccagaccgacaagcccccc

SEQ ID NO: 1694408 - RNA, 17 nt, Salmonella enterica enterica serovar Typhi
caccagaaucgccagca

SEQ ID NO: 1694409 - RNA, 18 nt, Salmonella enterica enterica serovar Typhi
caccagaacucccuguuc

SEQ ID NO: 1694410 - RNA, 19 nt, Salmonella enterica enterica serovar Typhi
caccagaaucgccagcauc

SEQ ID NO: 1694411 - RNA, 20 nt, Salmonella enterica enterica serovar Typhi
caccagaaucgccagcaucg

SEQ ID NO: 1694412 - RNA, 19 nt, Salmonella enterica enterica serovar Typhi
cacccucgucuuugccucg

SEQ ID NO: 1694413 - RNA, 11 nt, Salmonella enterica enterica serovar Typhi
cacccucugcg

SEQ ID NO: 1694414 - RNA, 19 nt, Salmonella enterica enterica serovar Typhi
cacccuauuuugcgccugg

SEQ ID NO: 1694415 - RNA, 13 nt, Salmonella enterica enterica serovar Typhi
cacccuauaagcu

SEQ ID NO: 1694416 - RNA, 15 nt, Salmonella enterica enterica serovar Typhi
cacccuauccgccag

SEQ ID NO: 1694417 - RNA, 20 nt, Salmonella enterica enterica serovar Typhi
cacccuauuuugcgccuggg

SEQ ID NO: 1694418 - RNA, 17 nt, Salmonella enterica enterica serovar Typhi
cacccgcucgcugcauu

SEQ ID NO: 1694419 - RNA, 14 nt, Salmonella enterica enterica serovar Typhi
cacccggagagaaa

SEQ ID NO: 1694420 - RNA, 15 nt, Salmonella enterica enterica serovar Typhi
cacccaauaaauaau

SEQ ID NO: 1694421 - RNA, 19 nt, Salmonella enterica enterica serovar Typhi
caccauuucacaaauuaaa

SEQ ID NO: 1694422 - RNA, 21 nt, Salmonella enterica enterica serovar Typhi
caccauuaugaccaauaauaa

SEQ ID NO: 1694423 - RNA, 13 nt, Salmonella enterica enterica serovar Typhi
caccauucccagc

SEQ ID NO: 1694424 - RNA, 12 nt, Salmonella enterica enterica serovar Typhi
caccauucuuca

SEQ ID NO: 1694425 - RNA, 14 nt, Salmonella enterica enterica serovar Typhi
caccauucuucaac

SEQ ID NO: 1694426 - RNA, 20 nt, Salmonella enterica enterica serovar Typhi
cacccgauacacgccgacgc

SEQ ID NO: 1694427 - RNA, 14 nt, Salmonella enterica enterica serovar Typhi
cacccacaggagcc

SEQ ID NO: 1694428 - RNA, 15 nt, Salmonella enterica enterica serovar Typhi
caccgcgaugcugcu

SEQ ID NO: 1694429 - RNA, 22 nt, Salmonella enterica enterica serovar Typhi
caccgcgaugcugcucuccacg

SEQ ID NO: 1694430 - RNA, 20 nt, Salmonella enterica enterica serovar Typhi
caccgcgaugaccaucaaau

SEQ ID NO: 1694431 - RNA, 14 nt, Salmonella enterica enterica serovar Typhi
caccgcgaugcugc

SEQ ID NO: 1694432 - RNA, 12 nt, Salmonella enterica enterica serovar Typhi
caccgccgcgcu

SEQ ID NO: 1694433 - RNA, 12 nt, Salmonella enterica enterica serovar Typhi
caccgccgggcu

SEQ ID NO: 1694434 - RNA, 22 nt, Salmonella enterica enterica serovar Typhi
caccgccauauuaugcuggccu

SEQ ID NO: 1694435 - RNA, 15 nt, Salmonella enterica enterica serovar Typhi
caccgcccagagaau

SEQ ID NO: 1694436 - RNA, 15 nt, Salmonella enterica enterica serovar Typhi
caccgcccgccgggc

SEQ ID NO: 1694437 - RNA, 16 nt, Salmonella enterica enterica serovar Typhi
caccgccagcgucugu

SEQ ID NO: 1694438 - RNA, 13 nt, Salmonella enterica enterica serovar Typhi
caccgccagacgc

SEQ ID NO: 1694439 - RNA, 15 nt, Salmonella enterica enterica serovar Typhi
caccgccagagcacg

SEQ ID NO: 1694440 - RNA, 18 nt, Salmonella enterica enterica serovar Typhi
caccgccaccugcccuuu

SEQ ID NO: 1694441 - RNA, 15 nt, Salmonella enterica enterica serovar Typhi
caccgccacuuccgc

SEQ ID NO: 1694442 - RNA, 23 nt, Salmonella enterica enterica serovar Typhi
caccgauuucaucgcugaauuug

SEQ ID NO: 1694443 - RNA, 14 nt, Salmonella enterica enterica serovar Typhi
caccgauccgaaga

SEQ ID NO: 1694444 - RNA, 13 nt, Salmonella enterica enterica serovar Typhi
caccgacacaaau

SEQ ID NO: 1694445 - RNA, 16 nt, Salmonella enterica enterica serovar Typhi
caccucuuccgccagg

SEQ ID NO: 1694446 - RNA, 17 nt, Salmonella enterica enterica serovar Typhi
caccucguucaaacaga

SEQ ID NO: 1694447 - RNA, 15 nt, Salmonella enterica enterica serovar Typhi
caccugaaugcaaag

SEQ ID NO: 1694448 - RNA, 16 nt, Salmonella enterica enterica serovar Typhi
caccugaaugcaaaga

SEQ ID NO: 1694449 - RNA, 12 nt, Salmonella enterica enterica serovar Typhi
caccugaugccc

SEQ ID NO: 1694450 - RNA, 18 nt, Salmonella enterica enterica serovar Typhi
caccugaugguuauuuuc

SEQ ID NO: 1694451 - RNA, 13 nt, Salmonella enterica enterica serovar Typhi
caccugauucugc

SEQ ID NO: 1694452 - RNA, 15 nt, Salmonella enterica enterica serovar Typhi
caccugacggcagcc

SEQ ID NO: 1694453 - RNA, 22 nt, Salmonella enterica enterica serovar Typhi
caccugcaucacgcccggcggu

SEQ ID NO: 1694454 - RNA, 16 nt, Salmonella enterica enterica serovar Typhi
caccugcaacuccugg

SEQ ID NO: 1694455 - RNA, 22 nt, Salmonella enterica enterica serovar Typhi
caccugcaaacguagcgcguca

SEQ ID NO: 1694456 - RNA, 17 nt, Salmonella enterica enterica serovar Typhi
aaaauaauaaucguuuu

SEQ ID NO: 1694457 - RNA, 23 nt, Salmonella enterica enterica serovar Typhi
aaaauaauagguacggggcaucu

SEQ ID NO: 1694458 - RNA, 23 nt, Salmonella enterica enterica serovar Typhi
aaaauaagagggcgccaugcuga

SEQ ID NO: 1694459 - RNA, 14 nt, Salmonella enterica enterica serovar Typhi
caccggacauccca

SEQ ID NO: 1694460 - RNA, 16 nt, Salmonella enterica enterica serovar Typhi
caccggaccgccgagu

SEQ ID NO: 1694461 - RNA, 13 nt, Salmonella enterica enterica serovar Typhi
caccggacauccc

SEQ ID NO: 1694462 - RNA, 16 nt, Salmonella enterica enterica serovar Typhi
caccgcgcgcgcggca

SEQ ID NO: 1694463 - RNA, 14 nt, Salmonella enterica enterica serovar Typhi
caccgggccaccga

SEQ ID NO: 1694464 - RNA, 14 nt, Salmonella enterica enterica serovar Typhi
caccggcgcgccag

SEQ ID NO: 1694465 - RNA, 13 nt, Salmonella enterica enterica serovar Typhi
caccggcgcgcca

SEQ ID NO: 1694466 - RNA, 18 nt, Salmonella enterica enterica serovar Typhi
caccggguuaaagcccug

SEQ ID NO: 1694467 - RNA, 19 nt, Salmonella enterica enterica serovar Typhi
caccggguuaaagcccuga

SEQ ID NO: 1694468 - RNA, 19 nt, Salmonella enterica enterica serovar Typhi
caccguaaaaggaaucaac

SEQ ID NO: 1694469 - RNA, 21 nt, Salmonella enterica enterica serovar Typhi
caccgguuuuuccgcuucacc

SEQ ID NO: 1694470 - RNA, 22 nt, Salmonella enterica enterica serovar Typhi
caccgguuuuuccgcuucaccu

SEQ ID NO: 1694471 - RNA, 15 nt, Salmonella enterica enterica serovar Typhi
caccguaaacggcuc

SEQ ID NO: 1694472 - RNA, 15 nt, Salmonella enterica enterica serovar Typhi
cacgcagacccaggc

SEQ ID NO: 1694473 - RNA, 19 nt, Salmonella enterica enterica serovar Typhi
cacgcagauaucuuccagc

SEQ ID NO: 1694474 - RNA, 21 nt, Salmonella enterica enterica serovar Typhi
cacgcagcgcauccaccagac

SEQ ID NO: 1694475 - RNA, 18 nt, Salmonella enterica enterica serovar Typhi
cacgcauucuuuuuucuc

SEQ ID NO: 1694476 - RNA, 21 nt, Salmonella enterica enterica serovar Typhi
cacgcauaaaaaaggcucgca

SEQ ID NO: 1694477 - RNA, 15 nt, Salmonella enterica enterica serovar Typhi
cacgcaguccaacaa

SEQ ID NO: 1694478 - RNA, 16 nt, Salmonella enterica enterica serovar Typhi
cacgcaguccaacaag

SEQ ID NO: 1694479 - RNA, 23 nt, Salmonella enterica enterica serovar Typhi
cacgcacacgucugagcaggcgg

SEQ ID NO: 1694480 - RNA, 19 nt, Salmonella enterica enterica serovar Typhi
cacgccagauaaaucagcc

SEQ ID NO: 1694481 - RNA, 14 nt, Salmonella enterica enterica serovar Typhi
cacgccaccgggcc

SEQ ID NO: 1694482 - RNA, 15 nt, Salmonella enterica enterica serovar Typhi
cacgccagauaaauc

SEQ ID NO: 1694483 - RNA, 13 nt, Salmonella enterica enterica serovar Typhi
cacgccaccaucc

SEQ ID NO: 1694484 - RNA, 16 nt, Salmonella enterica enterica serovar Typhi
cacgccaucauuggcu

SEQ ID NO: 1694485 - RNA, 20 nt, Salmonella enterica enterica serovar Typhi
cacgccaucgacaaaggcaa

SEQ ID NO: 1694486 - RNA, 16 nt, Salmonella enterica enterica serovar Typhi
cacgccaucgccugau

SEQ ID NO: 1694487 - RNA, 17 nt, Salmonella enterica enterica serovar Typhi
cacgccccuaaggcagc

SEQ ID NO: 1694488 - RNA, 22 nt, Salmonella enterica enterica serovar Typhi
cacgccccccgguagccacacc

SEQ ID NO: 1694489 - RNA, 18 nt, Salmonella enterica enterica serovar Typhi
cacgccgcccgccugagc

SEQ ID NO: 1694490 - RNA, 16 nt, Salmonella enterica enterica serovar Typhi
cacgccgccgccgacc

SEQ ID NO: 1694491 - RNA, 16 nt, Salmonella enterica enterica serovar Typhi
cacgccgcuacugccg

SEQ ID NO: 1694492 - RNA, 21 nt, Salmonella enterica enterica serovar Typhi
cacgccgcuaucgaccagcac

SEQ ID NO: 1694493 - RNA, 23 nt, Salmonella enterica enterica serovar Typhi
cacgccgcuaucgaccagcaccu

SEQ ID NO: 1694494 - RNA, 24 nt, Salmonella enterica enterica serovar Typhi
cacgccgcuaucgaccagcaccug

SEQ ID NO: 1694495 - RNA, 14 nt, Salmonella enterica enterica serovar Typhi
cacgccgcuccaca

SEQ ID NO: 1694496 - RNA, 22 nt, Salmonella enterica enterica serovar Typhi
caccuuugaacgucgcugauag

SEQ ID NO: 1694497 - RNA, 13 nt, Salmonella enterica enterica serovar Typhi
caccuuucugcca

SEQ ID NO: 1694498 - RNA, 23 nt, Salmonella enterica enterica serovar Typhi
caccuuuacuuaauucugcugcc

SEQ ID NO: 1694499 - RNA, 23 nt, Salmonella enterica enterica serovar Typhi
caccugcccuuucagagcgucuu

SEQ ID NO: 1694500 - RNA, 18 nt, Salmonella enterica enterica serovar Typhi
caccugccaguccgcccg

SEQ ID NO: 1694501 - RNA, 22 nt, Salmonella enterica enterica serovar Typhi
aaaauacugcuagaacauuucc

SEQ ID NO: 1694502 - RNA, 20 nt, Salmonella enterica enterica serovar Typhi
cacgauacuguugcaguuua

SEQ ID NO: 1694503 - RNA, 16 nt, Salmonella enterica enterica serovar Typhi
cacgauagacagcacc

SEQ ID NO: 1694504 - RNA, 13 nt, Salmonella enterica enterica serovar Typhi
cacgagugauccc

SEQ ID NO: 1694505 - RNA, 20 nt, Salmonella enterica enterica serovar Typhi
cacggcguguugaaauccuc

SEQ ID NO: 1694506 - RNA, 22 nt, Salmonella enterica enterica serovar Typhi
cacggcguguugaaauccucua

SEQ ID NO: 1694507 - RNA, 13 nt, Salmonella enterica enterica serovar Typhi
cacggcauucagu

SEQ ID NO: 1694508 - RNA, 23 nt, Salmonella enterica enterica serovar Typhi
cacggcauucacgucgcgcgccg

SEQ ID NO: 1694509 - RNA, 16 nt, Salmonella enterica enterica serovar Typhi
cacggcaguacacgca

SEQ ID NO: 1694510 - RNA, 14 nt, Salmonella enterica enterica serovar Typhi
cacggacucgccuu

SEQ ID NO: 1694511 - RNA, 15 nt, Salmonella enterica enterica serovar Typhi
cacggacagcgcgca

SEQ ID NO: 1694512 - RNA, 13 nt, Salmonella enterica enterica serovar Typhi
cacgcuguuuauu

SEQ ID NO: 1694513 - RNA, 14 nt, Salmonella enterica enterica serovar Typhi
cacgcugccgccgc

SEQ ID NO: 1694514 - RNA, 17 nt, Salmonella enterica enterica serovar Typhi
cacgcugaccuuuuuca

SEQ ID NO: 1694515 - RNA, 16 nt, Salmonella enterica enterica serovar Typhi
cacgcugccgccgcuc

SEQ ID NO: 1694516 - RNA, 15 nt, Salmonella enterica enterica serovar Typhi
cacgcuggcaucaau

SEQ ID NO: 1694517 - RNA, 19 nt, Salmonella enterica enterica serovar Typhi
cacgcugaccacgccgccg

SEQ ID NO: 1694518 - RNA, 20 nt, Salmonella enterica enterica serovar Typhi
cacgcugaccacgccgccgc

SEQ ID NO: 1694519 - RNA, 21 nt, Salmonella enterica enterica serovar Typhi
cacgccggaaucgcgauccag

SEQ ID NO: 1694520 - RNA, 18 nt, Salmonella enterica enterica serovar Typhi
cacgccggaaagaauaau

SEQ ID NO: 1694521 - RNA, 14 nt, Salmonella enterica enterica serovar Typhi
cacgcucgcggaag

SEQ ID NO: 1694522 - RNA, 15 nt, Salmonella enterica enterica serovar Typhi
cacgcucgcuggugc

SEQ ID NO: 1694523 - RNA, 19 nt, Salmonella enterica enterica serovar Typhi
cacgcucgcggaagcgacc

SEQ ID NO: 1694524 - RNA, 20 nt, Salmonella enterica enterica serovar Typhi
cacguauucggcuuacccaa

SEQ ID NO: 1694525 - RNA, 18 nt, Salmonella enterica enterica serovar Typhi
cacguauaaacgccgccg

SEQ ID NO: 1694526 - RNA, 17 nt, Salmonella enterica enterica serovar Typhi
cacgucauccggcaagc

SEQ ID NO: 1694527 - RNA, 15 nt, Salmonella enterica enterica serovar Typhi
cacggugugccgcca

SEQ ID NO: 1694528 - RNA, 15 nt, Salmonella enterica enterica serovar Typhi
cacgguuggcccagc

SEQ ID NO: 1694529 - RNA, 17 nt, Salmonella enterica enterica serovar Typhi
cacgguguaccccgccu

SEQ ID NO: 1694530 - RNA, 17 nt, Salmonella enterica enterica serovar Typhi
cacgguauuaacaggcg

SEQ ID NO: 1694531 - RNA, 21 nt, Salmonella enterica enterica serovar Typhi
cacggcucgccuuugcgcccg

SEQ ID NO: 1694532 - RNA, 23 nt, Salmonella enterica enterica serovar Typhi
caaacagugggaagcacauccau

SEQ ID NO: 1694533 - RNA, 15 nt, Salmonella enterica enterica serovar Typhi
caaacagugaaaaaa

SEQ ID NO: 1694534 - RNA, 14 nt, Salmonella enterica enterica serovar Typhi
caaacaucgcgcuc

SEQ ID NO: 1694535 - RNA, 12 nt, Salmonella enterica enterica serovar Typhi
caaacagcagaa

SEQ ID NO: 1694536 - RNA, 22 nt, Salmonella enterica enterica serovar Typhi
caaacacuaccgggcagcaucu

SEQ ID NO: 1694537 - RNA, 19 nt, Salmonella enterica enterica serovar Typhi
caaacaccucagccaccca

SEQ ID NO: 1694538 - RNA, 16 nt, Salmonella enterica enterica serovar Typhi
caaacaccugaaccag

SEQ ID NO: 1694539 - RNA, 21 nt, Salmonella enterica enterica serovar Typhi
caaacacuaccgggcagcauc

SEQ ID NO: 1694540 - RNA, 13 nt, Salmonella enterica enterica serovar Typhi
caaacaccagauc

SEQ ID NO: 1694541 - RNA, 20 nt, Salmonella enterica enterica serovar Typhi
caaacccgaccucuucuuug

SEQ ID NO: 1694542 - RNA, 23 nt, Salmonella enterica enterica serovar Typhi
caaaccccggacacaugaccuga

SEQ ID NO: 1694543 - RNA, 22 nt, Salmonella enterica enterica serovar Typhi
caaaccgauagcuaucacacau

SEQ ID NO: 1694544 - RNA, 16 nt, Salmonella enterica enterica serovar Typhi
caaaccgacccaaaaa

SEQ ID NO: 1694545 - RNA, 18 nt, Salmonella enterica enterica serovar Typhi
caaaccgauaaucaccag

SEQ ID NO: 1694546 - RNA, 22 nt, Salmonella enterica enterica serovar Typhi
caaaccgauaaucaccagcccg

SEQ ID NO: 1694547 - RNA, 18 nt, Salmonella enterica enterica serovar Typhi
caaaccgaauucguccac

SEQ ID NO: 1694548 - RNA, 14 nt, Salmonella enterica enterica serovar Typhi
caaacccuuuggca

SEQ ID NO: 1694549 - RNA, 17 nt, Salmonella enterica enterica serovar Typhi
caaacgccgauggcgcc

SEQ ID NO: 1694550 - RNA, 23 nt, Salmonella enterica enterica serovar Typhi
caaacgcuaucaccgccgcccgu

SEQ ID NO: 1694551 - RNA, 13 nt, Salmonella enterica enterica serovar Typhi
caaacgccaccgc

SEQ ID NO: 1694552 - RNA, 18 nt, Salmonella enterica enterica serovar Typhi
caaacacaaucacgccca

SEQ ID NO: 1694553 - RNA, 13 nt, Salmonella enterica enterica serovar Typhi
caaacacagccau

SEQ ID NO: 1694554 - RNA, 17 nt, Salmonella enterica enterica serovar Typhi
caaacacaaucacaacg

SEQ ID NO: 1694555 - RNA, 20 nt, Salmonella enterica enterica serovar Typhi
caaaauuugugguggucauc

SEQ ID NO: 1694556 - RNA, 14 nt, Salmonella enterica enterica serovar Typhi
caaaauuuucaaua

SEQ ID NO: 1694557 - RNA, 21 nt, Salmonella enterica enterica serovar Typhi
caaaauuugugguggucaucc

SEQ ID NO: 1694558 - RNA, 18 nt, Salmonella enterica enterica serovar Typhi
caaaaugcccuucgaccg

SEQ ID NO: 1694559 - RNA, 19 nt, Salmonella enterica enterica serovar Typhi
caaaauggcaaguaaaaua

SEQ ID NO: 1694560 - RNA, 16 nt, Salmonella enterica enterica serovar Typhi
caaaauggaaaauaau

SEQ ID NO: 1694561 - RNA, 17 nt, Salmonella enterica enterica serovar Typhi
caaaaucaggcaucccg

SEQ ID NO: 1694562 - RNA, 15 nt, Salmonella enterica enterica serovar Typhi
caaaaucuuuuucgc

SEQ ID NO: 1694563 - RNA, 13 nt, Salmonella enterica enterica serovar Typhi
caaaaucauucgg

SEQ ID NO: 1694564 - RNA, 16 nt, Salmonella enterica enterica serovar Typhi
caaaaucuuuuucgcu

SEQ ID NO: 1694565 - RNA, 18 nt, Salmonella enterica enterica serovar Typhi
caaaauauauaauuuaua

SEQ ID NO: 1694566 - RNA, 16 nt, Salmonella enterica enterica serovar Typhi
caaaaucaaacagaau

SEQ ID NO: 1694567 - RNA, 19 nt, Salmonella enterica enterica serovar Typhi
caaaauaauacguuuauuc

SEQ ID NO: 1694568 - RNA, 16 nt, Salmonella enterica enterica serovar Typhi
caaaauaauaaaaauc

SEQ ID NO: 1694569 - RNA, 20 nt, Salmonella enterica enterica serovar Typhi
caaaacccagaaucaguaac

SEQ ID NO: 1694570 - RNA, 15 nt, Salmonella enterica enterica serovar Typhi
caaaacccaccagca

SEQ ID NO: 1694571 - RNA, 18 nt, Salmonella enterica enterica serovar Typhi
caaaacccaccagcaggg

SEQ ID NO: 1694572 - RNA, 17 nt, Salmonella enterica enterica serovar Typhi
caaaacccagaaucagu

SEQ ID NO: 1694573 - RNA, 15 nt, Salmonella enterica enterica serovar Typhi
caaaaccacagugac

SEQ ID NO: 1694574 - RNA, 14 nt, Salmonella enterica enterica serovar Typhi
caaaguuaaucagc

SEQ ID NO: 1694575 - RNA, 23 nt, Salmonella enterica enterica serovar Typhi
caaagguuuguuuaauuuuguug

SEQ ID NO: 1694576 - RNA, 18 nt, Salmonella enterica enterica serovar Typhi
caaaguuaucccugcuga

SEQ ID NO: 1694577 - RNA, 19 nt, Salmonella enterica enterica serovar Typhi
caaaguuaccggcauuaau

SEQ ID NO: 1694578 - RNA, 18 nt, Salmonella enterica enterica serovar Typhi
caaaguugguucccagca

SEQ ID NO: 1694579 - RNA, 21 nt, Salmonella enterica enterica serovar Typhi
caaauacgcgauaaaaaccca

SEQ ID NO: 1694580 - RNA, 15 nt, Salmonella enterica enterica serovar Typhi
caaauacugcuuuuc

SEQ ID NO: 1694581 - RNA, 12 nt, Salmonella enterica enterica serovar Typhi
caaacuccagcu

SEQ ID NO: 1694582 - RNA, 21 nt, Salmonella enterica enterica serovar Typhi
caaacuccagcucgcaugcau

SEQ ID NO: 1694583 - RNA, 12 nt, Salmonella enterica enterica serovar Typhi
caaacucagcgg

SEQ ID NO: 1694584 - RNA, 18 nt, Salmonella enterica enterica serovar Typhi
caaacucacguuccccag

SEQ ID NO: 1694585 - RNA, 23 nt, Salmonella enterica enterica serovar Typhi
caaacucacguuccccagcaccg

SEQ ID NO: 1694586 - RNA, 14 nt, Salmonella enterica enterica serovar Typhi
caaacuauuuuuag

SEQ ID NO: 1694587 - RNA, 15 nt, Salmonella enterica enterica serovar Typhi
caaacuauuuuuagc

SEQ ID NO: 1694588 - RNA, 23 nt, Salmonella enterica enterica serovar Typhi
caaacuauguacgccaagcugca

SEQ ID NO: 1694589 - RNA, 21 nt, Salmonella enterica enterica serovar Typhi
caaacugaaaacgggugaucu

SEQ ID NO: 1694590 - RNA, 19 nt, Salmonella enterica enterica serovar Typhi
caaacugaaaaucaaauaa

SEQ ID NO: 1694591 - RNA, 21 nt, Salmonella enterica enterica serovar Typhi
caaacuccucacugcguaaaa

SEQ ID NO: 1694592 - RNA, 19 nt, Salmonella enterica enterica serovar Typhi
caaacucuuuuucaauaaa

SEQ ID NO: 1694593 - RNA, 17 nt, Salmonella enterica enterica serovar Typhi
caaacucugaaaaaauu

SEQ ID NO: 1694594 - RNA, 11 nt, Salmonella enterica enterica serovar Typhi
caaacugcugg

SEQ ID NO: 1694595 - RNA, 18 nt, Salmonella enterica enterica serovar Typhi
caaacuggcaaauaaaau

SEQ ID NO: 1694596 - RNA, 15 nt, Salmonella enterica enterica serovar Typhi
caaacuggccacagc

SEQ ID NO: 1694597 - RNA, 22 nt, Salmonella enterica enterica serovar Typhi
caaacugcucguaaagcaucag

SEQ ID NO: 1694598 - RNA, 17 nt, Salmonella enterica enterica serovar Typhi
caaacugauaagggccu

SEQ ID NO: 1694599 - RNA, 22 nt, Salmonella enterica enterica serovar Typhi
caaacugcgcuagccgccgugu

SEQ ID NO: 1694600 - RNA, 19 nt, Salmonella enterica enterica serovar Typhi
caaagagguugcugauuaa

SEQ ID NO: 1694601 - RNA, 21 nt, Salmonella enterica enterica serovar Typhi
caaagcguugcaaccccagac

SEQ ID NO: 1694602 - RNA, 19 nt, Salmonella enterica enterica serovar Typhi
caaagccaggccgccagca

SEQ ID NO: 1694603 - RNA, 20 nt, Salmonella enterica enterica serovar Typhi
caaagguaauaucacacccg

SEQ ID NO: 1694604 - RNA, 19 nt, Salmonella enterica enterica serovar Typhi
caaagcaccauucuucaac

SEQ ID NO: 1694605 - RNA, 23 nt, Salmonella enterica enterica serovar Typhi
caaagcacugcugcugaaagaag

SEQ ID NO: 1694606 - RNA, 23 nt, Salmonella enterica enterica serovar Typhi
caaagauauaguuuauugaagug

SEQ ID NO: 1694607 - RNA, 16 nt, Salmonella enterica enterica serovar Typhi
caaagcguaccgucug

SEQ ID NO: 1694608 - RNA, 16 nt, Salmonella enterica enterica serovar Typhi
caaagcccaucagcgc

SEQ ID NO: 1694609 - RNA, 16 nt, Salmonella enterica enterica serovar Typhi
caaagccaggccgcca

SEQ ID NO: 1694610 - RNA, 15 nt, Salmonella enterica enterica serovar Typhi
caaagcccacgcccu

SEQ ID NO: 1694611 - RNA, 17 nt, Salmonella enterica enterica serovar Typhi
caaauagagaaaauaac

SEQ ID NO: 1694612 - RNA, 14 nt, Salmonella enterica enterica serovar Typhi
caaaugccauccca

SEQ ID NO: 1694613 - RNA, 20 nt, Salmonella enterica enterica serovar Typhi
caaaugggaucuucaaugaa

SEQ ID NO: 1694614 - RNA, 17 nt, Salmonella enterica enterica serovar Typhi
caaauuaucuguugaua

SEQ ID NO: 1694615 - RNA, 24 nt, Salmonella enterica enterica serovar Typhi
caaauuaucuguugauaaaacacu

SEQ ID NO: 1694616 - RNA, 18 nt, Salmonella enterica enterica serovar Typhi
caaauuaugauucaaucg

SEQ ID NO: 1694617 - RNA, 17 nt, Salmonella enterica enterica serovar Typhi
caaauuuugauaaaaac

SEQ ID NO: 1694618 - RNA, 18 nt, Salmonella enterica enterica serovar Typhi
caaauucuuuucacgcau

SEQ ID NO: 1694619 - RNA, 21 nt, Salmonella enterica enterica serovar Typhi
caacaaugccacgccccuaag

SEQ ID NO: 1694620 - RNA, 20 nt, Salmonella enterica enterica serovar Typhi
caacacuuagaacgcggaag

SEQ ID NO: 1694621 - RNA, 21 nt, Salmonella enterica enterica serovar Typhi
caacacuuugcgcugcgcauu

SEQ ID NO: 1694622 - RNA, 17 nt, Salmonella enterica enterica serovar Typhi
caacagcucgccaugca

SEQ ID NO: 1694623 - RNA, 14 nt, Salmonella enterica enterica serovar Typhi
caacagcucgccau

SEQ ID NO: 1694624 - RNA, 16 nt, Salmonella enterica enterica serovar Typhi
caacagcuugcgccca

SEQ ID NO: 1694625 - RNA, 15 nt, Salmonella enterica enterica serovar Typhi
caacacgauccccau

SEQ ID NO: 1694626 - RNA, 23 nt, Salmonella enterica enterica serovar Typhi
caacacauaagcaacuugaagua

SEQ ID NO: 1694627 - RNA, 16 nt, Salmonella enterica enterica serovar Typhi
caacacauaagccacu

SEQ ID NO: 1694628 - RNA, 21 nt, Salmonella enterica enterica serovar Typhi
caacgaggugaauaaauccuu

SEQ ID NO: 1694629 - RNA, 20 nt, Salmonella enterica enterica serovar Typhi
caacgcacuguaacgcacug

SEQ ID NO: 1694630 - RNA, 20 nt, Salmonella enterica enterica serovar Typhi
caacgcagacaacguccugc

SEQ ID NO: 1694631 - RNA, 12 nt, Salmonella enterica enterica serovar Typhi
caacgccaagcg

SEQ ID NO: 1694632 - RNA, 15 nt, Salmonella enterica enterica serovar Typhi
caacgccaagcgcgg

SEQ ID NO: 1694633 - RNA, 17 nt, Salmonella enterica enterica serovar Typhi
caacgccaagcgcggca

SEQ ID NO: 1694634 - RNA, 14 nt, Salmonella enterica enterica serovar Typhi
caacgccagcagcg

SEQ ID NO: 1694635 - RNA, 14 nt, Salmonella enterica enterica serovar Typhi
caacgccaacauag

SEQ ID NO: 1694636 - RNA, 18 nt, Salmonella enterica enterica serovar Typhi
caacgcaucgcugcgcuu

SEQ ID NO: 1694637 - RNA, 19 nt, Salmonella enterica enterica serovar Typhi
caacgcaggcuggagagcg

SEQ ID NO: 1694638 - RNA, 18 nt, Salmonella enterica enterica serovar Typhi
caacgaagagaccugugu

SEQ ID NO: 1694639 - RNA, 15 nt, Salmonella enterica enterica serovar Typhi
caaccuuugggcaga

SEQ ID NO: 1694640 - RNA, 15 nt, Salmonella enterica enterica serovar Typhi
caaccugcgcugacg

SEQ ID NO: 1694641 - RNA, 22 nt, Salmonella enterica enterica serovar Typhi
caaccgccagucacccugcccu

SEQ ID NO: 1694642 - RNA, 19 nt, Salmonella enterica enterica serovar Typhi
caaccugccgaugaaagag

SEQ ID NO: 1694643 - RNA, 22 nt, Salmonella enterica enterica serovar Typhi
caaccugcgcagaauuuguuua

SEQ ID NO: 1694644 - RNA, 20 nt, Salmonella enterica enterica serovar Typhi
caaccugaggaaaaagcgca

SEQ ID NO: 1694645 - RNA, 11 nt, Salmonella enterica enterica serovar Typhi
caaccugauau

SEQ ID NO: 1694646 - RNA, 15 nt, Salmonella enterica enterica serovar Typhi
caaccgcucuccgca

SEQ ID NO: 1694647 - RNA, 14 nt, Salmonella enterica enterica serovar Typhi
caaccaaugcaacg

SEQ ID NO: 1694648 - RNA, 18 nt, Salmonella enterica enterica serovar Typhi
caaccaaccaacccaaaa

SEQ ID NO: 1694649 - RNA, 17 nt, Salmonella enterica enterica serovar Typhi
caacauauuuuucacac

SEQ ID NO: 1694650 - RNA, 23 nt, Salmonella enterica enterica serovar Typhi
caacauagcggcaaggaaaacca

SEQ ID NO: 1694651 - RNA, 17 nt, Salmonella enterica enterica serovar Typhi
caacagguaccccgcca

SEQ ID NO: 1694652 - RNA, 13 nt, Salmonella enterica enterica serovar Typhi
caacauacaugcc

SEQ ID NO: 1694653 - RNA, 18 nt, Salmonella enterica enterica serovar Typhi
caacagggcggccuccug

SEQ ID NO: 1694654 - RNA, 13 nt, Salmonella enterica enterica serovar Typhi
caaccaccaaaaa

SEQ ID NO: 1694655 - RNA, 12 nt, Salmonella enterica enterica serovar Typhi
caaccagcaaug

SEQ ID NO: 1694656 - RNA, 18 nt, Salmonella enterica enterica serovar Typhi
caaccagcaaugagacaa

SEQ ID NO: 1694657 - RNA, 13 nt, Salmonella enterica enterica serovar Typhi
caaccagaauaau

SEQ ID NO: 1694658 - RNA, 16 nt, Salmonella enterica enterica serovar Typhi
caaccagaauaauggg

SEQ ID NO: 1694659 - RNA, 15 nt, Salmonella enterica enterica serovar Typhi
caaccccguggugac

SEQ ID NO: 1694660 - RNA, 20 nt, Salmonella enterica enterica serovar Typhi
caaccccaaacaccaacaaa

SEQ ID NO: 1694661 - RNA, 21 nt, Salmonella enterica enterica serovar Typhi
caacccgcuccagaagcacuu

SEQ ID NO: 1694662 - RNA, 14 nt, Salmonella enterica enterica serovar Typhi
caaucaucagaaga

SEQ ID NO: 1694663 - RNA, 20 nt, Salmonella enterica enterica serovar Typhi
caaucauugugguuucccug

SEQ ID NO: 1694664 - RNA, 18 nt, Salmonella enterica enterica serovar Typhi
caauccgcgccgcaucuu

SEQ ID NO: 1694665 - RNA, 23 nt, Salmonella enterica enterica serovar Typhi
caauauugaacauuuuuucagcc

SEQ ID NO: 1694666 - RNA, 15 nt, Salmonella enterica enterica serovar Typhi
caauauuuauuuaau

SEQ ID NO: 1694667 - RNA, 21 nt, Salmonella enterica enterica serovar Typhi
caaucaucagaccgauaaaua

SEQ ID NO: 1694668 - RNA, 22 nt, Salmonella enterica enterica serovar Typhi
caaucuccuccggcuucagcaa

SEQ ID NO: 1694669 - RNA, 18 nt, Salmonella enterica enterica serovar Typhi
caaucuccagaccgcugc

SEQ ID NO: 1694670 - RNA, 15 nt, Salmonella enterica enterica serovar Typhi
caaucucuuccgccc

SEQ ID NO: 1694671 - RNA, 22 nt, Salmonella enterica enterica serovar Typhi
caaucucgcaagauuccagaua

SEQ ID NO: 1694672 - RNA, 13 nt, Salmonella enterica enterica serovar Typhi
caaucucuauacc

SEQ ID NO: 1694673 - RNA, 23 nt, Salmonella enterica enterica serovar Typhi
caaucggcgauaaaccaacagcc

SEQ ID NO: 1694674 - RNA, 21 nt, Salmonella enterica enterica serovar Typhi
caaucggcgucuggagcgugc

SEQ ID NO: 1694675 - RNA, 16 nt, Salmonella enterica enterica serovar Typhi
caaucgcguuuuccag

SEQ ID NO: 1694676 - RNA, 13 nt, Salmonella enterica enterica serovar Typhi
caaucgccugcaa

SEQ ID NO: 1694677 - RNA, 15 nt, Salmonella enterica enterica serovar Typhi
caaucgccugcugua

SEQ ID NO: 1694678 - RNA, 18 nt, Salmonella enterica enterica serovar Typhi
caauccguuauuucacag

SEQ ID NO: 1694679 - RNA, 13 nt, Salmonella enterica enterica serovar Typhi
caaugaucagacg

SEQ ID NO: 1694680 - RNA, 19 nt, Salmonella enterica enterica serovar Typhi
caaugaacagcacguuacc

SEQ ID NO: 1694681 - RNA, 20 nt, Salmonella enterica enterica serovar Typhi
caaugagauccacugagcgc

SEQ ID NO: 1694682 - RNA, 14 nt, Salmonella enterica enterica serovar Typhi
caaugcaacgccuu

SEQ ID NO: 1694683 - RNA, 15 nt, Salmonella enterica enterica serovar Typhi
caaugcccacgccgu

SEQ ID NO: 1694684 - RNA, 13 nt, Salmonella enterica enterica serovar Typhi
caaugcccaaaau

SEQ ID NO: 1694685 - RNA, 13 nt, Salmonella enterica enterica serovar Typhi
caaugcccagcgc

SEQ ID NO: 1694686 - RNA, 15 nt, Salmonella enterica enterica serovar Typhi
caaugccaccagcgc

SEQ ID NO: 1694687 - RNA, 18 nt, Salmonella enterica enterica serovar Typhi
caaugccaaaaaaacuaa

SEQ ID NO: 1694688 - RNA, 15 nt, Salmonella enterica enterica serovar Typhi
caaugcgaauaacau

SEQ ID NO: 1694689 - RNA, 16 nt, Salmonella enterica enterica serovar Typhi
caaugccuaacccuuu

SEQ ID NO: 1694690 - RNA, 19 nt, Salmonella enterica enterica serovar Typhi
caaugccuaacccuuuucc

SEQ ID NO: 1694691 - RNA, 20 nt, Salmonella enterica enterica serovar Typhi
caaugccgcgggaaauacca

SEQ ID NO: 1694692 - RNA, 21 nt, Salmonella enterica enterica serovar Typhi
caaugccgcgggaaauaccaa

SEQ ID NO: 1694693 - RNA, 17 nt, Salmonella enterica enterica serovar Typhi
caaugccggacgccacc

SEQ ID NO: 1694694 - RNA, 21 nt, Salmonella enterica enterica serovar Typhi
caaguacagcuuaaucaccag

SEQ ID NO: 1694695 - RNA, 15 nt, Salmonella enterica enterica serovar Typhi
caaguaauaaaauaa

SEQ ID NO: 1694696 - RNA, 18 nt, Salmonella enterica enterica serovar Typhi
caaguaaaaugcccugcu

SEQ ID NO: 1694697 - RNA, 12 nt, Salmonella enterica enterica serovar Typhi
caauaaauaaua

SEQ ID NO: 1694698 - RNA, 15 nt, Salmonella enterica enterica serovar Typhi
caauaacagccagcg

SEQ ID NO: 1694699 - RNA, 19 nt, Salmonella enterica enterica serovar Typhi
caauaaucccuucuuuuac

SEQ ID NO: 1694700 - RNA, 18 nt, Salmonella enterica enterica serovar Typhi
caauaaucgaaauaaagu

SEQ ID NO: 1694701 - RNA, 19 nt, Salmonella enterica enterica serovar Typhi
caauaauggagaugaaaau

SEQ ID NO: 1694702 - RNA, 19 nt, Salmonella enterica enterica serovar Typhi
caauaugcagaucgacggu

SEQ ID NO: 1694703 - RNA, 15 nt, Salmonella enterica enterica serovar Typhi
caauauggcaccgaa

SEQ ID NO: 1694704 - RNA, 17 nt, Salmonella enterica enterica serovar Typhi
caauaugucuuaaacag

SEQ ID NO: 1694705 - RNA, 14 nt, Salmonella enterica enterica serovar Typhi
caauauuaaauaaa

SEQ ID NO: 1694706 - RNA, 15 nt, Salmonella enterica enterica serovar Typhi
caauauuaaauaaau

SEQ ID NO: 1694707 - RNA, 15 nt, Salmonella enterica enterica serovar Typhi
caauauguuuaaaga

SEQ ID NO: 1694708 - RNA, 19 nt, Salmonella enterica enterica serovar Typhi
caauaguauccauaauuuu

SEQ ID NO: 1694709 - RNA, 22 nt, Salmonella enterica enterica serovar Typhi
caauaguauccauaauuuuccc

SEQ ID NO: 1694710 - RNA, 23 nt, Salmonella enterica enterica serovar Typhi
caauagcgcgucguugccuuugc

SEQ ID NO: 1694711 - RNA, 15 nt, Salmonella enterica enterica serovar Typhi
caauagcgcuaaaca

SEQ ID NO: 1694712 - RNA, 18 nt, Salmonella enterica enterica serovar Typhi
caauagcgagaggcaauu

SEQ ID NO: 1694713 - RNA, 19 nt, Salmonella enterica enterica serovar Typhi
caauagccaauaacgucug

SEQ ID NO: 1694714 - RNA, 16 nt, Salmonella enterica enterica serovar Typhi
caauagcaaucuguaa

SEQ ID NO: 1694715 - RNA, 17 nt, Salmonella enterica enterica serovar Typhi
caauagcaaucuguaac

SEQ ID NO: 1694716 - RNA, 23 nt, Salmonella enterica enterica serovar Typhi
caauagaguaaugacaaaaauua

SEQ ID NO: 1694717 - RNA, 22 nt, Salmonella enterica enterica serovar Typhi
caauacuuuuugacuccugaca

SEQ ID NO: 1694718 - RNA, 18 nt, Salmonella enterica enterica serovar Typhi
caauaccacaaccggaau

SEQ ID NO: 1694719 - RNA, 15 nt, Salmonella enterica enterica serovar Typhi
caauacccagcgcca

SEQ ID NO: 1694720 - RNA, 20 nt, Salmonella enterica enterica serovar Typhi
caauacuccacaguucaaug

SEQ ID NO: 1694721 - RNA, 19 nt, Salmonella enterica enterica serovar Typhi
caagguggaaaaaagauaa

SEQ ID NO: 1694722 - RNA, 14 nt, Salmonella enterica enterica serovar Typhi
caaggucggcuccu

SEQ ID NO: 1694723 - RNA, 17 nt, Salmonella enterica enterica serovar Typhi
caagggagugagucccc

SEQ ID NO: 1694724 - RNA, 15 nt, Salmonella enterica enterica serovar Typhi
caaggcgcaaaacca

SEQ ID NO: 1694725 - RNA, 12 nt, Salmonella enterica enterica serovar Typhi
caaggcgcgcca

SEQ ID NO: 1694726 - RNA, 15 nt, Salmonella enterica enterica serovar Typhi
caaggcgacucaaaa

SEQ ID NO: 1694727 - RNA, 19 nt, Salmonella enterica enterica serovar Typhi
caaggcgcaaaaccauacu

SEQ ID NO: 1694728 - RNA, 13 nt, Salmonella enterica enterica serovar Typhi
caagcggcggcca

SEQ ID NO: 1694729 - RNA, 14 nt, Salmonella enterica enterica serovar Typhi
caagcgcggcagca

SEQ ID NO: 1694730 - RNA, 17 nt, Salmonella enterica enterica serovar Typhi
caagcgcggcagcagcu

SEQ ID NO: 1694731 - RNA, 21 nt, Salmonella enterica enterica serovar Typhi
caagccccccgcacagcacau

SEQ ID NO: 1694732 - RNA, 14 nt, Salmonella enterica enterica serovar Typhi
caagcccagcucag

SEQ ID NO: 1694733 - RNA, 11 nt, Salmonella enterica enterica serovar Typhi
caagcccagcu

SEQ ID NO: 1694734 - RNA, 14 nt, Salmonella enterica enterica serovar Typhi
caagcccaacuauu

SEQ ID NO: 1694735 - RNA, 15 nt, Salmonella enterica enterica serovar Typhi
caagagccgccgcca

SEQ ID NO: 1694736 - RNA, 24 nt, Salmonella enterica enterica serovar Typhi
caagagguaaugcccgauggcgcu

SEQ ID NO: 1694737 - RNA, 13 nt, Salmonella enterica enterica serovar Typhi
caagcacaaaaag

SEQ ID NO: 1694738 - RNA, 15 nt, Salmonella enterica enterica serovar Typhi
caagcacugaaugcu

SEQ ID NO: 1694739 - RNA, 13 nt, Salmonella enterica enterica serovar Typhi
caagcagaaauac

SEQ ID NO: 1694740 - RNA, 12 nt, Salmonella enterica enterica serovar Typhi
caacuucugcug

SEQ ID NO: 1694741 - RNA, 20 nt, Salmonella enterica enterica serovar Typhi
caacuuuuucuuaagcugag

SEQ ID NO: 1694742 - RNA, 23 nt, Salmonella enterica enterica serovar Typhi
caagaaaugcaggcguuuuauug

SEQ ID NO: 1694743 - RNA, 23 nt, Salmonella enterica enterica serovar Typhi
caagaaccgcuuuuccugcugcc

SEQ ID NO: 1694744 - RNA, 21 nt, Salmonella enterica enterica serovar Typhi
caagacgguuauuuuucagau

SEQ ID NO: 1694745 - RNA, 18 nt, Salmonella enterica enterica serovar Typhi
caagaccgccuaacagcg

SEQ ID NO: 1694746 - RNA, 17 nt, Salmonella enterica enterica serovar Typhi
caagaccgccuaacagc

SEQ ID NO: 1694747 - RNA, 17 nt, Salmonella enterica enterica serovar Typhi
caagacgaaaaaugaau

SEQ ID NO: 1694748 - RNA, 16 nt, Salmonella enterica enterica serovar Typhi
caagacgaaaaaugaa

SEQ ID NO: 1694749 - RNA, 15 nt, Salmonella enterica enterica serovar Typhi
caacgccuccugccg

SEQ ID NO: 1694750 - RNA, 19 nt, Salmonella enterica enterica serovar Typhi
caacguuuucagcagugca

SEQ ID NO: 1694751 - RNA, 13 nt, Salmonella enterica enterica serovar Typhi
caacuccgccggc

SEQ ID NO: 1694752 - RNA, 23 nt, Salmonella enterica enterica serovar Typhi
caacuccgccggcgcggaaggga

SEQ ID NO: 1694753 - RNA, 17 nt, Salmonella enterica enterica serovar Typhi
caacugauucaaaaggu

SEQ ID NO: 1694754 - RNA, 19 nt, Salmonella enterica enterica serovar Typhi
caacugauuaaucugccga

SEQ ID NO: 1694755 - RNA, 22 nt, Salmonella enterica enterica serovar Typhi
caacucgcacaguacaccugca

SEQ ID NO: 1694756 - RNA, 13 nt, Salmonella enterica enterica serovar Typhi
caacucgcacuga

SEQ ID NO: 1694757 - RNA, 16 nt, Salmonella enterica enterica serovar Typhi
caacuucguucaguuc

SEQ ID NO: 1694758 - RNA, 21 nt, Salmonella enterica enterica serovar Typhi
caacuucuaauuuuuccagca

SEQ ID NO: 1694759 - RNA, 22 nt, Salmonella enterica enterica serovar Typhi
caacuguuuuaccaaaucaaua

SEQ ID NO: 1694760 - RNA, 17 nt, Salmonella enterica enterica serovar Typhi
caacuguucuucgguuu

SEQ ID NO: 1694761 - RNA, 15 nt, Salmonella enterica enterica serovar Typhi
caacugggcuugcau

SEQ ID NO: 1694762 - RNA, 15 nt, Salmonella enterica enterica serovar Typhi
caacuguauuuugaa

SEQ ID NO: 1694763 - RNA, 14 nt, Salmonella enterica enterica serovar Typhi
cagcgccugaaugu

SEQ ID NO: 1694764 - RNA, 20 nt, Salmonella enterica enterica serovar Typhi
cagcgcgauacgcagcaccg

SEQ ID NO: 1694765 - RNA, 19 nt, Salmonella enterica enterica serovar Typhi
cagcgcgccaaaguuaauc

SEQ ID NO: 1694766 - RNA, 19 nt, Salmonella enterica enterica serovar Typhi
cagcgcgcccgccaccagc

SEQ ID NO: 1694767 - RNA, 14 nt, Salmonella enterica enterica serovar Typhi
cagcgcgccgcagc

SEQ ID NO: 1694768 - RNA, 15 nt, Salmonella enterica enterica serovar Typhi
cagcgcgcgacccag

SEQ ID NO: 1694769 - RNA, 19 nt, Salmonella enterica enterica serovar Typhi
cagcgccgucauaccgccc

SEQ ID NO: 1694770 - RNA, 21 nt, Salmonella enterica enterica serovar Typhi
cagcgccggaucgggcuucca

SEQ ID NO: 1694771 - RNA, 14 nt, Salmonella enterica enterica serovar Typhi
cagcgccggcagca

SEQ ID NO: 1694772 - RNA, 15 nt, Salmonella enterica enterica serovar Typhi
cagcgccggcagcag

SEQ ID NO: 1694773 - RNA, 18 nt, Salmonella enterica enterica serovar Typhi
cagcgccgcgaaugugcc

SEQ ID NO: 1694774 - RNA, 14 nt, Salmonella enterica enterica serovar Typhi
cagcgccgcgccga

SEQ ID NO: 1694775 - RNA, 17 nt, Salmonella enterica enterica serovar Typhi
cagcgcaccuucaacag

SEQ ID NO: 1694776 - RNA, 15 nt, Salmonella enterica enterica serovar Typhi
cagcgagacgcugga

SEQ ID NO: 1694777 - RNA, 14 nt, Salmonella enterica enterica serovar Typhi
cagcgacucauuca

SEQ ID NO: 1694778 - RNA, 14 nt, Salmonella enterica enterica serovar Typhi
cagcgccccgccgc

SEQ ID NO: 1694779 - RNA, 15 nt, Salmonella enterica enterica serovar Typhi
cagcgcccagcagcu

SEQ ID NO: 1694780 - RNA, 19 nt, Salmonella enterica enterica serovar Typhi
cagcgccagcgugcgcagc

SEQ ID NO: 1694781 - RNA, 19 nt, Salmonella enterica enterica serovar Typhi
cagcgccagcggcugcucc

SEQ ID NO: 1694782 - RNA, 18 nt, Salmonella enterica enterica serovar Typhi
cagcgccaguuuuucccg

SEQ ID NO: 1694783 - RNA, 19 nt, Salmonella enterica enterica serovar Typhi
cagcgccauccggcaaaau

SEQ ID NO: 1694784 - RNA, 14 nt, Salmonella enterica enterica serovar Typhi
cagcgccagcccug

SEQ ID NO: 1694785 - RNA, 14 nt, Salmonella enterica enterica serovar Typhi
cagcgccagcagca

SEQ ID NO: 1694786 - RNA, 17 nt, Salmonella enterica enterica serovar Typhi
cagcgccagcggcggcu

SEQ ID NO: 1694787 - RNA, 16 nt, Salmonella enterica enterica serovar Typhi
cagcgccagcggcugc

SEQ ID NO: 1694788 - RNA, 16 nt, Salmonella enterica enterica serovar Typhi
cagcgccagcccugcg

SEQ ID NO: 1694789 - RNA, 13 nt, Salmonella enterica enterica serovar Typhi
cagcgccagccgc

SEQ ID NO: 1694790 - RNA, 12 nt, Salmonella enterica enterica serovar Typhi
cagcgccaccgg

SEQ ID NO: 1694791 - RNA, 21 nt, Salmonella enterica enterica serovar Typhi
cagcgccacggagcauaauuu

SEQ ID NO: 1694792 - RNA, 23 nt, Salmonella enterica enterica serovar Typhi
cagcccuaaauggagcgagcugg

SEQ ID NO: 1694793 - RNA, 16 nt, Salmonella enterica enterica serovar Typhi
cagcccuuugagaaaa

SEQ ID NO: 1694794 - RNA, 15 nt, Salmonella enterica enterica serovar Typhi
cagccauccccauau

SEQ ID NO: 1694795 - RNA, 13 nt, Salmonella enterica enterica serovar Typhi
cagccauccgacg

SEQ ID NO: 1694796 - RNA, 22 nt, Salmonella enterica enterica serovar Typhi
cagccauggcccaaaagguagc

SEQ ID NO: 1694797 - RNA, 22 nt, Salmonella enterica enterica serovar Typhi
cagccaugccauauggccgucg

SEQ ID NO: 1694798 - RNA, 21 nt, Salmonella enterica enterica serovar Typhi
cagcccguucugugcgccgcu

SEQ ID NO: 1694799 - RNA, 14 nt, Salmonella enterica enterica serovar Typhi
cagccauucaccac

SEQ ID NO: 1694800 - RNA, 13 nt, Salmonella enterica enterica serovar Typhi
cagccauggcccu

SEQ ID NO: 1694801 - RNA, 14 nt, Salmonella enterica enterica serovar Typhi
cagccgaucaggcc

SEQ ID NO: 1694802 - RNA, 24 nt, Salmonella enterica enterica serovar Typhi
cagccgaucaacgggguuagcguu

SEQ ID NO: 1694803 - RNA, 16 nt, Salmonella enterica enterica serovar Typhi
cagccgauaacucuuc

SEQ ID NO: 1694804 - RNA, 17 nt, Salmonella enterica enterica serovar Typhi
cagccgaucuauuucau

SEQ ID NO: 1694805 - RNA, 17 nt, Salmonella enterica enterica serovar Typhi
cagccgcgccaucuccu

SEQ ID NO: 1694806 - RNA, 23 nt, Salmonella enterica enterica serovar Typhi
cagccgcauuuuucauggugaac

SEQ ID NO: 1694807 - RNA, 21 nt, Salmonella enterica enterica serovar Typhi
cagccgcccgcgauaaaaauc

SEQ ID NO: 1694808 - RNA, 15 nt, Salmonella enterica enterica serovar Typhi
cagccugccgucuuu

SEQ ID NO: 1694809 - RNA, 23 nt, Salmonella enterica enterica serovar Typhi
cagccggaaaagcgcuggcuggc

SEQ ID NO: 1694810 - RNA, 21 nt, Salmonella enterica enterica serovar Typhi
cagccggaaaagcgcuggcug

SEQ ID NO: 1694811 - RNA, 15 nt, Salmonella enterica enterica serovar Typhi
cagcgaaccuuccau

SEQ ID NO: 1694812 - RNA, 21 nt, Salmonella enterica enterica serovar Typhi
cagcgacaaggcaccguuucu

SEQ ID NO: 1694813 - RNA, 21 nt, Salmonella enterica enterica serovar Typhi
cagcgaauuccggccaucaga

SEQ ID NO: 1694814 - RNA, 19 nt, Salmonella enterica enterica serovar Typhi
cagccuggagagcagcgcc

SEQ ID NO: 1694815 - RNA, 13 nt, Salmonella enterica enterica serovar Typhi
cagccugcugguc

SEQ ID NO: 1694816 - RNA, 21 nt, Salmonella enterica enterica serovar Typhi
cagccugcuggucugaaucug

SEQ ID NO: 1694817 - RNA, 17 nt, Salmonella enterica enterica serovar Typhi
cagcgaaacgacgucga

SEQ ID NO: 1694818 - RNA, 23 nt, Salmonella enterica enterica serovar Typhi
cagcgaaacgacgucgacgccuu

SEQ ID NO: 1694819 - RNA, 16 nt, Salmonella enterica enterica serovar Typhi
cagcgaaagcugccuu

SEQ ID NO: 1694820 - RNA, 23 nt, Salmonella enterica enterica serovar Typhi
cagcgaaaugacggccaccagcg

SEQ ID NO: 1694821 - RNA, 17 nt, Salmonella enterica enterica serovar Typhi
cagcgaaagcugccuuu

SEQ ID NO: 1694822 - RNA, 23 nt, Salmonella enterica enterica serovar Typhi
cagcagauagcccgccagcacca

SEQ ID NO: 1694823 - RNA, 22 nt, Salmonella enterica enterica serovar Typhi
cagcagacugccuacgcggcca

SEQ ID NO: 1694824 - RNA, 14 nt, Salmonella enterica enterica serovar Typhi
cagcagacagguga

SEQ ID NO: 1694825 - RNA, 12 nt, Salmonella enterica enterica serovar Typhi
cagcagaauaac

SEQ ID NO: 1694826 - RNA, 16 nt, Salmonella enterica enterica serovar Typhi
cagcagacaggugaac

SEQ ID NO: 1694827 - RNA, 16 nt, Salmonella enterica enterica serovar Typhi
cagcagcgcuuucuuc

SEQ ID NO: 1694828 - RNA, 22 nt, Salmonella enterica enterica serovar Typhi
cagcagcgcuuucuucuucacg

SEQ ID NO: 1694829 - RNA, 20 nt, Salmonella enterica enterica serovar Typhi
cagcagcgcccagccaaagc

SEQ ID NO: 1694830 - RNA, 13 nt, Salmonella enterica enterica serovar Typhi
cagcagcugcugu

SEQ ID NO: 1694831 - RNA, 17 nt, Salmonella enterica enterica serovar Typhi
cagcagcuucaugcauc

SEQ ID NO: 1694832 - RNA, 14 nt, Salmonella enterica enterica serovar Typhi
cagcagcuucagca

SEQ ID NO: 1694833 - RNA, 15 nt, Salmonella enterica enterica serovar Typhi
cagcauauccagcgc

SEQ ID NO: 1694834 - RNA, 19 nt, Salmonella enterica enterica serovar Typhi
cagcauauccagcgccugc

SEQ ID NO: 1694835 - RNA, 14 nt, Salmonella enterica enterica serovar Typhi
cagcauagucgcuc

SEQ ID NO: 1694836 - RNA, 21 nt, Salmonella enterica enterica serovar Typhi
cagcauacugaugucguugua

SEQ ID NO: 1694837 - RNA, 23 nt, Salmonella enterica enterica serovar Typhi
cagcauaauauucauaacgccga

SEQ ID NO: 1694838 - RNA, 18 nt, Salmonella enterica enterica serovar Typhi
cagcauacgacaucgcca

SEQ ID NO: 1694839 - RNA, 17 nt, Salmonella enterica enterica serovar Typhi
cagcauacgucugcgcu

SEQ ID NO: 1694840 - RNA, 16 nt, Salmonella enterica enterica serovar Typhi
cagcagugggaaaauu

SEQ ID NO: 1694841 - RNA, 23 nt, Salmonella enterica enterica serovar Typhi
cagcaguggcucagucagucccg

SEQ ID NO: 1694842 - RNA, 16 nt, Salmonella enterica enterica serovar Typhi
cagcagucucuacuac

SEQ ID NO: 1694843 - RNA, 17 nt, Salmonella enterica enterica serovar Typhi
cagcaguuccccgccgc

SEQ ID NO: 1694844 - RNA, 18 nt, Salmonella enterica enterica serovar Typhi
cagcaguuggcggaggug

SEQ ID NO: 1694845 - RNA, 17 nt, Salmonella enterica enterica serovar Typhi
cagccacaugccuucuu

SEQ ID NO: 1694846 - RNA, 12 nt, Salmonella enterica enterica serovar Typhi
cagccacccacu

SEQ ID NO: 1694847 - RNA, 19 nt, Salmonella enterica enterica serovar Typhi
cagcauuucaaucgcgccc

SEQ ID NO: 1694848 - RNA, 19 nt, Salmonella enterica enterica serovar Typhi
cagcauugggucaugcgga

SEQ ID NO: 1694849 - RNA, 22 nt, Salmonella enterica enterica serovar Typhi
cagccaaaaauaacgcccugcg

SEQ ID NO: 1694850 - RNA, 17 nt, Salmonella enterica enterica serovar Typhi
cagccaaaauaugcugg

SEQ ID NO: 1694851 - RNA, 15 nt, Salmonella enterica enterica serovar Typhi
cagccaaaacgucgu

SEQ ID NO: 1694852 - RNA, 12 nt, Salmonella enterica enterica serovar Typhi
cagcauuucuuc

SEQ ID NO: 1694853 - RNA, 14 nt, Salmonella enterica enterica serovar Typhi
cagccaggucugca

SEQ ID NO: 1694854 - RNA, 11 nt, Salmonella enterica enterica serovar Typhi
cagccaggugg

SEQ ID NO: 1694855 - RNA, 17 nt, Salmonella enterica enterica serovar Typhi
cagccagguugccagaa

SEQ ID NO: 1694856 - RNA, 23 nt, Salmonella enterica enterica serovar Typhi
cagccagggaucaagcaaugcca

SEQ ID NO: 1694857 - RNA, 17 nt, Salmonella enterica enterica serovar Typhi
cagccagcucaccagcc

SEQ ID NO: 1694858 - RNA, 23 nt, Salmonella enterica enterica serovar Typhi
cagccaggcgaucgcacagagau

SEQ ID NO: 1694859 - RNA, 17 nt, Salmonella enterica enterica serovar Typhi
cagccaggcaaaacagu

SEQ ID NO: 1694860 - RNA, 18 nt, Salmonella enterica enterica serovar Typhi
cagccaggcaaagcccca

SEQ ID NO: 1694861 - RNA, 19 nt, Salmonella enterica enterica serovar Typhi
cagccagccguugugcugg

SEQ ID NO: 1694862 - RNA, 20 nt, Salmonella enterica enterica serovar Typhi
cagccagcgccaccaaagcc

SEQ ID NO: 1694863 - RNA, 17 nt, Salmonella enterica enterica serovar Typhi
cagccacggcaacgccg

SEQ ID NO: 1694864 - RNA, 17 nt, Salmonella enterica enterica serovar Typhi
cagcauuaacccggccc

SEQ ID NO: 1694865 - RNA, 15 nt, Salmonella enterica enterica serovar Typhi
cagcauggcgccugc

SEQ ID NO: 1694866 - RNA, 21 nt, Salmonella enterica enterica serovar Typhi
cagcaugaauaaccucccgcc

SEQ ID NO: 1694867 - RNA, 16 nt, Salmonella enterica enterica serovar Typhi
cagcaugagccagccc

SEQ ID NO: 1694868 - RNA, 14 nt, Salmonella enterica enterica serovar Typhi
cagcaugcccgcca

SEQ ID NO: 1694869 - RNA, 19 nt, Salmonella enterica enterica serovar Typhi
cagcaucccgcuggcgcca

SEQ ID NO: 1694870 - RNA, 20 nt, Salmonella enterica enterica serovar Typhi
cagcaucaucucccaggccg

SEQ ID NO: 1694871 - RNA, 22 nt, Salmonella enterica enterica serovar Typhi
cagcaucaucucccaggccgcc

SEQ ID NO: 1694872 - RNA, 21 nt, Salmonella enterica enterica serovar Typhi
cagcaucaugggcucaucaaa

SEQ ID NO: 1694873 - RNA, 13 nt, Salmonella enterica enterica serovar Typhi
cagcauccaugcc

SEQ ID NO: 1694874 - RNA, 16 nt, Salmonella enterica enterica serovar Typhi
cagcaucaccggcccc

SEQ ID NO: 1694875 - RNA, 14 nt, Salmonella enterica enterica serovar Typhi
cagcaucuccuggc

SEQ ID NO: 1694876 - RNA, 17 nt, Salmonella enterica enterica serovar Typhi
cagcaucuuaugcgcaa

SEQ ID NO: 1694877 - RNA, 22 nt, Salmonella enterica enterica serovar Typhi
cagcaucugcauaauggcgacg

SEQ ID NO: 1694878 - RNA, 24 nt, Salmonella enterica enterica serovar Typhi
cagcaucugcggcuuucaucauuc

SEQ ID NO: 1694879 - RNA, 23 nt, Salmonella enterica enterica serovar Typhi
cagcaucgcccgggcaauuucuc

SEQ ID NO: 1694880 - RNA, 15 nt, Salmonella enterica enterica serovar Typhi
cagcaucgccaucaa

SEQ ID NO: 1694881 - RNA, 17 nt, Salmonella enterica enterica serovar Typhi
cagcaucgggaaucauc

SEQ ID NO: 1694882 - RNA, 17 nt, Salmonella enterica enterica serovar Typhi
cagcaaugccgccgcca

SEQ ID NO: 1694883 - RNA, 18 nt, Salmonella enterica enterica serovar Typhi
cagcaagucgcgggcgcu

SEQ ID NO: 1694884 - RNA, 17 nt, Salmonella enterica enterica serovar Typhi
cagcaaggcugccgcca

SEQ ID NO: 1694885 - RNA, 22 nt, Salmonella enterica enterica serovar Typhi
cagcacaauaccuucugcgccc

SEQ ID NO: 1694886 - RNA, 14 nt, Salmonella enterica enterica serovar Typhi
cagcacaaaauccc

SEQ ID NO: 1694887 - RNA, 20 nt, Salmonella enterica enterica serovar Typhi
cagcaauuccgccaucucau

SEQ ID NO: 1694888 - RNA, 20 nt, Salmonella enterica enterica serovar Typhi
cagcaauguuaaauucagca

SEQ ID NO: 1694889 - RNA, 20 nt, Salmonella enterica enterica serovar Typhi
cagcaaugccgccgccaggu

SEQ ID NO: 1694890 - RNA, 23 nt, Salmonella enterica enterica serovar Typhi
cagcaauuccgccaucucauucg

SEQ ID NO: 1694891 - RNA, 17 nt, Salmonella enterica enterica serovar Typhi
cagcaacgagcuuuuuu

SEQ ID NO: 1694892 - RNA, 13 nt, Salmonella enterica enterica serovar Typhi
cagcaacgcccag

SEQ ID NO: 1694893 - RNA, 21 nt, Salmonella enterica enterica serovar Typhi
aaaauggaugcgcccacaaug

SEQ ID NO: 1694894 - RNA, 13 nt, Salmonella enterica enterica serovar Typhi
cagcaacgcgcca

SEQ ID NO: 1694895 - RNA, 15 nt, Salmonella enterica enterica serovar Typhi
cagcacacuacacag

SEQ ID NO: 1694896 - RNA, 19 nt, Salmonella enterica enterica serovar Typhi
cagcacauucagcagcgcc

SEQ ID NO: 1694897 - RNA, 22 nt, Salmonella enterica enterica serovar Typhi
cagcacauuacaggcaucuucc

SEQ ID NO: 1694898 - RNA, 15 nt, Salmonella enterica enterica serovar Typhi
cagcaccgcuggcga

SEQ ID NO: 1694899 - RNA, 16 nt, Salmonella enterica enterica serovar Typhi
cagcacgaugcauaug

SEQ ID NO: 1694900 - RNA, 18 nt, Salmonella enterica enterica serovar Typhi
cagcacgccggaaagaau

SEQ ID NO: 1694901 - RNA, 19 nt, Salmonella enterica enterica serovar Typhi
cagcacgccgcccgccuga

SEQ ID NO: 1694902 - RNA, 15 nt, Salmonella enterica enterica serovar Typhi
cagcacgcucaaaua

SEQ ID NO: 1694903 - RNA, 19 nt, Salmonella enterica enterica serovar Typhi
cagcagaacaaccagugcg

SEQ ID NO: 1694904 - RNA, 19 nt, Salmonella enterica enterica serovar Typhi
cagcacuuccggaucgcua

SEQ ID NO: 1694905 - RNA, 15 nt, Salmonella enterica enterica serovar Typhi
cagcacuucccgcuc

SEQ ID NO: 1694906 - RNA, 15 nt, Salmonella enterica enterica serovar Typhi
cagaucgaccagcgc

SEQ ID NO: 1694907 - RNA, 20 nt, Salmonella enterica enterica serovar Typhi
cagaucgccaaagucauugc

SEQ ID NO: 1694908 - RNA, 23 nt, Salmonella enterica enterica serovar Typhi
cagaucguagccauguuccucac

SEQ ID NO: 1694909 - RNA, 18 nt, Salmonella enterica enterica serovar Typhi
cagaucguaugcgccugu

SEQ ID NO: 1694910 - RNA, 20 nt, Salmonella enterica enterica serovar Typhi
cagaucguaugcgccuguua

SEQ ID NO: 1694911 - RNA, 15 nt, Salmonella enterica enterica serovar Typhi
cagaucgguuuaucc

SEQ ID NO: 1694912 - RNA, 16 nt, Salmonella enterica enterica serovar Typhi
cagaucgguuuauccc

SEQ ID NO: 1694913 - RNA, 22 nt, Salmonella enterica enterica serovar Typhi
cagauaacgcaucagacuguua

SEQ ID NO: 1694914 - RNA, 13 nt, Salmonella enterica enterica serovar Typhi
cagauaacuuccu

SEQ ID NO: 1694915 - RNA, 13 nt, Salmonella enterica enterica serovar Typhi
cagauaacugagc

SEQ ID NO: 1694916 - RNA, 21 nt, Salmonella enterica enterica serovar Typhi
cagauaacugagcuugagcca

SEQ ID NO: 1694917 - RNA, 20 nt, Salmonella enterica enterica serovar Typhi
cagauaagcgacucuguauu

SEQ ID NO: 1694918 - RNA, 16 nt, Salmonella enterica enterica serovar Typhi
cagaugcaguucaccc

SEQ ID NO: 1694919 - RNA, 21 nt, Salmonella enterica enterica serovar Typhi
cagaugcgccagauucaugau

SEQ ID NO: 1694920 - RNA, 17 nt, Salmonella enterica enterica serovar Typhi
cagaugcagcaacguuu

SEQ ID NO: 1694921 - RNA, 18 nt, Salmonella enterica enterica serovar Typhi
cagaucuugugaguaaua

SEQ ID NO: 1694922 - RNA, 17 nt, Salmonella enterica enterica serovar Typhi
cagaucuuuauccugca

SEQ ID NO: 1694923 - RNA, 22 nt, Salmonella enterica enterica serovar Typhi
cagaucuuauaugagcgggccg

SEQ ID NO: 1694924 - RNA, 21 nt, Salmonella enterica enterica serovar Typhi
cagaucuucaaucgugaccac

SEQ ID NO: 1694925 - RNA, 18 nt, Salmonella enterica enterica serovar Typhi
cagauuucgcagcagcau

SEQ ID NO: 1694926 - RNA, 18 nt, Salmonella enterica enterica serovar Typhi
cagauuacgcauggucaa

SEQ ID NO: 1694927 - RNA, 17 nt, Salmonella enterica enterica serovar Typhi
cagauuaugcaguucuu

SEQ ID NO: 1694928 - RNA, 15 nt, Salmonella enterica enterica serovar Typhi
cagauuuucuuuaau

SEQ ID NO: 1694929 - RNA, 15 nt, Salmonella enterica enterica serovar Typhi
cagaugcgcuucaag

SEQ ID NO: 1694930 - RNA, 17 nt, Salmonella enterica enterica serovar Typhi
cagaugcuuaaacugcg

SEQ ID NO: 1694931 - RNA, 18 nt, Salmonella enterica enterica serovar Typhi
cagaugguuggcgccgau

SEQ ID NO: 1694932 - RNA, 20 nt, Salmonella enterica enterica serovar Typhi
cagauggugauagcgcgcca

SEQ ID NO: 1694933 - RNA, 18 nt, Salmonella enterica enterica serovar Typhi
cagaugggccauuuacgc

SEQ ID NO: 1694934 - RNA, 22 nt, Salmonella enterica enterica serovar Typhi
cagauggcgauucauaugcgcc

SEQ ID NO: 1694935 - RNA, 21 nt, Salmonella enterica enterica serovar Typhi
cagauggcgucacauggcgaa

SEQ ID NO: 1694936 - RNA, 23 nt, Salmonella enterica enterica serovar Typhi
cagauguccaccgauuucaucgc

SEQ ID NO: 1694937 - RNA, 15 nt, Salmonella enterica enterica serovar Typhi
cagauguuauaaacu

SEQ ID NO: 1694938 - RNA, 14 nt, Salmonella enterica enterica serovar Typhi
cagauguugauaca

SEQ ID NO: 1694939 - RNA, 17 nt, Salmonella enterica enterica serovar Typhi
cagauguuuacgcugcu

SEQ ID NO: 1694940 - RNA, 22 nt, Salmonella enterica enterica serovar Typhi
cagagagcguuucuacgccaug

SEQ ID NO: 1694941 - RNA, 15 nt, Salmonella enterica enterica serovar Typhi
cagagagggaaaaaa

SEQ ID NO: 1694942 - RNA, 15 nt, Salmonella enterica enterica serovar Typhi
cagaggccugaaugc

SEQ ID NO: 1694943 - RNA, 13 nt, Salmonella enterica enterica serovar Typhi
cagaguccagcgg

SEQ ID NO: 1694944 - RNA, 17 nt, Salmonella enterica enterica serovar Typhi
cagaguccagcggcagc

SEQ ID NO: 1694945 - RNA, 15 nt, Salmonella enterica enterica serovar Typhi
cagaggacauuaaag

SEQ ID NO: 1694946 - RNA, 20 nt, Salmonella enterica enterica serovar Typhi
cagaggaucuggacgccaau

SEQ ID NO: 1694947 - RNA, 15 nt, Salmonella enterica enterica serovar Typhi
cagagugcucaauaa

SEQ ID NO: 1694948 - RNA, 20 nt, Salmonella enterica enterica serovar Typhi
cagaguccggcgccugaaua

SEQ ID NO: 1694949 - RNA, 21 nt, Salmonella enterica enterica serovar Typhi
cagagcagucguugcgccugu

SEQ ID NO: 1694950 - RNA, 17 nt, Salmonella enterica enterica serovar Typhi
cagagcucgucaaaaau

SEQ ID NO: 1694951 - RNA, 15 nt, Salmonella enterica enterica serovar Typhi
cagaggaaugaaaac

SEQ ID NO: 1694952 - RNA, 16 nt, Salmonella enterica enterica serovar Typhi
cagacuucauuuucca

SEQ ID NO: 1694953 - RNA, 18 nt, Salmonella enterica enterica serovar Typhi
cagacuacggaaacugua

SEQ ID NO: 1694954 - RNA, 22 nt, Salmonella enterica enterica serovar Typhi
cagacuauccguccucuuuccc

SEQ ID NO: 1694955 - RNA, 17 nt, Salmonella enterica enterica serovar Typhi
cagacgcaucuuuuucc

SEQ ID NO: 1694956 - RNA, 13 nt, Salmonella enterica enterica serovar Typhi
cagacgcuccgca

SEQ ID NO: 1694957 - RNA, 20 nt, Salmonella enterica enterica serovar Typhi
cagacguucgcgaugcagca

SEQ ID NO: 1694958 - RNA, 22 nt, Salmonella enterica enterica serovar Typhi
cagacgcuucauugguuaauuc

SEQ ID NO: 1694959 - RNA, 14 nt, Salmonella enterica enterica serovar Typhi
cagacgcugguugu

SEQ ID NO: 1694960 - RNA, 16 nt, Salmonella enterica enterica serovar Typhi
cagaccagucggacag

SEQ ID NO: 1694961 - RNA, 17 nt, Salmonella enterica enterica serovar Typhi
cagacauauuuucucug

SEQ ID NO: 1694962 - RNA, 17 nt, Salmonella enterica enterica serovar Typhi
cagaccacgaaucagga

SEQ ID NO: 1694963 - RNA, 20 nt, Salmonella enterica enterica serovar Typhi
cagaccacgaaucaggauau

SEQ ID NO: 1694964 - RNA, 17 nt, Salmonella enterica enterica serovar Typhi
cagacagauaacaccag

SEQ ID NO: 1694965 - RNA, 19 nt, Salmonella enterica enterica serovar Typhi
cagacagauaacaccagcg

SEQ ID NO: 1694966 - RNA, 17 nt, Salmonella enterica enterica serovar Typhi
cagacagaucgguuuau

SEQ ID NO: 1694967 - RNA, 22 nt, Salmonella enterica enterica serovar Typhi
cagacagauaacaccagcgauc

SEQ ID NO: 1694968 - RNA, 12 nt, Salmonella enterica enterica serovar Typhi
cagacacugcca

SEQ ID NO: 1694969 - RNA, 15 nt, Salmonella enterica enterica serovar Typhi
cagacaggacgccag

SEQ ID NO: 1694970 - RNA, 21 nt, Salmonella enterica enterica serovar Typhi
cagacagccgaucaggccgca

SEQ ID NO: 1694971 - RNA, 17 nt, Salmonella enterica enterica serovar Typhi
cagacagccauauuuau

SEQ ID NO: 1694972 - RNA, 12 nt, Salmonella enterica enterica serovar Typhi
cagacagccgac

SEQ ID NO: 1694973 - RNA, 20 nt, Salmonella enterica enterica serovar Typhi
cagacagccgacggcaaaaa

SEQ ID NO: 1694974 - RNA, 18 nt, Salmonella enterica enterica serovar Typhi
cagaauuaacucaucaca

SEQ ID NO: 1694975 - RNA, 15 nt, Salmonella enterica enterica serovar Typhi
cagaauuuauuucug

SEQ ID NO: 1694976 - RNA, 16 nt, Salmonella enterica enterica serovar Typhi
cagaauuuauuucugc

SEQ ID NO: 1694977 - RNA, 20 nt, Salmonella enterica enterica serovar Typhi
cagacaauuagcgacgcaua

SEQ ID NO: 1694978 - RNA, 16 nt, Salmonella enterica enterica serovar Typhi
cagacaagcacauaac

SEQ ID NO: 1694979 - RNA, 20 nt, Salmonella enterica enterica serovar Typhi
cagacaagcacauaacugag

SEQ ID NO: 1694980 - RNA, 17 nt, Salmonella enterica enterica serovar Typhi
cagaauggcgauuaacg

SEQ ID NO: 1694981 - RNA, 18 nt, Salmonella enterica enterica serovar Typhi
cagaagcaauccugacca

SEQ ID NO: 1694982 - RNA, 22 nt, Salmonella enterica enterica serovar Typhi
cagaagaucuaaagccaguuuc

SEQ ID NO: 1694983 - RNA, 22 nt, Salmonella enterica enterica serovar Typhi
cagaaacaacgcgggccauaca

SEQ ID NO: 1694984 - RNA, 11 nt, Salmonella enterica enterica serovar Typhi
cagaaaaaccu

SEQ ID NO: 1694985 - RNA, 19 nt, Salmonella enterica enterica serovar Typhi
cagaaaaaagccaagcaca

SEQ ID NO: 1694986 - RNA, 22 nt, Salmonella enterica enterica serovar Typhi
cagaaacaagaagcacgacaca

SEQ ID NO: 1694987 - RNA, 20 nt, Salmonella enterica enterica serovar Typhi
cagaaauaaaauacuuccau

SEQ ID NO: 1694988 - RNA, 19 nt, Salmonella enterica enterica serovar Typhi
cagaaauaaaauacuucca

SEQ ID NO: 1694989 - RNA, 18 nt, Salmonella enterica enterica serovar Typhi
cagaaaucggcagcaccc

SEQ ID NO: 1694990 - RNA, 22 nt, Salmonella enterica enterica serovar Typhi
cagaaauccgcgaauaccuucc

SEQ ID NO: 1694991 - RNA, 12 nt, Salmonella enterica enterica serovar Typhi
cacuuucucggc

SEQ ID NO: 1694992 - RNA, 22 nt, Salmonella enterica enterica serovar Typhi
cacuuuuucucuuaucgccgcc

SEQ ID NO: 1694993 - RNA, 17 nt, Salmonella enterica enterica serovar Typhi
cacuuucgcccggcgcc

SEQ ID NO: 1694994 - RNA, 17 nt, Salmonella enterica enterica serovar Typhi
cacgucugaugcguggc

SEQ ID NO: 1694995 - RNA, 15 nt, Salmonella enterica enterica serovar Typhi
cacgucgauuuuccc

SEQ ID NO: 1694996 - RNA, 17 nt, Salmonella enterica enterica serovar Typhi
cagcucgcgcaguucca

SEQ ID NO: 1694997 - RNA, 18 nt, Salmonella enterica enterica serovar Typhi
cagcucccgcgucacgac

SEQ ID NO: 1694998 - RNA, 20 nt, Salmonella enterica enterica serovar Typhi
cagcuccauccaccagcccc

SEQ ID NO: 1694999 - RNA, 23 nt, Salmonella enterica enterica serovar Typhi
cagcuccagcucaggguccccau

SEQ ID NO: 1695000 - RNA, 20 nt, Salmonella enterica enterica serovar Typhi
cagcuccagccgcugccuuc

SEQ ID NO: 1695001 - RNA, 17 nt, Salmonella enterica enterica serovar Typhi
cagcuacuucaggcugu

SEQ ID NO: 1695002 - RNA, 15 nt, Salmonella enterica enterica serovar Typhi
cagcuaauuuuacuu

SEQ ID NO: 1695003 - RNA, 16 nt, Salmonella enterica enterica serovar Typhi
cagcucaagcgccgcg

SEQ ID NO: 1695004 - RNA, 18 nt, Salmonella enterica enterica serovar Typhi
cagcucaccgagacugcc

SEQ ID NO: 1695005 - RNA, 15 nt, Salmonella enterica enterica serovar Typhi
cagcuauccaguuuc

SEQ ID NO: 1695006 - RNA, 17 nt, Salmonella enterica enterica serovar Typhi
cagcucacgcgccagca

SEQ ID NO: 1695007 - RNA, 14 nt, Salmonella enterica enterica serovar Typhi
cagcucaacuauua

SEQ ID NO: 1695008 - RNA, 23 nt, Salmonella enterica enterica serovar Typhi
cagcgcuccgggguucuuuuuaa

SEQ ID NO: 1695009 - RNA, 17 nt, Salmonella enterica enterica serovar Typhi
cagcgcgguuucuacac

SEQ ID NO: 1695010 - RNA, 18 nt, Salmonella enterica enterica serovar Typhi
cagcgcguccaauagccc

SEQ ID NO: 1695011 - RNA, 19 nt, Salmonella enterica enterica serovar Typhi
cagcgcggcguacacuuca

SEQ ID NO: 1695012 - RNA, 23 nt, Salmonella enterica enterica serovar Typhi
cagcgcggguucuuuccacaauc

SEQ ID NO: 1695013 - RNA, 20 nt, Salmonella enterica enterica serovar Typhi
cagcgcgggcgaggccucgu

SEQ ID NO: 1695014 - RNA, 23 nt, Salmonella enterica enterica serovar Typhi
cagcgcugcuguaacagacgcag

SEQ ID NO: 1695015 - RNA, 18 nt, Salmonella enterica enterica serovar Typhi
cagcgcugucagugaaaa

SEQ ID NO: 1695016 - RNA, 17 nt, Salmonella enterica enterica serovar Typhi
cagcuucaucaccgcau

SEQ ID NO: 1695017 - RNA, 18 nt, Salmonella enterica enterica serovar Typhi
cagcuucagcaucaucuc

SEQ ID NO: 1695018 - RNA, 21 nt, Salmonella enterica enterica serovar Typhi
cagcuguuuaagcgccuccac

SEQ ID NO: 1695019 - RNA, 18 nt, Salmonella enterica enterica serovar Typhi
cagcuuaaaucgcggcgc

SEQ ID NO: 1695020 - RNA, 18 nt, Salmonella enterica enterica serovar Typhi
cagcuuaaucaccagcgc

SEQ ID NO: 1695021 - RNA, 18 nt, Salmonella enterica enterica serovar Typhi
cagcuuauuccagucauu

SEQ ID NO: 1695022 - RNA, 18 nt, Salmonella enterica enterica serovar Typhi
cagcucuuuaggcaggaa

SEQ ID NO: 1695023 - RNA, 14 nt, Salmonella enterica enterica serovar Typhi
cagcucuucaggcg

SEQ ID NO: 1695024 - RNA, 22 nt, Salmonella enterica enterica serovar Typhi
cagcucugccgguugaccggcc

SEQ ID NO: 1695025 - RNA, 15 nt, Salmonella enterica enterica serovar Typhi
cagcuuuugcgcguu

SEQ ID NO: 1695026 - RNA, 17 nt, Salmonella enterica enterica serovar Typhi
caggaaaaacugucccu

SEQ ID NO: 1695027 - RNA, 19 nt, Salmonella enterica enterica serovar Typhi
cagcuuuucauuuguuccu

SEQ ID NO: 1695028 - RNA, 16 nt, Salmonella enterica enterica serovar Typhi
caggaacagauacugg

SEQ ID NO: 1695029 - RNA, 14 nt, Salmonella enterica enterica serovar Typhi
caggagacuauucg

SEQ ID NO: 1695030 - RNA, 18 nt, Salmonella enterica enterica serovar Typhi
caggagaucggcgcaggu

SEQ ID NO: 1695031 - RNA, 14 nt, Salmonella enterica enterica serovar Typhi
caggagcauagaua

SEQ ID NO: 1695032 - RNA, 15 nt, Salmonella enterica enterica serovar Typhi
caggauaauaaugau

SEQ ID NO: 1695033 - RNA, 18 nt, Salmonella enterica enterica serovar Typhi
caggagcggguagagcuu

SEQ ID NO: 1695034 - RNA, 20 nt, Salmonella enterica enterica serovar Typhi
caggauaauaucgcuggcca

SEQ ID NO: 1695035 - RNA, 15 nt, Salmonella enterica enterica serovar Typhi
caggauacagccgac

SEQ ID NO: 1695036 - RNA, 16 nt, Salmonella enterica enterica serovar Typhi
caggacugacugcugu

SEQ ID NO: 1695037 - RNA, 15 nt, Salmonella enterica enterica serovar Typhi
caggacgcacccugu

SEQ ID NO: 1695038 - RNA, 17 nt, Salmonella enterica enterica serovar Typhi
caggacgccagugaaag

SEQ ID NO: 1695039 - RNA, 18 nt, Salmonella enterica enterica serovar Typhi
caggacgagagacugaua

SEQ ID NO: 1695040 - RNA, 23 nt, Salmonella enterica enterica serovar Typhi
caggaauaaccacugauggcugg

SEQ ID NO: 1695041 - RNA, 14 nt, Salmonella enterica enterica serovar Typhi
aaaauuucugccga

SEQ ID NO: 1695042 - RNA, 14 nt, Salmonella enterica enterica serovar Typhi
caggaaggcgugca

SEQ ID NO: 1695043 - RNA, 12 nt, Salmonella enterica enterica serovar Typhi
caggaacgccau

SEQ ID NO: 1695044 - RNA, 22 nt, Salmonella enterica enterica serovar Typhi
caggcuucaucggauagaugaa

SEQ ID NO: 1695045 - RNA, 15 nt, Salmonella enterica enterica serovar Typhi
caggcuuccagauac

SEQ ID NO: 1695046 - RNA, 19 nt, Salmonella enterica enterica serovar Typhi
cagggaauacccgcccggu

SEQ ID NO: 1695047 - RNA, 19 nt, Salmonella enterica enterica serovar Typhi
cagggaauaugauuuaaaa

SEQ ID NO: 1695048 - RNA, 14 nt, Salmonella enterica enterica serovar Typhi
caggcugugcaaca

SEQ ID NO: 1695049 - RNA, 12 nt, Salmonella enterica enterica serovar Typhi
caggcuggaaau

SEQ ID NO: 1695050 - RNA, 14 nt, Salmonella enterica enterica serovar Typhi
caggcugucgcggc

SEQ ID NO: 1695051 - RNA, 16 nt, Salmonella enterica enterica serovar Typhi
caggcugucgcggcgg

SEQ ID NO: 1695052 - RNA, 17 nt, Salmonella enterica enterica serovar Typhi
caggcuccaaguauuga

SEQ ID NO: 1695053 - RNA, 17 nt, Salmonella enterica enterica serovar Typhi
caggcucaucagcgcca

SEQ ID NO: 1695054 - RNA, 21 nt, Salmonella enterica enterica serovar Typhi
caggcgucaaaacaggucugu

SEQ ID NO: 1695055 - RNA, 20 nt, Salmonella enterica enterica serovar Typhi
caggcgucagcauggugugu

SEQ ID NO: 1695056 - RNA, 22 nt, Salmonella enterica enterica serovar Typhi
caggcgucauagccgcgcguca

SEQ ID NO: 1695057 - RNA, 13 nt, Salmonella enterica enterica serovar Typhi
caggcgcaggcau

SEQ ID NO: 1695058 - RNA, 15 nt, Salmonella enterica enterica serovar Typhi
caggcggucagggug

SEQ ID NO: 1695059 - RNA, 14 nt, Salmonella enterica enterica serovar Typhi
cagggacuuauuaa

SEQ ID NO: 1695060 - RNA, 21 nt, Salmonella enterica enterica serovar Typhi
cagggcaugauuacagauauc

SEQ ID NO: 1695061 - RNA, 16 nt, Salmonella enterica enterica serovar Typhi
cagggcaucccguccc

SEQ ID NO: 1695062 - RNA, 18 nt, Salmonella enterica enterica serovar Typhi
cagggccgcgagaacuuc

SEQ ID NO: 1695063 - RNA, 18 nt, Salmonella enterica enterica serovar Typhi
aaaauuuugcauaaauaa

SEQ ID NO: 1695064 - RNA, 19 nt, Salmonella enterica enterica serovar Typhi
cagggcugaaucggcaccu

SEQ ID NO: 1695065 - RNA, 14 nt, Salmonella enterica enterica serovar Typhi
cagggcguaagcgc

SEQ ID NO: 1695066 - RNA, 20 nt, Salmonella enterica enterica serovar Typhi
aaaauuuuuuaucagguugu

SEQ ID NO: 1695067 - RNA, 16 nt, Salmonella enterica enterica serovar Typhi
cagggcggaagcagau

SEQ ID NO: 1695068 - RNA, 17 nt, Salmonella enterica enterica serovar Typhi
cagggcggccuccuggc

SEQ ID NO: 1695069 - RNA, 16 nt, Salmonella enterica enterica serovar Typhi
caggcaucgacgccag

SEQ ID NO: 1695070 - RNA, 18 nt, Salmonella enterica enterica serovar Typhi
caggcaucgacgccagcg

SEQ ID NO: 1695071 - RNA, 13 nt, Salmonella enterica enterica serovar Typhi
caggcauccagac

SEQ ID NO: 1695072 - RNA, 15 nt, Salmonella enterica enterica serovar Typhi
caggcauccagaccc

SEQ ID NO: 1695073 - RNA, 15 nt, Salmonella enterica enterica serovar Typhi
caggaugccaaccac

SEQ ID NO: 1695074 - RNA, 22 nt, Salmonella enterica enterica serovar Typhi
caggcaucaacguuguccagcg

SEQ ID NO: 1695075 - RNA, 20 nt, Salmonella enterica enterica serovar Typhi
caggcaucuuccagcgucgg

SEQ ID NO: 1695076 - RNA, 20 nt, Salmonella enterica enterica serovar Typhi
caggcauguugcgcaaucac

SEQ ID NO: 1695077 - RNA, 14 nt, Salmonella enterica enterica serovar Typhi
caggcauuaaaaaa

SEQ ID NO: 1695078 - RNA, 22 nt, Salmonella enterica enterica serovar Typhi
caggauauuuugcucauauugu

SEQ ID NO: 1695079 - RNA, 22 nt, Salmonella enterica enterica serovar Typhi
caggauaguacugaccagacag

SEQ ID NO: 1695080 - RNA, 18 nt, Salmonella enterica enterica serovar Typhi
caggauauacuucaucag

SEQ ID NO: 1695081 - RNA, 13 nt, Salmonella enterica enterica serovar Typhi
caggaucuuuuuc

SEQ ID NO: 1695082 - RNA, 14 nt, Salmonella enterica enterica serovar Typhi
caggaucuuuuuca

SEQ ID NO: 1695083 - RNA, 13 nt, Salmonella enterica enterica serovar Typhi
caggaucuucauc

SEQ ID NO: 1695084 - RNA, 16 nt, Salmonella enterica enterica serovar Typhi
caggccaugcgccgcg

SEQ ID NO: 1695085 - RNA, 19 nt, Salmonella enterica enterica serovar Typhi
caggccaucauugauacug

SEQ ID NO: 1695086 - RNA, 18 nt, Salmonella enterica enterica serovar Typhi
caggcccaguaccauuga

SEQ ID NO: 1695087 - RNA, 13 nt, Salmonella enterica enterica serovar Typhi
caggcccagccgc

SEQ ID NO: 1695088 - RNA, 15 nt, Salmonella enterica enterica serovar Typhi
caggcccagccgcuc

SEQ ID NO: 1695089 - RNA, 19 nt, Salmonella enterica enterica serovar Typhi
caggccgccgcaaaagccg

SEQ ID NO: 1695090 - RNA, 16 nt, Salmonella enterica enterica serovar Typhi
caggccugguuaacaa

SEQ ID NO: 1695091 - RNA, 19 nt, Salmonella enterica enterica serovar Typhi
caggccugccugaucgcca

SEQ ID NO: 1695092 - RNA, 19 nt, Salmonella enterica enterica serovar Typhi
caggccugaugagcgcagc

SEQ ID NO: 1695093 - RNA, 20 nt, Salmonella enterica enterica serovar Typhi
caggccugauaagcacaggc

SEQ ID NO: 1695094 - RNA, 22 nt, Salmonella enterica enterica serovar Typhi
caggccugauaagcacaggcca

SEQ ID NO: 1695095 - RNA, 19 nt, Salmonella enterica enterica serovar Typhi
caggcgauucggacucaua

SEQ ID NO: 1695096 - RNA, 15 nt, Salmonella enterica enterica serovar Typhi
caggcgauugccggu

SEQ ID NO: 1695097 - RNA, 18 nt, Salmonella enterica enterica serovar Typhi
caggcgauccuguucaaa

SEQ ID NO: 1695098 - RNA, 16 nt, Salmonella enterica enterica serovar Typhi
caggccuuucggcagc

SEQ ID NO: 1695099 - RNA, 19 nt, Salmonella enterica enterica serovar Typhi
caggcgauagccguccaug

SEQ ID NO: 1695100 - RNA, 20 nt, Salmonella enterica enterica serovar Typhi
caggcgauagccguccaugu

SEQ ID NO: 1695101 - RNA, 18 nt, Salmonella enterica enterica serovar Typhi
caggccucugcuuuucuc

SEQ ID NO: 1695102 - RNA, 16 nt, Salmonella enterica enterica serovar Typhi
cagugaacacccugcc

SEQ ID NO: 1695103 - RNA, 17 nt, Salmonella enterica enterica serovar Typhi
cagugaacacccugccc

SEQ ID NO: 1695104 - RNA, 13 nt, Salmonella enterica enterica serovar Typhi
cagugaaauaaau

SEQ ID NO: 1695105 - RNA, 18 nt, Salmonella enterica enterica serovar Typhi
cagugaaaccggcgcgcc

SEQ ID NO: 1695106 - RNA, 15 nt, Salmonella enterica enterica serovar Typhi
cagugacauuuaucu

SEQ ID NO: 1695107 - RNA, 18 nt, Salmonella enterica enterica serovar Typhi
cagugaauuaugaccaau

SEQ ID NO: 1695108 - RNA, 17 nt, Salmonella enterica enterica serovar Typhi
cagugaaaaaccgaucu

SEQ ID NO: 1695109 - RNA, 16 nt, Salmonella enterica enterica serovar Typhi
cagugcagaaagugug

SEQ ID NO: 1695110 - RNA, 19 nt, Salmonella enterica enterica serovar Typhi
cagugcaggauuuguauca

SEQ ID NO: 1695111 - RNA, 23 nt, Salmonella enterica enterica serovar Typhi
cagugauucgcgaaucgcuucac

SEQ ID NO: 1695112 - RNA, 16 nt, Salmonella enterica enterica serovar Typhi
cagugauggauuucac

SEQ ID NO: 1695113 - RNA, 15 nt, Salmonella enterica enterica serovar Typhi
cagugauuacaaaau

SEQ ID NO: 1695114 - RNA, 17 nt, Salmonella enterica enterica serovar Typhi
cagugagcccuccucca

SEQ ID NO: 1695115 - RNA, 15 nt, Salmonella enterica enterica serovar Typhi
cagugaguaacguua

SEQ ID NO: 1695116 - RNA, 18 nt, Salmonella enterica enterica serovar Typhi
caguccuccggcugaagc

SEQ ID NO: 1695117 - RNA, 22 nt, Salmonella enterica enterica serovar Typhi
caguccuccggcugaagcccca

SEQ ID NO: 1695118 - RNA, 18 nt, Salmonella enterica enterica serovar Typhi
caguccugucccugccag

SEQ ID NO: 1695119 - RNA, 14 nt, Salmonella enterica enterica serovar Typhi
caguccuuccgccg

SEQ ID NO: 1695120 - RNA, 23 nt, Salmonella enterica enterica serovar Typhi
cagucgaacauccuugcacgcca

SEQ ID NO: 1695121 - RNA, 23 nt, Salmonella enterica enterica serovar Typhi
caguccgggccgugacacauuug

SEQ ID NO: 1695122 - RNA, 16 nt, Salmonella enterica enterica serovar Typhi
caguccgcacgccugc

SEQ ID NO: 1695123 - RNA, 15 nt, Salmonella enterica enterica serovar Typhi
caguccgcccgccuc

SEQ ID NO: 1695124 - RNA, 22 nt, Salmonella enterica enterica serovar Typhi
caguccggaugucucagcgcau

SEQ ID NO: 1695125 - RNA, 20 nt, Salmonella enterica enterica serovar Typhi
cagucccugaagaaaaggaa

SEQ ID NO: 1695126 - RNA, 24 nt, Salmonella enterica enterica serovar Typhi
cagucccugaagaaaaggaaugcc

SEQ ID NO: 1695127 - RNA, 15 nt, Salmonella enterica enterica serovar Typhi
cagucgucuggcgcu

SEQ ID NO: 1695128 - RNA, 20 nt, Salmonella enterica enterica serovar Typhi
cagucgucauggcguaaauc

SEQ ID NO: 1695129 - RNA, 23 nt, Salmonella enterica enterica serovar Typhi
cagucguuaucugacauauacaa

SEQ ID NO: 1695130 - RNA, 16 nt, Salmonella enterica enterica serovar Typhi
cagucuaauuuauuaa

SEQ ID NO: 1695131 - RNA, 20 nt, Salmonella enterica enterica serovar Typhi
cagucuaauuuauuaacccu

SEQ ID NO: 1695132 - RNA, 19 nt, Salmonella enterica enterica serovar Typhi
cagucgggaucgccagauc

SEQ ID NO: 1695133 - RNA, 23 nt, Salmonella enterica enterica serovar Typhi
cagucgcucuaucgccuggagcu

SEQ ID NO: 1695134 - RNA, 16 nt, Salmonella enterica enterica serovar Typhi
cagucgcagagcccag

SEQ ID NO: 1695135 - RNA, 19 nt, Salmonella enterica enterica serovar Typhi
cagucgccagaaggcaggc

SEQ ID NO: 1695136 - RNA, 20 nt, Salmonella enterica enterica serovar Typhi
cagucgcgccgugcccagca

SEQ ID NO: 1695137 - RNA, 18 nt, Salmonella enterica enterica serovar Typhi
cagucacccugcccugca

SEQ ID NO: 1695138 - RNA, 16 nt, Salmonella enterica enterica serovar Typhi
caguauugccgaugcc

SEQ ID NO: 1695139 - RNA, 20 nt, Salmonella enterica enterica serovar Typhi
caguauugccgaugccugcg

SEQ ID NO: 1695140 - RNA, 22 nt, Salmonella enterica enterica serovar Typhi
caguaugaucaugcccggcaaa

SEQ ID NO: 1695141 - RNA, 12 nt, Salmonella enterica enterica serovar Typhi
cagucaguuuau

SEQ ID NO: 1695142 - RNA, 17 nt, Salmonella enterica enterica serovar Typhi
cagucauuugcagguua

SEQ ID NO: 1695143 - RNA, 17 nt, Salmonella enterica enterica serovar Typhi
cagucaugaaaucgauu

SEQ ID NO: 1695144 - RNA, 15 nt, Salmonella enterica enterica serovar Typhi
cagucauggcuuuua

SEQ ID NO: 1695145 - RNA, 21 nt, Salmonella enterica enterica serovar Typhi
cagucauuaauucccgcagcc

SEQ ID NO: 1695146 - RNA, 16 nt, Salmonella enterica enterica serovar Typhi
cagucagcgcgagcgu

SEQ ID NO: 1695147 - RNA, 11 nt, Salmonella enterica enterica serovar Typhi
cagucagcucc

SEQ ID NO: 1695148 - RNA, 14 nt, Salmonella enterica enterica serovar Typhi
cagucagccuugac

SEQ ID NO: 1695149 - RNA, 19 nt, Salmonella enterica enterica serovar Typhi
cagucagccuugaccgccu

SEQ ID NO: 1695150 - RNA, 17 nt, Salmonella enterica enterica serovar Typhi
cagucagcaauuaacaa

SEQ ID NO: 1695151 - RNA, 16 nt, Salmonella enterica enterica serovar Typhi
cagucagaggaauucu

SEQ ID NO: 1695152 - RNA, 22 nt, Salmonella enterica enterica serovar Typhi
caguccagccgccgcgcggcag

SEQ ID NO: 1695153 - RNA, 12 nt, Salmonella enterica enterica serovar Typhi
caguccagaugc

SEQ ID NO: 1695154 - RNA, 22 nt, Salmonella enterica enterica serovar Typhi
cagucccaaugcggaaaccagu

SEQ ID NO: 1695155 - RNA, 21 nt, Salmonella enterica enterica serovar Typhi
caguccccagcguaccacgcc

SEQ ID NO: 1695156 - RNA, 23 nt, Salmonella enterica enterica serovar Typhi
caguccccagcguaccacgccgc

SEQ ID NO: 1695157 - RNA, 16 nt, Salmonella enterica enterica serovar Typhi
caguagcagacagccg

SEQ ID NO: 1695158 - RNA, 20 nt, Salmonella enterica enterica serovar Typhi
caguagccgccgcaggacag

SEQ ID NO: 1695159 - RNA, 12 nt, Salmonella enterica enterica serovar Typhi
caguagccaugc

SEQ ID NO: 1695160 - RNA, 22 nt, Salmonella enterica enterica serovar Typhi
caguagcgcgacgccaaaccug

SEQ ID NO: 1695161 - RNA, 14 nt, Salmonella enterica enterica serovar Typhi
caguaggacaaaaa

SEQ ID NO: 1695162 - RNA, 16 nt, Salmonella enterica enterica serovar Typhi
caguaggacaaaaaug

SEQ ID NO: 1695163 - RNA, 17 nt, Salmonella enterica enterica serovar Typhi
caguacgcgcgcggcgu

SEQ ID NO: 1695164 - RNA, 21 nt, Salmonella enterica enterica serovar Typhi
caguacgcccgugacgccagg

SEQ ID NO: 1695165 - RNA, 17 nt, Salmonella enterica enterica serovar Typhi
caguacgcgaccgccgc

SEQ ID NO: 1695166 - RNA, 15 nt, Salmonella enterica enterica serovar Typhi
caguacgcccgccuc

SEQ ID NO: 1695167 - RNA, 17 nt, Salmonella enterica enterica serovar Typhi
caguacgaucaugaguc

SEQ ID NO: 1695168 - RNA, 21 nt, Salmonella enterica enterica serovar Typhi
caguaccgggccuccuuuccu

SEQ ID NO: 1695169 - RNA, 22 nt, Salmonella enterica enterica serovar Typhi
caguaccgggccuccuuuccug

SEQ ID NO: 1695170 - RNA, 17 nt, Salmonella enterica enterica serovar Typhi
caguacccgcacgcuuu

SEQ ID NO: 1695171 - RNA, 14 nt, Salmonella enterica enterica serovar Typhi
caguaccagcgaga

SEQ ID NO: 1695172 - RNA, 17 nt, Salmonella enterica enterica serovar Typhi
caguaccgccuucagcg

SEQ ID NO: 1695173 - RNA, 19 nt, Salmonella enterica enterica serovar Typhi
caguacggaugauguacag

SEQ ID NO: 1695174 - RNA, 12 nt, Salmonella enterica enterica serovar Typhi
caguagauggcg

SEQ ID NO: 1695175 - RNA, 17 nt, Salmonella enterica enterica serovar Typhi
caggugaucuguucaaa

SEQ ID NO: 1695176 - RNA, 14 nt, Salmonella enterica enterica serovar Typhi
caggugaacauuac

SEQ ID NO: 1695177 - RNA, 15 nt, Salmonella enterica enterica serovar Typhi
caggugacgaagauc

SEQ ID NO: 1695178 - RNA, 15 nt, Salmonella enterica enterica serovar Typhi
caggugcggcugggc

SEQ ID NO: 1695179 - RNA, 17 nt, Salmonella enterica enterica serovar Typhi
cagguuauuguugcuac

SEQ ID NO: 1695180 - RNA, 20 nt, Salmonella enterica enterica serovar Typhi
cagguuacucuuccaccauc

SEQ ID NO: 1695181 - RNA, 15 nt, Salmonella enterica enterica serovar Typhi
cagguuauacuguga

SEQ ID NO: 1695182 - RNA, 13 nt, Salmonella enterica enterica serovar Typhi
cagguuagcagcc

SEQ ID NO: 1695183 - RNA, 20 nt, Salmonella enterica enterica serovar Typhi
cagguuauauuccgccucgu

SEQ ID NO: 1695184 - RNA, 18 nt, Salmonella enterica enterica serovar Typhi
cagguguuaaucauuuuc

SEQ ID NO: 1695185 - RNA, 18 nt, Salmonella enterica enterica serovar Typhi
caggugucguuaaugcuc

SEQ ID NO: 1695186 - RNA, 23 nt, Salmonella enterica enterica serovar Typhi
cagguguuauucgcccaaaugca

SEQ ID NO: 1695187 - RNA, 12 nt, Salmonella enterica enterica serovar Typhi
cagguuaacucc

SEQ ID NO: 1695188 - RNA, 20 nt, Salmonella enterica enterica serovar Typhi
caggugguacaucaaaucag

SEQ ID NO: 1695189 - RNA, 18 nt, Salmonella enterica enterica serovar Typhi
cagguggaucccccuggc

SEQ ID NO: 1695190 - RNA, 22 nt, Salmonella enterica enterica serovar Typhi
cagguggauuuuugcugguugu

SEQ ID NO: 1695191 - RNA, 17 nt, Salmonella enterica enterica serovar Typhi
caggugcugccacaucg

SEQ ID NO: 1695192 - RNA, 20 nt, Salmonella enterica enterica serovar Typhi
cagguggaucccccuggccc

SEQ ID NO: 1695193 - RNA, 17 nt, Salmonella enterica enterica serovar Typhi
cagggguguuacgccau

SEQ ID NO: 1695194 - RNA, 19 nt, Salmonella enterica enterica serovar Typhi
caggggcuccugcgccgga

SEQ ID NO: 1695195 - RNA, 16 nt, Salmonella enterica enterica serovar Typhi
cagggguuccggcaau

SEQ ID NO: 1695196 - RNA, 20 nt, Salmonella enterica enterica serovar Typhi
cagguauuuagccacgccgu

SEQ ID NO: 1695197 - RNA, 18 nt, Salmonella enterica enterica serovar Typhi
caggucgcccagccauaa

SEQ ID NO: 1695198 - RNA, 23 nt, Salmonella enterica enterica serovar Typhi
caggucgaugaggauauugguau

SEQ ID NO: 1695199 - RNA, 22 nt, Salmonella enterica enterica serovar Typhi
cagguuuuuugugaguucauaa

SEQ ID NO: 1695200 - RNA, 17 nt, Salmonella enterica enterica serovar Typhi
cagguuuuuaagcugcc

SEQ ID NO: 1695201 - RNA, 20 nt, Salmonella enterica enterica serovar Typhi
cagguuuuuaagcugcccac

SEQ ID NO: 1695202 - RNA, 14 nt, Salmonella enterica enterica serovar Typhi
cagguugugcaucu

SEQ ID NO: 1695203 - RNA, 20 nt, Salmonella enterica enterica serovar Typhi
cagguuguccugauagcaau

SEQ ID NO: 1695204 - RNA, 16 nt, Salmonella enterica enterica serovar Typhi
cagguugugcaucucc

SEQ ID NO: 1695205 - RNA, 21 nt, Salmonella enterica enterica serovar Typhi
cagguuuacccugauuuucaa

SEQ ID NO: 1695206 - RNA, 22 nt, Salmonella enterica enterica serovar Typhi
cagguuuacguagcagcgcgcg

SEQ ID NO: 1695207 - RNA, 17 nt, Salmonella enterica enterica serovar Typhi
cagguucccgcccugcc

SEQ ID NO: 1695208 - RNA, 22 nt, Salmonella enterica enterica serovar Typhi
cagguucccgcccugcccgcca

SEQ ID NO: 1695209 - RNA, 17 nt, Salmonella enterica enterica serovar Typhi
cagguugcguccgccgc

SEQ ID NO: 1695210 - RNA, 22 nt, Salmonella enterica enterica serovar Typhi
caguaaucccggucgcgccagc

SEQ ID NO: 1695211 - RNA, 18 nt, Salmonella enterica enterica serovar Typhi
caguaauguccagauuac

SEQ ID NO: 1695212 - RNA, 13 nt, Salmonella enterica enterica serovar Typhi
caguaauuuuucc

SEQ ID NO: 1695213 - RNA, 18 nt, Salmonella enterica enterica serovar Typhi
caguaauuuuuccgccuc

SEQ ID NO: 1695214 - RNA, 14 nt, Salmonella enterica enterica serovar Typhi
caguaauuuuucuc

SEQ ID NO: 1695215 - RNA, 22 nt, Salmonella enterica enterica serovar Typhi
caguaauuuuucucccagcaga

SEQ ID NO: 1695216 - RNA, 16 nt, Salmonella enterica enterica serovar Typhi
caguaauaauauaaag

SEQ ID NO: 1695217 - RNA, 22 nt, Salmonella enterica enterica serovar Typhi
caguaauauaaccaauuuaaaa

SEQ ID NO: 1695218 - RNA, 20 nt, Salmonella enterica enterica serovar Typhi
caguaauauccccaucccag

SEQ ID NO: 1695219 - RNA, 12 nt, Salmonella enterica enterica serovar Typhi
caguacaggcau

SEQ ID NO: 1695220 - RNA, 17 nt, Salmonella enterica enterica serovar Typhi
caguaccgaaaucauca

SEQ ID NO: 1695221 - RNA, 17 nt, Salmonella enterica enterica serovar Typhi
caguacagacuggaugg

SEQ ID NO: 1695222 - RNA, 17 nt, Salmonella enterica enterica serovar Typhi
caguacagccaaaaaua

SEQ ID NO: 1695223 - RNA, 19 nt, Salmonella enterica enterica serovar Typhi
caguacagccaaaaauaac

SEQ ID NO: 1695224 - RNA, 21 nt, Salmonella enterica enterica serovar Typhi
caguacaaacaaauaaaucca

SEQ ID NO: 1695225 - RNA, 23 nt, Salmonella enterica enterica serovar Typhi
caguacaaacaaauaaauccaug

SEQ ID NO: 1695226 - RNA, 15 nt, Salmonella enterica enterica serovar Typhi
caguacaaacaaaua

SEQ ID NO: 1695227 - RNA, 16 nt, Salmonella enterica enterica serovar Typhi
caguacaaacaaauaa

SEQ ID NO: 1695228 - RNA, 19 nt, Salmonella enterica enterica serovar Typhi
caguaacaucgaaugucga

SEQ ID NO: 1695229 - RNA, 16 nt, Salmonella enterica enterica serovar Typhi
caguaacacccgcgcc

SEQ ID NO: 1695230 - RNA, 13 nt, Salmonella enterica enterica serovar Typhi
caguaaaggggag

SEQ ID NO: 1695231 - RNA, 20 nt, Salmonella enterica enterica serovar Typhi
caguaaaucccgcaucaccc

SEQ ID NO: 1695232 - RNA, 22 nt, Salmonella enterica enterica serovar Typhi
caguaaagauuuguuucaucgc

SEQ ID NO: 1695233 - RNA, 12 nt, Salmonella enterica enterica serovar Typhi
caguaaaagccc

SEQ ID NO: 1695234 - RNA, 22 nt, Salmonella enterica enterica serovar Typhi
caguaaaagcccgcccagcauu

SEQ ID NO: 1695235 - RNA, 22 nt, Salmonella enterica enterica serovar Typhi
caguaagcguaccauuccauuc

SEQ ID NO: 1695236 - RNA, 12 nt, Salmonella enterica enterica serovar Typhi
caguaaggggau

SEQ ID NO: 1695237 - RNA, 15 nt, Salmonella enterica enterica serovar Typhi
caguaacgcguccaa

SEQ ID NO: 1695238 - RNA, 15 nt, Salmonella enterica enterica serovar Typhi
caguaacgcacuuuu

SEQ ID NO: 1695239 - RNA, 14 nt, Salmonella enterica enterica serovar Typhi
caguaacucaucgc

SEQ ID NO: 1695240 - RNA, 16 nt, Salmonella enterica enterica serovar Typhi
caguaaccgccacagc

SEQ ID NO: 1695241 - RNA, 18 nt, Salmonella enterica enterica serovar Typhi
caguaaccgccacagcau

SEQ ID NO: 1695242 - RNA, 16 nt, Salmonella enterica enterica serovar Typhi
cauugaguaaauaaau

SEQ ID NO: 1695243 - RNA, 19 nt, Salmonella enterica enterica serovar Typhi
cauugaggcuacccagaca

SEQ ID NO: 1695244 - RNA, 18 nt, Salmonella enterica enterica serovar Typhi
cauugaucaggcaaaaau

SEQ ID NO: 1695245 - RNA, 18 nt, Salmonella enterica enterica serovar Typhi
cauuuuggggaaaauacc

SEQ ID NO: 1695246 - RNA, 18 nt, Salmonella enterica enterica serovar Typhi
cauuuuggccgcuuuagu

SEQ ID NO: 1695247 - RNA, 15 nt, Salmonella enterica enterica serovar Typhi
cauuuucuuuacgcu

SEQ ID NO: 1695248 - RNA, 16 nt, Salmonella enterica enterica serovar Typhi
cauuuucuuucaucaa

SEQ ID NO: 1695249 - RNA, 22 nt, Salmonella enterica enterica serovar Typhi
cauuuuguggcggauacgcuuc

SEQ ID NO: 1695250 - RNA, 21 nt, Salmonella enterica enterica serovar Typhi
cauuuuuaucaggccugccug

SEQ ID NO: 1695251 - RNA, 13 nt, Salmonella enterica enterica serovar Typhi
cauuuuucccgau

SEQ ID NO: 1695252 - RNA, 18 nt, Salmonella enterica enterica serovar Typhi
cauuuuucgaucuucucc

SEQ ID NO: 1695253 - RNA, 18 nt, Salmonella enterica enterica serovar Typhi
cauuuuucgcccacaucu

SEQ ID NO: 1695254 - RNA, 15 nt, Salmonella enterica enterica serovar Typhi
cauuuuuuucagccu

SEQ ID NO: 1695255 - RNA, 13 nt, Salmonella enterica enterica serovar Typhi
cauuuuugccauu

SEQ ID NO: 1695256 - RNA, 19 nt, Salmonella enterica enterica serovar Typhi
cauuuuucucaggacgcca

SEQ ID NO: 1695257 - RNA, 16 nt, Salmonella enterica enterica serovar Typhi
ccaaaauaauaaaaau

SEQ ID NO: 1695258 - RNA, 20 nt, Salmonella enterica enterica serovar Typhi
ccaaaauccagggaaaccau

SEQ ID NO: 1695259 - RNA, 16 nt, Salmonella enterica enterica serovar Typhi
ccaaaaccacagugac

SEQ ID NO: 1695260 - RNA, 16 nt, Salmonella enterica enterica serovar Typhi
ccaaaacccaccagca

SEQ ID NO: 1695261 - RNA, 14 nt, Salmonella enterica enterica serovar Typhi
ccaaaaauaaaagg

SEQ ID NO: 1695262 - RNA, 11 nt, Salmonella enterica enterica serovar Typhi
ccaaaaagaaa

SEQ ID NO: 1695263 - RNA, 13 nt, Salmonella enterica enterica serovar Typhi
ccaaacagcggcu

SEQ ID NO: 1695264 - RNA, 22 nt, Salmonella enterica enterica serovar Typhi
ccaaaccagacucaccccuucu

SEQ ID NO: 1695265 - RNA, 22 nt, Salmonella enterica enterica serovar Typhi
ccaaaccacugauggaguuuca

SEQ ID NO: 1695266 - RNA, 13 nt, Salmonella enterica enterica serovar Typhi
ccaaaccagaccc

SEQ ID NO: 1695267 - RNA, 15 nt, Salmonella enterica enterica serovar Typhi
ccaaacacuuccccu

SEQ ID NO: 1695268 - RNA, 20 nt, Salmonella enterica enterica serovar Typhi
ccaaacgacgcguuucacau

SEQ ID NO: 1695269 - RNA, 20 nt, Salmonella enterica enterica serovar Typhi
ccaaaccugagcauauaaau

SEQ ID NO: 1695270 - RNA, 17 nt, Salmonella enterica enterica serovar Typhi
ccaaacgaauuuaaaua

SEQ ID NO: 1695271 - RNA, 19 nt, Salmonella enterica enterica serovar Typhi
ccaaacgaauuuaaauagc

SEQ ID NO: 1695272 - RNA, 12 nt, Salmonella enterica enterica serovar Typhi
ccaaacggcagc

SEQ ID NO: 1695273 - RNA, 19 nt, Salmonella enterica enterica serovar Typhi
ccaaacgcggucaggguga

SEQ ID NO: 1695274 - RNA, 13 nt, Salmonella enterica enterica serovar Typhi
ccaaacggcagcu

SEQ ID NO: 1695275 - RNA, 19 nt, Salmonella enterica enterica serovar Typhi
ccaaacuggcaaauaaaau

SEQ ID NO: 1695276 - RNA, 19 nt, Salmonella enterica enterica serovar Typhi
ccaaacugcggaauuuuau

SEQ ID NO: 1695277 - RNA, 21 nt, Salmonella enterica enterica serovar Typhi
ccaacuuuuccuaauuuuuaa

SEQ ID NO: 1695278 - RNA, 17 nt, Salmonella enterica enterica serovar Typhi
ccaaguaaauuugcugu

SEQ ID NO: 1695279 - RNA, 14 nt, Salmonella enterica enterica serovar Typhi
ccaaccgccacaau

SEQ ID NO: 1695280 - RNA, 15 nt, Salmonella enterica enterica serovar Typhi
ccaaccgaacaauau

SEQ ID NO: 1695281 - RNA, 12 nt, Salmonella enterica enterica serovar Typhi
ccaaacugcgga

SEQ ID NO: 1695282 - RNA, 16 nt, Salmonella enterica enterica serovar Typhi
ccaaacuuacgcagcu

SEQ ID NO: 1695283 - RNA, 18 nt, Salmonella enterica enterica serovar Typhi
ccaaagcccgcaaacaga

SEQ ID NO: 1695284 - RNA, 19 nt, Salmonella enterica enterica serovar Typhi
ccaaagcagcggaaaauau

SEQ ID NO: 1695285 - RNA, 18 nt, Salmonella enterica enterica serovar Typhi
ccaaagcgcauccgguaa

SEQ ID NO: 1695286 - RNA, 14 nt, Salmonella enterica enterica serovar Typhi
ccaaaguuuuuaaa

SEQ ID NO: 1695287 - RNA, 13 nt, Salmonella enterica enterica serovar Typhi
ccaaaugcccagc

SEQ ID NO: 1695288 - RNA, 15 nt, Salmonella enterica enterica serovar Typhi
ccaaauaacccaggg

SEQ ID NO: 1695289 - RNA, 19 nt, Salmonella enterica enterica serovar Typhi
ccaacacaucgacaugcag

SEQ ID NO: 1695290 - RNA, 12 nt, Salmonella enterica enterica serovar Typhi
ccaacaccagcc

SEQ ID NO: 1695291 - RNA, 18 nt, Salmonella enterica enterica serovar Typhi
ccaacacggcgcucagga

SEQ ID NO: 1695292 - RNA, 18 nt, Salmonella enterica enterica serovar Typhi
ccaacccacgcgccacgu

SEQ ID NO: 1695293 - RNA, 21 nt, Salmonella enterica enterica serovar Typhi
ccaccguuuaaucgcccugcg

SEQ ID NO: 1695294 - RNA, 22 nt, Salmonella enterica enterica serovar Typhi
ccaccgcugauggcguggcgca

SEQ ID NO: 1695295 - RNA, 15 nt, Salmonella enterica enterica serovar Typhi
ccaccgcuccgcgca

SEQ ID NO: 1695296 - RNA, 17 nt, Salmonella enterica enterica serovar Typhi
ccacgcaggcgaccucg

SEQ ID NO: 1695297 - RNA, 15 nt, Salmonella enterica enterica serovar Typhi
ccacgaaaauuauuu

SEQ ID NO: 1695298 - RNA, 18 nt, Salmonella enterica enterica serovar Typhi
ccacgaaaauuauuuucg

SEQ ID NO: 1695299 - RNA, 15 nt, Salmonella enterica enterica serovar Typhi
ccaccuuucugcucc

SEQ ID NO: 1695300 - RNA, 21 nt, Salmonella enterica enterica serovar Typhi
ccaccuuaaucgacuucaugc

SEQ ID NO: 1695301 - RNA, 18 nt, Salmonella enterica enterica serovar Typhi
ccaccuggcccugcauca

SEQ ID NO: 1695302 - RNA, 13 nt, Salmonella enterica enterica serovar Typhi
ccaccugcgcguu

SEQ ID NO: 1695303 - RNA, 21 nt, Salmonella enterica enterica serovar Typhi
ccaccuggcccugcaucagcu

SEQ ID NO: 1695304 - RNA, 11 nt, Salmonella enterica enterica serovar Typhi
ccaccacaaac

SEQ ID NO: 1695305 - RNA, 12 nt, Salmonella enterica enterica serovar Typhi
ccaccacaaagc

SEQ ID NO: 1695306 - RNA, 23 nt, Salmonella enterica enterica serovar Typhi
ccaccagccgauaacucuucauc

SEQ ID NO: 1695307 - RNA, 16 nt, Salmonella enterica enterica serovar Typhi
ccacccauuuuccgcu

SEQ ID NO: 1695308 - RNA, 23 nt, Salmonella enterica enterica serovar Typhi
ccacccauuuauguuugcccagc

SEQ ID NO: 1695309 - RNA, 23 nt, Salmonella enterica enterica serovar Typhi
ccaccagcgccauaauccagaau

SEQ ID NO: 1695310 - RNA, 12 nt, Salmonella enterica enterica serovar Typhi
ccaccagcgcca

SEQ ID NO: 1695311 - RNA, 16 nt, Salmonella enterica enterica serovar Typhi
ccaccagcgccagcgg

SEQ ID NO: 1695312 - RNA, 19 nt, Salmonella enterica enterica serovar Typhi
ccaccagcgccaggccauu

SEQ ID NO: 1695313 - RNA, 21 nt, Salmonella enterica enterica serovar Typhi
ccaccaggaaugcggccaucc

SEQ ID NO: 1695314 - RNA, 19 nt, Salmonella enterica enterica serovar Typhi
ccacccgcgcgcuuuccac

SEQ ID NO: 1695315 - RNA, 15 nt, Salmonella enterica enterica serovar Typhi
ccacccgcuaugaag

SEQ ID NO: 1695316 - RNA, 13 nt, Salmonella enterica enterica serovar Typhi
ccaauaauuuuag

SEQ ID NO: 1695317 - RNA, 18 nt, Salmonella enterica enterica serovar Typhi
ccaaguaauaaagagaac

SEQ ID NO: 1695318 - RNA, 17 nt, Salmonella enterica enterica serovar Typhi
ccaauaacguaaccgcu

SEQ ID NO: 1695319 - RNA, 16 nt, Salmonella enterica enterica serovar Typhi
ccaaugccaaaaaaac

SEQ ID NO: 1695320 - RNA, 13 nt, Salmonella enterica enterica serovar Typhi
ccaaugcagcgcg

SEQ ID NO: 1695321 - RNA, 21 nt, Salmonella enterica enterica serovar Typhi
ccaaugaaauaauuguguaau

SEQ ID NO: 1695322 - RNA, 14 nt, Salmonella enterica enterica serovar Typhi
ccaauaauuuuaga

SEQ ID NO: 1695323 - RNA, 15 nt, Salmonella enterica enterica serovar Typhi
ccaaugacaauaauc

SEQ ID NO: 1695324 - RNA, 12 nt, Salmonella enterica enterica serovar Typhi
ccaaugagcugc

SEQ ID NO: 1695325 - RNA, 13 nt, Salmonella enterica enterica serovar Typhi
ccacaaaggcgcg

SEQ ID NO: 1695326 - RNA, 20 nt, Salmonella enterica enterica serovar Typhi
ccaauucguguuuuugaaca

SEQ ID NO: 1695327 - RNA, 16 nt, Salmonella enterica enterica serovar Typhi
ccacaaccggcuggcu

SEQ ID NO: 1695328 - RNA, 17 nt, Salmonella enterica enterica serovar Typhi
ccacaacgccugaugcu

SEQ ID NO: 1695329 - RNA, 18 nt, Salmonella enterica enterica serovar Typhi
ccacaacggcaauuuuua

SEQ ID NO: 1695330 - RNA, 15 nt, Salmonella enterica enterica serovar Typhi
ccacauuaaagagcg

SEQ ID NO: 1695331 - RNA, 21 nt, Salmonella enterica enterica serovar Typhi
ccacaugagaagggcaauauc

SEQ ID NO: 1695332 - RNA, 14 nt, Salmonella enterica enterica serovar Typhi
ccacaugaccagcg

SEQ ID NO: 1695333 - RNA, 23 nt, Salmonella enterica enterica serovar Typhi
ccacaugccggugcgagaaaaag

SEQ ID NO: 1695334 - RNA, 16 nt, Salmonella enterica enterica serovar Typhi
ccacauuccagaccug

SEQ ID NO: 1695335 - RNA, 17 nt, Salmonella enterica enterica serovar Typhi
ccacauccaccccgguu

SEQ ID NO: 1695336 - RNA, 23 nt, Salmonella enterica enterica serovar Typhi
ccacaucgcgagcacuuuuuccu

SEQ ID NO: 1695337 - RNA, 21 nt, Salmonella enterica enterica serovar Typhi
ccacaucggaucgauaugugu

SEQ ID NO: 1695338 - RNA, 13 nt, Salmonella enterica enterica serovar Typhi
ccacaugaccagc

SEQ ID NO: 1695339 - RNA, 13 nt, Salmonella enterica enterica serovar Typhi
ccacacugcugug

SEQ ID NO: 1695340 - RNA, 15 nt, Salmonella enterica enterica serovar Typhi
ccacacugcaucgaa

SEQ ID NO: 1695341 - RNA, 16 nt, Salmonella enterica enterica serovar Typhi
ccacacggcauucacg

SEQ ID NO: 1695342 - RNA, 21 nt, Salmonella enterica enterica serovar Typhi
ccacacgcuuauccugccacu

SEQ ID NO: 1695343 - RNA, 14 nt, Salmonella enterica enterica serovar Typhi
ccacaccggcgcau

SEQ ID NO: 1695344 - RNA, 17 nt, Salmonella enterica enterica serovar Typhi
ccacagguuaucgccgc

SEQ ID NO: 1695345 - RNA, 17 nt, Salmonella enterica enterica serovar Typhi
ccacagucgucuggcgc

SEQ ID NO: 1695346 - RNA, 21 nt, Salmonella enterica enterica serovar Typhi
ccacagucauggcuuuuaccc

SEQ ID NO: 1695347 - RNA, 20 nt, Salmonella enterica enterica serovar Typhi
ccacagugacccgccgccag

SEQ ID NO: 1695348 - RNA, 18 nt, Salmonella enterica enterica serovar Typhi
ccacagucgucuggcgcu

SEQ ID NO: 1695349 - RNA, 20 nt, Salmonella enterica enterica serovar Typhi
ccacaguaauggacagguaa

SEQ ID NO: 1695350 - RNA, 22 nt, Salmonella enterica enterica serovar Typhi
ccacagugacccgccgccagca

SEQ ID NO: 1695351 - RNA, 14 nt, Salmonella enterica enterica serovar Typhi
ccacugcacgccag

SEQ ID NO: 1695352 - RNA, 12 nt, Salmonella enterica enterica serovar Typhi
ccacugcccgcc

SEQ ID NO: 1695353 - RNA, 22 nt, Salmonella enterica enterica serovar Typhi
ccacgccaacguccgccgucag

SEQ ID NO: 1695354 - RNA, 15 nt, Salmonella enterica enterica serovar Typhi
ccacuggguuuccca

SEQ ID NO: 1695355 - RNA, 13 nt, Salmonella enterica enterica serovar Typhi
ccacuggcccccu

SEQ ID NO: 1695356 - RNA, 18 nt, Salmonella enterica enterica serovar Typhi
ccacuggcccccuguucc

SEQ ID NO: 1695357 - RNA, 20 nt, Salmonella enterica enterica serovar Typhi
ccacgccaccgggccgucag

SEQ ID NO: 1695358 - RNA, 14 nt, Salmonella enterica enterica serovar Typhi
ccacuuaggcagcc

SEQ ID NO: 1695359 - RNA, 19 nt, Salmonella enterica enterica serovar Typhi
ccacuuccagcgcgccguc

SEQ ID NO: 1695360 - RNA, 20 nt, Salmonella enterica enterica serovar Typhi
ccacuucuuccagcggcaga

SEQ ID NO: 1695361 - RNA, 16 nt, Salmonella enterica enterica serovar Typhi
ccacuucuuccagcgu

SEQ ID NO: 1695362 - RNA, 13 nt, Salmonella enterica enterica serovar Typhi
ccagacacuggaa

SEQ ID NO: 1695363 - RNA, 22 nt, Salmonella enterica enterica serovar Typhi
ccagacacuggaaacagccaau

SEQ ID NO: 1695364 - RNA, 15 nt, Salmonella enterica enterica serovar Typhi
ccagacagauaacac

SEQ ID NO: 1695365 - RNA, 13 nt, Salmonella enterica enterica serovar Typhi
ccagaauucagca

SEQ ID NO: 1695366 - RNA, 22 nt, Salmonella enterica enterica serovar Typhi
ccagaauuuccuucgcuuccug

SEQ ID NO: 1695367 - RNA, 22 nt, Salmonella enterica enterica serovar Typhi
ccagaaucaucgcuaucaugcu

SEQ ID NO: 1695368 - RNA, 19 nt, Salmonella enterica enterica serovar Typhi
ccagaaucaccgacagcac

SEQ ID NO: 1695369 - RNA, 23 nt, Salmonella enterica enterica serovar Typhi
ccagaaguagcagagaaaagguu

SEQ ID NO: 1695370 - RNA, 18 nt, Salmonella enterica enterica serovar Typhi
ccagaaggcgaacauaag

SEQ ID NO: 1695371 - RNA, 15 nt, Salmonella enterica enterica serovar Typhi
ccagaauacgccgcc

SEQ ID NO: 1695372 - RNA, 14 nt, Salmonella enterica enterica serovar Typhi
ccagaagcacuucu

SEQ ID NO: 1695373 - RNA, 13 nt, Salmonella enterica enterica serovar Typhi
ccagaaggcaaaa

SEQ ID NO: 1695374 - RNA, 22 nt, Salmonella enterica enterica serovar Typhi
ccagaaggcaaaaugccagccc

SEQ ID NO: 1695375 - RNA, 14 nt, Salmonella enterica enterica serovar Typhi
ccagaaggcaggcu

SEQ ID NO: 1695376 - RNA, 12 nt, Salmonella enterica enterica serovar Typhi
ccagaagcacuu

SEQ ID NO: 1695377 - RNA, 18 nt, Salmonella enterica enterica serovar Typhi
ccagaagcgcuuugccaa

SEQ ID NO: 1695378 - RNA, 15 nt, Salmonella enterica enterica serovar Typhi
ccagaaagaucagca

SEQ ID NO: 1695379 - RNA, 16 nt, Salmonella enterica enterica serovar Typhi
ccagaaaaaaaagcgc

SEQ ID NO: 1695380 - RNA, 16 nt, Salmonella enterica enterica serovar Typhi
ccagaaaaagggaaaa

SEQ ID NO: 1695381 - RNA, 21 nt, Salmonella enterica enterica serovar Typhi
ccacuuucucggcuuuccagc

SEQ ID NO: 1695382 - RNA, 19 nt, Salmonella enterica enterica serovar Typhi
ccacuuucuguaauuugaa

SEQ ID NO: 1695383 - RNA, 13 nt, Salmonella enterica enterica serovar Typhi
ccacuuugcgcuc

SEQ ID NO: 1695384 - RNA, 23 nt, Salmonella enterica enterica serovar Typhi
ccagaacguugacguuucaguca

SEQ ID NO: 1695385 - RNA, 14 nt, Salmonella enterica enterica serovar Typhi
ccagaacucaucuu

SEQ ID NO: 1695386 - RNA, 12 nt, Salmonella enterica enterica serovar Typhi
ccagaacagaag

SEQ ID NO: 1695387 - RNA, 19 nt, Salmonella enterica enterica serovar Typhi
ccagauguugauacagaaa

SEQ ID NO: 1695388 - RNA, 17 nt, Salmonella enterica enterica serovar Typhi
ccagauuacugcccuga

SEQ ID NO: 1695389 - RNA, 17 nt, Salmonella enterica enterica serovar Typhi
ccagauuaucggccagc

SEQ ID NO: 1695390 - RNA, 14 nt, Salmonella enterica enterica serovar Typhi
ccagauucuuaguc

SEQ ID NO: 1695391 - RNA, 18 nt, Salmonella enterica enterica serovar Typhi
ccagauggcugcacccgg

SEQ ID NO: 1695392 - RNA, 17 nt, Salmonella enterica enterica serovar Typhi
ccagauggcaagauuaa

SEQ ID NO: 1695393 - RNA, 21 nt, Salmonella enterica enterica serovar Typhi
ccagauggcugcacccggaga

SEQ ID NO: 1695394 - RNA, 16 nt, Salmonella enterica enterica serovar Typhi
ccagaugcgccaguac

SEQ ID NO: 1695395 - RNA, 18 nt, Salmonella enterica enterica serovar Typhi
ccagauggauaaccugcc

SEQ ID NO: 1695396 - RNA, 22 nt, Salmonella enterica enterica serovar Typhi
ccagauggcaagauuaaccagc

SEQ ID NO: 1695397 - RNA, 20 nt, Salmonella enterica enterica serovar Typhi
ccagauguuauaaacuucaa

SEQ ID NO: 1695398 - RNA, 18 nt, Salmonella enterica enterica serovar Typhi
ccagaugucgcggauaug

SEQ ID NO: 1695399 - RNA, 21 nt, Salmonella enterica enterica serovar Typhi
ccagauggcuaugaagcugga

SEQ ID NO: 1695400 - RNA, 21 nt, Salmonella enterica enterica serovar Typhi
ccagauggggcuuccauugca

SEQ ID NO: 1695401 - RNA, 19 nt, Salmonella enterica enterica serovar Typhi
ccagaucggcaugauggcg

SEQ ID NO: 1695402 - RNA, 22 nt, Salmonella enterica enterica serovar Typhi
ccagaucguagccauguuccuc

SEQ ID NO: 1695403 - RNA, 14 nt, Salmonella enterica enterica serovar Typhi
ccagaugcugggcg

SEQ ID NO: 1695404 - RNA, 19 nt, Salmonella enterica enterica serovar Typhi
ccagaucgauauccgugcg

SEQ ID NO: 1695405 - RNA, 22 nt, Salmonella enterica enterica serovar Typhi
ccagauaucgcguacaggaugu

SEQ ID NO: 1695406 - RNA, 13 nt, Salmonella enterica enterica serovar Typhi
ccagauauggcaa

SEQ ID NO: 1695407 - RNA, 15 nt, Salmonella enterica enterica serovar Typhi
ccagauauuuuuccg

SEQ ID NO: 1695408 - RNA, 21 nt, Salmonella enterica enterica serovar Typhi
ccagauaagcucuccuggaug

SEQ ID NO: 1695409 - RNA, 13 nt, Salmonella enterica enterica serovar Typhi
ccagauacauggc

SEQ ID NO: 1695410 - RNA, 21 nt, Salmonella enterica enterica serovar Typhi
ccagauacaaaucucagggug

SEQ ID NO: 1695411 - RNA, 17 nt, Salmonella enterica enterica serovar Typhi
ccagauacgcgccggcc

SEQ ID NO: 1695412 - RNA, 14 nt, Salmonella enterica enterica serovar Typhi
ccagauacgcgccg

SEQ ID NO: 1695413 - RNA, 22 nt, Salmonella enterica enterica serovar Typhi
ccagauaaucgccgccagcuca

SEQ ID NO: 1695414 - RNA, 20 nt, Salmonella enterica enterica serovar Typhi
ccagauaaucaaacgcgccg

SEQ ID NO: 1695415 - RNA, 14 nt, Salmonella enterica enterica serovar Typhi
ccagauaaggcuca

SEQ ID NO: 1695416 - RNA, 16 nt, Salmonella enterica enterica serovar Typhi
ccagauaauccagcgu

SEQ ID NO: 1695417 - RNA, 13 nt, Salmonella enterica enterica serovar Typhi
ccagacgccagcc

SEQ ID NO: 1695418 - RNA, 17 nt, Salmonella enterica enterica serovar Typhi
ccagacgggccaggcga

SEQ ID NO: 1695419 - RNA, 17 nt, Salmonella enterica enterica serovar Typhi
ccagacgcguaaccccu

SEQ ID NO: 1695420 - RNA, 19 nt, Salmonella enterica enterica serovar Typhi
ccagaccggcaucucaucu

SEQ ID NO: 1695421 - RNA, 17 nt, Salmonella enterica enterica serovar Typhi
ccagacaugcacauggu

SEQ ID NO: 1695422 - RNA, 14 nt, Salmonella enterica enterica serovar Typhi
ccagacagcccaac

SEQ ID NO: 1695423 - RNA, 19 nt, Salmonella enterica enterica serovar Typhi
ccagacagauuuggucagu

SEQ ID NO: 1695424 - RNA, 13 nt, Salmonella enterica enterica serovar Typhi
ccagacaggacgc

SEQ ID NO: 1695425 - RNA, 17 nt, Salmonella enterica enterica serovar Typhi
ccagacaggacgccagc

SEQ ID NO: 1695426 - RNA, 19 nt, Salmonella enterica enterica serovar Typhi
ccagacccgauaguguaaa

SEQ ID NO: 1695427 - RNA, 18 nt, Salmonella enterica enterica serovar Typhi
ccagagccccaaugcuuu

SEQ ID NO: 1695428 - RNA, 17 nt, Salmonella enterica enterica serovar Typhi
ccagagcgcgcuggcaa

SEQ ID NO: 1695429 - RNA, 18 nt, Salmonella enterica enterica serovar Typhi
ccagagcgcggccuuugc

SEQ ID NO: 1695430 - RNA, 17 nt, Salmonella enterica enterica serovar Typhi
ccagaguccggcgccug

SEQ ID NO: 1695431 - RNA, 13 nt, Salmonella enterica enterica serovar Typhi
ccagacuaaucca

SEQ ID NO: 1695432 - RNA, 16 nt, Salmonella enterica enterica serovar Typhi
ccagacucaccccuuc

SEQ ID NO: 1695433 - RNA, 14 nt, Salmonella enterica enterica serovar Typhi
ccagacuuuccagc

SEQ ID NO: 1695434 - RNA, 21 nt, Salmonella enterica enterica serovar Typhi
ccagcagaugcaguucacccu

SEQ ID NO: 1695435 - RNA, 20 nt, Salmonella enterica enterica serovar Typhi
ccagcagauuuuuauccguc

SEQ ID NO: 1695436 - RNA, 9 nt, Salmonella enterica enterica serovar Typhi
ccagcagca

SEQ ID NO: 1695437 - RNA, 15 nt, Salmonella enterica enterica serovar Typhi
ccagcagcacuuccg

SEQ ID NO: 1695438 - RNA, 17 nt, Salmonella enterica enterica serovar Typhi
ccagcagcagcaccggc

SEQ ID NO: 1695439 - RNA, 14 nt, Salmonella enterica enterica serovar Typhi
ccagcagcagcgca

SEQ ID NO: 1695440 - RNA, 23 nt, Salmonella enterica enterica serovar Typhi
ccagcagcauaaaaccgccgccc

SEQ ID NO: 1695441 - RNA, 14 nt, Salmonella enterica enterica serovar Typhi
ccagcagccagccg

SEQ ID NO: 1695442 - RNA, 21 nt, Salmonella enterica enterica serovar Typhi
ccagcagcauaaaaccgccgc

SEQ ID NO: 1695443 - RNA, 12 nt, Salmonella enterica enterica serovar Typhi
ccagcagcgaca

SEQ ID NO: 1695444 - RNA, 13 nt, Salmonella enterica enterica serovar Typhi
ccagcagcagcuc

SEQ ID NO: 1695445 - RNA, 22 nt, Salmonella enterica enterica serovar Typhi
ccagcagcgccaguuuuucccg

SEQ ID NO: 1695446 - RNA, 18 nt, Salmonella enterica enterica serovar Typhi
ccagcacggccuugaagu

SEQ ID NO: 1695447 - RNA, 17 nt, Salmonella enterica enterica serovar Typhi
ccagcacuaacagcagc

SEQ ID NO: 1695448 - RNA, 16 nt, Salmonella enterica enterica serovar Typhi
ccagcacuaacagcag

SEQ ID NO: 1695449 - RNA, 19 nt, Salmonella enterica enterica serovar Typhi
ccagcagaugcaguucacc

SEQ ID NO: 1695450 - RNA, 17 nt, Salmonella enterica enterica serovar Typhi
ccagcagacgcugcuuc

SEQ ID NO: 1695451 - RNA, 20 nt, Salmonella enterica enterica serovar Typhi
ccagcagacgcugcuucacg

SEQ ID NO: 1695452 - RNA, 15 nt, Salmonella enterica enterica serovar Typhi
ccagcaacagcguac

SEQ ID NO: 1695453 - RNA, 19 nt, Salmonella enterica enterica serovar Typhi
ccagcaacgcgcuaaaugc

SEQ ID NO: 1695454 - RNA, 17 nt, Salmonella enterica enterica serovar Typhi
ccagcaacccaccugcc

SEQ ID NO: 1695455 - RNA, 22 nt, Salmonella enterica enterica serovar Typhi
ccagcaacguauuccacggaau

SEQ ID NO: 1695456 - RNA, 23 nt, Salmonella enterica enterica serovar Typhi
ccagcaaaccuuccgccaggcgg

SEQ ID NO: 1695457 - RNA, 12 nt, Salmonella enterica enterica serovar Typhi
ccagcaaaucgc

SEQ ID NO: 1695458 - RNA, 20 nt, Salmonella enterica enterica serovar Typhi
ccagauugucgcaaaccacc

SEQ ID NO: 1695459 - RNA, 22 nt, Salmonella enterica enterica serovar Typhi
ccagauugucgcaaaccaccgg

SEQ ID NO: 1695460 - RNA, 18 nt, Salmonella enterica enterica serovar Typhi
ccagauuuuucucacaca

SEQ ID NO: 1695461 - RNA, 16 nt, Salmonella enterica enterica serovar Typhi
ccagcaccaacgccgc

SEQ ID NO: 1695462 - RNA, 15 nt, Salmonella enterica enterica serovar Typhi
ccagcacagcccagu

SEQ ID NO: 1695463 - RNA, 16 nt, Salmonella enterica enterica serovar Typhi
ccagcaccagcagcgc

SEQ ID NO: 1695464 - RNA, 15 nt, Salmonella enterica enterica serovar Typhi
ccagcaccagcagug

SEQ ID NO: 1695465 - RNA, 15 nt, Salmonella enterica enterica serovar Typhi
ccagcaauaacaccg

SEQ ID NO: 1695466 - RNA, 19 nt, Salmonella enterica enterica serovar Typhi
ccagcaagcggcgauugau

SEQ ID NO: 1695467 - RNA, 23 nt, Salmonella enterica enterica serovar Typhi
ccagcaaggagacgcccgucacc

SEQ ID NO: 1695468 - RNA, 18 nt, Salmonella enterica enterica serovar Typhi
ccagcaaugccgccgcca

SEQ ID NO: 1695469 - RNA, 18 nt, Salmonella enterica enterica serovar Typhi
ccagcaaugagccgucgc

SEQ ID NO: 1695470 - RNA, 18 nt, Salmonella enterica enterica serovar Typhi
ccagccacaagagcagca

SEQ ID NO: 1695471 - RNA, 17 nt, Salmonella enterica enterica serovar Typhi
ccagccagacgccagcc

SEQ ID NO: 1695472 - RNA, 13 nt, Salmonella enterica enterica serovar Typhi
ccagccacugacu

SEQ ID NO: 1695473 - RNA, 17 nt, Salmonella enterica enterica serovar Typhi
ccagccagcgacgcaug

SEQ ID NO: 1695474 - RNA, 14 nt, Salmonella enterica enterica serovar Typhi
ccagccaggcgauu

SEQ ID NO: 1695475 - RNA, 18 nt, Salmonella enterica enterica serovar Typhi
ccagccagggaucaagca

SEQ ID NO: 1695476 - RNA, 16 nt, Salmonella enterica enterica serovar Typhi
ccagccaguccuccgg

SEQ ID NO: 1695477 - RNA, 15 nt, Salmonella enterica enterica serovar Typhi
ccagccauagcagca

SEQ ID NO: 1695478 - RNA, 14 nt, Salmonella enterica enterica serovar Typhi
ccagccauaaauau

SEQ ID NO: 1695479 - RNA, 15 nt, Salmonella enterica enterica serovar Typhi
ccagccgaucuauuu

SEQ ID NO: 1695480 - RNA, 18 nt, Salmonella enterica enterica serovar Typhi
ccagccgaucaucacgaa

SEQ ID NO: 1695481 - RNA, 21 nt, Salmonella enterica enterica serovar Typhi
ccagccgagcgguaagagcca

SEQ ID NO: 1695482 - RNA, 16 nt, Salmonella enterica enterica serovar Typhi
ccagcccuaaaaauag

SEQ ID NO: 1695483 - RNA, 22 nt, Salmonella enterica enterica serovar Typhi
ccagcccggaaauaaacgccag

SEQ ID NO: 1695484 - RNA, 23 nt, Salmonella enterica enterica serovar Typhi
ccagcccggaaauaaacgccagu

SEQ ID NO: 1695485 - RNA, 19 nt, Salmonella enterica enterica serovar Typhi
ccagcccaauacgccagcc

SEQ ID NO: 1695486 - RNA, 13 nt, Salmonella enterica enterica serovar Typhi
ccagccccagccc

SEQ ID NO: 1695487 - RNA, 14 nt, Salmonella enterica enterica serovar Typhi
ccagccccaccguc

SEQ ID NO: 1695488 - RNA, 14 nt, Salmonella enterica enterica serovar Typhi
ccagcccgccgccc

SEQ ID NO: 1695489 - RNA, 15 nt, Salmonella enterica enterica serovar Typhi
ccagcccgccgcccu

SEQ ID NO: 1695490 - RNA, 18 nt, Salmonella enterica enterica serovar Typhi
ccagcccgccgcccuccg

SEQ ID NO: 1695491 - RNA, 17 nt, Salmonella enterica enterica serovar Typhi
ccagcaguugccauagc

SEQ ID NO: 1695492 - RNA, 14 nt, Salmonella enterica enterica serovar Typhi
ccagcauaccgccc

SEQ ID NO: 1695493 - RNA, 21 nt, Salmonella enterica enterica serovar Typhi
ccagcagguggaucugaaucu

SEQ ID NO: 1695494 - RNA, 11 nt, Salmonella enterica enterica serovar Typhi
ccagcauuucu

SEQ ID NO: 1695495 - RNA, 18 nt, Salmonella enterica enterica serovar Typhi
ccagcauuucaaucgcgc

SEQ ID NO: 1695496 - RNA, 20 nt, Salmonella enterica enterica serovar Typhi
ccagcauuuccagcugguua

SEQ ID NO: 1695497 - RNA, 17 nt, Salmonella enterica enterica serovar Typhi
ccagcauuagcgccacc

SEQ ID NO: 1695498 - RNA, 14 nt, Salmonella enterica enterica serovar Typhi
ccagcaugcccgcc

SEQ ID NO: 1695499 - RNA, 21 nt, Salmonella enterica enterica serovar Typhi
ccagcaugaucauacugccgc

SEQ ID NO: 1695500 - RNA, 13 nt, Salmonella enterica enterica serovar Typhi
ccagcaucgacca

SEQ ID NO: 1695501 - RNA, 17 nt, Salmonella enterica enterica serovar Typhi
ccagcaucggcagcgcc

SEQ ID NO: 1695502 - RNA, 14 nt, Salmonella enterica enterica serovar Typhi
ccagcaguugccuu

SEQ ID NO: 1695503 - RNA, 16 nt, Salmonella enterica enterica serovar Typhi
ccagcaugagccagcc

SEQ ID NO: 1695504 - RNA, 17 nt, Salmonella enterica enterica serovar Typhi
ccagcaugagccagccc

SEQ ID NO: 1695505 - RNA, 18 nt, Salmonella enterica enterica serovar Typhi
ccagcaucaauagcagcu

SEQ ID NO: 1695506 - RNA, 20 nt, Salmonella enterica enterica serovar Typhi
ccagcauauuaacagugagu

SEQ ID NO: 1695507 - RNA, 14 nt, Salmonella enterica enterica serovar Typhi
ccagcaucaggugg

SEQ ID NO: 1695508 - RNA, 20 nt, Salmonella enterica enterica serovar Typhi
ccagcaucaugggcucauca

SEQ ID NO: 1695509 - RNA, 13 nt, Salmonella enterica enterica serovar Typhi
ccagcaucccgcu

SEQ ID NO: 1695510 - RNA, 17 nt, Salmonella enterica enterica serovar Typhi
ccagcaucgaccaggau

SEQ ID NO: 1695511 - RNA, 13 nt, Salmonella enterica enterica serovar Typhi
cauacuuugcauu

SEQ ID NO: 1695512 - RNA, 23 nt, Salmonella enterica enterica serovar Typhi
cauagaaaaagaacugcaaauac

SEQ ID NO: 1695513 - RNA, 20 nt, Salmonella enterica enterica serovar Typhi
cauacugcuuuuucggcuca

SEQ ID NO: 1695514 - RNA, 14 nt, Salmonella enterica enterica serovar Typhi
cauacugcccagcc

SEQ ID NO: 1695515 - RNA, 14 nt, Salmonella enterica enterica serovar Typhi
cauacuguuuauca

SEQ ID NO: 1695516 - RNA, 15 nt, Salmonella enterica enterica serovar Typhi
cauacucuccuccau

SEQ ID NO: 1695517 - RNA, 15 nt, Salmonella enterica enterica serovar Typhi
cauacugaagauaaa

SEQ ID NO: 1695518 - RNA, 23 nt, Salmonella enterica enterica serovar Typhi
cagugcaguauugcaccaggaag

SEQ ID NO: 1695519 - RNA, 17 nt, Salmonella enterica enterica serovar Typhi
cauagauauaacccagu

SEQ ID NO: 1695520 - RNA, 20 nt, Salmonella enterica enterica serovar Typhi
cauagacgcccugcaaagca

SEQ ID NO: 1695521 - RNA, 21 nt, Salmonella enterica enterica serovar Typhi
cauagacgcccugcaaagcaa

SEQ ID NO: 1695522 - RNA, 13 nt, Salmonella enterica enterica serovar Typhi
cauagaauuucag

SEQ ID NO: 1695523 - RNA, 18 nt, Salmonella enterica enterica serovar Typhi
cauagaaagauuucauca

SEQ ID NO: 1695524 - RNA, 16 nt, Salmonella enterica enterica serovar Typhi
cauagaacgcuugucu

SEQ ID NO: 1695525 - RNA, 19 nt, Salmonella enterica enterica serovar Typhi
cauaggcuuugcugagcgc

SEQ ID NO: 1695526 - RNA, 17 nt, Salmonella enterica enterica serovar Typhi
cauaggccggcgaagau

SEQ ID NO: 1695527 - RNA, 18 nt, Salmonella enterica enterica serovar Typhi
cauauagugcgugacaau

SEQ ID NO: 1695528 - RNA, 16 nt, Salmonella enterica enterica serovar Typhi
cauauaacuuucaaua

SEQ ID NO: 1695529 - RNA, 16 nt, Salmonella enterica enterica serovar Typhi
cauauaugcgacagaa

SEQ ID NO: 1695530 - RNA, 18 nt, Salmonella enterica enterica serovar Typhi
cauauaaauuucauccau

SEQ ID NO: 1695531 - RNA, 14 nt, Salmonella enterica enterica serovar Typhi
cauagcgccuucag

SEQ ID NO: 1695532 - RNA, 15 nt, Salmonella enterica enterica serovar Typhi
cauagcgcgaaugau

SEQ ID NO: 1695533 - RNA, 13 nt, Salmonella enterica enterica serovar Typhi
cauagccuaauga

SEQ ID NO: 1695534 - RNA, 13 nt, Salmonella enterica enterica serovar Typhi
cauagcaucacca

SEQ ID NO: 1695535 - RNA, 20 nt, Salmonella enterica enterica serovar Typhi
cauagccaacacauaagcca

SEQ ID NO: 1695536 - RNA, 22 nt, Salmonella enterica enterica serovar Typhi
cauagccggcgauagcgcccca

SEQ ID NO: 1695537 - RNA, 15 nt, Salmonella enterica enterica serovar Typhi
cauagccgcgcguca

SEQ ID NO: 1695538 - RNA, 14 nt, Salmonella enterica enterica serovar Typhi
cauagccgccaccc

SEQ ID NO: 1695539 - RNA, 20 nt, Salmonella enterica enterica serovar Typhi
cauagcuaaauaaaaauaau

SEQ ID NO: 1695540 - RNA, 18 nt, Salmonella enterica enterica serovar Typhi
cauagcuaaauaaaaaua

SEQ ID NO: 1695541 - RNA, 22 nt, Salmonella enterica enterica serovar Typhi
cauagcguugauaugcucgaca

SEQ ID NO: 1695542 - RNA, 21 nt, Salmonella enterica enterica serovar Typhi
cauagcguuuaaaaagcugca

SEQ ID NO: 1695543 - RNA, 14 nt, Salmonella enterica enterica serovar Typhi
caucaaaaaaaaua

SEQ ID NO: 1695544 - RNA, 16 nt, Salmonella enterica enterica serovar Typhi
cauauuuuuucaggaa

SEQ ID NO: 1695545 - RNA, 13 nt, Salmonella enterica enterica serovar Typhi
cauauuuuuaugc

SEQ ID NO: 1695546 - RNA, 19 nt, Salmonella enterica enterica serovar Typhi
cauauuuucaacggcauca

SEQ ID NO: 1695547 - RNA, 21 nt, Salmonella enterica enterica serovar Typhi
cauauuuucaacggcaucaau

SEQ ID NO: 1695548 - RNA, 14 nt, Salmonella enterica enterica serovar Typhi
cauauugcgccgca

SEQ ID NO: 1695549 - RNA, 19 nt, Salmonella enterica enterica serovar Typhi
cauauuugcgugucaucaa

SEQ ID NO: 1695550 - RNA, 15 nt, Salmonella enterica enterica serovar Typhi
caucaaauaauacgc

SEQ ID NO: 1695551 - RNA, 19 nt, Salmonella enterica enterica serovar Typhi
caucaaguaccgugaagaa

SEQ ID NO: 1695552 - RNA, 12 nt, Salmonella enterica enterica serovar Typhi
cauaucgacggu

SEQ ID NO: 1695553 - RNA, 15 nt, Salmonella enterica enterica serovar Typhi
cauaucgcgcagcgu

SEQ ID NO: 1695554 - RNA, 14 nt, Salmonella enterica enterica serovar Typhi
cauaucgcaauuga

SEQ ID NO: 1695555 - RNA, 20 nt, Salmonella enterica enterica serovar Typhi
cauaucgcagaccauccaug

SEQ ID NO: 1695556 - RNA, 12 nt, Salmonella enterica enterica serovar Typhi
cauaucgaauga

SEQ ID NO: 1695557 - RNA, 18 nt, Salmonella enterica enterica serovar Typhi
cauaucaaucaacgguuc

SEQ ID NO: 1695558 - RNA, 17 nt, Salmonella enterica enterica serovar Typhi
cauauccgacagauagu

SEQ ID NO: 1695559 - RNA, 13 nt, Salmonella enterica enterica serovar Typhi
cauauauuuacug

SEQ ID NO: 1695560 - RNA, 21 nt, Salmonella enterica enterica serovar Typhi
cauauauuuacugaauaaaua

SEQ ID NO: 1695561 - RNA, 12 nt, Salmonella enterica enterica serovar Typhi
cauauauuauua

SEQ ID NO: 1695562 - RNA, 17 nt, Salmonella enterica enterica serovar Typhi
cauauaugcgacagaaa

SEQ ID NO: 1695563 - RNA, 15 nt, Salmonella enterica enterica serovar Typhi
cauaucgcuaaacca

SEQ ID NO: 1695564 - RNA, 16 nt, Salmonella enterica enterica serovar Typhi
cauaucgcuaaaccaa

SEQ ID NO: 1695565 - RNA, 22 nt, Salmonella enterica enterica serovar Typhi
cauauuccagccacacgacggu

SEQ ID NO: 1695566 - RNA, 19 nt, Salmonella enterica enterica serovar Typhi
cauaucguacugcuuuaau

SEQ ID NO: 1695567 - RNA, 13 nt, Salmonella enterica enterica serovar Typhi
cauauucaugguu

SEQ ID NO: 1695568 - RNA, 11 nt, Salmonella enterica enterica serovar Typhi
cauauuccugc

SEQ ID NO: 1695569 - RNA, 16 nt, Salmonella enterica enterica serovar Typhi
cauauucgucuucauc

SEQ ID NO: 1695570 - RNA, 22 nt, Salmonella enterica enterica serovar Typhi
cauauucuuugcgccuuauuca

SEQ ID NO: 1695571 - RNA, 18 nt, Salmonella enterica enterica serovar Typhi
caucacugaacccaaaca

SEQ ID NO: 1695572 - RNA, 21 nt, Salmonella enterica enterica serovar Typhi
caucacuuuaugaccauacug

SEQ ID NO: 1695573 - RNA, 13 nt, Salmonella enterica enterica serovar Typhi
caucacuuccauc

SEQ ID NO: 1695574 - RNA, 23 nt, Salmonella enterica enterica serovar Typhi
caucagcaauuucucgcccgcca

SEQ ID NO: 1695575 - RNA, 18 nt, Salmonella enterica enterica serovar Typhi
caucagcacaaaauccca

SEQ ID NO: 1695576 - RNA, 19 nt, Salmonella enterica enterica serovar Typhi
caucagcaaaauaccggca

SEQ ID NO: 1695577 - RNA, 22 nt, Salmonella enterica enterica serovar Typhi
caucagcaaaauaccggcagcg

SEQ ID NO: 1695578 - RNA, 15 nt, Salmonella enterica enterica serovar Typhi
caucacuuuuggcga

SEQ ID NO: 1695579 - RNA, 21 nt, Salmonella enterica enterica serovar Typhi
caucacuuuuggcgacaggaa

SEQ ID NO: 1695580 - RNA, 21 nt, Salmonella enterica enterica serovar Typhi
caucagaaaaaagccaagcac

SEQ ID NO: 1695581 - RNA, 13 nt, Salmonella enterica enterica serovar Typhi
caucaccggcccc

SEQ ID NO: 1695582 - RNA, 17 nt, Salmonella enterica enterica serovar Typhi
caucaccgacggggcgu

SEQ ID NO: 1695583 - RNA, 14 nt, Salmonella enterica enterica serovar Typhi
caucacgaaauaac

SEQ ID NO: 1695584 - RNA, 16 nt, Salmonella enterica enterica serovar Typhi
caucaccuccagcacg

SEQ ID NO: 1695585 - RNA, 16 nt, Salmonella enterica enterica serovar Typhi
caucaauuugaaaagg

SEQ ID NO: 1695586 - RNA, 22 nt, Salmonella enterica enterica serovar Typhi
caucaauaccugucggcaaauc

SEQ ID NO: 1695587 - RNA, 11 nt, Salmonella enterica enterica serovar Typhi
caucaauagca

SEQ ID NO: 1695588 - RNA, 19 nt, Salmonella enterica enterica serovar Typhi
caucacauguagcgcggca

SEQ ID NO: 1695589 - RNA, 21 nt, Salmonella enterica enterica serovar Typhi
caucacaugcgggagcaaaau

SEQ ID NO: 1695590 - RNA, 18 nt, Salmonella enterica enterica serovar Typhi
caucacagccacacugcu

SEQ ID NO: 1695591 - RNA, 19 nt, Salmonella enterica enterica serovar Typhi
caucacagccacacugcug

SEQ ID NO: 1695592 - RNA, 20 nt, Salmonella enterica enterica serovar Typhi
caucacagccacacugcugu

SEQ ID NO: 1695593 - RNA, 15 nt, Salmonella enterica enterica serovar Typhi
caucggcgcgucgcu

SEQ ID NO: 1695594 - RNA, 18 nt, Salmonella enterica enterica serovar Typhi
caucgggauuuacaaccg

SEQ ID NO: 1695595 - RNA, 23 nt, Salmonella enterica enterica serovar Typhi
caucgugauagacggcugaaugu

SEQ ID NO: 1695596 - RNA, 14 nt, Salmonella enterica enterica serovar Typhi
caucgugauaaacg

SEQ ID NO: 1695597 - RNA, 22 nt, Salmonella enterica enterica serovar Typhi
caucgucuuuuaccgcgucgcu

SEQ ID NO: 1695598 - RNA, 18 nt, Salmonella enterica enterica serovar Typhi
caucgguguacggcguca

SEQ ID NO: 1695599 - RNA, 18 nt, Salmonella enterica enterica serovar Typhi
caucgggucgcgcgccgc

SEQ ID NO: 1695600 - RNA, 15 nt, Salmonella enterica enterica serovar Typhi
caucggucaguguuu

SEQ ID NO: 1695601 - RNA, 17 nt, Salmonella enterica enterica serovar Typhi
caucggucaguuugccc

SEQ ID NO: 1695602 - RNA, 21 nt, Salmonella enterica enterica serovar Typhi
caucgcccugauggcgcgcca

SEQ ID NO: 1695603 - RNA, 19 nt, Salmonella enterica enterica serovar Typhi
caucgccgcaaugaccaca

SEQ ID NO: 1695604 - RNA, 20 nt, Salmonella enterica enterica serovar Typhi
caucgcuggucgcuaccaca

SEQ ID NO: 1695605 - RNA, 16 nt, Salmonella enterica enterica serovar Typhi
caucgcuuagcggcuc

SEQ ID NO: 1695606 - RNA, 14 nt, Salmonella enterica enterica serovar Typhi
caucggauuauuuu

SEQ ID NO: 1695607 - RNA, 15 nt, Salmonella enterica enterica serovar Typhi
caucggauagaugaa

SEQ ID NO: 1695608 - RNA, 12 nt, Salmonella enterica enterica serovar Typhi
caucggcaaacg

SEQ ID NO: 1695609 - RNA, 21 nt, Salmonella enterica enterica serovar Typhi
caucggcacguaguaaugcau

SEQ ID NO: 1695610 - RNA, 15 nt, Salmonella enterica enterica serovar Typhi
caucggcacagccag

SEQ ID NO: 1695611 - RNA, 16 nt, Salmonella enterica enterica serovar Typhi
caucggcacagccagu

SEQ ID NO: 1695612 - RNA, 13 nt, Salmonella enterica enterica serovar Typhi
caucggcaucaaa

SEQ ID NO: 1695613 - RNA, 15 nt, Salmonella enterica enterica serovar Typhi
caucggcagcgccag

SEQ ID NO: 1695614 - RNA, 18 nt, Salmonella enterica enterica serovar Typhi
caucgcauuaacguccau

SEQ ID NO: 1695615 - RNA, 19 nt, Salmonella enterica enterica serovar Typhi
caucgccacaugcggcagg

SEQ ID NO: 1695616 - RNA, 13 nt, Salmonella enterica enterica serovar Typhi
caucgccagccau

SEQ ID NO: 1695617 - RNA, 20 nt, Salmonella enterica enterica serovar Typhi
caucgccauccugcagccau

SEQ ID NO: 1695618 - RNA, 13 nt, Salmonella enterica enterica serovar Typhi
caucgccagcuuc

SEQ ID NO: 1695619 - RNA, 18 nt, Salmonella enterica enterica serovar Typhi
caucgacuucgaagguuc

SEQ ID NO: 1695620 - RNA, 16 nt, Salmonella enterica enterica serovar Typhi
cauccggcgcugauga

SEQ ID NO: 1695621 - RNA, 19 nt, Salmonella enterica enterica serovar Typhi
cauccggcgcugcgcggcg

SEQ ID NO: 1695622 - RNA, 19 nt, Salmonella enterica enterica serovar Typhi
cauccggcguugcgccgcc

SEQ ID NO: 1695623 - RNA, 20 nt, Salmonella enterica enterica serovar Typhi
cauccgggaguuucaugcca

SEQ ID NO: 1695624 - RNA, 18 nt, Salmonella enterica enterica serovar Typhi
cauccgcccggcaucaag

SEQ ID NO: 1695625 - RNA, 23 nt, Salmonella enterica enterica serovar Typhi
cauccgcgcaauaugcggcgcca

SEQ ID NO: 1695626 - RNA, 19 nt, Salmonella enterica enterica serovar Typhi
cauccgccagcgccucuuc

SEQ ID NO: 1695627 - RNA, 14 nt, Salmonella enterica enterica serovar Typhi
cauccggccuguuc

SEQ ID NO: 1695628 - RNA, 15 nt, Salmonella enterica enterica serovar Typhi
cauccggcauuuuuu

SEQ ID NO: 1695629 - RNA, 13 nt, Salmonella enterica enterica serovar Typhi
cauccggccagcg

SEQ ID NO: 1695630 - RNA, 18 nt, Salmonella enterica enterica serovar Typhi
cauccggcauuuaugcug

SEQ ID NO: 1695631 - RNA, 21 nt, Salmonella enterica enterica serovar Typhi
cauccggcacgccaucgccug

SEQ ID NO: 1695632 - RNA, 10 nt, Salmonella enterica enterica serovar Typhi
caucccagac

SEQ ID NO: 1695633 - RNA, 23 nt, Salmonella enterica enterica serovar Typhi
caucccauccgggccacucucca

SEQ ID NO: 1695634 - RNA, 16 nt, Salmonella enterica enterica serovar Typhi
cauccccaccgcugau

SEQ ID NO: 1695635 - RNA, 15 nt, Salmonella enterica enterica serovar Typhi
cauccccgccgagaa

SEQ ID NO: 1695636 - RNA, 21 nt, Salmonella enterica enterica serovar Typhi
cauccgauuucauggucaucg

SEQ ID NO: 1695637 - RNA, 19 nt, Salmonella enterica enterica serovar Typhi
cauccgagcgaaucuuccc

SEQ ID NO: 1695638 - RNA, 14 nt, Salmonella enterica enterica serovar Typhi
cauccccggcgccc

SEQ ID NO: 1695639 - RNA, 15 nt, Salmonella enterica enterica serovar Typhi
caucccgcccagcaa

SEQ ID NO: 1695640 - RNA, 17 nt, Salmonella enterica enterica serovar Typhi
cauccauguacuccuga

SEQ ID NO: 1695641 - RNA, 18 nt, Salmonella enterica enterica serovar Typhi
cauccauugcgccacgga

SEQ ID NO: 1695642 - RNA, 16 nt, Salmonella enterica enterica serovar Typhi
caucccaccggaaaug

SEQ ID NO: 1695643 - RNA, 17 nt, Salmonella enterica enterica serovar Typhi
caucccacuccaucgcc

SEQ ID NO: 1695644 - RNA, 13 nt, Salmonella enterica enterica serovar Typhi
cauccaugccagc

SEQ ID NO: 1695645 - RNA, 15 nt, Salmonella enterica enterica serovar Typhi
cauccauuaaaaucu

SEQ ID NO: 1695646 - RNA, 13 nt, Salmonella enterica enterica serovar Typhi
cauccaucaucua

SEQ ID NO: 1695647 - RNA, 14 nt, Salmonella enterica enterica serovar Typhi
cauccagcucaugu

SEQ ID NO: 1695648 - RNA, 22 nt, Salmonella enterica enterica serovar Typhi
cauccaggguuuaaucacgcca

SEQ ID NO: 1695649 - RNA, 15 nt, Salmonella enterica enterica serovar Typhi
cauccagucagcaau

SEQ ID NO: 1695650 - RNA, 23 nt, Salmonella enterica enterica serovar Typhi
cauccaguuuauauucuucgccc

SEQ ID NO: 1695651 - RNA, 19 nt, Salmonella enterica enterica serovar Typhi
cauccaguuguuuauucca

SEQ ID NO: 1695652 - RNA, 17 nt, Salmonella enterica enterica serovar Typhi
cauccaacugcgccuga

SEQ ID NO: 1695653 - RNA, 17 nt, Salmonella enterica enterica serovar Typhi
caucaugcccacaggca

SEQ ID NO: 1695654 - RNA, 20 nt, Salmonella enterica enterica serovar Typhi
caucaugcgcagaaacugau

SEQ ID NO: 1695655 - RNA, 15 nt, Salmonella enterica enterica serovar Typhi
caucaugcgccaggu

SEQ ID NO: 1695656 - RNA, 16 nt, Salmonella enterica enterica serovar Typhi
caucaugcuugcuuug

SEQ ID NO: 1695657 - RNA, 19 nt, Salmonella enterica enterica serovar Typhi
caucaugcuaaaagcgacu

SEQ ID NO: 1695658 - RNA, 15 nt, Salmonella enterica enterica serovar Typhi
caucagccagcagcu

SEQ ID NO: 1695659 - RNA, 12 nt, Salmonella enterica enterica serovar Typhi
cauccacauucg

SEQ ID NO: 1695660 - RNA, 14 nt, Salmonella enterica enterica serovar Typhi
cauccaccagaccc

SEQ ID NO: 1695661 - RNA, 23 nt, Salmonella enterica enterica serovar Typhi
cauccacauucguaacaugcugg

SEQ ID NO: 1695662 - RNA, 13 nt, Salmonella enterica enterica serovar Typhi
cauccacccuggc

SEQ ID NO: 1695663 - RNA, 18 nt, Salmonella enterica enterica serovar Typhi
cauccagcacgagcgcca

SEQ ID NO: 1695664 - RNA, 21 nt, Salmonella enterica enterica serovar Typhi
cauccagcaauaacaccggcg

SEQ ID NO: 1695665 - RNA, 14 nt, Salmonella enterica enterica serovar Typhi
cauccagagcaguc

SEQ ID NO: 1695666 - RNA, 19 nt, Salmonella enterica enterica serovar Typhi
cauccagacaugcacaugg

SEQ ID NO: 1695667 - RNA, 22 nt, Salmonella enterica enterica serovar Typhi
cauccagcacagguacaggccg

SEQ ID NO: 1695668 - RNA, 17 nt, Salmonella enterica enterica serovar Typhi
cauccagcgcucaauca

SEQ ID NO: 1695669 - RNA, 18 nt, Salmonella enterica enterica serovar Typhi
cauccagcgucacaggcu

SEQ ID NO: 1695670 - RNA, 18 nt, Salmonella enterica enterica serovar Typhi
caucuugaaugauuuugu

SEQ ID NO: 1695671 - RNA, 21 nt, Salmonella enterica enterica serovar Typhi
caucuucuuugacccacgcca

SEQ ID NO: 1695672 - RNA, 13 nt, Salmonella enterica enterica serovar Typhi
caucuucugcguc

SEQ ID NO: 1695673 - RNA, 21 nt, Salmonella enterica enterica serovar Typhi
caucguuacccauuaccuggc

SEQ ID NO: 1695674 - RNA, 14 nt, Salmonella enterica enterica serovar Typhi
caucguuacccauu

SEQ ID NO: 1695675 - RNA, 22 nt, Salmonella enterica enterica serovar Typhi
caucguguauaccaaaaauaau

SEQ ID NO: 1695676 - RNA, 16 nt, Salmonella enterica enterica serovar Typhi
caugaacguuaucggc

SEQ ID NO: 1695677 - RNA, 18 nt, Salmonella enterica enterica serovar Typhi
caugaaacucgacacacu

SEQ ID NO: 1695678 - RNA, 16 nt, Salmonella enterica enterica serovar Typhi
caugaaaaauauaaaa

SEQ ID NO: 1695679 - RNA, 19 nt, Salmonella enterica enterica serovar Typhi
caugaaaaauauaaaaagc

SEQ ID NO: 1695680 - RNA, 13 nt, Salmonella enterica enterica serovar Typhi
caugaaaaaaacg

SEQ ID NO: 1695681 - RNA, 13 nt, Salmonella enterica enterica serovar Typhi
caucuuuuuucac

SEQ ID NO: 1695682 - RNA, 13 nt, Salmonella enterica enterica serovar Typhi
caucuuuguucug

SEQ ID NO: 1695683 - RNA, 14 nt, Salmonella enterica enterica serovar Typhi
caucuuucuuuucg

SEQ ID NO: 1695684 - RNA, 18 nt, Salmonella enterica enterica serovar Typhi
caugaaucaucacaauua

SEQ ID NO: 1695685 - RNA, 21 nt, Salmonella enterica enterica serovar Typhi
caugaaugccccagcgcugcu

SEQ ID NO: 1695686 - RNA, 18 nt, Salmonella enterica enterica serovar Typhi
caugaaugccccagcgcu

SEQ ID NO: 1695687 - RNA, 17 nt, Salmonella enterica enterica serovar Typhi
caugacaauaacggccu

SEQ ID NO: 1695688 - RNA, 13 nt, Salmonella enterica enterica serovar Typhi
caugacauccaug

SEQ ID NO: 1695689 - RNA, 16 nt, Salmonella enterica enterica serovar Typhi
caugaccagcgccgcg

SEQ ID NO: 1695690 - RNA, 17 nt, Salmonella enterica enterica serovar Typhi
caugaguaaugaccaca

SEQ ID NO: 1695691 - RNA, 18 nt, Salmonella enterica enterica serovar Typhi
caugauacccagcguccc

SEQ ID NO: 1695692 - RNA, 17 nt, Salmonella enterica enterica serovar Typhi
caugauacguggcucaa

SEQ ID NO: 1695693 - RNA, 14 nt, Salmonella enterica enterica serovar Typhi
caugacucuuguuu

SEQ ID NO: 1695694 - RNA, 13 nt, Salmonella enterica enterica serovar Typhi
caugagaagaaaa

SEQ ID NO: 1695695 - RNA, 18 nt, Salmonella enterica enterica serovar Typhi
caugacuuuuuucaaccu

SEQ ID NO: 1695696 - RNA, 16 nt, Salmonella enterica enterica serovar Typhi
caugagccagcccuca

SEQ ID NO: 1695697 - RNA, 14 nt, Salmonella enterica enterica serovar Typhi
caugacggcugacg

SEQ ID NO: 1695698 - RNA, 18 nt, Salmonella enterica enterica serovar Typhi
caugacgccgaaauaaau

SEQ ID NO: 1695699 - RNA, 21 nt, Salmonella enterica enterica serovar Typhi
caugacgccaagcugcagaau

SEQ ID NO: 1695700 - RNA, 22 nt, Salmonella enterica enterica serovar Typhi
caugccggugcgagaaaaagca

SEQ ID NO: 1695701 - RNA, 15 nt, Salmonella enterica enterica serovar Typhi
caugccgccacuucg

SEQ ID NO: 1695702 - RNA, 21 nt, Salmonella enterica enterica serovar Typhi
caugccgccugccgcgccgcc

SEQ ID NO: 1695703 - RNA, 16 nt, Salmonella enterica enterica serovar Typhi
caugccugauggcgcu

SEQ ID NO: 1695704 - RNA, 21 nt, Salmonella enterica enterica serovar Typhi
caugccuuuauuucaagcaau

SEQ ID NO: 1695705 - RNA, 18 nt, Salmonella enterica enterica serovar Typhi
caugcgcagaaacugauc

SEQ ID NO: 1695706 - RNA, 18 nt, Salmonella enterica enterica serovar Typhi
caugcgacgugucgcgua

SEQ ID NO: 1695707 - RNA, 18 nt, Salmonella enterica enterica serovar Typhi
caugcgaucgggcaaucc

SEQ ID NO: 1695708 - RNA, 21 nt, Salmonella enterica enterica serovar Typhi
caugcgaucgggcaauccauu

SEQ ID NO: 1695709 - RNA, 22 nt, Salmonella enterica enterica serovar Typhi
caugccagcaguuuuucaaucu

SEQ ID NO: 1695710 - RNA, 13 nt, Salmonella enterica enterica serovar Typhi
caugccagaagca

SEQ ID NO: 1695711 - RNA, 16 nt, Salmonella enterica enterica serovar Typhi
caugccagaagcaaau

SEQ ID NO: 1695712 - RNA, 17 nt, Salmonella enterica enterica serovar Typhi
caugccagaagcaaauu

SEQ ID NO: 1695713 - RNA, 21 nt, Salmonella enterica enterica serovar Typhi
caugccagaagcaaauucagg

SEQ ID NO: 1695714 - RNA, 21 nt, Salmonella enterica enterica serovar Typhi
caugccauaaucgauauaauu

SEQ ID NO: 1695715 - RNA, 18 nt, Salmonella enterica enterica serovar Typhi
caugccauacuccugccu

SEQ ID NO: 1695716 - RNA, 16 nt, Salmonella enterica enterica serovar Typhi
caugccaucucuuaau

SEQ ID NO: 1695717 - RNA, 15 nt, Salmonella enterica enterica serovar Typhi
caugcccacaggcag

SEQ ID NO: 1695718 - RNA, 18 nt, Salmonella enterica enterica serovar Typhi
caugcccacaggcagggc

SEQ ID NO: 1695719 - RNA, 21 nt, Salmonella enterica enterica serovar Typhi
caugcccgucugggagccgcu

SEQ ID NO: 1695720 - RNA, 20 nt, Salmonella enterica enterica serovar Typhi
caugcccaguuuacccagcg

SEQ ID NO: 1695721 - RNA, 18 nt, Salmonella enterica enterica serovar Typhi
caugcccaguucaaucaa

SEQ ID NO: 1695722 - RNA, 20 nt, Salmonella enterica enterica serovar Typhi
caugcagccauagcgcgccg

SEQ ID NO: 1695723 - RNA, 15 nt, Salmonella enterica enterica serovar Typhi
caugcagcucaagcg

SEQ ID NO: 1695724 - RNA, 17 nt, Salmonella enterica enterica serovar Typhi
caugcauuaaugggcga

SEQ ID NO: 1695725 - RNA, 16 nt, Salmonella enterica enterica serovar Typhi
caugcaacuucaccuc

SEQ ID NO: 1695726 - RNA, 23 nt, Salmonella enterica enterica serovar Typhi
caugaucuuuccuuuuucaggca

SEQ ID NO: 1695727 - RNA, 13 nt, Salmonella enterica enterica serovar Typhi
caugaucuuuccu

SEQ ID NO: 1695728 - RNA, 16 nt, Salmonella enterica enterica serovar Typhi
caugaucgccgccauc

SEQ ID NO: 1695729 - RNA, 19 nt, Salmonella enterica enterica serovar Typhi
caugaucucuugcauaaua

SEQ ID NO: 1695730 - RNA, 19 nt, Salmonella enterica enterica serovar Typhi
caugauaguaucgcugcua

SEQ ID NO: 1695731 - RNA, 16 nt, Salmonella enterica enterica serovar Typhi
caugauuaaagccacg

SEQ ID NO: 1695732 - RNA, 23 nt, Salmonella enterica enterica serovar Typhi
caugaugccacgagaaauccaca

SEQ ID NO: 1695733 - RNA, 22 nt, Salmonella enterica enterica serovar Typhi
caugauucuugcggauuaucgu

SEQ ID NO: 1695734 - RNA, 20 nt, Salmonella enterica enterica serovar Typhi
caugauggcgaacagcccca

SEQ ID NO: 1695735 - RNA, 17 nt, Salmonella enterica enterica serovar Typhi
caugauggugaacagaa

SEQ ID NO: 1695736 - RNA, 16 nt, Salmonella enterica enterica serovar Typhi
caugauggcguaaucc

SEQ ID NO: 1695737 - RNA, 13 nt, Salmonella enterica enterica serovar Typhi
caugaugccaaau

SEQ ID NO: 1695738 - RNA, 13 nt, Salmonella enterica enterica serovar Typhi
caugaugaagaua

SEQ ID NO: 1695739 - RNA, 15 nt, Salmonella enterica enterica serovar Typhi
caugaugaucuucag

SEQ ID NO: 1695740 - RNA, 16 nt, Salmonella enterica enterica serovar Typhi
caugaugaucuucagc

SEQ ID NO: 1695741 - RNA, 17 nt, Salmonella enterica enterica serovar Typhi
cauggcgaagugcagcg

SEQ ID NO: 1695742 - RNA, 21 nt, Salmonella enterica enterica serovar Typhi
cauggccggucuuaugcugcc

SEQ ID NO: 1695743 - RNA, 23 nt, Salmonella enterica enterica serovar Typhi
caugcguccgcccagaaagauca

SEQ ID NO: 1695744 - RNA, 18 nt, Salmonella enterica enterica serovar Typhi
caugcgucuucauuuucg

SEQ ID NO: 1695745 - RNA, 15 nt, Salmonella enterica enterica serovar Typhi
caugcguuagauaua

SEQ ID NO: 1695746 - RNA, 13 nt, Salmonella enterica enterica serovar Typhi
caugcgcuggacu

SEQ ID NO: 1695747 - RNA, 19 nt, Salmonella enterica enterica serovar Typhi
caugcggugcaugaauauc

SEQ ID NO: 1695748 - RNA, 23 nt, Salmonella enterica enterica serovar Typhi
caugcgggggaaucuuauuuucc

SEQ ID NO: 1695749 - RNA, 23 nt, Salmonella enterica enterica serovar Typhi
cauggggugaggcaucgcccugu

SEQ ID NO: 1695750 - RNA, 22 nt, Salmonella enterica enterica serovar Typhi
caugguuaaaaucacuaagacc

SEQ ID NO: 1695751 - RNA, 13 nt, Salmonella enterica enterica serovar Typhi
caugguugaaaaa

SEQ ID NO: 1695752 - RNA, 15 nt, Salmonella enterica enterica serovar Typhi
caugguugacuuaca

SEQ ID NO: 1695753 - RNA, 22 nt, Salmonella enterica enterica serovar Typhi
caugguugacuuacaaaaaaua

SEQ ID NO: 1695754 - RNA, 17 nt, Salmonella enterica enterica serovar Typhi
cauguaaauaaggcugc

SEQ ID NO: 1695755 - RNA, 21 nt, Salmonella enterica enterica serovar Typhi
cauguaaaugacgccagacua

SEQ ID NO: 1695756 - RNA, 20 nt, Salmonella enterica enterica serovar Typhi
caugggcagcuugccgccaa

SEQ ID NO: 1695757 - RNA, 20 nt, Salmonella enterica enterica serovar Typhi
caugggcgcggcgaacuggu

SEQ ID NO: 1695758 - RNA, 20 nt, Salmonella enterica enterica serovar Typhi
cauggcgcauuaucgauuug

SEQ ID NO: 1695759 - RNA, 13 nt, Salmonella enterica enterica serovar Typhi
cauggcgccacca

SEQ ID NO: 1695760 - RNA, 15 nt, Salmonella enterica enterica serovar Typhi
cauggcgccaccagc

SEQ ID NO: 1695761 - RNA, 21 nt, Salmonella enterica enterica serovar Typhi
cauguucaugaaccacgccaa

SEQ ID NO: 1695762 - RNA, 22 nt, Salmonella enterica enterica serovar Typhi
caugucagcgcaaagccaauac

SEQ ID NO: 1695763 - RNA, 17 nt, Salmonella enterica enterica serovar Typhi
cauguugcguaaauaaa

SEQ ID NO: 1695764 - RNA, 18 nt, Salmonella enterica enterica serovar Typhi
cauguugcguaaauaaau

SEQ ID NO: 1695765 - RNA, 23 nt, Salmonella enterica enterica serovar Typhi
cauguugaucguaaaaugaaaaa

SEQ ID NO: 1695766 - RNA, 17 nt, Salmonella enterica enterica serovar Typhi
cauguuccgccccgccu

SEQ ID NO: 1695767 - RNA, 15 nt, Salmonella enterica enterica serovar Typhi
cauguuuccccuucu

SEQ ID NO: 1695768 - RNA, 17 nt, Salmonella enterica enterica serovar Typhi
cauguuuccccuucugg

SEQ ID NO: 1695769 - RNA, 19 nt, Salmonella enterica enterica serovar Typhi
cauuaaaugcgcccagccc

SEQ ID NO: 1695770 - RNA, 15 nt, Salmonella enterica enterica serovar Typhi
cauuaaaaaaacaug

SEQ ID NO: 1695771 - RNA, 19 nt, Salmonella enterica enterica serovar Typhi
cauguuuuuuaauugugau

SEQ ID NO: 1695772 - RNA, 10 nt, Salmonella enterica enterica serovar Typhi
cauuaaaaaa

SEQ ID NO: 1695773 - RNA, 12 nt, Salmonella enterica enterica serovar Typhi
cauuaaaaaaac

SEQ ID NO: 1695774 - RNA, 15 nt, Salmonella enterica enterica serovar Typhi
cauuaacccggcccc

SEQ ID NO: 1695775 - RNA, 17 nt, Salmonella enterica enterica serovar Typhi
cauuaacccggccccga

SEQ ID NO: 1695776 - RNA, 13 nt, Salmonella enterica enterica serovar Typhi
cauuaacguccau

SEQ ID NO: 1695777 - RNA, 20 nt, Salmonella enterica enterica serovar Typhi
cauuaacuccggacguaccc

SEQ ID NO: 1695778 - RNA, 23 nt, Salmonella enterica enterica serovar Typhi
cauuaacgaggcgcuugcuaccc

SEQ ID NO: 1695779 - RNA, 18 nt, Salmonella enterica enterica serovar Typhi
cauuacaauguacagaau

SEQ ID NO: 1695780 - RNA, 17 nt, Salmonella enterica enterica serovar Typhi
cauuacaggcaucuucc

SEQ ID NO: 1695781 - RNA, 17 nt, Salmonella enterica enterica serovar Typhi
cauuauauagucuuaau

SEQ ID NO: 1695782 - RNA, 16 nt, Salmonella enterica enterica serovar Typhi
cauuaaucuauuuaau

SEQ ID NO: 1695783 - RNA, 20 nt, Salmonella enterica enterica serovar Typhi
cauuauuaaauuaacaccca

SEQ ID NO: 1695784 - RNA, 17 nt, Salmonella enterica enterica serovar Typhi
cauuauguuuugaacau

SEQ ID NO: 1695785 - RNA, 15 nt, Salmonella enterica enterica serovar Typhi
cauucacacuccagg

SEQ ID NO: 1695786 - RNA, 15 nt, Salmonella enterica enterica serovar Typhi
cauucacgccaccau

SEQ ID NO: 1695787 - RNA, 20 nt, Salmonella enterica enterica serovar Typhi
cauucacccaauaaauaaua

SEQ ID NO: 1695788 - RNA, 17 nt, Salmonella enterica enterica serovar Typhi
cauuauugaucucuuca

SEQ ID NO: 1695789 - RNA, 15 nt, Salmonella enterica enterica serovar Typhi
cauuauugcaucaau

SEQ ID NO: 1695790 - RNA, 13 nt, Salmonella enterica enterica serovar Typhi
cauuauuccccuc

SEQ ID NO: 1695791 - RNA, 16 nt, Salmonella enterica enterica serovar Typhi
cauucauugccgccag

SEQ ID NO: 1695792 - RNA, 17 nt, Salmonella enterica enterica serovar Typhi
cauucagcaacugcgua

SEQ ID NO: 1695793 - RNA, 12 nt, Salmonella enterica enterica serovar Typhi
cauuccagaccc

SEQ ID NO: 1695794 - RNA, 12 nt, Salmonella enterica enterica serovar Typhi
cauuccagaccu

SEQ ID NO: 1695795 - RNA, 12 nt, Salmonella enterica enterica serovar Typhi
cauuccagccgg

SEQ ID NO: 1695796 - RNA, 14 nt, Salmonella enterica enterica serovar Typhi
cauugacucaugaa

SEQ ID NO: 1695797 - RNA, 17 nt, Salmonella enterica enterica serovar Typhi
cauugaccggaaaaaaa

SEQ ID NO: 1695798 - RNA, 15 nt, Salmonella enterica enterica serovar Typhi
cauugagcauucuac

SEQ ID NO: 1695799 - RNA, 23 nt, Salmonella enterica enterica serovar Typhi
cauucugauuuuacuaaugaauu

SEQ ID NO: 1695800 - RNA, 23 nt, Salmonella enterica enterica serovar Typhi
cauucuuugcuuuguaaagcgcc

SEQ ID NO: 1695801 - RNA, 19 nt, Salmonella enterica enterica serovar Typhi
cauucuuuaaaaugacuca

SEQ ID NO: 1695802 - RNA, 18 nt, Salmonella enterica enterica serovar Typhi
cauucccgccaauaacca

SEQ ID NO: 1695803 - RNA, 13 nt, Salmonella enterica enterica serovar Typhi
cauuccccacgcc

SEQ ID NO: 1695804 - RNA, 17 nt, Salmonella enterica enterica serovar Typhi
cauucccagccgagcgg

SEQ ID NO: 1695805 - RNA, 15 nt, Salmonella enterica enterica serovar Typhi
cauucugcugaugcu

SEQ ID NO: 1695806 - RNA, 20 nt, Salmonella enterica enterica serovar Typhi
cauucugggaggugaaggau

SEQ ID NO: 1695807 - RNA, 18 nt, Salmonella enterica enterica serovar Typhi
cauucugacggcccuuuu

SEQ ID NO: 1695808 - RNA, 15 nt, Salmonella enterica enterica serovar Typhi
cauucucuugccugc

SEQ ID NO: 1695809 - RNA, 20 nt, Salmonella enterica enterica serovar Typhi
cauucucuucuaccacgcug

SEQ ID NO: 1695810 - RNA, 22 nt, Salmonella enterica enterica serovar Typhi
ccugcaggguuugcgcagacug

SEQ ID NO: 1695811 - RNA, 15 nt, Salmonella enterica enterica serovar Typhi
ccugcaggguaauua

SEQ ID NO: 1695812 - RNA, 22 nt, Salmonella enterica enterica serovar Typhi
ccugcagggaauaagcgcccau

SEQ ID NO: 1695813 - RNA, 12 nt, Salmonella enterica enterica serovar Typhi
ccugcagggaau

SEQ ID NO: 1695814 - RNA, 17 nt, Salmonella enterica enterica serovar Typhi
ccugcaggcgagugcua

SEQ ID NO: 1695815 - RNA, 12 nt, Salmonella enterica enterica serovar Typhi
ccugcacccgcc

SEQ ID NO: 1695816 - RNA, 16 nt, Salmonella enterica enterica serovar Typhi
ccugccauucccagcc

SEQ ID NO: 1695817 - RNA, 20 nt, Salmonella enterica enterica serovar Typhi
ccugccauucccagccgagc

SEQ ID NO: 1695818 - RNA, 19 nt, Salmonella enterica enterica serovar Typhi
ccugcccacuuugccauga

SEQ ID NO: 1695819 - RNA, 15 nt, Salmonella enterica enterica serovar Typhi
ccugcccuuucuuca

SEQ ID NO: 1695820 - RNA, 19 nt, Salmonella enterica enterica serovar Typhi
ccugccgauacguccccau

SEQ ID NO: 1695821 - RNA, 16 nt, Salmonella enterica enterica serovar Typhi
ccugccaguccgcccg

SEQ ID NO: 1695822 - RNA, 18 nt, Salmonella enterica enterica serovar Typhi
ccugccauagcaucacca

SEQ ID NO: 1695823 - RNA, 14 nt, Salmonella enterica enterica serovar Typhi
ccugccagauaguu

SEQ ID NO: 1695824 - RNA, 23 nt, Salmonella enterica enterica serovar Typhi
ccugcauacucacauucauaaaa

SEQ ID NO: 1695825 - RNA, 18 nt, Salmonella enterica enterica serovar Typhi
ccugccuuucccauccgc

SEQ ID NO: 1695826 - RNA, 10 nt, Salmonella enterica enterica serovar Typhi
ccugccuguu

SEQ ID NO: 1695827 - RNA, 21 nt, Salmonella enterica enterica serovar Typhi
ccugccuuaauccccggcccg

SEQ ID NO: 1695828 - RNA, 15 nt, Salmonella enterica enterica serovar Typhi
ccugccguuuuuaac

SEQ ID NO: 1695829 - RNA, 18 nt, Salmonella enterica enterica serovar Typhi
ccugccuaagccggacgc

SEQ ID NO: 1695830 - RNA, 14 nt, Salmonella enterica enterica serovar Typhi
ccugcucaaucgca

SEQ ID NO: 1695831 - RNA, 18 nt, Salmonella enterica enterica serovar Typhi
ccugcggguucaucgcca

SEQ ID NO: 1695832 - RNA, 20 nt, Salmonella enterica enterica serovar Typhi
ccugcgguaaucgccgcgac

SEQ ID NO: 1695833 - RNA, 19 nt, Salmonella enterica enterica serovar Typhi
ccugcggccuugccgccag

SEQ ID NO: 1695834 - RNA, 13 nt, Salmonella enterica enterica serovar Typhi
ccugcggccccag

SEQ ID NO: 1695835 - RNA, 20 nt, Salmonella enterica enterica serovar Typhi
ccugcggccaugaucgccgc

SEQ ID NO: 1695836 - RNA, 17 nt, Salmonella enterica enterica serovar Typhi
ccugcggcgcgcccggc

SEQ ID NO: 1695837 - RNA, 11 nt, Salmonella enterica enterica serovar Typhi
ccugcucaugc

SEQ ID NO: 1695838 - RNA, 12 nt, Salmonella enterica enterica serovar Typhi
ccugcucccaga

SEQ ID NO: 1695839 - RNA, 13 nt, Salmonella enterica enterica serovar Typhi
ccugcugcgccag

SEQ ID NO: 1695840 - RNA, 19 nt, Salmonella enterica enterica serovar Typhi
ccugcuggucgccgcccau

SEQ ID NO: 1695841 - RNA, 15 nt, Salmonella enterica enterica serovar Typhi
ccugcuguaaccccu

SEQ ID NO: 1695842 - RNA, 21 nt, Salmonella enterica enterica serovar Typhi
ccugcuggucugaaucugcuc

SEQ ID NO: 1695843 - RNA, 16 nt, Salmonella enterica enterica serovar Typhi
ccugcuggcaaaacgc

SEQ ID NO: 1695844 - RNA, 16 nt, Salmonella enterica enterica serovar Typhi
ccugcuggcgcaugau

SEQ ID NO: 1695845 - RNA, 13 nt, Salmonella enterica enterica serovar Typhi
ccugcugugacau

SEQ ID NO: 1695846 - RNA, 15 nt, Salmonella enterica enterica serovar Typhi
ccugcuguacuuuug

SEQ ID NO: 1695847 - RNA, 16 nt, Salmonella enterica enterica serovar Typhi
ccugcuguaaccccug

SEQ ID NO: 1695848 - RNA, 17 nt, Salmonella enterica enterica serovar Typhi
ccugcuguaaccccugc

SEQ ID NO: 1695849 - RNA, 22 nt, Salmonella enterica enterica serovar Typhi
ccuggaauagcgugggcagacc

SEQ ID NO: 1695850 - RNA, 23 nt, Salmonella enterica enterica serovar Typhi
ccuggaaaaaagcgcccagcgcc

SEQ ID NO: 1695851 - RNA, 11 nt, Salmonella enterica enterica serovar Typhi
ccugcuucaga

SEQ ID NO: 1695852 - RNA, 18 nt, Salmonella enterica enterica serovar Typhi
ccugcuugucgaucauca

SEQ ID NO: 1695853 - RNA, 15 nt, Salmonella enterica enterica serovar Typhi
ccuggaggaacagcg

SEQ ID NO: 1695854 - RNA, 17 nt, Salmonella enterica enterica serovar Typhi
ccuggagcguaagcgcg

SEQ ID NO: 1695855 - RNA, 22 nt, Salmonella enterica enterica serovar Typhi
ccuggagagcagcgccagcgac

SEQ ID NO: 1695856 - RNA, 18 nt, Salmonella enterica enterica serovar Typhi
ccuggauaauaagacgcc

SEQ ID NO: 1695857 - RNA, 14 nt, Salmonella enterica enterica serovar Typhi
ccuggaugcuuaaa

SEQ ID NO: 1695858 - RNA, 19 nt, Salmonella enterica enterica serovar Typhi
ccuggaugcuuaaaauccc

SEQ ID NO: 1695859 - RNA, 22 nt, Salmonella enterica enterica serovar Typhi
ccuggcacuucgcgccauugau

SEQ ID NO: 1695860 - RNA, 13 nt, Salmonella enterica enterica serovar Typhi
ccuggcagaaagg

SEQ ID NO: 1695861 - RNA, 17 nt, Salmonella enterica enterica serovar Typhi
ccuggcagaaaggugaa

SEQ ID NO: 1695862 - RNA, 16 nt, Salmonella enterica enterica serovar Typhi
ccuggcagguauuaau

SEQ ID NO: 1695863 - RNA, 13 nt, Salmonella enterica enterica serovar Typhi
ccuggcauggcuc

SEQ ID NO: 1695864 - RNA, 22 nt, Salmonella enterica enterica serovar Typhi
ccuggcauggugcagccgccau

SEQ ID NO: 1695865 - RNA, 14 nt, Salmonella enterica enterica serovar Typhi
ccuggccaggcuuc

SEQ ID NO: 1695866 - RNA, 17 nt, Salmonella enterica enterica serovar Typhi
ccuggcccugcaucagc

SEQ ID NO: 1695867 - RNA, 19 nt, Salmonella enterica enterica serovar Typhi
ccuggcccggcaguugcug

SEQ ID NO: 1695868 - RNA, 18 nt, Salmonella enterica enterica serovar Typhi
ccuggccgauaugaauaa

SEQ ID NO: 1695869 - RNA, 14 nt, Salmonella enterica enterica serovar Typhi
ccuggcgaauaaaa

SEQ ID NO: 1695870 - RNA, 19 nt, Salmonella enterica enterica serovar Typhi
ccuggcgguaagccaccag

SEQ ID NO: 1695871 - RNA, 17 nt, Salmonella enterica enterica serovar Typhi
ccuggcggagcugcgcu

SEQ ID NO: 1695872 - RNA, 19 nt, Salmonella enterica enterica serovar Typhi
ccuggcgggaaacagguac

SEQ ID NO: 1695873 - RNA, 14 nt, Salmonella enterica enterica serovar Typhi
ccuggcgcagcgcg

SEQ ID NO: 1695874 - RNA, 15 nt, Salmonella enterica enterica serovar Typhi
ccuggcucaauccag

SEQ ID NO: 1695875 - RNA, 21 nt, Salmonella enterica enterica serovar Typhi
ccuggcguaguacgcgcgccg

SEQ ID NO: 1695876 - RNA, 20 nt, Salmonella enterica enterica serovar Typhi
ccuggcgugucaucaaaauc

SEQ ID NO: 1695877 - RNA, 13 nt, Salmonella enterica enterica serovar Typhi
ccuggcucuuccg

SEQ ID NO: 1695878 - RNA, 20 nt, Salmonella enterica enterica serovar Typhi
ccuggcugucggcagaaccu

SEQ ID NO: 1695879 - RNA, 20 nt, Salmonella enterica enterica serovar Typhi
ccuggcuucaaccuccugca

SEQ ID NO: 1695880 - RNA, 19 nt, Salmonella enterica enterica serovar Typhi
ccuggcuuaccugcucugg

SEQ ID NO: 1695881 - RNA, 19 nt, Salmonella enterica enterica serovar Typhi
ccuggcuucaaccuccugc

SEQ ID NO: 1695882 - RNA, 19 nt, Salmonella enterica enterica serovar Typhi
ccugggcgaaaacgcccgc

SEQ ID NO: 1695883 - RNA, 16 nt, Salmonella enterica enterica serovar Typhi
ccuggcuugccggcac

SEQ ID NO: 1695884 - RNA, 22 nt, Salmonella enterica enterica serovar Typhi
ccugggucguugacgugagaga

SEQ ID NO: 1695885 - RNA, 13 nt, Salmonella enterica enterica serovar Typhi
ccuggucugccag

SEQ ID NO: 1695886 - RNA, 18 nt, Salmonella enterica enterica serovar Typhi
ccuggucuauucguucuc

SEQ ID NO: 1695887 - RNA, 20 nt, Salmonella enterica enterica serovar Typhi
ccuggucuauucguucucug

SEQ ID NO: 1695888 - RNA, 20 nt, Salmonella enterica enterica serovar Typhi
ccugguuauuagaugcgaau

SEQ ID NO: 1695889 - RNA, 18 nt, Salmonella enterica enterica serovar Typhi
ccuucacgcagugcgcga

SEQ ID NO: 1695890 - RNA, 14 nt, Salmonella enterica enterica serovar Typhi
ccuucacgccgcca

SEQ ID NO: 1695891 - RNA, 22 nt, Salmonella enterica enterica serovar Typhi
ccuucagauucaaacugauaag

SEQ ID NO: 1695892 - RNA, 23 nt, Salmonella enterica enterica serovar Typhi
ccuucacauuggcaaaccccugc

SEQ ID NO: 1695893 - RNA, 23 nt, Salmonella enterica enterica serovar Typhi
ccuuauucgcuagcgugccauua

SEQ ID NO: 1695894 - RNA, 22 nt, Salmonella enterica enterica serovar Typhi
ccuucaaucacaaaauggcuga

SEQ ID NO: 1695895 - RNA, 17 nt, Salmonella enterica enterica serovar Typhi
ccuucaaauauauugaa

SEQ ID NO: 1695896 - RNA, 20 nt, Salmonella enterica enterica serovar Typhi
ccuucaaauauauugaaaag

SEQ ID NO: 1695897 - RNA, 13 nt, Salmonella enterica enterica serovar Typhi
ccuuauuuuucag

SEQ ID NO: 1695898 - RNA, 17 nt, Salmonella enterica enterica serovar Typhi
ccuuaccgucagccacu

SEQ ID NO: 1695899 - RNA, 20 nt, Salmonella enterica enterica serovar Typhi
ccuuacgcucgcugauggcg

SEQ ID NO: 1695900 - RNA, 20 nt, Salmonella enterica enterica serovar Typhi
ccuuacaggcgcaucagaaa

SEQ ID NO: 1695901 - RNA, 18 nt, Salmonella enterica enterica serovar Typhi
ccuuacccgaccuacauc

SEQ ID NO: 1695902 - RNA, 14 nt, Salmonella enterica enterica serovar Typhi
ccuuacccggccug

SEQ ID NO: 1695903 - RNA, 14 nt, Salmonella enterica enterica serovar Typhi
ccuuaugucauuca

SEQ ID NO: 1695904 - RNA, 18 nt, Salmonella enterica enterica serovar Typhi
ccuuauucccauuccugc

SEQ ID NO: 1695905 - RNA, 18 nt, Salmonella enterica enterica serovar Typhi
ccuuaucggagucuuauc

SEQ ID NO: 1695906 - RNA, 22 nt, Salmonella enterica enterica serovar Typhi
ccuuaucgagugucaauaagcc

SEQ ID NO: 1695907 - RNA, 15 nt, Salmonella enterica enterica serovar Typhi
ccuguaccaccacgc

SEQ ID NO: 1695908 - RNA, 19 nt, Salmonella enterica enterica serovar Typhi
ccuguaaugucuggugcag

SEQ ID NO: 1695909 - RNA, 17 nt, Salmonella enterica enterica serovar Typhi
ccuguacuugcgccgcc

SEQ ID NO: 1695910 - RNA, 24 nt, Salmonella enterica enterica serovar Typhi
ccuuaauuugugauugcagauaau

SEQ ID NO: 1695911 - RNA, 14 nt, Salmonella enterica enterica serovar Typhi
ccuucgccuucacg

SEQ ID NO: 1695912 - RNA, 19 nt, Salmonella enterica enterica serovar Typhi
ccuucgcggugaucccagg

SEQ ID NO: 1695913 - RNA, 19 nt, Salmonella enterica enterica serovar Typhi
ccuucuguaagcaauuaau

SEQ ID NO: 1695914 - RNA, 21 nt, Salmonella enterica enterica serovar Typhi
ccuucuguaagcaauuaauau

SEQ ID NO: 1695915 - RNA, 19 nt, Salmonella enterica enterica serovar Typhi
ccuucuuccgucaccguau

SEQ ID NO: 1695916 - RNA, 14 nt, Salmonella enterica enterica serovar Typhi
ccuucuucgccaac

SEQ ID NO: 1695917 - RNA, 18 nt, Salmonella enterica enterica serovar Typhi
ccuucuucaucuucaccu

SEQ ID NO: 1695918 - RNA, 15 nt, Salmonella enterica enterica serovar Typhi
ccuucuucacccacu

SEQ ID NO: 1695919 - RNA, 18 nt, Salmonella enterica enterica serovar Typhi
ccuucuugcucaaaaagc

SEQ ID NO: 1695920 - RNA, 21 nt, Salmonella enterica enterica serovar Typhi
ccuucuuuggugcgacgccag

SEQ ID NO: 1695921 - RNA, 13 nt, Salmonella enterica enterica serovar Typhi
ccuucuuuggcuu

SEQ ID NO: 1695922 - RNA, 16 nt, Salmonella enterica enterica serovar Typhi
ccuucuuuggcuuaau

SEQ ID NO: 1695923 - RNA, 16 nt, Salmonella enterica enterica serovar Typhi
ccuuccuggucugcca

SEQ ID NO: 1695924 - RNA, 14 nt, Salmonella enterica enterica serovar Typhi
ccuucgaacagcuc

SEQ ID NO: 1695925 - RNA, 13 nt, Salmonella enterica enterica serovar Typhi
ccuucgccgccca

SEQ ID NO: 1695926 - RNA, 12 nt, Salmonella enterica enterica serovar Typhi
ccuucgccgccg

SEQ ID NO: 1695927 - RNA, 14 nt, Salmonella enterica enterica serovar Typhi
ccuucgccgccgcu

SEQ ID NO: 1695928 - RNA, 20 nt, Salmonella enterica enterica serovar Typhi
ccuucgaugagcgcgaaauc

SEQ ID NO: 1695929 - RNA, 13 nt, Salmonella enterica enterica serovar Typhi
ccuucaggcauca

SEQ ID NO: 1695930 - RNA, 20 nt, Salmonella enterica enterica serovar Typhi
ccuucagaaaauuauuuuca

SEQ ID NO: 1695931 - RNA, 20 nt, Salmonella enterica enterica serovar Typhi
ccuuccucgucggcaagaau

SEQ ID NO: 1695932 - RNA, 22 nt, Salmonella enterica enterica serovar Typhi
ccuuuggccuggagaucagcau

SEQ ID NO: 1695933 - RNA, 22 nt, Salmonella enterica enterica serovar Typhi
ccuuugucgaaauugccgcccg

SEQ ID NO: 1695934 - RNA, 21 nt, Salmonella enterica enterica serovar Typhi
ccuuugucacccgcuuuuccu

SEQ ID NO: 1695935 - RNA, 12 nt, Salmonella enterica enterica serovar Typhi
ccuuugccuuuc

SEQ ID NO: 1695936 - RNA, 23 nt, Salmonella enterica enterica serovar Typhi
ccuuugcgaauggccuccagcag

SEQ ID NO: 1695937 - RNA, 21 nt, Salmonella enterica enterica serovar Typhi
ccuuugcgcgcgauauccacc

SEQ ID NO: 1695938 - RNA, 24 nt, Salmonella enterica enterica serovar Typhi
ccuuugcgcgcgauauccaccuga

SEQ ID NO: 1695939 - RNA, 21 nt, Salmonella enterica enterica serovar Typhi
ccuuucguaguuggcaacccg

SEQ ID NO: 1695940 - RNA, 17 nt, Salmonella enterica enterica serovar Typhi
ccuuucggacuuccugu

SEQ ID NO: 1695941 - RNA, 23 nt, Salmonella enterica enterica serovar Typhi
ccuuuccuuauuaaagccccuuc

SEQ ID NO: 1695942 - RNA, 22 nt, Salmonella enterica enterica serovar Typhi
ccuuucauucgucaaauucacc

SEQ ID NO: 1695943 - RNA, 23 nt, Salmonella enterica enterica serovar Typhi
ccuuucagagcgucuuuuauccc

SEQ ID NO: 1695944 - RNA, 11 nt, Salmonella enterica enterica serovar Typhi
ccuuucauuuu

SEQ ID NO: 1695945 - RNA, 15 nt, Salmonella enterica enterica serovar Typhi
ccuuuacugcgccag

SEQ ID NO: 1695946 - RNA, 22 nt, Salmonella enterica enterica serovar Typhi
ccuuuacugaaucucagauaau

SEQ ID NO: 1695947 - RNA, 22 nt, Salmonella enterica enterica serovar Typhi
ccuuuauauuuuucccuggccg

SEQ ID NO: 1695948 - RNA, 19 nt, Salmonella enterica enterica serovar Typhi
ccuuuacuucuuugcgauu

SEQ ID NO: 1695949 - RNA, 19 nt, Salmonella enterica enterica serovar Typhi
ccuuucaacggauugugaa

SEQ ID NO: 1695950 - RNA, 13 nt, Salmonella enterica enterica serovar Typhi
ccuugugucacau

SEQ ID NO: 1695951 - RNA, 22 nt, Salmonella enterica enterica serovar Typhi
ccuuguucaauagagcgcagca

SEQ ID NO: 1695952 - RNA, 20 nt, Salmonella enterica enterica serovar Typhi
ccuuguuauccuaaaucugc

SEQ ID NO: 1695953 - RNA, 22 nt, Salmonella enterica enterica serovar Typhi
ccuuguugauaaaacgaauacu

SEQ ID NO: 1695954 - RNA, 14 nt, Salmonella enterica enterica serovar Typhi
ccuuguaggccuga

SEQ ID NO: 1695955 - RNA, 22 nt, Salmonella enterica enterica serovar Typhi
ccuuguccauguaaacuccauu

SEQ ID NO: 1695956 - RNA, 16 nt, Salmonella enterica enterica serovar Typhi
ccuugcgguugcagca

SEQ ID NO: 1695957 - RNA, 16 nt, Salmonella enterica enterica serovar Typhi
ccuugcggugagaaac

SEQ ID NO: 1695958 - RNA, 15 nt, Salmonella enterica enterica serovar Typhi
ccuugcggugcagca

SEQ ID NO: 1695959 - RNA, 18 nt, Salmonella enterica enterica serovar Typhi
ccuugcggugcagcagac

SEQ ID NO: 1695960 - RNA, 14 nt, Salmonella enterica enterica serovar Typhi
cgacggcgcagaca

SEQ ID NO: 1695961 - RNA, 19 nt, Salmonella enterica enterica serovar Typhi
cgacgguaauaccaaccgc

SEQ ID NO: 1695962 - RNA, 20 nt, Salmonella enterica enterica serovar Typhi
cgacggugaugacccgcagc

SEQ ID NO: 1695963 - RNA, 20 nt, Salmonella enterica enterica serovar Typhi
cgacgggaaaaagcgcgccc

SEQ ID NO: 1695964 - RNA, 16 nt, Salmonella enterica enterica serovar Typhi
cgacgcuuaucagccc

SEQ ID NO: 1695965 - RNA, 13 nt, Salmonella enterica enterica serovar Typhi
cgacgcugccaca

SEQ ID NO: 1695966 - RNA, 14 nt, Salmonella enterica enterica serovar Typhi
cgacgcguuuucca

SEQ ID NO: 1695967 - RNA, 12 nt, Salmonella enterica enterica serovar Typhi
cgacgcucauua

SEQ ID NO: 1695968 - RNA, 17 nt, Salmonella enterica enterica serovar Typhi
cgacgcucuuccucaau

SEQ ID NO: 1695969 - RNA, 16 nt, Salmonella enterica enterica serovar Typhi
cgacgcgccaccaucg

SEQ ID NO: 1695970 - RNA, 17 nt, Salmonella enterica enterica serovar Typhi
cgacgcggcuccggcuu

SEQ ID NO: 1695971 - RNA, 18 nt, Salmonella enterica enterica serovar Typhi
cgacgccgucucuuuuug

SEQ ID NO: 1695972 - RNA, 12 nt, Salmonella enterica enterica serovar Typhi
cgacgccugcau

SEQ ID NO: 1695973 - RNA, 22 nt, Salmonella enterica enterica serovar Typhi
cgacgccgccgacacaguaaaa

SEQ ID NO: 1695974 - RNA, 19 nt, Salmonella enterica enterica serovar Typhi
cgacgauacaacucaucca

SEQ ID NO: 1695975 - RNA, 15 nt, Salmonella enterica enterica serovar Typhi
cgacgaucagcgcca

SEQ ID NO: 1695976 - RNA, 19 nt, Salmonella enterica enterica serovar Typhi
cgacgauaaaaaaaguauc

SEQ ID NO: 1695977 - RNA, 14 nt, Salmonella enterica enterica serovar Typhi
cgacgcacuccaga

SEQ ID NO: 1695978 - RNA, 17 nt, Salmonella enterica enterica serovar Typhi
cgacgccauuccccagc

SEQ ID NO: 1695979 - RNA, 15 nt, Salmonella enterica enterica serovar Typhi
cgacgcacuccagau

SEQ ID NO: 1695980 - RNA, 20 nt, Salmonella enterica enterica serovar Typhi
cgacgccaaucggcgucuug

SEQ ID NO: 1695981 - RNA, 14 nt, Salmonella enterica enterica serovar Typhi
cgacgccaaaccug

SEQ ID NO: 1695982 - RNA, 13 nt, Salmonella enterica enterica serovar Typhi
cgacgccaaccgc

SEQ ID NO: 1695983 - RNA, 17 nt, Salmonella enterica enterica serovar Typhi
cgaccuucacgccgcca

SEQ ID NO: 1695984 - RNA, 16 nt, Salmonella enterica enterica serovar Typhi
cgaccuggcgcucaau

SEQ ID NO: 1695985 - RNA, 11 nt, Salmonella enterica enterica serovar Typhi
cgaccuucucc

SEQ ID NO: 1695986 - RNA, 13 nt, Salmonella enterica enterica serovar Typhi
cgaccaauauccg

SEQ ID NO: 1695987 - RNA, 19 nt, Salmonella enterica enterica serovar Typhi
cgaccaaacaagaucgcag

SEQ ID NO: 1695988 - RNA, 23 nt, Salmonella enterica enterica serovar Typhi
cgacauucgauguuacugagcaa

SEQ ID NO: 1695989 - RNA, 16 nt, Salmonella enterica enterica serovar Typhi
cgacauggcugagaau

SEQ ID NO: 1695990 - RNA, 15 nt, Salmonella enterica enterica serovar Typhi
cgacaucucaggcaa

SEQ ID NO: 1695991 - RNA, 21 nt, Salmonella enterica enterica serovar Typhi
cgacaucucaggcaagacaca

SEQ ID NO: 1695992 - RNA, 17 nt, Salmonella enterica enterica serovar Typhi
cgaccacgccaccgccg

SEQ ID NO: 1695993 - RNA, 16 nt, Salmonella enterica enterica serovar Typhi
cgaccaggaucagacc

SEQ ID NO: 1695994 - RNA, 12 nt, Salmonella enterica enterica serovar Typhi
cgaccaucgccg

SEQ ID NO: 1695995 - RNA, 21 nt, Salmonella enterica enterica serovar Typhi
cgaccacuucaacgccgcgcu

SEQ ID NO: 1695996 - RNA, 22 nt, Salmonella enterica enterica serovar Typhi
cgaccacuucaacgccgcgcuu

SEQ ID NO: 1695997 - RNA, 16 nt, Salmonella enterica enterica serovar Typhi
cgaccagcagaugcag

SEQ ID NO: 1695998 - RNA, 13 nt, Salmonella enterica enterica serovar Typhi
cgaccagcgcgcc

SEQ ID NO: 1695999 - RNA, 13 nt, Salmonella enterica enterica serovar Typhi
cgaccagccugcc

SEQ ID NO: 1696000 - RNA, 13 nt, Salmonella enterica enterica serovar Typhi
cgaccaggaucag

SEQ ID NO: 1696001 - RNA, 16 nt, Salmonella enterica enterica serovar Typhi
cgacccgcaucagacc

SEQ ID NO: 1696002 - RNA, 20 nt, Salmonella enterica enterica serovar Typhi
cgaccccuucgcccucgcca

SEQ ID NO: 1696003 - RNA, 15 nt, Salmonella enterica enterica serovar Typhi
cgacccaucaauaac

SEQ ID NO: 1696004 - RNA, 19 nt, Salmonella enterica enterica serovar Typhi
cgacccauaacgggaagcc

SEQ ID NO: 1696005 - RNA, 19 nt, Salmonella enterica enterica serovar Typhi
cgaccgcaggcucuuuuuc

SEQ ID NO: 1696006 - RNA, 11 nt, Salmonella enterica enterica serovar Typhi
cgaccgccaua

SEQ ID NO: 1696007 - RNA, 15 nt, Salmonella enterica enterica serovar Typhi
cgaccgccagcagag

SEQ ID NO: 1696008 - RNA, 11 nt, Salmonella enterica enterica serovar Typhi
cgaccggcucg

SEQ ID NO: 1696009 - RNA, 22 nt, Salmonella enterica enterica serovar Typhi
cgaccggcucgcuguucgccag

SEQ ID NO: 1696010 - RNA, 16 nt, Salmonella enterica enterica serovar Typhi
cgaccgugauuuuuac

SEQ ID NO: 1696011 - RNA, 22 nt, Salmonella enterica enterica serovar Typhi
cgaccguuagcgacggcgcgcc

SEQ ID NO: 1696012 - RNA, 13 nt, Salmonella enterica enterica serovar Typhi
cgaccggcagccg

SEQ ID NO: 1696013 - RNA, 23 nt, Salmonella enterica enterica serovar Typhi
cgaccggcaaaaagaaucgccag

SEQ ID NO: 1696014 - RNA, 21 nt, Salmonella enterica enterica serovar Typhi
cgaccgcgccacggccaacgc

SEQ ID NO: 1696015 - RNA, 19 nt, Salmonella enterica enterica serovar Typhi
cgaagcgucauccggcaau

SEQ ID NO: 1696016 - RNA, 20 nt, Salmonella enterica enterica serovar Typhi
cgaagccaccggauugccuu

SEQ ID NO: 1696017 - RNA, 20 nt, Salmonella enterica enterica serovar Typhi
cgaacuucgcgguugcgccc

SEQ ID NO: 1696018 - RNA, 24 nt, Salmonella enterica enterica serovar Typhi
cgaacugucugaaucagugcaucu

SEQ ID NO: 1696019 - RNA, 23 nt, Salmonella enterica enterica serovar Typhi
cgaacuuacgacgcgccaccauc

SEQ ID NO: 1696020 - RNA, 22 nt, Salmonella enterica enterica serovar Typhi
cgaacugauggcgcuaagccag

SEQ ID NO: 1696021 - RNA, 15 nt, Salmonella enterica enterica serovar Typhi
cgaaccguggccucc

SEQ ID NO: 1696022 - RNA, 19 nt, Salmonella enterica enterica serovar Typhi
ccuuuuucauccucaacca

SEQ ID NO: 1696023 - RNA, 19 nt, Salmonella enterica enterica serovar Typhi
ccuuuuuauggcccgccag

SEQ ID NO: 1696024 - RNA, 20 nt, Salmonella enterica enterica serovar Typhi
ccuuuuuauggcccgccagc

SEQ ID NO: 1696025 - RNA, 17 nt, Salmonella enterica enterica serovar Typhi
cgaacgcaucaaagcca

SEQ ID NO: 1696026 - RNA, 14 nt, Salmonella enterica enterica serovar Typhi
cgaacuccagcgcg

SEQ ID NO: 1696027 - RNA, 12 nt, Salmonella enterica enterica serovar Typhi
cgaacuccccga

SEQ ID NO: 1696028 - RNA, 16 nt, Salmonella enterica enterica serovar Typhi
cgaacguuggcugggu

SEQ ID NO: 1696029 - RNA, 17 nt, Salmonella enterica enterica serovar Typhi
cgaaucauguuuuucuc

SEQ ID NO: 1696030 - RNA, 15 nt, Salmonella enterica enterica serovar Typhi
cgaauaacauaauau

SEQ ID NO: 1696031 - RNA, 15 nt, Salmonella enterica enterica serovar Typhi
cgaauaucuuugucc

SEQ ID NO: 1696032 - RNA, 16 nt, Salmonella enterica enterica serovar Typhi
cgaauccuccuguuga

SEQ ID NO: 1696033 - RNA, 17 nt, Salmonella enterica enterica serovar Typhi
cgaaucgccgcuuuuuc

SEQ ID NO: 1696034 - RNA, 16 nt, Salmonella enterica enterica serovar Typhi
cgaaugcugcaucuua

SEQ ID NO: 1696035 - RNA, 16 nt, Salmonella enterica enterica serovar Typhi
cgaaugugcuuaucac

SEQ ID NO: 1696036 - RNA, 22 nt, Salmonella enterica enterica serovar Typhi
cgacagggcgugaaccagcauc

SEQ ID NO: 1696037 - RNA, 21 nt, Salmonella enterica enterica serovar Typhi
cgacaggguuugccagcacca

SEQ ID NO: 1696038 - RNA, 14 nt, Salmonella enterica enterica serovar Typhi
cgacaguaacugca

SEQ ID NO: 1696039 - RNA, 17 nt, Salmonella enterica enterica serovar Typhi
cgacaucagccagccgc

SEQ ID NO: 1696040 - RNA, 12 nt, Salmonella enterica enterica serovar Typhi
cgacaucgccaa

SEQ ID NO: 1696041 - RNA, 16 nt, Salmonella enterica enterica serovar Typhi
cgacaucgccaaccgc

SEQ ID NO: 1696042 - RNA, 15 nt, Salmonella enterica enterica serovar Typhi
cgacaucgccugcuu

SEQ ID NO: 1696043 - RNA, 14 nt, Salmonella enterica enterica serovar Typhi
cgacauagcugaac

SEQ ID NO: 1696044 - RNA, 22 nt, Salmonella enterica enterica serovar Typhi
cgacaggguuugccagcaccag

SEQ ID NO: 1696045 - RNA, 21 nt, Salmonella enterica enterica serovar Typhi
cgacauaagcugcgacaacaa

SEQ ID NO: 1696046 - RNA, 20 nt, Salmonella enterica enterica serovar Typhi
cgacagcgcuauccggccca

SEQ ID NO: 1696047 - RNA, 14 nt, Salmonella enterica enterica serovar Typhi
cgacagcgcgcgcg

SEQ ID NO: 1696048 - RNA, 15 nt, Salmonella enterica enterica serovar Typhi
cgacagcgcccaacg

SEQ ID NO: 1696049 - RNA, 12 nt, Salmonella enterica enterica serovar Typhi
cgacagcgcgcc

SEQ ID NO: 1696050 - RNA, 21 nt, Salmonella enterica enterica serovar Typhi
cgacacugaaacuccgcagcc

SEQ ID NO: 1696051 - RNA, 19 nt, Salmonella enterica enterica serovar Typhi
cgacagagaaugcgccgcc

SEQ ID NO: 1696052 - RNA, 22 nt, Salmonella enterica enterica serovar Typhi
cgacacgcgcgcugcgccugga

SEQ ID NO: 1696053 - RNA, 16 nt, Salmonella enterica enterica serovar Typhi
cgacaaccagcgaaau

SEQ ID NO: 1696054 - RNA, 20 nt, Salmonella enterica enterica serovar Typhi
cgacaacgccuccugccgau

SEQ ID NO: 1696055 - RNA, 18 nt, Salmonella enterica enterica serovar Typhi
cgacaacgcguuuauuau

SEQ ID NO: 1696056 - RNA, 15 nt, Salmonella enterica enterica serovar Typhi
cgacaaacagcuauc

SEQ ID NO: 1696057 - RNA, 15 nt, Salmonella enterica enterica serovar Typhi
cgacaaaagccagau

SEQ ID NO: 1696058 - RNA, 17 nt, Salmonella enterica enterica serovar Typhi
cgaauuugccccagaua

SEQ ID NO: 1696059 - RNA, 18 nt, Salmonella enterica enterica serovar Typhi
cgaauuugaaaaaaacau

SEQ ID NO: 1696060 - RNA, 18 nt, Salmonella enterica enterica serovar Typhi
cgaauuuacugugaucca

SEQ ID NO: 1696061 - RNA, 22 nt, Salmonella enterica enterica serovar Typhi
cgaauucguccacacgccuggc

SEQ ID NO: 1696062 - RNA, 21 nt, Salmonella enterica enterica serovar Typhi
cgacaagguugaucaggaagu

SEQ ID NO: 1696063 - RNA, 22 nt, Salmonella enterica enterica serovar Typhi
cgacaagcuaauccccagcgcu

SEQ ID NO: 1696064 - RNA, 16 nt, Salmonella enterica enterica serovar Typhi
cgacaacguuuucagc

SEQ ID NO: 1696065 - RNA, 20 nt, Salmonella enterica enterica serovar Typhi
cgacaagcggguggucugga

SEQ ID NO: 1696066 - RNA, 15 nt, Salmonella enterica enterica serovar Typhi
cgacaaucagcacca

SEQ ID NO: 1696067 - RNA, 20 nt, Salmonella enterica enterica serovar Typhi
cgacaauggcuagggaaacg

SEQ ID NO: 1696068 - RNA, 15 nt, Salmonella enterica enterica serovar Typhi
ccgguauagcgccuu

SEQ ID NO: 1696069 - RNA, 18 nt, Salmonella enterica enterica serovar Typhi
ccgguauuuuucaccuca

SEQ ID NO: 1696070 - RNA, 15 nt, Salmonella enterica enterica serovar Typhi
ccgguagccaggcgc

SEQ ID NO: 1696071 - RNA, 17 nt, Salmonella enterica enterica serovar Typhi
ccgguagcgagaagccg

SEQ ID NO: 1696072 - RNA, 15 nt, Salmonella enterica enterica serovar Typhi
ccgguagccagccaa

SEQ ID NO: 1696073 - RNA, 20 nt, Salmonella enterica enterica serovar Typhi
ccggucauguuccaacaaug

SEQ ID NO: 1696074 - RNA, 14 nt, Salmonella enterica enterica serovar Typhi
ccggucgcgccagc

SEQ ID NO: 1696075 - RNA, 13 nt, Salmonella enterica enterica serovar Typhi
ccggucauccagc

SEQ ID NO: 1696076 - RNA, 15 nt, Salmonella enterica enterica serovar Typhi
ccggucagucccagc

SEQ ID NO: 1696077 - RNA, 14 nt, Salmonella enterica enterica serovar Typhi
ccgguauuuuuucu

SEQ ID NO: 1696078 - RNA, 17 nt, Salmonella enterica enterica serovar Typhi
ccgguggcgcugcgcuu

SEQ ID NO: 1696079 - RNA, 16 nt, Salmonella enterica enterica serovar Typhi
ccgguggcgcugcgcu

SEQ ID NO: 1696080 - RNA, 20 nt, Salmonella enterica enterica serovar Typhi
ccggugauggugcagccccg

SEQ ID NO: 1696081 - RNA, 15 nt, Salmonella enterica enterica serovar Typhi
ccggucggcgcguca

SEQ ID NO: 1696082 - RNA, 23 nt, Salmonella enterica enterica serovar Typhi
ccgggucggacgagcgcgucagc

SEQ ID NO: 1696083 - RNA, 19 nt, Salmonella enterica enterica serovar Typhi
ccggguaucgcuuucggca

SEQ ID NO: 1696084 - RNA, 23 nt, Salmonella enterica enterica serovar Typhi
ccggguaggacauagccgccacc

SEQ ID NO: 1696085 - RNA, 22 nt, Salmonella enterica enterica serovar Typhi
ccgggcgcaccaguuccccaua

SEQ ID NO: 1696086 - RNA, 20 nt, Salmonella enterica enterica serovar Typhi
ccgggugcaaauccaucuca

SEQ ID NO: 1696087 - RNA, 18 nt, Salmonella enterica enterica serovar Typhi
ccgggugcaaauccaucu

SEQ ID NO: 1696088 - RNA, 18 nt, Salmonella enterica enterica serovar Typhi
ccgguaaagcagugcagu

SEQ ID NO: 1696089 - RNA, 22 nt, Salmonella enterica enterica serovar Typhi
ccgguaacgauaaaaugcaaau

SEQ ID NO: 1696090 - RNA, 19 nt, Salmonella enterica enterica serovar Typhi
ccgguacaccaacuaccaa

SEQ ID NO: 1696091 - RNA, 15 nt, Salmonella enterica enterica serovar Typhi
ccggcuggcuauagu

SEQ ID NO: 1696092 - RNA, 23 nt, Salmonella enterica enterica serovar Typhi
ccggcuguucgacgaauggcggc

SEQ ID NO: 1696093 - RNA, 20 nt, Salmonella enterica enterica serovar Typhi
ccggcugguuaaucacuuuu

SEQ ID NO: 1696094 - RNA, 22 nt, Salmonella enterica enterica serovar Typhi
ccggcugcauauacucacugaa

SEQ ID NO: 1696095 - RNA, 15 nt, Salmonella enterica enterica serovar Typhi
ccggcugccauuauc

SEQ ID NO: 1696096 - RNA, 12 nt, Salmonella enterica enterica serovar Typhi
ccgggccacucu

SEQ ID NO: 1696097 - RNA, 20 nt, Salmonella enterica enterica serovar Typhi
ccgggccaucuuuuuucacu

SEQ ID NO: 1696098 - RNA, 20 nt, Salmonella enterica enterica serovar Typhi
ccgggccgacaggcggccgc

SEQ ID NO: 1696099 - RNA, 13 nt, Salmonella enterica enterica serovar Typhi
ccgggccuggcau

SEQ ID NO: 1696100 - RNA, 18 nt, Salmonella enterica enterica serovar Typhi
ccgggcgacacgcgcgcu

SEQ ID NO: 1696101 - RNA, 13 nt, Salmonella enterica enterica serovar Typhi
ccgggcgaccacc

SEQ ID NO: 1696102 - RNA, 13 nt, Salmonella enterica enterica serovar Typhi
ccgggccaaugcc

SEQ ID NO: 1696103 - RNA, 13 nt, Salmonella enterica enterica serovar Typhi
ccgggcauggcuc

SEQ ID NO: 1696104 - RNA, 16 nt, Salmonella enterica enterica serovar Typhi
ccgggcauaaaaaaag

SEQ ID NO: 1696105 - RNA, 21 nt, Salmonella enterica enterica serovar Typhi
ccgggcagacaucgccgugcu

SEQ ID NO: 1696106 - RNA, 17 nt, Salmonella enterica enterica serovar Typhi
ccggcggcgacuggcua

SEQ ID NO: 1696107 - RNA, 17 nt, Salmonella enterica enterica serovar Typhi
ccggcgauagcggccug

SEQ ID NO: 1696108 - RNA, 13 nt, Salmonella enterica enterica serovar Typhi
ccggcgauggugc

SEQ ID NO: 1696109 - RNA, 18 nt, Salmonella enterica enterica serovar Typhi
ccggcgauggugcggcgc

SEQ ID NO: 1696110 - RNA, 16 nt, Salmonella enterica enterica serovar Typhi
ccggcgauguuggcgc

SEQ ID NO: 1696111 - RNA, 14 nt, Salmonella enterica enterica serovar Typhi
ccggcgcagacggc

SEQ ID NO: 1696112 - RNA, 18 nt, Salmonella enterica enterica serovar Typhi
ccggcguaauugcgccug

SEQ ID NO: 1696113 - RNA, 20 nt, Salmonella enterica enterica serovar Typhi
ccggcggucgauuuugccuu

SEQ ID NO: 1696114 - RNA, 23 nt, Salmonella enterica enterica serovar Typhi
ccggcggucgauuuugccuucaa

SEQ ID NO: 1696115 - RNA, 16 nt, Salmonella enterica enterica serovar Typhi
aaaccgucauuuacca

SEQ ID NO: 1696116 - RNA, 21 nt, Salmonella enterica enterica serovar Typhi
aaaccgucauuuaccagugcu

SEQ ID NO: 1696117 - RNA, 17 nt, Salmonella enterica enterica serovar Typhi
ccggcgugacucagcgg

SEQ ID NO: 1696118 - RNA, 18 nt, Salmonella enterica enterica serovar Typhi
ccggcguuccgcccaggc

SEQ ID NO: 1696119 - RNA, 13 nt, Salmonella enterica enterica serovar Typhi
ccggcauuucacu

SEQ ID NO: 1696120 - RNA, 14 nt, Salmonella enterica enterica serovar Typhi
ccggcaucggcagc

SEQ ID NO: 1696121 - RNA, 20 nt, Salmonella enterica enterica serovar Typhi
ccggcccgcuaucaccgccc

SEQ ID NO: 1696122 - RNA, 16 nt, Salmonella enterica enterica serovar Typhi
ccggcgauagcggccu

SEQ ID NO: 1696123 - RNA, 23 nt, Salmonella enterica enterica serovar Typhi
ccggcgauaacccgcgcauggcc

SEQ ID NO: 1696124 - RNA, 17 nt, Salmonella enterica enterica serovar Typhi
ccggcgaauagcgccag

SEQ ID NO: 1696125 - RNA, 19 nt, Salmonella enterica enterica serovar Typhi
ccggcgaaaccgauuuccu

SEQ ID NO: 1696126 - RNA, 15 nt, Salmonella enterica enterica serovar Typhi
ccggcgaaagcggac

SEQ ID NO: 1696127 - RNA, 12 nt, Salmonella enterica enterica serovar Typhi
ccggcaguccau

SEQ ID NO: 1696128 - RNA, 22 nt, Salmonella enterica enterica serovar Typhi
ccggcaguuauuuuacgggcgu

SEQ ID NO: 1696129 - RNA, 19 nt, Salmonella enterica enterica serovar Typhi
ccggcaucacaaaccagac

SEQ ID NO: 1696130 - RNA, 15 nt, Salmonella enterica enterica serovar Typhi
ccggcaucacgccgg

SEQ ID NO: 1696131 - RNA, 19 nt, Salmonella enterica enterica serovar Typhi
ccggcagguagucauauuc

SEQ ID NO: 1696132 - RNA, 15 nt, Salmonella enterica enterica serovar Typhi
ccggcaggcagcgcc

SEQ ID NO: 1696133 - RNA, 16 nt, Salmonella enterica enterica serovar Typhi
ccggcagcuuuugcgc

SEQ ID NO: 1696134 - RNA, 18 nt, Salmonella enterica enterica serovar Typhi
ccggcagacggcugggcu

SEQ ID NO: 1696135 - RNA, 23 nt, Salmonella enterica enterica serovar Typhi
ccggcagaaaugaccacguacug

SEQ ID NO: 1696136 - RNA, 14 nt, Salmonella enterica enterica serovar Typhi
ccggcacacagaau

SEQ ID NO: 1696137 - RNA, 20 nt, Salmonella enterica enterica serovar Typhi
ccggcacaccggccauugcc

SEQ ID NO: 1696138 - RNA, 21 nt, Salmonella enterica enterica serovar Typhi
ccggcacaccggccauugccg

SEQ ID NO: 1696139 - RNA, 21 nt, Salmonella enterica enterica serovar Typhi
ccggcacauccagcgccugcu

SEQ ID NO: 1696140 - RNA, 18 nt, Salmonella enterica enterica serovar Typhi
ccggcacuguucggggau

SEQ ID NO: 1696141 - RNA, 17 nt, Salmonella enterica enterica serovar Typhi
ccggcaccucguccaga

SEQ ID NO: 1696142 - RNA, 14 nt, Salmonella enterica enterica serovar Typhi
ccgcuucgcgggac

SEQ ID NO: 1696143 - RNA, 22 nt, Salmonella enterica enterica serovar Typhi
ccgcuuuaugcgcuuccagcau

SEQ ID NO: 1696144 - RNA, 16 nt, Salmonella enterica enterica serovar Typhi
ccgcuuugcgaacagc

SEQ ID NO: 1696145 - RNA, 12 nt, Salmonella enterica enterica serovar Typhi
ccgcuuuuccug

SEQ ID NO: 1696146 - RNA, 19 nt, Salmonella enterica enterica serovar Typhi
ccgcuuuucuggcuucagc

SEQ ID NO: 1696147 - RNA, 17 nt, Salmonella enterica enterica serovar Typhi
ccggaaaagcgcuggcu

SEQ ID NO: 1696148 - RNA, 17 nt, Salmonella enterica enterica serovar Typhi
ccgcuuuuuucagcggc

SEQ ID NO: 1696149 - RNA, 21 nt, Salmonella enterica enterica serovar Typhi
ccgcuuuugguuuuucaacca

SEQ ID NO: 1696150 - RNA, 16 nt, Salmonella enterica enterica serovar Typhi
ccggacaaggcgcgcc

SEQ ID NO: 1696151 - RNA, 20 nt, Salmonella enterica enterica serovar Typhi
ccggaaaagcgcuggcuggc

SEQ ID NO: 1696152 - RNA, 18 nt, Salmonella enterica enterica serovar Typhi
ccggacaucauccccggc

SEQ ID NO: 1696153 - RNA, 18 nt, Salmonella enterica enterica serovar Typhi
ccggacgaucaauaaaau

SEQ ID NO: 1696154 - RNA, 11 nt, Salmonella enterica enterica serovar Typhi
ccggaccuaau

SEQ ID NO: 1696155 - RNA, 22 nt, Salmonella enterica enterica serovar Typhi
ccggaccuaauagccagcccca

SEQ ID NO: 1696156 - RNA, 13 nt, Salmonella enterica enterica serovar Typhi
ccgccuccuccgg

SEQ ID NO: 1696157 - RNA, 14 nt, Salmonella enterica enterica serovar Typhi
ccgccugaaucgcc

SEQ ID NO: 1696158 - RNA, 17 nt, Salmonella enterica enterica serovar Typhi
ccgcuucacgcgcggcu

SEQ ID NO: 1696159 - RNA, 14 nt, Salmonella enterica enterica serovar Typhi
ccgcuucacacugg

SEQ ID NO: 1696160 - RNA, 18 nt, Salmonella enterica enterica serovar Typhi
ccgcuguuuuucaucauc

SEQ ID NO: 1696161 - RNA, 17 nt, Salmonella enterica enterica serovar Typhi
ccgcuuccagcgcgucg

SEQ ID NO: 1696162 - RNA, 17 nt, Salmonella enterica enterica serovar Typhi
ccgcuucauuggcgucu

SEQ ID NO: 1696163 - RNA, 14 nt, Salmonella enterica enterica serovar Typhi
ccgcuucgccacuc

SEQ ID NO: 1696164 - RNA, 21 nt, Salmonella enterica enterica serovar Typhi
ccggauacucgacgcacucca

SEQ ID NO: 1696165 - RNA, 16 nt, Salmonella enterica enterica serovar Typhi
ccggaucgaucccggc

SEQ ID NO: 1696166 - RNA, 23 nt, Salmonella enterica enterica serovar Typhi
ccggaucaauaaacagcuccgca

SEQ ID NO: 1696167 - RNA, 18 nt, Salmonella enterica enterica serovar Typhi
ccggaugacgcuucgcuu

SEQ ID NO: 1696168 - RNA, 17 nt, Salmonella enterica enterica serovar Typhi
ccggaucggucuggcgc

SEQ ID NO: 1696169 - RNA, 16 nt, Salmonella enterica enterica serovar Typhi
ccggaucggccauauc

SEQ ID NO: 1696170 - RNA, 14 nt, Salmonella enterica enterica serovar Typhi
ccggaugcagucug

SEQ ID NO: 1696171 - RNA, 15 nt, Salmonella enterica enterica serovar Typhi
ccggaugcgacgcgc

SEQ ID NO: 1696172 - RNA, 14 nt, Salmonella enterica enterica serovar Typhi
ccggauuccagaau

SEQ ID NO: 1696173 - RNA, 22 nt, Salmonella enterica enterica serovar Typhi
ccggauuaaggcguuugcgccg

SEQ ID NO: 1696174 - RNA, 15 nt, Salmonella enterica enterica serovar Typhi
ccggauugcccgcgg

SEQ ID NO: 1696175 - RNA, 20 nt, Salmonella enterica enterica serovar Typhi
ccggauggcggcuacgccuu

SEQ ID NO: 1696176 - RNA, 14 nt, Salmonella enterica enterica serovar Typhi
ccggauggcggcgc

SEQ ID NO: 1696177 - RNA, 23 nt, Salmonella enterica enterica serovar Typhi
ccggauggcggcgugaccgccuu

SEQ ID NO: 1696178 - RNA, 22 nt, Salmonella enterica enterica serovar Typhi
ccggauggcaguacagggcgau

SEQ ID NO: 1696179 - RNA, 19 nt, Salmonella enterica enterica serovar Typhi
ccggauggcgcuaaugcuu

SEQ ID NO: 1696180 - RNA, 18 nt, Salmonella enterica enterica serovar Typhi
ccggauggcgcugcgcuu

SEQ ID NO: 1696181 - RNA, 14 nt, Salmonella enterica enterica serovar Typhi
ccggauggcacugc

SEQ ID NO: 1696182 - RNA, 23 nt, Salmonella enterica enterica serovar Typhi
ccggaugcgccucaucugcuuca

SEQ ID NO: 1696183 - RNA, 13 nt, Salmonella enterica enterica serovar Typhi
ccggaugcggcua

SEQ ID NO: 1696184 - RNA, 14 nt, Salmonella enterica enterica serovar Typhi
ccggcaaacucagc

SEQ ID NO: 1696185 - RNA, 23 nt, Salmonella enterica enterica serovar Typhi
ccggcaaaggaauuacgggcgau

SEQ ID NO: 1696186 - RNA, 13 nt, Salmonella enterica enterica serovar Typhi
ccggcaagcgcug

SEQ ID NO: 1696187 - RNA, 19 nt, Salmonella enterica enterica serovar Typhi
ccuacaauggaaaaaucug

SEQ ID NO: 1696188 - RNA, 18 nt, Salmonella enterica enterica serovar Typhi
ccuacaaggcauucaggc

SEQ ID NO: 1696189 - RNA, 17 nt, Salmonella enterica enterica serovar Typhi
ccuacacaaaaucauuc

SEQ ID NO: 1696190 - RNA, 18 nt, Salmonella enterica enterica serovar Typhi
ccuacacaaaaucauucg

SEQ ID NO: 1696191 - RNA, 12 nt, Salmonella enterica enterica serovar Typhi
ccuaauuuuuaa

SEQ ID NO: 1696192 - RNA, 14 nt, Salmonella enterica enterica serovar Typhi
ccuaauuuuuaaag

SEQ ID NO: 1696193 - RNA, 18 nt, Salmonella enterica enterica serovar Typhi
ccuaccggcggcacccgu

SEQ ID NO: 1696194 - RNA, 15 nt, Salmonella enterica enterica serovar Typhi
ccuaccugccgccau

SEQ ID NO: 1696195 - RNA, 21 nt, Salmonella enterica enterica serovar Typhi
ccuacggaaagcuguuguugc

SEQ ID NO: 1696196 - RNA, 13 nt, Salmonella enterica enterica serovar Typhi
ccuacgcuauccg

SEQ ID NO: 1696197 - RNA, 22 nt, Salmonella enterica enterica serovar Typhi
ccuacgcuuaccgggccugugu

SEQ ID NO: 1696198 - RNA, 14 nt, Salmonella enterica enterica serovar Typhi
ccuaggccagugcc

SEQ ID NO: 1696199 - RNA, 17 nt, Salmonella enterica enterica serovar Typhi
ccuauaagcugccucuu

SEQ ID NO: 1696200 - RNA, 14 nt, Salmonella enterica enterica serovar Typhi
ccuagcgucccggc

SEQ ID NO: 1696201 - RNA, 17 nt, Salmonella enterica enterica serovar Typhi
ccuauauuaguguuaua

SEQ ID NO: 1696202 - RNA, 12 nt, Salmonella enterica enterica serovar Typhi
ccuauccggccg

SEQ ID NO: 1696203 - RNA, 20 nt, Salmonella enterica enterica serovar Typhi
ccucacacugauggcagacc

SEQ ID NO: 1696204 - RNA, 16 nt, Salmonella enterica enterica serovar Typhi
ccucaaaaccgggcag

SEQ ID NO: 1696205 - RNA, 17 nt, Salmonella enterica enterica serovar Typhi
ccuauuuugcaaaacug

SEQ ID NO: 1696206 - RNA, 12 nt, Salmonella enterica enterica serovar Typhi
ccucagaauccg

SEQ ID NO: 1696207 - RNA, 22 nt, Salmonella enterica enterica serovar Typhi
ccucagaaagcguuggcgugcg

SEQ ID NO: 1696208 - RNA, 15 nt, Salmonella enterica enterica serovar Typhi
ccucaucggcaaaca

SEQ ID NO: 1696209 - RNA, 18 nt, Salmonella enterica enterica serovar Typhi
ccucaucccguagcguca

SEQ ID NO: 1696210 - RNA, 13 nt, Salmonella enterica enterica serovar Typhi
aaacgcacccgcg

SEQ ID NO: 1696211 - RNA, 12 nt, Salmonella enterica enterica serovar Typhi
ccucaucaugaa

SEQ ID NO: 1696212 - RNA, 19 nt, Salmonella enterica enterica serovar Typhi
ccuccggugaagguaauuu

SEQ ID NO: 1696213 - RNA, 15 nt, Salmonella enterica enterica serovar Typhi
ccuccggcgcggcgc

SEQ ID NO: 1696214 - RNA, 17 nt, Salmonella enterica enterica serovar Typhi
ccuccggcggugaagca

SEQ ID NO: 1696215 - RNA, 15 nt, Salmonella enterica enterica serovar Typhi
ccuccgggaaaacau

SEQ ID NO: 1696216 - RNA, 12 nt, Salmonella enterica enterica serovar Typhi
ccuccugcucca

SEQ ID NO: 1696217 - RNA, 13 nt, Salmonella enterica enterica serovar Typhi
ccuccggcacaca

SEQ ID NO: 1696218 - RNA, 16 nt, Salmonella enterica enterica serovar Typhi
ccuccggccagcgcca

SEQ ID NO: 1696219 - RNA, 17 nt, Salmonella enterica enterica serovar Typhi
ccuccggccagcgccag

SEQ ID NO: 1696220 - RNA, 20 nt, Salmonella enterica enterica serovar Typhi
ccuccaguaauucccggcag

SEQ ID NO: 1696221 - RNA, 14 nt, Salmonella enterica enterica serovar Typhi
ccuccauccaggua

SEQ ID NO: 1696222 - RNA, 14 nt, Salmonella enterica enterica serovar Typhi
ccuccauacacugc

SEQ ID NO: 1696223 - RNA, 13 nt, Salmonella enterica enterica serovar Typhi
ccuccaucgccag

SEQ ID NO: 1696224 - RNA, 16 nt, Salmonella enterica enterica serovar Typhi
ccucgcgauccgccag

SEQ ID NO: 1696225 - RNA, 17 nt, Salmonella enterica enterica serovar Typhi
ccucgcuuaaaccacca

SEQ ID NO: 1696226 - RNA, 20 nt, Salmonella enterica enterica serovar Typhi
ccucggcaacauaccgggua

SEQ ID NO: 1696227 - RNA, 13 nt, Salmonella enterica enterica serovar Typhi
ccucgaccccuuc

SEQ ID NO: 1696228 - RNA, 14 nt, Salmonella enterica enterica serovar Typhi
ccuccuuuccugug

SEQ ID NO: 1696229 - RNA, 20 nt, Salmonella enterica enterica serovar Typhi
ccguuuccgcaauaagugca

SEQ ID NO: 1696230 - RNA, 20 nt, Salmonella enterica enterica serovar Typhi
ccguuuaucguuaccggcuc

SEQ ID NO: 1696231 - RNA, 21 nt, Salmonella enterica enterica serovar Typhi
ccguuucagaaagagauuaga

SEQ ID NO: 1696232 - RNA, 18 nt, Salmonella enterica enterica serovar Typhi
ccguuuaccggugcagac

SEQ ID NO: 1696233 - RNA, 16 nt, Salmonella enterica enterica serovar Typhi
ccguuguuuggcagga

SEQ ID NO: 1696234 - RNA, 20 nt, Salmonella enterica enterica serovar Typhi
ccguugcaauauaguugagc

SEQ ID NO: 1696235 - RNA, 23 nt, Salmonella enterica enterica serovar Typhi
ccguucaucuaucgccagcgcgu

SEQ ID NO: 1696236 - RNA, 20 nt, Salmonella enterica enterica serovar Typhi
ccguucauucgccccagcau

SEQ ID NO: 1696237 - RNA, 15 nt, Salmonella enterica enterica serovar Typhi
ccguuccaccgccaa

SEQ ID NO: 1696238 - RNA, 19 nt, Salmonella enterica enterica serovar Typhi
ccguucaucgguaauauua

SEQ ID NO: 1696239 - RNA, 15 nt, Salmonella enterica enterica serovar Typhi
ccguuacuuccccca

SEQ ID NO: 1696240 - RNA, 18 nt, Salmonella enterica enterica serovar Typhi
ccguuacgcagucagcac

SEQ ID NO: 1696241 - RNA, 16 nt, Salmonella enterica enterica serovar Typhi
ccguuauucauucacc

SEQ ID NO: 1696242 - RNA, 21 nt, Salmonella enterica enterica serovar Typhi
ccguuaugcaguucaaaaggu

SEQ ID NO: 1696243 - RNA, 13 nt, Salmonella enterica enterica serovar Typhi
ccguuaccagcau

SEQ ID NO: 1696244 - RNA, 13 nt, Salmonella enterica enterica serovar Typhi
ccguuaagcccug

SEQ ID NO: 1696245 - RNA, 23 nt, Salmonella enterica enterica serovar Typhi
ccguuaaaccaaagguauugccu

SEQ ID NO: 1696246 - RNA, 23 nt, Salmonella enterica enterica serovar Typhi
ccguuaaacugcgcgauaucugc

SEQ ID NO: 1696247 - RNA, 15 nt, Salmonella enterica enterica serovar Typhi
ccguuaacugcugcu

SEQ ID NO: 1696248 - RNA, 15 nt, Salmonella enterica enterica serovar Typhi
ccuaauaaaauaacu

SEQ ID NO: 1696249 - RNA, 18 nt, Salmonella enterica enterica serovar Typhi
ccuaacuggaaaaagacc

SEQ ID NO: 1696250 - RNA, 15 nt, Salmonella enterica enterica serovar Typhi
ccuaacuggaaaaag

SEQ ID NO: 1696251 - RNA, 18 nt, Salmonella enterica enterica serovar Typhi
ccuaagagaaaaccccgu

SEQ ID NO: 1696252 - RNA, 15 nt, Salmonella enterica enterica serovar Typhi
ccuaacaucauuccc

SEQ ID NO: 1696253 - RNA, 21 nt, Salmonella enterica enterica serovar Typhi
ccuaacacaugcaagucgaac

SEQ ID NO: 1696254 - RNA, 22 nt, Salmonella enterica enterica serovar Typhi
ccuaaaucugccaucagcaccu

SEQ ID NO: 1696255 - RNA, 21 nt, Salmonella enterica enterica serovar Typhi
ccuaaauccguuaagcccuga

SEQ ID NO: 1696256 - RNA, 20 nt, Salmonella enterica enterica serovar Typhi
ccguuugcgccagcccggcg

SEQ ID NO: 1696257 - RNA, 12 nt, Salmonella enterica enterica serovar Typhi
ccguuugccaua

SEQ ID NO: 1696258 - RNA, 13 nt, Salmonella enterica enterica serovar Typhi
ccguuuguuuauu

SEQ ID NO: 1696259 - RNA, 17 nt, Salmonella enterica enterica serovar Typhi
ccguuuucgucaacaua

SEQ ID NO: 1696260 - RNA, 18 nt, Salmonella enterica enterica serovar Typhi
ccguuuuaccuucugccg

SEQ ID NO: 1696261 - RNA, 17 nt, Salmonella enterica enterica serovar Typhi
ccguuuuagguucuuca

SEQ ID NO: 1696262 - RNA, 16 nt, Salmonella enterica enterica serovar Typhi
ccguuuuggcagcgcc

SEQ ID NO: 1696263 - RNA, 23 nt, Salmonella enterica enterica serovar Typhi
ccuaaaccaaacaccagaucauu

SEQ ID NO: 1696264 - RNA, 12 nt, Salmonella enterica enterica serovar Typhi
ccgguugcgcug

SEQ ID NO: 1696265 - RNA, 17 nt, Salmonella enterica enterica serovar Typhi
ccgguuucaauccaugu

SEQ ID NO: 1696266 - RNA, 21 nt, Salmonella enterica enterica serovar Typhi
ccgucgagaaaccgcucgccg

SEQ ID NO: 1696267 - RNA, 17 nt, Salmonella enterica enterica serovar Typhi
ccgguucggcaucgccc

SEQ ID NO: 1696268 - RNA, 13 nt, Salmonella enterica enterica serovar Typhi
ccgguugcgcgcu

SEQ ID NO: 1696269 - RNA, 18 nt, Salmonella enterica enterica serovar Typhi
ccgguugaccggcccgcu

SEQ ID NO: 1696270 - RNA, 22 nt, Salmonella enterica enterica serovar Typhi
ccgguuagcucaacgcaucgcu

SEQ ID NO: 1696271 - RNA, 16 nt, Salmonella enterica enterica serovar Typhi
ccgguuauccauauga

SEQ ID NO: 1696272 - RNA, 21 nt, Salmonella enterica enterica serovar Typhi
ccgguuccagcggccgcuccg

SEQ ID NO: 1696273 - RNA, 15 nt, Salmonella enterica enterica serovar Typhi
aaacgaauuuaaaua

SEQ ID NO: 1696274 - RNA, 15 nt, Salmonella enterica enterica serovar Typhi
aaacgacucaucagu

SEQ ID NO: 1696275 - RNA, 19 nt, Salmonella enterica enterica serovar Typhi
aaacgauuaauaaccaaua

SEQ ID NO: 1696276 - RNA, 16 nt, Salmonella enterica enterica serovar Typhi
ccguggguggcaaggc

SEQ ID NO: 1696277 - RNA, 14 nt, Salmonella enterica enterica serovar Typhi
ccguguccaaacug

SEQ ID NO: 1696278 - RNA, 17 nt, Salmonella enterica enterica serovar Typhi
ccguggugggguucccg

SEQ ID NO: 1696279 - RNA, 15 nt, Salmonella enterica enterica serovar Typhi
ccguguggucgcggc

SEQ ID NO: 1696280 - RNA, 16 nt, Salmonella enterica enterica serovar Typhi
ccguggccaaaaaauc

SEQ ID NO: 1696281 - RNA, 13 nt, Salmonella enterica enterica serovar Typhi
ccgugcccagcau

SEQ ID NO: 1696282 - RNA, 14 nt, Salmonella enterica enterica serovar Typhi
ccgucugcaaaauu

SEQ ID NO: 1696283 - RNA, 16 nt, Salmonella enterica enterica serovar Typhi
ccgucucaaaguugcc

SEQ ID NO: 1696284 - RNA, 19 nt, Salmonella enterica enterica serovar Typhi
ccgucucaaccagcaauga

SEQ ID NO: 1696285 - RNA, 21 nt, Salmonella enterica enterica serovar Typhi
ccgucgugacuaauagccaaa

SEQ ID NO: 1696286 - RNA, 22 nt, Salmonella enterica enterica serovar Typhi
ccgucgugccuuucaggcgcgg

SEQ ID NO: 1696287 - RNA, 18 nt, Salmonella enterica enterica serovar Typhi
ccgucguuaacaucauca

SEQ ID NO: 1696288 - RNA, 16 nt, Salmonella enterica enterica serovar Typhi
ccgucguuacccuccu

SEQ ID NO: 1696289 - RNA, 22 nt, Salmonella enterica enterica serovar Typhi
ccgucuccuccuugugggcagc

SEQ ID NO: 1696290 - RNA, 19 nt, Salmonella enterica enterica serovar Typhi
ccgccgucggcaauaaacu

SEQ ID NO: 1696291 - RNA, 19 nt, Salmonella enterica enterica serovar Typhi
ccgccgucgucaccgccgc

SEQ ID NO: 1696292 - RNA, 20 nt, Salmonella enterica enterica serovar Typhi
ccgccucaauugccgccagc

SEQ ID NO: 1696293 - RNA, 12 nt, Salmonella enterica enterica serovar Typhi
ccgccuccagca

SEQ ID NO: 1696294 - RNA, 14 nt, Salmonella enterica enterica serovar Typhi
ccgccuccaggccg

SEQ ID NO: 1696295 - RNA, 15 nt, Salmonella enterica enterica serovar Typhi
ccgccuagcgucccg

SEQ ID NO: 1696296 - RNA, 21 nt, Salmonella enterica enterica serovar Typhi
ccgccuaacagcgccgcgccg

SEQ ID NO: 1696297 - RNA, 19 nt, Salmonella enterica enterica serovar Typhi
ccgccgguuuauccccgcu

SEQ ID NO: 1696298 - RNA, 23 nt, Salmonella enterica enterica serovar Typhi
ccgccggggcucccacucuucca

SEQ ID NO: 1696299 - RNA, 22 nt, Salmonella enterica enterica serovar Typhi
ccgccgcaauuccugacugcgc

SEQ ID NO: 1696300 - RNA, 19 nt, Salmonella enterica enterica serovar Typhi
ccgccgccagccaucccca

SEQ ID NO: 1696301 - RNA, 15 nt, Salmonella enterica enterica serovar Typhi
ccgccgccaucacca

SEQ ID NO: 1696302 - RNA, 16 nt, Salmonella enterica enterica serovar Typhi
ccgccgccgggccgcc

SEQ ID NO: 1696303 - RNA, 11 nt, Salmonella enterica enterica serovar Typhi
ccgccggaggg

SEQ ID NO: 1696304 - RNA, 23 nt, Salmonella enterica enterica serovar Typhi
ccgccgcuuuuuucagcggcagc

SEQ ID NO: 1696305 - RNA, 15 nt, Salmonella enterica enterica serovar Typhi
ccgccgcuggcuggc

SEQ ID NO: 1696306 - RNA, 15 nt, Salmonella enterica enterica serovar Typhi
ccgccggcagcagcu

SEQ ID NO: 1696307 - RNA, 15 nt, Salmonella enterica enterica serovar Typhi
ccgccgcgcgucagc

SEQ ID NO: 1696308 - RNA, 16 nt, Salmonella enterica enterica serovar Typhi
ccgccgcgcggcccca

SEQ ID NO: 1696309 - RNA, 22 nt, Salmonella enterica enterica serovar Typhi
ccgccccuguggaaucagucgg

SEQ ID NO: 1696310 - RNA, 13 nt, Salmonella enterica enterica serovar Typhi
ccgccccugugga

SEQ ID NO: 1696311 - RNA, 14 nt, Salmonella enterica enterica serovar Typhi
ccgcccccuccagu

SEQ ID NO: 1696312 - RNA, 22 nt, Salmonella enterica enterica serovar Typhi
ccgcccagaaagaucagcagaa

SEQ ID NO: 1696313 - RNA, 12 nt, Salmonella enterica enterica serovar Typhi
ccgcccagaacg

SEQ ID NO: 1696314 - RNA, 17 nt, Salmonella enterica enterica serovar Typhi
ccgcccagaacggcagc

SEQ ID NO: 1696315 - RNA, 15 nt, Salmonella enterica enterica serovar Typhi
ccgcccaaccagccc

SEQ ID NO: 1696316 - RNA, 20 nt, Salmonella enterica enterica serovar Typhi
ccgccauucgcuuccgccgg

SEQ ID NO: 1696317 - RNA, 18 nt, Salmonella enterica enterica serovar Typhi
ccgccauugccaguaccg

SEQ ID NO: 1696318 - RNA, 18 nt, Salmonella enterica enterica serovar Typhi
ccgccauggcgaauccgu

SEQ ID NO: 1696319 - RNA, 20 nt, Salmonella enterica enterica serovar Typhi
ccgccaucucacgcauggcg

SEQ ID NO: 1696320 - RNA, 13 nt, Salmonella enterica enterica serovar Typhi
ccgccaucucacg

SEQ ID NO: 1696321 - RNA, 16 nt, Salmonella enterica enterica serovar Typhi
ccgccaucguccagcc

SEQ ID NO: 1696322 - RNA, 13 nt, Salmonella enterica enterica serovar Typhi
ccgcccugcccgc

SEQ ID NO: 1696323 - RNA, 23 nt, Salmonella enterica enterica serovar Typhi
ccgcccguacagacaucaucgaa

SEQ ID NO: 1696324 - RNA, 16 nt, Salmonella enterica enterica serovar Typhi
ccgcccggacccgcuu

SEQ ID NO: 1696325 - RNA, 20 nt, Salmonella enterica enterica serovar Typhi
ccgccgaacagacggcggcu

SEQ ID NO: 1696326 - RNA, 23 nt, Salmonella enterica enterica serovar Typhi
ccgcccuucacaaccaucgucug

SEQ ID NO: 1696327 - RNA, 16 nt, Salmonella enterica enterica serovar Typhi
ccgccgacccccuccu

SEQ ID NO: 1696328 - RNA, 16 nt, Salmonella enterica enterica serovar Typhi
ccgccgacaccggccu

SEQ ID NO: 1696329 - RNA, 15 nt, Salmonella enterica enterica serovar Typhi
ccgccgacaccggcc

SEQ ID NO: 1696330 - RNA, 14 nt, Salmonella enterica enterica serovar Typhi
ccgccgacaaccag

SEQ ID NO: 1696331 - RNA, 13 nt, Salmonella enterica enterica serovar Typhi
aaacccgccaccg

SEQ ID NO: 1696332 - RNA, 18 nt, Salmonella enterica enterica serovar Typhi
aaaccccagauuacugcc

SEQ ID NO: 1696333 - RNA, 15 nt, Salmonella enterica enterica serovar Typhi
aaacccggugcggca

SEQ ID NO: 1696334 - RNA, 22 nt, Salmonella enterica enterica serovar Typhi
aaacccacccgguaauaccgau

SEQ ID NO: 1696335 - RNA, 21 nt, Salmonella enterica enterica serovar Typhi
aaaccauucaaauucaauaaa

SEQ ID NO: 1696336 - RNA, 20 nt, Salmonella enterica enterica serovar Typhi
aaaccauguugaucguaaaa

SEQ ID NO: 1696337 - RNA, 13 nt, Salmonella enterica enterica serovar Typhi
ccgccagacucag

SEQ ID NO: 1696338 - RNA, 22 nt, Salmonella enterica enterica serovar Typhi
ccgccagacucagccaggucug

SEQ ID NO: 1696339 - RNA, 16 nt, Salmonella enterica enterica serovar Typhi
ccgccagacucagcca

SEQ ID NO: 1696340 - RNA, 15 nt, Salmonella enterica enterica serovar Typhi
ccgccagcaaugccg

SEQ ID NO: 1696341 - RNA, 14 nt, Salmonella enterica enterica serovar Typhi
ccgccagcacagca

SEQ ID NO: 1696342 - RNA, 14 nt, Salmonella enterica enterica serovar Typhi
ccgccagcaccagg

SEQ ID NO: 1696343 - RNA, 14 nt, Salmonella enterica enterica serovar Typhi
ccgccagccccacc

SEQ ID NO: 1696344 - RNA, 11 nt, Salmonella enterica enterica serovar Typhi
ccgccagcagu

SEQ ID NO: 1696345 - RNA, 14 nt, Salmonella enterica enterica serovar Typhi
ccgccaaagcgccc

SEQ ID NO: 1696346 - RNA, 19 nt, Salmonella enterica enterica serovar Typhi
ccgcauuuaacaggacgcu

SEQ ID NO: 1696347 - RNA, 23 nt, Salmonella enterica enterica serovar Typhi
ccgcauuuaacaggacgcuccau

SEQ ID NO: 1696348 - RNA, 23 nt, Salmonella enterica enterica serovar Typhi
ccgccaauauccggcacgccagc

SEQ ID NO: 1696349 - RNA, 16 nt, Salmonella enterica enterica serovar Typhi
ccgccaauaaccaccu

SEQ ID NO: 1696350 - RNA, 14 nt, Salmonella enterica enterica serovar Typhi
ccgccaccgcgcgc

SEQ ID NO: 1696351 - RNA, 11 nt, Salmonella enterica enterica serovar Typhi
ccgccaccacg

SEQ ID NO: 1696352 - RNA, 14 nt, Salmonella enterica enterica serovar Typhi
ccgccaccacgccc

SEQ ID NO: 1696353 - RNA, 14 nt, Salmonella enterica enterica serovar Typhi
aaaccagcauaaua

SEQ ID NO: 1696354 - RNA, 18 nt, Salmonella enterica enterica serovar Typhi
ccgccagcgacauggcgg

SEQ ID NO: 1696355 - RNA, 17 nt, Salmonella enterica enterica serovar Typhi
aaaccaguugccagggu

SEQ ID NO: 1696356 - RNA, 20 nt, Salmonella enterica enterica serovar Typhi
aaaccagcgcggauaaaaaa

SEQ ID NO: 1696357 - RNA, 20 nt, Salmonella enterica enterica serovar Typhi
aaaccagcuuuucauuuguu

SEQ ID NO: 1696358 - RNA, 13 nt, Salmonella enterica enterica serovar Typhi
ccgccagcggcgc

SEQ ID NO: 1696359 - RNA, 15 nt, Salmonella enterica enterica serovar Typhi
ccgccagcggcgcca

SEQ ID NO: 1696360 - RNA, 18 nt, Salmonella enterica enterica serovar Typhi
ccgccagcuccugcgggc

SEQ ID NO: 1696361 - RNA, 19 nt, Salmonella enterica enterica serovar Typhi
aaaccaucccagguuauuc

SEQ ID NO: 1696362 - RNA, 15 nt, Salmonella enterica enterica serovar Typhi
aaaccaugaucguca

SEQ ID NO: 1696363 - RNA, 13 nt, Salmonella enterica enterica serovar Typhi
ccgccagcgccgc

SEQ ID NO: 1696364 - RNA, 23 nt, Salmonella enterica enterica serovar Typhi
ccgccaguaauuuuucucccagc

SEQ ID NO: 1696365 - RNA, 21 nt, Salmonella enterica enterica serovar Typhi
ccgccaguuuguaaccaacaa

SEQ ID NO: 1696366 - RNA, 21 nt, Salmonella enterica enterica serovar Typhi
ccgccaggucuuuaucuauca

SEQ ID NO: 1696367 - RNA, 15 nt, Salmonella enterica enterica serovar Typhi
ccgccaucacaccaa

SEQ ID NO: 1696368 - RNA, 16 nt, Salmonella enterica enterica serovar Typhi
ccgccauauauuuacu

SEQ ID NO: 1696369 - RNA, 20 nt, Salmonella enterica enterica serovar Typhi
ccgccauagaaauagccccg

SEQ ID NO: 1696370 - RNA, 15 nt, Salmonella enterica enterica serovar Typhi
ccgccauaagaaugu

SEQ ID NO: 1696371 - RNA, 19 nt, Salmonella enterica enterica serovar Typhi
ccgccauacccggcuccca

SEQ ID NO: 1696372 - RNA, 14 nt, Salmonella enterica enterica serovar Typhi
ccgccaguuuuuau

SEQ ID NO: 1696373 - RNA, 14 nt, Salmonella enterica enterica serovar Typhi
ccgccaucgccucg

SEQ ID NO: 1696374 - RNA, 16 nt, Salmonella enterica enterica serovar Typhi
ccgccaucgcugggau

SEQ ID NO: 1696375 - RNA, 14 nt, Salmonella enterica enterica serovar Typhi
ccgccaucgacagc

SEQ ID NO: 1696376 - RNA, 11 nt, Salmonella enterica enterica serovar Typhi
ccgccaucaug

SEQ ID NO: 1696377 - RNA, 19 nt, Salmonella enterica enterica serovar Typhi
ccgccauccggcacaguau

SEQ ID NO: 1696378 - RNA, 15 nt, Salmonella enterica enterica serovar Typhi
ccgcacagacgucgg

SEQ ID NO: 1696379 - RNA, 13 nt, Salmonella enterica enterica serovar Typhi
ccgcaaucuggcg

SEQ ID NO: 1696380 - RNA, 17 nt, Salmonella enterica enterica serovar Typhi
ccgcaaugaccacaaau

SEQ ID NO: 1696381 - RNA, 13 nt, Salmonella enterica enterica serovar Typhi
ccgcaauccccug

SEQ ID NO: 1696382 - RNA, 22 nt, Salmonella enterica enterica serovar Typhi
ccgcaauaccaauuaccggcuu

SEQ ID NO: 1696383 - RNA, 16 nt, Salmonella enterica enterica serovar Typhi
ccgcaaacagagcgcc

SEQ ID NO: 1696384 - RNA, 16 nt, Salmonella enterica enterica serovar Typhi
ccgcaaacagcacgcc

SEQ ID NO: 1696385 - RNA, 23 nt, Salmonella enterica enterica serovar Typhi
ccgcaaaaugaggacacaguaau

SEQ ID NO: 1696386 - RNA, 23 nt, Salmonella enterica enterica serovar Typhi
ccgaugucgcuucgcuuaucugg

SEQ ID NO: 1696387 - RNA, 17 nt, Salmonella enterica enterica serovar Typhi
ccgagcgguaagagcca

SEQ ID NO: 1696388 - RNA, 13 nt, Salmonella enterica enterica serovar Typhi
ccgauucccaguc

SEQ ID NO: 1696389 - RNA, 18 nt, Salmonella enterica enterica serovar Typhi
ccgauucugccaguucac

SEQ ID NO: 1696390 - RNA, 11 nt, Salmonella enterica enterica serovar Typhi
ccgcaggacag

SEQ ID NO: 1696391 - RNA, 22 nt, Salmonella enterica enterica serovar Typhi
ccgcaggacagcgacauccucu

SEQ ID NO: 1696392 - RNA, 18 nt, Salmonella enterica enterica serovar Typhi
ccgcaggagagccagaag

SEQ ID NO: 1696393 - RNA, 15 nt, Salmonella enterica enterica serovar Typhi
ccgcaucacggcagc

SEQ ID NO: 1696394 - RNA, 18 nt, Salmonella enterica enterica serovar Typhi
ccgcaucagcaacgcgcc

SEQ ID NO: 1696395 - RNA, 14 nt, Salmonella enterica enterica serovar Typhi
ccgcaucaaugccc

SEQ ID NO: 1696396 - RNA, 16 nt, Salmonella enterica enterica serovar Typhi
ccgcauuauaaauauc

SEQ ID NO: 1696397 - RNA, 15 nt, Salmonella enterica enterica serovar Typhi
ccgcaucgauacccu

SEQ ID NO: 1696398 - RNA, 17 nt, Salmonella enterica enterica serovar Typhi
ccgcaucuucgcccggc

SEQ ID NO: 1696399 - RNA, 13 nt, Salmonella enterica enterica serovar Typhi
cccuucaggaaua

SEQ ID NO: 1696400 - RNA, 11 nt, Salmonella enterica enterica serovar Typhi
aaacagaugcu

SEQ ID NO: 1696401 - RNA, 15 nt, Salmonella enterica enterica serovar Typhi
aaacagcagaacaac

SEQ ID NO: 1696402 - RNA, 21 nt, Salmonella enterica enterica serovar Typhi
aaacagcagcgcggcacacag

SEQ ID NO: 1696403 - RNA, 14 nt, Salmonella enterica enterica serovar Typhi
aaacagcaaaucgg

SEQ ID NO: 1696404 - RNA, 16 nt, Salmonella enterica enterica serovar Typhi
cccuggggcgcucuuu

SEQ ID NO: 1696405 - RNA, 23 nt, Salmonella enterica enterica serovar Typhi
cccuguaacagaauuaacgcaga

SEQ ID NO: 1696406 - RNA, 15 nt, Salmonella enterica enterica serovar Typhi
cccuuaaagccgccc

SEQ ID NO: 1696407 - RNA, 18 nt, Salmonella enterica enterica serovar Typhi
cccuguuuuuucgccgcg

SEQ ID NO: 1696408 - RNA, 20 nt, Salmonella enterica enterica serovar Typhi
aaacaggccugcggaaaaag

SEQ ID NO: 1696409 - RNA, 15 nt, Salmonella enterica enterica serovar Typhi
aaacaggcugcccgg

SEQ ID NO: 1696410 - RNA, 15 nt, Salmonella enterica enterica serovar Typhi
aaacagguaaaacaa

SEQ ID NO: 1696411 - RNA, 13 nt, Salmonella enterica enterica serovar Typhi
cccuuuuucaauu

SEQ ID NO: 1696412 - RNA, 19 nt, Salmonella enterica enterica serovar Typhi
aaacagguacuuacccaga

SEQ ID NO: 1696413 - RNA, 14 nt, Salmonella enterica enterica serovar Typhi
aaacagccagcagc

SEQ ID NO: 1696414 - RNA, 18 nt, Salmonella enterica enterica serovar Typhi
aaacagcgccaguuuuuc

SEQ ID NO: 1696415 - RNA, 20 nt, Salmonella enterica enterica serovar Typhi
aaacagcgccccgacaaaac

SEQ ID NO: 1696416 - RNA, 15 nt, Salmonella enterica enterica serovar Typhi
aaacagccgccaugg

SEQ ID NO: 1696417 - RNA, 13 nt, Salmonella enterica enterica serovar Typhi
ccgaagcaggcgg

SEQ ID NO: 1696418 - RNA, 17 nt, Salmonella enterica enterica serovar Typhi
aaacaucgcccuccagc

SEQ ID NO: 1696419 - RNA, 20 nt, Salmonella enterica enterica serovar Typhi
aaacaugguggagucugaaa

SEQ ID NO: 1696420 - RNA, 13 nt, Salmonella enterica enterica serovar Typhi
aaacauaagcaaa

SEQ ID NO: 1696421 - RNA, 14 nt, Salmonella enterica enterica serovar Typhi
aaacauauaucucu

SEQ ID NO: 1696422 - RNA, 15 nt, Salmonella enterica enterica serovar Typhi
aaacauauccauaca

SEQ ID NO: 1696423 - RNA, 17 nt, Salmonella enterica enterica serovar Typhi
ccgaaagcgaccuucuc

SEQ ID NO: 1696424 - RNA, 20 nt, Salmonella enterica enterica serovar Typhi
ccgaaagccgguaaucgauc

SEQ ID NO: 1696425 - RNA, 16 nt, Salmonella enterica enterica serovar Typhi
aaacaucauaauaauu

SEQ ID NO: 1696426 - RNA, 15 nt, Salmonella enterica enterica serovar Typhi
aaacaucaugcccaa

SEQ ID NO: 1696427 - RNA, 15 nt, Salmonella enterica enterica serovar Typhi
aaacauauaucucua

SEQ ID NO: 1696428 - RNA, 14 nt, Salmonella enterica enterica serovar Typhi
aaacaucagccauu

SEQ ID NO: 1696429 - RNA, 18 nt, Salmonella enterica enterica serovar Typhi
ccgagcagcuuggcggcu

SEQ ID NO: 1696430 - RNA, 19 nt, Salmonella enterica enterica serovar Typhi
ccgagcauuuccgcagcca

SEQ ID NO: 1696431 - RNA, 22 nt, Salmonella enterica enterica serovar Typhi
ccgagccagaacgagaggagga

SEQ ID NO: 1696432 - RNA, 15 nt, Salmonella enterica enterica serovar Typhi
ccgagaaacaccaga

SEQ ID NO: 1696433 - RNA, 18 nt, Salmonella enterica enterica serovar Typhi
ccgacuuuuuugccuuuc

SEQ ID NO: 1696434 - RNA, 19 nt, Salmonella enterica enterica serovar Typhi
ccgacuuuuuugccuuuca

SEQ ID NO: 1696435 - RNA, 14 nt, Salmonella enterica enterica serovar Typhi
ccgacuuuucgccc

SEQ ID NO: 1696436 - RNA, 13 nt, Salmonella enterica enterica serovar Typhi
ccgacuuucaaau

SEQ ID NO: 1696437 - RNA, 19 nt, Salmonella enterica enterica serovar Typhi
ccgagcaacagaaaccaua

SEQ ID NO: 1696438 - RNA, 15 nt, Salmonella enterica enterica serovar Typhi
ccgacgcgaugccag

SEQ ID NO: 1696439 - RNA, 19 nt, Salmonella enterica enterica serovar Typhi
ccgacgcauuucuccugau

SEQ ID NO: 1696440 - RNA, 23 nt, Salmonella enterica enterica serovar Typhi
ccgacgauaaacagauaugaaau

SEQ ID NO: 1696441 - RNA, 15 nt, Salmonella enterica enterica serovar Typhi
ccgaccgucagcucc

SEQ ID NO: 1696442 - RNA, 14 nt, Salmonella enterica enterica serovar Typhi
ccgaccgucggcgc

SEQ ID NO: 1696443 - RNA, 13 nt, Salmonella enterica enterica serovar Typhi
ccgacagcggaaa

SEQ ID NO: 1696444 - RNA, 12 nt, Salmonella enterica enterica serovar Typhi
aaaccacuccgg

SEQ ID NO: 1696445 - RNA, 16 nt, Salmonella enterica enterica serovar Typhi
aaaccaccgagacuac

SEQ ID NO: 1696446 - RNA, 14 nt, Salmonella enterica enterica serovar Typhi
ccgacauucccagu

SEQ ID NO: 1696447 - RNA, 15 nt, Salmonella enterica enterica serovar Typhi
ccgaccaccagcuug

SEQ ID NO: 1696448 - RNA, 22 nt, Salmonella enterica enterica serovar Typhi
ccgacaugguuaaccaccagcg

SEQ ID NO: 1696449 - RNA, 15 nt, Salmonella enterica enterica serovar Typhi
ccgaccaccgcccug

SEQ ID NO: 1696450 - RNA, 16 nt, Salmonella enterica enterica serovar Typhi
ccgaccagggcauccc

SEQ ID NO: 1696451 - RNA, 21 nt, Salmonella enterica enterica serovar Typhi
ccgaccaguuuuugcgccagc

SEQ ID NO: 1696452 - RNA, 15 nt, Salmonella enterica enterica serovar Typhi
ccgacccaccugacu

SEQ ID NO: 1696453 - RNA, 21 nt, Salmonella enterica enterica serovar Typhi
ccgaccauuggcaccaccagg

SEQ ID NO: 1696454 - RNA, 15 nt, Salmonella enterica enterica serovar Typhi
ccgaccauuacccac

SEQ ID NO: 1696455 - RNA, 22 nt, Salmonella enterica enterica serovar Typhi
ccgaccauccagacaugcacau

SEQ ID NO: 1696456 - RNA, 15 nt, Salmonella enterica enterica serovar Typhi
ccgaccgccagcaga

SEQ ID NO: 1696457 - RNA, 19 nt, Salmonella enterica enterica serovar Typhi
cccggugucaaagcgccag

SEQ ID NO: 1696458 - RNA, 12 nt, Salmonella enterica enterica serovar Typhi
cccgguggcggc

SEQ ID NO: 1696459 - RNA, 11 nt, Salmonella enterica enterica serovar Typhi
cccggugggca

SEQ ID NO: 1696460 - RNA, 16 nt, Salmonella enterica enterica serovar Typhi
cccggugagcgccgcg

SEQ ID NO: 1696461 - RNA, 14 nt, Salmonella enterica enterica serovar Typhi
cccgggugcgcagc

SEQ ID NO: 1696462 - RNA, 19 nt, Salmonella enterica enterica serovar Typhi
cccggucaacgcgccgcca

SEQ ID NO: 1696463 - RNA, 17 nt, Salmonella enterica enterica serovar Typhi
cccgguagccacaccca

SEQ ID NO: 1696464 - RNA, 21 nt, Salmonella enterica enterica serovar Typhi
cccggcuuaccggcuaucagc

SEQ ID NO: 1696465 - RNA, 17 nt, Salmonella enterica enterica serovar Typhi
cccggcuuaaauuuuua

SEQ ID NO: 1696466 - RNA, 22 nt, Salmonella enterica enterica serovar Typhi
cccggcugccauuaucaccauu

SEQ ID NO: 1696467 - RNA, 20 nt, Salmonella enterica enterica serovar Typhi
cccgggagaacgccgggccu

SEQ ID NO: 1696468 - RNA, 20 nt, Salmonella enterica enterica serovar Typhi
cccggcuuuauuacuucuuc

SEQ ID NO: 1696469 - RNA, 12 nt, Salmonella enterica enterica serovar Typhi
cccgccgccauu

SEQ ID NO: 1696470 - RNA, 22 nt, Salmonella enterica enterica serovar Typhi
cccgccgggcgucacccgccgg

SEQ ID NO: 1696471 - RNA, 16 nt, Salmonella enterica enterica serovar Typhi
cccguugcgucacgaa

SEQ ID NO: 1696472 - RNA, 15 nt, Salmonella enterica enterica serovar Typhi
cccguugucuucacc

SEQ ID NO: 1696473 - RNA, 20 nt, Salmonella enterica enterica serovar Typhi
cccguuucagccccuugcug

SEQ ID NO: 1696474 - RNA, 16 nt, Salmonella enterica enterica serovar Typhi
cccuaaggucacgccg

SEQ ID NO: 1696475 - RNA, 15 nt, Salmonella enterica enterica serovar Typhi
cccguuuuuuccagc

SEQ ID NO: 1696476 - RNA, 15 nt, Salmonella enterica enterica serovar Typhi
cccuauuagcacgcc

SEQ ID NO: 1696477 - RNA, 19 nt, Salmonella enterica enterica serovar Typhi
cccuaaggcagcaagguac

SEQ ID NO: 1696478 - RNA, 15 nt, Salmonella enterica enterica serovar Typhi
cccuacugcuuagcu

SEQ ID NO: 1696479 - RNA, 14 nt, Salmonella enterica enterica serovar Typhi
cccguuaaauacca

SEQ ID NO: 1696480 - RNA, 14 nt, Salmonella enterica enterica serovar Typhi
cccgucucuuuauc

SEQ ID NO: 1696481 - RNA, 21 nt, Salmonella enterica enterica serovar Typhi
cccgucaucuucuaccuggaa

SEQ ID NO: 1696482 - RNA, 18 nt, Salmonella enterica enterica serovar Typhi
aaacaccggggcauuucc

SEQ ID NO: 1696483 - RNA, 21 nt, Salmonella enterica enterica serovar Typhi
cccucaacgcccugcucccac

SEQ ID NO: 1696484 - RNA, 17 nt, Salmonella enterica enterica serovar Typhi
cccucaagacgguuauu

SEQ ID NO: 1696485 - RNA, 22 nt, Salmonella enterica enterica serovar Typhi
cccucaacgcccugcucccaca

SEQ ID NO: 1696486 - RNA, 23 nt, Salmonella enterica enterica serovar Typhi
cccucaaguuauguuauccccac

SEQ ID NO: 1696487 - RNA, 18 nt, Salmonella enterica enterica serovar Typhi
cccucaauaucuuugccu

SEQ ID NO: 1696488 - RNA, 16 nt, Salmonella enterica enterica serovar Typhi
cccucaccucccccgc

SEQ ID NO: 1696489 - RNA, 13 nt, Salmonella enterica enterica serovar Typhi
cccuccggccagc

SEQ ID NO: 1696490 - RNA, 16 nt, Salmonella enterica enterica serovar Typhi
cccuccggccagcgcc

SEQ ID NO: 1696491 - RNA, 17 nt, Salmonella enterica enterica serovar Typhi
cccucgacaggaguaua

SEQ ID NO: 1696492 - RNA, 14 nt, Salmonella enterica enterica serovar Typhi
cccugaauauuaga

SEQ ID NO: 1696493 - RNA, 21 nt, Salmonella enterica enterica serovar Typhi
cccucuucuucuuccgucagc

SEQ ID NO: 1696494 - RNA, 17 nt, Salmonella enterica enterica serovar Typhi
cccucugcaccagaacu

SEQ ID NO: 1696495 - RNA, 22 nt, Salmonella enterica enterica serovar Typhi
cccucugauuggcuguuaguaa

SEQ ID NO: 1696496 - RNA, 22 nt, Salmonella enterica enterica serovar Typhi
cccucugaaacgcuucaccggc

SEQ ID NO: 1696497 - RNA, 22 nt, Salmonella enterica enterica serovar Typhi
cccugaugcguauccagcgcgg

SEQ ID NO: 1696498 - RNA, 23 nt, Salmonella enterica enterica serovar Typhi
cccugauggcgcgccacuucuuu

SEQ ID NO: 1696499 - RNA, 16 nt, Salmonella enterica enterica serovar Typhi
cccugagcccacagcg

SEQ ID NO: 1696500 - RNA, 15 nt, Salmonella enterica enterica serovar Typhi
cccugccggcggcag

SEQ ID NO: 1696501 - RNA, 14 nt, Salmonella enterica enterica serovar Typhi
cccugcccgccagg

SEQ ID NO: 1696502 - RNA, 13 nt, Salmonella enterica enterica serovar Typhi
cccugcccgccag

SEQ ID NO: 1696503 - RNA, 13 nt, Salmonella enterica enterica serovar Typhi
cccugcccaugaa

SEQ ID NO: 1696504 - RNA, 17 nt, Salmonella enterica enterica serovar Typhi
cccugcauuauccacga

SEQ ID NO: 1696505 - RNA, 12 nt, Salmonella enterica enterica serovar Typhi
cccugccacagu

SEQ ID NO: 1696506 - RNA, 15 nt, Salmonella enterica enterica serovar Typhi
cccuggcugguuaau

SEQ ID NO: 1696507 - RNA, 18 nt, Salmonella enterica enterica serovar Typhi
ccccgacugcugcgcuuu

SEQ ID NO: 1696508 - RNA, 15 nt, Salmonella enterica enterica serovar Typhi
cccccugccagcgcu

SEQ ID NO: 1696509 - RNA, 15 nt, Salmonella enterica enterica serovar Typhi
cccccuuugacaacc

SEQ ID NO: 1696510 - RNA, 15 nt, Salmonella enterica enterica serovar Typhi
cccccuaucuggaug

SEQ ID NO: 1696511 - RNA, 19 nt, Salmonella enterica enterica serovar Typhi
ccccgaguaacaccgcggc

SEQ ID NO: 1696512 - RNA, 15 nt, Salmonella enterica enterica serovar Typhi
ccccgcaacggcgcu

SEQ ID NO: 1696513 - RNA, 15 nt, Salmonella enterica enterica serovar Typhi
cccccaccucaauca

SEQ ID NO: 1696514 - RNA, 20 nt, Salmonella enterica enterica serovar Typhi
cccccagaaugccgcccauc

SEQ ID NO: 1696515 - RNA, 20 nt, Salmonella enterica enterica serovar Typhi
cccccagauagaaccacgca

SEQ ID NO: 1696516 - RNA, 17 nt, Salmonella enterica enterica serovar Typhi
ccccaguugguuguagc

SEQ ID NO: 1696517 - RNA, 19 nt, Salmonella enterica enterica serovar Typhi
ccccauauugaucgggauu

SEQ ID NO: 1696518 - RNA, 21 nt, Salmonella enterica enterica serovar Typhi
ccccauauugauggccacauc

SEQ ID NO: 1696519 - RNA, 13 nt, Salmonella enterica enterica serovar Typhi
ccccaucuccaga

SEQ ID NO: 1696520 - RNA, 18 nt, Salmonella enterica enterica serovar Typhi
ccccaucaugcgccaggu

SEQ ID NO: 1696521 - RNA, 13 nt, Salmonella enterica enterica serovar Typhi
ccccaucccagac

SEQ ID NO: 1696522 - RNA, 15 nt, Salmonella enterica enterica serovar Typhi
cccauggccccaugu

SEQ ID NO: 1696523 - RNA, 17 nt, Salmonella enterica enterica serovar Typhi
cccauggaugcgccgcc

SEQ ID NO: 1696524 - RNA, 13 nt, Salmonella enterica enterica serovar Typhi
cccaugcuuccag

SEQ ID NO: 1696525 - RNA, 22 nt, Salmonella enterica enterica serovar Typhi
cccauguucaugaaccacgcca

SEQ ID NO: 1696526 - RNA, 14 nt, Salmonella enterica enterica serovar Typhi
cccauguugcgccg

SEQ ID NO: 1696527 - RNA, 18 nt, Salmonella enterica enterica serovar Typhi
cccaugaugggcaagcgu

SEQ ID NO: 1696528 - RNA, 21 nt, Salmonella enterica enterica serovar Typhi
cccaugccgccugccgcgccg

SEQ ID NO: 1696529 - RNA, 23 nt, Salmonella enterica enterica serovar Typhi
cccaugcaccagucccagcccca

SEQ ID NO: 1696530 - RNA, 17 nt, Salmonella enterica enterica serovar Typhi
cccaucuaaccgggccu

SEQ ID NO: 1696531 - RNA, 13 nt, Salmonella enterica enterica serovar Typhi
cccaucuccagcc

SEQ ID NO: 1696532 - RNA, 18 nt, Salmonella enterica enterica serovar Typhi
ccccagcacgacagagau

SEQ ID NO: 1696533 - RNA, 20 nt, Salmonella enterica enterica serovar Typhi
ccccagaugccguagccaag

SEQ ID NO: 1696534 - RNA, 13 nt, Salmonella enterica enterica serovar Typhi
ccccacgcccgcc

SEQ ID NO: 1696535 - RNA, 13 nt, Salmonella enterica enterica serovar Typhi
ccccaccgccaga

SEQ ID NO: 1696536 - RNA, 16 nt, Salmonella enterica enterica serovar Typhi
ccccaccgacacaaau

SEQ ID NO: 1696537 - RNA, 12 nt, Salmonella enterica enterica serovar Typhi
ccccaaacacca

SEQ ID NO: 1696538 - RNA, 17 nt, Salmonella enterica enterica serovar Typhi
ccccaaacaccaacaaa

SEQ ID NO: 1696539 - RNA, 15 nt, Salmonella enterica enterica serovar Typhi
ccccaaacgcucaua

SEQ ID NO: 1696540 - RNA, 14 nt, Salmonella enterica enterica serovar Typhi
ccccaaacugcucg

SEQ ID NO: 1696541 - RNA, 19 nt, Salmonella enterica enterica serovar Typhi
cccgccaucguccagccau

SEQ ID NO: 1696542 - RNA, 14 nt, Salmonella enterica enterica serovar Typhi
cccgcccacaggcu

SEQ ID NO: 1696543 - RNA, 23 nt, Salmonella enterica enterica serovar Typhi
cccgcccacaggcugcggcacgc

SEQ ID NO: 1696544 - RNA, 15 nt, Salmonella enterica enterica serovar Typhi
cccgccgccaccaug

SEQ ID NO: 1696545 - RNA, 21 nt, Salmonella enterica enterica serovar Typhi
cccgccgcacacgccgugcac

SEQ ID NO: 1696546 - RNA, 17 nt, Salmonella enterica enterica serovar Typhi
cccgccgccagcaccgc

SEQ ID NO: 1696547 - RNA, 11 nt, Salmonella enterica enterica serovar Typhi
cccgccgccau

SEQ ID NO: 1696548 - RNA, 12 nt, Salmonella enterica enterica serovar Typhi
cccgccgccauc

SEQ ID NO: 1696549 - RNA, 12 nt, Salmonella enterica enterica serovar Typhi
cccgccagcacc

SEQ ID NO: 1696550 - RNA, 14 nt, Salmonella enterica enterica serovar Typhi
cccgccagcggcgc

SEQ ID NO: 1696551 - RNA, 13 nt, Salmonella enterica enterica serovar Typhi
cccgccaggguau

SEQ ID NO: 1696552 - RNA, 14 nt, Salmonella enterica enterica serovar Typhi
cccgccaccgccgc

SEQ ID NO: 1696553 - RNA, 13 nt, Salmonella enterica enterica serovar Typhi
cccgccagaugca

SEQ ID NO: 1696554 - RNA, 21 nt, Salmonella enterica enterica serovar Typhi
cccgccagaugcagcggcagu

SEQ ID NO: 1696555 - RNA, 17 nt, Salmonella enterica enterica serovar Typhi
cccgcaugguaaacgca

SEQ ID NO: 1696556 - RNA, 15 nt, Salmonella enterica enterica serovar Typhi
cccgcagccacuccc

SEQ ID NO: 1696557 - RNA, 13 nt, Salmonella enterica enterica serovar Typhi
cccgcagccacuc

SEQ ID NO: 1696558 - RNA, 22 nt, Salmonella enterica enterica serovar Typhi
cccgcacuaccagcucgcgcag

SEQ ID NO: 1696559 - RNA, 16 nt, Salmonella enterica enterica serovar Typhi
cccgcacgcuuucuuc

SEQ ID NO: 1696560 - RNA, 19 nt, Salmonella enterica enterica serovar Typhi
cccgcaaacuggccacagc

SEQ ID NO: 1696561 - RNA, 11 nt, Salmonella enterica enterica serovar Typhi
cccgcaaaagc

SEQ ID NO: 1696562 - RNA, 19 nt, Salmonella enterica enterica serovar Typhi
cccgaaagucaucugccag

SEQ ID NO: 1696563 - RNA, 21 nt, Salmonella enterica enterica serovar Typhi
cccgaaaagcguaacgccccc

SEQ ID NO: 1696564 - RNA, 22 nt, Salmonella enterica enterica serovar Typhi
cccgacaggguuugccagcacc

SEQ ID NO: 1696565 - RNA, 13 nt, Salmonella enterica enterica serovar Typhi
cccgaccacgccc

SEQ ID NO: 1696566 - RNA, 12 nt, Salmonella enterica enterica serovar Typhi
ccccuuuuucaa

SEQ ID NO: 1696567 - RNA, 22 nt, Salmonella enterica enterica serovar Typhi
ccccuucuuuaucuucugcugc

SEQ ID NO: 1696568 - RNA, 18 nt, Salmonella enterica enterica serovar Typhi
ccccucggcagcaauacg

SEQ ID NO: 1696569 - RNA, 21 nt, Salmonella enterica enterica serovar Typhi
ccccugaugcguauccagcgc

SEQ ID NO: 1696570 - RNA, 13 nt, Salmonella enterica enterica serovar Typhi
ccccuucgcuguc

SEQ ID NO: 1696571 - RNA, 14 nt, Salmonella enterica enterica serovar Typhi
ccccugacgcgcgc

SEQ ID NO: 1696572 - RNA, 21 nt, Salmonella enterica enterica serovar Typhi
ccccugaaauaacagacuccg

SEQ ID NO: 1696573 - RNA, 14 nt, Salmonella enterica enterica serovar Typhi
ccccgcuggcgcgg

SEQ ID NO: 1696574 - RNA, 20 nt, Salmonella enterica enterica serovar Typhi
ccccggugcuuucuccugcg

SEQ ID NO: 1696575 - RNA, 13 nt, Salmonella enterica enterica serovar Typhi
cccauacguuuuu

SEQ ID NO: 1696576 - RNA, 11 nt, Salmonella enterica enterica serovar Typhi
cccauaaucac

SEQ ID NO: 1696577 - RNA, 23 nt, Salmonella enterica enterica serovar Typhi
cccauaauaaugacuaauuauua

SEQ ID NO: 1696578 - RNA, 13 nt, Salmonella enterica enterica serovar Typhi
aaacaccagaaug

SEQ ID NO: 1696579 - RNA, 22 nt, Salmonella enterica enterica serovar Typhi
aaacaccaccgguuugucgcuu

SEQ ID NO: 1696580 - RNA, 22 nt, Salmonella enterica enterica serovar Typhi
cccaguugaucggccagcaagc

SEQ ID NO: 1696581 - RNA, 12 nt, Salmonella enterica enterica serovar Typhi
cccaguuuaccc

SEQ ID NO: 1696582 - RNA, 14 nt, Salmonella enterica enterica serovar Typhi
cccauaaagauggc

SEQ ID NO: 1696583 - RNA, 14 nt, Salmonella enterica enterica serovar Typhi
cccaucgagccaac

SEQ ID NO: 1696584 - RNA, 21 nt, Salmonella enterica enterica serovar Typhi
cccaucgggccgcucagcauc

SEQ ID NO: 1696585 - RNA, 18 nt, Salmonella enterica enterica serovar Typhi
cccaucagggaaaaaugu

SEQ ID NO: 1696586 - RNA, 13 nt, Salmonella enterica enterica serovar Typhi
cccauccccauau

SEQ ID NO: 1696587 - RNA, 16 nt, Salmonella enterica enterica serovar Typhi
cccauccgcccaccca

SEQ ID NO: 1696588 - RNA, 15 nt, Salmonella enterica enterica serovar Typhi
cccauacugcccagc

SEQ ID NO: 1696589 - RNA, 13 nt, Salmonella enterica enterica serovar Typhi
cccauauuccugc

SEQ ID NO: 1696590 - RNA, 13 nt, Salmonella enterica enterica serovar Typhi
cccaucaccugac

SEQ ID NO: 1696591 - RNA, 18 nt, Salmonella enterica enterica serovar Typhi
cccaucacgcccuguaaa

SEQ ID NO: 1696592 - RNA, 17 nt, Salmonella enterica enterica serovar Typhi
cccaucagcgccagccc

SEQ ID NO: 1696593 - RNA, 14 nt, Salmonella enterica enterica serovar Typhi
cccaucagcgccag

SEQ ID NO: 1696594 - RNA, 17 nt, Salmonella enterica enterica serovar Typhi
cccaguacaaacaaaua

SEQ ID NO: 1696595 - RNA, 19 nt, Salmonella enterica enterica serovar Typhi
cccagguuauucaggugga

SEQ ID NO: 1696596 - RNA, 23 nt, Salmonella enterica enterica serovar Typhi
cccagguuguaucauguuccggc

SEQ ID NO: 1696597 - RNA, 14 nt, Salmonella enterica enterica serovar Typhi
cccagucacggcuc

SEQ ID NO: 1696598 - RNA, 18 nt, Salmonella enterica enterica serovar Typhi
cccaguauugcaccuggg

SEQ ID NO: 1696599 - RNA, 19 nt, Salmonella enterica enterica serovar Typhi
cccaguccacguuuuacuu

SEQ ID NO: 1696600 - RNA, 17 nt, Salmonella enterica enterica serovar Typhi
cccaguagcagacagcc

SEQ ID NO: 1696601 - RNA, 18 nt, Salmonella enterica enterica serovar Typhi
cccaguagcagacagccg

SEQ ID NO: 1696602 - RNA, 12 nt, Salmonella enterica enterica serovar Typhi
cccaguagccau

SEQ ID NO: 1696603 - RNA, 19 nt, Salmonella enterica enterica serovar Typhi
cccaguuauuaaguuuuac

SEQ ID NO: 1696604 - RNA, 15 nt, Salmonella enterica enterica serovar Typhi
cccaguguacugcca

SEQ ID NO: 1696605 - RNA, 18 nt, Salmonella enterica enterica serovar Typhi
cccagugucaacugcgcc

SEQ ID NO: 1696606 - RNA, 15 nt, Salmonella enterica enterica serovar Typhi
cccaguggcaaaauc

SEQ ID NO: 1696607 - RNA, 20 nt, Salmonella enterica enterica serovar Typhi
cccaggggcauauauuauua

SEQ ID NO: 1696608 - RNA, 13 nt, Salmonella enterica enterica serovar Typhi
cccaggguuuagc

SEQ ID NO: 1696609 - RNA, 22 nt, Salmonella enterica enterica serovar Typhi
cccaggccugaugagcgcagcg

SEQ ID NO: 1696610 - RNA, 23 nt, Salmonella enterica enterica serovar Typhi
cccaggcgcguuguccaacuguc

SEQ ID NO: 1696611 - RNA, 19 nt, Salmonella enterica enterica serovar Typhi
cccaggcgcgcagcugcca

SEQ ID NO: 1696612 - RNA, 20 nt, Salmonella enterica enterica serovar Typhi
cccacuuguagcgagcgccg

SEQ ID NO: 1696613 - RNA, 16 nt, Salmonella enterica enterica serovar Typhi
cccacuuucagcuccg

SEQ ID NO: 1696614 - RNA, 19 nt, Salmonella enterica enterica serovar Typhi
cccagaaagaucagcagaa

SEQ ID NO: 1696615 - RNA, 14 nt, Salmonella enterica enterica serovar Typhi
cccagaaucacccc

SEQ ID NO: 1696616 - RNA, 18 nt, Salmonella enterica enterica serovar Typhi
cccagaaucccgccuugc

SEQ ID NO: 1696617 - RNA, 20 nt, Salmonella enterica enterica serovar Typhi
cccagcaaugcacuacgaaa

SEQ ID NO: 1696618 - RNA, 19 nt, Salmonella enterica enterica serovar Typhi
cccagauguugauacagaa

SEQ ID NO: 1696619 - RNA, 21 nt, Salmonella enterica enterica serovar Typhi
cccagccgugaauggucacau

SEQ ID NO: 1696620 - RNA, 14 nt, Salmonella enterica enterica serovar Typhi
cccagccuucuccc

SEQ ID NO: 1696621 - RNA, 17 nt, Salmonella enterica enterica serovar Typhi
cccagcccugugccgcu

SEQ ID NO: 1696622 - RNA, 15 nt, Salmonella enterica enterica serovar Typhi
cccagcagcagccgg

SEQ ID NO: 1696623 - RNA, 18 nt, Salmonella enterica enterica serovar Typhi
cccaggauaguacugacc

SEQ ID NO: 1696624 - RNA, 19 nt, Salmonella enterica enterica serovar Typhi
cccagcuugcccagauccu

SEQ ID NO: 1696625 - RNA, 13 nt, Salmonella enterica enterica serovar Typhi
cccaggccaaaac

SEQ ID NO: 1696626 - RNA, 21 nt, Salmonella enterica enterica serovar Typhi
cccaggcaaaugauuaucucc

SEQ ID NO: 1696627 - RNA, 18 nt, Salmonella enterica enterica serovar Typhi
cccaggccgccaccgccu

SEQ ID NO: 1696628 - RNA, 21 nt, Salmonella enterica enterica serovar Typhi
cccaggccgccaccgccucgc

SEQ ID NO: 1696629 - RNA, 12 nt, Salmonella enterica enterica serovar Typhi
cccaggccgcca

SEQ ID NO: 1696630 - RNA, 15 nt, Salmonella enterica enterica serovar Typhi
cccaggccgccaccg

SEQ ID NO: 1696631 - RNA, 22 nt, Salmonella enterica enterica serovar Typhi
cccagcgggugaugcgccagcc

SEQ ID NO: 1696632 - RNA, 17 nt, Salmonella enterica enterica serovar Typhi
cccagcguaccacgccg

SEQ ID NO: 1696633 - RNA, 22 nt, Salmonella enterica enterica serovar Typhi
cccagcucaugauagggcagca

SEQ ID NO: 1696634 - RNA, 20 nt, Salmonella enterica enterica serovar Typhi
cccagcgcgccgcagcgccg

SEQ ID NO: 1696635 - RNA, 12 nt, Salmonella enterica enterica serovar Typhi
cccagcgcgccg

SEQ ID NO: 1696636 - RNA, 23 nt, Salmonella enterica enterica serovar Typhi
cccagcggaugucggucaucagg

SEQ ID NO: 1696637 - RNA, 15 nt, Salmonella enterica enterica serovar Typhi
cccagcgcuggcaga

SEQ ID NO: 1696638 - RNA, 17 nt, Salmonella enterica enterica serovar Typhi
cccagcgcccccagcaa

SEQ ID NO: 1696639 - RNA, 16 nt, Salmonella enterica enterica serovar Typhi
cccagcgcccccagca

SEQ ID NO: 1696640 - RNA, 13 nt, Salmonella enterica enterica serovar Typhi
cccagcgccagcc

SEQ ID NO: 1696641 - RNA, 18 nt, Salmonella enterica enterica serovar Typhi
cccagcgccagccgcgcc

SEQ ID NO: 1696642 - RNA, 19 nt, Salmonella enterica enterica serovar Typhi
cccagcgccagccgcgcca

SEQ ID NO: 1696643 - RNA, 23 nt, Salmonella enterica enterica serovar Typhi
ccaucgcgaauuucaaucgccag

SEQ ID NO: 1696644 - RNA, 14 nt, Salmonella enterica enterica serovar Typhi
ccaucgcgccgcug

SEQ ID NO: 1696645 - RNA, 16 nt, Salmonella enterica enterica serovar Typhi
ccauccaccagaaccu

SEQ ID NO: 1696646 - RNA, 19 nt, Salmonella enterica enterica serovar Typhi
ccauccagacaugcacaug

SEQ ID NO: 1696647 - RNA, 19 nt, Salmonella enterica enterica serovar Typhi
ccauccgggccacucucca

SEQ ID NO: 1696648 - RNA, 14 nt, Salmonella enterica enterica serovar Typhi
ccauccggcacugu

SEQ ID NO: 1696649 - RNA, 16 nt, Salmonella enterica enterica serovar Typhi
ccauccggcauuuuuu

SEQ ID NO: 1696650 - RNA, 15 nt, Salmonella enterica enterica serovar Typhi
ccauccggcaaaauu

SEQ ID NO: 1696651 - RNA, 14 nt, Salmonella enterica enterica serovar Typhi
ccauccggcaaaau

SEQ ID NO: 1696652 - RNA, 16 nt, Salmonella enterica enterica serovar Typhi
ccauccggcaaacuca

SEQ ID NO: 1696653 - RNA, 17 nt, Salmonella enterica enterica serovar Typhi
ccauccggcacaguauu

SEQ ID NO: 1696654 - RNA, 22 nt, Salmonella enterica enterica serovar Typhi
ccauccggcacggucaaucauc

SEQ ID NO: 1696655 - RNA, 23 nt, Salmonella enterica enterica serovar Typhi
ccauccggcacggucaaucauca

SEQ ID NO: 1696656 - RNA, 14 nt, Salmonella enterica enterica serovar Typhi
ccauaguccaugcc

SEQ ID NO: 1696657 - RNA, 17 nt, Salmonella enterica enterica serovar Typhi
ccauauuuuuccagcgc

SEQ ID NO: 1696658 - RNA, 16 nt, Salmonella enterica enterica serovar Typhi
ccauauucuucgcaua

SEQ ID NO: 1696659 - RNA, 13 nt, Salmonella enterica enterica serovar Typhi
ccauccaccagaa

SEQ ID NO: 1696660 - RNA, 15 nt, Salmonella enterica enterica serovar Typhi
ccaucauaccgccaa

SEQ ID NO: 1696661 - RNA, 20 nt, Salmonella enterica enterica serovar Typhi
ccaucauugacuucaacgca

SEQ ID NO: 1696662 - RNA, 15 nt, Salmonella enterica enterica serovar Typhi
ccaucauagcccaua

SEQ ID NO: 1696663 - RNA, 13 nt, Salmonella enterica enterica serovar Typhi
ccaucagggaaaa

SEQ ID NO: 1696664 - RNA, 15 nt, Salmonella enterica enterica serovar Typhi
ccaucagggaaaaau

SEQ ID NO: 1696665 - RNA, 22 nt, Salmonella enterica enterica serovar Typhi
ccaucaggcaucugaaaugcuc

SEQ ID NO: 1696666 - RNA, 14 nt, Salmonella enterica enterica serovar Typhi
aaacaaugcaggua

SEQ ID NO: 1696667 - RNA, 13 nt, Salmonella enterica enterica serovar Typhi
ccaugccagcagu

SEQ ID NO: 1696668 - RNA, 17 nt, Salmonella enterica enterica serovar Typhi
ccaugcauaaugcagcc

SEQ ID NO: 1696669 - RNA, 18 nt, Salmonella enterica enterica serovar Typhi
ccaugcauaaugcagcca

SEQ ID NO: 1696670 - RNA, 14 nt, Salmonella enterica enterica serovar Typhi
ccaugacgacaggu

SEQ ID NO: 1696671 - RNA, 19 nt, Salmonella enterica enterica serovar Typhi
ccaugacgcagggcaauau

SEQ ID NO: 1696672 - RNA, 19 nt, Salmonella enterica enterica serovar Typhi
ccaugcccaguucaaucaa

SEQ ID NO: 1696673 - RNA, 20 nt, Salmonella enterica enterica serovar Typhi
ccauggaacauccucuccug

SEQ ID NO: 1696674 - RNA, 19 nt, Salmonella enterica enterica serovar Typhi
ccauggaacauccucuccu

SEQ ID NO: 1696675 - RNA, 15 nt, Salmonella enterica enterica serovar Typhi
ccauggccgcagccc

SEQ ID NO: 1696676 - RNA, 18 nt, Salmonella enterica enterica serovar Typhi
ccauggccgcagcccgcc

SEQ ID NO: 1696677 - RNA, 14 nt, Salmonella enterica enterica serovar Typhi
ccaucuuuuuucac

SEQ ID NO: 1696678 - RNA, 16 nt, Salmonella enterica enterica serovar Typhi
ccaucuuuaccaaugu

SEQ ID NO: 1696679 - RNA, 13 nt, Salmonella enterica enterica serovar Typhi
ccaucuuucuuuu

SEQ ID NO: 1696680 - RNA, 21 nt, Salmonella enterica enterica serovar Typhi
ccaugaagcgauuuauccacc

SEQ ID NO: 1696681 - RNA, 21 nt, Salmonella enterica enterica serovar Typhi
ccaucggcacgucgucccagg

SEQ ID NO: 1696682 - RNA, 16 nt, Salmonella enterica enterica serovar Typhi
ccaucggaguccagca

SEQ ID NO: 1696683 - RNA, 19 nt, Salmonella enterica enterica serovar Typhi
ccaucggcaaacgccgccu

SEQ ID NO: 1696684 - RNA, 18 nt, Salmonella enterica enterica serovar Typhi
ccaucuuccucacagccu

SEQ ID NO: 1696685 - RNA, 23 nt, Salmonella enterica enterica serovar Typhi
ccaucgguucucugccaucaucc

SEQ ID NO: 1696686 - RNA, 20 nt, Salmonella enterica enterica serovar Typhi
ccaugucuugcuaucaaacu

SEQ ID NO: 1696687 - RNA, 22 nt, Salmonella enterica enterica serovar Typhi
ccauguggccagcggccagcca

SEQ ID NO: 1696688 - RNA, 22 nt, Salmonella enterica enterica serovar Typhi
ccauguugaucguaaaaugaaa

SEQ ID NO: 1696689 - RNA, 13 nt, Salmonella enterica enterica serovar Typhi
ccauguucaguuc

SEQ ID NO: 1696690 - RNA, 14 nt, Salmonella enterica enterica serovar Typhi
ccauguugagcgcu

SEQ ID NO: 1696691 - RNA, 15 nt, Salmonella enterica enterica serovar Typhi
ccauguacuccugau

SEQ ID NO: 1696692 - RNA, 20 nt, Salmonella enterica enterica serovar Typhi
ccauucccgauaaugaccga

SEQ ID NO: 1696693 - RNA, 16 nt, Salmonella enterica enterica serovar Typhi
ccauucggccugcggu

SEQ ID NO: 1696694 - RNA, 22 nt, Salmonella enterica enterica serovar Typhi
ccauucgccagcccgaucaucu

SEQ ID NO: 1696695 - RNA, 12 nt, Salmonella enterica enterica serovar Typhi
ccauuacucuca

SEQ ID NO: 1696696 - RNA, 17 nt, Salmonella enterica enterica serovar Typhi
ccauucccgauaaugac

SEQ ID NO: 1696697 - RNA, 18 nt, Salmonella enterica enterica serovar Typhi
ccauuaucgaucugagcg

SEQ ID NO: 1696698 - RNA, 17 nt, Salmonella enterica enterica serovar Typhi
ccauuaggcuauuuuau

SEQ ID NO: 1696699 - RNA, 21 nt, Salmonella enterica enterica serovar Typhi
ccauuaccuggcaacauagca

SEQ ID NO: 1696700 - RNA, 13 nt, Salmonella enterica enterica serovar Typhi
ccauuaaugcagg

SEQ ID NO: 1696701 - RNA, 15 nt, Salmonella enterica enterica serovar Typhi
ccauuaauacccaua

SEQ ID NO: 1696702 - RNA, 21 nt, Salmonella enterica enterica serovar Typhi
ccauuaauauagaguugugaa

SEQ ID NO: 1696703 - RNA, 15 nt, Salmonella enterica enterica serovar Typhi
cccaacuacacucuu

SEQ ID NO: 1696704 - RNA, 20 nt, Salmonella enterica enterica serovar Typhi
cccaacgacagcacuacgcu

SEQ ID NO: 1696705 - RNA, 22 nt, Salmonella enterica enterica serovar Typhi
cccaacggaugcgccaucccau

SEQ ID NO: 1696706 - RNA, 20 nt, Salmonella enterica enterica serovar Typhi
cccaacggaugcgccauccc

SEQ ID NO: 1696707 - RNA, 17 nt, Salmonella enterica enterica serovar Typhi
cccaaccgaaacguaug

SEQ ID NO: 1696708 - RNA, 11 nt, Salmonella enterica enterica serovar Typhi
ccauuuuucag

SEQ ID NO: 1696709 - RNA, 21 nt, Salmonella enterica enterica serovar Typhi
ccauuucgccuauuuucucuu

SEQ ID NO: 1696710 - RNA, 18 nt, Salmonella enterica enterica serovar Typhi
ccauuucuucuucaagcc

SEQ ID NO: 1696711 - RNA, 14 nt, Salmonella enterica enterica serovar Typhi
ccauuugccagaua

SEQ ID NO: 1696712 - RNA, 17 nt, Salmonella enterica enterica serovar Typhi
ccauuugccagauagcg

SEQ ID NO: 1696713 - RNA, 23 nt, Salmonella enterica enterica serovar Typhi
ccauuuuccuauggacauuggcc

SEQ ID NO: 1696714 - RNA, 15 nt, Salmonella enterica enterica serovar Typhi
ccauuuuaaauacac

SEQ ID NO: 1696715 - RNA, 14 nt, Salmonella enterica enterica serovar Typhi
ccauuuuaaauaca

SEQ ID NO: 1696716 - RNA, 23 nt, Salmonella enterica enterica serovar Typhi
ccauuuuagggccgggcagugcu

SEQ ID NO: 1696717 - RNA, 15 nt, Salmonella enterica enterica serovar Typhi
ccauuuuauccucuu

SEQ ID NO: 1696718 - RNA, 13 nt, Salmonella enterica enterica serovar Typhi
ccauucugcugau

SEQ ID NO: 1696719 - RNA, 15 nt, Salmonella enterica enterica serovar Typhi
ccauugccaguaccg

SEQ ID NO: 1696720 - RNA, 14 nt, Salmonella enterica enterica serovar Typhi
ccauugcguauuuc

SEQ ID NO: 1696721 - RNA, 16 nt, Salmonella enterica enterica serovar Typhi
ccauugcuaggaacag

SEQ ID NO: 1696722 - RNA, 20 nt, Salmonella enterica enterica serovar Typhi
ccauugcuaggaacagugac

SEQ ID NO: 1696723 - RNA, 16 nt, Salmonella enterica enterica serovar Typhi
ccauugcgagaaaaaa

SEQ ID NO: 1696724 - RNA, 16 nt, Salmonella enterica enterica serovar Typhi
ccauugcugacaaaau

SEQ ID NO: 1696725 - RNA, 16 nt, Salmonella enterica enterica serovar Typhi
ccauugcugucgacaa

SEQ ID NO: 1696726 - RNA, 13 nt, Salmonella enterica enterica serovar Typhi
ccauaaacaaaac

SEQ ID NO: 1696727 - RNA, 12 nt, Salmonella enterica enterica serovar Typhi
ccauaaugacgc

SEQ ID NO: 1696728 - RNA, 18 nt, Salmonella enterica enterica serovar Typhi
ccauaaucgauauaauuu

SEQ ID NO: 1696729 - RNA, 17 nt, Salmonella enterica enterica serovar Typhi
ccauaaugauccacacc

SEQ ID NO: 1696730 - RNA, 21 nt, Salmonella enterica enterica serovar Typhi
ccauaaugaucguaugcagcc

SEQ ID NO: 1696731 - RNA, 14 nt, Salmonella enterica enterica serovar Typhi
ccauaaugcaauca

SEQ ID NO: 1696732 - RNA, 13 nt, Salmonella enterica enterica serovar Typhi
ccauaauuuuccc

SEQ ID NO: 1696733 - RNA, 23 nt, Salmonella enterica enterica serovar Typhi
ccauaauuaccggcacaccggcc

SEQ ID NO: 1696734 - RNA, 13 nt, Salmonella enterica enterica serovar Typhi
ccaguuuuuucca

SEQ ID NO: 1696735 - RNA, 20 nt, Salmonella enterica enterica serovar Typhi
ccauaaaauaaagucagcaa

SEQ ID NO: 1696736 - RNA, 20 nt, Salmonella enterica enterica serovar Typhi
ccaguuguccgcuggucagc

SEQ ID NO: 1696737 - RNA, 15 nt, Salmonella enterica enterica serovar Typhi
ccaguuuuaagcgca

SEQ ID NO: 1696738 - RNA, 20 nt, Salmonella enterica enterica serovar Typhi
ccaguuuuaaauaucauuua

SEQ ID NO: 1696739 - RNA, 14 nt, Salmonella enterica enterica serovar Typhi
ccaguuggcaacgu

SEQ ID NO: 1696740 - RNA, 14 nt, Salmonella enterica enterica serovar Typhi
ccaguugcgcaggg

SEQ ID NO: 1696741 - RNA, 20 nt, Salmonella enterica enterica serovar Typhi
ccaguugcucauaacggcua

SEQ ID NO: 1696742 - RNA, 18 nt, Salmonella enterica enterica serovar Typhi
ccaguugcauacauaaau

SEQ ID NO: 1696743 - RNA, 20 nt, Salmonella enterica enterica serovar Typhi
ccauaccuaaugcccgcuug

SEQ ID NO: 1696744 - RNA, 15 nt, Salmonella enterica enterica serovar Typhi
ccauacccggcuccc

SEQ ID NO: 1696745 - RNA, 16 nt, Salmonella enterica enterica serovar Typhi
ccauacccggcuccca

SEQ ID NO: 1696746 - RNA, 21 nt, Salmonella enterica enterica serovar Typhi
ccauacauugaguaaauaaau

SEQ ID NO: 1696747 - RNA, 20 nt, Salmonella enterica enterica serovar Typhi
ccauacacugcauaaauauc

SEQ ID NO: 1696748 - RNA, 19 nt, Salmonella enterica enterica serovar Typhi
ccauacgcccacgcggcgu

SEQ ID NO: 1696749 - RNA, 19 nt, Salmonella enterica enterica serovar Typhi
ccauacguuuuuauuaucu

SEQ ID NO: 1696750 - RNA, 23 nt, Salmonella enterica enterica serovar Typhi
ccauagcaucgacccuugcgacc

SEQ ID NO: 1696751 - RNA, 18 nt, Salmonella enterica enterica serovar Typhi
ccauagcccacuauuuuu

SEQ ID NO: 1696752 - RNA, 20 nt, Salmonella enterica enterica serovar Typhi
ccauagcgcuaugcgcucca

SEQ ID NO: 1696753 - RNA, 14 nt, Salmonella enterica enterica serovar Typhi
ccauaggccagcgu

SEQ ID NO: 1696754 - RNA, 21 nt, Salmonella enterica enterica serovar Typhi
ccauagcguuuaaaaagcugc

SEQ ID NO: 1696755 - RNA, 22 nt, Salmonella enterica enterica serovar Typhi
ccauagcguuuaaaaagcugca

SEQ ID NO: 1696756 - RNA, 19 nt, Salmonella enterica enterica serovar Typhi
ccagugcagaaagugugau

SEQ ID NO: 1696757 - RNA, 17 nt, Salmonella enterica enterica serovar Typhi
ccagugccaguuaagca

SEQ ID NO: 1696758 - RNA, 23 nt, Salmonella enterica enterica serovar Typhi
ccagugccaccagccggagccgg

SEQ ID NO: 1696759 - RNA, 22 nt, Salmonella enterica enterica serovar Typhi
ccagugcgcauacuaccgcugc

SEQ ID NO: 1696760 - RNA, 20 nt, Salmonella enterica enterica serovar Typhi
ccaguuaaugccgacccacc

SEQ ID NO: 1696761 - RNA, 17 nt, Salmonella enterica enterica serovar Typhi
ccaguucauugauuaac

SEQ ID NO: 1696762 - RNA, 12 nt, Salmonella enterica enterica serovar Typhi
ccaguucacucc

SEQ ID NO: 1696763 - RNA, 22 nt, Salmonella enterica enterica serovar Typhi
ccaguucacuccuaagagaaaa

SEQ ID NO: 1696764 - RNA, 17 nt, Salmonella enterica enterica serovar Typhi
ccaguugaucggccagc

SEQ ID NO: 1696765 - RNA, 16 nt, Salmonella enterica enterica serovar Typhi
ccaguucauuaacauc

SEQ ID NO: 1696766 - RNA, 16 nt, Salmonella enterica enterica serovar Typhi
ccaguucccacagcuu

SEQ ID NO: 1696767 - RNA, 13 nt, Salmonella enterica enterica serovar Typhi
ccagucgcagcca

SEQ ID NO: 1696768 - RNA, 18 nt, Salmonella enterica enterica serovar Typhi
ccagucgcagcaaacggc

SEQ ID NO: 1696769 - RNA, 15 nt, Salmonella enterica enterica serovar Typhi
ccagucgcuccacca

SEQ ID NO: 1696770 - RNA, 18 nt, Salmonella enterica enterica serovar Typhi
ccaguccugucccugcca

SEQ ID NO: 1696771 - RNA, 17 nt, Salmonella enterica enterica serovar Typhi
ccaguccugccaccagc

SEQ ID NO: 1696772 - RNA, 14 nt, Salmonella enterica enterica serovar Typhi
ccaguccccuuuuc

SEQ ID NO: 1696773 - RNA, 14 nt, Salmonella enterica enterica serovar Typhi
ccagugaaaaaaag

SEQ ID NO: 1696774 - RNA, 23 nt, Salmonella enterica enterica serovar Typhi
ccagugaaaguugguguuucuca

SEQ ID NO: 1696775 - RNA, 13 nt, Salmonella enterica enterica serovar Typhi
ccagugaaauaaa

SEQ ID NO: 1696776 - RNA, 14 nt, Salmonella enterica enterica serovar Typhi
ccagugaauacugc

SEQ ID NO: 1696777 - RNA, 17 nt, Salmonella enterica enterica serovar Typhi
ccagucgcuccaccacu

SEQ ID NO: 1696778 - RNA, 17 nt, Salmonella enterica enterica serovar Typhi
ccagucggaaccggcaa

SEQ ID NO: 1696779 - RNA, 16 nt, Salmonella enterica enterica serovar Typhi
ccagucggcaaagacc

SEQ ID NO: 1696780 - RNA, 22 nt, Salmonella enterica enterica serovar Typhi
ccagucggcaaagaccaauaaa

SEQ ID NO: 1696781 - RNA, 16 nt, Salmonella enterica enterica serovar Typhi
ccagucgggcgugccg

SEQ ID NO: 1696782 - RNA, 14 nt, Salmonella enterica enterica serovar Typhi
ccagucguaauuca

SEQ ID NO: 1696783 - RNA, 21 nt, Salmonella enterica enterica serovar Typhi
ccagucgcucuaacugaugug

SEQ ID NO: 1696784 - RNA, 20 nt, Salmonella enterica enterica serovar Typhi
ccaguaacucaucgccagcc

SEQ ID NO: 1696785 - RNA, 20 nt, Salmonella enterica enterica serovar Typhi
ccaguaaaaucggaccuccg

SEQ ID NO: 1696786 - RNA, 15 nt, Salmonella enterica enterica serovar Typhi
ccaguaagggcagcc

SEQ ID NO: 1696787 - RNA, 19 nt, Salmonella enterica enterica serovar Typhi
ccagguuuucaggccgcgu

SEQ ID NO: 1696788 - RNA, 20 nt, Salmonella enterica enterica serovar Typhi
ccagguuuuggucagcucac

SEQ ID NO: 1696789 - RNA, 23 nt, Salmonella enterica enterica serovar Typhi
ccagguugcucagguuauacugu

SEQ ID NO: 1696790 - RNA, 13 nt, Salmonella enterica enterica serovar Typhi
ccaguaccgccgc

SEQ ID NO: 1696791 - RNA, 13 nt, Salmonella enterica enterica serovar Typhi
ccaguaccagcac

SEQ ID NO: 1696792 - RNA, 15 nt, Salmonella enterica enterica serovar Typhi
ccaguaauuuuuccg

SEQ ID NO: 1696793 - RNA, 23 nt, Salmonella enterica enterica serovar Typhi
ccaguaauuuuucucccagcaga

SEQ ID NO: 1696794 - RNA, 22 nt, Salmonella enterica enterica serovar Typhi
ccaguacaaacaaauaaaucca

SEQ ID NO: 1696795 - RNA, 22 nt, Salmonella enterica enterica serovar Typhi
ccaguacaauuucuggccccug

SEQ ID NO: 1696796 - RNA, 17 nt, Salmonella enterica enterica serovar Typhi
ccaguaaugccgugccg

SEQ ID NO: 1696797 - RNA, 15 nt, Salmonella enterica enterica serovar Typhi
ccaguaauucccccg

SEQ ID NO: 1696798 - RNA, 19 nt, Salmonella enterica enterica serovar Typhi
ccaguaauaucgccucccu

SEQ ID NO: 1696799 - RNA, 23 nt, Salmonella enterica enterica serovar Typhi
ccaguaauaucgccucccugccu

SEQ ID NO: 1696800 - RNA, 22 nt, Salmonella enterica enterica serovar Typhi
ccagucagcaauuaacaaauaa

SEQ ID NO: 1696801 - RNA, 21 nt, Salmonella enterica enterica serovar Typhi
ccagucaacgaggugaauaaa

SEQ ID NO: 1696802 - RNA, 17 nt, Salmonella enterica enterica serovar Typhi
ccagucaucauaauuca

SEQ ID NO: 1696803 - RNA, 18 nt, Salmonella enterica enterica serovar Typhi
ccagucaucauaauucag

SEQ ID NO: 1696804 - RNA, 19 nt, Salmonella enterica enterica serovar Typhi
ccagucaggcgaucccggc

SEQ ID NO: 1696805 - RNA, 20 nt, Salmonella enterica enterica serovar Typhi
ccagucaggcgaucccggcc

SEQ ID NO: 1696806 - RNA, 12 nt, Salmonella enterica enterica serovar Typhi
ccaguagcagcg

SEQ ID NO: 1696807 - RNA, 18 nt, Salmonella enterica enterica serovar Typhi
ccaguagcgcgacgccaa

SEQ ID NO: 1696808 - RNA, 14 nt, Salmonella enterica enterica serovar Typhi
ccaguagcgcgccc

SEQ ID NO: 1696809 - RNA, 18 nt, Salmonella enterica enterica serovar Typhi
ccaggugucguuaaugcu

SEQ ID NO: 1696810 - RNA, 12 nt, Salmonella enterica enterica serovar Typhi
ccagguucagca

SEQ ID NO: 1696811 - RNA, 18 nt, Salmonella enterica enterica serovar Typhi
ccagguuauucaggugga

SEQ ID NO: 1696812 - RNA, 14 nt, Salmonella enterica enterica serovar Typhi
ccaggugccgaggu

SEQ ID NO: 1696813 - RNA, 18 nt, Salmonella enterica enterica serovar Typhi
ccaggugacuuugcccuu

SEQ ID NO: 1696814 - RNA, 19 nt, Salmonella enterica enterica serovar Typhi
ccagguaacauacaaaaag

SEQ ID NO: 1696815 - RNA, 22 nt, Salmonella enterica enterica serovar Typhi
ccagguaacauacaaaaaguac

SEQ ID NO: 1696816 - RNA, 17 nt, Salmonella enterica enterica serovar Typhi
ccaggguucgcuggcca

SEQ ID NO: 1696817 - RNA, 21 nt, Salmonella enterica enterica serovar Typhi
ccaggguuuagccccagaccg

SEQ ID NO: 1696818 - RNA, 22 nt, Salmonella enterica enterica serovar Typhi
cggcgcgguauuucgccgccgc

SEQ ID NO: 1696819 - RNA, 13 nt, Salmonella enterica enterica serovar Typhi
cggcgcggcauca

SEQ ID NO: 1696820 - RNA, 19 nt, Salmonella enterica enterica serovar Typhi
cggcgcggauagucauaau

SEQ ID NO: 1696821 - RNA, 19 nt, Salmonella enterica enterica serovar Typhi
cggcgcguuuuggcagaca

SEQ ID NO: 1696822 - RNA, 22 nt, Salmonella enterica enterica serovar Typhi
cggcgcugcgcggcgugcagau

SEQ ID NO: 1696823 - RNA, 15 nt, Salmonella enterica enterica serovar Typhi
cggcgcuggcgcgcu

SEQ ID NO: 1696824 - RNA, 22 nt, Salmonella enterica enterica serovar Typhi
cggcgcugucacuccggcugca

SEQ ID NO: 1696825 - RNA, 13 nt, Salmonella enterica enterica serovar Typhi
cggcggaaaauag

SEQ ID NO: 1696826 - RNA, 12 nt, Salmonella enterica enterica serovar Typhi
cggcggaagcga

SEQ ID NO: 1696827 - RNA, 19 nt, Salmonella enterica enterica serovar Typhi
cggcggaaaauagccagaa

SEQ ID NO: 1696828 - RNA, 16 nt, Salmonella enterica enterica serovar Typhi
cggcgcuuccugcagu

SEQ ID NO: 1696829 - RNA, 15 nt, Salmonella enterica enterica serovar Typhi
cggcgcuucgcagcg

SEQ ID NO: 1696830 - RNA, 21 nt, Salmonella enterica enterica serovar Typhi
cggcggagacagaacaggaug

SEQ ID NO: 1696831 - RNA, 21 nt, Salmonella enterica enterica serovar Typhi
cggcggugcagguugccugau

SEQ ID NO: 1696832 - RNA, 15 nt, Salmonella enterica enterica serovar Typhi
cggcgguggccaguc

SEQ ID NO: 1696833 - RNA, 15 nt, Salmonella enterica enterica serovar Typhi
cggcguaaacgccuu

SEQ ID NO: 1696834 - RNA, 15 nt, Salmonella enterica enterica serovar Typhi
cggcguaacccagug

SEQ ID NO: 1696835 - RNA, 14 nt, Salmonella enterica enterica serovar Typhi
cggcggucagccag

SEQ ID NO: 1696836 - RNA, 17 nt, Salmonella enterica enterica serovar Typhi
cggcggguauggcaaug

SEQ ID NO: 1696837 - RNA, 20 nt, Salmonella enterica enterica serovar Typhi
cggcguaacggcugacgccc

SEQ ID NO: 1696838 - RNA, 17 nt, Salmonella enterica enterica serovar Typhi
cggcguaccgcgcgccc

SEQ ID NO: 1696839 - RNA, 13 nt, Salmonella enterica enterica serovar Typhi
cggcgaucaccac

SEQ ID NO: 1696840 - RNA, 22 nt, Salmonella enterica enterica serovar Typhi
cggcgcaggggcauuuuccggc

SEQ ID NO: 1696841 - RNA, 20 nt, Salmonella enterica enterica serovar Typhi
cggcgccaaucaccgccagc

SEQ ID NO: 1696842 - RNA, 13 nt, Salmonella enterica enterica serovar Typhi
cggcgcagcgacc

SEQ ID NO: 1696843 - RNA, 19 nt, Salmonella enterica enterica serovar Typhi
cggcgcagacacugccacc

SEQ ID NO: 1696844 - RNA, 14 nt, Salmonella enterica enterica serovar Typhi
cggcgcagacacug

SEQ ID NO: 1696845 - RNA, 24 nt, Salmonella enterica enterica serovar Typhi
cggcgcgccgcuggcgaccagccu

SEQ ID NO: 1696846 - RNA, 14 nt, Salmonella enterica enterica serovar Typhi
cggcgcgccggcaa

SEQ ID NO: 1696847 - RNA, 12 nt, Salmonella enterica enterica serovar Typhi
cggcgcgcgcgc

SEQ ID NO: 1696848 - RNA, 13 nt, Salmonella enterica enterica serovar Typhi
cggcgcgcguggc

SEQ ID NO: 1696849 - RNA, 16 nt, Salmonella enterica enterica serovar Typhi
cggcgcgcugccgccc

SEQ ID NO: 1696850 - RNA, 13 nt, Salmonella enterica enterica serovar Typhi
cggcgcggaaggg

SEQ ID NO: 1696851 - RNA, 23 nt, Salmonella enterica enterica serovar Typhi
cggcgcgaguguagucccgccgg

SEQ ID NO: 1696852 - RNA, 18 nt, Salmonella enterica enterica serovar Typhi
cggcgcgacuuuaaucac

SEQ ID NO: 1696853 - RNA, 14 nt, Salmonella enterica enterica serovar Typhi
cggcgcgacgccgc

SEQ ID NO: 1696854 - RNA, 10 nt, Salmonella enterica enterica serovar Typhi
cggcgcgcca

SEQ ID NO: 1696855 - RNA, 13 nt, Salmonella enterica enterica serovar Typhi
cggcgccggcgcg

SEQ ID NO: 1696856 - RNA, 21 nt, Salmonella enterica enterica serovar Typhi
cggcgccuuuaauuccgccgg

SEQ ID NO: 1696857 - RNA, 18 nt, Salmonella enterica enterica serovar Typhi
cggccugcaaaccgccuc

SEQ ID NO: 1696858 - RNA, 20 nt, Salmonella enterica enterica serovar Typhi
cggccugcaaaccgccucgc

SEQ ID NO: 1696859 - RNA, 23 nt, Salmonella enterica enterica serovar Typhi
cggccucuucacgcagcgccuua

SEQ ID NO: 1696860 - RNA, 20 nt, Salmonella enterica enterica serovar Typhi
cggcgaaaucgugcgcccca

SEQ ID NO: 1696861 - RNA, 15 nt, Salmonella enterica enterica serovar Typhi
cggcgaaagaagcgc

SEQ ID NO: 1696862 - RNA, 21 nt, Salmonella enterica enterica serovar Typhi
cggcgaaccggcaucggcagc

SEQ ID NO: 1696863 - RNA, 13 nt, Salmonella enterica enterica serovar Typhi
cggcgaccagcag

SEQ ID NO: 1696864 - RNA, 17 nt, Salmonella enterica enterica serovar Typhi
cggcgacugccgcagac

SEQ ID NO: 1696865 - RNA, 20 nt, Salmonella enterica enterica serovar Typhi
cggcgacgugacgcgccagc

SEQ ID NO: 1696866 - RNA, 15 nt, Salmonella enterica enterica serovar Typhi
cggccggaugccagu

SEQ ID NO: 1696867 - RNA, 17 nt, Salmonella enterica enterica serovar Typhi
cggccgcuuuucggcgc

SEQ ID NO: 1696868 - RNA, 15 nt, Salmonella enterica enterica serovar Typhi
cggccccagccugga

SEQ ID NO: 1696869 - RNA, 22 nt, Salmonella enterica enterica serovar Typhi
cggcccaggcaucgacgccagc

SEQ ID NO: 1696870 - RNA, 17 nt, Salmonella enterica enterica serovar Typhi
cggccgccaucgcaauc

SEQ ID NO: 1696871 - RNA, 17 nt, Salmonella enterica enterica serovar Typhi
cggcagugcggugguau

SEQ ID NO: 1696872 - RNA, 17 nt, Salmonella enterica enterica serovar Typhi
cggcaguugcuggcgcu

SEQ ID NO: 1696873 - RNA, 20 nt, Salmonella enterica enterica serovar Typhi
cggcaguguuucccaacaau

SEQ ID NO: 1696874 - RNA, 19 nt, Salmonella enterica enterica serovar Typhi
cggcauacugucgcgcggc

SEQ ID NO: 1696875 - RNA, 23 nt, Salmonella enterica enterica serovar Typhi
cggcaggugauggcggcuuggcu

SEQ ID NO: 1696876 - RNA, 11 nt, Salmonella enterica enterica serovar Typhi
cggcaggcugg

SEQ ID NO: 1696877 - RNA, 23 nt, Salmonella enterica enterica serovar Typhi
cggcagcucugccuguagcagcg

SEQ ID NO: 1696878 - RNA, 16 nt, Salmonella enterica enterica serovar Typhi
cggcagcucuuccaga

SEQ ID NO: 1696879 - RNA, 13 nt, Salmonella enterica enterica serovar Typhi
cggcagcgcgcac

SEQ ID NO: 1696880 - RNA, 19 nt, Salmonella enterica enterica serovar Typhi
cggcagcgcgacauagagc

SEQ ID NO: 1696881 - RNA, 20 nt, Salmonella enterica enterica serovar Typhi
cggcaggccggagcugauac

SEQ ID NO: 1696882 - RNA, 12 nt, Salmonella enterica enterica serovar Typhi
cggcaggcauuu

SEQ ID NO: 1696883 - RNA, 15 nt, Salmonella enterica enterica serovar Typhi
cggcaggcagcgcca

SEQ ID NO: 1696884 - RNA, 17 nt, Salmonella enterica enterica serovar Typhi
cggcaggcagcgccagc

SEQ ID NO: 1696885 - RNA, 23 nt, Salmonella enterica enterica serovar Typhi
cggcaggacaaucauaauaaacu

SEQ ID NO: 1696886 - RNA, 19 nt, Salmonella enterica enterica serovar Typhi
cggcagacgauagcgggug

SEQ ID NO: 1696887 - RNA, 15 nt, Salmonella enterica enterica serovar Typhi
cggcagacggcuggg

SEQ ID NO: 1696888 - RNA, 17 nt, Salmonella enterica enterica serovar Typhi
cggcagaccggcagccu

SEQ ID NO: 1696889 - RNA, 15 nt, Salmonella enterica enterica serovar Typhi
cggcagaccggcagc

SEQ ID NO: 1696890 - RNA, 12 nt, Salmonella enterica enterica serovar Typhi
cggcagaccgga

SEQ ID NO: 1696891 - RNA, 23 nt, Salmonella enterica enterica serovar Typhi
cggcagcgcauaagccacuucaa

SEQ ID NO: 1696892 - RNA, 13 nt, Salmonella enterica enterica serovar Typhi
cgcuugcauggca

SEQ ID NO: 1696893 - RNA, 13 nt, Salmonella enterica enterica serovar Typhi
cgcuugcgccgcc

SEQ ID NO: 1696894 - RNA, 15 nt, Salmonella enterica enterica serovar Typhi
cgcuugcgccgccau

SEQ ID NO: 1696895 - RNA, 14 nt, Salmonella enterica enterica serovar Typhi
cgcuugcuccgcag

SEQ ID NO: 1696896 - RNA, 17 nt, Salmonella enterica enterica serovar Typhi
cggcacgaaaaauaaaa

SEQ ID NO: 1696897 - RNA, 14 nt, Salmonella enterica enterica serovar Typhi
cggcaucucaucuu

SEQ ID NO: 1696898 - RNA, 20 nt, Salmonella enterica enterica serovar Typhi
cggcaucuuuaaccgccugc

SEQ ID NO: 1696899 - RNA, 14 nt, Salmonella enterica enterica serovar Typhi
cggcaucgccgccc

SEQ ID NO: 1696900 - RNA, 14 nt, Salmonella enterica enterica serovar Typhi
cggcaucaggaaaa

SEQ ID NO: 1696901 - RNA, 22 nt, Salmonella enterica enterica serovar Typhi
cggcaucaagcauaaaccggcg

SEQ ID NO: 1696902 - RNA, 13 nt, Salmonella enterica enterica serovar Typhi
cggcaucacgccg

SEQ ID NO: 1696903 - RNA, 15 nt, Salmonella enterica enterica serovar Typhi
cggcauccagcgcuc

SEQ ID NO: 1696904 - RNA, 16 nt, Salmonella enterica enterica serovar Typhi
cggcauaugcaggucg

SEQ ID NO: 1696905 - RNA, 11 nt, Salmonella enterica enterica serovar Typhi
cggcauagcug

SEQ ID NO: 1696906 - RNA, 11 nt, Salmonella enterica enterica serovar Typhi
cggcaucaagc

SEQ ID NO: 1696907 - RNA, 17 nt, Salmonella enterica enterica serovar Typhi
cggcauggaugcaugag

SEQ ID NO: 1696908 - RNA, 20 nt, Salmonella enterica enterica serovar Typhi
cggcauggguaaagcccauc

SEQ ID NO: 1696909 - RNA, 17 nt, Salmonella enterica enterica serovar Typhi
cggcauuaauacaggcc

SEQ ID NO: 1696910 - RNA, 16 nt, Salmonella enterica enterica serovar Typhi
cggcaugucgccagcc

SEQ ID NO: 1696911 - RNA, 16 nt, Salmonella enterica enterica serovar Typhi
cggcauuaauuucuug

SEQ ID NO: 1696912 - RNA, 18 nt, Salmonella enterica enterica serovar Typhi
cggcauguccggcgacuc

SEQ ID NO: 1696913 - RNA, 20 nt, Salmonella enterica enterica serovar Typhi
cggcauucacgucgcgcgcc

SEQ ID NO: 1696914 - RNA, 14 nt, Salmonella enterica enterica serovar Typhi
cggccaaagcgcga

SEQ ID NO: 1696915 - RNA, 18 nt, Salmonella enterica enterica serovar Typhi
cggcaugucgccagccag

SEQ ID NO: 1696916 - RNA, 17 nt, Salmonella enterica enterica serovar Typhi
cggcauuagcaugggcu

SEQ ID NO: 1696917 - RNA, 16 nt, Salmonella enterica enterica serovar Typhi
cggccaacgcgcccuc

SEQ ID NO: 1696918 - RNA, 22 nt, Salmonella enterica enterica serovar Typhi
cggccaaagcgcgacuggaacg

SEQ ID NO: 1696919 - RNA, 14 nt, Salmonella enterica enterica serovar Typhi
cggccaccaggccu

SEQ ID NO: 1696920 - RNA, 22 nt, Salmonella enterica enterica serovar Typhi
cggccaauccugcacccgccuu

SEQ ID NO: 1696921 - RNA, 22 nt, Salmonella enterica enterica serovar Typhi
cggccauggagagugagccacg

SEQ ID NO: 1696922 - RNA, 22 nt, Salmonella enterica enterica serovar Typhi
cggccauggaacauccucuccu

SEQ ID NO: 1696923 - RNA, 23 nt, Salmonella enterica enterica serovar Typhi
cggccacccauccccauauucca

SEQ ID NO: 1696924 - RNA, 14 nt, Salmonella enterica enterica serovar Typhi
cgccgaccaccagc

SEQ ID NO: 1696925 - RNA, 18 nt, Salmonella enterica enterica serovar Typhi
cgccgacaucgccaccgc

SEQ ID NO: 1696926 - RNA, 23 nt, Salmonella enterica enterica serovar Typhi
cgccgacaugguuaaccaccagc

SEQ ID NO: 1696927 - RNA, 14 nt, Salmonella enterica enterica serovar Typhi
cgccgacucacgca

SEQ ID NO: 1696928 - RNA, 15 nt, Salmonella enterica enterica serovar Typhi
cgccgaucagcacca

SEQ ID NO: 1696929 - RNA, 23 nt, Salmonella enterica enterica serovar Typhi
cgccgaucaucccgcccagcaac

SEQ ID NO: 1696930 - RNA, 15 nt, Salmonella enterica enterica serovar Typhi
cgccgauuccugcug

SEQ ID NO: 1696931 - RNA, 17 nt, Salmonella enterica enterica serovar Typhi
cgccgcaaaccagacca

SEQ ID NO: 1696932 - RNA, 17 nt, Salmonella enterica enterica serovar Typhi
cgccgcacacagcagaa

SEQ ID NO: 1696933 - RNA, 22 nt, Salmonella enterica enterica serovar Typhi
cgccgauugagggggaggcggc

SEQ ID NO: 1696934 - RNA, 17 nt, Salmonella enterica enterica serovar Typhi
cgccgcaaugccgccug

SEQ ID NO: 1696935 - RNA, 15 nt, Salmonella enterica enterica serovar Typhi
cgccgcaacgcgcac

SEQ ID NO: 1696936 - RNA, 14 nt, Salmonella enterica enterica serovar Typhi
cgccgccaggucuu

SEQ ID NO: 1696937 - RNA, 15 nt, Salmonella enterica enterica serovar Typhi
cgccgccgaacagac

SEQ ID NO: 1696938 - RNA, 20 nt, Salmonella enterica enterica serovar Typhi
cgccgccaggauaauaauga

SEQ ID NO: 1696939 - RNA, 12 nt, Salmonella enterica enterica serovar Typhi
cgccgccagcac

SEQ ID NO: 1696940 - RNA, 20 nt, Salmonella enterica enterica serovar Typhi
cgccgccagauagccgcgcu

SEQ ID NO: 1696941 - RNA, 15 nt, Salmonella enterica enterica serovar Typhi
cgcccuugccgcuuc

SEQ ID NO: 1696942 - RNA, 16 nt, Salmonella enterica enterica serovar Typhi
cgcccuucgucaggag

SEQ ID NO: 1696943 - RNA, 15 nt, Salmonella enterica enterica serovar Typhi
cgcccugcggacagg

SEQ ID NO: 1696944 - RNA, 18 nt, Salmonella enterica enterica serovar Typhi
cgcccgcucgcgauccuc

SEQ ID NO: 1696945 - RNA, 14 nt, Salmonella enterica enterica serovar Typhi
cgcccggcgccagc

SEQ ID NO: 1696946 - RNA, 18 nt, Salmonella enterica enterica serovar Typhi
cgcccggcgcgcuggagg

SEQ ID NO: 1696947 - RNA, 13 nt, Salmonella enterica enterica serovar Typhi
cgcccggcgggua

SEQ ID NO: 1696948 - RNA, 13 nt, Salmonella enterica enterica serovar Typhi
cgcccgguuuugu

SEQ ID NO: 1696949 - RNA, 22 nt, Salmonella enterica enterica serovar Typhi
cgcccgguugcaauuccgccau

SEQ ID NO: 1696950 - RNA, 23 nt, Salmonella enterica enterica serovar Typhi
cgcccugaggaguauuauccauu

SEQ ID NO: 1696951 - RNA, 14 nt, Salmonella enterica enterica serovar Typhi
cgcccugacgccgc

SEQ ID NO: 1696952 - RNA, 15 nt, Salmonella enterica enterica serovar Typhi
cgcccugacgccgcu

SEQ ID NO: 1696953 - RNA, 21 nt, Salmonella enterica enterica serovar Typhi
cgcccugccauucccagccga

SEQ ID NO: 1696954 - RNA, 18 nt, Salmonella enterica enterica serovar Typhi
cgcccguaccgcggcgcu

SEQ ID NO: 1696955 - RNA, 14 nt, Salmonella enterica enterica serovar Typhi
cgcccaucgccaca

SEQ ID NO: 1696956 - RNA, 15 nt, Salmonella enterica enterica serovar Typhi
cgcccaucgccacag

SEQ ID NO: 1696957 - RNA, 14 nt, Salmonella enterica enterica serovar Typhi
cgcccaucgccuga

SEQ ID NO: 1696958 - RNA, 16 nt, Salmonella enterica enterica serovar Typhi
cgcccaucgccacagc

SEQ ID NO: 1696959 - RNA, 16 nt, Salmonella enterica enterica serovar Typhi
cgcccaucaacaccag

SEQ ID NO: 1696960 - RNA, 12 nt, Salmonella enterica enterica serovar Typhi
cgcccaggccug

SEQ ID NO: 1696961 - RNA, 15 nt, Salmonella enterica enterica serovar Typhi
cgcccaucuccagcc

SEQ ID NO: 1696962 - RNA, 20 nt, Salmonella enterica enterica serovar Typhi
cgcccauggaugcgccgccc

SEQ ID NO: 1696963 - RNA, 15 nt, Salmonella enterica enterica serovar Typhi
cgcccaugcggcuga

SEQ ID NO: 1696964 - RNA, 18 nt, Salmonella enterica enterica serovar Typhi
cgcccagauauccgcgcu

SEQ ID NO: 1696965 - RNA, 17 nt, Salmonella enterica enterica serovar Typhi
cgcccagauauccgcgc

SEQ ID NO: 1696966 - RNA, 16 nt, Salmonella enterica enterica serovar Typhi
cgcccagaucgaccuc

SEQ ID NO: 1696967 - RNA, 12 nt, Salmonella enterica enterica serovar Typhi
cgcccagcgccg

SEQ ID NO: 1696968 - RNA, 21 nt, Salmonella enterica enterica serovar Typhi
cgccccggcgagugccugcug

SEQ ID NO: 1696969 - RNA, 22 nt, Salmonella enterica enterica serovar Typhi
cgccccaguaacgugccccaga

SEQ ID NO: 1696970 - RNA, 22 nt, Salmonella enterica enterica serovar Typhi
cgcccccaugccgccugccgcg

SEQ ID NO: 1696971 - RNA, 12 nt, Salmonella enterica enterica serovar Typhi
cgcccgcggcga

SEQ ID NO: 1696972 - RNA, 23 nt, Salmonella enterica enterica serovar Typhi
cgcccgcgauaaaaauccugcuc

SEQ ID NO: 1696973 - RNA, 18 nt, Salmonella enterica enterica serovar Typhi
cgccauuugccagauagc

SEQ ID NO: 1696974 - RNA, 20 nt, Salmonella enterica enterica serovar Typhi
cgccauuuuauccaggccag

SEQ ID NO: 1696975 - RNA, 13 nt, Salmonella enterica enterica serovar Typhi
cgccauuuccagc

SEQ ID NO: 1696976 - RNA, 16 nt, Salmonella enterica enterica serovar Typhi
cgccauuuccagcccc

SEQ ID NO: 1696977 - RNA, 22 nt, Salmonella enterica enterica serovar Typhi
cgccauuggcaaucaguacgcg

SEQ ID NO: 1696978 - RNA, 23 nt, Salmonella enterica enterica serovar Typhi
cgccauuggcucggcgucauccc

SEQ ID NO: 1696979 - RNA, 16 nt, Salmonella enterica enterica serovar Typhi
cgccauuuagcgccga

SEQ ID NO: 1696980 - RNA, 21 nt, Salmonella enterica enterica serovar Typhi
cgccauugaucauuggggaac

SEQ ID NO: 1696981 - RNA, 14 nt, Salmonella enterica enterica serovar Typhi
cgcccacgcggcgu

SEQ ID NO: 1696982 - RNA, 19 nt, Salmonella enterica enterica serovar Typhi
cgcccacgcggcgugcgcu

SEQ ID NO: 1696983 - RNA, 17 nt, Salmonella enterica enterica serovar Typhi
cgcccacaaugacagaa

SEQ ID NO: 1696984 - RNA, 14 nt, Salmonella enterica enterica serovar Typhi
cgcccacgccgcgc

SEQ ID NO: 1696985 - RNA, 18 nt, Salmonella enterica enterica serovar Typhi
cgcccaaccagcccaggu

SEQ ID NO: 1696986 - RNA, 14 nt, Salmonella enterica enterica serovar Typhi
cgcccaaccagccc

SEQ ID NO: 1696987 - RNA, 18 nt, Salmonella enterica enterica serovar Typhi
cgccaucaggcauggcag

SEQ ID NO: 1696988 - RNA, 14 nt, Salmonella enterica enterica serovar Typhi
cgccaucaggcaug

SEQ ID NO: 1696989 - RNA, 20 nt, Salmonella enterica enterica serovar Typhi
cgccaucaggcaugccaaac

SEQ ID NO: 1696990 - RNA, 22 nt, Salmonella enterica enterica serovar Typhi
cgccaucaggcaauucggcccu

SEQ ID NO: 1696991 - RNA, 18 nt, Salmonella enterica enterica serovar Typhi
cgccaucaacuccuccgg

SEQ ID NO: 1696992 - RNA, 18 nt, Salmonella enterica enterica serovar Typhi
cgccauaucuucgcgcgu

SEQ ID NO: 1696993 - RNA, 13 nt, Salmonella enterica enterica serovar Typhi
cgccauaucggca

SEQ ID NO: 1696994 - RNA, 17 nt, Salmonella enterica enterica serovar Typhi
cgccaucaccaggucaa

SEQ ID NO: 1696995 - RNA, 13 nt, Salmonella enterica enterica serovar Typhi
cgccauccugccg

SEQ ID NO: 1696996 - RNA, 14 nt, Salmonella enterica enterica serovar Typhi
cgccaucggcgagc

SEQ ID NO: 1696997 - RNA, 14 nt, Salmonella enterica enterica serovar Typhi
cgccaucgcggcgc

SEQ ID NO: 1696998 - RNA, 17 nt, Salmonella enterica enterica serovar Typhi
cgccaucgccgccucgc

SEQ ID NO: 1696999 - RNA, 19 nt, Salmonella enterica enterica serovar Typhi
cgccaucgccgccucgcgu

SEQ ID NO: 1697000 - RNA, 19 nt, Salmonella enterica enterica serovar Typhi
cgccauccggcacggucaa

SEQ ID NO: 1697001 - RNA, 13 nt, Salmonella enterica enterica serovar Typhi
cgccauccggcau

SEQ ID NO: 1697002 - RNA, 23 nt, Salmonella enterica enterica serovar Typhi
cgccauccggcggugcagguugc

SEQ ID NO: 1697003 - RNA, 17 nt, Salmonella enterica enterica serovar Typhi
cgccauccggcauuuuu

SEQ ID NO: 1697004 - RNA, 11 nt, Salmonella enterica enterica serovar Typhi
cgccauaauac

SEQ ID NO: 1697005 - RNA, 18 nt, Salmonella enterica enterica serovar Typhi
cgccauaaaucagaucca

SEQ ID NO: 1697006 - RNA, 15 nt, Salmonella enterica enterica serovar Typhi
cgccauaaagcugua

SEQ ID NO: 1697007 - RNA, 22 nt, Salmonella enterica enterica serovar Typhi
cgccauaaaaagcguacaaaaa

SEQ ID NO: 1697008 - RNA, 16 nt, Salmonella enterica enterica serovar Typhi
cgccaguuuuuauacu

SEQ ID NO: 1697009 - RNA, 14 nt, Salmonella enterica enterica serovar Typhi
cgccauauacgcca

SEQ ID NO: 1697010 - RNA, 20 nt, Salmonella enterica enterica serovar Typhi
cgccauauaggcauguuccu

SEQ ID NO: 1697011 - RNA, 15 nt, Salmonella enterica enterica serovar Typhi
cgccauauccaagcc

SEQ ID NO: 1697012 - RNA, 19 nt, Salmonella enterica enterica serovar Typhi
cgccauagaaauagccccg

SEQ ID NO: 1697013 - RNA, 19 nt, Salmonella enterica enterica serovar Typhi
cgccaguuugguuaauucc

SEQ ID NO: 1697014 - RNA, 16 nt, Salmonella enterica enterica serovar Typhi
cgccaguucccacagc

SEQ ID NO: 1697015 - RNA, 11 nt, Salmonella enterica enterica serovar Typhi
cgccagugaca

SEQ ID NO: 1697016 - RNA, 17 nt, Salmonella enterica enterica serovar Typhi
cgccagugaugccaaac

SEQ ID NO: 1697017 - RNA, 14 nt, Salmonella enterica enterica serovar Typhi
cgccagugcgcaua

SEQ ID NO: 1697018 - RNA, 19 nt, Salmonella enterica enterica serovar Typhi
cgccagguuuuacgugccg

SEQ ID NO: 1697019 - RNA, 21 nt, Salmonella enterica enterica serovar Typhi
cgccaggucucauagcgcccc

SEQ ID NO: 1697020 - RNA, 22 nt, Salmonella enterica enterica serovar Typhi
cgccagggcgggauccccugcu

SEQ ID NO: 1697021 - RNA, 16 nt, Salmonella enterica enterica serovar Typhi
cgccagggcuucugcu

SEQ ID NO: 1697022 - RNA, 12 nt, Salmonella enterica enterica serovar Typhi
cgccagggcggc

SEQ ID NO: 1697023 - RNA, 18 nt, Salmonella enterica enterica serovar Typhi
cgccagcgguguuugcca

SEQ ID NO: 1697024 - RNA, 19 nt, Salmonella enterica enterica serovar Typhi
cgccagcggcgacaguaac

SEQ ID NO: 1697025 - RNA, 12 nt, Salmonella enterica enterica serovar Typhi
cgccagcggcgc

SEQ ID NO: 1697026 - RNA, 23 nt, Salmonella enterica enterica serovar Typhi
cgccagcgcgguuucuacaccuu

SEQ ID NO: 1697027 - RNA, 22 nt, Salmonella enterica enterica serovar Typhi
cgccagcggccagcguaccugc

SEQ ID NO: 1697028 - RNA, 15 nt, Salmonella enterica enterica serovar Typhi
cgccagcgcgguggc

SEQ ID NO: 1697029 - RNA, 15 nt, Salmonella enterica enterica serovar Typhi
cgccagccgcgccau

SEQ ID NO: 1697030 - RNA, 19 nt, Salmonella enterica enterica serovar Typhi
cgccagccgcgccaucucc

SEQ ID NO: 1697031 - RNA, 16 nt, Salmonella enterica enterica serovar Typhi
cgccagcgccagcagc

SEQ ID NO: 1697032 - RNA, 15 nt, Salmonella enterica enterica serovar Typhi
cgccagcgagaugaa

SEQ ID NO: 1697033 - RNA, 20 nt, Salmonella enterica enterica serovar Typhi
cgccagcgacgguaauacca

SEQ ID NO: 1697034 - RNA, 16 nt, Salmonella enterica enterica serovar Typhi
cgccagcgccaccugc

SEQ ID NO: 1697035 - RNA, 21 nt, Salmonella enterica enterica serovar Typhi
cgccagcucaugcgcggcggg

SEQ ID NO: 1697036 - RNA, 13 nt, Salmonella enterica enterica serovar Typhi
cgccagcucaugc

SEQ ID NO: 1697037 - RNA, 12 nt, Salmonella enterica enterica serovar Typhi
cgccagcucugc

SEQ ID NO: 1697038 - RNA, 16 nt, Salmonella enterica enterica serovar Typhi
cgccagcugcgcgcua

SEQ ID NO: 1697039 - RNA, 15 nt, Salmonella enterica enterica serovar Typhi
cgccagcugcgcgcu

SEQ ID NO: 1697040 - RNA, 18 nt, Salmonella enterica enterica serovar Typhi
cgccagcgugcuuaaucc

SEQ ID NO: 1697041 - RNA, 18 nt, Salmonella enterica enterica serovar Typhi
cgccagcuaauuuuacuu

SEQ ID NO: 1697042 - RNA, 14 nt, Salmonella enterica enterica serovar Typhi
cgccagcguugacc

SEQ ID NO: 1697043 - RNA, 19 nt, Salmonella enterica enterica serovar Typhi
cgccaggcauguuaugaau

SEQ ID NO: 1697044 - RNA, 11 nt, Salmonella enterica enterica serovar Typhi
cgccaggccau

SEQ ID NO: 1697045 - RNA, 20 nt, Salmonella enterica enterica serovar Typhi
cgccaggaucgccgccgcga

SEQ ID NO: 1697046 - RNA, 18 nt, Salmonella enterica enterica serovar Typhi
cgcauccggcaaaacgaa

SEQ ID NO: 1697047 - RNA, 14 nt, Salmonella enterica enterica serovar Typhi
cgcauccggcauca

SEQ ID NO: 1697048 - RNA, 14 nt, Salmonella enterica enterica serovar Typhi
cgccaccagcgcag

SEQ ID NO: 1697049 - RNA, 21 nt, Salmonella enterica enterica serovar Typhi
cgccaccaucgucgccagacc

SEQ ID NO: 1697050 - RNA, 17 nt, Salmonella enterica enterica serovar Typhi
cgccaccauccggcgcu

SEQ ID NO: 1697051 - RNA, 19 nt, Salmonella enterica enterica serovar Typhi
cgccacucuggcgacgcca

SEQ ID NO: 1697052 - RNA, 13 nt, Salmonella enterica enterica serovar Typhi
cgccacuuccagc

SEQ ID NO: 1697053 - RNA, 15 nt, Salmonella enterica enterica serovar Typhi
cgccacuuccagcgc

SEQ ID NO: 1697054 - RNA, 20 nt, Salmonella enterica enterica serovar Typhi
cgccacuuccagcgcgccgu

SEQ ID NO: 1697055 - RNA, 17 nt, Salmonella enterica enterica serovar Typhi
cgccaccuuucugcucc

SEQ ID NO: 1697056 - RNA, 14 nt, Salmonella enterica enterica serovar Typhi
cgccacccaacauc

SEQ ID NO: 1697057 - RNA, 15 nt, Salmonella enterica enterica serovar Typhi
cgccacgccaccggg

SEQ ID NO: 1697058 - RNA, 19 nt, Salmonella enterica enterica serovar Typhi
cgccacgcccaacauaaac

SEQ ID NO: 1697059 - RNA, 14 nt, Salmonella enterica enterica serovar Typhi
cgccacggcuuuca

SEQ ID NO: 1697060 - RNA, 21 nt, Salmonella enterica enterica serovar Typhi
cgccagccagcgccaccaaag

SEQ ID NO: 1697061 - RNA, 17 nt, Salmonella enterica enterica serovar Typhi
cgccagccagucgccag

SEQ ID NO: 1697062 - RNA, 21 nt, Salmonella enterica enterica serovar Typhi
cgccagccacaagagcagcaa

SEQ ID NO: 1697063 - RNA, 16 nt, Salmonella enterica enterica serovar Typhi
cgccagcaccaggcuc

SEQ ID NO: 1697064 - RNA, 15 nt, Salmonella enterica enterica serovar Typhi
cgccagcaccagcag

SEQ ID NO: 1697065 - RNA, 14 nt, Salmonella enterica enterica serovar Typhi
cgccagcaccacgu

SEQ ID NO: 1697066 - RNA, 15 nt, Salmonella enterica enterica serovar Typhi
cgccagcagcucgcc

SEQ ID NO: 1697067 - RNA, 17 nt, Salmonella enterica enterica serovar Typhi
cgccagcauaccgccca

SEQ ID NO: 1697068 - RNA, 22 nt, Salmonella enterica enterica serovar Typhi
cgccagcauaugcacacgcagc

SEQ ID NO: 1697069 - RNA, 16 nt, Salmonella enterica enterica serovar Typhi
cgccagcaguugcagc

SEQ ID NO: 1697070 - RNA, 20 nt, Salmonella enterica enterica serovar Typhi
cgccagcaaugccgccgcca

SEQ ID NO: 1697071 - RNA, 21 nt, Salmonella enterica enterica serovar Typhi
cgccagcaaugccgccgccag

SEQ ID NO: 1697072 - RNA, 23 nt, Salmonella enterica enterica serovar Typhi
cgccagcaacgagcuuuuuucuu

SEQ ID NO: 1697073 - RNA, 16 nt, Salmonella enterica enterica serovar Typhi
cgccagaugucggcgg

SEQ ID NO: 1697074 - RNA, 17 nt, Salmonella enterica enterica serovar Typhi
cgccagauucaugauuu

SEQ ID NO: 1697075 - RNA, 16 nt, Salmonella enterica enterica serovar Typhi
cgccagauccggcagc

SEQ ID NO: 1697076 - RNA, 15 nt, Salmonella enterica enterica serovar Typhi
cgccagauacacgcc

SEQ ID NO: 1697077 - RNA, 16 nt, Salmonella enterica enterica serovar Typhi
cgccagauaaaucagc

SEQ ID NO: 1697078 - RNA, 19 nt, Salmonella enterica enterica serovar Typhi
cgccagauaaucgccgcca

SEQ ID NO: 1697079 - RNA, 14 nt, Salmonella enterica enterica serovar Typhi
cgccagaggcgugc

SEQ ID NO: 1697080 - RNA, 21 nt, Salmonella enterica enterica serovar Typhi
cgccagaggcgugcaugggca

SEQ ID NO: 1697081 - RNA, 22 nt, Salmonella enterica enterica serovar Typhi
cgccagaggcgugcaugggcag

SEQ ID NO: 1697082 - RNA, 23 nt, Salmonella enterica enterica serovar Typhi
cgccagaucgaacagcggcaggc

SEQ ID NO: 1697083 - RNA, 14 nt, Salmonella enterica enterica serovar Typhi
cgccagauuaucca

SEQ ID NO: 1697084 - RNA, 22 nt, Salmonella enterica enterica serovar Typhi
cgccagacacuggaaacagcca

SEQ ID NO: 1697085 - RNA, 16 nt, Salmonella enterica enterica serovar Typhi
cgccagaauagcgcag

SEQ ID NO: 1697086 - RNA, 23 nt, Salmonella enterica enterica serovar Typhi
cgccagacacuggaaacagccaa

SEQ ID NO: 1697087 - RNA, 14 nt, Salmonella enterica enterica serovar Typhi
cgccagacccagcg

SEQ ID NO: 1697088 - RNA, 15 nt, Salmonella enterica enterica serovar Typhi
cgccagacccagcgc

SEQ ID NO: 1697089 - RNA, 23 nt, Salmonella enterica enterica serovar Typhi
cgccagacccacuaacugccgcu

SEQ ID NO: 1697090 - RNA, 18 nt, Salmonella enterica enterica serovar Typhi
cgccagaccgacgccaac

SEQ ID NO: 1697091 - RNA, 21 nt, Salmonella enterica enterica serovar Typhi
cgccagagcacgaaaagugug

SEQ ID NO: 1697092 - RNA, 15 nt, Salmonella enterica enterica serovar Typhi
cgcagcaaacgccau

SEQ ID NO: 1697093 - RNA, 15 nt, Salmonella enterica enterica serovar Typhi
cgcagagcccagcgc

SEQ ID NO: 1697094 - RNA, 15 nt, Salmonella enterica enterica serovar Typhi
cgcagcaagaacaga

SEQ ID NO: 1697095 - RNA, 16 nt, Salmonella enterica enterica serovar Typhi
cgcagagcccagcgcg

SEQ ID NO: 1697096 - RNA, 14 nt, Salmonella enterica enterica serovar Typhi
cgcagacaguggcc

SEQ ID NO: 1697097 - RNA, 16 nt, Salmonella enterica enterica serovar Typhi
cgcagaccgcgcucca

SEQ ID NO: 1697098 - RNA, 18 nt, Salmonella enterica enterica serovar Typhi
cgcacugauagccgccag

SEQ ID NO: 1697099 - RNA, 22 nt, Salmonella enterica enterica serovar Typhi
cgcacggcgcguccucacacug

SEQ ID NO: 1697100 - RNA, 17 nt, Salmonella enterica enterica serovar Typhi
cgcaccgcgaugcugcu

SEQ ID NO: 1697101 - RNA, 19 nt, Salmonella enterica enterica serovar Typhi
cgcaaucucgcaagauucc

SEQ ID NO: 1697102 - RNA, 18 nt, Salmonella enterica enterica serovar Typhi
cgcaaucuccgccgcuuu

SEQ ID NO: 1697103 - RNA, 16 nt, Salmonella enterica enterica serovar Typhi
cgcaaugccaccacac

SEQ ID NO: 1697104 - RNA, 18 nt, Salmonella enterica enterica serovar Typhi
cgcaauguggacaaucag

SEQ ID NO: 1697105 - RNA, 13 nt, Salmonella enterica enterica serovar Typhi
cgcaauuaauuua

SEQ ID NO: 1697106 - RNA, 14 nt, Salmonella enterica enterica serovar Typhi
cgcacccgcgcagg

SEQ ID NO: 1697107 - RNA, 17 nt, Salmonella enterica enterica serovar Typhi
cgcaccaguuccccaua

SEQ ID NO: 1697108 - RNA, 19 nt, Salmonella enterica enterica serovar Typhi
cgcaauacagcccgccagc

SEQ ID NO: 1697109 - RNA, 18 nt, Salmonella enterica enterica serovar Typhi
cgcaauagggggugacau

SEQ ID NO: 1697110 - RNA, 22 nt, Salmonella enterica enterica serovar Typhi
cgcaaggcggcguuuuuuuauc

SEQ ID NO: 1697111 - RNA, 13 nt, Salmonella enterica enterica serovar Typhi
cgcaagcagcaca

SEQ ID NO: 1697112 - RNA, 18 nt, Salmonella enterica enterica serovar Typhi
cgauuucauuacgccugu

SEQ ID NO: 1697113 - RNA, 21 nt, Salmonella enterica enterica serovar Typhi
cgcagcgaacucccgggcgcu

SEQ ID NO: 1697114 - RNA, 22 nt, Salmonella enterica enterica serovar Typhi
cgcagcgaccuccgcgcagcaa

SEQ ID NO: 1697115 - RNA, 15 nt, Salmonella enterica enterica serovar Typhi
cgcagcgauauuucu

SEQ ID NO: 1697116 - RNA, 15 nt, Salmonella enterica enterica serovar Typhi
cgcagcgcaacgccu

SEQ ID NO: 1697117 - RNA, 13 nt, Salmonella enterica enterica serovar Typhi
cgcagcgcggccu

SEQ ID NO: 1697118 - RNA, 19 nt, Salmonella enterica enterica serovar Typhi
cgcagcgccauccggcaaa

SEQ ID NO: 1697119 - RNA, 18 nt, Salmonella enterica enterica serovar Typhi
cgcagcgcauccaccaga

SEQ ID NO: 1697120 - RNA, 18 nt, Salmonella enterica enterica serovar Typhi
cgcagcgccaucaggccc

SEQ ID NO: 1697121 - RNA, 23 nt, Salmonella enterica enterica serovar Typhi
cgcagcgcuuugccgcugcugcc

SEQ ID NO: 1697122 - RNA, 11 nt, Salmonella enterica enterica serovar Typhi
cgcagccagaa

SEQ ID NO: 1697123 - RNA, 17 nt, Salmonella enterica enterica serovar Typhi
cgcagccagaacagaag

SEQ ID NO: 1697124 - RNA, 20 nt, Salmonella enterica enterica serovar Typhi
cgcagcagauguggcggccc

SEQ ID NO: 1697125 - RNA, 14 nt, Salmonella enterica enterica serovar Typhi
cgcagugaccagca

SEQ ID NO: 1697126 - RNA, 16 nt, Salmonella enterica enterica serovar Typhi
cgcaguaaacuccucu

SEQ ID NO: 1697127 - RNA, 18 nt, Salmonella enterica enterica serovar Typhi
cgcaguaauacgccgccg

SEQ ID NO: 1697128 - RNA, 15 nt, Salmonella enterica enterica serovar Typhi
aaacgguaugaaaca

SEQ ID NO: 1697129 - RNA, 15 nt, Salmonella enterica enterica serovar Typhi
cgcagguaaaaucca

SEQ ID NO: 1697130 - RNA, 15 nt, Salmonella enterica enterica serovar Typhi
cgcagcuucgccgcg

SEQ ID NO: 1697131 - RNA, 15 nt, Salmonella enterica enterica serovar Typhi
cgcagcugggccugc

SEQ ID NO: 1697132 - RNA, 22 nt, Salmonella enterica enterica serovar Typhi
cgcagcugccacaccacaugcg

SEQ ID NO: 1697133 - RNA, 19 nt, Salmonella enterica enterica serovar Typhi
cgcagcugccacaccacau

SEQ ID NO: 1697134 - RNA, 17 nt, Salmonella enterica enterica serovar Typhi
cgauaggugacuuuccu

SEQ ID NO: 1697135 - RNA, 23 nt, Salmonella enterica enterica serovar Typhi
cgauauaccacccgcuaugaaga

SEQ ID NO: 1697136 - RNA, 17 nt, Salmonella enterica enterica serovar Typhi
cgauauaauuuuauuau

SEQ ID NO: 1697137 - RNA, 19 nt, Salmonella enterica enterica serovar Typhi
cgauauaauuuuauuauau

SEQ ID NO: 1697138 - RNA, 16 nt, Salmonella enterica enterica serovar Typhi
cgauaucgauaaucaa

SEQ ID NO: 1697139 - RNA, 16 nt, Salmonella enterica enterica serovar Typhi
cgauaucauucucuac

SEQ ID NO: 1697140 - RNA, 19 nt, Salmonella enterica enterica serovar Typhi
cgauacccgcccagaucag

SEQ ID NO: 1697141 - RNA, 13 nt, Salmonella enterica enterica serovar Typhi
cgauacccgcgau

SEQ ID NO: 1697142 - RNA, 17 nt, Salmonella enterica enterica serovar Typhi
cgauacgccccugcugg

SEQ ID NO: 1697143 - RNA, 13 nt, Salmonella enterica enterica serovar Typhi
cgauacuaaaacu

SEQ ID NO: 1697144 - RNA, 15 nt, Salmonella enterica enterica serovar Typhi
cgauacccaccagcg

SEQ ID NO: 1697145 - RNA, 18 nt, Salmonella enterica enterica serovar Typhi
cgauaauacagccugcgu

SEQ ID NO: 1697146 - RNA, 14 nt, Salmonella enterica enterica serovar Typhi
cgauaccaguaaua

SEQ ID NO: 1697147 - RNA, 19 nt, Salmonella enterica enterica serovar Typhi
cgauaaggauaucuugaug

SEQ ID NO: 1697148 - RNA, 20 nt, Salmonella enterica enterica serovar Typhi
cgauaaggucgcuauccagc

SEQ ID NO: 1697149 - RNA, 18 nt, Salmonella enterica enterica serovar Typhi
cgauaauaauuaccacgc

SEQ ID NO: 1697150 - RNA, 13 nt, Salmonella enterica enterica serovar Typhi
cgauaagcgcugu

SEQ ID NO: 1697151 - RNA, 19 nt, Salmonella enterica enterica serovar Typhi
cgauaacguuaccgcagcg

SEQ ID NO: 1697152 - RNA, 13 nt, Salmonella enterica enterica serovar Typhi
cgacgucaauaaa

SEQ ID NO: 1697153 - RNA, 16 nt, Salmonella enterica enterica serovar Typhi
cgaucgcuaaucagga

SEQ ID NO: 1697154 - RNA, 18 nt, Salmonella enterica enterica serovar Typhi
cgaucgcucaacuccugc

SEQ ID NO: 1697155 - RNA, 23 nt, Salmonella enterica enterica serovar Typhi
cgaucgcuggacgucgucaccac

SEQ ID NO: 1697156 - RNA, 21 nt, Salmonella enterica enterica serovar Typhi
cgauccggcauccaaccgaac

SEQ ID NO: 1697157 - RNA, 19 nt, Salmonella enterica enterica serovar Typhi
cgaucccgggcgauaaacc

SEQ ID NO: 1697158 - RNA, 12 nt, Salmonella enterica enterica serovar Typhi
cgaucagcgcca

SEQ ID NO: 1697159 - RNA, 15 nt, Salmonella enterica enterica serovar Typhi
cgaucagcgccacca

SEQ ID NO: 1697160 - RNA, 13 nt, Salmonella enterica enterica serovar Typhi
cgauccaggucuu

SEQ ID NO: 1697161 - RNA, 22 nt, Salmonella enterica enterica serovar Typhi
cgaucaucauuccgagggugga

SEQ ID NO: 1697162 - RNA, 20 nt, Salmonella enterica enterica serovar Typhi
cgaugagcgcgaaaucaaag

SEQ ID NO: 1697163 - RNA, 17 nt, Salmonella enterica enterica serovar Typhi
cgaugacgacuuuuugc

SEQ ID NO: 1697164 - RNA, 22 nt, Salmonella enterica enterica serovar Typhi
cgaugaaagagcgcgcgcgccu

SEQ ID NO: 1697165 - RNA, 15 nt, Salmonella enterica enterica serovar Typhi
cgaugaaaaacugga

SEQ ID NO: 1697166 - RNA, 15 nt, Salmonella enterica enterica serovar Typhi
cgaucguccgccucc

SEQ ID NO: 1697167 - RNA, 16 nt, Salmonella enterica enterica serovar Typhi
cgaucuccaucuccag

SEQ ID NO: 1697168 - RNA, 14 nt, Salmonella enterica enterica serovar Typhi
cgaucucccagccg

SEQ ID NO: 1697169 - RNA, 17 nt, Salmonella enterica enterica serovar Typhi
cgaucuacgguaucugc

SEQ ID NO: 1697170 - RNA, 12 nt, Salmonella enterica enterica serovar Typhi
cgaucuauuuca

SEQ ID NO: 1697171 - RNA, 18 nt, Salmonella enterica enterica serovar Typhi
cgaucuauuucauaauaa

SEQ ID NO: 1697172 - RNA, 23 nt, Salmonella enterica enterica serovar Typhi
cgaucguaaucacccgcuuccag

SEQ ID NO: 1697173 - RNA, 16 nt, Salmonella enterica enterica serovar Typhi
cgaucuccgccgucgu

SEQ ID NO: 1697174 - RNA, 17 nt, Salmonella enterica enterica serovar Typhi
cgauuaaugcuccaaua

SEQ ID NO: 1697175 - RNA, 21 nt, Salmonella enterica enterica serovar Typhi
cgauuaaugcuccaauaaaua

SEQ ID NO: 1697176 - RNA, 22 nt, Salmonella enterica enterica serovar Typhi
cgauuaaugcuccaauaaauau

SEQ ID NO: 1697177 - RNA, 16 nt, Salmonella enterica enterica serovar Typhi
cgauuaacgcauguuc

SEQ ID NO: 1697178 - RNA, 13 nt, Salmonella enterica enterica serovar Typhi
cgauuccccacca

SEQ ID NO: 1697179 - RNA, 16 nt, Salmonella enterica enterica serovar Typhi
cgauucccgaucuuca

SEQ ID NO: 1697180 - RNA, 17 nt, Salmonella enterica enterica serovar Typhi
cgauuccgugucugaau

SEQ ID NO: 1697181 - RNA, 21 nt, Salmonella enterica enterica serovar Typhi
cgauuuaccucucaccaguag

SEQ ID NO: 1697182 - RNA, 18 nt, Salmonella enterica enterica serovar Typhi
cgauguauuuauccacgc

SEQ ID NO: 1697183 - RNA, 16 nt, Salmonella enterica enterica serovar Typhi
cgauggcgauauugug

SEQ ID NO: 1697184 - RNA, 14 nt, Salmonella enterica enterica serovar Typhi
cgauggcaaauaau

SEQ ID NO: 1697185 - RNA, 16 nt, Salmonella enterica enterica serovar Typhi
cgauggcaaauaauac

SEQ ID NO: 1697186 - RNA, 16 nt, Salmonella enterica enterica serovar Typhi
cgauggcagugaugga

SEQ ID NO: 1697187 - RNA, 14 nt, Salmonella enterica enterica serovar Typhi
cgcucgcccgccgc

SEQ ID NO: 1697188 - RNA, 16 nt, Salmonella enterica enterica serovar Typhi
cgcucgccgccucccc

SEQ ID NO: 1697189 - RNA, 13 nt, Salmonella enterica enterica serovar Typhi
cgcucggccagau

SEQ ID NO: 1697190 - RNA, 21 nt, Salmonella enterica enterica serovar Typhi
cgcucggcauacaccgccagc

SEQ ID NO: 1697191 - RNA, 16 nt, Salmonella enterica enterica serovar Typhi
cgcucggccagauaac

SEQ ID NO: 1697192 - RNA, 13 nt, Salmonella enterica enterica serovar Typhi
cgcucuuccgcca

SEQ ID NO: 1697193 - RNA, 15 nt, Salmonella enterica enterica serovar Typhi
cgcucuuccgccagc

SEQ ID NO: 1697194 - RNA, 19 nt, Salmonella enterica enterica serovar Typhi
cgcucuuccgccagcgcca

SEQ ID NO: 1697195 - RNA, 21 nt, Salmonella enterica enterica serovar Typhi
cgcucuucgccaaucgccgcc

SEQ ID NO: 1697196 - RNA, 16 nt, Salmonella enterica enterica serovar Typhi
cgcucucgccgcgcuc

SEQ ID NO: 1697197 - RNA, 22 nt, Salmonella enterica enterica serovar Typhi
cgcucucauagccgacccgcau

SEQ ID NO: 1697198 - RNA, 18 nt, Salmonella enterica enterica serovar Typhi
cgcucuaucaccgcccgc

SEQ ID NO: 1697199 - RNA, 17 nt, Salmonella enterica enterica serovar Typhi
cgcucuauauccugccc

SEQ ID NO: 1697200 - RNA, 15 nt, Salmonella enterica enterica serovar Typhi
cgcugaccacgccgc

SEQ ID NO: 1697201 - RNA, 21 nt, Salmonella enterica enterica serovar Typhi
cgcugaagcuugaaccgggua

SEQ ID NO: 1697202 - RNA, 15 nt, Salmonella enterica enterica serovar Typhi
cgcuccggcgcuggc

SEQ ID NO: 1697203 - RNA, 17 nt, Salmonella enterica enterica serovar Typhi
cgcucccuucccccaga

SEQ ID NO: 1697204 - RNA, 16 nt, Salmonella enterica enterica serovar Typhi
cgcuccugcucccaga

SEQ ID NO: 1697205 - RNA, 15 nt, Salmonella enterica enterica serovar Typhi
cgcucgccauaucuu

SEQ ID NO: 1697206 - RNA, 20 nt, Salmonella enterica enterica serovar Typhi
cgcucaucacaucgcgcagc

SEQ ID NO: 1697207 - RNA, 16 nt, Salmonella enterica enterica serovar Typhi
cgcucaugcgccuggc

SEQ ID NO: 1697208 - RNA, 14 nt, Salmonella enterica enterica serovar Typhi
cgcucaugccacgc

SEQ ID NO: 1697209 - RNA, 15 nt, Salmonella enterica enterica serovar Typhi
cgcucaugcgcgucc

SEQ ID NO: 1697210 - RNA, 15 nt, Salmonella enterica enterica serovar Typhi
cgcuccagcuggcug

SEQ ID NO: 1697211 - RNA, 11 nt, Salmonella enterica enterica serovar Typhi
cgcuccagaag

SEQ ID NO: 1697212 - RNA, 14 nt, Salmonella enterica enterica serovar Typhi
cgcuccaccgccgg

SEQ ID NO: 1697213 - RNA, 19 nt, Salmonella enterica enterica serovar Typhi
cgcuccacugauaguccau

SEQ ID NO: 1697214 - RNA, 18 nt, Salmonella enterica enterica serovar Typhi
cgcucaccaccgccgcga

SEQ ID NO: 1697215 - RNA, 22 nt, Salmonella enterica enterica serovar Typhi
cgcucaauuauuaaucuuuaca

SEQ ID NO: 1697216 - RNA, 23 nt, Salmonella enterica enterica serovar Typhi
cgcucacauucauugccgccagu

SEQ ID NO: 1697217 - RNA, 21 nt, Salmonella enterica enterica serovar Typhi
cgcucaagcgaaaaaauaauc

SEQ ID NO: 1697218 - RNA, 16 nt, Salmonella enterica enterica serovar Typhi
cgcuaugcuuaccauc

SEQ ID NO: 1697219 - RNA, 19 nt, Salmonella enterica enterica serovar Typhi
cgcuauuaccccgcggcau

SEQ ID NO: 1697220 - RNA, 15 nt, Salmonella enterica enterica serovar Typhi
cgcucaaauaaugca

SEQ ID NO: 1697221 - RNA, 15 nt, Salmonella enterica enterica serovar Typhi
cgcucaccgacuccu

SEQ ID NO: 1697222 - RNA, 14 nt, Salmonella enterica enterica serovar Typhi
cgcucacgcggcgc

SEQ ID NO: 1697223 - RNA, 16 nt, Salmonella enterica enterica serovar Typhi
cgcucacgauaacgca

SEQ ID NO: 1697224 - RNA, 20 nt, Salmonella enterica enterica serovar Typhi
cgcucacgguuucaacuucc

SEQ ID NO: 1697225 - RNA, 19 nt, Salmonella enterica enterica serovar Typhi
cgcuagcgcuuacccgacc

SEQ ID NO: 1697226 - RNA, 15 nt, Salmonella enterica enterica serovar Typhi
cgcuagcuggcaggg

SEQ ID NO: 1697227 - RNA, 16 nt, Salmonella enterica enterica serovar Typhi
cgcuacugccgccauc

SEQ ID NO: 1697228 - RNA, 20 nt, Salmonella enterica enterica serovar Typhi
cgcuacgcuuaucaggccua

SEQ ID NO: 1697229 - RNA, 14 nt, Salmonella enterica enterica serovar Typhi
cgcuauccagcagu

SEQ ID NO: 1697230 - RNA, 18 nt, Salmonella enterica enterica serovar Typhi
cgcuaugcccaccgcgcg

SEQ ID NO: 1697231 - RNA, 17 nt, Salmonella enterica enterica serovar Typhi
cgcuaucgaccagcacc

SEQ ID NO: 1697232 - RNA, 17 nt, Salmonella enterica enterica serovar Typhi
cgcuaucaggcacugaa

SEQ ID NO: 1697233 - RNA, 18 nt, Salmonella enterica enterica serovar Typhi
cgcuauccaggccgucgg

SEQ ID NO: 1697234 - RNA, 15 nt, Salmonella enterica enterica serovar Typhi
cgcuauccggcgcgc

SEQ ID NO: 1697235 - RNA, 16 nt, Salmonella enterica enterica serovar Typhi
cgcuauccggcgcgcu

SEQ ID NO: 1697236 - RNA, 13 nt, Salmonella enterica enterica serovar Typhi
cgcuauccggcau

SEQ ID NO: 1697237 - RNA, 21 nt, Salmonella enterica enterica serovar Typhi
cgcuaucaacgccuccaggcu

SEQ ID NO: 1697238 - RNA, 19 nt, Salmonella enterica enterica serovar Typhi
cgcuaucaccgccgcccgu

SEQ ID NO: 1697239 - RNA, 23 nt, Salmonella enterica enterica serovar Typhi
cgcgucacaaucgcgccugccag

SEQ ID NO: 1697240 - RNA, 17 nt, Salmonella enterica enterica serovar Typhi
cgcgucaucggcgcgcu

SEQ ID NO: 1697241 - RNA, 17 nt, Salmonella enterica enterica serovar Typhi
cgcgucagggcaaggcg

SEQ ID NO: 1697242 - RNA, 18 nt, Salmonella enterica enterica serovar Typhi
cgcgggccauacacucaa

SEQ ID NO: 1697243 - RNA, 15 nt, Salmonella enterica enterica serovar Typhi
cgcguccagcccgcu

SEQ ID NO: 1697244 - RNA, 12 nt, Salmonella enterica enterica serovar Typhi
cgcgucgcuguu

SEQ ID NO: 1697245 - RNA, 17 nt, Salmonella enterica enterica serovar Typhi
cgcuaccuucuucccau

SEQ ID NO: 1697246 - RNA, 17 nt, Salmonella enterica enterica serovar Typhi
cgcguuuagcgccagca

SEQ ID NO: 1697247 - RNA, 19 nt, Salmonella enterica enterica serovar Typhi
cgcguggaaauaaucugua

SEQ ID NO: 1697248 - RNA, 15 nt, Salmonella enterica enterica serovar Typhi
cgcugcccugacucg

SEQ ID NO: 1697249 - RNA, 13 nt, Salmonella enterica enterica serovar Typhi
cgcugccgccgcu

SEQ ID NO: 1697250 - RNA, 16 nt, Salmonella enterica enterica serovar Typhi
cgcugccgcccuuucc

SEQ ID NO: 1697251 - RNA, 23 nt, Salmonella enterica enterica serovar Typhi
cgcugcgcauuagcaauaaucuc

SEQ ID NO: 1697252 - RNA, 14 nt, Salmonella enterica enterica serovar Typhi
cgcugcgcaggcgu

SEQ ID NO: 1697253 - RNA, 21 nt, Salmonella enterica enterica serovar Typhi
cgcugccuuccgggcggcugu

SEQ ID NO: 1697254 - RNA, 15 nt, Salmonella enterica enterica serovar Typhi
cgcugcgaagugaau

SEQ ID NO: 1697255 - RNA, 23 nt, Salmonella enterica enterica serovar Typhi
cgcugcgcuuaccgggccgacag

SEQ ID NO: 1697256 - RNA, 21 nt, Salmonella enterica enterica serovar Typhi
cgcugcggccagaccgccgcu

SEQ ID NO: 1697257 - RNA, 20 nt, Salmonella enterica enterica serovar Typhi
cgcugcggccagaccgccgc

SEQ ID NO: 1697258 - RNA, 21 nt, Salmonella enterica enterica serovar Typhi
cgcuggcaauaaagcagggcg

SEQ ID NO: 1697259 - RNA, 20 nt, Salmonella enterica enterica serovar Typhi
cgcuggaaucauccaccaga

SEQ ID NO: 1697260 - RNA, 23 nt, Salmonella enterica enterica serovar Typhi
cgcuggaaguaugccucgcgcac

SEQ ID NO: 1697261 - RNA, 13 nt, Salmonella enterica enterica serovar Typhi
cgcuggacauuaa

SEQ ID NO: 1697262 - RNA, 15 nt, Salmonella enterica enterica serovar Typhi
cgcugcugcggcguu

SEQ ID NO: 1697263 - RNA, 23 nt, Salmonella enterica enterica serovar Typhi
cgcugcucauuuaugcgcugggc

SEQ ID NO: 1697264 - RNA, 12 nt, Salmonella enterica enterica serovar Typhi
cgcugcuccggc

SEQ ID NO: 1697265 - RNA, 17 nt, Salmonella enterica enterica serovar Typhi
cgcugcggucaggaaug

SEQ ID NO: 1697266 - RNA, 12 nt, Salmonella enterica enterica serovar Typhi
cgcugaccucaa

SEQ ID NO: 1697267 - RNA, 14 nt, Salmonella enterica enterica serovar Typhi
cgcugacugaacuc

SEQ ID NO: 1697268 - RNA, 20 nt, Salmonella enterica enterica serovar Typhi
cgcugacgccgaccaccgcc

SEQ ID NO: 1697269 - RNA, 17 nt, Salmonella enterica enterica serovar Typhi
cgcugacgcugcccgcc

SEQ ID NO: 1697270 - RNA, 22 nt, Salmonella enterica enterica serovar Typhi
cgcugagucagaaacggccugg

SEQ ID NO: 1697271 - RNA, 21 nt, Salmonella enterica enterica serovar Typhi
cgcugagucauccuuccccca

SEQ ID NO: 1697272 - RNA, 20 nt, Salmonella enterica enterica serovar Typhi
cgcugauacgcuggcacagg

SEQ ID NO: 1697273 - RNA, 16 nt, Salmonella enterica enterica serovar Typhi
cgcugauagccacggc

SEQ ID NO: 1697274 - RNA, 17 nt, Salmonella enterica enterica serovar Typhi
cgcugaugaaaacccag

SEQ ID NO: 1697275 - RNA, 16 nt, Salmonella enterica enterica serovar Typhi
cgcugauuuguuaucu

SEQ ID NO: 1697276 - RNA, 19 nt, Salmonella enterica enterica serovar Typhi
cgcugauguuuugcgccgc

SEQ ID NO: 1697277 - RNA, 18 nt, Salmonella enterica enterica serovar Typhi
cgcugcacaaucgccagc

SEQ ID NO: 1697278 - RNA, 20 nt, Salmonella enterica enterica serovar Typhi
cgcugcaucguuugcaguuc

SEQ ID NO: 1697279 - RNA, 23 nt, Salmonella enterica enterica serovar Typhi
cgcuguccagauagggccaggcg

SEQ ID NO: 1697280 - RNA, 14 nt, Salmonella enterica enterica serovar Typhi
cgcuguccgcccag

SEQ ID NO: 1697281 - RNA, 15 nt, Salmonella enterica enterica serovar Typhi
cgcugucuauccacu

SEQ ID NO: 1697282 - RNA, 17 nt, Salmonella enterica enterica serovar Typhi
cgcuggucagcgcgcca

SEQ ID NO: 1697283 - RNA, 13 nt, Salmonella enterica enterica serovar Typhi
cgcuggugcagcc

SEQ ID NO: 1697284 - RNA, 14 nt, Salmonella enterica enterica serovar Typhi
cgcugguuccccgu

SEQ ID NO: 1697285 - RNA, 16 nt, Salmonella enterica enterica serovar Typhi
cgcugguggccggggg

SEQ ID NO: 1697286 - RNA, 15 nt, Salmonella enterica enterica serovar Typhi
cgcugguuggcgcgc

SEQ ID NO: 1697287 - RNA, 16 nt, Salmonella enterica enterica serovar Typhi
cgcuguaaaccggccc

SEQ ID NO: 1697288 - RNA, 15 nt, Salmonella enterica enterica serovar Typhi
cgcuguaacccgccg

SEQ ID NO: 1697289 - RNA, 12 nt, Salmonella enterica enterica serovar Typhi
cgcuggcgcgcu

SEQ ID NO: 1697290 - RNA, 20 nt, Salmonella enterica enterica serovar Typhi
cgcuggcgcaaagaaggcau

SEQ ID NO: 1697291 - RNA, 23 nt, Salmonella enterica enterica serovar Typhi
cgcuggcguauucgcccggcagg

SEQ ID NO: 1697292 - RNA, 20 nt, Salmonella enterica enterica serovar Typhi
cgcuggcguauucgcccggc

SEQ ID NO: 1697293 - RNA, 20 nt, Salmonella enterica enterica serovar Typhi
cgcuuaauggcgucaaucaa

SEQ ID NO: 1697294 - RNA, 23 nt, Salmonella enterica enterica serovar Typhi
cgcuuaaucaguugcaggaaggu

SEQ ID NO: 1697295 - RNA, 15 nt, Salmonella enterica enterica serovar Typhi
cgcuguuaugcacgc

SEQ ID NO: 1697296 - RNA, 15 nt, Salmonella enterica enterica serovar Typhi
cgcuguucuugcugc

SEQ ID NO: 1697297 - RNA, 16 nt, Salmonella enterica enterica serovar Typhi
cgcuguuuauccacag

SEQ ID NO: 1697298 - RNA, 14 nt, Salmonella enterica enterica serovar Typhi
cgcuuauccggccu

SEQ ID NO: 1697299 - RNA, 18 nt, Salmonella enterica enterica serovar Typhi
cgcuuauccggccuaccg

SEQ ID NO: 1697300 - RNA, 14 nt, Salmonella enterica enterica serovar Typhi
cgcuuaucaggccu

SEQ ID NO: 1697301 - RNA, 19 nt, Salmonella enterica enterica serovar Typhi
cgcuuaucccagccgcgau

SEQ ID NO: 1697302 - RNA, 22 nt, Salmonella enterica enterica serovar Typhi
cgcuucaccuuucgccgccaga

SEQ ID NO: 1697303 - RNA, 15 nt, Salmonella enterica enterica serovar Typhi
cgcuuaccgggcagg

SEQ ID NO: 1697304 - RNA, 20 nt, Salmonella enterica enterica serovar Typhi
cgcuuacgcuuacccggccu

SEQ ID NO: 1697305 - RNA, 19 nt, Salmonella enterica enterica serovar Typhi
cgcuuacucagccagauac

SEQ ID NO: 1697306 - RNA, 15 nt, Salmonella enterica enterica serovar Typhi
cgcuuacaucgccau

SEQ ID NO: 1697307 - RNA, 16 nt, Salmonella enterica enterica serovar Typhi
cgcuuacaauuuaucu

SEQ ID NO: 1697308 - RNA, 17 nt, Salmonella enterica enterica serovar Typhi
cgcuuacaauuuaucug

SEQ ID NO: 1697309 - RNA, 21 nt, Salmonella enterica enterica serovar Typhi
cgcuuaccacuuugcgcuccu

SEQ ID NO: 1697310 - RNA, 14 nt, Salmonella enterica enterica serovar Typhi
cgcuuaccgggccu

SEQ ID NO: 1697311 - RNA, 12 nt, Salmonella enterica enterica serovar Typhi
cgcuuccagaau

SEQ ID NO: 1697312 - RNA, 14 nt, Salmonella enterica enterica serovar Typhi
cgcuuccagcgcau

SEQ ID NO: 1697313 - RNA, 14 nt, Salmonella enterica enterica serovar Typhi
cgcuucgcgcgcca

SEQ ID NO: 1697314 - RNA, 23 nt, Salmonella enterica enterica serovar Typhi
cgcuucgcagcgauauuucuccg

SEQ ID NO: 1697315 - RNA, 13 nt, Salmonella enterica enterica serovar Typhi
cgcuuccugcagu

SEQ ID NO: 1697316 - RNA, 11 nt, Salmonella enterica enterica serovar Typhi
cgcuuccuggg

SEQ ID NO: 1697317 - RNA, 18 nt, Salmonella enterica enterica serovar Typhi
cgcuucuaacgaaacaga

SEQ ID NO: 1697318 - RNA, 16 nt, Salmonella enterica enterica serovar Typhi
cgcuucuacagccacc

SEQ ID NO: 1697319 - RNA, 18 nt, Salmonella enterica enterica serovar Typhi
cgcuucuauuaccgcagc

SEQ ID NO: 1697320 - RNA, 19 nt, Salmonella enterica enterica serovar Typhi
cgcuucgcuugcccggccu

SEQ ID NO: 1697321 - RNA, 12 nt, Salmonella enterica enterica serovar Typhi
cgcuucuucaug

SEQ ID NO: 1697322 - RNA, 17 nt, Salmonella enterica enterica serovar Typhi
cgcuucuucuaccaccu

SEQ ID NO: 1697323 - RNA, 15 nt, Salmonella enterica enterica serovar Typhi
cgcggauugccgccc

SEQ ID NO: 1697324 - RNA, 14 nt, Salmonella enterica enterica serovar Typhi
cgcggaucggcaca

SEQ ID NO: 1697325 - RNA, 19 nt, Salmonella enterica enterica serovar Typhi
cgcggauauggcggcggcu

SEQ ID NO: 1697326 - RNA, 20 nt, Salmonella enterica enterica serovar Typhi
cgcggaucagacggcugacc

SEQ ID NO: 1697327 - RNA, 21 nt, Salmonella enterica enterica serovar Typhi
cgcggcgacggacucgcgcag

SEQ ID NO: 1697328 - RNA, 22 nt, Salmonella enterica enterica serovar Typhi
cgcggcgcugaguuucucccgc

SEQ ID NO: 1697329 - RNA, 13 nt, Salmonella enterica enterica serovar Typhi
cgcggcgugcgcu

SEQ ID NO: 1697330 - RNA, 19 nt, Salmonella enterica enterica serovar Typhi
cgcggcguaccgcgcgccc

SEQ ID NO: 1697331 - RNA, 14 nt, Salmonella enterica enterica serovar Typhi
cgcggcuacagaca

SEQ ID NO: 1697332 - RNA, 14 nt, Salmonella enterica enterica serovar Typhi
cgcggcucaccagc

SEQ ID NO: 1697333 - RNA, 15 nt, Salmonella enterica enterica serovar Typhi
cgcgcucaagcuggg

SEQ ID NO: 1697334 - RNA, 14 nt, Salmonella enterica enterica serovar Typhi
cgcgcugaugguuu

SEQ ID NO: 1697335 - RNA, 17 nt, Salmonella enterica enterica serovar Typhi
cgcgcuuucuggcgcag

SEQ ID NO: 1697336 - RNA, 24 nt, Salmonella enterica enterica serovar Typhi
cgcgcuuuagggcuuccucgccac

SEQ ID NO: 1697337 - RNA, 19 nt, Salmonella enterica enterica serovar Typhi
cgcgcuggcaagcgccagc

SEQ ID NO: 1697338 - RNA, 12 nt, Salmonella enterica enterica serovar Typhi
cgcgcuggcaau

SEQ ID NO: 1697339 - RNA, 23 nt, Salmonella enterica enterica serovar Typhi
cgcgcugcggcggcggaaaauag

SEQ ID NO: 1697340 - RNA, 13 nt, Salmonella enterica enterica serovar Typhi
cgcggaaggcgcc

SEQ ID NO: 1697341 - RNA, 20 nt, Salmonella enterica enterica serovar Typhi
cgcggaagcgaccggcguca

SEQ ID NO: 1697342 - RNA, 23 nt, Salmonella enterica enterica serovar Typhi
cgcggaaucgucacagaccccgc

SEQ ID NO: 1697343 - RNA, 14 nt, Salmonella enterica enterica serovar Typhi
cgcggaagccacgu

SEQ ID NO: 1697344 - RNA, 16 nt, Salmonella enterica enterica serovar Typhi
cgcgcggcuaccggac

SEQ ID NO: 1697345 - RNA, 22 nt, Salmonella enterica enterica serovar Typhi
cgcgcgguugggcuuccgucgg

SEQ ID NO: 1697346 - RNA, 22 nt, Salmonella enterica enterica serovar Typhi
cgcgcguccacggcgggacgcu

SEQ ID NO: 1697347 - RNA, 19 nt, Salmonella enterica enterica serovar Typhi
cgcgcuaauuuucagggug

SEQ ID NO: 1697348 - RNA, 23 nt, Salmonella enterica enterica serovar Typhi
cgcgcuagugccgccaggcaaau

SEQ ID NO: 1697349 - RNA, 21 nt, Salmonella enterica enterica serovar Typhi
cgcgcuagugccgccaggcaa

SEQ ID NO: 1697350 - RNA, 21 nt, Salmonella enterica enterica serovar Typhi
cgcgcucauacgaucgcgcac

SEQ ID NO: 1697351 - RNA, 17 nt, Salmonella enterica enterica serovar Typhi
cgcgcucaagcgaaaaa

SEQ ID NO: 1697352 - RNA, 19 nt, Salmonella enterica enterica serovar Typhi
cgcgcucaaauggucccug

SEQ ID NO: 1697353 - RNA, 22 nt, Salmonella enterica enterica serovar Typhi
cgcgcuaucaacgccuccaggc

SEQ ID NO: 1697354 - RNA, 20 nt, Salmonella enterica enterica serovar Typhi
cgcgcaucccacaccacacg

SEQ ID NO: 1697355 - RNA, 21 nt, Salmonella enterica enterica serovar Typhi
cgcgcaguuucuuaccuaccu

SEQ ID NO: 1697356 - RNA, 18 nt, Salmonella enterica enterica serovar Typhi
cgcgcaguucaauauuca

SEQ ID NO: 1697357 - RNA, 15 nt, Salmonella enterica enterica serovar Typhi
cgcgcaguuccagcg

SEQ ID NO: 1697358 - RNA, 12 nt, Salmonella enterica enterica serovar Typhi
cgcgcagcugcc

SEQ ID NO: 1697359 - RNA, 23 nt, Salmonella enterica enterica serovar Typhi
cgcgcauggcagggcgauaucca

SEQ ID NO: 1697360 - RNA, 13 nt, Salmonella enterica enterica serovar Typhi
cgcgccacgccau

SEQ ID NO: 1697361 - RNA, 14 nt, Salmonella enterica enterica serovar Typhi
cgcgccacauacug

SEQ ID NO: 1697362 - RNA, 16 nt, Salmonella enterica enterica serovar Typhi
cgcgccagccaauguc

SEQ ID NO: 1697363 - RNA, 15 nt, Salmonella enterica enterica serovar Typhi
cgcgccagacgccau

SEQ ID NO: 1697364 - RNA, 19 nt, Salmonella enterica enterica serovar Typhi
cgcgcaaucauuaccggac

SEQ ID NO: 1697365 - RNA, 18 nt, Salmonella enterica enterica serovar Typhi
cgcgcacagggugaaauc

SEQ ID NO: 1697366 - RNA, 17 nt, Salmonella enterica enterica serovar Typhi
cgcgaguauucgcgccc

SEQ ID NO: 1697367 - RNA, 23 nt, Salmonella enterica enterica serovar Typhi
cgcgagcguucuauuuggccugc

SEQ ID NO: 1697368 - RNA, 20 nt, Salmonella enterica enterica serovar Typhi
cgcgcgaaacgcacccgcgc

SEQ ID NO: 1697369 - RNA, 11 nt, Salmonella enterica enterica serovar Typhi
cgcgcgaccca

SEQ ID NO: 1697370 - RNA, 23 nt, Salmonella enterica enterica serovar Typhi
cgcgccggggcggggaaaccguc

SEQ ID NO: 1697371 - RNA, 20 nt, Salmonella enterica enterica serovar Typhi
cgcgccuggaucugcgcauu

SEQ ID NO: 1697372 - RNA, 17 nt, Salmonella enterica enterica serovar Typhi
cgcgcgcagguucgucu

SEQ ID NO: 1697373 - RNA, 23 nt, Salmonella enterica enterica serovar Typhi
cgcgccaguaaucggcgcgaaac

SEQ ID NO: 1697374 - RNA, 19 nt, Salmonella enterica enterica serovar Typhi
cgcgccagucaucgccgcu

SEQ ID NO: 1697375 - RNA, 22 nt, Salmonella enterica enterica serovar Typhi
cgcgccaggucucauagcgccc

SEQ ID NO: 1697376 - RNA, 15 nt, Salmonella enterica enterica serovar Typhi
cgcgccgccaacgau

SEQ ID NO: 1697377 - RNA, 22 nt, Salmonella enterica enterica serovar Typhi
cgcgccgccaacgccaacauag

SEQ ID NO: 1697378 - RNA, 14 nt, Salmonella enterica enterica serovar Typhi
cgcgccgcagcgcc

SEQ ID NO: 1697379 - RNA, 16 nt, Salmonella enterica enterica serovar Typhi
cgccuccgacaacaag

SEQ ID NO: 1697380 - RNA, 20 nt, Salmonella enterica enterica serovar Typhi
cgccucaucggcguugccca

SEQ ID NO: 1697381 - RNA, 15 nt, Salmonella enterica enterica serovar Typhi
cgccucaucugcuuc

SEQ ID NO: 1697382 - RNA, 22 nt, Salmonella enterica enterica serovar Typhi
cgccuccugccgaugccgccgc

SEQ ID NO: 1697383 - RNA, 21 nt, Salmonella enterica enterica serovar Typhi
cgccuaacagcgccgcgccga

SEQ ID NO: 1697384 - RNA, 21 nt, Salmonella enterica enterica serovar Typhi
cgccuaaaucaagcagugacg

SEQ ID NO: 1697385 - RNA, 12 nt, Salmonella enterica enterica serovar Typhi
cgccuauuguuc

SEQ ID NO: 1697386 - RNA, 21 nt, Salmonella enterica enterica serovar Typhi
cgccuaucgccagcaggguca

SEQ ID NO: 1697387 - RNA, 18 nt, Salmonella enterica enterica serovar Typhi
cgccuauuuucucuucca

SEQ ID NO: 1697388 - RNA, 14 nt, Salmonella enterica enterica serovar Typhi
cgccuaccgcuucc

SEQ ID NO: 1697389 - RNA, 23 nt, Salmonella enterica enterica serovar Typhi
cgccguuggcguaaaucaggcca

SEQ ID NO: 1697390 - RNA, 18 nt, Salmonella enterica enterica serovar Typhi
cgccgugucuggcgaacg

SEQ ID NO: 1697391 - RNA, 17 nt, Salmonella enterica enterica serovar Typhi
cgccguguucuuaccca

SEQ ID NO: 1697392 - RNA, 21 nt, Salmonella enterica enterica serovar Typhi
cgccguguugugugccgcgcu

SEQ ID NO: 1697393 - RNA, 22 nt, Salmonella enterica enterica serovar Typhi
cgccguguugugugccgcgcug

SEQ ID NO: 1697394 - RNA, 16 nt, Salmonella enterica enterica serovar Typhi
cgccguuaaaccguua

SEQ ID NO: 1697395 - RNA, 16 nt, Salmonella enterica enterica serovar Typhi
cgccgugcacuucugc

SEQ ID NO: 1697396 - RNA, 19 nt, Salmonella enterica enterica serovar Typhi
cgccguccauuucaaugca

SEQ ID NO: 1697397 - RNA, 17 nt, Salmonella enterica enterica serovar Typhi
cgccgucauaccgccca

SEQ ID NO: 1697398 - RNA, 14 nt, Salmonella enterica enterica serovar Typhi
cgccgucauaaaac

SEQ ID NO: 1697399 - RNA, 16 nt, Salmonella enterica enterica serovar Typhi
cgccgguuccaacagc

SEQ ID NO: 1697400 - RNA, 22 nt, Salmonella enterica enterica serovar Typhi
cgccgguguuuccgucacuucc

SEQ ID NO: 1697401 - RNA, 16 nt, Salmonella enterica enterica serovar Typhi
cgccgguacgcagcag

SEQ ID NO: 1697402 - RNA, 15 nt, Salmonella enterica enterica serovar Typhi
cgccgguacgcagca

SEQ ID NO: 1697403 - RNA, 19 nt, Salmonella enterica enterica serovar Typhi
cgccggguuuggcgggcuu

SEQ ID NO: 1697404 - RNA, 14 nt, Salmonella enterica enterica serovar Typhi
cgccgccgccaacg

SEQ ID NO: 1697405 - RNA, 15 nt, Salmonella enterica enterica serovar Typhi
cgccgccgccaacgc

SEQ ID NO: 1697406 - RNA, 13 nt, Salmonella enterica enterica serovar Typhi
cgccgccgccaga

SEQ ID NO: 1697407 - RNA, 16 nt, Salmonella enterica enterica serovar Typhi
cgccgccgcgaccgcu

SEQ ID NO: 1697408 - RNA, 14 nt, Salmonella enterica enterica serovar Typhi
cgccgccgcguccu

SEQ ID NO: 1697409 - RNA, 13 nt, Salmonella enterica enterica serovar Typhi
cgcgaccagcgcg

SEQ ID NO: 1697410 - RNA, 18 nt, Salmonella enterica enterica serovar Typhi
cgcgacgggaaggaaauu

SEQ ID NO: 1697411 - RNA, 21 nt, Salmonella enterica enterica serovar Typhi
cgcgacgggaaggaaauucag

SEQ ID NO: 1697412 - RNA, 13 nt, Salmonella enterica enterica serovar Typhi
cgcgacagcgcgc

SEQ ID NO: 1697413 - RNA, 15 nt, Salmonella enterica enterica serovar Typhi
cgcgacauccgcuuu

SEQ ID NO: 1697414 - RNA, 16 nt, Salmonella enterica enterica serovar Typhi
cgcgacagucgcagag

SEQ ID NO: 1697415 - RNA, 12 nt, Salmonella enterica enterica serovar Typhi
cgcgaccagcag

SEQ ID NO: 1697416 - RNA, 21 nt, Salmonella enterica enterica serovar Typhi
cgccuuccggccacuccgcca

SEQ ID NO: 1697417 - RNA, 20 nt, Salmonella enterica enterica serovar Typhi
cgcgaaucgacaauccgcca

SEQ ID NO: 1697418 - RNA, 24 nt, Salmonella enterica enterica serovar Typhi
cgcgaaucgacaauccgccacgcu

SEQ ID NO: 1697419 - RNA, 18 nt, Salmonella enterica enterica serovar Typhi
cgccucgcgauccgccag

SEQ ID NO: 1697420 - RNA, 19 nt, Salmonella enterica enterica serovar Typhi
cgccucgcgauccgccagc

SEQ ID NO: 1697421 - RNA, 17 nt, Salmonella enterica enterica serovar Typhi
cgccugaagauacgcca

SEQ ID NO: 1697422 - RNA, 20 nt, Salmonella enterica enterica serovar Typhi
cgccucguaucugucccagc

SEQ ID NO: 1697423 - RNA, 21 nt, Salmonella enterica enterica serovar Typhi
cgccucguaucugucccagcc

SEQ ID NO: 1697424 - RNA, 24 nt, Salmonella enterica enterica serovar Typhi
cgccugacgcggacgccaccacag

SEQ ID NO: 1697425 - RNA, 15 nt, Salmonella enterica enterica serovar Typhi
cgccugaucgcgcag

SEQ ID NO: 1697426 - RNA, 16 nt, Salmonella enterica enterica serovar Typhi
cgccugauccggccua

SEQ ID NO: 1697427 - RNA, 20 nt, Salmonella enterica enterica serovar Typhi
cgccugaucguuacccgugc

SEQ ID NO: 1697428 - RNA, 16 nt, Salmonella enterica enterica serovar Typhi
cgccugaucuuucugg

SEQ ID NO: 1697429 - RNA, 14 nt, Salmonella enterica enterica serovar Typhi
cgccugaugacgcu

SEQ ID NO: 1697430 - RNA, 11 nt, Salmonella enterica enterica serovar Typhi
cgccugcacca

SEQ ID NO: 1697431 - RNA, 15 nt, Salmonella enterica enterica serovar Typhi
cgccugauucauucc

SEQ ID NO: 1697432 - RNA, 17 nt, Salmonella enterica enterica serovar Typhi
cgccugaugcgccgccu

SEQ ID NO: 1697433 - RNA, 16 nt, Salmonella enterica enterica serovar Typhi
cgccugaugcuggcag

SEQ ID NO: 1697434 - RNA, 13 nt, Salmonella enterica enterica serovar Typhi
cgccugccagaua

SEQ ID NO: 1697435 - RNA, 14 nt, Salmonella enterica enterica serovar Typhi
cgccugcauaaugc

SEQ ID NO: 1697436 - RNA, 13 nt, Salmonella enterica enterica serovar Typhi
cgccugccagcgc

SEQ ID NO: 1697437 - RNA, 15 nt, Salmonella enterica enterica serovar Typhi
cgccugccgcgccgc

SEQ ID NO: 1697438 - RNA, 16 nt, Salmonella enterica enterica serovar Typhi
cgccugcgccagcgcc

SEQ ID NO: 1697439 - RNA, 20 nt, Salmonella enterica enterica serovar Typhi
cgccugccgcgccgccgccu

SEQ ID NO: 1697440 - RNA, 21 nt, Salmonella enterica enterica serovar Typhi
cgccuggcuugcggguuuuga

SEQ ID NO: 1697441 - RNA, 16 nt, Salmonella enterica enterica serovar Typhi
cgccuggcgguaugaa

SEQ ID NO: 1697442 - RNA, 16 nt, Salmonella enterica enterica serovar Typhi
uuuuuuauaacauaaa

SEQ ID NO: 1697443 - RNA, 24 nt, Salmonella enterica enterica serovar Typhi
uuuuuuaugaccguauuacaagua

SEQ ID NO: 1697444 - RNA, 19 nt, Salmonella enterica enterica serovar Typhi
uuuuuuacuuucaaaauac

SEQ ID NO: 1697445 - RNA, 11 nt, Salmonella enterica enterica serovar Typhi
uuuuuccagcg

SEQ ID NO: 1697446 - RNA, 21 nt, Salmonella enterica enterica serovar Typhi
uuuuuccagcacggcauaagc

SEQ ID NO: 1697447 - RNA, 22 nt, Salmonella enterica enterica serovar Typhi
uuuuuccccguugcucauguua

SEQ ID NO: 1697448 - RNA, 21 nt, Salmonella enterica enterica serovar Typhi
uuuuucucgauaucuuccccg

SEQ ID NO: 1697449 - RNA, 23 nt, Salmonella enterica enterica serovar Typhi
uuuuuccgccaccuguuucgcca

SEQ ID NO: 1697450 - RNA, 19 nt, Salmonella enterica enterica serovar Typhi
uuuuugaguuugucaucca

SEQ ID NO: 1697451 - RNA, 22 nt, Salmonella enterica enterica serovar Typhi
uuuuugcacggcaucuuuguuc

SEQ ID NO: 1697452 - RNA, 17 nt, Salmonella enterica enterica serovar Typhi
uuuuugccacauuuccc

SEQ ID NO: 1697453 - RNA, 18 nt, Salmonella enterica enterica serovar Typhi
uuuuugccacauuucccg

SEQ ID NO: 1697454 - RNA, 21 nt, Salmonella enterica enterica serovar Typhi
uuuuugcgacacgcugcauau

SEQ ID NO: 1697455 - RNA, 18 nt, Salmonella enterica enterica serovar Typhi
uuugucugucggacucag

SEQ ID NO: 1697456 - RNA, 22 nt, Salmonella enterica enterica serovar Typhi
uuugucaucagaucaugaggau

SEQ ID NO: 1697457 - RNA, 14 nt, Salmonella enterica enterica serovar Typhi
uuuguugauuuuau

SEQ ID NO: 1697458 - RNA, 22 nt, Salmonella enterica enterica serovar Typhi
uuuguugaucugguucacagau

SEQ ID NO: 1697459 - RNA, 18 nt, Salmonella enterica enterica serovar Typhi
uuuguuuaucauccugac

SEQ ID NO: 1697460 - RNA, 22 nt, Salmonella enterica enterica serovar Typhi
uuuguucagacacauucuguga

SEQ ID NO: 1697461 - RNA, 13 nt, Salmonella enterica enterica serovar Typhi
uuuuaaaaguuag

SEQ ID NO: 1697462 - RNA, 14 nt, Salmonella enterica enterica serovar Typhi
uuuuaaaaaucagu

SEQ ID NO: 1697463 - RNA, 12 nt, Salmonella enterica enterica serovar Typhi
uuuuaaaaauaa

SEQ ID NO: 1697464 - RNA, 15 nt, Salmonella enterica enterica serovar Typhi
uuuuaaacgccugau

SEQ ID NO: 1697465 - RNA, 16 nt, Salmonella enterica enterica serovar Typhi
uuuuaaacgccugauc

SEQ ID NO: 1697466 - RNA, 22 nt, Salmonella enterica enterica serovar Typhi
uuuuaaauaacuuuuaauuuuu

SEQ ID NO: 1697467 - RNA, 12 nt, Salmonella enterica enterica serovar Typhi
uuuuaaccauca

SEQ ID NO: 1697468 - RNA, 12 nt, Salmonella enterica enterica serovar Typhi
uuuuaaauuccu

SEQ ID NO: 1697469 - RNA, 13 nt, Salmonella enterica enterica serovar Typhi
uuuuaaauguuuu

SEQ ID NO: 1697470 - RNA, 19 nt, Salmonella enterica enterica serovar Typhi
uuugguuagggaucaucuu

SEQ ID NO: 1697471 - RNA, 21 nt, Salmonella enterica enterica serovar Typhi
uuuggugcccgcguggaaaac

SEQ ID NO: 1697472 - RNA, 20 nt, Salmonella enterica enterica serovar Typhi
uuuggucggagccaauaauc

SEQ ID NO: 1697473 - RNA, 21 nt, Salmonella enterica enterica serovar Typhi
uuuggucggcguaacccagug

SEQ ID NO: 1697474 - RNA, 13 nt, Salmonella enterica enterica serovar Typhi
uuuggccugcugc

SEQ ID NO: 1697475 - RNA, 15 nt, Salmonella enterica enterica serovar Typhi
uuuggcgauuuucag

SEQ ID NO: 1697476 - RNA, 21 nt, Salmonella enterica enterica serovar Typhi
uuuggcgcgaaauguauuuuu

SEQ ID NO: 1697477 - RNA, 20 nt, Salmonella enterica enterica serovar Typhi
uuuggguaaauaccaggcac

SEQ ID NO: 1697478 - RNA, 18 nt, Salmonella enterica enterica serovar Typhi
uuugggcagauaucggaa

SEQ ID NO: 1697479 - RNA, 17 nt, Salmonella enterica enterica serovar Typhi
uuuggcuuaaauaaucu

SEQ ID NO: 1697480 - RNA, 19 nt, Salmonella enterica enterica serovar Typhi
uuuguaaaauacauucucu

SEQ ID NO: 1697481 - RNA, 18 nt, Salmonella enterica enterica serovar Typhi
uuuguaacauauuuuuau

SEQ ID NO: 1697482 - RNA, 14 nt, Salmonella enterica enterica serovar Typhi
uuuguaacauauuu

SEQ ID NO: 1697483 - RNA, 18 nt, Salmonella enterica enterica serovar Typhi
uuuguacguauuuacaaa

SEQ ID NO: 1697484 - RNA, 21 nt, Salmonella enterica enterica serovar Typhi
uuugcugguugucucaaaaaa

SEQ ID NO: 1697485 - RNA, 19 nt, Salmonella enterica enterica serovar Typhi
uuugcugcauuucuuguug

SEQ ID NO: 1697486 - RNA, 16 nt, Salmonella enterica enterica serovar Typhi
uuugcucaauuuuuuu

SEQ ID NO: 1697487 - RNA, 15 nt, Salmonella enterica enterica serovar Typhi
uuugcugacaaucug

SEQ ID NO: 1697488 - RNA, 18 nt, Salmonella enterica enterica serovar Typhi
uuugcgucguuaacugca

SEQ ID NO: 1697489 - RNA, 18 nt, Salmonella enterica enterica serovar Typhi
uuugcgguuuuaauuucc

SEQ ID NO: 1697490 - RNA, 16 nt, Salmonella enterica enterica serovar Typhi
uuugcguaaaaaacau

SEQ ID NO: 1697491 - RNA, 18 nt, Salmonella enterica enterica serovar Typhi
uuugcguaaaaaacauca

SEQ ID NO: 1697492 - RNA, 16 nt, Salmonella enterica enterica serovar Typhi
uuugcgguuuuaauuu

SEQ ID NO: 1697493 - RNA, 19 nt, Salmonella enterica enterica serovar Typhi
uuugcggcgucgccuggug

SEQ ID NO: 1697494 - RNA, 19 nt, Salmonella enterica enterica serovar Typhi
uuugcgcgguccacaggcc

SEQ ID NO: 1697495 - RNA, 15 nt, Salmonella enterica enterica serovar Typhi
uuugcgcuacgcugc

SEQ ID NO: 1697496 - RNA, 14 nt, Salmonella enterica enterica serovar Typhi
uuugcuucucgccu

SEQ ID NO: 1697497 - RNA, 16 nt, Salmonella enterica enterica serovar Typhi
uuugcuuauccggccu

SEQ ID NO: 1697498 - RNA, 19 nt, Salmonella enterica enterica serovar Typhi
uuugcuguuuuauuuccuc

SEQ ID NO: 1697499 - RNA, 18 nt, Salmonella enterica enterica serovar Typhi
uuugcuuuaauauucauu

SEQ ID NO: 1697500 - RNA, 15 nt, Salmonella enterica enterica serovar Typhi
uuugcuuuauuuguu

SEQ ID NO: 1697501 - RNA, 12 nt, Salmonella enterica enterica serovar Typhi
uuugcuuuguag

SEQ ID NO: 1697502 - RNA, 20 nt, Salmonella enterica enterica serovar Typhi
uuuggcagacagccauauuu

SEQ ID NO: 1697503 - RNA, 24 nt, Salmonella enterica enterica serovar Typhi
uuuggcaggccucuaucuucucag

SEQ ID NO: 1697504 - RNA, 21 nt, Salmonella enterica enterica serovar Typhi
uuuggcaaucaaauccagcuc

SEQ ID NO: 1697505 - RNA, 22 nt, Salmonella enterica enterica serovar Typhi
uuuuccagcgccgccagaauca

SEQ ID NO: 1697506 - RNA, 11 nt, Salmonella enterica enterica serovar Typhi
uuuuccagcac

SEQ ID NO: 1697507 - RNA, 19 nt, Salmonella enterica enterica serovar Typhi
uuuuccagcauuucuucaa

SEQ ID NO: 1697508 - RNA, 22 nt, Salmonella enterica enterica serovar Typhi
uuuuccagccgcuuuucgcuua

SEQ ID NO: 1697509 - RNA, 12 nt, Salmonella enterica enterica serovar Typhi
uuuuccagcuca

SEQ ID NO: 1697510 - RNA, 17 nt, Salmonella enterica enterica serovar Typhi
uuuucaaugcacgccac

SEQ ID NO: 1697511 - RNA, 19 nt, Salmonella enterica enterica serovar Typhi
uuuucaacggcaucaauaa

SEQ ID NO: 1697512 - RNA, 12 nt, Salmonella enterica enterica serovar Typhi
uuuucaaaaaca

SEQ ID NO: 1697513 - RNA, 13 nt, Salmonella enterica enterica serovar Typhi
uuuucaaaaacaa

SEQ ID NO: 1697514 - RNA, 21 nt, Salmonella enterica enterica serovar Typhi
uuuuauuauuuugauacucau

SEQ ID NO: 1697515 - RNA, 19 nt, Salmonella enterica enterica serovar Typhi
uuuuauuuguguauuuuuu

SEQ ID NO: 1697516 - RNA, 20 nt, Salmonella enterica enterica serovar Typhi
uuuuaugcguuuaauugaau

SEQ ID NO: 1697517 - RNA, 22 nt, Salmonella enterica enterica serovar Typhi
uuuuccauucacacaauuuucu

SEQ ID NO: 1697518 - RNA, 13 nt, Salmonella enterica enterica serovar Typhi
uuuuccaucacgu

SEQ ID NO: 1697519 - RNA, 23 nt, Salmonella enterica enterica serovar Typhi
uuuucccacucgcuuccuuuauu

SEQ ID NO: 1697520 - RNA, 21 nt, Salmonella enterica enterica serovar Typhi
uuuucccgccagcugcgcgcu

SEQ ID NO: 1697521 - RNA, 12 nt, Salmonella enterica enterica serovar Typhi
uuuucggcucac

SEQ ID NO: 1697522 - RNA, 13 nt, Salmonella enterica enterica serovar Typhi
uuuucuauuuucu

SEQ ID NO: 1697523 - RNA, 14 nt, Salmonella enterica enterica serovar Typhi
uuuucguuccagag

SEQ ID NO: 1697524 - RNA, 17 nt, Salmonella enterica enterica serovar Typhi
uuuugaaaucacgccac

SEQ ID NO: 1697525 - RNA, 17 nt, Salmonella enterica enterica serovar Typhi
uuuugauaaaucagcac

SEQ ID NO: 1697526 - RNA, 20 nt, Salmonella enterica enterica serovar Typhi
uuuugauaagagaaaauacc

SEQ ID NO: 1697527 - RNA, 17 nt, Salmonella enterica enterica serovar Typhi
uuuucuguaauucuccc

SEQ ID NO: 1697528 - RNA, 20 nt, Salmonella enterica enterica serovar Typhi
uuuucugucguguccuugcc

SEQ ID NO: 1697529 - RNA, 16 nt, Salmonella enterica enterica serovar Typhi
uuuucuuauuacaaga

SEQ ID NO: 1697530 - RNA, 23 nt, Salmonella enterica enterica serovar Typhi
uuuuacgagaaccaacugccaaa

SEQ ID NO: 1697531 - RNA, 20 nt, Salmonella enterica enterica serovar Typhi
uuuuagauccccaaacugcu

SEQ ID NO: 1697532 - RNA, 19 nt, Salmonella enterica enterica serovar Typhi
uuuuacuuucaaaauacug

SEQ ID NO: 1697533 - RNA, 15 nt, Salmonella enterica enterica serovar Typhi
uuuuacuuucauucc

SEQ ID NO: 1697534 - RNA, 23 nt, Salmonella enterica enterica serovar Typhi
uuuuaccccccaugaauuacagc

SEQ ID NO: 1697535 - RNA, 20 nt, Salmonella enterica enterica serovar Typhi
uuuuaccaguacaauuucug

SEQ ID NO: 1697536 - RNA, 18 nt, Salmonella enterica enterica serovar Typhi
uuuuacaggcacuuacuc

SEQ ID NO: 1697537 - RNA, 13 nt, Salmonella enterica enterica serovar Typhi
uuuuacacugaag

SEQ ID NO: 1697538 - RNA, 17 nt, Salmonella enterica enterica serovar Typhi
uuuuaauuuucuguaau

SEQ ID NO: 1697539 - RNA, 19 nt, Salmonella enterica enterica serovar Typhi
uuuuaauuuuuaugucauu

SEQ ID NO: 1697540 - RNA, 23 nt, Salmonella enterica enterica serovar Typhi
uuuuauccguuuccgcaauaagu

SEQ ID NO: 1697541 - RNA, 21 nt, Salmonella enterica enterica serovar Typhi
uuuuauccuguguuuggccgc

SEQ ID NO: 1697542 - RNA, 20 nt, Salmonella enterica enterica serovar Typhi
uuuuauauguugaauauuca

SEQ ID NO: 1697543 - RNA, 13 nt, Salmonella enterica enterica serovar Typhi
uuuuauauuuuua

SEQ ID NO: 1697544 - RNA, 23 nt, Salmonella enterica enterica serovar Typhi
uuuuaucucuuuugcuucaauaa

SEQ ID NO: 1697545 - RNA, 20 nt, Salmonella enterica enterica serovar Typhi
uuuuaugcacgcuauaacgu

SEQ ID NO: 1697546 - RNA, 20 nt, Salmonella enterica enterica serovar Typhi
uuuuagccuguuauucaauu

SEQ ID NO: 1697547 - RNA, 14 nt, Salmonella enterica enterica serovar Typhi
uuuuagcuuaaaaa

SEQ ID NO: 1697548 - RNA, 15 nt, Salmonella enterica enterica serovar Typhi
uuuuauagcagucag

SEQ ID NO: 1697549 - RNA, 13 nt, Salmonella enterica enterica serovar Typhi
uuuuauacauccu

SEQ ID NO: 1697550 - RNA, 13 nt, Salmonella enterica enterica serovar Typhi
uuuuauaacauaa

SEQ ID NO: 1697551 - RNA, 14 nt, Salmonella enterica enterica serovar Typhi
uuuuauaaauauag

SEQ ID NO: 1697552 - RNA, 15 nt, Salmonella enterica enterica serovar Typhi
uugaauaucgcuuuu

SEQ ID NO: 1697553 - RNA, 18 nt, Salmonella enterica enterica serovar Typhi
uugaccagauaaucaaac

SEQ ID NO: 1697554 - RNA, 19 nt, Salmonella enterica enterica serovar Typhi
uugaccaggucgccagcgg

SEQ ID NO: 1697555 - RNA, 14 nt, Salmonella enterica enterica serovar Typhi
uugacaugaaaaau

SEQ ID NO: 1697556 - RNA, 13 nt, Salmonella enterica enterica serovar Typhi
uugacaugaaaaa

SEQ ID NO: 1697557 - RNA, 16 nt, Salmonella enterica enterica serovar Typhi
uucuuucauuuuaccu

SEQ ID NO: 1697558 - RNA, 14 nt, Salmonella enterica enterica serovar Typhi
uucuuuccugcaaa

SEQ ID NO: 1697559 - RNA, 15 nt, Salmonella enterica enterica serovar Typhi
uucuuuaauuugugc

SEQ ID NO: 1697560 - RNA, 13 nt, Salmonella enterica enterica serovar Typhi
uucuucuggcugc

SEQ ID NO: 1697561 - RNA, 14 nt, Salmonella enterica enterica serovar Typhi
uucuuuucuuucag

SEQ ID NO: 1697562 - RNA, 16 nt, Salmonella enterica enterica serovar Typhi
uucuuuucaauaaagc

SEQ ID NO: 1697563 - RNA, 12 nt, Salmonella enterica enterica serovar Typhi
uugaaauccucu

SEQ ID NO: 1697564 - RNA, 13 nt, Salmonella enterica enterica serovar Typhi
uugaaauccucua

SEQ ID NO: 1697565 - RNA, 16 nt, Salmonella enterica enterica serovar Typhi
uugaggaaauucugac

SEQ ID NO: 1697566 - RNA, 18 nt, Salmonella enterica enterica serovar Typhi
uugacuggauuuuugacu

SEQ ID NO: 1697567 - RNA, 16 nt, Salmonella enterica enterica serovar Typhi
uugacuuacaaaaaau

SEQ ID NO: 1697568 - RNA, 15 nt, Salmonella enterica enterica serovar Typhi
uugagacaugccgcc

SEQ ID NO: 1697569 - RNA, 19 nt, Salmonella enterica enterica serovar Typhi
uugacuucaacgcaggcga

SEQ ID NO: 1697570 - RNA, 20 nt, Salmonella enterica enterica serovar Typhi
uugacugaaauuacgccaua

SEQ ID NO: 1697571 - RNA, 13 nt, Salmonella enterica enterica serovar Typhi
uugacucugaagc

SEQ ID NO: 1697572 - RNA, 12 nt, Salmonella enterica enterica serovar Typhi
uugaccauuacc

SEQ ID NO: 1697573 - RNA, 17 nt, Salmonella enterica enterica serovar Typhi
uugaccauuaccauucc

SEQ ID NO: 1697574 - RNA, 20 nt, Salmonella enterica enterica serovar Typhi
uugaccgcauaaucugugau

SEQ ID NO: 1697575 - RNA, 16 nt, Salmonella enterica enterica serovar Typhi
uugacguuauccagua

SEQ ID NO: 1697576 - RNA, 21 nt, Salmonella enterica enterica serovar Typhi
uugauaagcggguugcacauu

SEQ ID NO: 1697577 - RNA, 23 nt, Salmonella enterica enterica serovar Typhi
uugauagcgacgcccauuagcau

SEQ ID NO: 1697578 - RNA, 16 nt, Salmonella enterica enterica serovar Typhi
uugauaccuauuuaau

SEQ ID NO: 1697579 - RNA, 15 nt, Salmonella enterica enterica serovar Typhi
uugcacggcaucuuu

SEQ ID NO: 1697580 - RNA, 19 nt, Salmonella enterica enterica serovar Typhi
uugcaccgcuaaaaaacag

SEQ ID NO: 1697581 - RNA, 16 nt, Salmonella enterica enterica serovar Typhi
uugcaaagcccauaaa

SEQ ID NO: 1697582 - RNA, 15 nt, Salmonella enterica enterica serovar Typhi
uugcaaagcccauaa

SEQ ID NO: 1697583 - RNA, 17 nt, Salmonella enterica enterica serovar Typhi
uugauuaaucgucaucc

SEQ ID NO: 1697584 - RNA, 12 nt, Salmonella enterica enterica serovar Typhi
uugauggccagc

SEQ ID NO: 1697585 - RNA, 17 nt, Salmonella enterica enterica serovar Typhi
uugaugcuaaccucuau

SEQ ID NO: 1697586 - RNA, 13 nt, Salmonella enterica enterica serovar Typhi
uugauggacgcga

SEQ ID NO: 1697587 - RNA, 20 nt, Salmonella enterica enterica serovar Typhi
uugaugccuggcaguucccu

SEQ ID NO: 1697588 - RNA, 22 nt, Salmonella enterica enterica serovar Typhi
uugaucaggcaaaaaucggccu

SEQ ID NO: 1697589 - RNA, 20 nt, Salmonella enterica enterica serovar Typhi
uugaucaggaaaucuuccag

SEQ ID NO: 1697590 - RNA, 23 nt, Salmonella enterica enterica serovar Typhi
uugaucacgguacgcaucaccag

SEQ ID NO: 1697591 - RNA, 23 nt, Salmonella enterica enterica serovar Typhi
uugaucaucagggcgaacauucc

SEQ ID NO: 1697592 - RNA, 23 nt, Salmonella enterica enterica serovar Typhi
uucuucgcgcauuucuguugcaa

SEQ ID NO: 1697593 - RNA, 15 nt, Salmonella enterica enterica serovar Typhi
uucuucugccuuuuu

SEQ ID NO: 1697594 - RNA, 17 nt, Salmonella enterica enterica serovar Typhi
uucuuaucccacagcgu

SEQ ID NO: 1697595 - RNA, 22 nt, Salmonella enterica enterica serovar Typhi
uucuuaauacccauuucuucuu

SEQ ID NO: 1697596 - RNA, 18 nt, Salmonella enterica enterica serovar Typhi
uucuuaacccacaagaaa

SEQ ID NO: 1697597 - RNA, 18 nt, Salmonella enterica enterica serovar Typhi
uucugcgccagccagcuc

SEQ ID NO: 1697598 - RNA, 22 nt, Salmonella enterica enterica serovar Typhi
uucugcgccgcuugugccgaca

SEQ ID NO: 1697599 - RNA, 19 nt, Salmonella enterica enterica serovar Typhi
uucugcgccauuuccagcc

SEQ ID NO: 1697600 - RNA, 16 nt, Salmonella enterica enterica serovar Typhi
uucugcucgguaaaaa

SEQ ID NO: 1697601 - RNA, 14 nt, Salmonella enterica enterica serovar Typhi
uucugucagccuug

SEQ ID NO: 1697602 - RNA, 22 nt, Salmonella enterica enterica serovar Typhi
uucugccgcgcgguauuucgca

SEQ ID NO: 1697603 - RNA, 13 nt, Salmonella enterica enterica serovar Typhi
uucugcaggccaa

SEQ ID NO: 1697604 - RNA, 14 nt, Salmonella enterica enterica serovar Typhi
uucucuuuuauuau

SEQ ID NO: 1697605 - RNA, 19 nt, Salmonella enterica enterica serovar Typhi
uucucuuaugccgcuuuug

SEQ ID NO: 1697606 - RNA, 18 nt, Salmonella enterica enterica serovar Typhi
uucucuucguuauuuucc

SEQ ID NO: 1697607 - RNA, 22 nt, Salmonella enterica enterica serovar Typhi
uucucuucuaccacgcugccgc

SEQ ID NO: 1697608 - RNA, 19 nt, Salmonella enterica enterica serovar Typhi
uucucuucguuauuuuccu

SEQ ID NO: 1697609 - RNA, 15 nt, Salmonella enterica enterica serovar Typhi
uucucuucuucaaug

SEQ ID NO: 1697610 - RNA, 20 nt, Salmonella enterica enterica serovar Typhi
uucuccauggucagacgcuc

SEQ ID NO: 1697611 - RNA, 20 nt, Salmonella enterica enterica serovar Typhi
uucuccaggcgaauccccau

SEQ ID NO: 1697612 - RNA, 16 nt, Salmonella enterica enterica serovar Typhi
uucucacggucuccug

SEQ ID NO: 1697613 - RNA, 22 nt, Salmonella enterica enterica serovar Typhi
uucucacagaaucaucaggcua

SEQ ID NO: 1697614 - RNA, 22 nt, Salmonella enterica enterica serovar Typhi
uucuccgggauagcaaucucgc

SEQ ID NO: 1697615 - RNA, 15 nt, Salmonella enterica enterica serovar Typhi
uucuccggcagucca

SEQ ID NO: 1697616 - RNA, 18 nt, Salmonella enterica enterica serovar Typhi
uucuccggcaguccaugc

SEQ ID NO: 1697617 - RNA, 23 nt, Salmonella enterica enterica serovar Typhi
uucucccgccagaugcagcggca

SEQ ID NO: 1697618 - RNA, 15 nt, Salmonella enterica enterica serovar Typhi
uucucccuacugcuu

SEQ ID NO: 1697619 - RNA, 18 nt, Salmonella enterica enterica serovar Typhi
uucucucucguucccgcc

SEQ ID NO: 1697620 - RNA, 17 nt, Salmonella enterica enterica serovar Typhi
uucgggcacuccggcuc

SEQ ID NO: 1697621 - RNA, 13 nt, Salmonella enterica enterica serovar Typhi
uucgggccgccgc

SEQ ID NO: 1697622 - RNA, 20 nt, Salmonella enterica enterica serovar Typhi
uucgguauuuaucaaaaaga

SEQ ID NO: 1697623 - RNA, 17 nt, Salmonella enterica enterica serovar Typhi
uucgguaguuccagaau

SEQ ID NO: 1697624 - RNA, 17 nt, Salmonella enterica enterica serovar Typhi
uucggcgauuuccagcg

SEQ ID NO: 1697625 - RNA, 20 nt, Salmonella enterica enterica serovar Typhi
uucggcgauuuccagcgccg

SEQ ID NO: 1697626 - RNA, 21 nt, Salmonella enterica enterica serovar Typhi
uuaucaggccgacaaaugacg

SEQ ID NO: 1697627 - RNA, 11 nt, Salmonella enterica enterica serovar Typhi
uuaucaggccu

SEQ ID NO: 1697628 - RNA, 15 nt, Salmonella enterica enterica serovar Typhi
uucguucucugaaua

SEQ ID NO: 1697629 - RNA, 18 nt, Salmonella enterica enterica serovar Typhi
uucguagcgcaaauaucc

SEQ ID NO: 1697630 - RNA, 13 nt, Salmonella enterica enterica serovar Typhi
uucguagacucag

SEQ ID NO: 1697631 - RNA, 16 nt, Salmonella enterica enterica serovar Typhi
uucguagacucaggcg

SEQ ID NO: 1697632 - RNA, 20 nt, Salmonella enterica enterica serovar Typhi
uucgucaaugcugcuuugau

SEQ ID NO: 1697633 - RNA, 13 nt, Salmonella enterica enterica serovar Typhi
uucuauuaaauca

SEQ ID NO: 1697634 - RNA, 19 nt, Salmonella enterica enterica serovar Typhi
uucuacuacagaaagccau

SEQ ID NO: 1697635 - RNA, 18 nt, Salmonella enterica enterica serovar Typhi
uucuacucgggccagcuc

SEQ ID NO: 1697636 - RNA, 16 nt, Salmonella enterica enterica serovar Typhi
uucuaugccaggcgca

SEQ ID NO: 1697637 - RNA, 16 nt, Salmonella enterica enterica serovar Typhi
uucuaucguuauauau

SEQ ID NO: 1697638 - RNA, 20 nt, Salmonella enterica enterica serovar Typhi
uucuaaacguucaucuuccc

SEQ ID NO: 1697639 - RNA, 21 nt, Salmonella enterica enterica serovar Typhi
uucuaaaaguaagcuauguuu

SEQ ID NO: 1697640 - RNA, 18 nt, Salmonella enterica enterica serovar Typhi
uucuaaagacaugaucuu

SEQ ID NO: 1697641 - RNA, 16 nt, Salmonella enterica enterica serovar Typhi
uucuacaaguucagua

SEQ ID NO: 1697642 - RNA, 14 nt, Salmonella enterica enterica serovar Typhi
uucuacaaugcggu

SEQ ID NO: 1697643 - RNA, 15 nt, Salmonella enterica enterica serovar Typhi
uuguucaugcaauuc

SEQ ID NO: 1697644 - RNA, 14 nt, Salmonella enterica enterica serovar Typhi
uuguuccagcagcu

SEQ ID NO: 1697645 - RNA, 21 nt, Salmonella enterica enterica serovar Typhi
uuguucaguuucaaagaacga

SEQ ID NO: 1697646 - RNA, 15 nt, Salmonella enterica enterica serovar Typhi
uuguucgcuucuucu

SEQ ID NO: 1697647 - RNA, 19 nt, Salmonella enterica enterica serovar Typhi
uuguuccugcuggcaaaac

SEQ ID NO: 1697648 - RNA, 15 nt, Salmonella enterica enterica serovar Typhi
uuguucagugccauc

SEQ ID NO: 1697649 - RNA, 17 nt, Salmonella enterica enterica serovar Typhi
uuguggcgaccagcaga

SEQ ID NO: 1697650 - RNA, 13 nt, Salmonella enterica enterica serovar Typhi
uugugauuccagu

SEQ ID NO: 1697651 - RNA, 21 nt, Salmonella enterica enterica serovar Typhi
uugugcccgcgaucgcuucca

SEQ ID NO: 1697652 - RNA, 17 nt, Salmonella enterica enterica serovar Typhi
uugucucaaaaaauauc

SEQ ID NO: 1697653 - RNA, 20 nt, Salmonella enterica enterica serovar Typhi
uugucucaaaaaauaucucu

SEQ ID NO: 1697654 - RNA, 13 nt, Salmonella enterica enterica serovar Typhi
uugucccgccuug

SEQ ID NO: 1697655 - RNA, 20 nt, Salmonella enterica enterica serovar Typhi
uuguccgaugcagacaaaau

SEQ ID NO: 1697656 - RNA, 13 nt, Salmonella enterica enterica serovar Typhi
uugucgggcagaa

SEQ ID NO: 1697657 - RNA, 17 nt, Salmonella enterica enterica serovar Typhi
uuguccauaaaaugaug

SEQ ID NO: 1697658 - RNA, 17 nt, Salmonella enterica enterica serovar Typhi
uugucagucugguacuc

SEQ ID NO: 1697659 - RNA, 13 nt, Salmonella enterica enterica serovar Typhi
uugucagcuuucu

SEQ ID NO: 1697660 - RNA, 16 nt, Salmonella enterica enterica serovar Typhi
uugucaucagaucaug

SEQ ID NO: 1697661 - RNA, 15 nt, Salmonella enterica enterica serovar Typhi
uugucagacaugaua

SEQ ID NO: 1697662 - RNA, 18 nt, Salmonella enterica enterica serovar Typhi
uuguacggcggcauuaaa

SEQ ID NO: 1697663 - RNA, 16 nt, Salmonella enterica enterica serovar Typhi
uuguacagcaauaaaa

SEQ ID NO: 1697664 - RNA, 20 nt, Salmonella enterica enterica serovar Typhi
uuguacagcaauaaaaggaa

SEQ ID NO: 1697665 - RNA, 15 nt, Salmonella enterica enterica serovar Typhi
uuguacagcuugccg

SEQ ID NO: 1697666 - RNA, 19 nt, Salmonella enterica enterica serovar Typhi
uuguacaaaaaaugugagc

SEQ ID NO: 1697667 - RNA, 23 nt, Salmonella enterica enterica serovar Typhi
uuuaauuccaccagcuuaucuga

SEQ ID NO: 1697668 - RNA, 18 nt, Salmonella enterica enterica serovar Typhi
uuuaauaccgcguaaaaa

SEQ ID NO: 1697669 - RNA, 13 nt, Salmonella enterica enterica serovar Typhi
uuuaauaaagaaa

SEQ ID NO: 1697670 - RNA, 18 nt, Salmonella enterica enterica serovar Typhi
uuuaagucaucuguucaa

SEQ ID NO: 1697671 - RNA, 15 nt, Salmonella enterica enterica serovar Typhi
uuuaacgauuucccc

SEQ ID NO: 1697672 - RNA, 20 nt, Salmonella enterica enterica serovar Typhi
uuuaacagauaauuaauaau

SEQ ID NO: 1697673 - RNA, 18 nt, Salmonella enterica enterica serovar Typhi
uuguucgucuuuugaaua

SEQ ID NO: 1697674 - RNA, 20 nt, Salmonella enterica enterica serovar Typhi
uuguuuuaaauucaaccagu

SEQ ID NO: 1697675 - RNA, 17 nt, Salmonella enterica enterica serovar Typhi
uugcuguuuuauuuccu

SEQ ID NO: 1697676 - RNA, 20 nt, Salmonella enterica enterica serovar Typhi
uugcuguuagaaucucugac

SEQ ID NO: 1697677 - RNA, 17 nt, Salmonella enterica enterica serovar Typhi
uugcugucgcgcaauac

SEQ ID NO: 1697678 - RNA, 17 nt, Salmonella enterica enterica serovar Typhi
uugcuguuaauuucccg

SEQ ID NO: 1697679 - RNA, 21 nt, Salmonella enterica enterica serovar Typhi
uugcugaggaucaccccaaca

SEQ ID NO: 1697680 - RNA, 23 nt, Salmonella enterica enterica serovar Typhi
uugcuccagcagcgccaguuuuu

SEQ ID NO: 1697681 - RNA, 18 nt, Salmonella enterica enterica serovar Typhi
uugcugaaucugcggcug

SEQ ID NO: 1697682 - RNA, 17 nt, Salmonella enterica enterica serovar Typhi
uugcugaagauaaaauu

SEQ ID NO: 1697683 - RNA, 17 nt, Salmonella enterica enterica serovar Typhi
uugcuuuucaucaccau

SEQ ID NO: 1697684 - RNA, 13 nt, Salmonella enterica enterica serovar Typhi
uugcuuuuuucca

SEQ ID NO: 1697685 - RNA, 21 nt, Salmonella enterica enterica serovar Typhi
uuggcagccccugaaauaaca

SEQ ID NO: 1697686 - RNA, 16 nt, Salmonella enterica enterica serovar Typhi
uuggcgcgaaccguaa

SEQ ID NO: 1697687 - RNA, 14 nt, Salmonella enterica enterica serovar Typhi
uuggcgauuuccag

SEQ ID NO: 1697688 - RNA, 18 nt, Salmonella enterica enterica serovar Typhi
uuggcgaauaaucaacca

SEQ ID NO: 1697689 - RNA, 18 nt, Salmonella enterica enterica serovar Typhi
uuggcguaaaucaggcca

SEQ ID NO: 1697690 - RNA, 19 nt, Salmonella enterica enterica serovar Typhi
uuggcguaaaucaggccaa

SEQ ID NO: 1697691 - RNA, 13 nt, Salmonella enterica enterica serovar Typhi
uuggcuccaguac

SEQ ID NO: 1697692 - RNA, 22 nt, Salmonella enterica enterica serovar Typhi
uuggcuccaguaccgggcagga

SEQ ID NO: 1697693 - RNA, 14 nt, Salmonella enterica enterica serovar Typhi
uuggcgugacggcg

SEQ ID NO: 1697694 - RNA, 19 nt, Salmonella enterica enterica serovar Typhi
uugggcgcgacgccugggc

SEQ ID NO: 1697695 - RNA, 20 nt, Salmonella enterica enterica serovar Typhi
uuggggaaccuggcagaaag

SEQ ID NO: 1697696 - RNA, 22 nt, Salmonella enterica enterica serovar Typhi
uuggucacaaaggccagcagca

SEQ ID NO: 1697697 - RNA, 16 nt, Salmonella enterica enterica serovar Typhi
uuggugggugaugacg

SEQ ID NO: 1697698 - RNA, 19 nt, Salmonella enterica enterica serovar Typhi
uugguauucaacgccaucu

SEQ ID NO: 1697699 - RNA, 15 nt, Salmonella enterica enterica serovar Typhi
uugccccgcuuucag

SEQ ID NO: 1697700 - RNA, 24 nt, Salmonella enterica enterica serovar Typhi
uugccccgcuuucagcguugcagc

SEQ ID NO: 1697701 - RNA, 12 nt, Salmonella enterica enterica serovar Typhi
uugccccuuccg

SEQ ID NO: 1697702 - RNA, 23 nt, Salmonella enterica enterica serovar Typhi
uugcccgcaggcuuccagauaca

SEQ ID NO: 1697703 - RNA, 14 nt, Salmonella enterica enterica serovar Typhi
uugccacagccuca

SEQ ID NO: 1697704 - RNA, 20 nt, Salmonella enterica enterica serovar Typhi
uugccgauuccaugcccagu

SEQ ID NO: 1697705 - RNA, 22 nt, Salmonella enterica enterica serovar Typhi
uugccgcaauugguaauuaaag

SEQ ID NO: 1697706 - RNA, 19 nt, Salmonella enterica enterica serovar Typhi
uugccgaguggaaucagcc

SEQ ID NO: 1697707 - RNA, 22 nt, Salmonella enterica enterica serovar Typhi
uugcccggccguuaccguggcg

SEQ ID NO: 1697708 - RNA, 13 nt, Salmonella enterica enterica serovar Typhi
uugcccuccagcc

SEQ ID NO: 1697709 - RNA, 13 nt, Salmonella enterica enterica serovar Typhi
uugcauuauauuu

SEQ ID NO: 1697710 - RNA, 14 nt, Salmonella enterica enterica serovar Typhi
uugcagauccgcga

SEQ ID NO: 1697711 - RNA, 23 nt, Salmonella enterica enterica serovar Typhi
uugcucaacuggaugacugaauu

SEQ ID NO: 1697712 - RNA, 24 nt, Salmonella enterica enterica serovar Typhi
uugcucacggcgauaccaguaaua

SEQ ID NO: 1697713 - RNA, 20 nt, Salmonella enterica enterica serovar Typhi
uugcgcgguuaacagccgcu

SEQ ID NO: 1697714 - RNA, 14 nt, Salmonella enterica enterica serovar Typhi
uugcguccauuaag

SEQ ID NO: 1697715 - RNA, 22 nt, Salmonella enterica enterica serovar Typhi
uugcgucguuaacugcauuaca

SEQ ID NO: 1697716 - RNA, 14 nt, Salmonella enterica enterica serovar Typhi
uugcgucuguuuuu

SEQ ID NO: 1697717 - RNA, 13 nt, Salmonella enterica enterica serovar Typhi
uugcgugucauca

SEQ ID NO: 1697718 - RNA, 22 nt, Salmonella enterica enterica serovar Typhi
uugcgaauggccuccagcagca

SEQ ID NO: 1697719 - RNA, 17 nt, Salmonella enterica enterica serovar Typhi
uugcgacaaccuguagg

SEQ ID NO: 1697720 - RNA, 17 nt, Salmonella enterica enterica serovar Typhi
uugcgcccaggccaaaa

SEQ ID NO: 1697721 - RNA, 23 nt, Salmonella enterica enterica serovar Typhi
uugcgccuuuccggccugaaugc

SEQ ID NO: 1697722 - RNA, 20 nt, Salmonella enterica enterica serovar Typhi
uugccgcgcggauucuccag

SEQ ID NO: 1697723 - RNA, 17 nt, Salmonella enterica enterica serovar Typhi
uugccggauggcgcuuu

SEQ ID NO: 1697724 - RNA, 20 nt, Salmonella enterica enterica serovar Typhi
uugccggauggcacugcgcu

SEQ ID NO: 1697725 - RNA, 14 nt, Salmonella enterica enterica serovar Typhi
uugccgcaggcaac

SEQ ID NO: 1697726 - RNA, 12 nt, Salmonella enterica enterica serovar Typhi
uuucugcugcca

SEQ ID NO: 1697727 - RNA, 21 nt, Salmonella enterica enterica serovar Typhi
uuucugauagcccuauucgug

SEQ ID NO: 1697728 - RNA, 20 nt, Salmonella enterica enterica serovar Typhi
uuucugauaacgcaggcgau

SEQ ID NO: 1697729 - RNA, 20 nt, Salmonella enterica enterica serovar Typhi
uuucugccagguuccccaau

SEQ ID NO: 1697730 - RNA, 18 nt, Salmonella enterica enterica serovar Typhi
uuucugacguaacuuauc

SEQ ID NO: 1697731 - RNA, 12 nt, Salmonella enterica enterica serovar Typhi
uuucucaucaag

SEQ ID NO: 1697732 - RNA, 18 nt, Salmonella enterica enterica serovar Typhi
uuucucauuaaaaaaccg

SEQ ID NO: 1697733 - RNA, 19 nt, Salmonella enterica enterica serovar Typhi
uuucucccgccagaugcag

SEQ ID NO: 1697734 - RNA, 14 nt, Salmonella enterica enterica serovar Typhi
uuucuccguuguug

SEQ ID NO: 1697735 - RNA, 17 nt, Salmonella enterica enterica serovar Typhi
uuucucggcuuuccagc

SEQ ID NO: 1697736 - RNA, 11 nt, Salmonella enterica enterica serovar Typhi
uuucucgccau

SEQ ID NO: 1697737 - RNA, 18 nt, Salmonella enterica enterica serovar Typhi
uuucuaucagguaacaua

SEQ ID NO: 1697738 - RNA, 13 nt, Salmonella enterica enterica serovar Typhi
uuucucaauacga

SEQ ID NO: 1697739 - RNA, 18 nt, Salmonella enterica enterica serovar Typhi
uuucguccggcugccacu

SEQ ID NO: 1697740 - RNA, 24 nt, Salmonella enterica enterica serovar Typhi
uuucguaaaauauauauuuucuca

SEQ ID NO: 1697741 - RNA, 23 nt, Salmonella enterica enterica serovar Typhi
uuucggcguguaacugcaaacgc

SEQ ID NO: 1697742 - RNA, 15 nt, Salmonella enterica enterica serovar Typhi
uuucgcuguaauagu

SEQ ID NO: 1697743 - RNA, 16 nt, Salmonella enterica enterica serovar Typhi
uuucgcucgcuuugcc

SEQ ID NO: 1697744 - RNA, 17 nt, Salmonella enterica enterica serovar Typhi
uuucgcgaauaaucugu

SEQ ID NO: 1697745 - RNA, 17 nt, Salmonella enterica enterica serovar Typhi
uuucgccccacuggccc

SEQ ID NO: 1697746 - RNA, 17 nt, Salmonella enterica enterica serovar Typhi
uuucgcccgcucgcgau

SEQ ID NO: 1697747 - RNA, 15 nt, Salmonella enterica enterica serovar Typhi
uuucgcccucgccac

SEQ ID NO: 1697748 - RNA, 20 nt, Salmonella enterica enterica serovar Typhi
uuucgccguaaaacaacagc

SEQ ID NO: 1697749 - RNA, 17 nt, Salmonella enterica enterica serovar Typhi
uuucuacuacaacuguc

SEQ ID NO: 1697750 - RNA, 16 nt, Salmonella enterica enterica serovar Typhi
uuucuacuacaacugu

SEQ ID NO: 1697751 - RNA, 15 nt, Salmonella enterica enterica serovar Typhi
uuucccaagucacgc

SEQ ID NO: 1697752 - RNA, 18 nt, Salmonella enterica enterica serovar Typhi
uuuccgccugaucuuucu

SEQ ID NO: 1697753 - RNA, 17 nt, Salmonella enterica enterica serovar Typhi
uuuccgccaugaaaaaa

SEQ ID NO: 1697754 - RNA, 18 nt, Salmonella enterica enterica serovar Typhi
uuucccucauauuuguau

SEQ ID NO: 1697755 - RNA, 16 nt, Salmonella enterica enterica serovar Typhi
uuuccaggugcugcca

SEQ ID NO: 1697756 - RNA, 17 nt, Salmonella enterica enterica serovar Typhi
uuuccaggugcugccac

SEQ ID NO: 1697757 - RNA, 21 nt, Salmonella enterica enterica serovar Typhi
uuuccagucccugaagaaaag

SEQ ID NO: 1697758 - RNA, 20 nt, Salmonella enterica enterica serovar Typhi
uuuccaguguuguucucuga

SEQ ID NO: 1697759 - RNA, 20 nt, Salmonella enterica enterica serovar Typhi
uuuccaguucuggcugcgcu

SEQ ID NO: 1697760 - RNA, 20 nt, Salmonella enterica enterica serovar Typhi
uuuccaguugcggcaucaga

SEQ ID NO: 1697761 - RNA, 22 nt, Salmonella enterica enterica serovar Typhi
uuuccauucacacaauuuucuu

SEQ ID NO: 1697762 - RNA, 15 nt, Salmonella enterica enterica serovar Typhi
uuuccauucguucug

SEQ ID NO: 1697763 - RNA, 13 nt, Salmonella enterica enterica serovar Typhi
uuuccauuuuuca

SEQ ID NO: 1697764 - RNA, 23 nt, Salmonella enterica enterica serovar Typhi
uuuccagcacggcauaagccuca

SEQ ID NO: 1697765 - RNA, 21 nt, Salmonella enterica enterica serovar Typhi
uuuccagccguaccacccggg

SEQ ID NO: 1697766 - RNA, 18 nt, Salmonella enterica enterica serovar Typhi
uuuccagcauuagcgcca

SEQ ID NO: 1697767 - RNA, 17 nt, Salmonella enterica enterica serovar Typhi
uuuccagcucagaaaua

SEQ ID NO: 1697768 - RNA, 23 nt, Salmonella enterica enterica serovar Typhi
uuucgaccgcaggcucuuuuucu

SEQ ID NO: 1697769 - RNA, 17 nt, Salmonella enterica enterica serovar Typhi
uuucgacggcaaccuuc

SEQ ID NO: 1697770 - RNA, 18 nt, Salmonella enterica enterica serovar Typhi
uuucgagcagaacuggcg

SEQ ID NO: 1697771 - RNA, 21 nt, Salmonella enterica enterica serovar Typhi
uuucgcaaacugaucgaggac

SEQ ID NO: 1697772 - RNA, 17 nt, Salmonella enterica enterica serovar Typhi
uuucgcaaacacccgac

SEQ ID NO: 1697773 - RNA, 20 nt, Salmonella enterica enterica serovar Typhi
uuucgccacgcucacuuuuc

SEQ ID NO: 1697774 - RNA, 20 nt, Salmonella enterica enterica serovar Typhi
uuucgaaacaggaaaaacau

SEQ ID NO: 1697775 - RNA, 18 nt, Salmonella enterica enterica serovar Typhi
uuuccggcgggagcucua

SEQ ID NO: 1697776 - RNA, 19 nt, Salmonella enterica enterica serovar Typhi
uuuccggcagcgcauaagc

SEQ ID NO: 1697777 - RNA, 16 nt, Salmonella enterica enterica serovar Typhi
uuuccgcugucuaucc

SEQ ID NO: 1697778 - RNA, 16 nt, Salmonella enterica enterica serovar Typhi
uuuccguccaccuggc

SEQ ID NO: 1697779 - RNA, 17 nt, Salmonella enterica enterica serovar Typhi
uuuccguauugcaaugc

SEQ ID NO: 1697780 - RNA, 13 nt, Salmonella enterica enterica serovar Typhi
uuuccguuuuuau

SEQ ID NO: 1697781 - RNA, 18 nt, Salmonella enterica enterica serovar Typhi
uuuccugccuucugaaag

SEQ ID NO: 1697782 - RNA, 22 nt, Salmonella enterica enterica serovar Typhi
uuuccugguaaucgauacggga

SEQ ID NO: 1697783 - RNA, 21 nt, Salmonella enterica enterica serovar Typhi
uuuccugccuucugaaaguuu

SEQ ID NO: 1697784 - RNA, 19 nt, Salmonella enterica enterica serovar Typhi
uuuccugaugauauuucuu

SEQ ID NO: 1697785 - RNA, 23 nt, Salmonella enterica enterica serovar Typhi
uuuccugaucaaucaacucuuua

SEQ ID NO: 1697786 - RNA, 22 nt, Salmonella enterica enterica serovar Typhi
uuuccucccauacccagguuug

SEQ ID NO: 1697787 - RNA, 16 nt, Salmonella enterica enterica serovar Typhi
uuuccucaaccucuuu

SEQ ID NO: 1697788 - RNA, 17 nt, Salmonella enterica enterica serovar Typhi
uuugcauaccaaguuug

SEQ ID NO: 1697789 - RNA, 21 nt, Salmonella enterica enterica serovar Typhi
uuugcaguuccgcaauccugg

SEQ ID NO: 1697790 - RNA, 13 nt, Salmonella enterica enterica serovar Typhi
uuugcauaaauaa

SEQ ID NO: 1697791 - RNA, 18 nt, Salmonella enterica enterica serovar Typhi
uuugcagcaacugauuca

SEQ ID NO: 1697792 - RNA, 21 nt, Salmonella enterica enterica serovar Typhi
uuugcagguuacucacugccg

SEQ ID NO: 1697793 - RNA, 19 nt, Salmonella enterica enterica serovar Typhi
uuugcagguuacucacugc

SEQ ID NO: 1697794 - RNA, 19 nt, Salmonella enterica enterica serovar Typhi
uuugcaccgcuaaaaaaca

SEQ ID NO: 1697795 - RNA, 22 nt, Salmonella enterica enterica serovar Typhi
uuugcacggcaucuuuguucug

SEQ ID NO: 1697796 - RNA, 15 nt, Salmonella enterica enterica serovar Typhi
uuugcgacacgcugc

SEQ ID NO: 1697797 - RNA, 21 nt, Salmonella enterica enterica serovar Typhi
uuugccucuggccaguuucaa

SEQ ID NO: 1697798 - RNA, 15 nt, Salmonella enterica enterica serovar Typhi
uuugccucuggccag

SEQ ID NO: 1697799 - RNA, 23 nt, Salmonella enterica enterica serovar Typhi
uuugcgcagcaacgucucgacau

SEQ ID NO: 1697800 - RNA, 15 nt, Salmonella enterica enterica serovar Typhi
uuugcgccuuccagu

SEQ ID NO: 1697801 - RNA, 10 nt, Salmonella enterica enterica serovar Typhi
uuugcgcgcg

SEQ ID NO: 1697802 - RNA, 11 nt, Salmonella enterica enterica serovar Typhi
uuugcgcggcu

SEQ ID NO: 1697803 - RNA, 23 nt, Salmonella enterica enterica serovar Typhi
uuugcgccggcaguccuugcagc

SEQ ID NO: 1697804 - RNA, 12 nt, Salmonella enterica enterica serovar Typhi
uuugccauaucu

SEQ ID NO: 1697805 - RNA, 20 nt, Salmonella enterica enterica serovar Typhi
uuugccaaauauucucccua

SEQ ID NO: 1697806 - RNA, 14 nt, Salmonella enterica enterica serovar Typhi
uuugcauugccacu

SEQ ID NO: 1697807 - RNA, 13 nt, Salmonella enterica enterica serovar Typhi
uuugcauucgcuc

SEQ ID NO: 1697808 - RNA, 15 nt, Salmonella enterica enterica serovar Typhi
uuugcauucgcuccu

SEQ ID NO: 1697809 - RNA, 21 nt, Salmonella enterica enterica serovar Typhi
uuugaugcaaaugucagaucg

SEQ ID NO: 1697810 - RNA, 17 nt, Salmonella enterica enterica serovar Typhi
uuugauauuuaaucgcu

SEQ ID NO: 1697811 - RNA, 22 nt, Salmonella enterica enterica serovar Typhi
uuugauaaacugcgccauguuc

SEQ ID NO: 1697812 - RNA, 20 nt, Salmonella enterica enterica serovar Typhi
uuugauccguuucagaaaga

SEQ ID NO: 1697813 - RNA, 18 nt, Salmonella enterica enterica serovar Typhi
uuugauccguuucagaaa

SEQ ID NO: 1697814 - RNA, 14 nt, Salmonella enterica enterica serovar Typhi
uuugaucugcuuga

SEQ ID NO: 1697815 - RNA, 18 nt, Salmonella enterica enterica serovar Typhi
uuugauuuauuuugaauu

SEQ ID NO: 1697816 - RNA, 23 nt, Salmonella enterica enterica serovar Typhi
uuugauuuauuuugaauuuuuau

SEQ ID NO: 1697817 - RNA, 13 nt, Salmonella enterica enterica serovar Typhi
uuugauugccauc

SEQ ID NO: 1697818 - RNA, 17 nt, Salmonella enterica enterica serovar Typhi
uuugauaaacugcgcca

SEQ ID NO: 1697819 - RNA, 14 nt, Salmonella enterica enterica serovar Typhi
uuugauacucugcu

SEQ ID NO: 1697820 - RNA, 15 nt, Salmonella enterica enterica serovar Typhi
uuugauaagagaaaa

SEQ ID NO: 1697821 - RNA, 21 nt, Salmonella enterica enterica serovar Typhi
uuugauagacguaaugaucag

SEQ ID NO: 1697822 - RNA, 18 nt, Salmonella enterica enterica serovar Typhi
uuugaggaaaccuuucuu

SEQ ID NO: 1697823 - RNA, 15 nt, Salmonella enterica enterica serovar Typhi
uuugagcaacuucag

SEQ ID NO: 1697824 - RNA, 15 nt, Salmonella enterica enterica serovar Typhi
uuugagaaaaacauc

SEQ ID NO: 1697825 - RNA, 22 nt, Salmonella enterica enterica serovar Typhi
uuugacucgcuacgcucgcccu

SEQ ID NO: 1697826 - RNA, 22 nt, Salmonella enterica enterica serovar Typhi
uuugaccauuaccauuccucac

SEQ ID NO: 1697827 - RNA, 21 nt, Salmonella enterica enterica serovar Typhi
uuugacgacaaacuccagcuc

SEQ ID NO: 1697828 - RNA, 14 nt, Salmonella enterica enterica serovar Typhi
uuugacauugucau

SEQ ID NO: 1697829 - RNA, 20 nt, Salmonella enterica enterica serovar Typhi
uuugacaaccucgcuucgcu

SEQ ID NO: 1697830 - RNA, 13 nt, Salmonella enterica enterica serovar Typhi
uuucuuuuccaga

SEQ ID NO: 1697831 - RNA, 13 nt, Salmonella enterica enterica serovar Typhi
uuucuuucaucag

SEQ ID NO: 1697832 - RNA, 14 nt, Salmonella enterica enterica serovar Typhi
uuugaaguguuccu

SEQ ID NO: 1697833 - RNA, 13 nt, Salmonella enterica enterica serovar Typhi
uuucuucaucaaa

SEQ ID NO: 1697834 - RNA, 19 nt, Salmonella enterica enterica serovar Typhi
uuucuuccauuagcuguug

SEQ ID NO: 1697835 - RNA, 21 nt, Salmonella enterica enterica serovar Typhi
uuucuucccuccccugcgccu

SEQ ID NO: 1697836 - RNA, 11 nt, Salmonella enterica enterica serovar Typhi
uuucuucuuca

SEQ ID NO: 1697837 - RNA, 19 nt, Salmonella enterica enterica serovar Typhi
uuucuucuggccauuucau

SEQ ID NO: 1697838 - RNA, 19 nt, Salmonella enterica enterica serovar Typhi
uuucuuguuccugcacccg

SEQ ID NO: 1697839 - RNA, 17 nt, Salmonella enterica enterica serovar Typhi
uuucuuucagcucuuca

SEQ ID NO: 1697840 - RNA, 13 nt, Salmonella enterica enterica serovar Typhi
uuucuuucaucaa

SEQ ID NO: 1697841 - RNA, 21 nt, Salmonella enterica enterica serovar Typhi
uuucuucaagcguuuccagag

SEQ ID NO: 1697842 - RNA, 17 nt, Salmonella enterica enterica serovar Typhi
uuucuuauuacaagaaa

SEQ ID NO: 1697843 - RNA, 13 nt, Salmonella enterica enterica serovar Typhi
uuucuuaauuccu

SEQ ID NO: 1697844 - RNA, 20 nt, Salmonella enterica enterica serovar Typhi
uuucuguguugcucaaaaaa

SEQ ID NO: 1697845 - RNA, 15 nt, Salmonella enterica enterica serovar Typhi
uuucuguuccgaaau

SEQ ID NO: 1697846 - RNA, 17 nt, Salmonella enterica enterica serovar Typhi
uuucuguaauuugaaau

SEQ ID NO: 1697847 - RNA, 16 nt, Salmonella enterica enterica serovar Typhi
uuucaaaaaagagaag

SEQ ID NO: 1697848 - RNA, 21 nt, Salmonella enterica enterica serovar Typhi
uuuauuuuuuuacauuauucc

SEQ ID NO: 1697849 - RNA, 12 nt, Salmonella enterica enterica serovar Typhi
uuuauuuuucaa

SEQ ID NO: 1697850 - RNA, 13 nt, Salmonella enterica enterica serovar Typhi
uuucaaauagcug

SEQ ID NO: 1697851 - RNA, 15 nt, Salmonella enterica enterica serovar Typhi
uuuauucgcuuguuu

SEQ ID NO: 1697852 - RNA, 13 nt, Salmonella enterica enterica serovar Typhi
uuuauuauuucca

SEQ ID NO: 1697853 - RNA, 12 nt, Salmonella enterica enterica serovar Typhi
uuuauuaucuga

SEQ ID NO: 1697854 - RNA, 17 nt, Salmonella enterica enterica serovar Typhi
uuuauuaguaauaucag

SEQ ID NO: 1697855 - RNA, 18 nt, Salmonella enterica enterica serovar Typhi
uuuauuuaggauuugucu

SEQ ID NO: 1697856 - RNA, 23 nt, Salmonella enterica enterica serovar Typhi
uuuauugggcguaagaaaaguuu

SEQ ID NO: 1697857 - RNA, 12 nt, Salmonella enterica enterica serovar Typhi
uuuauugccgcu

SEQ ID NO: 1697858 - RNA, 18 nt, Salmonella enterica enterica serovar Typhi
uuucaauuugugagauaa

SEQ ID NO: 1697859 - RNA, 14 nt, Salmonella enterica enterica serovar Typhi
uuucaauuuccagu

SEQ ID NO: 1697860 - RNA, 23 nt, Salmonella enterica enterica serovar Typhi
uuucaauuccgcaggagagccag

SEQ ID NO: 1697861 - RNA, 21 nt, Salmonella enterica enterica serovar Typhi
uuucacuaauccccauuuuuu

SEQ ID NO: 1697862 - RNA, 19 nt, Salmonella enterica enterica serovar Typhi
uuucacucgcauucuucag

SEQ ID NO: 1697863 - RNA, 19 nt, Salmonella enterica enterica serovar Typhi
uuucaccguggcaucauca

SEQ ID NO: 1697864 - RNA, 20 nt, Salmonella enterica enterica serovar Typhi
uuucaccucacuccagaccu

SEQ ID NO: 1697865 - RNA, 19 nt, Salmonella enterica enterica serovar Typhi
uuucaacuuccgcguuagg

SEQ ID NO: 1697866 - RNA, 13 nt, Salmonella enterica enterica serovar Typhi
uuucaacuuccac

SEQ ID NO: 1697867 - RNA, 23 nt, Salmonella enterica enterica serovar Typhi
uuucaacccccucagcaaugauu

SEQ ID NO: 1697868 - RNA, 20 nt, Salmonella enterica enterica serovar Typhi
uuucaacagcacccaggcac

SEQ ID NO: 1697869 - RNA, 19 nt, Salmonella enterica enterica serovar Typhi
uuucaaauuucugauguga

SEQ ID NO: 1697870 - RNA, 11 nt, Salmonella enterica enterica serovar Typhi
uuucaauaaua

SEQ ID NO: 1697871 - RNA, 21 nt, Salmonella enterica enterica serovar Typhi
uuucaauaaucccuucuuuua

SEQ ID NO: 1697872 - RNA, 18 nt, Salmonella enterica enterica serovar Typhi
uuucaauacuccacaguu

SEQ ID NO: 1697873 - RNA, 16 nt, Salmonella enterica enterica serovar Typhi
uuucaaucgccaccac

SEQ ID NO: 1697874 - RNA, 20 nt, Salmonella enterica enterica serovar Typhi
uuucaauccuucuucugaaa

SEQ ID NO: 1697875 - RNA, 18 nt, Salmonella enterica enterica serovar Typhi
uuucaauccuucuucuga

SEQ ID NO: 1697876 - RNA, 13 nt, Salmonella enterica enterica serovar Typhi
uuucaaucaucau

SEQ ID NO: 1697877 - RNA, 18 nt, Salmonella enterica enterica serovar Typhi
uuucaguaauaauauaaa

SEQ ID NO: 1697878 - RNA, 15 nt, Salmonella enterica enterica serovar Typhi
uuucaguugcccauu

SEQ ID NO: 1697879 - RNA, 11 nt, Salmonella enterica enterica serovar Typhi
uuucaggucau

SEQ ID NO: 1697880 - RNA, 16 nt, Salmonella enterica enterica serovar Typhi
uuucagggaaaagaag

SEQ ID NO: 1697881 - RNA, 12 nt, Salmonella enterica enterica serovar Typhi
uuucagggcuua

SEQ ID NO: 1697882 - RNA, 20 nt, Salmonella enterica enterica serovar Typhi
uuucaggcaaaaaaaaaccg

SEQ ID NO: 1697883 - RNA, 20 nt, Salmonella enterica enterica serovar Typhi
uuucauaugcgggguuugca

SEQ ID NO: 1697884 - RNA, 22 nt, Salmonella enterica enterica serovar Typhi
uuucagaggucaggauuuucgc

SEQ ID NO: 1697885 - RNA, 14 nt, Salmonella enterica enterica serovar Typhi
uuucacuuccaugc

SEQ ID NO: 1697886 - RNA, 15 nt, Salmonella enterica enterica serovar Typhi
uuucacuuaucccug

SEQ ID NO: 1697887 - RNA, 15 nt, Salmonella enterica enterica serovar Typhi
uuucagaauaauguu

SEQ ID NO: 1697888 - RNA, 18 nt, Salmonella enterica enterica serovar Typhi
uuucagccgcgcauagcu

SEQ ID NO: 1697889 - RNA, 12 nt, Salmonella enterica enterica serovar Typhi
uuucagccccuu

SEQ ID NO: 1697890 - RNA, 15 nt, Salmonella enterica enterica serovar Typhi
uuucagcauccuccg

SEQ ID NO: 1697891 - RNA, 12 nt, Salmonella enterica enterica serovar Typhi
uuucagcgccag

SEQ ID NO: 1697892 - RNA, 21 nt, Salmonella enterica enterica serovar Typhi
uuucagcguaccgaagaacau

SEQ ID NO: 1697893 - RNA, 23 nt, Salmonella enterica enterica serovar Typhi
uuucagcucgcaggccauaaaac

SEQ ID NO: 1697894 - RNA, 12 nt, Salmonella enterica enterica serovar Typhi
uuucaucaccau

SEQ ID NO: 1697895 - RNA, 24 nt, Salmonella enterica enterica serovar Typhi
uuucaucgagcgugucagugccau

SEQ ID NO: 1697896 - RNA, 19 nt, Salmonella enterica enterica serovar Typhi
uuucaucgccgauuccugc

SEQ ID NO: 1697897 - RNA, 16 nt, Salmonella enterica enterica serovar Typhi
uuucaugauauucugu

SEQ ID NO: 1697898 - RNA, 14 nt, Salmonella enterica enterica serovar Typhi
uuucaugccauacu

SEQ ID NO: 1697899 - RNA, 14 nt, Salmonella enterica enterica serovar Typhi
uuucauuacgcuuc

SEQ ID NO: 1697900 - RNA, 22 nt, Salmonella enterica enterica serovar Typhi
uuucauggucaucgcaaauucu

SEQ ID NO: 1697901 - RNA, 11 nt, Salmonella enterica enterica serovar Typhi
uuucauccucu

SEQ ID NO: 1697902 - RNA, 16 nt, Salmonella enterica enterica serovar Typhi
uuucauguaaaugacg

SEQ ID NO: 1697903 - RNA, 16 nt, Salmonella enterica enterica serovar Typhi
uuucauuucgaucugu

SEQ ID NO: 1697904 - RNA, 13 nt, Salmonella enterica enterica serovar Typhi
uuucauuucugcc

SEQ ID NO: 1697905 - RNA, 14 nt, Salmonella enterica enterica serovar Typhi
uuucauuagccgcc

SEQ ID NO: 1697906 - RNA, 14 nt, Salmonella enterica enterica serovar Typhi
uuucauucagaccc

SEQ ID NO: 1697907 - RNA, 23 nt, Salmonella enterica enterica serovar Typhi
uuuccaaaauccagggaaaccau

SEQ ID NO: 1697908 - RNA, 13 nt, Salmonella enterica enterica serovar Typhi
uuuccaaaaucca

SEQ ID NO: 1697909 - RNA, 22 nt, Salmonella enterica enterica serovar Typhi
uuuaugcacgccgggaauuauu

SEQ ID NO: 1697910 - RNA, 20 nt, Salmonella enterica enterica serovar Typhi
uuuaugcaguuccguugcaa

SEQ ID NO: 1697911 - RNA, 22 nt, Salmonella enterica enterica serovar Typhi
uuuaugacuggggcguuuuuua

SEQ ID NO: 1697912 - RNA, 13 nt, Salmonella enterica enterica serovar Typhi
uuuauuaacccuu

SEQ ID NO: 1697913 - RNA, 16 nt, Salmonella enterica enterica serovar Typhi
uuuaugggaaaauucc

SEQ ID NO: 1697914 - RNA, 11 nt, Salmonella enterica enterica serovar Typhi
uuuaugguucc

SEQ ID NO: 1697915 - RNA, 22 nt, Salmonella enterica enterica serovar Typhi
uuuauccccgcuggcgcgggga

SEQ ID NO: 1697916 - RNA, 15 nt, Salmonella enterica enterica serovar Typhi
uuuaucgggcuguug

SEQ ID NO: 1697917 - RNA, 15 nt, Salmonella enterica enterica serovar Typhi
uuuaucuauuucuua

SEQ ID NO: 1697918 - RNA, 17 nt, Salmonella enterica enterica serovar Typhi
uuuaucugcccuuucuu

SEQ ID NO: 1697919 - RNA, 21 nt, Salmonella enterica enterica serovar Typhi
uuuaucugcgugaugcaucag

SEQ ID NO: 1697920 - RNA, 18 nt, Salmonella enterica enterica serovar Typhi
uuuaucuuuuacgcuguc

SEQ ID NO: 1697921 - RNA, 21 nt, Salmonella enterica enterica serovar Typhi
uuuauauucugggcuuacuuu

SEQ ID NO: 1697922 - RNA, 14 nt, Salmonella enterica enterica serovar Typhi
uuuaucagaccugu

SEQ ID NO: 1697923 - RNA, 14 nt, Salmonella enterica enterica serovar Typhi
uuuaucaaaaagac

SEQ ID NO: 1697924 - RNA, 13 nt, Salmonella enterica enterica serovar Typhi
uuuauaaaguaaa

SEQ ID NO: 1697925 - RNA, 13 nt, Salmonella enterica enterica serovar Typhi
uuuauaacauaaa

SEQ ID NO: 1697926 - RNA, 14 nt, Salmonella enterica enterica serovar Typhi
uuuauaacauaaau

SEQ ID NO: 1697927 - RNA, 17 nt, Salmonella enterica enterica serovar Typhi
uuuagcgccauuccugc

SEQ ID NO: 1697928 - RNA, 12 nt, Salmonella enterica enterica serovar Typhi
uuuagaaaauau

SEQ ID NO: 1697929 - RNA, 14 nt, Salmonella enterica enterica serovar Typhi
uuuagaaaauauau

SEQ ID NO: 1697930 - RNA, 21 nt, Salmonella enterica enterica serovar Typhi
uuuaguucagcauauuucuaa

SEQ ID NO: 1697931 - RNA, 17 nt, Salmonella enterica enterica serovar Typhi
uuuaguuucuuuucguu

SEQ ID NO: 1697932 - RNA, 18 nt, Salmonella enterica enterica serovar Typhi
uuuagcuguucaaucacu

SEQ ID NO: 1697933 - RNA, 15 nt, Salmonella enterica enterica serovar Typhi
uuuaggucaaaaaag

SEQ ID NO: 1697934 - RNA, 16 nt, Salmonella enterica enterica serovar Typhi
uuuacuuaauucugcu

SEQ ID NO: 1697935 - RNA, 16 nt, Salmonella enterica enterica serovar Typhi
uuuacuucuucaggcu

SEQ ID NO: 1697936 - RNA, 18 nt, Salmonella enterica enterica serovar Typhi
uuuacuuuuuuaaauguu

SEQ ID NO: 1697937 - RNA, 20 nt, Salmonella enterica enterica serovar Typhi
uuuacugaauaacagcacca

SEQ ID NO: 1697938 - RNA, 12 nt, Salmonella enterica enterica serovar Typhi
uuuacugaauaa

SEQ ID NO: 1697939 - RNA, 23 nt, Salmonella enterica enterica serovar Typhi
uuuacacggugugaucaccgccc

SEQ ID NO: 1697940 - RNA, 16 nt, Salmonella enterica enterica serovar Typhi
uuuacgcuuguuguaa

SEQ ID NO: 1697941 - RNA, 13 nt, Salmonella enterica enterica serovar Typhi
uuuacgcugcucc

SEQ ID NO: 1697942 - RNA, 20 nt, Salmonella enterica enterica serovar Typhi
uuuacggcccuaccauuacc

SEQ ID NO: 1697943 - RNA, 19 nt, Salmonella enterica enterica serovar Typhi
uuuacgcagcaagaacaga

SEQ ID NO: 1697944 - RNA, 22 nt, Salmonella enterica enterica serovar Typhi
uuuacguaacugcgguaaauaa

SEQ ID NO: 1697945 - RNA, 18 nt, Salmonella enterica enterica serovar Typhi
uuuacuaaugaauuuaau

SEQ ID NO: 1697946 - RNA, 23 nt, Salmonella enterica enterica serovar Typhi
ucaggcuaucggcgggguuuaac

SEQ ID NO: 1697947 - RNA, 21 nt, Salmonella enterica enterica serovar Typhi
ucaggcucgucgccuuccagc

SEQ ID NO: 1697948 - RNA, 22 nt, Salmonella enterica enterica serovar Typhi
ucaggcucgucgccuuccagcg

SEQ ID NO: 1697949 - RNA, 18 nt, Salmonella enterica enterica serovar Typhi
ucaggcucgcaaauaauc

SEQ ID NO: 1697950 - RNA, 21 nt, Salmonella enterica enterica serovar Typhi
ucaggcguuacagacgcugcg

SEQ ID NO: 1697951 - RNA, 15 nt, Salmonella enterica enterica serovar Typhi
ucaggcgugaugacu

SEQ ID NO: 1697952 - RNA, 21 nt, Salmonella enterica enterica serovar Typhi
ucagggcuuacucccugguga

SEQ ID NO: 1697953 - RNA, 21 nt, Salmonella enterica enterica serovar Typhi
ucaggcuguuguucuuuucuu

SEQ ID NO: 1697954 - RNA, 19 nt, Salmonella enterica enterica serovar Typhi
ucagggcaaaaaugaucac

SEQ ID NO: 1697955 - RNA, 22 nt, Salmonella enterica enterica serovar Typhi
ucagggcaaaaaugaucacuuc

SEQ ID NO: 1697956 - RNA, 13 nt, Salmonella enterica enterica serovar Typhi
ucagguggaagaa

SEQ ID NO: 1697957 - RNA, 20 nt, Salmonella enterica enterica serovar Typhi
ucaggugaauaccaaagccc

SEQ ID NO: 1697958 - RNA, 15 nt, Salmonella enterica enterica serovar Typhi
ucagguauugguaug

SEQ ID NO: 1697959 - RNA, 21 nt, Salmonella enterica enterica serovar Typhi
ucaggguuauuuccgcuggcc

SEQ ID NO: 1697960 - RNA, 19 nt, Salmonella enterica enterica serovar Typhi
ucaggguuauccuccagcc

SEQ ID NO: 1697961 - RNA, 14 nt, Salmonella enterica enterica serovar Typhi
ucaggguaucuaac

SEQ ID NO: 1697962 - RNA, 19 nt, Salmonella enterica enterica serovar Typhi
ucaggguuuucuaccgcag

SEQ ID NO: 1697963 - RNA, 14 nt, Salmonella enterica enterica serovar Typhi
ucaggguugucuca

SEQ ID NO: 1697964 - RNA, 14 nt, Salmonella enterica enterica serovar Typhi
ucagguaucccgcc

SEQ ID NO: 1697965 - RNA, 14 nt, Salmonella enterica enterica serovar Typhi
ucaggcagaaauaa

SEQ ID NO: 1697966 - RNA, 15 nt, Salmonella enterica enterica serovar Typhi
ucaggcagaaauaac

SEQ ID NO: 1697967 - RNA, 22 nt, Salmonella enterica enterica serovar Typhi
ucaggcaaagcauaggccacga

SEQ ID NO: 1697968 - RNA, 22 nt, Salmonella enterica enterica serovar Typhi
ucaggcaauaaaaaaggcagag

SEQ ID NO: 1697969 - RNA, 13 nt, Salmonella enterica enterica serovar Typhi
ucaggcauguugc

SEQ ID NO: 1697970 - RNA, 16 nt, Salmonella enterica enterica serovar Typhi
ucaggcauccagaccc

SEQ ID NO: 1697971 - RNA, 17 nt, Salmonella enterica enterica serovar Typhi
ucaggcauccugcccug

SEQ ID NO: 1697972 - RNA, 23 nt, Salmonella enterica enterica serovar Typhi
ucaggcacagaagcgccugucua

SEQ ID NO: 1697973 - RNA, 22 nt, Salmonella enterica enterica serovar Typhi
ucaggaugcugauuaaugauuu

SEQ ID NO: 1697974 - RNA, 22 nt, Salmonella enterica enterica serovar Typhi
ucaggaggccugaauaaugacc

SEQ ID NO: 1697975 - RNA, 13 nt, Salmonella enterica enterica serovar Typhi
ucaggaggccuga

SEQ ID NO: 1697976 - RNA, 19 nt, Salmonella enterica enterica serovar Typhi
ucaggagcaugguccggug

SEQ ID NO: 1697977 - RNA, 18 nt, Salmonella enterica enterica serovar Typhi
ucaggauaaaauccugca

SEQ ID NO: 1697978 - RNA, 14 nt, Salmonella enterica enterica serovar Typhi
ucaggauauucgcc

SEQ ID NO: 1697979 - RNA, 19 nt, Salmonella enterica enterica serovar Typhi
ucaggccuauagacaccuu

SEQ ID NO: 1697980 - RNA, 16 nt, Salmonella enterica enterica serovar Typhi
ucaggccuaccaucgc

SEQ ID NO: 1697981 - RNA, 19 nt, Salmonella enterica enterica serovar Typhi
ucaggcgauagccguccau

SEQ ID NO: 1697982 - RNA, 16 nt, Salmonella enterica enterica serovar Typhi
ucaggcgagacgcgcc

SEQ ID NO: 1697983 - RNA, 15 nt, Salmonella enterica enterica serovar Typhi
ucaggcggcugcgca

SEQ ID NO: 1697984 - RNA, 14 nt, Salmonella enterica enterica serovar Typhi
ucaggcggauauau

SEQ ID NO: 1697985 - RNA, 13 nt, Salmonella enterica enterica serovar Typhi
ucaggccauuaac

SEQ ID NO: 1697986 - RNA, 16 nt, Salmonella enterica enterica serovar Typhi
ucaggccgccagcaaa

SEQ ID NO: 1697987 - RNA, 15 nt, Salmonella enterica enterica serovar Typhi
ucaggccgauuucau

SEQ ID NO: 1697988 - RNA, 18 nt, Salmonella enterica enterica serovar Typhi
ucaggccgauuucauuca

SEQ ID NO: 1697989 - RNA, 14 nt, Salmonella enterica enterica serovar Typhi
ucaggccacugccc

SEQ ID NO: 1697990 - RNA, 17 nt, Salmonella enterica enterica serovar Typhi
ucaggcauuguugcguu

SEQ ID NO: 1697991 - RNA, 14 nt, Salmonella enterica enterica serovar Typhi
ucaggcaucugaaa

SEQ ID NO: 1697992 - RNA, 19 nt, Salmonella enterica enterica serovar Typhi
ucaggcaucugaaaugcuc

SEQ ID NO: 1697993 - RNA, 19 nt, Salmonella enterica enterica serovar Typhi
ucagcgcguuuuccaucau

SEQ ID NO: 1697994 - RNA, 20 nt, Salmonella enterica enterica serovar Typhi
ucagcgcguuuuccaucauc

SEQ ID NO: 1697995 - RNA, 21 nt, Salmonella enterica enterica serovar Typhi
ucagcggcuugucauccugcu

SEQ ID NO: 1697996 - RNA, 18 nt, Salmonella enterica enterica serovar Typhi
ucagcguugucccgccuu

SEQ ID NO: 1697997 - RNA, 13 nt, Salmonella enterica enterica serovar Typhi
ucagcgugccggu

SEQ ID NO: 1697998 - RNA, 17 nt, Salmonella enterica enterica serovar Typhi
ucagcgucggugaagaa

SEQ ID NO: 1697999 - RNA, 16 nt, Salmonella enterica enterica serovar Typhi
ucagcguaccgaagaa

SEQ ID NO: 1698000 - RNA, 22 nt, Salmonella enterica enterica serovar Typhi
ucagcguaaaacuuuucugcgu

SEQ ID NO: 1698001 - RNA, 18 nt, Salmonella enterica enterica serovar Typhi
ucagcguaccgaagaaca

SEQ ID NO: 1698002 - RNA, 18 nt, Salmonella enterica enterica serovar Typhi
uaucuucgccguauucuu

SEQ ID NO: 1698003 - RNA, 21 nt, Salmonella enterica enterica serovar Typhi
uaucuucccgauaacugaagg

SEQ ID NO: 1698004 - RNA, 17 nt, Salmonella enterica enterica serovar Typhi
uaucuucauguucuaac

SEQ ID NO: 1698005 - RNA, 20 nt, Salmonella enterica enterica serovar Typhi
uaucuucaucgguaagcgca

SEQ ID NO: 1698006 - RNA, 18 nt, Salmonella enterica enterica serovar Typhi
uaucuuccacgguaaaac

SEQ ID NO: 1698007 - RNA, 15 nt, Salmonella enterica enterica serovar Typhi
ucagcgcauguuagc

SEQ ID NO: 1698008 - RNA, 14 nt, Salmonella enterica enterica serovar Typhi
ucagcgccaccaca

SEQ ID NO: 1698009 - RNA, 21 nt, Salmonella enterica enterica serovar Typhi
ucagcgccacgcccaacauaa

SEQ ID NO: 1698010 - RNA, 18 nt, Salmonella enterica enterica serovar Typhi
ucagcgcgccgcgcagca

SEQ ID NO: 1698011 - RNA, 17 nt, Salmonella enterica enterica serovar Typhi
ucagcgcgccaauggcc

SEQ ID NO: 1698012 - RNA, 21 nt, Salmonella enterica enterica serovar Typhi
ucaggacuagcgcgauuuucu

SEQ ID NO: 1698013 - RNA, 15 nt, Salmonella enterica enterica serovar Typhi
ucaggaaugccacga

SEQ ID NO: 1698014 - RNA, 14 nt, Salmonella enterica enterica serovar Typhi
ucaggaaccacauc

SEQ ID NO: 1698015 - RNA, 18 nt, Salmonella enterica enterica serovar Typhi
ucaggaaccacauccacc

SEQ ID NO: 1698016 - RNA, 16 nt, Salmonella enterica enterica serovar Typhi
ucaggaaaucuuccag

SEQ ID NO: 1698017 - RNA, 23 nt, Salmonella enterica enterica serovar Typhi
ucaggaauaacaucguaaaucaa

SEQ ID NO: 1698018 - RNA, 21 nt, Salmonella enterica enterica serovar Typhi
ucaggaaaaagggaauaauac

SEQ ID NO: 1698019 - RNA, 13 nt, Salmonella enterica enterica serovar Typhi
ucaggaaaacaaa

SEQ ID NO: 1698020 - RNA, 15 nt, Salmonella enterica enterica serovar Typhi
ucaggaaaacaaauu

SEQ ID NO: 1698021 - RNA, 18 nt, Salmonella enterica enterica serovar Typhi
ucaggaaaacgcuuucca

SEQ ID NO: 1698022 - RNA, 22 nt, Salmonella enterica enterica serovar Typhi
ucagcuccuuucggacuuccug

SEQ ID NO: 1698023 - RNA, 14 nt, Salmonella enterica enterica serovar Typhi
ucagcuacuuuaaa

SEQ ID NO: 1698024 - RNA, 13 nt, Salmonella enterica enterica serovar Typhi
ucagcucuucaau

SEQ ID NO: 1698025 - RNA, 20 nt, Salmonella enterica enterica serovar Typhi
ucagcucuucaauuuccauc

SEQ ID NO: 1698026 - RNA, 20 nt, Salmonella enterica enterica serovar Typhi
ucagcugaacagucccacca

SEQ ID NO: 1698027 - RNA, 17 nt, Salmonella enterica enterica serovar Typhi
ucagguucgaauccugu

SEQ ID NO: 1698028 - RNA, 20 nt, Salmonella enterica enterica serovar Typhi
ucagguuuuuaagcugccca

SEQ ID NO: 1698029 - RNA, 15 nt, Salmonella enterica enterica serovar Typhi
ucagguuuuuuucau

SEQ ID NO: 1698030 - RNA, 20 nt, Salmonella enterica enterica serovar Typhi
ucaguaauguccagauuacg

SEQ ID NO: 1698031 - RNA, 15 nt, Salmonella enterica enterica serovar Typhi
ucaguaaccagggag

SEQ ID NO: 1698032 - RNA, 18 nt, Salmonella enterica enterica serovar Typhi
ucaguacagccaaaaaua

SEQ ID NO: 1698033 - RNA, 23 nt, Salmonella enterica enterica serovar Typhi
ucaguaugaucaugcccggcaaa

SEQ ID NO: 1698034 - RNA, 16 nt, Salmonella enterica enterica serovar Typhi
ucaguccccacauuac

SEQ ID NO: 1698035 - RNA, 13 nt, Salmonella enterica enterica serovar Typhi
ucagugaacaccc

SEQ ID NO: 1698036 - RNA, 17 nt, Salmonella enterica enterica serovar Typhi
ucaguggcggcaaaaaa

SEQ ID NO: 1698037 - RNA, 22 nt, Salmonella enterica enterica serovar Typhi
ucaguggcggcaaaaaauauag

SEQ ID NO: 1698038 - RNA, 22 nt, Salmonella enterica enterica serovar Typhi
ucagugauaaagcacagcccca

SEQ ID NO: 1698039 - RNA, 12 nt, Salmonella enterica enterica serovar Typhi
ucagugauaaag

SEQ ID NO: 1698040 - RNA, 15 nt, Salmonella enterica enterica serovar Typhi
ucaguuugucgguaa

SEQ ID NO: 1698041 - RNA, 13 nt, Salmonella enterica enterica serovar Typhi
ucaguuucggccc

SEQ ID NO: 1698042 - RNA, 21 nt, Salmonella enterica enterica serovar Typhi
ucauaaaaucaaucugcaugu

SEQ ID NO: 1698043 - RNA, 22 nt, Salmonella enterica enterica serovar Typhi
ucauaaauguacugcaauaacc

SEQ ID NO: 1698044 - RNA, 22 nt, Salmonella enterica enterica serovar Typhi
ucauaaaggcuuuaaagcaggc

SEQ ID NO: 1698045 - RNA, 13 nt, Salmonella enterica enterica serovar Typhi
ucaucaaauuauc

SEQ ID NO: 1698046 - RNA, 13 nt, Salmonella enterica enterica serovar Typhi
ucaucaaaaugca

SEQ ID NO: 1698047 - RNA, 20 nt, Salmonella enterica enterica serovar Typhi
ucaucaaaaucaucgccacg

SEQ ID NO: 1698048 - RNA, 17 nt, Salmonella enterica enterica serovar Typhi
ucaucaauaucuuuuug

SEQ ID NO: 1698049 - RNA, 23 nt, Salmonella enterica enterica serovar Typhi
ucauauuugugaccaacaucauu

SEQ ID NO: 1698050 - RNA, 21 nt, Salmonella enterica enterica serovar Typhi
ucauaucccggcugacauaau

SEQ ID NO: 1698051 - RNA, 16 nt, Salmonella enterica enterica serovar Typhi
ucauaguuuuccagcc

SEQ ID NO: 1698052 - RNA, 19 nt, Salmonella enterica enterica serovar Typhi
ucauauuaaauuccggcuc

SEQ ID NO: 1698053 - RNA, 19 nt, Salmonella enterica enterica serovar Typhi
ucauauggaagcuguuaau

SEQ ID NO: 1698054 - RNA, 21 nt, Salmonella enterica enterica serovar Typhi
ucauacauuugaauaauucug

SEQ ID NO: 1698055 - RNA, 13 nt, Salmonella enterica enterica serovar Typhi
ucauacccuucca

SEQ ID NO: 1698056 - RNA, 16 nt, Salmonella enterica enterica serovar Typhi
ucauaaugaauacgcu

SEQ ID NO: 1698057 - RNA, 20 nt, Salmonella enterica enterica serovar Typhi
ucauaaugucccugccacgc

SEQ ID NO: 1698058 - RNA, 23 nt, Salmonella enterica enterica serovar Typhi
ucauaaucgcgauacugccgccc

SEQ ID NO: 1698059 - RNA, 20 nt, Salmonella enterica enterica serovar Typhi
ucauaauaagcgcucaggca

SEQ ID NO: 1698060 - RNA, 17 nt, Salmonella enterica enterica serovar Typhi
ucauaacgaccaaacaa

SEQ ID NO: 1698061 - RNA, 23 nt, Salmonella enterica enterica serovar Typhi
ucauacggcaugccaucucuuaa

SEQ ID NO: 1698062 - RNA, 18 nt, Salmonella enterica enterica serovar Typhi
ucauacgcuuuacgcuua

SEQ ID NO: 1698063 - RNA, 20 nt, Salmonella enterica enterica serovar Typhi
ucauagacgcgguuaucucu

SEQ ID NO: 1698064 - RNA, 14 nt, Salmonella enterica enterica serovar Typhi
ucauagacugcgcu

SEQ ID NO: 1698065 - RNA, 21 nt, Salmonella enterica enterica serovar Typhi
ucauagugccggugacaugaa

SEQ ID NO: 1698066 - RNA, 14 nt, Salmonella enterica enterica serovar Typhi
ucauagugcgcgcg

SEQ ID NO: 1698067 - RNA, 21 nt, Salmonella enterica enterica serovar Typhi
ucauagcccugauuaaagaua

SEQ ID NO: 1698068 - RNA, 16 nt, Salmonella enterica enterica serovar Typhi
ucauagccgacccgca

SEQ ID NO: 1698069 - RNA, 16 nt, Salmonella enterica enterica serovar Typhi
ucauccgaccacggcc

SEQ ID NO: 1698070 - RNA, 23 nt, Salmonella enterica enterica serovar Typhi
ucauccgaccacggccacagcca

SEQ ID NO: 1698071 - RNA, 23 nt, Salmonella enterica enterica serovar Typhi
ucaucccgguuugggcgcgaaac

SEQ ID NO: 1698072 - RNA, 22 nt, Salmonella enterica enterica serovar Typhi
ucaucccggcuuaaauuuuuaa

SEQ ID NO: 1698073 - RNA, 17 nt, Salmonella enterica enterica serovar Typhi
ucauccgggcauaaaaa

SEQ ID NO: 1698074 - RNA, 19 nt, Salmonella enterica enterica serovar Typhi
ucaucccacuccaucgccu

SEQ ID NO: 1698075 - RNA, 11 nt, Salmonella enterica enterica serovar Typhi
ucauccagcaa

SEQ ID NO: 1698076 - RNA, 18 nt, Salmonella enterica enterica serovar Typhi
ucaucgccuuaacucuua

SEQ ID NO: 1698077 - RNA, 15 nt, Salmonella enterica enterica serovar Typhi
ucaucgccuucaucc

SEQ ID NO: 1698078 - RNA, 14 nt, Salmonella enterica enterica serovar Typhi
ucaucgcauccagg

SEQ ID NO: 1698079 - RNA, 19 nt, Salmonella enterica enterica serovar Typhi
ucaucauugcgccaagacc

SEQ ID NO: 1698080 - RNA, 23 nt, Salmonella enterica enterica serovar Typhi
ucaucauugaggcgcgaaaaaua

SEQ ID NO: 1698081 - RNA, 16 nt, Salmonella enterica enterica serovar Typhi
ucaucaugauauaauu

SEQ ID NO: 1698082 - RNA, 21 nt, Salmonella enterica enterica serovar Typhi
ucaucaugaaaaacaguaccg

SEQ ID NO: 1698083 - RNA, 19 nt, Salmonella enterica enterica serovar Typhi
ucaucauacugaagauaaa

SEQ ID NO: 1698084 - RNA, 13 nt, Salmonella enterica enterica serovar Typhi
ucaucauaaucaa

SEQ ID NO: 1698085 - RNA, 15 nt, Salmonella enterica enterica serovar Typhi
ucaucaguuuaaccg

SEQ ID NO: 1698086 - RNA, 14 nt, Salmonella enterica enterica serovar Typhi
ucaucaguaacuga

SEQ ID NO: 1698087 - RNA, 18 nt, Salmonella enterica enterica serovar Typhi
ucaucaucggcacagcca

SEQ ID NO: 1698088 - RNA, 22 nt, Salmonella enterica enterica serovar Typhi
ucaucaucuuguccucaucauu

SEQ ID NO: 1698089 - RNA, 13 nt, Salmonella enterica enterica serovar Typhi
ucaucacccaguc

SEQ ID NO: 1698090 - RNA, 17 nt, Salmonella enterica enterica serovar Typhi
ucaucacguucaggcag

SEQ ID NO: 1698091 - RNA, 21 nt, Salmonella enterica enterica serovar Typhi
ucaucagccgaccaauugcag

SEQ ID NO: 1698092 - RNA, 15 nt, Salmonella enterica enterica serovar Typhi
ucaucaggcaauaaa

SEQ ID NO: 1698093 - RNA, 21 nt, Salmonella enterica enterica serovar Typhi
ucaucaggccugcaaaccucu

SEQ ID NO: 1698094 - RNA, 18 nt, Salmonella enterica enterica serovar Typhi
ucaucagacccgcauaca

SEQ ID NO: 1698095 - RNA, 18 nt, Salmonella enterica enterica serovar Typhi
ucaucagaucaugaggau

SEQ ID NO: 1698096 - RNA, 17 nt, Salmonella enterica enterica serovar Typhi
ucaucuaucugcuucug

SEQ ID NO: 1698097 - RNA, 22 nt, Salmonella enterica enterica serovar Typhi
ucaucguuugcgcuacgcugcg

SEQ ID NO: 1698098 - RNA, 16 nt, Salmonella enterica enterica serovar Typhi
ucaucgcuggugugca

SEQ ID NO: 1698099 - RNA, 23 nt, Salmonella enterica enterica serovar Typhi
ucaucgcuuaacggcccaggcau

SEQ ID NO: 1698100 - RNA, 14 nt, Salmonella enterica enterica serovar Typhi
ucaucguaccaaua

SEQ ID NO: 1698101 - RNA, 23 nt, Salmonella enterica enterica serovar Typhi
ucaucguaaaaucaacagcaaaa

SEQ ID NO: 1698102 - RNA, 15 nt, Salmonella enterica enterica serovar Typhi
ucaucgucagcuccu

SEQ ID NO: 1698103 - RNA, 18 nt, Salmonella enterica enterica serovar Typhi
ucaucggucaguuugccc

SEQ ID NO: 1698104 - RNA, 13 nt, Salmonella enterica enterica serovar Typhi
ucaucugacugcg

SEQ ID NO: 1698105 - RNA, 17 nt, Salmonella enterica enterica serovar Typhi
ucaucuccgauaaauaa

SEQ ID NO: 1698106 - RNA, 19 nt, Salmonella enterica enterica serovar Typhi
ucaucuccgauaaauaaga

SEQ ID NO: 1698107 - RNA, 15 nt, Salmonella enterica enterica serovar Typhi
ucaucuuccaguacc

SEQ ID NO: 1698108 - RNA, 14 nt, Salmonella enterica enterica serovar Typhi
ucaucuucccgaau

SEQ ID NO: 1698109 - RNA, 15 nt, Salmonella enterica enterica serovar Typhi
ucaucuucacuucac

SEQ ID NO: 1698110 - RNA, 19 nt, Salmonella enterica enterica serovar Typhi
ucaugccgaccagggcauc

SEQ ID NO: 1698111 - RNA, 12 nt, Salmonella enterica enterica serovar Typhi
ucaugcaauaau

SEQ ID NO: 1698112 - RNA, 17 nt, Salmonella enterica enterica serovar Typhi
ucaugcaauaaucacug

SEQ ID NO: 1698113 - RNA, 23 nt, Salmonella enterica enterica serovar Typhi
ucaugcuguauaaacucagcaau

SEQ ID NO: 1698114 - RNA, 14 nt, Salmonella enterica enterica serovar Typhi
ucaugcuaaaacag

SEQ ID NO: 1698115 - RNA, 13 nt, Salmonella enterica enterica serovar Typhi
ucaugcuaaaagc

SEQ ID NO: 1698116 - RNA, 23 nt, Salmonella enterica enterica serovar Typhi
ucaugcgcgucccggcagugcau

SEQ ID NO: 1698117 - RNA, 15 nt, Salmonella enterica enterica serovar Typhi
ucaugcgggagcuug

SEQ ID NO: 1698118 - RNA, 17 nt, Salmonella enterica enterica serovar Typhi
ucaugcgguuaaaccag

SEQ ID NO: 1698119 - RNA, 18 nt, Salmonella enterica enterica serovar Typhi
ucaugcgagguauacgcc

SEQ ID NO: 1698120 - RNA, 22 nt, Salmonella enterica enterica serovar Typhi
ucaugcgcggucauucauuguc

SEQ ID NO: 1698121 - RNA, 16 nt, Salmonella enterica enterica serovar Typhi
ucaugaaaaauauaaa

SEQ ID NO: 1698122 - RNA, 20 nt, Salmonella enterica enterica serovar Typhi
ucaugaucuuuccuuuuuca

SEQ ID NO: 1698123 - RNA, 23 nt, Salmonella enterica enterica serovar Typhi
ucaugagucgcgcgcgccaguca

SEQ ID NO: 1698124 - RNA, 19 nt, Salmonella enterica enterica serovar Typhi
ucaugaucuuuccuuuuuc

SEQ ID NO: 1698125 - RNA, 13 nt, Salmonella enterica enterica serovar Typhi
ucaugauguuugu

SEQ ID NO: 1698126 - RNA, 17 nt, Salmonella enterica enterica serovar Typhi
ucaugacucuuguuucu

SEQ ID NO: 1698127 - RNA, 18 nt, Salmonella enterica enterica serovar Typhi
ucaugacugguuuuucgc

SEQ ID NO: 1698128 - RNA, 21 nt, Salmonella enterica enterica serovar Typhi
ucaugacuuuuuucaaccuca

SEQ ID NO: 1698129 - RNA, 16 nt, Salmonella enterica enterica serovar Typhi
ucauucacauuauuca

SEQ ID NO: 1698130 - RNA, 19 nt, Salmonella enterica enterica serovar Typhi
ucauucacccaauaaauaa

SEQ ID NO: 1698131 - RNA, 21 nt, Salmonella enterica enterica serovar Typhi
ucauucacccaauaaauaaua

SEQ ID NO: 1698132 - RNA, 17 nt, Salmonella enterica enterica serovar Typhi
ucauuauuuuuaaauaa

SEQ ID NO: 1698133 - RNA, 14 nt, Salmonella enterica enterica serovar Typhi
ucauuauucaggcc

SEQ ID NO: 1698134 - RNA, 23 nt, Salmonella enterica enterica serovar Typhi
ucauuacuggaucgcuccauucu

SEQ ID NO: 1698135 - RNA, 18 nt, Salmonella enterica enterica serovar Typhi
ucauuacuuauauuuauu

SEQ ID NO: 1698136 - RNA, 22 nt, Salmonella enterica enterica serovar Typhi
ucauuaucaauagcuucaauga

SEQ ID NO: 1698137 - RNA, 19 nt, Salmonella enterica enterica serovar Typhi
ucauugacgguggccgcca

SEQ ID NO: 1698138 - RNA, 15 nt, Salmonella enterica enterica serovar Typhi
ucauucugauuuuac

SEQ ID NO: 1698139 - RNA, 21 nt, Salmonella enterica enterica serovar Typhi
ucauugccguuaacugcugcu

SEQ ID NO: 1698140 - RNA, 21 nt, Salmonella enterica enterica serovar Typhi
ucauugaugaugaagcugcag

SEQ ID NO: 1698141 - RNA, 14 nt, Salmonella enterica enterica serovar Typhi
ucauucgggaugca

SEQ ID NO: 1698142 - RNA, 20 nt, Salmonella enterica enterica serovar Typhi
ucauucgguuaggaauagca

SEQ ID NO: 1698143 - RNA, 17 nt, Salmonella enterica enterica serovar Typhi
ucauucgucaaauucac

SEQ ID NO: 1698144 - RNA, 13 nt, Salmonella enterica enterica serovar Typhi
ucauguaaaggcg

SEQ ID NO: 1698145 - RNA, 20 nt, Salmonella enterica enterica serovar Typhi
ucauggguagccguuuaaaa

SEQ ID NO: 1698146 - RNA, 18 nt, Salmonella enterica enterica serovar Typhi
ucaugguacucaacauca

SEQ ID NO: 1698147 - RNA, 17 nt, Salmonella enterica enterica serovar Typhi
ucaugguagucaaauuc

SEQ ID NO: 1698148 - RNA, 19 nt, Salmonella enterica enterica serovar Typhi
ucaugguagucaaauucca

SEQ ID NO: 1698149 - RNA, 18 nt, Salmonella enterica enterica serovar Typhi
ucaugguaaaauccuuuu

SEQ ID NO: 1698150 - RNA, 15 nt, Salmonella enterica enterica serovar Typhi
ucaugguaaaugccg

SEQ ID NO: 1698151 - RNA, 16 nt, Salmonella enterica enterica serovar Typhi
ucaugggcucaucaaa

SEQ ID NO: 1698152 - RNA, 14 nt, Salmonella enterica enterica serovar Typhi
ucaugggaaaucac

SEQ ID NO: 1698153 - RNA, 18 nt, Salmonella enterica enterica serovar Typhi
ucauggacagauuuccac

SEQ ID NO: 1698154 - RNA, 22 nt, Salmonella enterica enterica serovar Typhi
ucauuaccuacgcgauaaaaaa

SEQ ID NO: 1698155 - RNA, 18 nt, Salmonella enterica enterica serovar Typhi
ucauuacccaauaaugaa

SEQ ID NO: 1698156 - RNA, 17 nt, Salmonella enterica enterica serovar Typhi
ucauuaacgggaaacug

SEQ ID NO: 1698157 - RNA, 22 nt, Salmonella enterica enterica serovar Typhi
ucauuaacgacaacuucuaauu

SEQ ID NO: 1698158 - RNA, 11 nt, Salmonella enterica enterica serovar Typhi
ucauuaaaaaa

SEQ ID NO: 1698159 - RNA, 21 nt, Salmonella enterica enterica serovar Typhi
ucauguugcggguuucugaau

SEQ ID NO: 1698160 - RNA, 12 nt, Salmonella enterica enterica serovar Typhi
uccaacauagcu

SEQ ID NO: 1698161 - RNA, 13 nt, Salmonella enterica enterica serovar Typhi
uccaacccuugcu

SEQ ID NO: 1698162 - RNA, 14 nt, Salmonella enterica enterica serovar Typhi
uccaacgugcagau

SEQ ID NO: 1698163 - RNA, 22 nt, Salmonella enterica enterica serovar Typhi
uccaacacaucgacaugcagau

SEQ ID NO: 1698164 - RNA, 14 nt, Salmonella enterica enterica serovar Typhi
uccaaauaaggacu

SEQ ID NO: 1698165 - RNA, 13 nt, Salmonella enterica enterica serovar Typhi
uccaaaauaauaa

SEQ ID NO: 1698166 - RNA, 20 nt, Salmonella enterica enterica serovar Typhi
uccaaaacgaacaggccgcc

SEQ ID NO: 1698167 - RNA, 23 nt, Salmonella enterica enterica serovar Typhi
uccaaacuggcugugccaauaac

SEQ ID NO: 1698168 - RNA, 16 nt, Salmonella enterica enterica serovar Typhi
uccaaagcgaagcugc

SEQ ID NO: 1698169 - RNA, 20 nt, Salmonella enterica enterica serovar Typhi
ucauugcgccagcuuucggc

SEQ ID NO: 1698170 - RNA, 17 nt, Salmonella enterica enterica serovar Typhi
ucauugcgcuaaaaucc

SEQ ID NO: 1698171 - RNA, 18 nt, Salmonella enterica enterica serovar Typhi
ucauugcgcuaaaaucca

SEQ ID NO: 1698172 - RNA, 21 nt, Salmonella enterica enterica serovar Typhi
ucauuggaagagacacgcuga

SEQ ID NO: 1698173 - RNA, 17 nt, Salmonella enterica enterica serovar Typhi
ucauuggauuaacggca

SEQ ID NO: 1698174 - RNA, 18 nt, Salmonella enterica enterica serovar Typhi
ucauuggggaaccuggca

SEQ ID NO: 1698175 - RNA, 14 nt, Salmonella enterica enterica serovar Typhi
ucauuguaaaaccg

SEQ ID NO: 1698176 - RNA, 14 nt, Salmonella enterica enterica serovar Typhi
ucauuucaggcaaa

SEQ ID NO: 1698177 - RNA, 18 nt, Salmonella enterica enterica serovar Typhi
ucauuucugccugcuuca

SEQ ID NO: 1698178 - RNA, 17 nt, Salmonella enterica enterica serovar Typhi
ucauuugcgcuuuuaau

SEQ ID NO: 1698179 - RNA, 13 nt, Salmonella enterica enterica serovar Typhi
ucauuuguuccuc

SEQ ID NO: 1698180 - RNA, 15 nt, Salmonella enterica enterica serovar Typhi
ucauuuguacaaaaa

SEQ ID NO: 1698181 - RNA, 20 nt, Salmonella enterica enterica serovar Typhi
ucauuuguacaaaaaaugug

SEQ ID NO: 1698182 - RNA, 21 nt, Salmonella enterica enterica serovar Typhi
ucauuuguacaaaaaauguga

SEQ ID NO: 1698183 - RNA, 21 nt, Salmonella enterica enterica serovar Typhi
ucauuuucaugauauucuguc

SEQ ID NO: 1698184 - RNA, 24 nt, Salmonella enterica enterica serovar Typhi
ucauuuuacugcguaaucuuuuca

SEQ ID NO: 1698185 - RNA, 18 nt, Salmonella enterica enterica serovar Typhi
ucauuuuaucgauaauau

SEQ ID NO: 1698186 - RNA, 14 nt, Salmonella enterica enterica serovar Typhi
uccauagaacgcuu

SEQ ID NO: 1698187 - RNA, 23 nt, Salmonella enterica enterica serovar Typhi
uccauaccguuucaacugccccu

SEQ ID NO: 1698188 - RNA, 17 nt, Salmonella enterica enterica serovar Typhi
uccauagaaaucagcag

SEQ ID NO: 1698189 - RNA, 22 nt, Salmonella enterica enterica serovar Typhi
uccauaccggacuccaggcaac

SEQ ID NO: 1698190 - RNA, 18 nt, Salmonella enterica enterica serovar Typhi
uccauaccguuucaacug

SEQ ID NO: 1698191 - RNA, 13 nt, Salmonella enterica enterica serovar Typhi
uccauacauccau

SEQ ID NO: 1698192 - RNA, 20 nt, Salmonella enterica enterica serovar Typhi
uccauacacugcauaaauau

SEQ ID NO: 1698193 - RNA, 19 nt, Salmonella enterica enterica serovar Typhi
uccauaaauaacauuucag

SEQ ID NO: 1698194 - RNA, 21 nt, Salmonella enterica enterica serovar Typhi
uccauaaaauaaagucagcaa

SEQ ID NO: 1698195 - RNA, 13 nt, Salmonella enterica enterica serovar Typhi
uccaguuuuuucc

SEQ ID NO: 1698196 - RNA, 17 nt, Salmonella enterica enterica serovar Typhi
uccaucagcgcuuugau

SEQ ID NO: 1698197 - RNA, 13 nt, Salmonella enterica enterica serovar Typhi
uccaucagccagg

SEQ ID NO: 1698198 - RNA, 13 nt, Salmonella enterica enterica serovar Typhi
uccaucauuuccg

SEQ ID NO: 1698199 - RNA, 14 nt, Salmonella enterica enterica serovar Typhi
uccaucccccugcc

SEQ ID NO: 1698200 - RNA, 15 nt, Salmonella enterica enterica serovar Typhi
uccauccauugcgcc

SEQ ID NO: 1698201 - RNA, 19 nt, Salmonella enterica enterica serovar Typhi
uccauauaacagaauaagc

SEQ ID NO: 1698202 - RNA, 12 nt, Salmonella enterica enterica serovar Typhi
uccauauuuauc

SEQ ID NO: 1698203 - RNA, 23 nt, Salmonella enterica enterica serovar Typhi
uccaucacgguaaaccuguuugu

SEQ ID NO: 1698204 - RNA, 22 nt, Salmonella enterica enterica serovar Typhi
uccaucacguuggggaauaaau

SEQ ID NO: 1698205 - RNA, 16 nt, Salmonella enterica enterica serovar Typhi
uccaguguuguucucu

SEQ ID NO: 1698206 - RNA, 16 nt, Salmonella enterica enterica serovar Typhi
uccagucgcuccacca

SEQ ID NO: 1698207 - RNA, 13 nt, Salmonella enterica enterica serovar Typhi
uccagugaaaccg

SEQ ID NO: 1698208 - RNA, 21 nt, Salmonella enterica enterica serovar Typhi
uccaguuugcgggaaauacca

SEQ ID NO: 1698209 - RNA, 18 nt, Salmonella enterica enterica serovar Typhi
uccaguugcuuaccuugu

SEQ ID NO: 1698210 - RNA, 15 nt, Salmonella enterica enterica serovar Typhi
uccaguugcggcauc

SEQ ID NO: 1698211 - RNA, 14 nt, Salmonella enterica enterica serovar Typhi
uccaguucauaagu

SEQ ID NO: 1698212 - RNA, 18 nt, Salmonella enterica enterica serovar Typhi
uccaguucauaagucauc

SEQ ID NO: 1698213 - RNA, 22 nt, Salmonella enterica enterica serovar Typhi
uccaguugaaaaccacaaucac

SEQ ID NO: 1698214 - RNA, 18 nt, Salmonella enterica enterica serovar Typhi
uccaguguuguucucuga

SEQ ID NO: 1698215 - RNA, 21 nt, Salmonella enterica enterica serovar Typhi
uccagggcugcuggccuucca

SEQ ID NO: 1698216 - RNA, 18 nt, Salmonella enterica enterica serovar Typhi
uccagguuuuaguuucac

SEQ ID NO: 1698217 - RNA, 24 nt, Salmonella enterica enterica serovar Typhi
uccaguaacgcguccaacuggcuu

SEQ ID NO: 1698218 - RNA, 18 nt, Salmonella enterica enterica serovar Typhi
uccaguaauucccggcag

SEQ ID NO: 1698219 - RNA, 22 nt, Salmonella enterica enterica serovar Typhi
uccaguaauucccggcaggcgu

SEQ ID NO: 1698220 - RNA, 16 nt, Salmonella enterica enterica serovar Typhi
uccagucagcaauuaa

SEQ ID NO: 1698221 - RNA, 14 nt, Salmonella enterica enterica serovar Typhi
uccagucagcguua

SEQ ID NO: 1698222 - RNA, 23 nt, Salmonella enterica enterica serovar Typhi
uccagcguuucaugaaugccggg

SEQ ID NO: 1698223 - RNA, 14 nt, Salmonella enterica enterica serovar Typhi
uccagcuacuggcc

SEQ ID NO: 1698224 - RNA, 16 nt, Salmonella enterica enterica serovar Typhi
uccagcuacuggccac

SEQ ID NO: 1698225 - RNA, 18 nt, Salmonella enterica enterica serovar Typhi
uccagcguuaaaauaccg

SEQ ID NO: 1698226 - RNA, 14 nt, Salmonella enterica enterica serovar Typhi
uccagcguuucucu

SEQ ID NO: 1698227 - RNA, 20 nt, Salmonella enterica enterica serovar Typhi
uccagcuaaguuuguaaaau

SEQ ID NO: 1698228 - RNA, 13 nt, Salmonella enterica enterica serovar Typhi
uccagcuccagcc

SEQ ID NO: 1698229 - RNA, 18 nt, Salmonella enterica enterica serovar Typhi
uccagcucagggucccca

SEQ ID NO: 1698230 - RNA, 16 nt, Salmonella enterica enterica serovar Typhi
uccagcucauuuuuac

SEQ ID NO: 1698231 - RNA, 15 nt, Salmonella enterica enterica serovar Typhi
uccagcucagggucc

SEQ ID NO: 1698232 - RNA, 14 nt, Salmonella enterica enterica serovar Typhi
uccagcucaguuuc

SEQ ID NO: 1698233 - RNA, 17 nt, Salmonella enterica enterica serovar Typhi
uccagcuguaccaucac

SEQ ID NO: 1698234 - RNA, 19 nt, Salmonella enterica enterica serovar Typhi
uccagcuguuuaagcgccu

SEQ ID NO: 1698235 - RNA, 20 nt, Salmonella enterica enterica serovar Typhi
uccagcucgcgauaggccuc

SEQ ID NO: 1698236 - RNA, 19 nt, Salmonella enterica enterica serovar Typhi
uccagcuccagccgcugcc

SEQ ID NO: 1698237 - RNA, 16 nt, Salmonella enterica enterica serovar Typhi
uccaggccgccagcgu

SEQ ID NO: 1698238 - RNA, 20 nt, Salmonella enterica enterica serovar Typhi
uccagggauugauggccagc

SEQ ID NO: 1698239 - RNA, 23 nt, Salmonella enterica enterica serovar Typhi
uccagcuugccgucacaggcggc

SEQ ID NO: 1698240 - RNA, 22 nt, Salmonella enterica enterica serovar Typhi
uccaggaaguaaauuauuccuu

SEQ ID NO: 1698241 - RNA, 15 nt, Salmonella enterica enterica serovar Typhi
uccagcgccugcugu

SEQ ID NO: 1698242 - RNA, 23 nt, Salmonella enterica enterica serovar Typhi
uccagcgccugcuguaaaauauc

SEQ ID NO: 1698243 - RNA, 22 nt, Salmonella enterica enterica serovar Typhi
uccagcggccaguguacauagc

SEQ ID NO: 1698244 - RNA, 22 nt, Salmonella enterica enterica serovar Typhi
uccagcgcguccuuauaaugcu

SEQ ID NO: 1698245 - RNA, 18 nt, Salmonella enterica enterica serovar Typhi
uccagcgcucaaucagcg

SEQ ID NO: 1698246 - RNA, 16 nt, Salmonella enterica enterica serovar Typhi
uccagcgcguccuuau

SEQ ID NO: 1698247 - RNA, 15 nt, Salmonella enterica enterica serovar Typhi
uccagcgaauaauga

SEQ ID NO: 1698248 - RNA, 17 nt, Salmonella enterica enterica serovar Typhi
uccagcgagcaggaaua

SEQ ID NO: 1698249 - RNA, 14 nt, Salmonella enterica enterica serovar Typhi
uccagcgccagcgc

SEQ ID NO: 1698250 - RNA, 15 nt, Salmonella enterica enterica serovar Typhi
uccagcgccagcgcc

SEQ ID NO: 1698251 - RNA, 16 nt, Salmonella enterica enterica serovar Typhi
uccagcgaaccuucca

SEQ ID NO: 1698252 - RNA, 17 nt, Salmonella enterica enterica serovar Typhi
uccagcgaaccuuccau

SEQ ID NO: 1698253 - RNA, 18 nt, Salmonella enterica enterica serovar Typhi
uccagccgcuuuucgcuu

SEQ ID NO: 1698254 - RNA, 22 nt, Salmonella enterica enterica serovar Typhi
uccagccguuuaaucucuucau

SEQ ID NO: 1698255 - RNA, 16 nt, Salmonella enterica enterica serovar Typhi
uccagccgguguuaac

SEQ ID NO: 1698256 - RNA, 17 nt, Salmonella enterica enterica serovar Typhi
uccagccgguguuaacc

SEQ ID NO: 1698257 - RNA, 18 nt, Salmonella enterica enterica serovar Typhi
uccagcagguggaucuga

SEQ ID NO: 1698258 - RNA, 22 nt, Salmonella enterica enterica serovar Typhi
uccagcagcagcaccggcuguu

SEQ ID NO: 1698259 - RNA, 15 nt, Salmonella enterica enterica serovar Typhi
uccagcaucagcaau

SEQ ID NO: 1698260 - RNA, 22 nt, Salmonella enterica enterica serovar Typhi
uccagcauaauaugaugcagac

SEQ ID NO: 1698261 - RNA, 18 nt, Salmonella enterica enterica serovar Typhi
uccagccccuucgcuguc

SEQ ID NO: 1698262 - RNA, 23 nt, Salmonella enterica enterica serovar Typhi
uccagccgcccgcgauaaaaauc

SEQ ID NO: 1698263 - RNA, 23 nt, Salmonella enterica enterica serovar Typhi
uccagccagcguuucuggaagua

SEQ ID NO: 1698264 - RNA, 13 nt, Salmonella enterica enterica serovar Typhi
uccagcauucuau

SEQ ID NO: 1698265 - RNA, 13 nt, Salmonella enterica enterica serovar Typhi
uccagccagggau

SEQ ID NO: 1698266 - RNA, 14 nt, Salmonella enterica enterica serovar Typhi
uccagcaacagaag

SEQ ID NO: 1698267 - RNA, 20 nt, Salmonella enterica enterica serovar Typhi
uccagcaaaccuuccgccag

SEQ ID NO: 1698268 - RNA, 16 nt, Salmonella enterica enterica serovar Typhi
uccagauugagacaaa

SEQ ID NO: 1698269 - RNA, 20 nt, Salmonella enterica enterica serovar Typhi
uccagaugcgccagauucau

SEQ ID NO: 1698270 - RNA, 20 nt, Salmonella enterica enterica serovar Typhi
uccagcagcagagccggaac

SEQ ID NO: 1698271 - RNA, 19 nt, Salmonella enterica enterica serovar Typhi
uccagcagcagcaccggcu

SEQ ID NO: 1698272 - RNA, 13 nt, Salmonella enterica enterica serovar Typhi
uccagcagcacuu

SEQ ID NO: 1698273 - RNA, 22 nt, Salmonella enterica enterica serovar Typhi
uccagcagacucauggacaaaa

SEQ ID NO: 1698274 - RNA, 11 nt, Salmonella enterica enterica serovar Typhi
uccagcagcca

SEQ ID NO: 1698275 - RNA, 12 nt, Salmonella enterica enterica serovar Typhi
uccagcacggca

SEQ ID NO: 1698276 - RNA, 20 nt, Salmonella enterica enterica serovar Typhi
uccagcacggcauaagccuc

SEQ ID NO: 1698277 - RNA, 20 nt, Salmonella enterica enterica serovar Typhi
uccagcacgagcgccagccc

SEQ ID NO: 1698278 - RNA, 22 nt, Salmonella enterica enterica serovar Typhi
uccagcacgauauccagcaccu

SEQ ID NO: 1698279 - RNA, 19 nt, Salmonella enterica enterica serovar Typhi
uccagaacugcgaaaucac

SEQ ID NO: 1698280 - RNA, 12 nt, Salmonella enterica enterica serovar Typhi
uccagacagcuu

SEQ ID NO: 1698281 - RNA, 17 nt, Salmonella enterica enterica serovar Typhi
uccagacccacagccgg

SEQ ID NO: 1698282 - RNA, 17 nt, Salmonella enterica enterica serovar Typhi
uccagaauacgccgccg

SEQ ID NO: 1698283 - RNA, 16 nt, Salmonella enterica enterica serovar Typhi
uccagauauggcaaac

SEQ ID NO: 1698284 - RNA, 16 nt, Salmonella enterica enterica serovar Typhi
uccagauagcgcugcg

SEQ ID NO: 1698285 - RNA, 12 nt, Salmonella enterica enterica serovar Typhi
uccagaucuuca

SEQ ID NO: 1698286 - RNA, 14 nt, Salmonella enterica enterica serovar Typhi
uccagaucuucaga

SEQ ID NO: 1698287 - RNA, 22 nt, Salmonella enterica enterica serovar Typhi
uccagaggaucuggacgccaau

SEQ ID NO: 1698288 - RNA, 18 nt, Salmonella enterica enterica serovar Typhi
uccagaguacauucucuu

SEQ ID NO: 1698289 - RNA, 19 nt, Salmonella enterica enterica serovar Typhi
uccagacggcgcuguuguu

SEQ ID NO: 1698290 - RNA, 15 nt, Salmonella enterica enterica serovar Typhi
uccagacguugcucu

SEQ ID NO: 1698291 - RNA, 16 nt, Salmonella enterica enterica serovar Typhi
uccacugagcgcgcca

SEQ ID NO: 1698292 - RNA, 20 nt, Salmonella enterica enterica serovar Typhi
uccacugagcuucaccgcca

SEQ ID NO: 1698293 - RNA, 17 nt, Salmonella enterica enterica serovar Typhi
uccacuuugccuuuauu

SEQ ID NO: 1698294 - RNA, 22 nt, Salmonella enterica enterica serovar Typhi
uccacuguucguccauaaaggc

SEQ ID NO: 1698295 - RNA, 12 nt, Salmonella enterica enterica serovar Typhi
uccaccuggccc

SEQ ID NO: 1698296 - RNA, 18 nt, Salmonella enterica enterica serovar Typhi
uccaccuggcccugcauc

SEQ ID NO: 1698297 - RNA, 15 nt, Salmonella enterica enterica serovar Typhi
uccaccucuucugca

SEQ ID NO: 1698298 - RNA, 22 nt, Salmonella enterica enterica serovar Typhi
uccaccuggcccugcaucagcu

SEQ ID NO: 1698299 - RNA, 19 nt, Salmonella enterica enterica serovar Typhi
uccaccuucucuuuaugcg

SEQ ID NO: 1698300 - RNA, 19 nt, Salmonella enterica enterica serovar Typhi
uccaccgccagacgcccca

SEQ ID NO: 1698301 - RNA, 14 nt, Salmonella enterica enterica serovar Typhi
uccaccagcuucau

SEQ ID NO: 1698302 - RNA, 13 nt, Salmonella enterica enterica serovar Typhi
uccaccagcgcca

SEQ ID NO: 1698303 - RNA, 19 nt, Salmonella enterica enterica serovar Typhi
uccaccagcccaucuuucg

SEQ ID NO: 1698304 - RNA, 18 nt, Salmonella enterica enterica serovar Typhi
uccaccaggcaugcagcu

SEQ ID NO: 1698305 - RNA, 21 nt, Salmonella enterica enterica serovar Typhi
uccacaccguuacgaccccau

SEQ ID NO: 1698306 - RNA, 20 nt, Salmonella enterica enterica serovar Typhi
uccacagguuaucgccgccc

SEQ ID NO: 1698307 - RNA, 17 nt, Salmonella enterica enterica serovar Typhi
uccacaguaaccccaua

SEQ ID NO: 1698308 - RNA, 16 nt, Salmonella enterica enterica serovar Typhi
uccacagcgaauuccg

SEQ ID NO: 1698309 - RNA, 15 nt, Salmonella enterica enterica serovar Typhi
uccacauaaaguagc

SEQ ID NO: 1698310 - RNA, 19 nt, Salmonella enterica enterica serovar Typhi
uccacauucguaacaugcu

SEQ ID NO: 1698311 - RNA, 12 nt, Salmonella enterica enterica serovar Typhi
uccaccaccucc

SEQ ID NO: 1698312 - RNA, 24 nt, Salmonella enterica enterica serovar Typhi
uccaccagacccgggacuucaggc

SEQ ID NO: 1698313 - RNA, 17 nt, Salmonella enterica enterica serovar Typhi
uccaaucucuuuugcgg

SEQ ID NO: 1698314 - RNA, 13 nt, Salmonella enterica enterica serovar Typhi
uccaauauuuauu

SEQ ID NO: 1698315 - RNA, 21 nt, Salmonella enterica enterica serovar Typhi
uccaauauuuauuuaauguuu

SEQ ID NO: 1698316 - RNA, 13 nt, Salmonella enterica enterica serovar Typhi
uccacaaucaauu

SEQ ID NO: 1698317 - RNA, 21 nt, Salmonella enterica enterica serovar Typhi
uccacaaacuccagacgauga

SEQ ID NO: 1698318 - RNA, 16 nt, Salmonella enterica enterica serovar Typhi
uccaauaauggagaug

SEQ ID NO: 1698319 - RNA, 19 nt, Salmonella enterica enterica serovar Typhi
uccaauagagcaguuaaua

SEQ ID NO: 1698320 - RNA, 17 nt, Salmonella enterica enterica serovar Typhi
uccaacuggcuuucauc

SEQ ID NO: 1698321 - RNA, 21 nt, Salmonella enterica enterica serovar Typhi
ucccccggcaccacgcacagu

SEQ ID NO: 1698322 - RNA, 22 nt, Salmonella enterica enterica serovar Typhi
ucccccuggccugcucaucagg

SEQ ID NO: 1698323 - RNA, 12 nt, Salmonella enterica enterica serovar Typhi
ucccccuggccc

SEQ ID NO: 1698324 - RNA, 21 nt, Salmonella enterica enterica serovar Typhi
ucccccuggccugcucaucag

SEQ ID NO: 1698325 - RNA, 17 nt, Salmonella enterica enterica serovar Typhi
uccccccuuuuuugcug

SEQ ID NO: 1698326 - RNA, 17 nt, Salmonella enterica enterica serovar Typhi
uccccccucugauuggc

SEQ ID NO: 1698327 - RNA, 20 nt, Salmonella enterica enterica serovar Typhi
uccccgcuggcgcggggaac

SEQ ID NO: 1698328 - RNA, 14 nt, Salmonella enterica enterica serovar Typhi
uccccggcaggcuc

SEQ ID NO: 1698329 - RNA, 22 nt, Salmonella enterica enterica serovar Typhi
uccccggcaaccuuaaacaucg

SEQ ID NO: 1698330 - RNA, 13 nt, Salmonella enterica enterica serovar Typhi
uccccggcagccu

SEQ ID NO: 1698331 - RNA, 20 nt, Salmonella enterica enterica serovar Typhi
uccccgccgagaaaauaccg

SEQ ID NO: 1698332 - RNA, 12 nt, Salmonella enterica enterica serovar Typhi
uccccgccgcca

SEQ ID NO: 1698333 - RNA, 17 nt, Salmonella enterica enterica serovar Typhi
uccccgccgccaucacc

SEQ ID NO: 1698334 - RNA, 19 nt, Salmonella enterica enterica serovar Typhi
uccccauauuccagaaagg

SEQ ID NO: 1698335 - RNA, 23 nt, Salmonella enterica enterica serovar Typhi
uccccauacugacggcgcucuuu

SEQ ID NO: 1698336 - RNA, 19 nt, Salmonella enterica enterica serovar Typhi
uccccauaucccgaaaagc

SEQ ID NO: 1698337 - RNA, 12 nt, Salmonella enterica enterica serovar Typhi
uccccauguuga

SEQ ID NO: 1698338 - RNA, 23 nt, Salmonella enterica enterica serovar Typhi
uccccagcguaccacgccgcaca

SEQ ID NO: 1698339 - RNA, 19 nt, Salmonella enterica enterica serovar Typhi
uccccaggcgcuauuccca

SEQ ID NO: 1698340 - RNA, 14 nt, Salmonella enterica enterica serovar Typhi
uccccaccaccgcc

SEQ ID NO: 1698341 - RNA, 22 nt, Salmonella enterica enterica serovar Typhi
uccccacgccgaccaccagcuu

SEQ ID NO: 1698342 - RNA, 22 nt, Salmonella enterica enterica serovar Typhi
uccccaccugacuauacccaaa

SEQ ID NO: 1698343 - RNA, 23 nt, Salmonella enterica enterica serovar Typhi
ucccauaccuguaucaaaccaac

SEQ ID NO: 1698344 - RNA, 21 nt, Salmonella enterica enterica serovar Typhi
ucccauaccuguaucaaacca

SEQ ID NO: 1698345 - RNA, 22 nt, Salmonella enterica enterica serovar Typhi
ucccaucgcuuugcagaaaauc

SEQ ID NO: 1698346 - RNA, 18 nt, Salmonella enterica enterica serovar Typhi
ucccauauuuuuucugcc

SEQ ID NO: 1698347 - RNA, 19 nt, Salmonella enterica enterica serovar Typhi
ucccauccgugcgaugaga

SEQ ID NO: 1698348 - RNA, 19 nt, Salmonella enterica enterica serovar Typhi
ucccaugacgacagguuua

SEQ ID NO: 1698349 - RNA, 15 nt, Salmonella enterica enterica serovar Typhi
ucccauucacguagc

SEQ ID NO: 1698350 - RNA, 16 nt, Salmonella enterica enterica serovar Typhi
uccccaaccgccagcc

SEQ ID NO: 1698351 - RNA, 22 nt, Salmonella enterica enterica serovar Typhi
uccccaacgacagcacuacgcu

SEQ ID NO: 1698352 - RNA, 13 nt, Salmonella enterica enterica serovar Typhi
uccccaaacugcu

SEQ ID NO: 1698353 - RNA, 16 nt, Salmonella enterica enterica serovar Typhi
ucccauuccugcaaga

SEQ ID NO: 1698354 - RNA, 18 nt, Salmonella enterica enterica serovar Typhi
ucccauuccugcaagaag

SEQ ID NO: 1698355 - RNA, 14 nt, Salmonella enterica enterica serovar Typhi
ucccaguggcgucg

SEQ ID NO: 1698356 - RNA, 17 nt, Salmonella enterica enterica serovar Typhi
ucccaguuggcagggcu

SEQ ID NO: 1698357 - RNA, 16 nt, Salmonella enterica enterica serovar Typhi
ucccagugucaacugc

SEQ ID NO: 1698358 - RNA, 16 nt, Salmonella enterica enterica serovar Typhi
ucccaggcgcgcagcu

SEQ ID NO: 1698359 - RNA, 19 nt, Salmonella enterica enterica serovar Typhi
ucccaggccgccaccgccu

SEQ ID NO: 1698360 - RNA, 19 nt, Salmonella enterica enterica serovar Typhi
ucccaggcgcgcagcugcc

SEQ ID NO: 1698361 - RNA, 23 nt, Salmonella enterica enterica serovar Typhi
ucccaguaguuaccguaaucauc

SEQ ID NO: 1698362 - RNA, 21 nt, Salmonella enterica enterica serovar Typhi
ucccagccgggcaggaaaagc

SEQ ID NO: 1698363 - RNA, 22 nt, Salmonella enterica enterica serovar Typhi
ucccagccuuccuggucugcca

SEQ ID NO: 1698364 - RNA, 14 nt, Salmonella enterica enterica serovar Typhi
ucccagccgggcag

SEQ ID NO: 1698365 - RNA, 17 nt, Salmonella enterica enterica serovar Typhi
ucccagauuaaaucauc

SEQ ID NO: 1698366 - RNA, 14 nt, Salmonella enterica enterica serovar Typhi
uccauggcaaaauu

SEQ ID NO: 1698367 - RNA, 17 nt, Salmonella enterica enterica serovar Typhi
uccaugccuuuggccug

SEQ ID NO: 1698368 - RNA, 21 nt, Salmonella enterica enterica serovar Typhi
uccaugccuuuggccuggaga

SEQ ID NO: 1698369 - RNA, 18 nt, Salmonella enterica enterica serovar Typhi
uccaugcuuucaauaaau

SEQ ID NO: 1698370 - RNA, 15 nt, Salmonella enterica enterica serovar Typhi
uccaugccggcccga

SEQ ID NO: 1698371 - RNA, 13 nt, Salmonella enterica enterica serovar Typhi
uccaugccggcuu

SEQ ID NO: 1698372 - RNA, 18 nt, Salmonella enterica enterica serovar Typhi
uccaugacgaccacagcc

SEQ ID NO: 1698373 - RNA, 20 nt, Salmonella enterica enterica serovar Typhi
uccaugacgaccacagccgu

SEQ ID NO: 1698374 - RNA, 16 nt, Salmonella enterica enterica serovar Typhi
uccaugagaagaaaaa

SEQ ID NO: 1698375 - RNA, 18 nt, Salmonella enterica enterica serovar Typhi
uccauguacgcaggcgac

SEQ ID NO: 1698376 - RNA, 23 nt, Salmonella enterica enterica serovar Typhi
uccauggucagacgcucagccuu

SEQ ID NO: 1698377 - RNA, 15 nt, Salmonella enterica enterica serovar Typhi
uccauguaaacucca

SEQ ID NO: 1698378 - RNA, 19 nt, Salmonella enterica enterica serovar Typhi
uccauguaaacuccauuaa

SEQ ID NO: 1698379 - RNA, 20 nt, Salmonella enterica enterica serovar Typhi
uccauguuuccccuucuggu

SEQ ID NO: 1698380 - RNA, 19 nt, Salmonella enterica enterica serovar Typhi
uccauguugccaugguuca

SEQ ID NO: 1698381 - RNA, 20 nt, Salmonella enterica enterica serovar Typhi
uccauuaagucgaugaauga

SEQ ID NO: 1698382 - RNA, 22 nt, Salmonella enterica enterica serovar Typhi
uccauuagcgccugaugcacau

SEQ ID NO: 1698383 - RNA, 22 nt, Salmonella enterica enterica serovar Typhi
uccauucucaucagaccgugaa

SEQ ID NO: 1698384 - RNA, 16 nt, Salmonella enterica enterica serovar Typhi
uccauugcgagaaaaa

SEQ ID NO: 1698385 - RNA, 19 nt, Salmonella enterica enterica serovar Typhi
uccauucggcgaaagaagc

SEQ ID NO: 1698386 - RNA, 14 nt, Salmonella enterica enterica serovar Typhi
uccauucaucgauu

SEQ ID NO: 1698387 - RNA, 10 nt, Salmonella enterica enterica serovar Typhi
uccauuuccu

SEQ ID NO: 1698388 - RNA, 14 nt, Salmonella enterica enterica serovar Typhi
uccauuuuaaauac

SEQ ID NO: 1698389 - RNA, 17 nt, Salmonella enterica enterica serovar Typhi
uccauuuuaaauacacc

SEQ ID NO: 1698390 - RNA, 17 nt, Salmonella enterica enterica serovar Typhi
uccauuuuuuaucugac

SEQ ID NO: 1698391 - RNA, 12 nt, Salmonella enterica enterica serovar Typhi
uccauuuuucag

SEQ ID NO: 1698392 - RNA, 20 nt, Salmonella enterica enterica serovar Typhi
uccauuuuucagauaacgaa

SEQ ID NO: 1698393 - RNA, 21 nt, Salmonella enterica enterica serovar Typhi
uccauuuuggggaaaauaccg

SEQ ID NO: 1698394 - RNA, 12 nt, Salmonella enterica enterica serovar Typhi
uccauuuuccua

SEQ ID NO: 1698395 - RNA, 18 nt, Salmonella enterica enterica serovar Typhi
uccauuuuggggaaaaua

SEQ ID NO: 1698396 - RNA, 21 nt, Salmonella enterica enterica serovar Typhi
ucccaacccgaccaggacaaa

SEQ ID NO: 1698397 - RNA, 15 nt, Salmonella enterica enterica serovar Typhi
ucccaacagcgagcu

SEQ ID NO: 1698398 - RNA, 17 nt, Salmonella enterica enterica serovar Typhi
ucccaaugcggaaacca

SEQ ID NO: 1698399 - RNA, 13 nt, Salmonella enterica enterica serovar Typhi
ucccaaugcuuuc

SEQ ID NO: 1698400 - RNA, 14 nt, Salmonella enterica enterica serovar Typhi
ucccacaccacacg

SEQ ID NO: 1698401 - RNA, 15 nt, Salmonella enterica enterica serovar Typhi
ucccacgcauagucc

SEQ ID NO: 1698402 - RNA, 13 nt, Salmonella enterica enterica serovar Typhi
ucccaccgggcca

SEQ ID NO: 1698403 - RNA, 13 nt, Salmonella enterica enterica serovar Typhi
ucccaccacgcag

SEQ ID NO: 1698404 - RNA, 12 nt, Salmonella enterica enterica serovar Typhi
ucccaccagcag

SEQ ID NO: 1698405 - RNA, 13 nt, Salmonella enterica enterica serovar Typhi
ucccagaccauuc

SEQ ID NO: 1698406 - RNA, 20 nt, Salmonella enterica enterica serovar Typhi
ucccacuuaggcagccaggc

SEQ ID NO: 1698407 - RNA, 13 nt, Salmonella enterica enterica serovar Typhi
ucccacucuucca

SEQ ID NO: 1698408 - RNA, 14 nt, Salmonella enterica enterica serovar Typhi
ucccgauaaugacc

SEQ ID NO: 1698409 - RNA, 15 nt, Salmonella enterica enterica serovar Typhi
ucccgauacgguugc

SEQ ID NO: 1698410 - RNA, 22 nt, Salmonella enterica enterica serovar Typhi
ucccgagccggguuauagccuu

SEQ ID NO: 1698411 - RNA, 20 nt, Salmonella enterica enterica serovar Typhi
ucccgacuuuacaccccacu

SEQ ID NO: 1698412 - RNA, 13 nt, Salmonella enterica enterica serovar Typhi
ucccgaucuucau

SEQ ID NO: 1698413 - RNA, 17 nt, Salmonella enterica enterica serovar Typhi
ucccgaugguggcgucg

SEQ ID NO: 1698414 - RNA, 15 nt, Salmonella enterica enterica serovar Typhi
ucccgauauaaaggu

SEQ ID NO: 1698415 - RNA, 20 nt, Salmonella enterica enterica serovar Typhi
ucccgcaaacuggccacagc

SEQ ID NO: 1698416 - RNA, 23 nt, Salmonella enterica enterica serovar Typhi
ucccgcacccgggaaagcggauc

SEQ ID NO: 1698417 - RNA, 13 nt, Salmonella enterica enterica serovar Typhi
ucccgcagccagc

SEQ ID NO: 1698418 - RNA, 14 nt, Salmonella enterica enterica serovar Typhi
ucccgcccagcaac

SEQ ID NO: 1698419 - RNA, 12 nt, Salmonella enterica enterica serovar Typhi
ucccgccgcgau

SEQ ID NO: 1698420 - RNA, 12 nt, Salmonella enterica enterica serovar Typhi
ucccgccugcug

SEQ ID NO: 1698421 - RNA, 14 nt, Salmonella enterica enterica serovar Typhi
ucccgccugcugca

SEQ ID NO: 1698422 - RNA, 17 nt, Salmonella enterica enterica serovar Typhi
ucccgccuugcggcgcc

SEQ ID NO: 1698423 - RNA, 17 nt, Salmonella enterica enterica serovar Typhi
uccccuauacgccaucu

SEQ ID NO: 1698424 - RNA, 21 nt, Salmonella enterica enterica serovar Typhi
uccccucaugacuuuuuucaa

SEQ ID NO: 1698425 - RNA, 21 nt, Salmonella enterica enterica serovar Typhi
uccccggucagucccagcguu

SEQ ID NO: 1698426 - RNA, 14 nt, Salmonella enterica enterica serovar Typhi
uccccggcuucaca

SEQ ID NO: 1698427 - RNA, 13 nt, Salmonella enterica enterica serovar Typhi
uccccggcuucca

SEQ ID NO: 1698428 - RNA, 21 nt, Salmonella enterica enterica serovar Typhi
uccccggguaucgcuuucggc

SEQ ID NO: 1698429 - RNA, 12 nt, Salmonella enterica enterica serovar Typhi
uccccgggaaca

SEQ ID NO: 1698430 - RNA, 19 nt, Salmonella enterica enterica serovar Typhi
uccccuucuguaagcaauu

SEQ ID NO: 1698431 - RNA, 16 nt, Salmonella enterica enterica serovar Typhi
uccccuuuuuucuguu

SEQ ID NO: 1698432 - RNA, 15 nt, Salmonella enterica enterica serovar Typhi
uccccucuuccauca

SEQ ID NO: 1698433 - RNA, 20 nt, Salmonella enterica enterica serovar Typhi
uccccugcgguuucuaccac

SEQ ID NO: 1698434 - RNA, 15 nt, Salmonella enterica enterica serovar Typhi
uccccugcuccugcc

SEQ ID NO: 1698435 - RNA, 14 nt, Salmonella enterica enterica serovar Typhi
uccccuucaggaau

SEQ ID NO: 1698436 - RNA, 12 nt, Salmonella enterica enterica serovar Typhi
ucccgcuggcug

SEQ ID NO: 1698437 - RNA, 21 nt, Salmonella enterica enterica serovar Typhi
ucccggaacaaaagaaagcaa

SEQ ID NO: 1698438 - RNA, 18 nt, Salmonella enterica enterica serovar Typhi
ucccgcugugauccaugu

SEQ ID NO: 1698439 - RNA, 17 nt, Salmonella enterica enterica serovar Typhi
ucccgcgcuucauccga

SEQ ID NO: 1698440 - RNA, 22 nt, Salmonella enterica enterica serovar Typhi
ucccgcguucgcgcaguucauc

SEQ ID NO: 1698441 - RNA, 18 nt, Salmonella enterica enterica serovar Typhi
ucccgcggcggacagcgg

SEQ ID NO: 1698442 - RNA, 21 nt, Salmonella enterica enterica serovar Typhi
ucccggcaauuaccgccagcg

SEQ ID NO: 1698443 - RNA, 23 nt, Salmonella enterica enterica serovar Typhi
ucccgggcgauaaaccagcccca

SEQ ID NO: 1698444 - RNA, 23 nt, Salmonella enterica enterica serovar Typhi
ucccgguuaucgaacagcuuacc

SEQ ID NO: 1698445 - RNA, 19 nt, Salmonella enterica enterica serovar Typhi
ucccuacucucgcaugggg

SEQ ID NO: 1698446 - RNA, 23 nt, Salmonella enterica enterica serovar Typhi
ucccuacugcuuagcucaucagc

SEQ ID NO: 1698447 - RNA, 18 nt, Salmonella enterica enterica serovar Typhi
ucccguuuucgucccagc

SEQ ID NO: 1698448 - RNA, 17 nt, Salmonella enterica enterica serovar Typhi
ucccguuucagccccuu

SEQ ID NO: 1698449 - RNA, 17 nt, Salmonella enterica enterica serovar Typhi
ucccuaagccggcaggc

SEQ ID NO: 1698450 - RNA, 17 nt, Salmonella enterica enterica serovar Typhi
ucccucauauuuguauc

SEQ ID NO: 1698451 - RNA, 14 nt, Salmonella enterica enterica serovar Typhi
ucccucgaaguauu

SEQ ID NO: 1698452 - RNA, 14 nt, Salmonella enterica enterica serovar Typhi
ucccuccugcucca

SEQ ID NO: 1698453 - RNA, 17 nt, Salmonella enterica enterica serovar Typhi
ucccucgacaauuucac

SEQ ID NO: 1698454 - RNA, 11 nt, Salmonella enterica enterica serovar Typhi
ucccucuccag

SEQ ID NO: 1698455 - RNA, 16 nt, Salmonella enterica enterica serovar Typhi
ucccucuccagggcaa

SEQ ID NO: 1698456 - RNA, 21 nt, Salmonella enterica enterica serovar Typhi
ucccugccagugaaaguuuuc

SEQ ID NO: 1698457 - RNA, 18 nt, Salmonella enterica enterica serovar Typhi
ucccugaccuuccaucca

SEQ ID NO: 1698458 - RNA, 16 nt, Salmonella enterica enterica serovar Typhi
ucccugagucuugccu

SEQ ID NO: 1698459 - RNA, 16 nt, Salmonella enterica enterica serovar Typhi
ucccuggauaaaauau

SEQ ID NO: 1698460 - RNA, 17 nt, Salmonella enterica enterica serovar Typhi
ucccuuccgccaccagg

SEQ ID NO: 1698461 - RNA, 16 nt, Salmonella enterica enterica serovar Typhi
ucccuucucgcuaaua

SEQ ID NO: 1698462 - RNA, 18 nt, Salmonella enterica enterica serovar Typhi
ucccuuccgccaccaggu

SEQ ID NO: 1698463 - RNA, 20 nt, Salmonella enterica enterica serovar Typhi
ucccuuccgccaccagguuc

SEQ ID NO: 1698464 - RNA, 15 nt, Salmonella enterica enterica serovar Typhi
ucccuucuuuuacug

SEQ ID NO: 1698465 - RNA, 12 nt, Salmonella enterica enterica serovar Typhi
ucccuucuuuua

SEQ ID NO: 1698466 - RNA, 14 nt, Salmonella enterica enterica serovar Typhi
ucccuucuuuuacu

SEQ ID NO: 1698467 - RNA, 16 nt, Salmonella enterica enterica serovar Typhi
ucccuuucaaaaaaga

SEQ ID NO: 1698468 - RNA, 21 nt, Salmonella enterica enterica serovar Typhi
uccgaauauuuagcuuuucgg

SEQ ID NO: 1698469 - RNA, 11 nt, Salmonella enterica enterica serovar Typhi
uccgaauaauc

SEQ ID NO: 1698470 - RNA, 15 nt, Salmonella enterica enterica serovar Typhi
uccgaacucaugccg

SEQ ID NO: 1698471 - RNA, 14 nt, Salmonella enterica enterica serovar Typhi
uccgacauuguucu

SEQ ID NO: 1698472 - RNA, 22 nt, Salmonella enterica enterica serovar Typhi
uccgacagugaacggcauaauc

SEQ ID NO: 1698473 - RNA, 13 nt, Salmonella enterica enterica serovar Typhi
uccgacauuagcg

SEQ ID NO: 1698474 - RNA, 22 nt, Salmonella enterica enterica serovar Typhi
uccgagacgguaagaauaauaa

SEQ ID NO: 1698475 - RNA, 18 nt, Salmonella enterica enterica serovar Typhi
uccgagacucaaagaaaa

SEQ ID NO: 1698476 - RNA, 20 nt, Salmonella enterica enterica serovar Typhi
uccgaucuacgcuauuucca

SEQ ID NO: 1698477 - RNA, 20 nt, Salmonella enterica enterica serovar Typhi
ucgcgucaauauuaaugcug

SEQ ID NO: 1698478 - RNA, 19 nt, Salmonella enterica enterica serovar Typhi
ucgcgucgccaucaggcag

SEQ ID NO: 1698479 - RNA, 19 nt, Salmonella enterica enterica serovar Typhi
ucgcgguuuacuucuucag

SEQ ID NO: 1698480 - RNA, 13 nt, Salmonella enterica enterica serovar Typhi
ucgcgguuagaaa

SEQ ID NO: 1698481 - RNA, 17 nt, Salmonella enterica enterica serovar Typhi
ucgcgguugacgcugcu

SEQ ID NO: 1698482 - RNA, 16 nt, Salmonella enterica enterica serovar Typhi
ucgcggugaucccagg

SEQ ID NO: 1698483 - RNA, 18 nt, Salmonella enterica enterica serovar Typhi
ucgcgguaacggccuggc

SEQ ID NO: 1698484 - RNA, 14 nt, Salmonella enterica enterica serovar Typhi
ucgcuaauaaauuc

SEQ ID NO: 1698485 - RNA, 22 nt, Salmonella enterica enterica serovar Typhi
ucgcuaagcgucagacacaaua

SEQ ID NO: 1698486 - RNA, 14 nt, Salmonella enterica enterica serovar Typhi
ucgcuaauuuuuaa

SEQ ID NO: 1698487 - RNA, 20 nt, Salmonella enterica enterica serovar Typhi
ucgcuacaaccagcgcggcc

SEQ ID NO: 1698488 - RNA, 15 nt, Salmonella enterica enterica serovar Typhi
ucgcuaacccaggcc

SEQ ID NO: 1698489 - RNA, 23 nt, Salmonella enterica enterica serovar Typhi
ucgcuaucugacagccaaacugc

SEQ ID NO: 1698490 - RNA, 14 nt, Salmonella enterica enterica serovar Typhi
ucgcuauccagcag

SEQ ID NO: 1698491 - RNA, 23 nt, Salmonella enterica enterica serovar Typhi
ucgcuaagagugacgguuuucac

SEQ ID NO: 1698492 - RNA, 20 nt, Salmonella enterica enterica serovar Typhi
ucgcuaccuucuucccauau

SEQ ID NO: 1698493 - RNA, 16 nt, Salmonella enterica enterica serovar Typhi
ucgcuaccuuuuuuca

SEQ ID NO: 1698494 - RNA, 17 nt, Salmonella enterica enterica serovar Typhi
ucgcuaccuuuuuucag

SEQ ID NO: 1698495 - RNA, 19 nt, Salmonella enterica enterica serovar Typhi
ucgcuaccuuuuuucagua

SEQ ID NO: 1698496 - RNA, 11 nt, Salmonella enterica enterica serovar Typhi
ucgcuccuccc

SEQ ID NO: 1698497 - RNA, 17 nt, Salmonella enterica enterica serovar Typhi
ucgcucuauauccugcc

SEQ ID NO: 1698498 - RNA, 19 nt, Salmonella enterica enterica serovar Typhi
ucgcucuuuuuuuugcuua

SEQ ID NO: 1698499 - RNA, 17 nt, Salmonella enterica enterica serovar Typhi
ucgcucucuuucaccag

SEQ ID NO: 1698500 - RNA, 15 nt, Salmonella enterica enterica serovar Typhi
ucgcucuaucgccug

SEQ ID NO: 1698501 - RNA, 17 nt, Salmonella enterica enterica serovar Typhi
ucgcugaauaaugccuu

SEQ ID NO: 1698502 - RNA, 18 nt, Salmonella enterica enterica serovar Typhi
ucgcuuccuuuauugguu

SEQ ID NO: 1698503 - RNA, 14 nt, Salmonella enterica enterica serovar Typhi
ucgcuuccagcgcc

SEQ ID NO: 1698504 - RNA, 16 nt, Salmonella enterica enterica serovar Typhi
ucgcuuacgcggcgcg

SEQ ID NO: 1698505 - RNA, 22 nt, Salmonella enterica enterica serovar Typhi
ucgcuuaacggcccaggcaucg

SEQ ID NO: 1698506 - RNA, 16 nt, Salmonella enterica enterica serovar Typhi
ucgcugccgaccuggc

SEQ ID NO: 1698507 - RNA, 19 nt, Salmonella enterica enterica serovar Typhi
ucggaaaucuguuccagcg

SEQ ID NO: 1698508 - RNA, 20 nt, Salmonella enterica enterica serovar Typhi
ucggaaugacaaacgccacc

SEQ ID NO: 1698509 - RNA, 22 nt, Salmonella enterica enterica serovar Typhi
ucggaaguauacauccacuggu

SEQ ID NO: 1698510 - RNA, 15 nt, Salmonella enterica enterica serovar Typhi
ucggcaccauuccca

SEQ ID NO: 1698511 - RNA, 18 nt, Salmonella enterica enterica serovar Typhi
ucggcaauggccagauga

SEQ ID NO: 1698512 - RNA, 19 nt, Salmonella enterica enterica serovar Typhi
ucggcacagccaguaagaa

SEQ ID NO: 1698513 - RNA, 14 nt, Salmonella enterica enterica serovar Typhi
ucggcaauuucuuu

SEQ ID NO: 1698514 - RNA, 23 nt, Salmonella enterica enterica serovar Typhi
ucggagaaauagacgagcgaaaa

SEQ ID NO: 1698515 - RNA, 21 nt, Salmonella enterica enterica serovar Typhi
ucggcaauaugcuguuuaugg

SEQ ID NO: 1698516 - RNA, 17 nt, Salmonella enterica enterica serovar Typhi
ucggcaauaugcuguuu

SEQ ID NO: 1698517 - RNA, 23 nt, Salmonella enterica enterica serovar Typhi
ucgccggcagacgauagcgggug

SEQ ID NO: 1698518 - RNA, 23 nt, Salmonella enterica enterica serovar Typhi
ucgccgguagcuucagcggcgcg

SEQ ID NO: 1698519 - RNA, 18 nt, Salmonella enterica enterica serovar Typhi
ucgccggggaaaauauua

SEQ ID NO: 1698520 - RNA, 16 nt, Salmonella enterica enterica serovar Typhi
ucgccauaaagcugua

SEQ ID NO: 1698521 - RNA, 20 nt, Salmonella enterica enterica serovar Typhi
ucgccauaaagcuguaccug

SEQ ID NO: 1698522 - RNA, 18 nt, Salmonella enterica enterica serovar Typhi
ucgccauauccaagcccc

SEQ ID NO: 1698523 - RNA, 19 nt, Salmonella enterica enterica serovar Typhi
ucgccauaucuucgcgcgu

SEQ ID NO: 1698524 - RNA, 13 nt, Salmonella enterica enterica serovar Typhi
ucgccgccgcgag

SEQ ID NO: 1698525 - RNA, 17 nt, Salmonella enterica enterica serovar Typhi
ucgccgccgcgagcagc

SEQ ID NO: 1698526 - RNA, 18 nt, Salmonella enterica enterica serovar Typhi
ucgccgcccaaccagccc

SEQ ID NO: 1698527 - RNA, 20 nt, Salmonella enterica enterica serovar Typhi
ucgcgauaaucaacucuccu

SEQ ID NO: 1698528 - RNA, 19 nt, Salmonella enterica enterica serovar Typhi
ucgcgauacugccgcccau

SEQ ID NO: 1698529 - RNA, 20 nt, Salmonella enterica enterica serovar Typhi
ucgcgagaaaauagaggaaa

SEQ ID NO: 1698530 - RNA, 18 nt, Salmonella enterica enterica serovar Typhi
ucgcgagcacuuuuuccu

SEQ ID NO: 1698531 - RNA, 15 nt, Salmonella enterica enterica serovar Typhi
ucgcgaauaauuauu

SEQ ID NO: 1698532 - RNA, 14 nt, Salmonella enterica enterica serovar Typhi
ucgccucccugccu

SEQ ID NO: 1698533 - RNA, 22 nt, Salmonella enterica enterica serovar Typhi
ucgccugauucaccaacugcug

SEQ ID NO: 1698534 - RNA, 15 nt, Salmonella enterica enterica serovar Typhi
ucgccuuucaccagc

SEQ ID NO: 1698535 - RNA, 14 nt, Salmonella enterica enterica serovar Typhi
ucgccugacaggag

SEQ ID NO: 1698536 - RNA, 16 nt, Salmonella enterica enterica serovar Typhi
ucgccugaugaccgcc

SEQ ID NO: 1698537 - RNA, 20 nt, Salmonella enterica enterica serovar Typhi
ucgccugaaugcacugcuga

SEQ ID NO: 1698538 - RNA, 13 nt, Salmonella enterica enterica serovar Typhi
ucgcgcaguucca

SEQ ID NO: 1698539 - RNA, 15 nt, Salmonella enterica enterica serovar Typhi
ucgcgauucgggccg

SEQ ID NO: 1698540 - RNA, 15 nt, Salmonella enterica enterica serovar Typhi
ucgcgcauccgggcc

SEQ ID NO: 1698541 - RNA, 16 nt, Salmonella enterica enterica serovar Typhi
ucgcgcauccgggccg

SEQ ID NO: 1698542 - RNA, 20 nt, Salmonella enterica enterica serovar Typhi
ucgcgcauccgggccgcuag

SEQ ID NO: 1698543 - RNA, 15 nt, Salmonella enterica enterica serovar Typhi
ucgcgccauuuagcg

SEQ ID NO: 1698544 - RNA, 21 nt, Salmonella enterica enterica serovar Typhi
ucgcgccagcgacaucccaga

SEQ ID NO: 1698545 - RNA, 24 nt, Salmonella enterica enterica serovar Typhi
ucgcgcccaaugcuuagucagccu

SEQ ID NO: 1698546 - RNA, 12 nt, Salmonella enterica enterica serovar Typhi
ucgcgccgccaa

SEQ ID NO: 1698547 - RNA, 17 nt, Salmonella enterica enterica serovar Typhi
ucgcgccgugcccagca

SEQ ID NO: 1698548 - RNA, 20 nt, Salmonella enterica enterica serovar Typhi
ucgcgcgcaaaugcaauuca

SEQ ID NO: 1698549 - RNA, 20 nt, Salmonella enterica enterica serovar Typhi
ucgcgcggcgguucauccug

SEQ ID NO: 1698550 - RNA, 16 nt, Salmonella enterica enterica serovar Typhi
ucgcgcguccacggcg

SEQ ID NO: 1698551 - RNA, 17 nt, Salmonella enterica enterica serovar Typhi
ucgcgcucuuccgccag

SEQ ID NO: 1698552 - RNA, 17 nt, Salmonella enterica enterica serovar Typhi
ucgcgcucaagcgaaaa

SEQ ID NO: 1698553 - RNA, 18 nt, Salmonella enterica enterica serovar Typhi
ucgcggaauuucaggaag

SEQ ID NO: 1698554 - RNA, 20 nt, Salmonella enterica enterica serovar Typhi
ucgcggaagcgaccggcguc

SEQ ID NO: 1698555 - RNA, 21 nt, Salmonella enterica enterica serovar Typhi
ucgcgcuuacacagacugcuu

SEQ ID NO: 1698556 - RNA, 19 nt, Salmonella enterica enterica serovar Typhi
ucgcgcuguauaaucccgc

SEQ ID NO: 1698557 - RNA, 19 nt, Salmonella enterica enterica serovar Typhi
ucgcgcugucugccggcgu

SEQ ID NO: 1698558 - RNA, 20 nt, Salmonella enterica enterica serovar Typhi
ucgcgcugauauuuuuacug

SEQ ID NO: 1698559 - RNA, 16 nt, Salmonella enterica enterica serovar Typhi
ucgacgaaauggugug

SEQ ID NO: 1698560 - RNA, 17 nt, Salmonella enterica enterica serovar Typhi
ucgacgauaaaaaaagu

SEQ ID NO: 1698561 - RNA, 19 nt, Salmonella enterica enterica serovar Typhi
ucgacgauaaaaaaaguau

SEQ ID NO: 1698562 - RNA, 20 nt, Salmonella enterica enterica serovar Typhi
ucgacgggacgaauuuccag

SEQ ID NO: 1698563 - RNA, 21 nt, Salmonella enterica enterica serovar Typhi
ucgacgggacgaauuuccagc

SEQ ID NO: 1698564 - RNA, 16 nt, Salmonella enterica enterica serovar Typhi
ucgacguccagcgcgu

SEQ ID NO: 1698565 - RNA, 19 nt, Salmonella enterica enterica serovar Typhi
ucgacuaauuuuaggaaga

SEQ ID NO: 1698566 - RNA, 20 nt, Salmonella enterica enterica serovar Typhi
ucgacguucagcauauccag

SEQ ID NO: 1698567 - RNA, 18 nt, Salmonella enterica enterica serovar Typhi
ucgacuguuguucuucau

SEQ ID NO: 1698568 - RNA, 14 nt, Salmonella enterica enterica serovar Typhi
ucgacauuacccau

SEQ ID NO: 1698569 - RNA, 18 nt, Salmonella enterica enterica serovar Typhi
ucgacaugguuggccacc

SEQ ID NO: 1698570 - RNA, 17 nt, Salmonella enterica enterica serovar Typhi
ucgaccagcagcgggcu

SEQ ID NO: 1698571 - RNA, 22 nt, Salmonella enterica enterica serovar Typhi
ucgacagccagcauuuccagcu

SEQ ID NO: 1698572 - RNA, 15 nt, Salmonella enterica enterica serovar Typhi
ucgacaggaguauag

SEQ ID NO: 1698573 - RNA, 15 nt, Salmonella enterica enterica serovar Typhi
ucgacaaagccgacg

SEQ ID NO: 1698574 - RNA, 19 nt, Salmonella enterica enterica serovar Typhi
ucgacaucuuggcgcugcc

SEQ ID NO: 1698575 - RNA, 19 nt, Salmonella enterica enterica serovar Typhi
ucgacauaguacccucugc

SEQ ID NO: 1698576 - RNA, 22 nt, Salmonella enterica enterica serovar Typhi
ucgacauaauuuccggccagua

SEQ ID NO: 1698577 - RNA, 16 nt, Salmonella enterica enterica serovar Typhi
ucgacaguucccggca

SEQ ID NO: 1698578 - RNA, 22 nt, Salmonella enterica enterica serovar Typhi
ucgacaguucccggcaacagua

SEQ ID NO: 1698579 - RNA, 14 nt, Salmonella enterica enterica serovar Typhi
ucgaaugagaacga

SEQ ID NO: 1698580 - RNA, 15 nt, Salmonella enterica enterica serovar Typhi
ucgaagaccuggccg

SEQ ID NO: 1698581 - RNA, 19 nt, Salmonella enterica enterica serovar Typhi
ucgaagaugaggagcugga

SEQ ID NO: 1698582 - RNA, 13 nt, Salmonella enterica enterica serovar Typhi
ucgcaggccauaa

SEQ ID NO: 1698583 - RNA, 15 nt, Salmonella enterica enterica serovar Typhi
ucgcauccuccaucc

SEQ ID NO: 1698584 - RNA, 20 nt, Salmonella enterica enterica serovar Typhi
ucgcaaaauagcgguucaau

SEQ ID NO: 1698585 - RNA, 13 nt, Salmonella enterica enterica serovar Typhi
ucgcaaaauuccg

SEQ ID NO: 1698586 - RNA, 17 nt, Salmonella enterica enterica serovar Typhi
ucgcaaacggaauaaac

SEQ ID NO: 1698587 - RNA, 21 nt, Salmonella enterica enterica serovar Typhi
ucgcaaagaaaucaacgaauu

SEQ ID NO: 1698588 - RNA, 14 nt, Salmonella enterica enterica serovar Typhi
ucgcaaauaaucuu

SEQ ID NO: 1698589 - RNA, 19 nt, Salmonella enterica enterica serovar Typhi
ucgccacaugcggcaggcu

SEQ ID NO: 1698590 - RNA, 16 nt, Salmonella enterica enterica serovar Typhi
ucgccaaaccagaccc

SEQ ID NO: 1698591 - RNA, 18 nt, Salmonella enterica enterica serovar Typhi
ucgccagcaacgcccaga

SEQ ID NO: 1698592 - RNA, 22 nt, Salmonella enterica enterica serovar Typhi
ucgccagcauacgucugcgcug

SEQ ID NO: 1698593 - RNA, 18 nt, Salmonella enterica enterica serovar Typhi
ucgccagcccgaucaucu

SEQ ID NO: 1698594 - RNA, 10 nt, Salmonella enterica enterica serovar Typhi
ucgccaggcc

SEQ ID NO: 1698595 - RNA, 20 nt, Salmonella enterica enterica serovar Typhi
ucgccagcggaucgcgucca

SEQ ID NO: 1698596 - RNA, 23 nt, Salmonella enterica enterica serovar Typhi
ucgauaaucgguagcacuuuaaa

SEQ ID NO: 1698597 - RNA, 18 nt, Salmonella enterica enterica serovar Typhi
ucgagcgugucagugcca

SEQ ID NO: 1698598 - RNA, 22 nt, Salmonella enterica enterica serovar Typhi
ucgauacucacgacuuucacca

SEQ ID NO: 1698599 - RNA, 14 nt, Salmonella enterica enterica serovar Typhi
ucgauagcauuuuu

SEQ ID NO: 1698600 - RNA, 17 nt, Salmonella enterica enterica serovar Typhi
ucgauacuauaacgcuu

SEQ ID NO: 1698601 - RNA, 21 nt, Salmonella enterica enterica serovar Typhi
ucgaugcccguugucacaggc

SEQ ID NO: 1698602 - RNA, 12 nt, Salmonella enterica enterica serovar Typhi
ucgauggcagug

SEQ ID NO: 1698603 - RNA, 16 nt, Salmonella enterica enterica serovar Typhi
ucgauggccucaucau

SEQ ID NO: 1698604 - RNA, 17 nt, Salmonella enterica enterica serovar Typhi
uccugcaacagcaccag

SEQ ID NO: 1698605 - RNA, 14 nt, Salmonella enterica enterica serovar Typhi
uccugcaacagaag

SEQ ID NO: 1698606 - RNA, 16 nt, Salmonella enterica enterica serovar Typhi
uccugcaacagaagag

SEQ ID NO: 1698607 - RNA, 13 nt, Salmonella enterica enterica serovar Typhi
uccugccgccgca

SEQ ID NO: 1698608 - RNA, 16 nt, Salmonella enterica enterica serovar Typhi
uccugccgacaggcag

SEQ ID NO: 1698609 - RNA, 22 nt, Salmonella enterica enterica serovar Typhi
uccugccgccgcaccacugcug

SEQ ID NO: 1698610 - RNA, 20 nt, Salmonella enterica enterica serovar Typhi
uccugcccuggugagcucca

SEQ ID NO: 1698611 - RNA, 20 nt, Salmonella enterica enterica serovar Typhi
uccugccagccgcucugcug

SEQ ID NO: 1698612 - RNA, 22 nt, Salmonella enterica enterica serovar Typhi
uccugagcgaauguauaaucca

SEQ ID NO: 1698613 - RNA, 12 nt, Salmonella enterica enterica serovar Typhi
uccugauaaccu

SEQ ID NO: 1698614 - RNA, 19 nt, Salmonella enterica enterica serovar Typhi
uccugagcagacauauuuu

SEQ ID NO: 1698615 - RNA, 15 nt, Salmonella enterica enterica serovar Typhi
uccuguaacaacugu

SEQ ID NO: 1698616 - RNA, 12 nt, Salmonella enterica enterica serovar Typhi
uccuguuccuga

SEQ ID NO: 1698617 - RNA, 15 nt, Salmonella enterica enterica serovar Typhi
uccuggugugguuau

SEQ ID NO: 1698618 - RNA, 21 nt, Salmonella enterica enterica serovar Typhi
uccugggcaaaauagcccggc

SEQ ID NO: 1698619 - RNA, 16 nt, Salmonella enterica enterica serovar Typhi
uccuggcuuaccugcu

SEQ ID NO: 1698620 - RNA, 12 nt, Salmonella enterica enterica serovar Typhi
uccuggcuucaa

SEQ ID NO: 1698621 - RNA, 14 nt, Salmonella enterica enterica serovar Typhi
uccuggcuugccag

SEQ ID NO: 1698622 - RNA, 16 nt, Salmonella enterica enterica serovar Typhi
uccugccugacaauga

SEQ ID NO: 1698623 - RNA, 19 nt, Salmonella enterica enterica serovar Typhi
uccugcgcugucaccagca

SEQ ID NO: 1698624 - RNA, 19 nt, Salmonella enterica enterica serovar Typhi
uccuggcgccacccaacau

SEQ ID NO: 1698625 - RNA, 19 nt, Salmonella enterica enterica serovar Typhi
uccucuuccgacaaaccuu

SEQ ID NO: 1698626 - RNA, 13 nt, Salmonella enterica enterica serovar Typhi
uccucuucucuga

SEQ ID NO: 1698627 - RNA, 11 nt, Salmonella enterica enterica serovar Typhi
uccugaaaaaa

SEQ ID NO: 1698628 - RNA, 18 nt, Salmonella enterica enterica serovar Typhi
uccucuuucccuuuuuaa

SEQ ID NO: 1698629 - RNA, 18 nt, Salmonella enterica enterica serovar Typhi
uccugaauugcaaggcga

SEQ ID NO: 1698630 - RNA, 21 nt, Salmonella enterica enterica serovar Typhi
uccugaccaugccacaacaga

SEQ ID NO: 1698631 - RNA, 14 nt, Salmonella enterica enterica serovar Typhi
uccucgaucgccug

SEQ ID NO: 1698632 - RNA, 20 nt, Salmonella enterica enterica serovar Typhi
uccucgcggguggccugcag

SEQ ID NO: 1698633 - RNA, 12 nt, Salmonella enterica enterica serovar Typhi
uccucacgcccu

SEQ ID NO: 1698634 - RNA, 17 nt, Salmonella enterica enterica serovar Typhi
uccucagaauccgucag

SEQ ID NO: 1698635 - RNA, 20 nt, Salmonella enterica enterica serovar Typhi
uccucagcgaauaucucuau

SEQ ID NO: 1698636 - RNA, 13 nt, Salmonella enterica enterica serovar Typhi
uccucauacagcc

SEQ ID NO: 1698637 - RNA, 16 nt, Salmonella enterica enterica serovar Typhi
uccucauucagcggcu

SEQ ID NO: 1698638 - RNA, 21 nt, Salmonella enterica enterica serovar Typhi
uccucauuuuguugcuccagc

SEQ ID NO: 1698639 - RNA, 16 nt, Salmonella enterica enterica serovar Typhi
uccuccaacgugcaga

SEQ ID NO: 1698640 - RNA, 22 nt, Salmonella enterica enterica serovar Typhi
uccuccggcgacugaaugccuu

SEQ ID NO: 1698641 - RNA, 20 nt, Salmonella enterica enterica serovar Typhi
uccuccggcgagcgaugcug

SEQ ID NO: 1698642 - RNA, 23 nt, Salmonella enterica enterica serovar Typhi
uccuccggcauagccggagguuu

SEQ ID NO: 1698643 - RNA, 21 nt, Salmonella enterica enterica serovar Typhi
uccguugccacccaaugaucc

SEQ ID NO: 1698644 - RNA, 16 nt, Salmonella enterica enterica serovar Typhi
uccguucccaaugcuu

SEQ ID NO: 1698645 - RNA, 19 nt, Salmonella enterica enterica serovar Typhi
uccguuaccccuuuuucaa

SEQ ID NO: 1698646 - RNA, 13 nt, Salmonella enterica enterica serovar Typhi
uccguuauuucac

SEQ ID NO: 1698647 - RNA, 19 nt, Salmonella enterica enterica serovar Typhi
uccgucucuuuauugaaaa

SEQ ID NO: 1698648 - RNA, 20 nt, Salmonella enterica enterica serovar Typhi
uccgucguuaaucagcgcgg

SEQ ID NO: 1698649 - RNA, 13 nt, Salmonella enterica enterica serovar Typhi
uccguccagaccg

SEQ ID NO: 1698650 - RNA, 13 nt, Salmonella enterica enterica serovar Typhi
uccgucaggaugg

SEQ ID NO: 1698651 - RNA, 12 nt, Salmonella enterica enterica serovar Typhi
uccggcaggcaa

SEQ ID NO: 1698652 - RNA, 18 nt, Salmonella enterica enterica serovar Typhi
uccggcacgauaaauugc

SEQ ID NO: 1698653 - RNA, 16 nt, Salmonella enterica enterica serovar Typhi
uccggcacucuucuuc

SEQ ID NO: 1698654 - RNA, 19 nt, Salmonella enterica enterica serovar Typhi
uccggcauaaaaagccucu

SEQ ID NO: 1698655 - RNA, 19 nt, Salmonella enterica enterica serovar Typhi
uccggcauucgcacacuac

SEQ ID NO: 1698656 - RNA, 12 nt, Salmonella enterica enterica serovar Typhi
uccggcauuuuu

SEQ ID NO: 1698657 - RNA, 18 nt, Salmonella enterica enterica serovar Typhi
uccggcaucucaaggucu

SEQ ID NO: 1698658 - RNA, 17 nt, Salmonella enterica enterica serovar Typhi
uccggcacacagcgcuu

SEQ ID NO: 1698659 - RNA, 18 nt, Salmonella enterica enterica serovar Typhi
uccggcacacagcgcuuu

SEQ ID NO: 1698660 - RNA, 15 nt, Salmonella enterica enterica serovar Typhi
uccggaugccccauc

SEQ ID NO: 1698661 - RNA, 19 nt, Salmonella enterica enterica serovar Typhi
uccggaucgccgaagcggc

SEQ ID NO: 1698662 - RNA, 21 nt, Salmonella enterica enterica serovar Typhi
uccggauggcaguacagggcg

SEQ ID NO: 1698663 - RNA, 20 nt, Salmonella enterica enterica serovar Typhi
uccggauucgcggcaaacac

SEQ ID NO: 1698664 - RNA, 23 nt, Salmonella enterica enterica serovar Typhi
uccggauucguaguucccccauc

SEQ ID NO: 1698665 - RNA, 16 nt, Salmonella enterica enterica serovar Typhi
uccggacgcaccagcc

SEQ ID NO: 1698666 - RNA, 23 nt, Salmonella enterica enterica serovar Typhi
uccggcgcgguauuucgccgccg

SEQ ID NO: 1698667 - RNA, 17 nt, Salmonella enterica enterica serovar Typhi
uccggcgcugcgcggcg

SEQ ID NO: 1698668 - RNA, 19 nt, Salmonella enterica enterica serovar Typhi
uccggcgggagcucuacca

SEQ ID NO: 1698669 - RNA, 23 nt, Salmonella enterica enterica serovar Typhi
uccggcgucuggguuugcagcag

SEQ ID NO: 1698670 - RNA, 14 nt, Salmonella enterica enterica serovar Typhi
uccggcgugacuca

SEQ ID NO: 1698671 - RNA, 17 nt, Salmonella enterica enterica serovar Typhi
uccggcggucagccagc

SEQ ID NO: 1698672 - RNA, 24 nt, Salmonella enterica enterica serovar Typhi
uccggcguuucguuuagcgccugc

SEQ ID NO: 1698673 - RNA, 17 nt, Salmonella enterica enterica serovar Typhi
uccggcuacgguuuuaa

SEQ ID NO: 1698674 - RNA, 23 nt, Salmonella enterica enterica serovar Typhi
uccggcccggagguaaauuaacg

SEQ ID NO: 1698675 - RNA, 15 nt, Salmonella enterica enterica serovar Typhi
uccggccagcgccag

SEQ ID NO: 1698676 - RNA, 19 nt, Salmonella enterica enterica serovar Typhi
uccggccagcgccagcguu

SEQ ID NO: 1698677 - RNA, 17 nt, Salmonella enterica enterica serovar Typhi
uccggccuguaaggucu

SEQ ID NO: 1698678 - RNA, 21 nt, Salmonella enterica enterica serovar Typhi
uccggccuauagcuaauggcu

SEQ ID NO: 1698679 - RNA, 16 nt, Salmonella enterica enterica serovar Typhi
uccggccugcaggcaa

SEQ ID NO: 1698680 - RNA, 22 nt, Salmonella enterica enterica serovar Typhi
uccggccuacggucgguuucau

SEQ ID NO: 1698681 - RNA, 18 nt, Salmonella enterica enterica serovar Typhi
uccggccuaccugagaug

SEQ ID NO: 1698682 - RNA, 19 nt, Salmonella enterica enterica serovar Typhi
uccgggauguuaauuucau

SEQ ID NO: 1698683 - RNA, 16 nt, Salmonella enterica enterica serovar Typhi
uccgggauauaaaauu

SEQ ID NO: 1698684 - RNA, 16 nt, Salmonella enterica enterica serovar Typhi
uccgggauagcacuac

SEQ ID NO: 1698685 - RNA, 20 nt, Salmonella enterica enterica serovar Typhi
uccgggaaggacgccaccgg

SEQ ID NO: 1698686 - RNA, 13 nt, Salmonella enterica enterica serovar Typhi
uccgguacaccaa

SEQ ID NO: 1698687 - RNA, 19 nt, Salmonella enterica enterica serovar Typhi
uccgggucaguuuuuugac

SEQ ID NO: 1698688 - RNA, 16 nt, Salmonella enterica enterica serovar Typhi
uccgggguucgaaucc

SEQ ID NO: 1698689 - RNA, 13 nt, Salmonella enterica enterica serovar Typhi
uccggguaauuuu

SEQ ID NO: 1698690 - RNA, 18 nt, Salmonella enterica enterica serovar Typhi
uccguaaucgcuuucauu

SEQ ID NO: 1698691 - RNA, 20 nt, Salmonella enterica enterica serovar Typhi
uccguacauaacagcagcag

SEQ ID NO: 1698692 - RNA, 20 nt, Salmonella enterica enterica serovar Typhi
uccguaagcggcggaccagc

SEQ ID NO: 1698693 - RNA, 12 nt, Salmonella enterica enterica serovar Typhi
uccgguuucaac

SEQ ID NO: 1698694 - RNA, 19 nt, Salmonella enterica enterica serovar Typhi
uccgucagcgaaucgaucu

SEQ ID NO: 1698695 - RNA, 23 nt, Salmonella enterica enterica serovar Typhi
uccgucagcgucacguuauacca

SEQ ID NO: 1698696 - RNA, 19 nt, Salmonella enterica enterica serovar Typhi
uccguauucggaauaaugu

SEQ ID NO: 1698697 - RNA, 15 nt, Salmonella enterica enterica serovar Typhi
uccgucaaagaaaac

SEQ ID NO: 1698698 - RNA, 12 nt, Salmonella enterica enterica serovar Typhi
uccguagccaac

SEQ ID NO: 1698699 - RNA, 18 nt, Salmonella enterica enterica serovar Typhi
uccguagcgauaaugacg

SEQ ID NO: 1698700 - RNA, 19 nt, Salmonella enterica enterica serovar Typhi
uccggugugaccagcgcgu

SEQ ID NO: 1698701 - RNA, 17 nt, Salmonella enterica enterica serovar Typhi
uccgguacaccaacuac

SEQ ID NO: 1698702 - RNA, 22 nt, Salmonella enterica enterica serovar Typhi
uccgguagguuuaaaccacucc

SEQ ID NO: 1698703 - RNA, 21 nt, Salmonella enterica enterica serovar Typhi
uccgguaucaugcugaugacu

SEQ ID NO: 1698704 - RNA, 18 nt, Salmonella enterica enterica serovar Typhi
uccggugaagguaauuuu

SEQ ID NO: 1698705 - RNA, 16 nt, Salmonella enterica enterica serovar Typhi
uccgccacgcucgcug

SEQ ID NO: 1698706 - RNA, 14 nt, Salmonella enterica enterica serovar Typhi
uccgcauucuaaau

SEQ ID NO: 1698707 - RNA, 14 nt, Salmonella enterica enterica serovar Typhi
uccgccaacagccg

SEQ ID NO: 1698708 - RNA, 12 nt, Salmonella enterica enterica serovar Typhi
uccgcaggcaac

SEQ ID NO: 1698709 - RNA, 15 nt, Salmonella enterica enterica serovar Typhi
uccgcagauccagca

SEQ ID NO: 1698710 - RNA, 14 nt, Salmonella enterica enterica serovar Typhi
uccgcacgcgcgcc

SEQ ID NO: 1698711 - RNA, 22 nt, Salmonella enterica enterica serovar Typhi
uccgcaaucacauacagcacuu

SEQ ID NO: 1698712 - RNA, 16 nt, Salmonella enterica enterica serovar Typhi
uccgcaauuuccugau

SEQ ID NO: 1698713 - RNA, 16 nt, Salmonella enterica enterica serovar Typhi
uccgcaauuaauuuau

SEQ ID NO: 1698714 - RNA, 17 nt, Salmonella enterica enterica serovar Typhi
uccgcacauaaucaccg

SEQ ID NO: 1698715 - RNA, 15 nt, Salmonella enterica enterica serovar Typhi
uccgccgucgucacc

SEQ ID NO: 1698716 - RNA, 13 nt, Salmonella enterica enterica serovar Typhi
uccgccccgcugg

SEQ ID NO: 1698717 - RNA, 14 nt, Salmonella enterica enterica serovar Typhi
uccgcccaggcggg

SEQ ID NO: 1698718 - RNA, 23 nt, Salmonella enterica enterica serovar Typhi
uccgccaucgccucgauaaacau

SEQ ID NO: 1698719 - RNA, 18 nt, Salmonella enterica enterica serovar Typhi
uccgccagguauucuaac

SEQ ID NO: 1698720 - RNA, 14 nt, Salmonella enterica enterica serovar Typhi
uccgccauaucccc

SEQ ID NO: 1698721 - RNA, 16 nt, Salmonella enterica enterica serovar Typhi
uccgccaggcccauga

SEQ ID NO: 1698722 - RNA, 19 nt, Salmonella enterica enterica serovar Typhi
uccgccagauacaaaucuc

SEQ ID NO: 1698723 - RNA, 16 nt, Salmonella enterica enterica serovar Typhi
uccgccagcaacacuu

SEQ ID NO: 1698724 - RNA, 11 nt, Salmonella enterica enterica serovar Typhi
uccgccugcug

SEQ ID NO: 1698725 - RNA, 18 nt, Salmonella enterica enterica serovar Typhi
uccgccuggaacccaggc

SEQ ID NO: 1698726 - RNA, 20 nt, Salmonella enterica enterica serovar Typhi
uccgccuggaacccaggcac

SEQ ID NO: 1698727 - RNA, 14 nt, Salmonella enterica enterica serovar Typhi
uccgccucguguaa

SEQ ID NO: 1698728 - RNA, 17 nt, Salmonella enterica enterica serovar Typhi
uccgccugaucuuucug

SEQ ID NO: 1698729 - RNA, 13 nt, Salmonella enterica enterica serovar Typhi
uccgcgaugugua

SEQ ID NO: 1698730 - RNA, 14 nt, Salmonella enterica enterica serovar Typhi
uccgcgagcagcca

SEQ ID NO: 1698731 - RNA, 23 nt, Salmonella enterica enterica serovar Typhi
uccgcgagagaaaaaaauccagu

SEQ ID NO: 1698732 - RNA, 21 nt, Salmonella enterica enterica serovar Typhi
uccgcgacguacuggaacagu

SEQ ID NO: 1698733 - RNA, 15 nt, Salmonella enterica enterica serovar Typhi
uccgcgccgccgccg

SEQ ID NO: 1698734 - RNA, 19 nt, Salmonella enterica enterica serovar Typhi
uccgcgccgagugcuugca

SEQ ID NO: 1698735 - RNA, 18 nt, Salmonella enterica enterica serovar Typhi
uccgcgccgccgccgaag

SEQ ID NO: 1698736 - RNA, 16 nt, Salmonella enterica enterica serovar Typhi
uccgcgcgcguaagcu

SEQ ID NO: 1698737 - RNA, 20 nt, Salmonella enterica enterica serovar Typhi
uccgcgggcaaaagggccau

SEQ ID NO: 1698738 - RNA, 18 nt, Salmonella enterica enterica serovar Typhi
uccgcgguagagcgcggu

SEQ ID NO: 1698739 - RNA, 15 nt, Salmonella enterica enterica serovar Typhi
uccgcgguguccugc

SEQ ID NO: 1698740 - RNA, 15 nt, Salmonella enterica enterica serovar Typhi
uccgcgcugaugguu

SEQ ID NO: 1698741 - RNA, 20 nt, Salmonella enterica enterica serovar Typhi
uccggaaucagugcugaaaa

SEQ ID NO: 1698742 - RNA, 14 nt, Salmonella enterica enterica serovar Typhi
uccgcuuccagaau

SEQ ID NO: 1698743 - RNA, 19 nt, Salmonella enterica enterica serovar Typhi
uccgcuucgcgggaccaaa

SEQ ID NO: 1698744 - RNA, 18 nt, Salmonella enterica enterica serovar Typhi
uccgcuggcguccagccc

SEQ ID NO: 1698745 - RNA, 23 nt, Salmonella enterica enterica serovar Typhi
uccgcuggcguccagcccgucca

SEQ ID NO: 1698746 - RNA, 22 nt, Salmonella enterica enterica serovar Typhi
uccgcuggugcguaacguaacc

SEQ ID NO: 1698747 - RNA, 23 nt, Salmonella enterica enterica serovar Typhi
uccgcguuagcaagaccgggcug

SEQ ID NO: 1698748 - RNA, 20 nt, Salmonella enterica enterica serovar Typhi
uccgcuaccugcgagcugua

SEQ ID NO: 1698749 - RNA, 14 nt, Salmonella enterica enterica serovar Typhi
uccgcuagggcauc

SEQ ID NO: 1698750 - RNA, 16 nt, Salmonella enterica enterica serovar Typhi
uccgcuccacauccug

SEQ ID NO: 1698751 - RNA, 13 nt, Salmonella enterica enterica serovar Typhi
uccgcucaugauu

SEQ ID NO: 1698752 - RNA, 16 nt, Salmonella enterica enterica serovar Typhi
uccgcuauuaccagua

SEQ ID NO: 1698753 - RNA, 20 nt, Salmonella enterica enterica serovar Typhi
uccgcuauuaccaguaauga

SEQ ID NO: 1698754 - RNA, 12 nt, Salmonella enterica enterica serovar Typhi
ucucaucaaaaa

SEQ ID NO: 1698755 - RNA, 17 nt, Salmonella enterica enterica serovar Typhi
ucucaucagaccgugaa

SEQ ID NO: 1698756 - RNA, 14 nt, Salmonella enterica enterica serovar Typhi
ucucaggagugaac

SEQ ID NO: 1698757 - RNA, 23 nt, Salmonella enterica enterica serovar Typhi
ucucaggguguuuuuauacaucc

SEQ ID NO: 1698758 - RNA, 18 nt, Salmonella enterica enterica serovar Typhi
ucucauaaacgccuggag

SEQ ID NO: 1698759 - RNA, 19 nt, Salmonella enterica enterica serovar Typhi
ucucauaaaacauuccuga

SEQ ID NO: 1698760 - RNA, 22 nt, Salmonella enterica enterica serovar Typhi
ucuccaugucacuggcggcggu

SEQ ID NO: 1698761 - RNA, 22 nt, Salmonella enterica enterica serovar Typhi
ucuccccaucugaacucuucca

SEQ ID NO: 1698762 - RNA, 15 nt, Salmonella enterica enterica serovar Typhi
ucucccagcugagcu

SEQ ID NO: 1698763 - RNA, 12 nt, Salmonella enterica enterica serovar Typhi
ucucccagcuga

SEQ ID NO: 1698764 - RNA, 20 nt, Salmonella enterica enterica serovar Typhi
ucuccgucucucauuuucuu

SEQ ID NO: 1698765 - RNA, 18 nt, Salmonella enterica enterica serovar Typhi
ucuccgucucucauuuuc

SEQ ID NO: 1698766 - RNA, 18 nt, Salmonella enterica enterica serovar Typhi
ucucacccguuuucuccu

SEQ ID NO: 1698767 - RNA, 14 nt, Salmonella enterica enterica serovar Typhi
ucucagauaauagc

SEQ ID NO: 1698768 - RNA, 18 nt, Salmonella enterica enterica serovar Typhi
ucucagauggaaaaaaag

SEQ ID NO: 1698769 - RNA, 20 nt, Salmonella enterica enterica serovar Typhi
ucucagauggaaaaaaagaa

SEQ ID NO: 1698770 - RNA, 16 nt, Salmonella enterica enterica serovar Typhi
ucucaauaaaaugucu

SEQ ID NO: 1698771 - RNA, 13 nt, Salmonella enterica enterica serovar Typhi
ucucaaugaacag

SEQ ID NO: 1698772 - RNA, 13 nt, Salmonella enterica enterica serovar Typhi
ucucacacauugg

SEQ ID NO: 1698773 - RNA, 16 nt, Salmonella enterica enterica serovar Typhi
ucuauugccuaaauaa

SEQ ID NO: 1698774 - RNA, 18 nt, Salmonella enterica enterica serovar Typhi
ucuauugccuaaauaacu

SEQ ID NO: 1698775 - RNA, 16 nt, Salmonella enterica enterica serovar Typhi
ucuauuuauugaagau

SEQ ID NO: 1698776 - RNA, 15 nt, Salmonella enterica enterica serovar Typhi
ucuauuucauaauaa

SEQ ID NO: 1698777 - RNA, 15 nt, Salmonella enterica enterica serovar Typhi
ucucaaacacuucua

SEQ ID NO: 1698778 - RNA, 18 nt, Salmonella enterica enterica serovar Typhi
ucuauucguucucugaau

SEQ ID NO: 1698779 - RNA, 14 nt, Salmonella enterica enterica serovar Typhi
ucuaugcgcuaugu

SEQ ID NO: 1698780 - RNA, 13 nt, Salmonella enterica enterica serovar Typhi
ucuaugcaaaaga

SEQ ID NO: 1698781 - RNA, 22 nt, Salmonella enterica enterica serovar Typhi
ucuaucacuucaauguuagcau

SEQ ID NO: 1698782 - RNA, 13 nt, Salmonella enterica enterica serovar Typhi
ucuaucaccgccu

SEQ ID NO: 1698783 - RNA, 14 nt, Salmonella enterica enterica serovar Typhi
ucuaucgccagcgc

SEQ ID NO: 1698784 - RNA, 14 nt, Salmonella enterica enterica serovar Typhi
ucuaucgccuggag

SEQ ID NO: 1698785 - RNA, 16 nt, Salmonella enterica enterica serovar Typhi
ucuaucgccuggagcu

SEQ ID NO: 1698786 - RNA, 15 nt, Salmonella enterica enterica serovar Typhi
ucuaucgcuccuccc

SEQ ID NO: 1698787 - RNA, 16 nt, Salmonella enterica enterica serovar Typhi
ucuaucggcaaaccau

SEQ ID NO: 1698788 - RNA, 13 nt, Salmonella enterica enterica serovar Typhi
ucuauauauucuu

SEQ ID NO: 1698789 - RNA, 13 nt, Salmonella enterica enterica serovar Typhi
ucuaggcgcugcu

SEQ ID NO: 1698790 - RNA, 18 nt, Salmonella enterica enterica serovar Typhi
ucuaggcgcugcuggcag

SEQ ID NO: 1698791 - RNA, 19 nt, Salmonella enterica enterica serovar Typhi
ucuagaugaugauuuauga

SEQ ID NO: 1698792 - RNA, 14 nt, Salmonella enterica enterica serovar Typhi
ucuacuuuccugaa

SEQ ID NO: 1698793 - RNA, 14 nt, Salmonella enterica enterica serovar Typhi
ucuacuacaacugu

SEQ ID NO: 1698794 - RNA, 19 nt, Salmonella enterica enterica serovar Typhi
ucuaccauugauaccaaua

SEQ ID NO: 1698795 - RNA, 18 nt, Salmonella enterica enterica serovar Typhi
ucuacaccguagaucgcc

SEQ ID NO: 1698796 - RNA, 15 nt, Salmonella enterica enterica serovar Typhi
ucuaaucgggagcag

SEQ ID NO: 1698797 - RNA, 21 nt, Salmonella enterica enterica serovar Typhi
ucuaacgcaacggaaggaaau

SEQ ID NO: 1698798 - RNA, 21 nt, Salmonella enterica enterica serovar Typhi
ucuaauugacggccaccauga

SEQ ID NO: 1698799 - RNA, 13 nt, Salmonella enterica enterica serovar Typhi
ucguuuuccgcaa

SEQ ID NO: 1698800 - RNA, 15 nt, Salmonella enterica enterica serovar Typhi
ucguugccagcggcc

SEQ ID NO: 1698801 - RNA, 17 nt, Salmonella enterica enterica serovar Typhi
ucguugacuucaaucac

SEQ ID NO: 1698802 - RNA, 20 nt, Salmonella enterica enterica serovar Typhi
ucguguggcggaaugaccug

SEQ ID NO: 1698803 - RNA, 12 nt, Salmonella enterica enterica serovar Typhi
ucggcagcgcga

SEQ ID NO: 1698804 - RNA, 11 nt, Salmonella enterica enterica serovar Typhi
ucggcaggccg

SEQ ID NO: 1698805 - RNA, 12 nt, Salmonella enterica enterica serovar Typhi
ucgguugaacca

SEQ ID NO: 1698806 - RNA, 21 nt, Salmonella enterica enterica serovar Typhi
ucgguuauucggucagauaaa

SEQ ID NO: 1698807 - RNA, 23 nt, Salmonella enterica enterica serovar Typhi
ucgguguucacaauuguggucgu

SEQ ID NO: 1698808 - RNA, 21 nt, Salmonella enterica enterica serovar Typhi
ucgguuuauccccgcuggcgc

SEQ ID NO: 1698809 - RNA, 16 nt, Salmonella enterica enterica serovar Typhi
ucgguuuauccccgcu

SEQ ID NO: 1698810 - RNA, 21 nt, Salmonella enterica enterica serovar Typhi
ucgucaaacaguucagacacc

SEQ ID NO: 1698811 - RNA, 16 nt, Salmonella enterica enterica serovar Typhi
ucguagccaccaucuu

SEQ ID NO: 1698812 - RNA, 15 nt, Salmonella enterica enterica serovar Typhi
ucguagccgcgcgcc

SEQ ID NO: 1698813 - RNA, 19 nt, Salmonella enterica enterica serovar Typhi
ucgucaccggaucgcugag

SEQ ID NO: 1698814 - RNA, 12 nt, Salmonella enterica enterica serovar Typhi
ucgucaguucca

SEQ ID NO: 1698815 - RNA, 21 nt, Salmonella enterica enterica serovar Typhi
ucgucauagcguugauaugcu

SEQ ID NO: 1698816 - RNA, 20 nt, Salmonella enterica enterica serovar Typhi
ucgucauaaauacacgaggc

SEQ ID NO: 1698817 - RNA, 23 nt, Salmonella enterica enterica serovar Typhi
ucgugcaucaggaaauccuggau

SEQ ID NO: 1698818 - RNA, 23 nt, Salmonella enterica enterica serovar Typhi
ucgugcauccggacgccagugcg

SEQ ID NO: 1698819 - RNA, 19 nt, Salmonella enterica enterica serovar Typhi
ucgugccagugaugcgcgg

SEQ ID NO: 1698820 - RNA, 16 nt, Salmonella enterica enterica serovar Typhi
ucguggguucgaaucc

SEQ ID NO: 1698821 - RNA, 18 nt, Salmonella enterica enterica serovar Typhi
ucgugguuagacaucacg

SEQ ID NO: 1698822 - RNA, 21 nt, Salmonella enterica enterica serovar Typhi
ucgugugcgguauagaucaga

SEQ ID NO: 1698823 - RNA, 22 nt, Salmonella enterica enterica serovar Typhi
ucgucuguuauuugugauuuuc

SEQ ID NO: 1698824 - RNA, 15 nt, Salmonella enterica enterica serovar Typhi
ucuuccucacagccu

SEQ ID NO: 1698825 - RNA, 14 nt, Salmonella enterica enterica serovar Typhi
ucuuccgucaaaaa

SEQ ID NO: 1698826 - RNA, 18 nt, Salmonella enterica enterica serovar Typhi
ucuuccgucagcgaaucg

SEQ ID NO: 1698827 - RNA, 12 nt, Salmonella enterica enterica serovar Typhi
ucuuccggcguc

SEQ ID NO: 1698828 - RNA, 18 nt, Salmonella enterica enterica serovar Typhi
ucuuccgccugauaaaac

SEQ ID NO: 1698829 - RNA, 18 nt, Salmonella enterica enterica serovar Typhi
ucuuccggcauaaaaagc

SEQ ID NO: 1698830 - RNA, 22 nt, Salmonella enterica enterica serovar Typhi
ucuucaugguaaaauccuuuuu

SEQ ID NO: 1698831 - RNA, 23 nt, Salmonella enterica enterica serovar Typhi
ucuucauggucggacgggcccug

SEQ ID NO: 1698832 - RNA, 15 nt, Salmonella enterica enterica serovar Typhi
ucuucaggcguauau

SEQ ID NO: 1698833 - RNA, 16 nt, Salmonella enterica enterica serovar Typhi
ucuuacagggcgaugc

SEQ ID NO: 1698834 - RNA, 16 nt, Salmonella enterica enterica serovar Typhi
ucuuacacuuagcaca

SEQ ID NO: 1698835 - RNA, 18 nt, Salmonella enterica enterica serovar Typhi
ucuucaguaaccagggag

SEQ ID NO: 1698836 - RNA, 16 nt, Salmonella enterica enterica serovar Typhi
ucuucaguaauuucga

SEQ ID NO: 1698837 - RNA, 14 nt, Salmonella enterica enterica serovar Typhi
ucuucgauaaaggg

SEQ ID NO: 1698838 - RNA, 16 nt, Salmonella enterica enterica serovar Typhi
ucuucgacauauuuac

SEQ ID NO: 1698839 - RNA, 20 nt, Salmonella enterica enterica serovar Typhi
ucuucgacauauuuacgugc

SEQ ID NO: 1698840 - RNA, 22 nt, Salmonella enterica enterica serovar Typhi
ucuucgcuggcggaaagaagca

SEQ ID NO: 1698841 - RNA, 17 nt, Salmonella enterica enterica serovar Typhi
ucuucgcaguagauucu

SEQ ID NO: 1698842 - RNA, 18 nt, Salmonella enterica enterica serovar Typhi
ucuucgccgucauaaaac

SEQ ID NO: 1698843 - RNA, 20 nt, Salmonella enterica enterica serovar Typhi
ucuucguguaacgcauacau

SEQ ID NO: 1698844 - RNA, 14 nt, Salmonella enterica enterica serovar Typhi
ucuucgucgucauc

SEQ ID NO: 1698845 - RNA, 20 nt, Salmonella enterica enterica serovar Typhi
ucuucgugacccgccagcau

SEQ ID NO: 1698846 - RNA, 18 nt, Salmonella enterica enterica serovar Typhi
ucuucggucgagcuuuug

SEQ ID NO: 1698847 - RNA, 18 nt, Salmonella enterica enterica serovar Typhi
ucuucggcaaaauauuca

SEQ ID NO: 1698848 - RNA, 13 nt, Salmonella enterica enterica serovar Typhi
ucuucuaccaccu

SEQ ID NO: 1698849 - RNA, 23 nt, Salmonella enterica enterica serovar Typhi
ucuucucaggcgagcccugugcg

SEQ ID NO: 1698850 - RNA, 19 nt, Salmonella enterica enterica serovar Typhi
ucuugcacaauacuuuuug

SEQ ID NO: 1698851 - RNA, 15 nt, Salmonella enterica enterica serovar Typhi
ucuugccacuggccu

SEQ ID NO: 1698852 - RNA, 13 nt, Salmonella enterica enterica serovar Typhi
ucuugccacuggc

SEQ ID NO: 1698853 - RNA, 18 nt, Salmonella enterica enterica serovar Typhi
ucuugugaguaauaauca

SEQ ID NO: 1698854 - RNA, 22 nt, Salmonella enterica enterica serovar Typhi
ucuuguagugugauccaucccu

SEQ ID NO: 1698855 - RNA, 21 nt, Salmonella enterica enterica serovar Typhi
ucuugucaggcagaaauaacu

SEQ ID NO: 1698856 - RNA, 16 nt, Salmonella enterica enterica serovar Typhi
ucuuuaaauuucaggg

SEQ ID NO: 1698857 - RNA, 14 nt, Salmonella enterica enterica serovar Typhi
ucuuuaaauuucag

SEQ ID NO: 1698858 - RNA, 22 nt, Salmonella enterica enterica serovar Typhi
ucuuuaaacaacgccauaauac

SEQ ID NO: 1698859 - RNA, 21 nt, Salmonella enterica enterica serovar Typhi
ucuuuagcgcuaauuccuguc

SEQ ID NO: 1698860 - RNA, 16 nt, Salmonella enterica enterica serovar Typhi
ucuuuagauaauuucg

SEQ ID NO: 1698861 - RNA, 17 nt, Salmonella enterica enterica serovar Typhi
ucuuuagauaauuucgc

SEQ ID NO: 1698862 - RNA, 17 nt, Salmonella enterica enterica serovar Typhi
ucuucugccuuuuuuaa

SEQ ID NO: 1698863 - RNA, 21 nt, Salmonella enterica enterica serovar Typhi
ucuucugauggcuuugcuguc

SEQ ID NO: 1698864 - RNA, 19 nt, Salmonella enterica enterica serovar Typhi
ucuucuguaauacgcugua

SEQ ID NO: 1698865 - RNA, 11 nt, Salmonella enterica enterica serovar Typhi
ucugacaucag

SEQ ID NO: 1698866 - RNA, 13 nt, Salmonella enterica enterica serovar Typhi
ucugaaugguucc

SEQ ID NO: 1698867 - RNA, 24 nt, Salmonella enterica enterica serovar Typhi
ucugagccgcccggcgcgcuggag

SEQ ID NO: 1698868 - RNA, 16 nt, Salmonella enterica enterica serovar Typhi
ucugagcgcaaacauc

SEQ ID NO: 1698869 - RNA, 13 nt, Salmonella enterica enterica serovar Typhi
ucugacagccaaa

SEQ ID NO: 1698870 - RNA, 13 nt, Salmonella enterica enterica serovar Typhi
ucugacccgcgaa

SEQ ID NO: 1698871 - RNA, 11 nt, Salmonella enterica enterica serovar Typhi
ucugaccaguu

SEQ ID NO: 1698872 - RNA, 15 nt, Salmonella enterica enterica serovar Typhi
ucugauucaguaaga

SEQ ID NO: 1698873 - RNA, 19 nt, Salmonella enterica enterica serovar Typhi
ucugaugccugaaggcgcu

SEQ ID NO: 1698874 - RNA, 15 nt, Salmonella enterica enterica serovar Typhi
ucugaggauuuuuac

SEQ ID NO: 1698875 - RNA, 16 nt, Salmonella enterica enterica serovar Typhi
ucucgcgaccagagac

SEQ ID NO: 1698876 - RNA, 14 nt, Salmonella enterica enterica serovar Typhi
ucucgcucgcccgc

SEQ ID NO: 1698877 - RNA, 14 nt, Salmonella enterica enterica serovar Typhi
ucucgcucuuccag

SEQ ID NO: 1698878 - RNA, 20 nt, Salmonella enterica enterica serovar Typhi
ucugccuuuuuuaauccagg

SEQ ID NO: 1698879 - RNA, 16 nt, Salmonella enterica enterica serovar Typhi
ucugccuuuaacaaau

SEQ ID NO: 1698880 - RNA, 22 nt, Salmonella enterica enterica serovar Typhi
ucugccuuuacugaaucucaga

SEQ ID NO: 1698881 - RNA, 14 nt, Salmonella enterica enterica serovar Typhi
ucugccuuuuuuaa

SEQ ID NO: 1698882 - RNA, 14 nt, Salmonella enterica enterica serovar Typhi
ucugccugcagacc

SEQ ID NO: 1698883 - RNA, 17 nt, Salmonella enterica enterica serovar Typhi
ucugccaguagcugcuc

SEQ ID NO: 1698884 - RNA, 21 nt, Salmonella enterica enterica serovar Typhi
ucugcaggcgggugcgcagcc

SEQ ID NO: 1698885 - RNA, 21 nt, Salmonella enterica enterica serovar Typhi
ucuguuucauggagauccagu

SEQ ID NO: 1698886 - RNA, 14 nt, Salmonella enterica enterica serovar Typhi
ucuguuuguucgca

SEQ ID NO: 1698887 - RNA, 19 nt, Salmonella enterica enterica serovar Typhi
ucuguggggcuuaacccac

SEQ ID NO: 1698888 - RNA, 23 nt, Salmonella enterica enterica serovar Typhi
ucuguggccgcgcauguuugccu

SEQ ID NO: 1698889 - RNA, 15 nt, Salmonella enterica enterica serovar Typhi
ucuuaaaauagccau

SEQ ID NO: 1698890 - RNA, 14 nt, Salmonella enterica enterica serovar Typhi
ucuuaaaucaugaa

SEQ ID NO: 1698891 - RNA, 15 nt, Salmonella enterica enterica serovar Typhi
ucugugauuauccca

SEQ ID NO: 1698892 - RNA, 18 nt, Salmonella enterica enterica serovar Typhi
ucugugaaaguuucagga

SEQ ID NO: 1698893 - RNA, 16 nt, Salmonella enterica enterica serovar Typhi
ucugugagugcgccag

SEQ ID NO: 1698894 - RNA, 12 nt, Salmonella enterica enterica serovar Typhi
ucuggugcagca

SEQ ID NO: 1698895 - RNA, 13 nt, Salmonella enterica enterica serovar Typhi
ucuguauaaaaua

SEQ ID NO: 1698896 - RNA, 18 nt, Salmonella enterica enterica serovar Typhi
ucuguauaaaauauuugg

SEQ ID NO: 1698897 - RNA, 20 nt, Salmonella enterica enterica serovar Typhi
ucuggucagcgaugacgccu

SEQ ID NO: 1698898 - RNA, 14 nt, Salmonella enterica enterica serovar Typhi
ucuggucaaguauu

SEQ ID NO: 1698899 - RNA, 22 nt, Salmonella enterica enterica serovar Typhi
ucugguaagacgggugcgccca

SEQ ID NO: 1698900 - RNA, 15 nt, Salmonella enterica enterica serovar Typhi
ucuggcacagggcaa

SEQ ID NO: 1698901 - RNA, 18 nt, Salmonella enterica enterica serovar Typhi
ucuggcgacgccaaucgg

SEQ ID NO: 1698902 - RNA, 18 nt, Salmonella enterica enterica serovar Typhi
ucugcuugagcaggcaga

SEQ ID NO: 1698903 - RNA, 18 nt, Salmonella enterica enterica serovar Typhi
ucugcuuguucuuuucaa

SEQ ID NO: 1698904 - RNA, 14 nt, Salmonella enterica enterica serovar Typhi
ucugcuuuucucac

SEQ ID NO: 1698905 - RNA, 15 nt, Salmonella enterica enterica serovar Typhi
ucuggaucaguuccg

SEQ ID NO: 1698906 - RNA, 15 nt, Salmonella enterica enterica serovar Typhi
ucugcgcaacuggaa

SEQ ID NO: 1698907 - RNA, 17 nt, Salmonella enterica enterica serovar Typhi
ucugcgcauuaacgcca

SEQ ID NO: 1698908 - RNA, 22 nt, Salmonella enterica enterica serovar Typhi
ucugcgccagccagcucaccag

SEQ ID NO: 1698909 - RNA, 14 nt, Salmonella enterica enterica serovar Typhi
ucugcuuccagaau

SEQ ID NO: 1698910 - RNA, 16 nt, Salmonella enterica enterica serovar Typhi
ucugcuguuccuucag

SEQ ID NO: 1698911 - RNA, 18 nt, Salmonella enterica enterica serovar Typhi
ucugcgccgcuugugccg

SEQ ID NO: 1698912 - RNA, 18 nt, Salmonella enterica enterica serovar Typhi
ugggauauuacagaucuu

SEQ ID NO: 1698913 - RNA, 21 nt, Salmonella enterica enterica serovar Typhi
uggcuuuccugaucaaucaac

SEQ ID NO: 1698914 - RNA, 17 nt, Salmonella enterica enterica serovar Typhi
uggcggcacuaaagcgu

SEQ ID NO: 1698915 - RNA, 16 nt, Salmonella enterica enterica serovar Typhi
uggcuuucuacuacaa

SEQ ID NO: 1698916 - RNA, 22 nt, Salmonella enterica enterica serovar Typhi
uggcggcaaggcgacucaaaac

SEQ ID NO: 1698917 - RNA, 15 nt, Salmonella enterica enterica serovar Typhi
uggcggcauaauaug

SEQ ID NO: 1698918 - RNA, 17 nt, Salmonella enterica enterica serovar Typhi
uggcggagggauuuuaa

SEQ ID NO: 1698919 - RNA, 12 nt, Salmonella enterica enterica serovar Typhi
uggcggcaaaaa

SEQ ID NO: 1698920 - RNA, 12 nt, Salmonella enterica enterica serovar Typhi
ugggcagaaacg

SEQ ID NO: 1698921 - RNA, 17 nt, Salmonella enterica enterica serovar Typhi
ugggcaggaacagauac

SEQ ID NO: 1698922 - RNA, 22 nt, Salmonella enterica enterica serovar Typhi
ugggaucuucaaugaacaauaa

SEQ ID NO: 1698923 - RNA, 17 nt, Salmonella enterica enterica serovar Typhi
ugggauuugaugcccaa

SEQ ID NO: 1698924 - RNA, 15 nt, Salmonella enterica enterica serovar Typhi
uggguagaguaaccc

SEQ ID NO: 1698925 - RNA, 19 nt, Salmonella enterica enterica serovar Typhi
uggguacguucggacuggg

SEQ ID NO: 1698926 - RNA, 20 nt, Salmonella enterica enterica serovar Typhi
uggguauuuuuuagcgccaa

SEQ ID NO: 1698927 - RNA, 14 nt, Salmonella enterica enterica serovar Typhi
ugggucucauccau

SEQ ID NO: 1698928 - RNA, 16 nt, Salmonella enterica enterica serovar Typhi
ugggcuaugaagagaa

SEQ ID NO: 1698929 - RNA, 17 nt, Salmonella enterica enterica serovar Typhi
ugggcucaucaaacagc

SEQ ID NO: 1698930 - RNA, 21 nt, Salmonella enterica enterica serovar Typhi
ugggcucaucaaacagcggca

SEQ ID NO: 1698931 - RNA, 18 nt, Salmonella enterica enterica serovar Typhi
uggucugaaucugcuccg

SEQ ID NO: 1698932 - RNA, 16 nt, Salmonella enterica enterica serovar Typhi
uggucuccaguaucag

SEQ ID NO: 1698933 - RNA, 18 nt, Salmonella enterica enterica serovar Typhi
uggucuccgccuggaacc

SEQ ID NO: 1698934 - RNA, 21 nt, Salmonella enterica enterica serovar Typhi
uggucguuagccagauggcug

SEQ ID NO: 1698935 - RNA, 20 nt, Salmonella enterica enterica serovar Typhi
uggucaguagcguucuuucc

SEQ ID NO: 1698936 - RNA, 15 nt, Salmonella enterica enterica serovar Typhi
uggucgagauacugc

SEQ ID NO: 1698937 - RNA, 15 nt, Salmonella enterica enterica serovar Typhi
ugguguugguacaca

SEQ ID NO: 1698938 - RNA, 19 nt, Salmonella enterica enterica serovar Typhi
uggugucaaucgccugcug

SEQ ID NO: 1698939 - RNA, 16 nt, Salmonella enterica enterica serovar Typhi
ugguggcgaauacugu

SEQ ID NO: 1698940 - RNA, 19 nt, Salmonella enterica enterica serovar Typhi
ugguggcuauagcucaguu

SEQ ID NO: 1698941 - RNA, 17 nt, Salmonella enterica enterica serovar Typhi
ugguggcuauagcucag

SEQ ID NO: 1698942 - RNA, 23 nt, Salmonella enterica enterica serovar Typhi
ugguggcagaguccagcggcagc

SEQ ID NO: 1698943 - RNA, 16 nt, Salmonella enterica enterica serovar Typhi
ugguggauauccagca

SEQ ID NO: 1698944 - RNA, 21 nt, Salmonella enterica enterica serovar Typhi
uggugagagcacguaggccug

SEQ ID NO: 1698945 - RNA, 18 nt, Salmonella enterica enterica serovar Typhi
uggugagcuccagcccgc

SEQ ID NO: 1698946 - RNA, 17 nt, Salmonella enterica enterica serovar Typhi
uggugauccagcguagc

SEQ ID NO: 1698947 - RNA, 17 nt, Salmonella enterica enterica serovar Typhi
uggugauauaaacgggc

SEQ ID NO: 1698948 - RNA, 16 nt, Salmonella enterica enterica serovar Typhi
uggugaguggccuguc

SEQ ID NO: 1698949 - RNA, 14 nt, Salmonella enterica enterica serovar Typhi
ugguauaaaucccg

SEQ ID NO: 1698950 - RNA, 16 nt, Salmonella enterica enterica serovar Typhi
ugguauaggccaggcu

SEQ ID NO: 1698951 - RNA, 17 nt, Salmonella enterica enterica serovar Typhi
ugguauaggccaggcua

SEQ ID NO: 1698952 - RNA, 19 nt, Salmonella enterica enterica serovar Typhi
ugguagacaaacagcgcgc

SEQ ID NO: 1698953 - RNA, 16 nt, Salmonella enterica enterica serovar Typhi
ugguacuuuucaucca

SEQ ID NO: 1698954 - RNA, 14 nt, Salmonella enterica enterica serovar Typhi
ugguacucaacauc

SEQ ID NO: 1698955 - RNA, 21 nt, Salmonella enterica enterica serovar Typhi
ugguacgauuucauuacgccu

SEQ ID NO: 1698956 - RNA, 22 nt, Salmonella enterica enterica serovar Typhi
ugguaccggauuuagcggcagc

SEQ ID NO: 1698957 - RNA, 14 nt, Salmonella enterica enterica serovar Typhi
ugguacguccaucc

SEQ ID NO: 1698958 - RNA, 16 nt, Salmonella enterica enterica serovar Typhi
ugguacguccauccgc

SEQ ID NO: 1698959 - RNA, 12 nt, Salmonella enterica enterica serovar Typhi
uggucagcagcc

SEQ ID NO: 1698960 - RNA, 16 nt, Salmonella enterica enterica serovar Typhi
ugguaaauccaauaga

SEQ ID NO: 1698961 - RNA, 23 nt, Salmonella enterica enterica serovar Typhi
uggguuggucacaaaggccagca

SEQ ID NO: 1698962 - RNA, 15 nt, Salmonella enterica enterica serovar Typhi
uggguuuauuuggua

SEQ ID NO: 1698963 - RNA, 19 nt, Salmonella enterica enterica serovar Typhi
uggguuuauguaggguggc

SEQ ID NO: 1698964 - RNA, 13 nt, Salmonella enterica enterica serovar Typhi
ugucacaccggcg

SEQ ID NO: 1698965 - RNA, 21 nt, Salmonella enterica enterica serovar Typhi
uguauuugaauuuuagauccc

SEQ ID NO: 1698966 - RNA, 13 nt, Salmonella enterica enterica serovar Typhi
uguauuaaaggau

SEQ ID NO: 1698967 - RNA, 20 nt, Salmonella enterica enterica serovar Typhi
uguauagcaacuuaauaaua

SEQ ID NO: 1698968 - RNA, 18 nt, Salmonella enterica enterica serovar Typhi
uguauaccaaaaauaauu

SEQ ID NO: 1698969 - RNA, 20 nt, Salmonella enterica enterica serovar Typhi
uguauaauccaacauuauca

SEQ ID NO: 1698970 - RNA, 16 nt, Salmonella enterica enterica serovar Typhi
uguacuugcgccgcca

SEQ ID NO: 1698971 - RNA, 20 nt, Salmonella enterica enterica serovar Typhi
uguagaaaagaaggggcugg

SEQ ID NO: 1698972 - RNA, 13 nt, Salmonella enterica enterica serovar Typhi
uguagcaaauuuc

SEQ ID NO: 1698973 - RNA, 23 nt, Salmonella enterica enterica serovar Typhi
uguagcaaccucggcuugcuuca

SEQ ID NO: 1698974 - RNA, 15 nt, Salmonella enterica enterica serovar Typhi
uguagcagcgccagc

SEQ ID NO: 1698975 - RNA, 13 nt, Salmonella enterica enterica serovar Typhi
uguagcgcuuugg

SEQ ID NO: 1698976 - RNA, 16 nt, Salmonella enterica enterica serovar Typhi
uguagcagauagauaa

SEQ ID NO: 1698977 - RNA, 17 nt, Salmonella enterica enterica serovar Typhi
uguagcagcgccagcgu

SEQ ID NO: 1698978 - RNA, 15 nt, Salmonella enterica enterica serovar Typhi
uguaggcuuccagaa

SEQ ID NO: 1698979 - RNA, 19 nt, Salmonella enterica enterica serovar Typhi
uguaguuagagauauacca

SEQ ID NO: 1698980 - RNA, 17 nt, Salmonella enterica enterica serovar Typhi
uguaguuauaaauuuau

SEQ ID NO: 1698981 - RNA, 13 nt, Salmonella enterica enterica serovar Typhi
uguauaaaauauu

SEQ ID NO: 1698982 - RNA, 14 nt, Salmonella enterica enterica serovar Typhi
uguauaaaauauuu

SEQ ID NO: 1698983 - RNA, 20 nt, Salmonella enterica enterica serovar Typhi
uguaaagaaauuuaaagaua

SEQ ID NO: 1698984 - RNA, 15 nt, Salmonella enterica enterica serovar Typhi
uguaaagaaugaaaa

SEQ ID NO: 1698985 - RNA, 21 nt, Salmonella enterica enterica serovar Typhi
uguaaacccgauucugccagu

SEQ ID NO: 1698986 - RNA, 16 nt, Salmonella enterica enterica serovar Typhi
uguaaaccguuuuucc

SEQ ID NO: 1698987 - RNA, 22 nt, Salmonella enterica enterica serovar Typhi
uguaaaagggauacgguuuuuu

SEQ ID NO: 1698988 - RNA, 20 nt, Salmonella enterica enterica serovar Typhi
uguaaaauccggcaggcagc

SEQ ID NO: 1698989 - RNA, 18 nt, Salmonella enterica enterica serovar Typhi
ugguuaucgaauccagca

SEQ ID NO: 1698990 - RNA, 17 nt, Salmonella enterica enterica serovar Typhi
ugguuauccagcaggua

SEQ ID NO: 1698991 - RNA, 14 nt, Salmonella enterica enterica serovar Typhi
ugguuauuuucaga

SEQ ID NO: 1698992 - RNA, 12 nt, Salmonella enterica enterica serovar Typhi
uguaaaaaugcu

SEQ ID NO: 1698993 - RNA, 16 nt, Salmonella enterica enterica serovar Typhi
uguaaccaaagcacca

SEQ ID NO: 1698994 - RNA, 22 nt, Salmonella enterica enterica serovar Typhi
uguaacgaguugcggcaacgug

SEQ ID NO: 1698995 - RNA, 22 nt, Salmonella enterica enterica serovar Typhi
uguaaagucggccauuuuuuua

SEQ ID NO: 1698996 - RNA, 18 nt, Salmonella enterica enterica serovar Typhi
uguaaaggugagcucuuu

SEQ ID NO: 1698997 - RNA, 21 nt, Salmonella enterica enterica serovar Typhi
uguaaaccaggcauuuuauua

SEQ ID NO: 1698998 - RNA, 16 nt, Salmonella enterica enterica serovar Typhi
uguacaucuacuucag

SEQ ID NO: 1698999 - RNA, 15 nt, Salmonella enterica enterica serovar Typhi
uguacaagaagggua

SEQ ID NO: 1699000 - RNA, 22 nt, Salmonella enterica enterica serovar Typhi
uguacaaccaucacugaaccca

SEQ ID NO: 1699001 - RNA, 17 nt, Salmonella enterica enterica serovar Typhi
uguaauuuauaaaguaa

SEQ ID NO: 1699002 - RNA, 15 nt, Salmonella enterica enterica serovar Typhi
uguacuuuugcuucc

SEQ ID NO: 1699003 - RNA, 19 nt, Salmonella enterica enterica serovar Typhi
uguacccucgcgccaguga

SEQ ID NO: 1699004 - RNA, 22 nt, Salmonella enterica enterica serovar Typhi
uguacggcgucagccacgguuc

SEQ ID NO: 1699005 - RNA, 20 nt, Salmonella enterica enterica serovar Typhi
uguaccugauccagcucuuc

SEQ ID NO: 1699006 - RNA, 15 nt, Salmonella enterica enterica serovar Typhi
uguacgugaagggaa

SEQ ID NO: 1699007 - RNA, 15 nt, Salmonella enterica enterica serovar Typhi
uggccgacuggcacc

SEQ ID NO: 1699008 - RNA, 15 nt, Salmonella enterica enterica serovar Typhi
uggcccugcaucagc

SEQ ID NO: 1699009 - RNA, 14 nt, Salmonella enterica enterica serovar Typhi
uggcccucccuggc

SEQ ID NO: 1699010 - RNA, 23 nt, Salmonella enterica enterica serovar Typhi
uggccgauauugccuucacccag

SEQ ID NO: 1699011 - RNA, 19 nt, Salmonella enterica enterica serovar Typhi
uggcccauuuuggccgcuu

SEQ ID NO: 1699012 - RNA, 14 nt, Salmonella enterica enterica serovar Typhi
uggccccugagcaa

SEQ ID NO: 1699013 - RNA, 16 nt, Salmonella enterica enterica serovar Typhi
uggcccgcacugccga

SEQ ID NO: 1699014 - RNA, 14 nt, Salmonella enterica enterica serovar Typhi
uggcauuggcaucu

SEQ ID NO: 1699015 - RNA, 17 nt, Salmonella enterica enterica serovar Typhi
uggcauuggcaucuguc

SEQ ID NO: 1699016 - RNA, 16 nt, Salmonella enterica enterica serovar Typhi
uggcauucuuacgaua

SEQ ID NO: 1699017 - RNA, 20 nt, Salmonella enterica enterica serovar Typhi
uggcauugccggaaaccaac

SEQ ID NO: 1699018 - RNA, 19 nt, Salmonella enterica enterica serovar Typhi
uggcaucauaaaaggcauc

SEQ ID NO: 1699019 - RNA, 20 nt, Salmonella enterica enterica serovar Typhi
uggcauagccugauauccac

SEQ ID NO: 1699020 - RNA, 15 nt, Salmonella enterica enterica serovar Typhi
uggcaucaucaaacg

SEQ ID NO: 1699021 - RNA, 24 nt, Salmonella enterica enterica serovar Typhi
uggcaugcccggugauauuguguu

SEQ ID NO: 1699022 - RNA, 17 nt, Salmonella enterica enterica serovar Typhi
uggcaucugaucuacaa

SEQ ID NO: 1699023 - RNA, 18 nt, Salmonella enterica enterica serovar Typhi
uggcauuacgcuggcccc

SEQ ID NO: 1699024 - RNA, 21 nt, Salmonella enterica enterica serovar Typhi
uggccauauuuuuucaggaag

SEQ ID NO: 1699025 - RNA, 13 nt, Salmonella enterica enterica serovar Typhi
uggccaguuucaa

SEQ ID NO: 1699026 - RNA, 15 nt, Salmonella enterica enterica serovar Typhi
uggccaggaauaaag

SEQ ID NO: 1699027 - RNA, 22 nt, Salmonella enterica enterica serovar Typhi
uggccaccuuuacgguggccuu

SEQ ID NO: 1699028 - RNA, 16 nt, Salmonella enterica enterica serovar Typhi
uggccaaucagcgggu

SEQ ID NO: 1699029 - RNA, 17 nt, Salmonella enterica enterica serovar Typhi
uggccgcugaccacggc

SEQ ID NO: 1699030 - RNA, 17 nt, Salmonella enterica enterica serovar Typhi
uggccgcuauccucgcc

SEQ ID NO: 1699031 - RNA, 19 nt, Salmonella enterica enterica serovar Typhi
uggccgcgugcucgcggcg

SEQ ID NO: 1699032 - RNA, 20 nt, Salmonella enterica enterica serovar Typhi
uggcgaacagccccaccgcc

SEQ ID NO: 1699033 - RNA, 21 nt, Salmonella enterica enterica serovar Typhi
uggccugcagaccuauauggc

SEQ ID NO: 1699034 - RNA, 15 nt, Salmonella enterica enterica serovar Typhi
uggccugcucaucag

SEQ ID NO: 1699035 - RNA, 14 nt, Salmonella enterica enterica serovar Typhi
uggccguggugaag

SEQ ID NO: 1699036 - RNA, 12 nt, Salmonella enterica enterica serovar Typhi
uggccucauccg

SEQ ID NO: 1699037 - RNA, 13 nt, Salmonella enterica enterica serovar Typhi
uggccucaucaug

SEQ ID NO: 1699038 - RNA, 18 nt, Salmonella enterica enterica serovar Typhi
uggcgaggaacaucagcc

SEQ ID NO: 1699039 - RNA, 22 nt, Salmonella enterica enterica serovar Typhi
uggcgaggcuuuguccuuugcu

SEQ ID NO: 1699040 - RNA, 16 nt, Salmonella enterica enterica serovar Typhi
uggcgaucacaauuac

SEQ ID NO: 1699041 - RNA, 16 nt, Salmonella enterica enterica serovar Typhi
uggcgauauccgugcc

SEQ ID NO: 1699042 - RNA, 16 nt, Salmonella enterica enterica serovar Typhi
uggcgaucagcgccac

SEQ ID NO: 1699043 - RNA, 20 nt, Salmonella enterica enterica serovar Typhi
uggcgaucagcgccaccaca

SEQ ID NO: 1699044 - RNA, 21 nt, Salmonella enterica enterica serovar Typhi
uggcgaugcuaucgguagugu

SEQ ID NO: 1699045 - RNA, 17 nt, Salmonella enterica enterica serovar Typhi
uggcgaauucggcagac

SEQ ID NO: 1699046 - RNA, 23 nt, Salmonella enterica enterica serovar Typhi
uggcgaauccgggaaauggcaau

SEQ ID NO: 1699047 - RNA, 17 nt, Salmonella enterica enterica serovar Typhi
uggcgaccggcagccgu

SEQ ID NO: 1699048 - RNA, 15 nt, Salmonella enterica enterica serovar Typhi
uggcgaccgggucga

SEQ ID NO: 1699049 - RNA, 21 nt, Salmonella enterica enterica serovar Typhi
uggcgaccugauugaccagca

SEQ ID NO: 1699050 - RNA, 14 nt, Salmonella enterica enterica serovar Typhi
uggcgacgccagcc

SEQ ID NO: 1699051 - RNA, 16 nt, Salmonella enterica enterica serovar Typhi
uggcgagcaacuuuuu

SEQ ID NO: 1699052 - RNA, 20 nt, Salmonella enterica enterica serovar Typhi
uggcgcacaguacgcgaccg

SEQ ID NO: 1699053 - RNA, 16 nt, Salmonella enterica enterica serovar Typhi
uggcgauuucggugac

SEQ ID NO: 1699054 - RNA, 19 nt, Salmonella enterica enterica serovar Typhi
uggcgauuuucauagcugg

SEQ ID NO: 1699055 - RNA, 18 nt, Salmonella enterica enterica serovar Typhi
uggcgcaguggcgggugc

SEQ ID NO: 1699056 - RNA, 19 nt, Salmonella enterica enterica serovar Typhi
uggcgcagcauacgcugca

SEQ ID NO: 1699057 - RNA, 16 nt, Salmonella enterica enterica serovar Typhi
uggcgccaugagccug

SEQ ID NO: 1699058 - RNA, 18 nt, Salmonella enterica enterica serovar Typhi
uggcgccgcaaaccagac

SEQ ID NO: 1699059 - RNA, 20 nt, Salmonella enterica enterica serovar Typhi
uggcggaauccaucccccug

SEQ ID NO: 1699060 - RNA, 14 nt, Salmonella enterica enterica serovar Typhi
uggagucugaaaau

SEQ ID NO: 1699061 - RNA, 17 nt, Salmonella enterica enterica serovar Typhi
uggaguagauguagcug

SEQ ID NO: 1699062 - RNA, 15 nt, Salmonella enterica enterica serovar Typhi
uggaggaacagcgcc

SEQ ID NO: 1699063 - RNA, 15 nt, Salmonella enterica enterica serovar Typhi
uggagguuucuucau

SEQ ID NO: 1699064 - RNA, 16 nt, Salmonella enterica enterica serovar Typhi
uggaggguaagaaagu

SEQ ID NO: 1699065 - RNA, 19 nt, Salmonella enterica enterica serovar Typhi
uggacuauggucugaaaga

SEQ ID NO: 1699066 - RNA, 13 nt, Salmonella enterica enterica serovar Typhi
uggacgucaugcc

SEQ ID NO: 1699067 - RNA, 14 nt, Salmonella enterica enterica serovar Typhi
uggacgucaugccg

SEQ ID NO: 1699068 - RNA, 16 nt, Salmonella enterica enterica serovar Typhi
uggauagcaauuucag

SEQ ID NO: 1699069 - RNA, 17 nt, Salmonella enterica enterica serovar Typhi
uggauagcaauuucagc

SEQ ID NO: 1699070 - RNA, 15 nt, Salmonella enterica enterica serovar Typhi
uggauagucuucaag

SEQ ID NO: 1699071 - RNA, 23 nt, Salmonella enterica enterica serovar Typhi
uggaguuuaaacacucuccacca

SEQ ID NO: 1699072 - RNA, 23 nt, Salmonella enterica enterica serovar Typhi
uggaguuaucauuauauagucuu

SEQ ID NO: 1699073 - RNA, 18 nt, Salmonella enterica enterica serovar Typhi
uggauaaagccaauggug

SEQ ID NO: 1699074 - RNA, 17 nt, Salmonella enterica enterica serovar Typhi
uggauaacgaaaagggu

SEQ ID NO: 1699075 - RNA, 23 nt, Salmonella enterica enterica serovar Typhi
uggauaagacgacgguuaaaaag

SEQ ID NO: 1699076 - RNA, 16 nt, Salmonella enterica enterica serovar Typhi
uggaucggaaaucaaa

SEQ ID NO: 1699077 - RNA, 15 nt, Salmonella enterica enterica serovar Typhi
uggaucagaagcuuc

SEQ ID NO: 1699078 - RNA, 18 nt, Salmonella enterica enterica serovar Typhi
uggaucagacgccgcgcu

SEQ ID NO: 1699079 - RNA, 14 nt, Salmonella enterica enterica serovar Typhi
uggaugaacucaau

SEQ ID NO: 1699080 - RNA, 17 nt, Salmonella enterica enterica serovar Typhi
uggaugcgcugaauagc

SEQ ID NO: 1699081 - RNA, 22 nt, Salmonella enterica enterica serovar Typhi
uggaugcgcugaauagcgcugc

SEQ ID NO: 1699082 - RNA, 22 nt, Salmonella enterica enterica serovar Typhi
uggcauauuugccccuuccgcc

SEQ ID NO: 1699083 - RNA, 20 nt, Salmonella enterica enterica serovar Typhi
uggcauauugcgaucuguac

SEQ ID NO: 1699084 - RNA, 15 nt, Salmonella enterica enterica serovar Typhi
uggcauagccaaaga

SEQ ID NO: 1699085 - RNA, 21 nt, Salmonella enterica enterica serovar Typhi
uggcauaaccgcagcgcggcc

SEQ ID NO: 1699086 - RNA, 16 nt, Salmonella enterica enterica serovar Typhi
uggcagccucguccug

SEQ ID NO: 1699087 - RNA, 17 nt, Salmonella enterica enterica serovar Typhi
uggcagccccugaaaua

SEQ ID NO: 1699088 - RNA, 23 nt, Salmonella enterica enterica serovar Typhi
uggcagcgccugacggcgcuguc

SEQ ID NO: 1699089 - RNA, 19 nt, Salmonella enterica enterica serovar Typhi
uggcagcggcaguaaauuu

SEQ ID NO: 1699090 - RNA, 18 nt, Salmonella enterica enterica serovar Typhi
uggcagcggcaguaaauu

SEQ ID NO: 1699091 - RNA, 15 nt, Salmonella enterica enterica serovar Typhi
uggcacuucgcgcca

SEQ ID NO: 1699092 - RNA, 14 nt, Salmonella enterica enterica serovar Typhi
uggcacagcgcagc

SEQ ID NO: 1699093 - RNA, 22 nt, Salmonella enterica enterica serovar Typhi
uggcaaucaaauccagcucagu

SEQ ID NO: 1699094 - RNA, 21 nt, Salmonella enterica enterica serovar Typhi
uggcaaucauaccgucagauu

SEQ ID NO: 1699095 - RNA, 17 nt, Salmonella enterica enterica serovar Typhi
uggcaauuaaauuagaa

SEQ ID NO: 1699096 - RNA, 17 nt, Salmonella enterica enterica serovar Typhi
uggcaagcgcuaagcaa

SEQ ID NO: 1699097 - RNA, 13 nt, Salmonella enterica enterica serovar Typhi
uggcaagaaucac

SEQ ID NO: 1699098 - RNA, 17 nt, Salmonella enterica enterica serovar Typhi
uggcaagaauuauuuca

SEQ ID NO: 1699099 - RNA, 16 nt, Salmonella enterica enterica serovar Typhi
uggcaacaugaccagc

SEQ ID NO: 1699100 - RNA, 18 nt, Salmonella enterica enterica serovar Typhi
uggcaacaaagccugcug

SEQ ID NO: 1699101 - RNA, 20 nt, Salmonella enterica enterica serovar Typhi
uggcaaaaucguuaaccagc

SEQ ID NO: 1699102 - RNA, 16 nt, Salmonella enterica enterica serovar Typhi
uggcaaaacgcaucca

SEQ ID NO: 1699103 - RNA, 18 nt, Salmonella enterica enterica serovar Typhi
uggcaaaaacaccuaacc

SEQ ID NO: 1699104 - RNA, 21 nt, Salmonella enterica enterica serovar Typhi
uggcaaaaaaggccagacuca

SEQ ID NO: 1699105 - RNA, 18 nt, Salmonella enterica enterica serovar Typhi
uggauuuuugacuaaagu

SEQ ID NO: 1699106 - RNA, 21 nt, Salmonella enterica enterica serovar Typhi
uggauuuuccguuaagcugga

SEQ ID NO: 1699107 - RNA, 22 nt, Salmonella enterica enterica serovar Typhi
uggauuuauggcacaucaggca

SEQ ID NO: 1699108 - RNA, 17 nt, Salmonella enterica enterica serovar Typhi
uggauuacaaaaauaga

SEQ ID NO: 1699109 - RNA, 20 nt, Salmonella enterica enterica serovar Typhi
uguuugcugagaauuuccag

SEQ ID NO: 1699110 - RNA, 15 nt, Salmonella enterica enterica serovar Typhi
uguuucggauaauuc

SEQ ID NO: 1699111 - RNA, 16 nt, Salmonella enterica enterica serovar Typhi
uguuucggauaauucu

SEQ ID NO: 1699112 - RNA, 23 nt, Salmonella enterica enterica serovar Typhi
uguuucuuuuaaggcggcaaaga

SEQ ID NO: 1699113 - RNA, 10 nt, Salmonella enterica enterica serovar Typhi
uguuucugcg

SEQ ID NO: 1699114 - RNA, 14 nt, Salmonella enterica enterica serovar Typhi
uguuuuaccuguuu

SEQ ID NO: 1699115 - RNA, 18 nt, Salmonella enterica enterica serovar Typhi
uguuuuacuuuuuuaaau

SEQ ID NO: 1699116 - RNA, 21 nt, Salmonella enterica enterica serovar Typhi
uguuuuacuuuuuuaaauguu

SEQ ID NO: 1699117 - RNA, 20 nt, Salmonella enterica enterica serovar Typhi
uguuuuagcagaguaugcug

SEQ ID NO: 1699118 - RNA, 20 nt, Salmonella enterica enterica serovar Typhi
uguuuuauacucaaaaaauc

SEQ ID NO: 1699119 - RNA, 16 nt, Salmonella enterica enterica serovar Typhi
uguuuuauuaccuccu

SEQ ID NO: 1699120 - RNA, 17 nt, Salmonella enterica enterica serovar Typhi
uguuuaaugcuuucaau

SEQ ID NO: 1699121 - RNA, 19 nt, Salmonella enterica enterica serovar Typhi
uguuuaagcgccuccacaa

SEQ ID NO: 1699122 - RNA, 15 nt, Salmonella enterica enterica serovar Typhi
uguuuaaaaucaacg

SEQ ID NO: 1699123 - RNA, 14 nt, Salmonella enterica enterica serovar Typhi
uguuuacgccgcca

SEQ ID NO: 1699124 - RNA, 16 nt, Salmonella enterica enterica serovar Typhi
uguuuagacacauuga

SEQ ID NO: 1699125 - RNA, 19 nt, Salmonella enterica enterica serovar Typhi
uguuuaguacgcaaggaaa

SEQ ID NO: 1699126 - RNA, 22 nt, Salmonella enterica enterica serovar Typhi
uguuuaucagaccuguaaaaaa

SEQ ID NO: 1699127 - RNA, 15 nt, Salmonella enterica enterica serovar Typhi
uguuucaguucggag

SEQ ID NO: 1699128 - RNA, 23 nt, Salmonella enterica enterica serovar Typhi
uguuuccauacauuuuuguaaua

SEQ ID NO: 1699129 - RNA, 14 nt, Salmonella enterica enterica serovar Typhi
uguuucccaacaau

SEQ ID NO: 1699130 - RNA, 21 nt, Salmonella enterica enterica serovar Typhi
uuaaaguuaguaccgaacagc

SEQ ID NO: 1699131 - RNA, 15 nt, Salmonella enterica enterica serovar Typhi
uuaaagcacaagaac

SEQ ID NO: 1699132 - RNA, 23 nt, Salmonella enterica enterica serovar Typhi
uuaaagcacaagaacuuaaauua

SEQ ID NO: 1699133 - RNA, 19 nt, Salmonella enterica enterica serovar Typhi
uuaaagccaauccagaaua

SEQ ID NO: 1699134 - RNA, 23 nt, Salmonella enterica enterica serovar Typhi
uuaaagccgaccaucgcgccgcu

SEQ ID NO: 1699135 - RNA, 22 nt, Salmonella enterica enterica serovar Typhi
uuaaagcgcucaagcggcacca

SEQ ID NO: 1699136 - RNA, 20 nt, Salmonella enterica enterica serovar Typhi
uuaaaauuccaauauuuauu

SEQ ID NO: 1699137 - RNA, 23 nt, Salmonella enterica enterica serovar Typhi
uuaaaauaaaugaggcuguuuuu

SEQ ID NO: 1699138 - RNA, 21 nt, Salmonella enterica enterica serovar Typhi
uuaaaagcgccuuaaaccguc

SEQ ID NO: 1699139 - RNA, 22 nt, Salmonella enterica enterica serovar Typhi
uuaaaaacagguugcguaacgc

SEQ ID NO: 1699140 - RNA, 15 nt, Salmonella enterica enterica serovar Typhi
uuaaaaaauccugca

SEQ ID NO: 1699141 - RNA, 21 nt, Salmonella enterica enterica serovar Typhi
uuaaaaaaggccgcuuaauaa

SEQ ID NO: 1699142 - RNA, 13 nt, Salmonella enterica enterica serovar Typhi
uuaaaaagcugca

SEQ ID NO: 1699143 - RNA, 13 nt, Salmonella enterica enterica serovar Typhi
uuaaaaacaucau

SEQ ID NO: 1699144 - RNA, 18 nt, Salmonella enterica enterica serovar Typhi
uuaaaaaccaggcaaaaa

SEQ ID NO: 1699145 - RNA, 16 nt, Salmonella enterica enterica serovar Typhi
uguuuuuauuuuucuu

SEQ ID NO: 1699146 - RNA, 12 nt, Salmonella enterica enterica serovar Typhi
uguuuuucucuu

SEQ ID NO: 1699147 - RNA, 16 nt, Salmonella enterica enterica serovar Typhi
uguuuuugcuuuaaua

SEQ ID NO: 1699148 - RNA, 18 nt, Salmonella enterica enterica serovar Typhi
uguuuuugcuuuaauauu

SEQ ID NO: 1699149 - RNA, 13 nt, Salmonella enterica enterica serovar Typhi
uguuuuuaaaaga

SEQ ID NO: 1699150 - RNA, 14 nt, Salmonella enterica enterica serovar Typhi
uguuuuuguaccag

SEQ ID NO: 1699151 - RNA, 16 nt, Salmonella enterica enterica serovar Typhi
uguuuuuuaauauauu

SEQ ID NO: 1699152 - RNA, 11 nt, Salmonella enterica enterica serovar Typhi
uuaaaaaaacg

SEQ ID NO: 1699153 - RNA, 15 nt, Salmonella enterica enterica serovar Typhi
uguuaauaagcagaa

SEQ ID NO: 1699154 - RNA, 21 nt, Salmonella enterica enterica serovar Typhi
uguuaucaugugaucuauaua

SEQ ID NO: 1699155 - RNA, 16 nt, Salmonella enterica enterica serovar Typhi
uguuauccuaaaucug

SEQ ID NO: 1699156 - RNA, 17 nt, Salmonella enterica enterica serovar Typhi
uguuaucuacaguguaa

SEQ ID NO: 1699157 - RNA, 16 nt, Salmonella enterica enterica serovar Typhi
uguucacaucgcucag

SEQ ID NO: 1699158 - RNA, 21 nt, Salmonella enterica enterica serovar Typhi
uguuauuuacaaggaaagucu

SEQ ID NO: 1699159 - RNA, 14 nt, Salmonella enterica enterica serovar Typhi
uguuccaccugcgg

SEQ ID NO: 1699160 - RNA, 12 nt, Salmonella enterica enterica serovar Typhi
uguuccucuuuc

SEQ ID NO: 1699161 - RNA, 14 nt, Salmonella enterica enterica serovar Typhi
uguuccucuuuccc

SEQ ID NO: 1699162 - RNA, 17 nt, Salmonella enterica enterica serovar Typhi
uguuccugcuggcaaaa

SEQ ID NO: 1699163 - RNA, 22 nt, Salmonella enterica enterica serovar Typhi
uguuccuggacguggguuucaa

SEQ ID NO: 1699164 - RNA, 13 nt, Salmonella enterica enterica serovar Typhi
uguugcuccagca

SEQ ID NO: 1699165 - RNA, 23 nt, Salmonella enterica enterica serovar Typhi
uguuggaaaugcguggcauuaac

SEQ ID NO: 1699166 - RNA, 21 nt, Salmonella enterica enterica serovar Typhi
uguugcaccuguuucugcugg

SEQ ID NO: 1699167 - RNA, 14 nt, Salmonella enterica enterica serovar Typhi
uguugcaaauauuc

SEQ ID NO: 1699168 - RNA, 20 nt, Salmonella enterica enterica serovar Typhi
uguugauugaaacucgccau

SEQ ID NO: 1699169 - RNA, 22 nt, Salmonella enterica enterica serovar Typhi
uguuggugaguggccugucugg

SEQ ID NO: 1699170 - RNA, 22 nt, Salmonella enterica enterica serovar Typhi
uguuguaagggcuggaaaauca

SEQ ID NO: 1699171 - RNA, 20 nt, Salmonella enterica enterica serovar Typhi
uguuguguuuagcccucugg

SEQ ID NO: 1699172 - RNA, 21 nt, Salmonella enterica enterica serovar Typhi
uguuguucuuuucuuucagcu

SEQ ID NO: 1699173 - RNA, 21 nt, Salmonella enterica enterica serovar Typhi
uguuguucgucuuuugaauag

SEQ ID NO: 1699174 - RNA, 21 nt, Salmonella enterica enterica serovar Typhi
uguugugugccgcgcuggugg

SEQ ID NO: 1699175 - RNA, 19 nt, Salmonella enterica enterica serovar Typhi
ugugcagugacagaggaau

SEQ ID NO: 1699176 - RNA, 15 nt, Salmonella enterica enterica serovar Typhi
ugugaguaaagagau

SEQ ID NO: 1699177 - RNA, 23 nt, Salmonella enterica enterica serovar Typhi
ugugagccauaacaacuauuuuu

SEQ ID NO: 1699178 - RNA, 23 nt, Salmonella enterica enterica serovar Typhi
ugugcgacaacaaugaaacgguu

SEQ ID NO: 1699179 - RNA, 16 nt, Salmonella enterica enterica serovar Typhi
ugucacccgcuuuucc

SEQ ID NO: 1699180 - RNA, 22 nt, Salmonella enterica enterica serovar Typhi
ugucacgccguguucgucgcca

SEQ ID NO: 1699181 - RNA, 16 nt, Salmonella enterica enterica serovar Typhi
ugugaccaacaucauu

SEQ ID NO: 1699182 - RNA, 17 nt, Salmonella enterica enterica serovar Typhi
ugugaccagcaguuccg

SEQ ID NO: 1699183 - RNA, 14 nt, Salmonella enterica enterica serovar Typhi
ugugacggcauguc

SEQ ID NO: 1699184 - RNA, 21 nt, Salmonella enterica enterica serovar Typhi
ugugcgugacccacaguuuca

SEQ ID NO: 1699185 - RNA, 19 nt, Salmonella enterica enterica serovar Typhi
ugugcguauugagcgcagu

SEQ ID NO: 1699186 - RNA, 19 nt, Salmonella enterica enterica serovar Typhi
ugugcucgauauauuuucc

SEQ ID NO: 1699187 - RNA, 16 nt, Salmonella enterica enterica serovar Typhi
ugugcucgauauauuu

SEQ ID NO: 1699188 - RNA, 18 nt, Salmonella enterica enterica serovar Typhi
uguggccaggcacguuaa

SEQ ID NO: 1699189 - RNA, 17 nt, Salmonella enterica enterica serovar Typhi
uguggccugcucuacuc

SEQ ID NO: 1699190 - RNA, 13 nt, Salmonella enterica enterica serovar Typhi
uguggccugcuua

SEQ ID NO: 1699191 - RNA, 19 nt, Salmonella enterica enterica serovar Typhi
uguggcuguguucauccca

SEQ ID NO: 1699192 - RNA, 16 nt, Salmonella enterica enterica serovar Typhi
uguggcgcggccugga

SEQ ID NO: 1699193 - RNA, 15 nt, Salmonella enterica enterica serovar Typhi
ugugucguccaggcc

SEQ ID NO: 1699194 - RNA, 14 nt, Salmonella enterica enterica serovar Typhi
ugugucaccacggg

SEQ ID NO: 1699195 - RNA, 20 nt, Salmonella enterica enterica serovar Typhi
uguggucgcggcucaccagc

SEQ ID NO: 1699196 - RNA, 14 nt, Salmonella enterica enterica serovar Typhi
uguguuuuuuaaua

SEQ ID NO: 1699197 - RNA, 22 nt, Salmonella enterica enterica serovar Typhi
uguuaaccagauaagccugugc

SEQ ID NO: 1699198 - RNA, 19 nt, Salmonella enterica enterica serovar Typhi
uguuaaaaagaccaugaac

SEQ ID NO: 1699199 - RNA, 21 nt, Salmonella enterica enterica serovar Typhi
uuaccaguugaccaaacagca

SEQ ID NO: 1699200 - RNA, 20 nt, Salmonella enterica enterica serovar Typhi
uuacccuucagauaucccau

SEQ ID NO: 1699201 - RNA, 16 nt, Salmonella enterica enterica serovar Typhi
uuaccgcgcucaaaug

SEQ ID NO: 1699202 - RNA, 15 nt, Salmonella enterica enterica serovar Typhi
uuaccgccagcggcg

SEQ ID NO: 1699203 - RNA, 19 nt, Salmonella enterica enterica serovar Typhi
uuaccgcccuguccuccau

SEQ ID NO: 1699204 - RNA, 22 nt, Salmonella enterica enterica serovar Typhi
uuacccuuccccggcagccuca

SEQ ID NO: 1699205 - RNA, 15 nt, Salmonella enterica enterica serovar Typhi
uuaccggugcagacc

SEQ ID NO: 1699206 - RNA, 17 nt, Salmonella enterica enterica serovar Typhi
uuaccguuugucuucug

SEQ ID NO: 1699207 - RNA, 13 nt, Salmonella enterica enterica serovar Typhi
uuaccguaaaaug

SEQ ID NO: 1699208 - RNA, 21 nt, Salmonella enterica enterica serovar Typhi
uuaccguaaaaugcuggugca

SEQ ID NO: 1699209 - RNA, 19 nt, Salmonella enterica enterica serovar Typhi
uuaccguaugcaaaaggca

SEQ ID NO: 1699210 - RNA, 21 nt, Salmonella enterica enterica serovar Typhi
uuaccuacuguggugugccug

SEQ ID NO: 1699211 - RNA, 13 nt, Salmonella enterica enterica serovar Typhi
uuaccuaccaguu

SEQ ID NO: 1699212 - RNA, 17 nt, Salmonella enterica enterica serovar Typhi
uuaccuggguagcuucu

SEQ ID NO: 1699213 - RNA, 17 nt, Salmonella enterica enterica serovar Typhi
uuacaauuucgcaaaca

SEQ ID NO: 1699214 - RNA, 18 nt, Salmonella enterica enterica serovar Typhi
uuacaauuuaucugcgug

SEQ ID NO: 1699215 - RNA, 16 nt, Salmonella enterica enterica serovar Typhi
uuacaauguacagaau

SEQ ID NO: 1699216 - RNA, 14 nt, Salmonella enterica enterica serovar Typhi
uuacaggacagaug

SEQ ID NO: 1699217 - RNA, 22 nt, Salmonella enterica enterica serovar Typhi
uuacaggcauccgugaccugcu

SEQ ID NO: 1699218 - RNA, 19 nt, Salmonella enterica enterica serovar Typhi
uuacaggcaucuuccagcg

SEQ ID NO: 1699219 - RNA, 21 nt, Salmonella enterica enterica serovar Typhi
uuacaggcgcaucagaaaaac

SEQ ID NO: 1699220 - RNA, 13 nt, Salmonella enterica enterica serovar Typhi
uuacaggugccug

SEQ ID NO: 1699221 - RNA, 19 nt, Salmonella enterica enterica serovar Typhi
uuacaauuuaucugcguga

SEQ ID NO: 1699222 - RNA, 13 nt, Salmonella enterica enterica serovar Typhi
uuaccacuuugcg

SEQ ID NO: 1699223 - RNA, 18 nt, Salmonella enterica enterica serovar Typhi
uuaccacgguaacgccuu

SEQ ID NO: 1699224 - RNA, 22 nt, Salmonella enterica enterica serovar Typhi
uuaccagaccggcaucucaucu

SEQ ID NO: 1699225 - RNA, 14 nt, Salmonella enterica enterica serovar Typhi
uuaccaaucugcgu

SEQ ID NO: 1699226 - RNA, 20 nt, Salmonella enterica enterica serovar Typhi
uuaauccgcggauagacgau

SEQ ID NO: 1699227 - RNA, 22 nt, Salmonella enterica enterica serovar Typhi
uuaaucccuugcuggcgacggc

SEQ ID NO: 1699228 - RNA, 14 nt, Salmonella enterica enterica serovar Typhi
uuaaucgucauccc

SEQ ID NO: 1699229 - RNA, 15 nt, Salmonella enterica enterica serovar Typhi
uuaaucgucaucccg

SEQ ID NO: 1699230 - RNA, 14 nt, Salmonella enterica enterica serovar Typhi
uuaaucgauuuucu

SEQ ID NO: 1699231 - RNA, 13 nt, Salmonella enterica enterica serovar Typhi
uuaauuaauccau

SEQ ID NO: 1699232 - RNA, 18 nt, Salmonella enterica enterica serovar Typhi
uuaauuugcaucaggcca

SEQ ID NO: 1699233 - RNA, 20 nt, Salmonella enterica enterica serovar Typhi
uuaauuugcuccagaagauc

SEQ ID NO: 1699234 - RNA, 18 nt, Salmonella enterica enterica serovar Typhi
uuaauuugugccagcgug

SEQ ID NO: 1699235 - RNA, 18 nt, Salmonella enterica enterica serovar Typhi
uuaauucuuuuaacauaa

SEQ ID NO: 1699236 - RNA, 12 nt, Salmonella enterica enterica serovar Typhi
uuaauccagcag

SEQ ID NO: 1699237 - RNA, 14 nt, Salmonella enterica enterica serovar Typhi
uuaaucccaacccg

SEQ ID NO: 1699238 - RNA, 23 nt, Salmonella enterica enterica serovar Typhi
uuaauaaugugccgguaagaaga

SEQ ID NO: 1699239 - RNA, 11 nt, Salmonella enterica enterica serovar Typhi
uuaauacacga

SEQ ID NO: 1699240 - RNA, 17 nt, Salmonella enterica enterica serovar Typhi
uuaauacacgauaaacc

SEQ ID NO: 1699241 - RNA, 21 nt, Salmonella enterica enterica serovar Typhi
uuaauacaucaugcuugcuuu

SEQ ID NO: 1699242 - RNA, 15 nt, Salmonella enterica enterica serovar Typhi
uuaauacaucagaaa

SEQ ID NO: 1699243 - RNA, 14 nt, Salmonella enterica enterica serovar Typhi
uuaagucaucuguu

SEQ ID NO: 1699244 - RNA, 14 nt, Salmonella enterica enterica serovar Typhi
uuaagucauaccug

SEQ ID NO: 1699245 - RNA, 13 nt, Salmonella enterica enterica serovar Typhi
uuaagaagucugu

SEQ ID NO: 1699246 - RNA, 19 nt, Salmonella enterica enterica serovar Typhi
uuaagacagguaacugcac

SEQ ID NO: 1699247 - RNA, 23 nt, Salmonella enterica enterica serovar Typhi
uuaagacgcuucauaucgcccag

SEQ ID NO: 1699248 - RNA, 17 nt, Salmonella enterica enterica serovar Typhi
uuaaggaugaacucuau

SEQ ID NO: 1699249 - RNA, 15 nt, Salmonella enterica enterica serovar Typhi
uuaaggauugccgcc

SEQ ID NO: 1699250 - RNA, 21 nt, Salmonella enterica enterica serovar Typhi
uuaagaacgguuggaauaauu

SEQ ID NO: 1699251 - RNA, 15 nt, Salmonella enterica enterica serovar Typhi
uuaaauaacaaauga

SEQ ID NO: 1699252 - RNA, 17 nt, Salmonella enterica enterica serovar Typhi
uuaaaucaucauaauca

SEQ ID NO: 1699253 - RNA, 14 nt, Salmonella enterica enterica serovar Typhi
uuaaauaaacaaaa

SEQ ID NO: 1699254 - RNA, 17 nt, Salmonella enterica enterica serovar Typhi
uuaaaucgcgcaaauau

SEQ ID NO: 1699255 - RNA, 18 nt, Salmonella enterica enterica serovar Typhi
uuaaaucgcgcaaauauu

SEQ ID NO: 1699256 - RNA, 19 nt, Salmonella enterica enterica serovar Typhi
uuaaaucgcgcaaauauua

SEQ ID NO: 1699257 - RNA, 17 nt, Salmonella enterica enterica serovar Typhi
uuaaaucgcuaagcaga

SEQ ID NO: 1699258 - RNA, 17 nt, Salmonella enterica enterica serovar Typhi
uuaggcacuaccaccuc

SEQ ID NO: 1699259 - RNA, 18 nt, Salmonella enterica enterica serovar Typhi
uuagccuguuauucaauu

SEQ ID NO: 1699260 - RNA, 14 nt, Salmonella enterica enterica serovar Typhi
uuagcgcacaaaaa

SEQ ID NO: 1699261 - RNA, 17 nt, Salmonella enterica enterica serovar Typhi
uuagcgguacucuuuuu

SEQ ID NO: 1699262 - RNA, 18 nt, Salmonella enterica enterica serovar Typhi
uuagcuggccaaucagcg

SEQ ID NO: 1699263 - RNA, 21 nt, Salmonella enterica enterica serovar Typhi
uuagccaaacucugaaaaaau

SEQ ID NO: 1699264 - RNA, 19 nt, Salmonella enterica enterica serovar Typhi
uuagccaggugacuuugcc

SEQ ID NO: 1699265 - RNA, 20 nt, Salmonella enterica enterica serovar Typhi
uuagcaauugccauaaaaac

SEQ ID NO: 1699266 - RNA, 16 nt, Salmonella enterica enterica serovar Typhi
uuagcacagcucuaau

SEQ ID NO: 1699267 - RNA, 17 nt, Salmonella enterica enterica serovar Typhi
uuagcacagcucuaauu

SEQ ID NO: 1699268 - RNA, 19 nt, Salmonella enterica enterica serovar Typhi
uuagcagccacacacuguu

SEQ ID NO: 1699269 - RNA, 21 nt, Salmonella enterica enterica serovar Typhi
uuagcaacacagacuuugcac

SEQ ID NO: 1699270 - RNA, 14 nt, Salmonella enterica enterica serovar Typhi
uuagauuaaucacu

SEQ ID NO: 1699271 - RNA, 13 nt, Salmonella enterica enterica serovar Typhi
uuagacucagcga

SEQ ID NO: 1699272 - RNA, 15 nt, Salmonella enterica enterica serovar Typhi
uuacuucacguaauc

SEQ ID NO: 1699273 - RNA, 13 nt, Salmonella enterica enterica serovar Typhi
uuacgaaaagguc

SEQ ID NO: 1699274 - RNA, 15 nt, Salmonella enterica enterica serovar Typhi
uuaccuucugccgcg

SEQ ID NO: 1699275 - RNA, 17 nt, Salmonella enterica enterica serovar Typhi
uuauacgccuauuuucu

SEQ ID NO: 1699276 - RNA, 19 nt, Salmonella enterica enterica serovar Typhi
uuauaaaucaggaaaaagg

SEQ ID NO: 1699277 - RNA, 13 nt, Salmonella enterica enterica serovar Typhi
uuauaguccacuu

SEQ ID NO: 1699278 - RNA, 22 nt, Salmonella enterica enterica serovar Typhi
uuauauaaaaaaugguuuuauu

SEQ ID NO: 1699279 - RNA, 20 nt, Salmonella enterica enterica serovar Typhi
uuauacuugcugcuauguaa

SEQ ID NO: 1699280 - RNA, 12 nt, Salmonella enterica enterica serovar Typhi
uuauauaaaaau

SEQ ID NO: 1699281 - RNA, 24 nt, Salmonella enterica enterica serovar Typhi
uuaucacccugaauuucaauaauc

SEQ ID NO: 1699282 - RNA, 16 nt, Salmonella enterica enterica serovar Typhi
uuauauuuaaaauucc

SEQ ID NO: 1699283 - RNA, 19 nt, Salmonella enterica enterica serovar Typhi
uuauauuuaaaauuccaau

SEQ ID NO: 1699284 - RNA, 23 nt, Salmonella enterica enterica serovar Typhi
uuaguuucuauuaaaucagauaa

SEQ ID NO: 1699285 - RNA, 20 nt, Salmonella enterica enterica serovar Typhi
uuaguucaaguuuagaaaaa

SEQ ID NO: 1699286 - RNA, 21 nt, Salmonella enterica enterica serovar Typhi
uuaguuacgcacgccagauaa

SEQ ID NO: 1699287 - RNA, 15 nt, Salmonella enterica enterica serovar Typhi
uuagugcucagcuug

SEQ ID NO: 1699288 - RNA, 21 nt, Salmonella enterica enterica serovar Typhi
uuagucuccugccaaugaaau

SEQ ID NO: 1699289 - RNA, 18 nt, Salmonella enterica enterica serovar Typhi
uuaggguaucauuuccac

SEQ ID NO: 1699290 - RNA, 23 nt, Salmonella enterica enterica serovar Typhi
uuaggcggcuucacgccauccag

SEQ ID NO: 1699291 - RNA, 22 nt, Salmonella enterica enterica serovar Typhi
uuaguaccgaacagccaggcuu

SEQ ID NO: 1699292 - RNA, 21 nt, Salmonella enterica enterica serovar Typhi
uuaguacgcaaggaaauauua

SEQ ID NO: 1699293 - RNA, 22 nt, Salmonella enterica enterica serovar Typhi
ugcugguagagcaucgcggcau

SEQ ID NO: 1699294 - RNA, 16 nt, Salmonella enterica enterica serovar Typhi
ugcuggugaccgccuu

SEQ ID NO: 1699295 - RNA, 12 nt, Salmonella enterica enterica serovar Typhi
ugcuggccgcgu

SEQ ID NO: 1699296 - RNA, 21 nt, Salmonella enterica enterica serovar Typhi
ugcugguaccuuuguggcagg

SEQ ID NO: 1699297 - RNA, 16 nt, Salmonella enterica enterica serovar Typhi
ugcugucuuagugaaa

SEQ ID NO: 1699298 - RNA, 20 nt, Salmonella enterica enterica serovar Typhi
ugcugugacaucgccccggc

SEQ ID NO: 1699299 - RNA, 14 nt, Salmonella enterica enterica serovar Typhi
ugcugucuauuguc

SEQ ID NO: 1699300 - RNA, 17 nt, Salmonella enterica enterica serovar Typhi
ugcugucuauugucccg

SEQ ID NO: 1699301 - RNA, 14 nt, Salmonella enterica enterica serovar Typhi
ugcugugcauaaau

SEQ ID NO: 1699302 - RNA, 16 nt, Salmonella enterica enterica serovar Typhi
ugcugugccugccugu

SEQ ID NO: 1699303 - RNA, 13 nt, Salmonella enterica enterica serovar Typhi
ugcuggugguggg

SEQ ID NO: 1699304 - RNA, 14 nt, Salmonella enterica enterica serovar Typhi
ugcugguggugggc

SEQ ID NO: 1699305 - RNA, 16 nt, Salmonella enterica enterica serovar Typhi
ugcuguccgccagcaa

SEQ ID NO: 1699306 - RNA, 20 nt, Salmonella enterica enterica serovar Typhi
ugcuguccggcugcauauac

SEQ ID NO: 1699307 - RNA, 18 nt, Salmonella enterica enterica serovar Typhi
ugcugucgcccauugaaa

SEQ ID NO: 1699308 - RNA, 13 nt, Salmonella enterica enterica serovar Typhi
ugcugcgccagcc

SEQ ID NO: 1699309 - RNA, 20 nt, Salmonella enterica enterica serovar Typhi
ugcugaccuuaauccagcag

SEQ ID NO: 1699310 - RNA, 20 nt, Salmonella enterica enterica serovar Typhi
ugcugacaucucuuuuaauu

SEQ ID NO: 1699311 - RNA, 19 nt, Salmonella enterica enterica serovar Typhi
ugcugaauauuaucggcgu

SEQ ID NO: 1699312 - RNA, 21 nt, Salmonella enterica enterica serovar Typhi
ugcugacaaaauaaagugaaa

SEQ ID NO: 1699313 - RNA, 16 nt, Salmonella enterica enterica serovar Typhi
ugcugacaaucugcug

SEQ ID NO: 1699314 - RNA, 15 nt, Salmonella enterica enterica serovar Typhi
ugcugcucccucacg

SEQ ID NO: 1699315 - RNA, 22 nt, Salmonella enterica enterica serovar Typhi
ugcuggauucucucccaggcau

SEQ ID NO: 1699316 - RNA, 20 nt, Salmonella enterica enterica serovar Typhi
ugcuucguggcaaucagcaa

SEQ ID NO: 1699317 - RNA, 13 nt, Salmonella enterica enterica serovar Typhi
ugcuucucuucaa

SEQ ID NO: 1699318 - RNA, 23 nt, Salmonella enterica enterica serovar Typhi
ugcuucgccacgaccuacaccgu

SEQ ID NO: 1699319 - RNA, 15 nt, Salmonella enterica enterica serovar Typhi
ugcuucgauggccuc

SEQ ID NO: 1699320 - RNA, 16 nt, Salmonella enterica enterica serovar Typhi
ugcuuccaguagccua

SEQ ID NO: 1699321 - RNA, 20 nt, Salmonella enterica enterica serovar Typhi
ugcuuccgaccgcagcagag

SEQ ID NO: 1699322 - RNA, 19 nt, Salmonella enterica enterica serovar Typhi
ugcuuaccuuguucuucca

SEQ ID NO: 1699323 - RNA, 13 nt, Salmonella enterica enterica serovar Typhi
ugcuuaccagacc

SEQ ID NO: 1699324 - RNA, 13 nt, Salmonella enterica enterica serovar Typhi
ugcuuaacuucug

SEQ ID NO: 1699325 - RNA, 16 nt, Salmonella enterica enterica serovar Typhi
ugcuuucucgggccug

SEQ ID NO: 1699326 - RNA, 19 nt, Salmonella enterica enterica serovar Typhi
ugcuuucgcgauaaucaac

SEQ ID NO: 1699327 - RNA, 16 nt, Salmonella enterica enterica serovar Typhi
uggaaauaaagguuca

SEQ ID NO: 1699328 - RNA, 16 nt, Salmonella enterica enterica serovar Typhi
uggaaacuaugcaaaa

SEQ ID NO: 1699329 - RNA, 17 nt, Salmonella enterica enterica serovar Typhi
uggaaacuccagcggca

SEQ ID NO: 1699330 - RNA, 18 nt, Salmonella enterica enterica serovar Typhi
uggaaaccgcagaagguc

SEQ ID NO: 1699331 - RNA, 23 nt, Salmonella enterica enterica serovar Typhi
ugcuuuuuuuauuugugauaaag

SEQ ID NO: 1699332 - RNA, 16 nt, Salmonella enterica enterica serovar Typhi
ugcuuuuuauuuuucu

SEQ ID NO: 1699333 - RNA, 22 nt, Salmonella enterica enterica serovar Typhi
ugcuuuuugauacagcagcacc

SEQ ID NO: 1699334 - RNA, 23 nt, Salmonella enterica enterica serovar Typhi
uggaacagauguuuacgcugcuc

SEQ ID NO: 1699335 - RNA, 19 nt, Salmonella enterica enterica serovar Typhi
uggaacauccucuccugaa

SEQ ID NO: 1699336 - RNA, 15 nt, Salmonella enterica enterica serovar Typhi
uggaacgcauccagc

SEQ ID NO: 1699337 - RNA, 14 nt, Salmonella enterica enterica serovar Typhi
uggaagaaaauaua

SEQ ID NO: 1699338 - RNA, 14 nt, Salmonella enterica enterica serovar Typhi
uggaagcuguuaau

SEQ ID NO: 1699339 - RNA, 14 nt, Salmonella enterica enterica serovar Typhi
uggaauaaauauaa

SEQ ID NO: 1699340 - RNA, 22 nt, Salmonella enterica enterica serovar Typhi
uggaaucaauuucccuucaauc

SEQ ID NO: 1699341 - RNA, 16 nt, Salmonella enterica enterica serovar Typhi
uggaaucauccaccag

SEQ ID NO: 1699342 - RNA, 13 nt, Salmonella enterica enterica serovar Typhi
uggaauucuucau

SEQ ID NO: 1699343 - RNA, 24 nt, Salmonella enterica enterica serovar Typhi
uggaauuugucgucaugcgccagg

SEQ ID NO: 1699344 - RNA, 12 nt, Salmonella enterica enterica serovar Typhi
uggaauuuugca

SEQ ID NO: 1699345 - RNA, 14 nt, Salmonella enterica enterica serovar Typhi
uggaaugagcaucu

SEQ ID NO: 1699346 - RNA, 15 nt, Salmonella enterica enterica serovar Typhi
uggacagauuuccac

SEQ ID NO: 1699347 - RNA, 24 nt, Salmonella enterica enterica serovar Typhi
uggacauguccgacgacaagcaga

SEQ ID NO: 1699348 - RNA, 20 nt, Salmonella enterica enterica serovar Typhi
ugcuccccaaccgccagcca

SEQ ID NO: 1699349 - RNA, 14 nt, Salmonella enterica enterica serovar Typhi
ugcuccaugcuguc

SEQ ID NO: 1699350 - RNA, 16 nt, Salmonella enterica enterica serovar Typhi
ugcuccaguuguucca

SEQ ID NO: 1699351 - RNA, 17 nt, Salmonella enterica enterica serovar Typhi
ugcuccaugacguucaa

SEQ ID NO: 1699352 - RNA, 12 nt, Salmonella enterica enterica serovar Typhi
ugcuccaugauc

SEQ ID NO: 1699353 - RNA, 21 nt, Salmonella enterica enterica serovar Typhi
ugcucgcuaugaaaacgcagc

SEQ ID NO: 1699354 - RNA, 21 nt, Salmonella enterica enterica serovar Typhi
ugcucagggcauccgccgccg

SEQ ID NO: 1699355 - RNA, 13 nt, Salmonella enterica enterica serovar Typhi
ugcucaggcaaca

SEQ ID NO: 1699356 - RNA, 18 nt, Salmonella enterica enterica serovar Typhi
ugcucagccaaacuccuc

SEQ ID NO: 1699357 - RNA, 19 nt, Salmonella enterica enterica serovar Typhi
ugcucagcuuguagaaagg

SEQ ID NO: 1699358 - RNA, 17 nt, Salmonella enterica enterica serovar Typhi
ugcucuaccaacugagc

SEQ ID NO: 1699359 - RNA, 17 nt, Salmonella enterica enterica serovar Typhi
ugcucucccagcugagc

SEQ ID NO: 1699360 - RNA, 19 nt, Salmonella enterica enterica serovar Typhi
ugcucucccagcugagcua

SEQ ID NO: 1699361 - RNA, 23 nt, Salmonella enterica enterica serovar Typhi
ugcucucccagcugagcuaauca

SEQ ID NO: 1699362 - RNA, 13 nt, Salmonella enterica enterica serovar Typhi
ugcucuuuaacaa

SEQ ID NO: 1699363 - RNA, 12 nt, Salmonella enterica enterica serovar Typhi
ugcuacgcgcca

SEQ ID NO: 1699364 - RNA, 23 nt, Salmonella enterica enterica serovar Typhi
ugcuacgaaccugauuguuuuac

SEQ ID NO: 1699365 - RNA, 20 nt, Salmonella enterica enterica serovar Typhi
ugcuacgggcgcugucgccg

SEQ ID NO: 1699366 - RNA, 22 nt, Salmonella enterica enterica serovar Typhi
ugcuacaggcaaguuuaauucc

SEQ ID NO: 1699367 - RNA, 16 nt, Salmonella enterica enterica serovar Typhi
ugcuaaaagaagcugu

SEQ ID NO: 1699368 - RNA, 13 nt, Salmonella enterica enterica serovar Typhi
ugcuaaaagaagc

SEQ ID NO: 1699369 - RNA, 14 nt, Salmonella enterica enterica serovar Typhi
ugcuaacagugaaa

SEQ ID NO: 1699370 - RNA, 23 nt, Salmonella enterica enterica serovar Typhi
ugcuauaugcaggcauaaaaaag

SEQ ID NO: 1699371 - RNA, 21 nt, Salmonella enterica enterica serovar Typhi
ugcuauaugcaggcauaaaaa

SEQ ID NO: 1699372 - RNA, 15 nt, Salmonella enterica enterica serovar Typhi
ugcuauccgccgcca

SEQ ID NO: 1699373 - RNA, 19 nt, Salmonella enterica enterica serovar Typhi
ugcuaucaaacugaaaauc

SEQ ID NO: 1699374 - RNA, 22 nt, Salmonella enterica enterica serovar Typhi
ugcuagaacauuucccgaaaaa

SEQ ID NO: 1699375 - RNA, 14 nt, Salmonella enterica enterica serovar Typhi
ugcuauucagcagu

SEQ ID NO: 1699376 - RNA, 17 nt, Salmonella enterica enterica serovar Typhi
ugcucaaccaugauaac

SEQ ID NO: 1699377 - RNA, 23 nt, Salmonella enterica enterica serovar Typhi
ugcucacccauuuuauccucuuc

SEQ ID NO: 1699378 - RNA, 18 nt, Salmonella enterica enterica serovar Typhi
ugcggcaauggcucaggc

SEQ ID NO: 1699379 - RNA, 19 nt, Salmonella enterica enterica serovar Typhi
ugcggcacacagccaaaau

SEQ ID NO: 1699380 - RNA, 21 nt, Salmonella enterica enterica serovar Typhi
ugcggcaauggccgcagcgcc

SEQ ID NO: 1699381 - RNA, 17 nt, Salmonella enterica enterica serovar Typhi
ugcgcuucgaugcguuc

SEQ ID NO: 1699382 - RNA, 22 nt, Salmonella enterica enterica serovar Typhi
ugcgcuucgaugcguucaaaaa

SEQ ID NO: 1699383 - RNA, 20 nt, Salmonella enterica enterica serovar Typhi
ugcggcuauauaaaaucggg

SEQ ID NO: 1699384 - RNA, 16 nt, Salmonella enterica enterica serovar Typhi
ugcggcuucagcgaca

SEQ ID NO: 1699385 - RNA, 15 nt, Salmonella enterica enterica serovar Typhi
ugcggcuuacccuga

SEQ ID NO: 1699386 - RNA, 16 nt, Salmonella enterica enterica serovar Typhi
ugcggcggccucuuug

SEQ ID NO: 1699387 - RNA, 18 nt, Salmonella enterica enterica serovar Typhi
ugcggcguguuguaaaac

SEQ ID NO: 1699388 - RNA, 23 nt, Salmonella enterica enterica serovar Typhi
ugcggcggggauaaucagcagcg

SEQ ID NO: 1699389 - RNA, 18 nt, Salmonella enterica enterica serovar Typhi
ugcgcucaugcgccuggc

SEQ ID NO: 1699390 - RNA, 15 nt, Salmonella enterica enterica serovar Typhi
ugcgcuccugcuccc

SEQ ID NO: 1699391 - RNA, 14 nt, Salmonella enterica enterica serovar Typhi
ugcgccacaucauu

SEQ ID NO: 1699392 - RNA, 16 nt, Salmonella enterica enterica serovar Typhi
ugcgcaucaccguuac

SEQ ID NO: 1699393 - RNA, 14 nt, Salmonella enterica enterica serovar Typhi
ugcgccaaaucggu

SEQ ID NO: 1699394 - RNA, 15 nt, Salmonella enterica enterica serovar Typhi
ugcgcugucaccagc

SEQ ID NO: 1699395 - RNA, 16 nt, Salmonella enterica enterica serovar Typhi
ugcgcuuaccgggccu

SEQ ID NO: 1699396 - RNA, 18 nt, Salmonella enterica enterica serovar Typhi
ugcgcugguuggcgcgcu

SEQ ID NO: 1699397 - RNA, 17 nt, Salmonella enterica enterica serovar Typhi
ugcgcugcggccagacc

SEQ ID NO: 1699398 - RNA, 14 nt, Salmonella enterica enterica serovar Typhi
ugcgcuggacuggg

SEQ ID NO: 1699399 - RNA, 16 nt, Salmonella enterica enterica serovar Typhi
ugcgggacgcaucauc

SEQ ID NO: 1699400 - RNA, 23 nt, Salmonella enterica enterica serovar Typhi
ugcgggaaauaccauccgcgccg

SEQ ID NO: 1699401 - RNA, 15 nt, Salmonella enterica enterica serovar Typhi
ugcggcuuucaucau

SEQ ID NO: 1699402 - RNA, 20 nt, Salmonella enterica enterica serovar Typhi
ugcggguguccguuccugcc

SEQ ID NO: 1699403 - RNA, 22 nt, Salmonella enterica enterica serovar Typhi
ugcguaccgcuaucgccaaacu

SEQ ID NO: 1699404 - RNA, 14 nt, Salmonella enterica enterica serovar Typhi
ugcguacucagcag

SEQ ID NO: 1699405 - RNA, 14 nt, Salmonella enterica enterica serovar Typhi
ugcgguagcgccga

SEQ ID NO: 1699406 - RNA, 17 nt, Salmonella enterica enterica serovar Typhi
ugcggucaaaagcugca

SEQ ID NO: 1699407 - RNA, 18 nt, Salmonella enterica enterica serovar Typhi
ugcgucggcaccauuccc

SEQ ID NO: 1699408 - RNA, 23 nt, Salmonella enterica enterica serovar Typhi
ugcguuaacccgcuuacaauuua

SEQ ID NO: 1699409 - RNA, 20 nt, Salmonella enterica enterica serovar Typhi
ugcguucaggcggcaaaaaa

SEQ ID NO: 1699410 - RNA, 16 nt, Salmonella enterica enterica serovar Typhi
ugcguucauggcgcga

SEQ ID NO: 1699411 - RNA, 18 nt, Salmonella enterica enterica serovar Typhi
ugcgucaugcuuuuuuuc

SEQ ID NO: 1699412 - RNA, 16 nt, Salmonella enterica enterica serovar Typhi
ugcgucagcgcccgau

SEQ ID NO: 1699413 - RNA, 15 nt, Salmonella enterica enterica serovar Typhi
ugcguaucgcccacc

SEQ ID NO: 1699414 - RNA, 16 nt, Salmonella enterica enterica serovar Typhi
ugcguaucgcccaccg

SEQ ID NO: 1699415 - RNA, 22 nt, Salmonella enterica enterica serovar Typhi
ugccagaaacaacgcgggccau

SEQ ID NO: 1699416 - RNA, 14 nt, Salmonella enterica enterica serovar Typhi
ugccagaagagaau

SEQ ID NO: 1699417 - RNA, 20 nt, Salmonella enterica enterica serovar Typhi
ugccacuggguuucccauug

SEQ ID NO: 1699418 - RNA, 21 nt, Salmonella enterica enterica serovar Typhi
ugccacuguucagaaaucggc

SEQ ID NO: 1699419 - RNA, 13 nt, Salmonella enterica enterica serovar Typhi
ugccacuccgcca

SEQ ID NO: 1699420 - RNA, 19 nt, Salmonella enterica enterica serovar Typhi
ugccacuauagaugaugga

SEQ ID NO: 1699421 - RNA, 13 nt, Salmonella enterica enterica serovar Typhi
ugccacaggccaa

SEQ ID NO: 1699422 - RNA, 15 nt, Salmonella enterica enterica serovar Typhi
ugccacagccucagc

SEQ ID NO: 1699423 - RNA, 18 nt, Salmonella enterica enterica serovar Typhi
ugccaaguaauaaagaga

SEQ ID NO: 1699424 - RNA, 15 nt, Salmonella enterica enterica serovar Typhi
ugcagguaacgacua

SEQ ID NO: 1699425 - RNA, 15 nt, Salmonella enterica enterica serovar Typhi
ugcagggugcagcaa

SEQ ID NO: 1699426 - RNA, 14 nt, Salmonella enterica enterica serovar Typhi
ugcaguacaggcau

SEQ ID NO: 1699427 - RNA, 14 nt, Salmonella enterica enterica serovar Typhi
ugcagguucccgcc

SEQ ID NO: 1699428 - RNA, 21 nt, Salmonella enterica enterica serovar Typhi
ugccaagcguaguacguucca

SEQ ID NO: 1699429 - RNA, 18 nt, Salmonella enterica enterica serovar Typhi
ugcagucugguaacgcaa

SEQ ID NO: 1699430 - RNA, 19 nt, Salmonella enterica enterica serovar Typhi
ugcagucgcggaauaauca

SEQ ID NO: 1699431 - RNA, 19 nt, Salmonella enterica enterica serovar Typhi
ugccauaaucgauauaauu

SEQ ID NO: 1699432 - RNA, 15 nt, Salmonella enterica enterica serovar Typhi
ugccauaaaaugcug

SEQ ID NO: 1699433 - RNA, 20 nt, Salmonella enterica enterica serovar Typhi
ugccauaaagcggacugccu

SEQ ID NO: 1699434 - RNA, 16 nt, Salmonella enterica enterica serovar Typhi
ugccaguuucucaaag

SEQ ID NO: 1699435 - RNA, 14 nt, Salmonella enterica enterica serovar Typhi
ugccaguuaaugcc

SEQ ID NO: 1699436 - RNA, 17 nt, Salmonella enterica enterica serovar Typhi
ugccaguucauuccgcc

SEQ ID NO: 1699437 - RNA, 23 nt, Salmonella enterica enterica serovar Typhi
ugccaguaguugaauaaccucaa

SEQ ID NO: 1699438 - RNA, 13 nt, Salmonella enterica enterica serovar Typhi
ugccauauucaac

SEQ ID NO: 1699439 - RNA, 17 nt, Salmonella enterica enterica serovar Typhi
ugcccaauagcgcugag

SEQ ID NO: 1699440 - RNA, 15 nt, Salmonella enterica enterica serovar Typhi
ugcccacccgggccg

SEQ ID NO: 1699441 - RNA, 15 nt, Salmonella enterica enterica serovar Typhi
ugcccaccugaaaaa

SEQ ID NO: 1699442 - RNA, 20 nt, Salmonella enterica enterica serovar Typhi
ugcccaccggcccacgcagu

SEQ ID NO: 1699443 - RNA, 14 nt, Salmonella enterica enterica serovar Typhi
ugccagcaccagca

SEQ ID NO: 1699444 - RNA, 12 nt, Salmonella enterica enterica serovar Typhi
ugccagcaccag

SEQ ID NO: 1699445 - RNA, 14 nt, Salmonella enterica enterica serovar Typhi
ugccagcauuaacc

SEQ ID NO: 1699446 - RNA, 13 nt, Salmonella enterica enterica serovar Typhi
ugccagccauagc

SEQ ID NO: 1699447 - RNA, 14 nt, Salmonella enterica enterica serovar Typhi
ugccagcgucgcug

SEQ ID NO: 1699448 - RNA, 20 nt, Salmonella enterica enterica serovar Typhi
ugccagcuuaaaucgcggcg

SEQ ID NO: 1699449 - RNA, 23 nt, Salmonella enterica enterica serovar Typhi
ugccaggaagucagcuuccugca

SEQ ID NO: 1699450 - RNA, 18 nt, Salmonella enterica enterica serovar Typhi
ugccaggaagucagcuuc

SEQ ID NO: 1699451 - RNA, 23 nt, Salmonella enterica enterica serovar Typhi
ugccaguagcggaauaucuuccc

SEQ ID NO: 1699452 - RNA, 23 nt, Salmonella enterica enterica serovar Typhi
ugccagucaauaagcuugcuuuc

SEQ ID NO: 1699453 - RNA, 19 nt, Salmonella enterica enterica serovar Typhi
ugcccaucgcgccaugauu

SEQ ID NO: 1699454 - RNA, 14 nt, Salmonella enterica enterica serovar Typhi
ugcccaugaagcga

SEQ ID NO: 1699455 - RNA, 18 nt, Salmonella enterica enterica serovar Typhi
ugcccaguuuacccagcg

SEQ ID NO: 1699456 - RNA, 23 nt, Salmonella enterica enterica serovar Typhi
ugcccaguuuacccagcgaaugc

SEQ ID NO: 1699457 - RNA, 14 nt, Salmonella enterica enterica serovar Typhi
ugcccagccuucuc

SEQ ID NO: 1699458 - RNA, 13 nt, Salmonella enterica enterica serovar Typhi
ugcccaguuuacc

SEQ ID NO: 1699459 - RNA, 15 nt, Salmonella enterica enterica serovar Typhi
ugcccagcgccguca

SEQ ID NO: 1699460 - RNA, 18 nt, Salmonella enterica enterica serovar Typhi
ugcccauucuucgucguc

SEQ ID NO: 1699461 - RNA, 21 nt, Salmonella enterica enterica serovar Typhi
ugccccugaccgaagguuacc

SEQ ID NO: 1699462 - RNA, 15 nt, Salmonella enterica enterica serovar Typhi
ugccccucccugaau

SEQ ID NO: 1699463 - RNA, 13 nt, Salmonella enterica enterica serovar Typhi
ugcccgccagcgg

SEQ ID NO: 1699464 - RNA, 14 nt, Salmonella enterica enterica serovar Typhi
ugcccgccagcggg

SEQ ID NO: 1699465 - RNA, 17 nt, Salmonella enterica enterica serovar Typhi
ugcccgccagcgggccg

SEQ ID NO: 1699466 - RNA, 15 nt, Salmonella enterica enterica serovar Typhi
ugcccgccgccggcc

SEQ ID NO: 1699467 - RNA, 19 nt, Salmonella enterica enterica serovar Typhi
ugcccuucgaccgucagca

SEQ ID NO: 1699468 - RNA, 20 nt, Salmonella enterica enterica serovar Typhi
ugcccuuaucuggaugagga

SEQ ID NO: 1699469 - RNA, 21 nt, Salmonella enterica enterica serovar Typhi
ugcccuuaucuggaugaggac

SEQ ID NO: 1699470 - RNA, 21 nt, Salmonella enterica enterica serovar Typhi
ugcccgguuaaggggcaggcg

SEQ ID NO: 1699471 - RNA, 17 nt, Salmonella enterica enterica serovar Typhi
ugcccggggugaacaaa

SEQ ID NO: 1699472 - RNA, 16 nt, Salmonella enterica enterica serovar Typhi
ugcccgguuuuuuaau

SEQ ID NO: 1699473 - RNA, 23 nt, Salmonella enterica enterica serovar Typhi
ugcccggcgcguuuuggcagaca

SEQ ID NO: 1699474 - RNA, 18 nt, Salmonella enterica enterica serovar Typhi
ugcccgccguuaaaucau

SEQ ID NO: 1699475 - RNA, 19 nt, Salmonella enterica enterica serovar Typhi
ugcccggcgcggcaucauc

SEQ ID NO: 1699476 - RNA, 16 nt, Salmonella enterica enterica serovar Typhi
ugccgauggcuauuac

SEQ ID NO: 1699477 - RNA, 16 nt, Salmonella enterica enterica serovar Typhi
ugccgaugccgccgca

SEQ ID NO: 1699478 - RNA, 14 nt, Salmonella enterica enterica serovar Typhi
ugccgagcaacaga

SEQ ID NO: 1699479 - RNA, 21 nt, Salmonella enterica enterica serovar Typhi
ugccgagcaacagaaaccaua

SEQ ID NO: 1699480 - RNA, 22 nt, Salmonella enterica enterica serovar Typhi
ugccgauuccaugcccaguuca

SEQ ID NO: 1699481 - RNA, 20 nt, Salmonella enterica enterica serovar Typhi
ugccgcaaacgccugcuccg

SEQ ID NO: 1699482 - RNA, 17 nt, Salmonella enterica enterica serovar Typhi
ugccgacagaacugauu

SEQ ID NO: 1699483 - RNA, 20 nt, Salmonella enterica enterica serovar Typhi
ugcgcaguuuaaaucacagg

SEQ ID NO: 1699484 - RNA, 21 nt, Salmonella enterica enterica serovar Typhi
ugcgcagccccagcgccagcc

SEQ ID NO: 1699485 - RNA, 20 nt, Salmonella enterica enterica serovar Typhi
ugcgcagccccagcgccagc

SEQ ID NO: 1699486 - RNA, 17 nt, Salmonella enterica enterica serovar Typhi
ugcgcagcguuuccaga

SEQ ID NO: 1699487 - RNA, 14 nt, Salmonella enterica enterica serovar Typhi
ugcgauggccgcug

SEQ ID NO: 1699488 - RNA, 19 nt, Salmonella enterica enterica serovar Typhi
ugcgaugagauccgggcug

SEQ ID NO: 1699489 - RNA, 22 nt, Salmonella enterica enterica serovar Typhi
ugcgauaaugaagcauaaaaag

SEQ ID NO: 1699490 - RNA, 23 nt, Salmonella enterica enterica serovar Typhi
ugcgauaaugguugaacaggcug

SEQ ID NO: 1699491 - RNA, 14 nt, Salmonella enterica enterica serovar Typhi
ugcgcaagaaacau

SEQ ID NO: 1699492 - RNA, 18 nt, Salmonella enterica enterica serovar Typhi
ugcgcaacguuucuuuca

SEQ ID NO: 1699493 - RNA, 18 nt, Salmonella enterica enterica serovar Typhi
ugcgaauaacaucauccg

SEQ ID NO: 1699494 - RNA, 15 nt, Salmonella enterica enterica serovar Typhi
ugcgaauaaacacau

SEQ ID NO: 1699495 - RNA, 16 nt, Salmonella enterica enterica serovar Typhi
ugcgaauaaacacaua

SEQ ID NO: 1699496 - RNA, 19 nt, Salmonella enterica enterica serovar Typhi
ugcgacacgcugcauauaa

SEQ ID NO: 1699497 - RNA, 21 nt, Salmonella enterica enterica serovar Typhi
ugcgaacgauaccauccccuu

SEQ ID NO: 1699498 - RNA, 14 nt, Salmonella enterica enterica serovar Typhi
ugcgaaagccucuu

SEQ ID NO: 1699499 - RNA, 19 nt, Salmonella enterica enterica serovar Typhi
ugcgaaagccucuuccgcc

SEQ ID NO: 1699500 - RNA, 12 nt, Salmonella enterica enterica serovar Typhi
ugcgaaacgucc

SEQ ID NO: 1699501 - RNA, 20 nt, Salmonella enterica enterica serovar Typhi
ugccuuuuuuaauuccggag

SEQ ID NO: 1699502 - RNA, 19 nt, Salmonella enterica enterica serovar Typhi
ugccuuuuucccacugcgc

SEQ ID NO: 1699503 - RNA, 18 nt, Salmonella enterica enterica serovar Typhi
ugccuuuuugcagcgcgg

SEQ ID NO: 1699504 - RNA, 11 nt, Salmonella enterica enterica serovar Typhi
ugcgagaaaaa

SEQ ID NO: 1699505 - RNA, 13 nt, Salmonella enterica enterica serovar Typhi
ugcgacgccagau

SEQ ID NO: 1699506 - RNA, 14 nt, Salmonella enterica enterica serovar Typhi
ugcgacgccaggcg

SEQ ID NO: 1699507 - RNA, 20 nt, Salmonella enterica enterica serovar Typhi
ugcgacgccaggcgccacga

SEQ ID NO: 1699508 - RNA, 15 nt, Salmonella enterica enterica serovar Typhi
ugcgacaucagccag

SEQ ID NO: 1699509 - RNA, 18 nt, Salmonella enterica enterica serovar Typhi
ugcgacugaaaaucaaaa

SEQ ID NO: 1699510 - RNA, 21 nt, Salmonella enterica enterica serovar Typhi
ugcgacucggugccgcugcug

SEQ ID NO: 1699511 - RNA, 12 nt, Salmonella enterica enterica serovar Typhi
ugcgagaccauc

SEQ ID NO: 1699512 - RNA, 15 nt, Salmonella enterica enterica serovar Typhi
ugcgaggggccaaaa

SEQ ID NO: 1699513 - RNA, 16 nt, Salmonella enterica enterica serovar Typhi
ugcgaggggccaaaac

SEQ ID NO: 1699514 - RNA, 17 nt, Salmonella enterica enterica serovar Typhi
ugcgaggucaccgggcg

SEQ ID NO: 1699515 - RNA, 23 nt, Salmonella enterica enterica serovar Typhi
ugcgaggcgcgcucauuuuauug

SEQ ID NO: 1699516 - RNA, 18 nt, Salmonella enterica enterica serovar Typhi
ugcgagucgucaguucca

SEQ ID NO: 1699517 - RNA, 20 nt, Salmonella enterica enterica serovar Typhi
ugccgucgaugucgccgccg

SEQ ID NO: 1699518 - RNA, 20 nt, Salmonella enterica enterica serovar Typhi
ugccgucaaacaagccgcca

SEQ ID NO: 1699519 - RNA, 23 nt, Salmonella enterica enterica serovar Typhi
ugccgggacuuuaaacgucaugc

SEQ ID NO: 1699520 - RNA, 21 nt, Salmonella enterica enterica serovar Typhi
ugccguagaaaaugcgcuggg

SEQ ID NO: 1699521 - RNA, 17 nt, Salmonella enterica enterica serovar Typhi
ugccguagaacagcaug

SEQ ID NO: 1699522 - RNA, 16 nt, Salmonella enterica enterica serovar Typhi
ugccggauggcggcuu

SEQ ID NO: 1699523 - RNA, 23 nt, Salmonella enterica enterica serovar Typhi
ugccggauggcgguauaacugcc

SEQ ID NO: 1699524 - RNA, 13 nt, Salmonella enterica enterica serovar Typhi
ugccgggaaaacg

SEQ ID NO: 1699525 - RNA, 16 nt, Salmonella enterica enterica serovar Typhi
ugccgggaaaacggcc

SEQ ID NO: 1699526 - RNA, 16 nt, Salmonella enterica enterica serovar Typhi
ugccgcccaggccaug

SEQ ID NO: 1699527 - RNA, 19 nt, Salmonella enterica enterica serovar Typhi
ugccgccgcgaugcaucuu

SEQ ID NO: 1699528 - RNA, 22 nt, Salmonella enterica enterica serovar Typhi
ugccgccacgccgcuccacagc

SEQ ID NO: 1699529 - RNA, 21 nt, Salmonella enterica enterica serovar Typhi
ugccgccauaacgccggcgcu

SEQ ID NO: 1699530 - RNA, 20 nt, Salmonella enterica enterica serovar Typhi
ugccgccaucucacgcaugg

SEQ ID NO: 1699531 - RNA, 23 nt, Salmonella enterica enterica serovar Typhi
ugccgccaucagcgucagcagag

SEQ ID NO: 1699532 - RNA, 20 nt, Salmonella enterica enterica serovar Typhi
ugccgccauucgcuuccgcc

SEQ ID NO: 1699533 - RNA, 20 nt, Salmonella enterica enterica serovar Typhi
ugccggaucaggcguugugc

SEQ ID NO: 1699534 - RNA, 13 nt, Salmonella enterica enterica serovar Typhi
ugccggauggcac

SEQ ID NO: 1699535 - RNA, 14 nt, Salmonella enterica enterica serovar Typhi
ugccggacgcggcu

SEQ ID NO: 1699536 - RNA, 12 nt, Salmonella enterica enterica serovar Typhi
ugccuuucagau

SEQ ID NO: 1699537 - RNA, 22 nt, Salmonella enterica enterica serovar Typhi
ugccuugugucacauuuucuug

SEQ ID NO: 1699538 - RNA, 15 nt, Salmonella enterica enterica serovar Typhi
ugccugcgccauguu

SEQ ID NO: 1699539 - RNA, 15 nt, Salmonella enterica enterica serovar Typhi
ugccuucaaauauau

SEQ ID NO: 1699540 - RNA, 16 nt, Salmonella enterica enterica serovar Typhi
ugccucacccugaaau

SEQ ID NO: 1699541 - RNA, 23 nt, Salmonella enterica enterica serovar Typhi
ugccugaaggcgcuaugcuuacc

SEQ ID NO: 1699542 - RNA, 15 nt, Salmonella enterica enterica serovar Typhi
ugccugccgccucca

SEQ ID NO: 1699543 - RNA, 19 nt, Salmonella enterica enterica serovar Typhi
ugccgucgcggcuuucagc

SEQ ID NO: 1699544 - RNA, 21 nt, Salmonella enterica enterica serovar Typhi
ugccgucggcaauuaacauuu

SEQ ID NO: 1699545 - RNA, 16 nt, Salmonella enterica enterica serovar Typhi
ugccgugaaaacgaau

SEQ ID NO: 1699546 - RNA, 19 nt, Salmonella enterica enterica serovar Typhi
ugccucaacaaguccuucu

SEQ ID NO: 1699547 - RNA, 16 nt, Salmonella enterica enterica serovar Typhi
ugccgugaggcugaag

SEQ ID NO: 1699548 - RNA, 14 nt, Salmonella enterica enterica serovar Typhi
ugccuacgcggcca

SEQ ID NO: 1699549 - RNA, 12 nt, Salmonella enterica enterica serovar Typhi
ugccuaccgggc

SEQ ID NO: 1699550 - RNA, 22 nt, Salmonella enterica enterica serovar Typhi
ugaaucuggucggugauauauu

SEQ ID NO: 1699551 - RNA, 24 nt, Salmonella enterica enterica serovar Typhi
ugaaucuggucggugauauauuca

SEQ ID NO: 1699552 - RNA, 21 nt, Salmonella enterica enterica serovar Typhi
ugaaucucagauaauagcugc

SEQ ID NO: 1699553 - RNA, 21 nt, Salmonella enterica enterica serovar Typhi
ugaaucgccgucagugagccc

SEQ ID NO: 1699554 - RNA, 18 nt, Salmonella enterica enterica serovar Typhi
ugaaucggcaccuggagc

SEQ ID NO: 1699555 - RNA, 15 nt, Salmonella enterica enterica serovar Typhi
ugaaucgccgucagu

SEQ ID NO: 1699556 - RNA, 17 nt, Salmonella enterica enterica serovar Typhi
ugaauauucaauggguu

SEQ ID NO: 1699557 - RNA, 22 nt, Salmonella enterica enterica serovar Typhi
ugaauaucgagcggcaguagca

SEQ ID NO: 1699558 - RNA, 16 nt, Salmonella enterica enterica serovar Typhi
ugaauauccgccgccc

SEQ ID NO: 1699559 - RNA, 20 nt, Salmonella enterica enterica serovar Typhi
ugaauaugaucugcacaaca

SEQ ID NO: 1699560 - RNA, 12 nt, Salmonella enterica enterica serovar Typhi
ugaauacacaaa

SEQ ID NO: 1699561 - RNA, 18 nt, Salmonella enterica enterica serovar Typhi
ugaauaccaagucucagg

SEQ ID NO: 1699562 - RNA, 17 nt, Salmonella enterica enterica serovar Typhi
ugaauaccacaaauuuu

SEQ ID NO: 1699563 - RNA, 17 nt, Salmonella enterica enterica serovar Typhi
ugaauaaugguaaauuu

SEQ ID NO: 1699564 - RNA, 14 nt, Salmonella enterica enterica serovar Typhi
ugaauucguuaccu

SEQ ID NO: 1699565 - RNA, 17 nt, Salmonella enterica enterica serovar Typhi
ugaauuauuuuuucaug

SEQ ID NO: 1699566 - RNA, 18 nt, Salmonella enterica enterica serovar Typhi
ugaaugagucggaccauc

SEQ ID NO: 1699567 - RNA, 22 nt, Salmonella enterica enterica serovar Typhi
ugaauugcgguuuauccccgcu

SEQ ID NO: 1699568 - RNA, 18 nt, Salmonella enterica enterica serovar Typhi
ugaauugccauuguucgc

SEQ ID NO: 1699569 - RNA, 11 nt, Salmonella enterica enterica serovar Typhi
ugacaauaagu

SEQ ID NO: 1699570 - RNA, 14 nt, Salmonella enterica enterica serovar Typhi
ugacaacaaaaaga

SEQ ID NO: 1699571 - RNA, 11 nt, Salmonella enterica enterica serovar Typhi
ugacacagcgu

SEQ ID NO: 1699572 - RNA, 16 nt, Salmonella enterica enterica serovar Typhi
ugacaaaaauuaaaac

SEQ ID NO: 1699573 - RNA, 20 nt, Salmonella enterica enterica serovar Typhi
ugacaaauuguuuaaaaaca

SEQ ID NO: 1699574 - RNA, 13 nt, Salmonella enterica enterica serovar Typhi
ugacauauacaaa

SEQ ID NO: 1699575 - RNA, 18 nt, Salmonella enterica enterica serovar Typhi
ugaccauauaugaaaucg

SEQ ID NO: 1699576 - RNA, 18 nt, Salmonella enterica enterica serovar Typhi
ugaccaccagcgcgaccg

SEQ ID NO: 1699577 - RNA, 13 nt, Salmonella enterica enterica serovar Typhi
ugaccaccgcauc

SEQ ID NO: 1699578 - RNA, 15 nt, Salmonella enterica enterica serovar Typhi
ugaccacauuuucuc

SEQ ID NO: 1699579 - RNA, 14 nt, Salmonella enterica enterica serovar Typhi
ugacacggaacaac

SEQ ID NO: 1699580 - RNA, 20 nt, Salmonella enterica enterica serovar Typhi
ugacacggaacaacggcaca

SEQ ID NO: 1699581 - RNA, 16 nt, Salmonella enterica enterica serovar Typhi
ugacacucauccagac

SEQ ID NO: 1699582 - RNA, 14 nt, Salmonella enterica enterica serovar Typhi
ugacacugauauac

SEQ ID NO: 1699583 - RNA, 13 nt, Salmonella enterica enterica serovar Typhi
ugacacucaucca

SEQ ID NO: 1699584 - RNA, 21 nt, Salmonella enterica enterica serovar Typhi
ugacacuauauugcgaauaaa

SEQ ID NO: 1699585 - RNA, 19 nt, Salmonella enterica enterica serovar Typhi
ugacagccaaacugcugua

SEQ ID NO: 1699586 - RNA, 19 nt, Salmonella enterica enterica serovar Typhi
ugacagcacaauuccggcc

SEQ ID NO: 1699587 - RNA, 17 nt, Salmonella enterica enterica serovar Typhi
ugaccucaauccgugcc

SEQ ID NO: 1699588 - RNA, 23 nt, Salmonella enterica enterica serovar Typhi
ugacgagcagguuacucuuccac

SEQ ID NO: 1699589 - RNA, 19 nt, Salmonella enterica enterica serovar Typhi
ugacgaucaugccgcccag

SEQ ID NO: 1699590 - RNA, 16 nt, Salmonella enterica enterica serovar Typhi
ugacgagggaagggga

SEQ ID NO: 1699591 - RNA, 16 nt, Salmonella enterica enterica serovar Typhi
ugacgagucggaucau

SEQ ID NO: 1699592 - RNA, 19 nt, Salmonella enterica enterica serovar Typhi
ugacgauacgucauaucau

SEQ ID NO: 1699593 - RNA, 14 nt, Salmonella enterica enterica serovar Typhi
ugacgaucaugccg

SEQ ID NO: 1699594 - RNA, 13 nt, Salmonella enterica enterica serovar Typhi
ugacccagacaaa

SEQ ID NO: 1699595 - RNA, 19 nt, Salmonella enterica enterica serovar Typhi
ugaccauuaccauuccuca

SEQ ID NO: 1699596 - RNA, 17 nt, Salmonella enterica enterica serovar Typhi
ugaccauccgcagguua

SEQ ID NO: 1699597 - RNA, 16 nt, Salmonella enterica enterica serovar Typhi
ugaccaucgccagcca

SEQ ID NO: 1699598 - RNA, 14 nt, Salmonella enterica enterica serovar Typhi
ugaccguccccagc

SEQ ID NO: 1699599 - RNA, 21 nt, Salmonella enterica enterica serovar Typhi
ugaccgggcucacgcuggugc

SEQ ID NO: 1699600 - RNA, 19 nt, Salmonella enterica enterica serovar Typhi
ugacugcaaaucugccguc

SEQ ID NO: 1699601 - RNA, 13 nt, Salmonella enterica enterica serovar Typhi
ugacugcugucau

SEQ ID NO: 1699602 - RNA, 20 nt, Salmonella enterica enterica serovar Typhi
ugacugcgggggcaaaugcg

SEQ ID NO: 1699603 - RNA, 19 nt, Salmonella enterica enterica serovar Typhi
ugacggccugucuccucag

SEQ ID NO: 1699604 - RNA, 16 nt, Salmonella enterica enterica serovar Typhi
ugacggaaaccagcau

SEQ ID NO: 1699605 - RNA, 14 nt, Salmonella enterica enterica serovar Typhi
ugacgcuuugcauu

SEQ ID NO: 1699606 - RNA, 23 nt, Salmonella enterica enterica serovar Typhi
ugagaaaaggaagaauaaauaac

SEQ ID NO: 1699607 - RNA, 13 nt, Salmonella enterica enterica serovar Typhi
ugagaaaaauacg

SEQ ID NO: 1699608 - RNA, 14 nt, Salmonella enterica enterica serovar Typhi
ugagaaaaauuuaa

SEQ ID NO: 1699609 - RNA, 17 nt, Salmonella enterica enterica serovar Typhi
ugagaaaaccauauaaa

SEQ ID NO: 1699610 - RNA, 12 nt, Salmonella enterica enterica serovar Typhi
ugacuuugcucu

SEQ ID NO: 1699611 - RNA, 21 nt, Salmonella enterica enterica serovar Typhi
ugagcgaauccccgggaacau

SEQ ID NO: 1699612 - RNA, 13 nt, Salmonella enterica enterica serovar Typhi
ugagcccacagcg

SEQ ID NO: 1699613 - RNA, 14 nt, Salmonella enterica enterica serovar Typhi
ugagcccuccucca

SEQ ID NO: 1699614 - RNA, 20 nt, Salmonella enterica enterica serovar Typhi
ugagccgaaauccaccagcg

SEQ ID NO: 1699615 - RNA, 12 nt, Salmonella enterica enterica serovar Typhi
ugagcagcgcga

SEQ ID NO: 1699616 - RNA, 16 nt, Salmonella enterica enterica serovar Typhi
ugagcagaucagcacg

SEQ ID NO: 1699617 - RNA, 19 nt, Salmonella enterica enterica serovar Typhi
ugagcagacauauuuucaa

SEQ ID NO: 1699618 - RNA, 18 nt, Salmonella enterica enterica serovar Typhi
ugagaucgguaauuucca

SEQ ID NO: 1699619 - RNA, 20 nt, Salmonella enterica enterica serovar Typhi
ugagaaggucaguccaccug

SEQ ID NO: 1699620 - RNA, 21 nt, Salmonella enterica enterica serovar Typhi
ugaggccguuuuuuuguuuua

SEQ ID NO: 1699621 - RNA, 17 nt, Salmonella enterica enterica serovar Typhi
ugaggcgacaaucucac

SEQ ID NO: 1699622 - RNA, 16 nt, Salmonella enterica enterica serovar Typhi
ugagggcgauaauccg

SEQ ID NO: 1699623 - RNA, 19 nt, Salmonella enterica enterica serovar Typhi
ugaggcuuugagcgucagc

SEQ ID NO: 1699624 - RNA, 18 nt, Salmonella enterica enterica serovar Typhi
ugaguaaacgcucaagca

SEQ ID NO: 1699625 - RNA, 15 nt, Salmonella enterica enterica serovar Typhi
ugagguuucagcacc

SEQ ID NO: 1699626 - RNA, 16 nt, Salmonella enterica enterica serovar Typhi
ugagguuucagcaccu

SEQ ID NO: 1699627 - RNA, 16 nt, Salmonella enterica enterica serovar Typhi
ugaguauuggcaagaa

SEQ ID NO: 1699628 - RNA, 24 nt, Salmonella enterica enterica serovar Typhi
ugaggaaaaagcgcacuuuccaua

SEQ ID NO: 1699629 - RNA, 22 nt, Salmonella enterica enterica serovar Typhi
ugagcugcugcuugcuuuucau

SEQ ID NO: 1699630 - RNA, 12 nt, Salmonella enterica enterica serovar Typhi
ugagcugaaagc

SEQ ID NO: 1699631 - RNA, 16 nt, Salmonella enterica enterica serovar Typhi
ugagcuucaccgccag

SEQ ID NO: 1699632 - RNA, 22 nt, Salmonella enterica enterica serovar Typhi
ugagcgcagcgacuucaggcgu

SEQ ID NO: 1699633 - RNA, 13 nt, Salmonella enterica enterica serovar Typhi
ugagcgcaaugcu

SEQ ID NO: 1699634 - RNA, 17 nt, Salmonella enterica enterica serovar Typhi
ugagcgcagugaccagc

SEQ ID NO: 1699635 - RNA, 20 nt, Salmonella enterica enterica serovar Typhi
ugagcgccgcgccuaccagc

SEQ ID NO: 1699636 - RNA, 17 nt, Salmonella enterica enterica serovar Typhi
ugagcgcgaacgcucca

SEQ ID NO: 1699637 - RNA, 12 nt, Salmonella enterica enterica serovar Typhi
ugagcgggccgu

SEQ ID NO: 1699638 - RNA, 21 nt, Salmonella enterica enterica serovar Typhi
ugagcgguagcccgacaauaa

SEQ ID NO: 1699639 - RNA, 14 nt, Salmonella enterica enterica serovar Typhi
ugagcgucgccaga

SEQ ID NO: 1699640 - RNA, 23 nt, Salmonella enterica enterica serovar Typhi
ugagcgucacgccaucagggacg

SEQ ID NO: 1699641 - RNA, 22 nt, Salmonella enterica enterica serovar Typhi
ugagcguccagucgggcgugcc

SEQ ID NO: 1699642 - RNA, 21 nt, Salmonella enterica enterica serovar Typhi
ugcaggccaaauagaacgcuc

SEQ ID NO: 1699643 - RNA, 14 nt, Salmonella enterica enterica serovar Typhi
ugcaggccggauaa

SEQ ID NO: 1699644 - RNA, 22 nt, Salmonella enterica enterica serovar Typhi
ugcaggccggauaaggcagcaa

SEQ ID NO: 1699645 - RNA, 19 nt, Salmonella enterica enterica serovar Typhi
ugcaggacuuaccuugagu

SEQ ID NO: 1699646 - RNA, 13 nt, Salmonella enterica enterica serovar Typhi
ugcaggaggcgcg

SEQ ID NO: 1699647 - RNA, 19 nt, Salmonella enterica enterica serovar Typhi
ugcaggcgggugcgcagcc

SEQ ID NO: 1699648 - RNA, 15 nt, Salmonella enterica enterica serovar Typhi
ugcaggcgccugggu

SEQ ID NO: 1699649 - RNA, 16 nt, Salmonella enterica enterica serovar Typhi
ugcaggaaguuuucug

SEQ ID NO: 1699650 - RNA, 20 nt, Salmonella enterica enterica serovar Typhi
ugcaggacagacagacguug

SEQ ID NO: 1699651 - RNA, 16 nt, Salmonella enterica enterica serovar Typhi
ugcagcucaagcgccg

SEQ ID NO: 1699652 - RNA, 16 nt, Salmonella enterica enterica serovar Typhi
ugcagcgcuguccaga

SEQ ID NO: 1699653 - RNA, 21 nt, Salmonella enterica enterica serovar Typhi
ugcagcgccuggcgguaugaa

SEQ ID NO: 1699654 - RNA, 13 nt, Salmonella enterica enterica serovar Typhi
ugcagcgccgccu

SEQ ID NO: 1699655 - RNA, 18 nt, Salmonella enterica enterica serovar Typhi
ugcagcaggacgcgcacu

SEQ ID NO: 1699656 - RNA, 18 nt, Salmonella enterica enterica serovar Typhi
ugcagcauugggauggau

SEQ ID NO: 1699657 - RNA, 11 nt, Salmonella enterica enterica serovar Typhi
ugcagcaagaa

SEQ ID NO: 1699658 - RNA, 18 nt, Salmonella enterica enterica serovar Typhi
ugcagccauagcgcgccg

SEQ ID NO: 1699659 - RNA, 14 nt, Salmonella enterica enterica serovar Typhi
ugcagccaggccau

SEQ ID NO: 1699660 - RNA, 18 nt, Salmonella enterica enterica serovar Typhi
ugcagaucggccuguuuu

SEQ ID NO: 1699661 - RNA, 22 nt, Salmonella enterica enterica serovar Typhi
ugcagaucaagcgggggcgccu

SEQ ID NO: 1699662 - RNA, 15 nt, Salmonella enterica enterica serovar Typhi
ugcagauuuugcucc

SEQ ID NO: 1699663 - RNA, 18 nt, Salmonella enterica enterica serovar Typhi
ugcagacugcacuuccug

SEQ ID NO: 1699664 - RNA, 14 nt, Salmonella enterica enterica serovar Typhi
ugcagaccucugca

SEQ ID NO: 1699665 - RNA, 14 nt, Salmonella enterica enterica serovar Typhi
ugcagaaucauuaa

SEQ ID NO: 1699666 - RNA, 19 nt, Salmonella enterica enterica serovar Typhi
ugcaagccugauacuuuua

SEQ ID NO: 1699667 - RNA, 13 nt, Salmonella enterica enterica serovar Typhi
ugcaaagcaaaaa

SEQ ID NO: 1699668 - RNA, 16 nt, Salmonella enterica enterica serovar Typhi
ugcaaaguuauuacau

SEQ ID NO: 1699669 - RNA, 22 nt, Salmonella enterica enterica serovar Typhi
ugcaaagacagcaggcuuugcu

SEQ ID NO: 1699670 - RNA, 21 nt, Salmonella enterica enterica serovar Typhi
ugcaaucguucuugcacaaua

SEQ ID NO: 1699671 - RNA, 18 nt, Salmonella enterica enterica serovar Typhi
ugcaaucuuuacccggcg

SEQ ID NO: 1699672 - RNA, 17 nt, Salmonella enterica enterica serovar Typhi
ugcaaugcagaugcuca

SEQ ID NO: 1699673 - RNA, 21 nt, Salmonella enterica enterica serovar Typhi
ugcaaugcggcguguggcugu

SEQ ID NO: 1699674 - RNA, 16 nt, Salmonella enterica enterica serovar Typhi
ugcacaaaauacuguu

SEQ ID NO: 1699675 - RNA, 15 nt, Salmonella enterica enterica serovar Typhi
ugcacaauaccaaua

SEQ ID NO: 1699676 - RNA, 12 nt, Salmonella enterica enterica serovar Typhi
ugcacuuccugc

SEQ ID NO: 1699677 - RNA, 18 nt, Salmonella enterica enterica serovar Typhi
ugcacuucaugccgaaca

SEQ ID NO: 1699678 - RNA, 20 nt, Salmonella enterica enterica serovar Typhi
ugcaccaacgauaaauuuuc

SEQ ID NO: 1699679 - RNA, 15 nt, Salmonella enterica enterica serovar Typhi
ugcacauguuucagc

SEQ ID NO: 1699680 - RNA, 22 nt, Salmonella enterica enterica serovar Typhi
ugcaccuuaaccgucugcucag

SEQ ID NO: 1699681 - RNA, 17 nt, Salmonella enterica enterica serovar Typhi
ugcacgaaauguagagc

SEQ ID NO: 1699682 - RNA, 18 nt, Salmonella enterica enterica serovar Typhi
ugcacaucgccauuaaaa

SEQ ID NO: 1699683 - RNA, 14 nt, Salmonella enterica enterica serovar Typhi
ugaguguuacucuu

SEQ ID NO: 1699684 - RNA, 20 nt, Salmonella enterica enterica serovar Typhi
ugauauaccguccagacucc

SEQ ID NO: 1699685 - RNA, 16 nt, Salmonella enterica enterica serovar Typhi
ugauauugugcauacu

SEQ ID NO: 1699686 - RNA, 22 nt, Salmonella enterica enterica serovar Typhi
ugauauugcguaagcagcugcu

SEQ ID NO: 1699687 - RNA, 23 nt, Salmonella enterica enterica serovar Typhi
ugauauugcguaagcagcugcuu

SEQ ID NO: 1699688 - RNA, 23 nt, Salmonella enterica enterica serovar Typhi
ugauaucgcugugguuuauccgc

SEQ ID NO: 1699689 - RNA, 20 nt, Salmonella enterica enterica serovar Typhi
ugaucaggaaaucuuccagu

SEQ ID NO: 1699690 - RNA, 18 nt, Salmonella enterica enterica serovar Typhi
ugaucaggaaaucuucca

SEQ ID NO: 1699691 - RNA, 23 nt, Salmonella enterica enterica serovar Typhi
ugaucagcaaaauaguguugaau

SEQ ID NO: 1699692 - RNA, 23 nt, Salmonella enterica enterica serovar Typhi
ugaucacgguacgcaucaccagg

SEQ ID NO: 1699693 - RNA, 20 nt, Salmonella enterica enterica serovar Typhi
ugauccguucgaucagcugg

SEQ ID NO: 1699694 - RNA, 23 nt, Salmonella enterica enterica serovar Typhi
ugauccgcccccuccaguagcag

SEQ ID NO: 1699695 - RNA, 22 nt, Salmonella enterica enterica serovar Typhi
ugauccacagguuaucgccgcc

SEQ ID NO: 1699696 - RNA, 13 nt, Salmonella enterica enterica serovar Typhi
ugaucccccagaa

SEQ ID NO: 1699697 - RNA, 12 nt, Salmonella enterica enterica serovar Typhi
ugaucccaaugu

SEQ ID NO: 1699698 - RNA, 11 nt, Salmonella enterica enterica serovar Typhi
ugaucccacca

SEQ ID NO: 1699699 - RNA, 16 nt, Salmonella enterica enterica serovar Typhi
ugaugcaucagaacaa

SEQ ID NO: 1699700 - RNA, 16 nt, Salmonella enterica enterica serovar Typhi
ugaugauuuaugaaua

SEQ ID NO: 1699701 - RNA, 13 nt, Salmonella enterica enterica serovar Typhi
ugaugagaggcga

SEQ ID NO: 1699702 - RNA, 18 nt, Salmonella enterica enterica serovar Typhi
ugaugcguuuguuggaga

SEQ ID NO: 1699703 - RNA, 19 nt, Salmonella enterica enterica serovar Typhi
ugauggagguuguuuuauu

SEQ ID NO: 1699704 - RNA, 14 nt, Salmonella enterica enterica serovar Typhi
ugaucgaaaaugcg

SEQ ID NO: 1699705 - RNA, 16 nt, Salmonella enterica enterica serovar Typhi
ugaucgaauucauuac

SEQ ID NO: 1699706 - RNA, 17 nt, Salmonella enterica enterica serovar Typhi
ugaucgauccgcaucag

SEQ ID NO: 1699707 - RNA, 14 nt, Salmonella enterica enterica serovar Typhi
ugaucgccucuucg

SEQ ID NO: 1699708 - RNA, 24 nt, Salmonella enterica enterica serovar Typhi
ugaucgccggagaauccuuccagu

SEQ ID NO: 1699709 - RNA, 21 nt, Salmonella enterica enterica serovar Typhi
ugaucgccacgccuaaacuga

SEQ ID NO: 1699710 - RNA, 22 nt, Salmonella enterica enterica serovar Typhi
ugaucggccagauaguggcuga

SEQ ID NO: 1699711 - RNA, 14 nt, Salmonella enterica enterica serovar Typhi
ugaucggguuuucc

SEQ ID NO: 1699712 - RNA, 20 nt, Salmonella enterica enterica serovar Typhi
ugaugacgcgcaggccguca

SEQ ID NO: 1699713 - RNA, 21 nt, Salmonella enterica enterica serovar Typhi
ugaugacgcgaauuauagaac

SEQ ID NO: 1699714 - RNA, 21 nt, Salmonella enterica enterica serovar Typhi
ugaugacucauuaaaaaaaca

SEQ ID NO: 1699715 - RNA, 17 nt, Salmonella enterica enterica serovar Typhi
ugauuuguuuuuuauau

SEQ ID NO: 1699716 - RNA, 18 nt, Salmonella enterica enterica serovar Typhi
ugauuugcuuuauuuguu

SEQ ID NO: 1699717 - RNA, 13 nt, Salmonella enterica enterica serovar Typhi
ugauuuuaugaug

SEQ ID NO: 1699718 - RNA, 14 nt, Salmonella enterica enterica serovar Typhi
ugauuuuaugaugc

SEQ ID NO: 1699719 - RNA, 15 nt, Salmonella enterica enterica serovar Typhi
ugauucgcuggccuc

SEQ ID NO: 1699720 - RNA, 14 nt, Salmonella enterica enterica serovar Typhi
ugauuccuggcuug

SEQ ID NO: 1699721 - RNA, 21 nt, Salmonella enterica enterica serovar Typhi
ugauucguuuuuacacugaag

SEQ ID NO: 1699722 - RNA, 20 nt, Salmonella enterica enterica serovar Typhi
ugauuucgccccacuggccc

SEQ ID NO: 1699723 - RNA, 19 nt, Salmonella enterica enterica serovar Typhi
ugauuucgacgauaaaaaa

SEQ ID NO: 1699724 - RNA, 17 nt, Salmonella enterica enterica serovar Typhi
ugauggcgaacagcccc

SEQ ID NO: 1699725 - RNA, 20 nt, Salmonella enterica enterica serovar Typhi
ugauggcgcgacgcuuauca

SEQ ID NO: 1699726 - RNA, 18 nt, Salmonella enterica enterica serovar Typhi
ugauggcgcuaagccagc

SEQ ID NO: 1699727 - RNA, 20 nt, Salmonella enterica enterica serovar Typhi
ugauggcgcuacgcuuauca

SEQ ID NO: 1699728 - RNA, 13 nt, Salmonella enterica enterica serovar Typhi
ugauggcgcugcg

SEQ ID NO: 1699729 - RNA, 20 nt, Salmonella enterica enterica serovar Typhi
ugauggcgcugcgcuuauca

SEQ ID NO: 1699730 - RNA, 13 nt, Salmonella enterica enterica serovar Typhi
ugauggccuuugu

SEQ ID NO: 1699731 - RNA, 14 nt, Salmonella enterica enterica serovar Typhi
ugauggccuggcgg

SEQ ID NO: 1699732 - RNA, 18 nt, Salmonella enterica enterica serovar Typhi
ugaugggcgcacagcgcc

SEQ ID NO: 1699733 - RNA, 21 nt, Salmonella enterica enterica serovar Typhi
ugauuaucacccacaggagcc

SEQ ID NO: 1699734 - RNA, 18 nt, Salmonella enterica enterica serovar Typhi
ugauuauuguuaaaaaga

SEQ ID NO: 1699735 - RNA, 17 nt, Salmonella enterica enterica serovar Typhi
ugauguuuuuaaaagaa

SEQ ID NO: 1699736 - RNA, 18 nt, Salmonella enterica enterica serovar Typhi
ugauguuuuuaaaagaag

SEQ ID NO: 1699737 - RNA, 18 nt, Salmonella enterica enterica serovar Typhi
ugauguguuucagcagcc

SEQ ID NO: 1699738 - RNA, 13 nt, Salmonella enterica enterica serovar Typhi
ugaugugauggug

SEQ ID NO: 1699739 - RNA, 20 nt, Salmonella enterica enterica serovar Typhi
ugaugugauuuuugacccgc

SEQ ID NO: 1699740 - RNA, 22 nt, Salmonella enterica enterica serovar Typhi
gaccgccgucauagcaggagau

SEQ ID NO: 1699741 - RNA, 16 nt, Salmonella enterica enterica serovar Typhi
gaccgcugauggaccu

SEQ ID NO: 1699742 - RNA, 14 nt, Salmonella enterica enterica serovar Typhi
gaccgcuucgcugg

SEQ ID NO: 1699743 - RNA, 19 nt, Salmonella enterica enterica serovar Typhi
gaccggcagccguuuuccg

SEQ ID NO: 1699744 - RNA, 22 nt, Salmonella enterica enterica serovar Typhi
gaccggcacucaccucuuccgc

SEQ ID NO: 1699745 - RNA, 17 nt, Salmonella enterica enterica serovar Typhi
gaccggaacggacgugc

SEQ ID NO: 1699746 - RNA, 20 nt, Salmonella enterica enterica serovar Typhi
gaccggaugauggccuggcg

SEQ ID NO: 1699747 - RNA, 16 nt, Salmonella enterica enterica serovar Typhi
gaccggacguugaaaa

SEQ ID NO: 1699748 - RNA, 19 nt, Salmonella enterica enterica serovar Typhi
gaccgguccaccgggggcg

SEQ ID NO: 1699749 - RNA, 18 nt, Salmonella enterica enterica serovar Typhi
gaccgucaaacguccaua

SEQ ID NO: 1699750 - RNA, 12 nt, Salmonella enterica enterica serovar Typhi
gaccucaagaau

SEQ ID NO: 1699751 - RNA, 19 nt, Salmonella enterica enterica serovar Typhi
gaccgucuuugucaagcac

SEQ ID NO: 1699752 - RNA, 16 nt, Salmonella enterica enterica serovar Typhi
gaccgucgcgcccucc

SEQ ID NO: 1699753 - RNA, 20 nt, Salmonella enterica enterica serovar Typhi
gaccgucgcgcccuccucca

SEQ ID NO: 1699754 - RNA, 17 nt, Salmonella enterica enterica serovar Typhi
gaccgucgugccugcgg

SEQ ID NO: 1699755 - RNA, 20 nt, Salmonella enterica enterica serovar Typhi
gaccguuuucaacgccgcgc

SEQ ID NO: 1699756 - RNA, 15 nt, Salmonella enterica enterica serovar Typhi
gaccguuucaaagaa

SEQ ID NO: 1699757 - RNA, 15 nt, Salmonella enterica enterica serovar Typhi
gaccuaauagccagc

SEQ ID NO: 1699758 - RNA, 13 nt, Salmonella enterica enterica serovar Typhi
gaccuaaauaagc

SEQ ID NO: 1699759 - RNA, 18 nt, Salmonella enterica enterica serovar Typhi
gaccuggcgcucaaucag

SEQ ID NO: 1699760 - RNA, 11 nt, Salmonella enterica enterica serovar Typhi
gaccuggcgcu

SEQ ID NO: 1699761 - RNA, 22 nt, Salmonella enterica enterica serovar Typhi
gaccuguucuguaggcugugca

SEQ ID NO: 1699762 - RNA, 16 nt, Salmonella enterica enterica serovar Typhi
gaccuguagaugaaac

SEQ ID NO: 1699763 - RNA, 21 nt, Salmonella enterica enterica serovar Typhi
gaccucuucuuugagcucccg

SEQ ID NO: 1699764 - RNA, 18 nt, Salmonella enterica enterica serovar Typhi
gacccuuaugucauucag

SEQ ID NO: 1699765 - RNA, 19 nt, Salmonella enterica enterica serovar Typhi
gacccugagcucaaacgua

SEQ ID NO: 1699766 - RNA, 22 nt, Salmonella enterica enterica serovar Typhi
gacccguuacgcagucagcacu

SEQ ID NO: 1699767 - RNA, 22 nt, Salmonella enterica enterica serovar Typhi
gacccgggacuucaggcaucca

SEQ ID NO: 1699768 - RNA, 14 nt, Salmonella enterica enterica serovar Typhi
gacccgcagcaauc

SEQ ID NO: 1699769 - RNA, 16 nt, Salmonella enterica enterica serovar Typhi
gaccgaucucaugcaa

SEQ ID NO: 1699770 - RNA, 23 nt, Salmonella enterica enterica serovar Typhi
gaccgagucuacaucaagagaaa

SEQ ID NO: 1699771 - RNA, 16 nt, Salmonella enterica enterica serovar Typhi
gaccgauauagccacu

SEQ ID NO: 1699772 - RNA, 23 nt, Salmonella enterica enterica serovar Typhi
gaccgcccaggauaucgcgggcg

SEQ ID NO: 1699773 - RNA, 20 nt, Salmonella enterica enterica serovar Typhi
gaccgcagaccggaugaugg

SEQ ID NO: 1699774 - RNA, 23 nt, Salmonella enterica enterica serovar Typhi
gaccgcaaaccgaauucguccac

SEQ ID NO: 1699775 - RNA, 14 nt, Salmonella enterica enterica serovar Typhi
gacccgaaguggug

SEQ ID NO: 1699776 - RNA, 22 nt, Salmonella enterica enterica serovar Typhi
gaccccauuaaacuggccccgc

SEQ ID NO: 1699777 - RNA, 13 nt, Salmonella enterica enterica serovar Typhi
gaccccagauaau

SEQ ID NO: 1699778 - RNA, 18 nt, Salmonella enterica enterica serovar Typhi
gaccccaguaauccggca

SEQ ID NO: 1699779 - RNA, 22 nt, Salmonella enterica enterica serovar Typhi
gaccccgccgucagacaggccu

SEQ ID NO: 1699780 - RNA, 12 nt, Salmonella enterica enterica serovar Typhi
gacccauuuuaa

SEQ ID NO: 1699781 - RNA, 16 nt, Salmonella enterica enterica serovar Typhi
gacccaguacaaacaa

SEQ ID NO: 1699782 - RNA, 14 nt, Salmonella enterica enterica serovar Typhi
gacccacgccagca

SEQ ID NO: 1699783 - RNA, 16 nt, Salmonella enterica enterica serovar Typhi
gacccacuaacugccg

SEQ ID NO: 1699784 - RNA, 15 nt, Salmonella enterica enterica serovar Typhi
gacccacagccgguu

SEQ ID NO: 1699785 - RNA, 22 nt, Salmonella enterica enterica serovar Typhi
gacccacagccgguuagccaca

SEQ ID NO: 1699786 - RNA, 20 nt, Salmonella enterica enterica serovar Typhi
gaccauuaccauuccucacg

SEQ ID NO: 1699787 - RNA, 15 nt, Salmonella enterica enterica serovar Typhi
gaccauuccagguca

SEQ ID NO: 1699788 - RNA, 15 nt, Salmonella enterica enterica serovar Typhi
gaccaucuuccaacu

SEQ ID NO: 1699789 - RNA, 14 nt, Salmonella enterica enterica serovar Typhi
gaccaucaacagcg

SEQ ID NO: 1699790 - RNA, 16 nt, Salmonella enterica enterica serovar Typhi
gaccauauaugaaauc

SEQ ID NO: 1699791 - RNA, 19 nt, Salmonella enterica enterica serovar Typhi
gaccauacgcagcauuucg

SEQ ID NO: 1699792 - RNA, 14 nt, Salmonella enterica enterica serovar Typhi
gaccauaugcggca

SEQ ID NO: 1699793 - RNA, 12 nt, Salmonella enterica enterica serovar Typhi
gaccauacuaau

SEQ ID NO: 1699794 - RNA, 17 nt, Salmonella enterica enterica serovar Typhi
gaccaucaagcauauca

SEQ ID NO: 1699795 - RNA, 21 nt, Salmonella enterica enterica serovar Typhi
gaccaguucaccggcggccag

SEQ ID NO: 1699796 - RNA, 21 nt, Salmonella enterica enterica serovar Typhi
gaccaguuuuugcgccagcgc

SEQ ID NO: 1699797 - RNA, 19 nt, Salmonella enterica enterica serovar Typhi
gaccauaguccaugcccaa

SEQ ID NO: 1699798 - RNA, 14 nt, Salmonella enterica enterica serovar Typhi
gacgcgaagcggcg

SEQ ID NO: 1699799 - RNA, 13 nt, Salmonella enterica enterica serovar Typhi
gacgcgcagcacc

SEQ ID NO: 1699800 - RNA, 21 nt, Salmonella enterica enterica serovar Typhi
gacgcgcgagaacugcugcau

SEQ ID NO: 1699801 - RNA, 17 nt, Salmonella enterica enterica serovar Typhi
gacgcgccacuuccagc

SEQ ID NO: 1699802 - RNA, 20 nt, Salmonella enterica enterica serovar Typhi
gacgcgccacuuccagcgcg

SEQ ID NO: 1699803 - RNA, 21 nt, Salmonella enterica enterica serovar Typhi
gacgcgcgcgaaaagaaacug

SEQ ID NO: 1699804 - RNA, 22 nt, Salmonella enterica enterica serovar Typhi
gacgcggaacuggugaaacagg

SEQ ID NO: 1699805 - RNA, 23 nt, Salmonella enterica enterica serovar Typhi
gacgccgucugguacggccacca

SEQ ID NO: 1699806 - RNA, 12 nt, Salmonella enterica enterica serovar Typhi
gacgccugcaua

SEQ ID NO: 1699807 - RNA, 18 nt, Salmonella enterica enterica serovar Typhi
gacgccgggaaauuuuuc

SEQ ID NO: 1699808 - RNA, 22 nt, Salmonella enterica enterica serovar Typhi
gacgcauugagacaugccgcca

SEQ ID NO: 1699809 - RNA, 17 nt, Salmonella enterica enterica serovar Typhi
gacgccaagcugcagaa

SEQ ID NO: 1699810 - RNA, 15 nt, Salmonella enterica enterica serovar Typhi
gacgccaugggguga

SEQ ID NO: 1699811 - RNA, 22 nt, Salmonella enterica enterica serovar Typhi
gacgccauccguacguauuauc

SEQ ID NO: 1699812 - RNA, 21 nt, Salmonella enterica enterica serovar Typhi
gacgccaccggguuaaagccc

SEQ ID NO: 1699813 - RNA, 13 nt, Salmonella enterica enterica serovar Typhi
gacgccagccagc

SEQ ID NO: 1699814 - RNA, 14 nt, Salmonella enterica enterica serovar Typhi
gacgcccaucagca

SEQ ID NO: 1699815 - RNA, 17 nt, Salmonella enterica enterica serovar Typhi
gacgcccaucagcaucc

SEQ ID NO: 1699816 - RNA, 17 nt, Salmonella enterica enterica serovar Typhi
gacgccgacauaagcug

SEQ ID NO: 1699817 - RNA, 16 nt, Salmonella enterica enterica serovar Typhi
gacgccgauaaagccc

SEQ ID NO: 1699818 - RNA, 22 nt, Salmonella enterica enterica serovar Typhi
gacgccgaaccuggcgggcagc

SEQ ID NO: 1699819 - RNA, 13 nt, Salmonella enterica enterica serovar Typhi
gacggccaccagc

SEQ ID NO: 1699820 - RNA, 16 nt, Salmonella enterica enterica serovar Typhi
gacggcccuuuugcag

SEQ ID NO: 1699821 - RNA, 23 nt, Salmonella enterica enterica serovar Typhi
gacggcgaaucaauuuacgcacu

SEQ ID NO: 1699822 - RNA, 15 nt, Salmonella enterica enterica serovar Typhi
gacggccugucuccu

SEQ ID NO: 1699823 - RNA, 22 nt, Salmonella enterica enterica serovar Typhi
gacggccucuucacgcagcgcc

SEQ ID NO: 1699824 - RNA, 22 nt, Salmonella enterica enterica serovar Typhi
gacggauuggcgcucaauagcc

SEQ ID NO: 1699825 - RNA, 24 nt, Salmonella enterica enterica serovar Typhi
gacggcaacggcgacaagaauaug

SEQ ID NO: 1699826 - RNA, 16 nt, Salmonella enterica enterica serovar Typhi
gacggauucuuccucu

SEQ ID NO: 1699827 - RNA, 18 nt, Salmonella enterica enterica serovar Typhi
gacggagaugaucguuuc

SEQ ID NO: 1699828 - RNA, 18 nt, Salmonella enterica enterica serovar Typhi
gacggaggcgggcgcgca

SEQ ID NO: 1699829 - RNA, 19 nt, Salmonella enterica enterica serovar Typhi
gacgcugcgcuuauccggc

SEQ ID NO: 1699830 - RNA, 14 nt, Salmonella enterica enterica serovar Typhi
gacggaaaccagau

SEQ ID NO: 1699831 - RNA, 20 nt, Salmonella enterica enterica serovar Typhi
gacgcuguucaaagccgcca

SEQ ID NO: 1699832 - RNA, 16 nt, Salmonella enterica enterica serovar Typhi
gacgcugcgccuggau

SEQ ID NO: 1699833 - RNA, 14 nt, Salmonella enterica enterica serovar Typhi
gacgcugaugaaaa

SEQ ID NO: 1699834 - RNA, 18 nt, Salmonella enterica enterica serovar Typhi
gacgcugaaccuuccauu

SEQ ID NO: 1699835 - RNA, 15 nt, Salmonella enterica enterica serovar Typhi
gacgcugagagaacu

SEQ ID NO: 1699836 - RNA, 14 nt, Salmonella enterica enterica serovar Typhi
gacgcuauuuuuca

SEQ ID NO: 1699837 - RNA, 20 nt, Salmonella enterica enterica serovar Typhi
gacgcucgacgaagccuucg

SEQ ID NO: 1699838 - RNA, 20 nt, Salmonella enterica enterica serovar Typhi
gacgcucgacguccagcgcg

SEQ ID NO: 1699839 - RNA, 23 nt, Salmonella enterica enterica serovar Typhi
gacgcgucauaaugcccagcgcc

SEQ ID NO: 1699840 - RNA, 22 nt, Salmonella enterica enterica serovar Typhi
gacgcggugaaaggcuugcagg

SEQ ID NO: 1699841 - RNA, 19 nt, Salmonella enterica enterica serovar Typhi
gacgcgcucaccuccgcca

SEQ ID NO: 1699842 - RNA, 17 nt, Salmonella enterica enterica serovar Typhi
gacgacgccaggcgguc

SEQ ID NO: 1699843 - RNA, 16 nt, Salmonella enterica enterica serovar Typhi
gacgacccuguguagu

SEQ ID NO: 1699844 - RNA, 23 nt, Salmonella enterica enterica serovar Typhi
gacgaccguaauagcaauacuuu

SEQ ID NO: 1699845 - RNA, 18 nt, Salmonella enterica enterica serovar Typhi
gacgaauaccugaaagag

SEQ ID NO: 1699846 - RNA, 18 nt, Salmonella enterica enterica serovar Typhi
gacgaauccuauacccaa

SEQ ID NO: 1699847 - RNA, 15 nt, Salmonella enterica enterica serovar Typhi
gacgaacggccugau

SEQ ID NO: 1699848 - RNA, 17 nt, Salmonella enterica enterica serovar Typhi
gaccuucaucucuuugc

SEQ ID NO: 1699849 - RNA, 18 nt, Salmonella enterica enterica serovar Typhi
gacgaugaugagauacgu

SEQ ID NO: 1699850 - RNA, 13 nt, Salmonella enterica enterica serovar Typhi
gacgaugauaaua

SEQ ID NO: 1699851 - RNA, 15 nt, Salmonella enterica enterica serovar Typhi
gacgcagcuucgccg

SEQ ID NO: 1699852 - RNA, 12 nt, Salmonella enterica enterica serovar Typhi
gacgcagcuucu

SEQ ID NO: 1699853 - RNA, 20 nt, Salmonella enterica enterica serovar Typhi
gacgcaauagaguaaugaca

SEQ ID NO: 1699854 - RNA, 16 nt, Salmonella enterica enterica serovar Typhi
gacgcaacucacgcca

SEQ ID NO: 1699855 - RNA, 12 nt, Salmonella enterica enterica serovar Typhi
gacgcaccagcc

SEQ ID NO: 1699856 - RNA, 13 nt, Salmonella enterica enterica serovar Typhi
gacgcaccagcca

SEQ ID NO: 1699857 - RNA, 14 nt, Salmonella enterica enterica serovar Typhi
gacgcacaggcgcg

SEQ ID NO: 1699858 - RNA, 13 nt, Salmonella enterica enterica serovar Typhi
gacgauaaaaaaa

SEQ ID NO: 1699859 - RNA, 14 nt, Salmonella enterica enterica serovar Typhi
gacgauaaaaaaag

SEQ ID NO: 1699860 - RNA, 16 nt, Salmonella enterica enterica serovar Typhi
gacgauaaccaugcuc

SEQ ID NO: 1699861 - RNA, 13 nt, Salmonella enterica enterica serovar Typhi
gacgauaaccgga

SEQ ID NO: 1699862 - RNA, 22 nt, Salmonella enterica enterica serovar Typhi
gacgauaaccggacgauuuaag

SEQ ID NO: 1699863 - RNA, 17 nt, Salmonella enterica enterica serovar Typhi
gacgauacgucauauca

SEQ ID NO: 1699864 - RNA, 15 nt, Salmonella enterica enterica serovar Typhi
gacgaucagcgccac

SEQ ID NO: 1699865 - RNA, 16 nt, Salmonella enterica enterica serovar Typhi
gacgagcgaaaaacug

SEQ ID NO: 1699866 - RNA, 21 nt, Salmonella enterica enterica serovar Typhi
gacgagcgcgucagcgccucc

SEQ ID NO: 1699867 - RNA, 18 nt, Salmonella enterica enterica serovar Typhi
gacgacuucacccgcggg

SEQ ID NO: 1699868 - RNA, 23 nt, Salmonella enterica enterica serovar Typhi
gacgacuucacccgcgggcggcg

SEQ ID NO: 1699869 - RNA, 18 nt, Salmonella enterica enterica serovar Typhi
gacgacgguuaaaaagua

SEQ ID NO: 1699870 - RNA, 20 nt, Salmonella enterica enterica serovar Typhi
gacacagucauugguaagag

SEQ ID NO: 1699871 - RNA, 19 nt, Salmonella enterica enterica serovar Typhi
gacacagcguacaauggca

SEQ ID NO: 1699872 - RNA, 15 nt, Salmonella enterica enterica serovar Typhi
gacaauuuucuucau

SEQ ID NO: 1699873 - RNA, 23 nt, Salmonella enterica enterica serovar Typhi
gacacccgcagccagaacagaag

SEQ ID NO: 1699874 - RNA, 17 nt, Salmonella enterica enterica serovar Typhi
gacacaugaccugaaua

SEQ ID NO: 1699875 - RNA, 13 nt, Salmonella enterica enterica serovar Typhi
gacaccacgcagg

SEQ ID NO: 1699876 - RNA, 21 nt, Salmonella enterica enterica serovar Typhi
gacacgcucauaaauugcagc

SEQ ID NO: 1699877 - RNA, 23 nt, Salmonella enterica enterica serovar Typhi
gacacggugugccgccaucagcg

SEQ ID NO: 1699878 - RNA, 15 nt, Salmonella enterica enterica serovar Typhi
gacaccgcaaaccgu

SEQ ID NO: 1699879 - RNA, 23 nt, Salmonella enterica enterica serovar Typhi
gacagcgacacuccgcgcaugua

SEQ ID NO: 1699880 - RNA, 23 nt, Salmonella enterica enterica serovar Typhi
gacagcgaacaguguaaacgcca

SEQ ID NO: 1699881 - RNA, 19 nt, Salmonella enterica enterica serovar Typhi
gacagcccccauaaauaau

SEQ ID NO: 1699882 - RNA, 22 nt, Salmonella enterica enterica serovar Typhi
gacagcgcgcaaaaaccggagc

SEQ ID NO: 1699883 - RNA, 18 nt, Salmonella enterica enterica serovar Typhi
gacagcggggugugaagu

SEQ ID NO: 1699884 - RNA, 17 nt, Salmonella enterica enterica serovar Typhi
gacagcguaaugcgcca

SEQ ID NO: 1699885 - RNA, 14 nt, Salmonella enterica enterica serovar Typhi
gacaggaguauagc

SEQ ID NO: 1699886 - RNA, 16 nt, Salmonella enterica enterica serovar Typhi
gacagaauaugcauau

SEQ ID NO: 1699887 - RNA, 18 nt, Salmonella enterica enterica serovar Typhi
gacagaagcugagaaaag

SEQ ID NO: 1699888 - RNA, 18 nt, Salmonella enterica enterica serovar Typhi
gacagaacugauuuccgg

SEQ ID NO: 1699889 - RNA, 14 nt, Salmonella enterica enterica serovar Typhi
gacagaacugauuu

SEQ ID NO: 1699890 - RNA, 17 nt, Salmonella enterica enterica serovar Typhi
gacagcaccgccgggaa

SEQ ID NO: 1699891 - RNA, 17 nt, Salmonella enterica enterica serovar Typhi
gacagcaauaucagcca

SEQ ID NO: 1699892 - RNA, 24 nt, Salmonella enterica enterica serovar Typhi
gacagaugcagguucccgcccugc

SEQ ID NO: 1699893 - RNA, 16 nt, Salmonella enterica enterica serovar Typhi
gacagauaacaccagc

SEQ ID NO: 1699894 - RNA, 15 nt, Salmonella enterica enterica serovar Typhi
gacagcaaaacggcu

SEQ ID NO: 1699895 - RNA, 15 nt, Salmonella enterica enterica serovar Typhi
gacaagguugaucag

SEQ ID NO: 1699896 - RNA, 16 nt, Salmonella enterica enterica serovar Typhi
gacaauagcggacggc

SEQ ID NO: 1699897 - RNA, 19 nt, Salmonella enterica enterica serovar Typhi
gacaauaacggccucaauu

SEQ ID NO: 1699898 - RNA, 16 nt, Salmonella enterica enterica serovar Typhi
gacaaucagcaccauu

SEQ ID NO: 1699899 - RNA, 23 nt, Salmonella enterica enterica serovar Typhi
gacaaucuccuccggcuucagca

SEQ ID NO: 1699900 - RNA, 23 nt, Salmonella enterica enterica serovar Typhi
gacaaucgucacuucaauuugcc

SEQ ID NO: 1699901 - RNA, 15 nt, Salmonella enterica enterica serovar Typhi
gacaaugaucagacg

SEQ ID NO: 1699902 - RNA, 14 nt, Salmonella enterica enterica serovar Typhi
gacaaugaaccagc

SEQ ID NO: 1699903 - RNA, 14 nt, Salmonella enterica enterica serovar Typhi
gacaacgaccagug

SEQ ID NO: 1699904 - RNA, 14 nt, Salmonella enterica enterica serovar Typhi
gacaaccugcccuu

SEQ ID NO: 1699905 - RNA, 21 nt, Salmonella enterica enterica serovar Typhi
gacaacgcguuuauuauaaac

SEQ ID NO: 1699906 - RNA, 23 nt, Salmonella enterica enterica serovar Typhi
gacaacguaaacggcagccgcca

SEQ ID NO: 1699907 - RNA, 18 nt, Salmonella enterica enterica serovar Typhi
gacaacguuuucagcagu

SEQ ID NO: 1699908 - RNA, 11 nt, Salmonella enterica enterica serovar Typhi
gacaaccagcg

SEQ ID NO: 1699909 - RNA, 19 nt, Salmonella enterica enterica serovar Typhi
gacaaccagcgaaaugacg

SEQ ID NO: 1699910 - RNA, 17 nt, Salmonella enterica enterica serovar Typhi
gacaacaucccagaaaa

SEQ ID NO: 1699911 - RNA, 20 nt, Salmonella enterica enterica serovar Typhi
gacaacaucccagaaaauga

SEQ ID NO: 1699912 - RNA, 19 nt, Salmonella enterica enterica serovar Typhi
gacaaggcgguacgccgcc

SEQ ID NO: 1699913 - RNA, 21 nt, Salmonella enterica enterica serovar Typhi
gacaaggccgauaaagcguuu

SEQ ID NO: 1699914 - RNA, 17 nt, Salmonella enterica enterica serovar Typhi
gacaagaaucacguaau

SEQ ID NO: 1699915 - RNA, 21 nt, Salmonella enterica enterica serovar Typhi
gacaacuucuaauuuuuccag

SEQ ID NO: 1699916 - RNA, 20 nt, Salmonella enterica enterica serovar Typhi
gacaaacucacguuccccag

SEQ ID NO: 1699917 - RNA, 17 nt, Salmonella enterica enterica serovar Typhi
gacaaacagcuauccau

SEQ ID NO: 1699918 - RNA, 21 nt, Salmonella enterica enterica serovar Typhi
gacaaaauaaagugaaauaaa

SEQ ID NO: 1699919 - RNA, 17 nt, Salmonella enterica enterica serovar Typhi
gacaaaggcaagauccg

SEQ ID NO: 1699920 - RNA, 17 nt, Salmonella enterica enterica serovar Typhi
gacaaauaccuccuggc

SEQ ID NO: 1699921 - RNA, 16 nt, Salmonella enterica enterica serovar Typhi
gacaaauuguuuaaaa

SEQ ID NO: 1699922 - RNA, 22 nt, Salmonella enterica enterica serovar Typhi
gaauuuguugguuuaaacucug

SEQ ID NO: 1699923 - RNA, 14 nt, Salmonella enterica enterica serovar Typhi
gacaaaaauaccac

SEQ ID NO: 1699924 - RNA, 14 nt, Salmonella enterica enterica serovar Typhi
gacaaaaauggaua

SEQ ID NO: 1699925 - RNA, 16 nt, Salmonella enterica enterica serovar Typhi
gaccaccauccggcaa

SEQ ID NO: 1699926 - RNA, 15 nt, Salmonella enterica enterica serovar Typhi
gaccacgccaccgcc

SEQ ID NO: 1699927 - RNA, 18 nt, Salmonella enterica enterica serovar Typhi
gaccacgacgccggagac

SEQ ID NO: 1699928 - RNA, 23 nt, Salmonella enterica enterica serovar Typhi
gaccaaaauggcaaguaaaauag

SEQ ID NO: 1699929 - RNA, 20 nt, Salmonella enterica enterica serovar Typhi
gaccaaaugguugguauugc

SEQ ID NO: 1699930 - RNA, 15 nt, Salmonella enterica enterica serovar Typhi
gaccaacaacagaua

SEQ ID NO: 1699931 - RNA, 20 nt, Salmonella enterica enterica serovar Typhi
gaccaaugcuggcaggcgcg

SEQ ID NO: 1699932 - RNA, 20 nt, Salmonella enterica enterica serovar Typhi
gaccaaugacgcuauccgca

SEQ ID NO: 1699933 - RNA, 17 nt, Salmonella enterica enterica serovar Typhi
gaccaagcgucagcaug

SEQ ID NO: 1699934 - RNA, 22 nt, Salmonella enterica enterica serovar Typhi
gaccagcguaccgucucggccu

SEQ ID NO: 1699935 - RNA, 19 nt, Salmonella enterica enterica serovar Typhi
gaccagcugacgacgccag

SEQ ID NO: 1699936 - RNA, 14 nt, Salmonella enterica enterica serovar Typhi
gaccagcgucagcc

SEQ ID NO: 1699937 - RNA, 21 nt, Salmonella enterica enterica serovar Typhi
gaccagcgcaaacaacccggc

SEQ ID NO: 1699938 - RNA, 15 nt, Salmonella enterica enterica serovar Typhi
gaccagccaggcgau

SEQ ID NO: 1699939 - RNA, 14 nt, Salmonella enterica enterica serovar Typhi
gaccagauacuuca

SEQ ID NO: 1699940 - RNA, 11 nt, Salmonella enterica enterica serovar Typhi
gaccagcagca

SEQ ID NO: 1699941 - RNA, 23 nt, Salmonella enterica enterica serovar Typhi
gaccagcaccaucuuuuccggca

SEQ ID NO: 1699942 - RNA, 13 nt, Salmonella enterica enterica serovar Typhi
gaccagcaccugc

SEQ ID NO: 1699943 - RNA, 12 nt, Salmonella enterica enterica serovar Typhi
gaccagcaucag

SEQ ID NO: 1699944 - RNA, 22 nt, Salmonella enterica enterica serovar Typhi
gaccagcugacgacgccagccc

SEQ ID NO: 1699945 - RNA, 13 nt, Salmonella enterica enterica serovar Typhi
gaccaggaucaga

SEQ ID NO: 1699946 - RNA, 15 nt, Salmonella enterica enterica serovar Typhi
gaccaggauggccag

SEQ ID NO: 1699947 - RNA, 16 nt, Salmonella enterica enterica serovar Typhi
gaccaggauggccagc

SEQ ID NO: 1699948 - RNA, 15 nt, Salmonella enterica enterica serovar Typhi
gaccagguacagcuu

SEQ ID NO: 1699949 - RNA, 20 nt, Salmonella enterica enterica serovar Typhi
gaccaguuguaaucggcgcc

SEQ ID NO: 1699950 - RNA, 18 nt, Salmonella enterica enterica serovar Typhi
gaccaguucaccggcggc

SEQ ID NO: 1699951 - RNA, 16 nt, Salmonella enterica enterica serovar Typhi
gaccaguuauucggca

SEQ ID NO: 1699952 - RNA, 14 nt, Salmonella enterica enterica serovar Typhi
gacauuguucuaaa

SEQ ID NO: 1699953 - RNA, 17 nt, Salmonella enterica enterica serovar Typhi
gacauuugcaucaaacu

SEQ ID NO: 1699954 - RNA, 14 nt, Salmonella enterica enterica serovar Typhi
gacauugcgcggcg

SEQ ID NO: 1699955 - RNA, 17 nt, Salmonella enterica enterica serovar Typhi
gacauuauucaccugga

SEQ ID NO: 1699956 - RNA, 19 nt, Salmonella enterica enterica serovar Typhi
gacauggucgaacaucugc

SEQ ID NO: 1699957 - RNA, 21 nt, Salmonella enterica enterica serovar Typhi
gacauggcggucgccauaugu

SEQ ID NO: 1699958 - RNA, 15 nt, Salmonella enterica enterica serovar Typhi
gacauggcgaccggg

SEQ ID NO: 1699959 - RNA, 15 nt, Salmonella enterica enterica serovar Typhi
gacauggaguuccag

SEQ ID NO: 1699960 - RNA, 17 nt, Salmonella enterica enterica serovar Typhi
gacaugcuguugaaacg

SEQ ID NO: 1699961 - RNA, 23 nt, Salmonella enterica enterica serovar Typhi
gacauguccgacgacaagcagaa

SEQ ID NO: 1699962 - RNA, 17 nt, Salmonella enterica enterica serovar Typhi
gacaucgcucccggcac

SEQ ID NO: 1699963 - RNA, 21 nt, Salmonella enterica enterica serovar Typhi
gacauccaugauaaucagcac

SEQ ID NO: 1699964 - RNA, 13 nt, Salmonella enterica enterica serovar Typhi
gacauccccgccg

SEQ ID NO: 1699965 - RNA, 22 nt, Salmonella enterica enterica serovar Typhi
gacaucacguucgcgcauaccu

SEQ ID NO: 1699966 - RNA, 12 nt, Salmonella enterica enterica serovar Typhi
gacaugcagauc

SEQ ID NO: 1699967 - RNA, 14 nt, Salmonella enterica enterica serovar Typhi
gacaugaccgcaca

SEQ ID NO: 1699968 - RNA, 15 nt, Salmonella enterica enterica serovar Typhi
gacaucucaggcaag

SEQ ID NO: 1699969 - RNA, 16 nt, Salmonella enterica enterica serovar Typhi
gacaucguguauacca

SEQ ID NO: 1699970 - RNA, 23 nt, Salmonella enterica enterica serovar Typhi
gacaucgucacaauaugguuauc

SEQ ID NO: 1699971 - RNA, 20 nt, Salmonella enterica enterica serovar Typhi
gacaggugcgcuguggucgu

SEQ ID NO: 1699972 - RNA, 14 nt, Salmonella enterica enterica serovar Typhi
gacaggugaccagg

SEQ ID NO: 1699973 - RNA, 20 nt, Salmonella enterica enterica serovar Typhi
gacaggguuugccagcacca

SEQ ID NO: 1699974 - RNA, 18 nt, Salmonella enterica enterica serovar Typhi
gacaggggggaacagcaa

SEQ ID NO: 1699975 - RNA, 20 nt, Salmonella enterica enterica serovar Typhi
gacaggcggccgcuuacugu

SEQ ID NO: 1699976 - RNA, 16 nt, Salmonella enterica enterica serovar Typhi
gacauaagugcaggcu

SEQ ID NO: 1699977 - RNA, 15 nt, Salmonella enterica enterica serovar Typhi
gacauaguacccucu

SEQ ID NO: 1699978 - RNA, 19 nt, Salmonella enterica enterica serovar Typhi
gacauaguacccucugcac

SEQ ID NO: 1699979 - RNA, 22 nt, Salmonella enterica enterica serovar Typhi
gacauagucgucuauuuccgcu

SEQ ID NO: 1699980 - RNA, 18 nt, Salmonella enterica enterica serovar Typhi
gacauaaacgccucaucc

SEQ ID NO: 1699981 - RNA, 13 nt, Salmonella enterica enterica serovar Typhi
gacaguucccggc

SEQ ID NO: 1699982 - RNA, 12 nt, Salmonella enterica enterica serovar Typhi
gacagugcuaua

SEQ ID NO: 1699983 - RNA, 13 nt, Salmonella enterica enterica serovar Typhi
gacagugaugaau

SEQ ID NO: 1699984 - RNA, 21 nt, Salmonella enterica enterica serovar Typhi
gacuucugcucgguaaaaagu

SEQ ID NO: 1699985 - RNA, 12 nt, Salmonella enterica enterica serovar Typhi
gacuucucccuc

SEQ ID NO: 1699986 - RNA, 13 nt, Salmonella enterica enterica serovar Typhi
gacuucucccucu

SEQ ID NO: 1699987 - RNA, 20 nt, Salmonella enterica enterica serovar Typhi
gacuucacacugugguuucu

SEQ ID NO: 1699988 - RNA, 19 nt, Salmonella enterica enterica serovar Typhi
gacuuauuugcucaguuca

SEQ ID NO: 1699989 - RNA, 18 nt, Salmonella enterica enterica serovar Typhi
gacuucaacgcaggcgaa

SEQ ID NO: 1699990 - RNA, 13 nt, Salmonella enterica enterica serovar Typhi
gacuuauuaaaaa

SEQ ID NO: 1699991 - RNA, 18 nt, Salmonella enterica enterica serovar Typhi
gacuuaucgaccuuuucc

SEQ ID NO: 1699992 - RNA, 20 nt, Salmonella enterica enterica serovar Typhi
gacuuccgcacgcgcgcccu

SEQ ID NO: 1699993 - RNA, 14 nt, Salmonella enterica enterica serovar Typhi
gacuucauuuucca

SEQ ID NO: 1699994 - RNA, 23 nt, Salmonella enterica enterica serovar Typhi
gacuucauuuuccacaauaccgu

SEQ ID NO: 1699995 - RNA, 22 nt, Salmonella enterica enterica serovar Typhi
gacugucugaaggcguaugaau

SEQ ID NO: 1699996 - RNA, 16 nt, Salmonella enterica enterica serovar Typhi
gacugucgaaaccagc

SEQ ID NO: 1699997 - RNA, 18 nt, Salmonella enterica enterica serovar Typhi
gacugucuuguuuuucug

SEQ ID NO: 1699998 - RNA, 22 nt, Salmonella enterica enterica serovar Typhi
gacuguucacgcagcgcaucca

SEQ ID NO: 1699999 - RNA, 17 nt, Salmonella enterica enterica serovar Typhi
gacuuacggaaaaaugu

SEQ ID NO: 1700000 - RNA, 17 nt, Salmonella enterica enterica serovar Typhi
gacuuagcccuggccaa

SEQ ID NO: 1700001 - RNA, 22 nt, Salmonella enterica enterica serovar Typhi
gacuuaggaaugcccagcucag

SEQ ID NO: 1700002 - RNA, 21 nt, Salmonella enterica enterica serovar Typhi
gacuggcgccgucacguucgg

SEQ ID NO: 1700003 - RNA, 19 nt, Salmonella enterica enterica serovar Typhi
gacugggucgauguaguug

SEQ ID NO: 1700004 - RNA, 14 nt, Salmonella enterica enterica serovar Typhi
gacuggucgcccgg

SEQ ID NO: 1700005 - RNA, 20 nt, Salmonella enterica enterica serovar Typhi
gacuguagauaccuacuuua

SEQ ID NO: 1700006 - RNA, 22 nt, Salmonella enterica enterica serovar Typhi
gacuuuaucuuuaccagggaau

SEQ ID NO: 1700007 - RNA, 20 nt, Salmonella enterica enterica serovar Typhi
gacuuuaaacgucaugcugu

SEQ ID NO: 1700008 - RNA, 13 nt, Salmonella enterica enterica serovar Typhi
gacuuuggauaaa

SEQ ID NO: 1700009 - RNA, 22 nt, Salmonella enterica enterica serovar Typhi
gagaaaaacgaccaggaucaga

SEQ ID NO: 1700010 - RNA, 20 nt, Salmonella enterica enterica serovar Typhi
gagaaaucaacgaaaucaga

SEQ ID NO: 1700011 - RNA, 11 nt, Salmonella enterica enterica serovar Typhi
gagaaaucaac

SEQ ID NO: 1700012 - RNA, 23 nt, Salmonella enterica enterica serovar Typhi
gagaaauuuaggucaaaaaagcg

SEQ ID NO: 1700013 - RNA, 16 nt, Salmonella enterica enterica serovar Typhi
gagaacagguaguuac

SEQ ID NO: 1700014 - RNA, 14 nt, Salmonella enterica enterica serovar Typhi
gagaaccugaacaa

SEQ ID NO: 1700015 - RNA, 21 nt, Salmonella enterica enterica serovar Typhi
gagaaaauaacaauauuaaau

SEQ ID NO: 1700016 - RNA, 12 nt, Salmonella enterica enterica serovar Typhi
gagaaaauaccg

SEQ ID NO: 1700017 - RNA, 13 nt, Salmonella enterica enterica serovar Typhi
gagaaacauacug

SEQ ID NO: 1700018 - RNA, 23 nt, Salmonella enterica enterica serovar Typhi
gagaaagcguugccguaggcaac

SEQ ID NO: 1700019 - RNA, 13 nt, Salmonella enterica enterica serovar Typhi
gagacucaaagaa

SEQ ID NO: 1700020 - RNA, 22 nt, Salmonella enterica enterica serovar Typhi
gagacguucauuucuuccagca

SEQ ID NO: 1700021 - RNA, 13 nt, Salmonella enterica enterica serovar Typhi
gagacugauaaug

SEQ ID NO: 1700022 - RNA, 15 nt, Salmonella enterica enterica serovar Typhi
gagacuguuugucuc

SEQ ID NO: 1700023 - RNA, 13 nt, Salmonella enterica enterica serovar Typhi
gagaggaggagau

SEQ ID NO: 1700024 - RNA, 16 nt, Salmonella enterica enterica serovar Typhi
gagagcgggccguggc

SEQ ID NO: 1700025 - RNA, 19 nt, Salmonella enterica enterica serovar Typhi
gagagcguauccagcaccu

SEQ ID NO: 1700026 - RNA, 19 nt, Salmonella enterica enterica serovar Typhi
gagagccuuacaggcgcau

SEQ ID NO: 1700027 - RNA, 19 nt, Salmonella enterica enterica serovar Typhi
gagaggccaccagcgccag

SEQ ID NO: 1700028 - RNA, 13 nt, Salmonella enterica enterica serovar Typhi
gagagcaucaucu

SEQ ID NO: 1700029 - RNA, 20 nt, Salmonella enterica enterica serovar Typhi
gagagcaauggcguggcgcu

SEQ ID NO: 1700030 - RNA, 21 nt, Salmonella enterica enterica serovar Typhi
gagaagccgauggaaguacug

SEQ ID NO: 1700031 - RNA, 18 nt, Salmonella enterica enterica serovar Typhi
gagaauaacgaugaugaa

SEQ ID NO: 1700032 - RNA, 15 nt, Salmonella enterica enterica serovar Typhi
gagaaggucagucca

SEQ ID NO: 1700033 - RNA, 22 nt, Salmonella enterica enterica serovar Typhi
gagaacgguucauccagcagca

SEQ ID NO: 1700034 - RNA, 17 nt, Salmonella enterica enterica serovar Typhi
gagaagaagaauuauua

SEQ ID NO: 1700035 - RNA, 17 nt, Salmonella enterica enterica serovar Typhi
gagaagaauuccgauga

SEQ ID NO: 1700036 - RNA, 20 nt, Salmonella enterica enterica serovar Typhi
gagaagaauuccgaugaaaa

SEQ ID NO: 1700037 - RNA, 15 nt, Salmonella enterica enterica serovar Typhi
gagaauggaugugaa

SEQ ID NO: 1700038 - RNA, 16 nt, Salmonella enterica enterica serovar Typhi
gagaauggccagcaca

SEQ ID NO: 1700039 - RNA, 13 nt, Salmonella enterica enterica serovar Typhi
gagaauuuuuagc

SEQ ID NO: 1700040 - RNA, 17 nt, Salmonella enterica enterica serovar Typhi
gagaaugcgagcaaaac

SEQ ID NO: 1700041 - RNA, 15 nt, Salmonella enterica enterica serovar Typhi
gagaauccuuccagu

SEQ ID NO: 1700042 - RNA, 19 nt, Salmonella enterica enterica serovar Typhi
gagaaucaccuggcagccg

SEQ ID NO: 1700043 - RNA, 17 nt, Salmonella enterica enterica serovar Typhi
gagacaugccgccagac

SEQ ID NO: 1700044 - RNA, 17 nt, Salmonella enterica enterica serovar Typhi
gagacagagaaccugaa

SEQ ID NO: 1700045 - RNA, 21 nt, Salmonella enterica enterica serovar Typhi
gagacagagaaccugaacaau

SEQ ID NO: 1700046 - RNA, 22 nt, Salmonella enterica enterica serovar Typhi
gagacaaauaacuuuccugccu

SEQ ID NO: 1700047 - RNA, 13 nt, Salmonella enterica enterica serovar Typhi
gacucuuguuucu

SEQ ID NO: 1700048 - RNA, 17 nt, Salmonella enterica enterica serovar Typhi
gacucuuuuuucagaau

SEQ ID NO: 1700049 - RNA, 23 nt, Salmonella enterica enterica serovar Typhi
gacucugaagcgggaaagcguaa

SEQ ID NO: 1700050 - RNA, 15 nt, Salmonella enterica enterica serovar Typhi
gacucugacgccggu

SEQ ID NO: 1700051 - RNA, 18 nt, Salmonella enterica enterica serovar Typhi
gacucucaaugcccaucu

SEQ ID NO: 1700052 - RNA, 19 nt, Salmonella enterica enterica serovar Typhi
gacugaaaaucaaaaacau

SEQ ID NO: 1700053 - RNA, 14 nt, Salmonella enterica enterica serovar Typhi
gacugacaaugacg

SEQ ID NO: 1700054 - RNA, 17 nt, Salmonella enterica enterica serovar Typhi
gacugaccagacagauu

SEQ ID NO: 1700055 - RNA, 14 nt, Salmonella enterica enterica serovar Typhi
gacugcacuuccug

SEQ ID NO: 1700056 - RNA, 15 nt, Salmonella enterica enterica serovar Typhi
gacugcacuuccugc

SEQ ID NO: 1700057 - RNA, 16 nt, Salmonella enterica enterica serovar Typhi
gacugcacuuccugcg

SEQ ID NO: 1700058 - RNA, 17 nt, Salmonella enterica enterica serovar Typhi
gacugauuuaucaccca

SEQ ID NO: 1700059 - RNA, 14 nt, Salmonella enterica enterica serovar Typhi
gacugccagguaau

SEQ ID NO: 1700060 - RNA, 12 nt, Salmonella enterica enterica serovar Typhi
gacugccgcaga

SEQ ID NO: 1700061 - RNA, 20 nt, Salmonella enterica enterica serovar Typhi
gacugccguauaauccagcu

SEQ ID NO: 1700062 - RNA, 23 nt, Salmonella enterica enterica serovar Typhi
gacuggcaccacgaccagacugg

SEQ ID NO: 1700063 - RNA, 21 nt, Salmonella enterica enterica serovar Typhi
gacuggcgaccgccaccaucc

SEQ ID NO: 1700064 - RNA, 16 nt, Salmonella enterica enterica serovar Typhi
gacugcggggagcgaa

SEQ ID NO: 1700065 - RNA, 16 nt, Salmonella enterica enterica serovar Typhi
gacucaggccuuuuua

SEQ ID NO: 1700066 - RNA, 12 nt, Salmonella enterica enterica serovar Typhi
gacucacgcagc

SEQ ID NO: 1700067 - RNA, 13 nt, Salmonella enterica enterica serovar Typhi
gacucagccaggu

SEQ ID NO: 1700068 - RNA, 12 nt, Salmonella enterica enterica serovar Typhi
gacucauccagc

SEQ ID NO: 1700069 - RNA, 16 nt, Salmonella enterica enterica serovar Typhi
gacucauccagcaucg

SEQ ID NO: 1700070 - RNA, 16 nt, Salmonella enterica enterica serovar Typhi
gacucauggacaaaaa

SEQ ID NO: 1700071 - RNA, 22 nt, Salmonella enterica enterica serovar Typhi
gacucauggacaaaaaaggaaa

SEQ ID NO: 1700072 - RNA, 18 nt, Salmonella enterica enterica serovar Typhi
gacucauuaaaaaaacau

SEQ ID NO: 1700073 - RNA, 22 nt, Salmonella enterica enterica serovar Typhi
gacuccagcaacgcugcauccu

SEQ ID NO: 1700074 - RNA, 22 nt, Salmonella enterica enterica serovar Typhi
gacuccggauagagaucuuccg

SEQ ID NO: 1700075 - RNA, 19 nt, Salmonella enterica enterica serovar Typhi
gacuccucaaccgacgcga

SEQ ID NO: 1700076 - RNA, 23 nt, Salmonella enterica enterica serovar Typhi
gacucgcuggacauuaagcguaa

SEQ ID NO: 1700077 - RNA, 19 nt, Salmonella enterica enterica serovar Typhi
gacuacgguaaaccaggcc

SEQ ID NO: 1700078 - RNA, 15 nt, Salmonella enterica enterica serovar Typhi
gacuacguucaucag

SEQ ID NO: 1700079 - RNA, 21 nt, Salmonella enterica enterica serovar Typhi
gacuauacccaaaauaauucg

SEQ ID NO: 1700080 - RNA, 17 nt, Salmonella enterica enterica serovar Typhi
gacucacauaacaaaac

SEQ ID NO: 1700081 - RNA, 22 nt, Salmonella enterica enterica serovar Typhi
gacucacauaacaaaaccagca

SEQ ID NO: 1700082 - RNA, 19 nt, Salmonella enterica enterica serovar Typhi
gacuauucgcuaucagaau

SEQ ID NO: 1700083 - RNA, 15 nt, Salmonella enterica enterica serovar Typhi
gacuauugcugagcu

SEQ ID NO: 1700084 - RNA, 16 nt, Salmonella enterica enterica serovar Typhi
gacuauuggaaucgcu

SEQ ID NO: 1700085 - RNA, 18 nt, Salmonella enterica enterica serovar Typhi
gacuauccguccucuuuc

SEQ ID NO: 1700086 - RNA, 18 nt, Salmonella enterica enterica serovar Typhi
gacguuugcguaaagcug

SEQ ID NO: 1700087 - RNA, 20 nt, Salmonella enterica enterica serovar Typhi
gacguuaucucgccaggaac

SEQ ID NO: 1700088 - RNA, 19 nt, Salmonella enterica enterica serovar Typhi
gacguucagcauauccagc

SEQ ID NO: 1700089 - RNA, 15 nt, Salmonella enterica enterica serovar Typhi
gacgucgucaccacg

SEQ ID NO: 1700090 - RNA, 18 nt, Salmonella enterica enterica serovar Typhi
gacgugccuuccaucggc

SEQ ID NO: 1700091 - RNA, 14 nt, Salmonella enterica enterica serovar Typhi
gacgugccggaagc

SEQ ID NO: 1700092 - RNA, 17 nt, Salmonella enterica enterica serovar Typhi
gacguggggguucaagu

SEQ ID NO: 1700093 - RNA, 17 nt, Salmonella enterica enterica serovar Typhi
gacgguaccugaagcca

SEQ ID NO: 1700094 - RNA, 15 nt, Salmonella enterica enterica serovar Typhi
gacggugcucaugac

SEQ ID NO: 1700095 - RNA, 15 nt, Salmonella enterica enterica serovar Typhi
gacgguccuggccag

SEQ ID NO: 1700096 - RNA, 23 nt, Salmonella enterica enterica serovar Typhi
gacguaacgguguuucaucuuca

SEQ ID NO: 1700097 - RNA, 20 nt, Salmonella enterica enterica serovar Typhi
gacguauucaccucccugca

SEQ ID NO: 1700098 - RNA, 12 nt, Salmonella enterica enterica serovar Typhi
gacguacaaaca

SEQ ID NO: 1700099 - RNA, 17 nt, Salmonella enterica enterica serovar Typhi
gacgggcccuggccgca

SEQ ID NO: 1700100 - RNA, 16 nt, Salmonella enterica enterica serovar Typhi
gacgggugcgcccaga

SEQ ID NO: 1700101 - RNA, 23 nt, Salmonella enterica enterica serovar Typhi
gacgggggcgaucagcaggucag

SEQ ID NO: 1700102 - RNA, 21 nt, Salmonella enterica enterica serovar Typhi
gacggguauuacugauaaagu

SEQ ID NO: 1700103 - RNA, 21 nt, Salmonella enterica enterica serovar Typhi
gacgggcguccggcuuaggca

SEQ ID NO: 1700104 - RNA, 21 nt, Salmonella enterica enterica serovar Typhi
gacgggaaaucucccuggcag

SEQ ID NO: 1700105 - RNA, 13 nt, Salmonella enterica enterica serovar Typhi
gacggcugacgca

SEQ ID NO: 1700106 - RNA, 12 nt, Salmonella enterica enterica serovar Typhi
gagcugcugcuu

SEQ ID NO: 1700107 - RNA, 18 nt, Salmonella enterica enterica serovar Typhi
gagcucccgguucgccgc

SEQ ID NO: 1700108 - RNA, 18 nt, Salmonella enterica enterica serovar Typhi
gagcuaaucacccacuuc

SEQ ID NO: 1700109 - RNA, 16 nt, Salmonella enterica enterica serovar Typhi
gagcgugcggcugacg

SEQ ID NO: 1700110 - RNA, 17 nt, Salmonella enterica enterica serovar Typhi
gagcgugaucucauugg

SEQ ID NO: 1700111 - RNA, 18 nt, Salmonella enterica enterica serovar Typhi
gagcgugaucucauugga

SEQ ID NO: 1700112 - RNA, 17 nt, Salmonella enterica enterica serovar Typhi
gagcguccagucgggcg

SEQ ID NO: 1700113 - RNA, 20 nt, Salmonella enterica enterica serovar Typhi
gagcguaaugguggcaaccu

SEQ ID NO: 1700114 - RNA, 19 nt, Salmonella enterica enterica serovar Typhi
gagcggagagagcgcuucc

SEQ ID NO: 1700115 - RNA, 20 nt, Salmonella enterica enterica serovar Typhi
gagcggagagagcgcuucca

SEQ ID NO: 1700116 - RNA, 20 nt, Salmonella enterica enterica serovar Typhi
gagcgggccguggccaggaa

SEQ ID NO: 1700117 - RNA, 17 nt, Salmonella enterica enterica serovar Typhi
gagccuguuccagcugc

SEQ ID NO: 1700118 - RNA, 22 nt, Salmonella enterica enterica serovar Typhi
gagccuuacaggcgcaucagaa

SEQ ID NO: 1700119 - RNA, 17 nt, Salmonella enterica enterica serovar Typhi
gagccgucgcuaucaau

SEQ ID NO: 1700120 - RNA, 21 nt, Salmonella enterica enterica serovar Typhi
gagccuaaaacauuaaucgcc

SEQ ID NO: 1700121 - RNA, 16 nt, Salmonella enterica enterica serovar Typhi
gagcgaauguauaauc

SEQ ID NO: 1700122 - RNA, 15 nt, Salmonella enterica enterica serovar Typhi
gagcgacgcccugcc

SEQ ID NO: 1700123 - RNA, 16 nt, Salmonella enterica enterica serovar Typhi
gagcgacgcccugccc

SEQ ID NO: 1700124 - RNA, 21 nt, Salmonella enterica enterica serovar Typhi
gagcgacgguuuuauccccuu

SEQ ID NO: 1700125 - RNA, 13 nt, Salmonella enterica enterica serovar Typhi
gagcgaaggggcg

SEQ ID NO: 1700126 - RNA, 16 nt, Salmonella enterica enterica serovar Typhi
gagcgaucauaaggga

SEQ ID NO: 1700127 - RNA, 21 nt, Salmonella enterica enterica serovar Typhi
gagcgaucauaagggagcuga

SEQ ID NO: 1700128 - RNA, 20 nt, Salmonella enterica enterica serovar Typhi
gagcgaguacguaaugugaa

SEQ ID NO: 1700129 - RNA, 13 nt, Salmonella enterica enterica serovar Typhi
gagcgccagcccc

SEQ ID NO: 1700130 - RNA, 15 nt, Salmonella enterica enterica serovar Typhi
gagcgcauccggcca

SEQ ID NO: 1700131 - RNA, 14 nt, Salmonella enterica enterica serovar Typhi
gagcgcauccggca

SEQ ID NO: 1700132 - RNA, 15 nt, Salmonella enterica enterica serovar Typhi
gagcgccggcaaagc

SEQ ID NO: 1700133 - RNA, 14 nt, Salmonella enterica enterica serovar Typhi
gagcgcgccgcaca

SEQ ID NO: 1700134 - RNA, 17 nt, Salmonella enterica enterica serovar Typhi
gagcgcgcucugccuuu

SEQ ID NO: 1700135 - RNA, 13 nt, Salmonella enterica enterica serovar Typhi
gagcgcgcuggca

SEQ ID NO: 1700136 - RNA, 22 nt, Salmonella enterica enterica serovar Typhi
gagcgccgcgccuaccagcgcu

SEQ ID NO: 1700137 - RNA, 15 nt, Salmonella enterica enterica serovar Typhi
gagcgcgauaaccgg

SEQ ID NO: 1700138 - RNA, 13 nt, Salmonella enterica enterica serovar Typhi
gagcgcuugcugc

SEQ ID NO: 1700139 - RNA, 18 nt, Salmonella enterica enterica serovar Typhi
gaggccagauucaccacc

SEQ ID NO: 1700140 - RNA, 15 nt, Salmonella enterica enterica serovar Typhi
gaggccaccagcgcc

SEQ ID NO: 1700141 - RNA, 23 nt, Salmonella enterica enterica serovar Typhi
gaggccguuauugucaugcuaaa

SEQ ID NO: 1700142 - RNA, 14 nt, Salmonella enterica enterica serovar Typhi
gaggccuuuugcag

SEQ ID NO: 1700143 - RNA, 20 nt, Salmonella enterica enterica serovar Typhi
gaggcgcuggcuugaccgcu

SEQ ID NO: 1700144 - RNA, 12 nt, Salmonella enterica enterica serovar Typhi
gaggcagcagga

SEQ ID NO: 1700145 - RNA, 23 nt, Salmonella enterica enterica serovar Typhi
gaggcaggggcucuaaaaaggaa

SEQ ID NO: 1700146 - RNA, 13 nt, Salmonella enterica enterica serovar Typhi
gaggcauaaaaaa

SEQ ID NO: 1700147 - RNA, 22 nt, Salmonella enterica enterica serovar Typhi
gaggauauuuauuugcauugua

SEQ ID NO: 1700148 - RNA, 18 nt, Salmonella enterica enterica serovar Typhi
gagcugugguucguucaa

SEQ ID NO: 1700149 - RNA, 18 nt, Salmonella enterica enterica serovar Typhi
gagcuguagcgaagggua

SEQ ID NO: 1700150 - RNA, 15 nt, Salmonella enterica enterica serovar Typhi
gaggacauuaaaguc

SEQ ID NO: 1700151 - RNA, 14 nt, Salmonella enterica enterica serovar Typhi
gagcuuuuuuuugc

SEQ ID NO: 1700152 - RNA, 18 nt, Salmonella enterica enterica serovar Typhi
gaggaaaaagccgccgug

SEQ ID NO: 1700153 - RNA, 16 nt, Salmonella enterica enterica serovar Typhi
gagcuuuuuuuugcau

SEQ ID NO: 1700154 - RNA, 18 nt, Salmonella enterica enterica serovar Typhi
gagcacgcggugccgaug

SEQ ID NO: 1700155 - RNA, 22 nt, Salmonella enterica enterica serovar Typhi
gagcacuuuuuccuccugcgga

SEQ ID NO: 1700156 - RNA, 13 nt, Salmonella enterica enterica serovar Typhi
gagcacugcccag

SEQ ID NO: 1700157 - RNA, 16 nt, Salmonella enterica enterica serovar Typhi
gagcagcaacccugcc

SEQ ID NO: 1700158 - RNA, 15 nt, Salmonella enterica enterica serovar Typhi
gagcaagcgcauugc

SEQ ID NO: 1700159 - RNA, 19 nt, Salmonella enterica enterica serovar Typhi
gagcacaccauaucuuuca

SEQ ID NO: 1700160 - RNA, 20 nt, Salmonella enterica enterica serovar Typhi
gagcaaauacuggaaaaaac

SEQ ID NO: 1700161 - RNA, 19 nt, Salmonella enterica enterica serovar Typhi
gagcaacgccaucagcaaa

SEQ ID NO: 1700162 - RNA, 20 nt, Salmonella enterica enterica serovar Typhi
gagcaacagaaaccauaaac

SEQ ID NO: 1700163 - RNA, 14 nt, Salmonella enterica enterica serovar Typhi
gagaguccagcgcc

SEQ ID NO: 1700164 - RNA, 20 nt, Salmonella enterica enterica serovar Typhi
gagagucgccaggaucgccg

SEQ ID NO: 1700165 - RNA, 13 nt, Salmonella enterica enterica serovar Typhi
gagauagcgaggc

SEQ ID NO: 1700166 - RNA, 15 nt, Salmonella enterica enterica serovar Typhi
gagauagcggugccu

SEQ ID NO: 1700167 - RNA, 20 nt, Salmonella enterica enterica serovar Typhi
gagauaagccgucauaaaau

SEQ ID NO: 1700168 - RNA, 15 nt, Salmonella enterica enterica serovar Typhi
gagauaauuuaugau

SEQ ID NO: 1700169 - RNA, 22 nt, Salmonella enterica enterica serovar Typhi
gagauccgggcuggcaaacagg

SEQ ID NO: 1700170 - RNA, 21 nt, Salmonella enterica enterica serovar Typhi
gagaucgacaaaccacugcug

SEQ ID NO: 1700171 - RNA, 15 nt, Salmonella enterica enterica serovar Typhi
gagaucagcaguugc

SEQ ID NO: 1700172 - RNA, 14 nt, Salmonella enterica enterica serovar Typhi
gagauccauaagau

SEQ ID NO: 1700173 - RNA, 23 nt, Salmonella enterica enterica serovar Typhi
gagauuacugcgugcuggcggcc

SEQ ID NO: 1700174 - RNA, 21 nt, Salmonella enterica enterica serovar Typhi
gagaucguuauuaaacagaca

SEQ ID NO: 1700175 - RNA, 14 nt, Salmonella enterica enterica serovar Typhi
gagaugcaggccaa

SEQ ID NO: 1700176 - RNA, 17 nt, Salmonella enterica enterica serovar Typhi
gagaugcaggccaagca

SEQ ID NO: 1700177 - RNA, 17 nt, Salmonella enterica enterica serovar Typhi
gagcaggacgcgcgcga

SEQ ID NO: 1700178 - RNA, 11 nt, Salmonella enterica enterica serovar Typhi
gagcaggccag

SEQ ID NO: 1700179 - RNA, 16 nt, Salmonella enterica enterica serovar Typhi
gagcaggaaccacauc

SEQ ID NO: 1700180 - RNA, 14 nt, Salmonella enterica enterica serovar Typhi
gagcaggaaaaguc

SEQ ID NO: 1700181 - RNA, 19 nt, Salmonella enterica enterica serovar Typhi
gagcagcgccagcgacaga

SEQ ID NO: 1700182 - RNA, 16 nt, Salmonella enterica enterica serovar Typhi
gagcaguucagcagca

SEQ ID NO: 1700183 - RNA, 15 nt, Salmonella enterica enterica serovar Typhi
gagcaguucagcagc

SEQ ID NO: 1700184 - RNA, 20 nt, Salmonella enterica enterica serovar Typhi
gagcagucguugcgccuguu

SEQ ID NO: 1700185 - RNA, 18 nt, Salmonella enterica enterica serovar Typhi
gagcagugauuuuaucuc

SEQ ID NO: 1700186 - RNA, 18 nt, Salmonella enterica enterica serovar Typhi
gagcagguuacucuucca

SEQ ID NO: 1700187 - RNA, 16 nt, Salmonella enterica enterica serovar Typhi
gagcauuuccgcagcc

SEQ ID NO: 1700188 - RNA, 14 nt, Salmonella enterica enterica serovar Typhi
gagcauuggaaauu

SEQ ID NO: 1700189 - RNA, 23 nt, Salmonella enterica enterica serovar Typhi
gagcauaucgacggucaggcugu

SEQ ID NO: 1700190 - RNA, 15 nt, Salmonella enterica enterica serovar Typhi
gagcauaugcgcugc

SEQ ID NO: 1700191 - RNA, 21 nt, Salmonella enterica enterica serovar Typhi
gagcaguuuuacguggacgcc

SEQ ID NO: 1700192 - RNA, 22 nt, Salmonella enterica enterica serovar Typhi
gagccauaacaacuauuuuucc

SEQ ID NO: 1700193 - RNA, 14 nt, Salmonella enterica enterica serovar Typhi
gagccacuauccag

SEQ ID NO: 1700194 - RNA, 13 nt, Salmonella enterica enterica serovar Typhi
gagcccaguagcc

SEQ ID NO: 1700195 - RNA, 15 nt, Salmonella enterica enterica serovar Typhi
gagccauuaaugcag

SEQ ID NO: 1700196 - RNA, 21 nt, Salmonella enterica enterica serovar Typhi
gagcccugugcgguauugaua

SEQ ID NO: 1700197 - RNA, 15 nt, Salmonella enterica enterica serovar Typhi
gagccgauauccgga

SEQ ID NO: 1700198 - RNA, 13 nt, Salmonella enterica enterica serovar Typhi
gagccgcugcuca

SEQ ID NO: 1700199 - RNA, 23 nt, Salmonella enterica enterica serovar Typhi
gaugugucuauuuauugaagaug

SEQ ID NO: 1700200 - RNA, 22 nt, Salmonella enterica enterica serovar Typhi
gauguugguuaauauaucgcag

SEQ ID NO: 1700201 - RNA, 16 nt, Salmonella enterica enterica serovar Typhi
gauguugauacagaaa

SEQ ID NO: 1700202 - RNA, 16 nt, Salmonella enterica enterica serovar Typhi
gauuagacuucuucca

SEQ ID NO: 1700203 - RNA, 16 nt, Salmonella enterica enterica serovar Typhi
gauuaaucgucauccc

SEQ ID NO: 1700204 - RNA, 20 nt, Salmonella enterica enterica serovar Typhi
gaugugaccuuugugcagga

SEQ ID NO: 1700205 - RNA, 22 nt, Salmonella enterica enterica serovar Typhi
gaugugaccuuugugcaggauc

SEQ ID NO: 1700206 - RNA, 20 nt, Salmonella enterica enterica serovar Typhi
gauggcuaugaagcuggagc

SEQ ID NO: 1700207 - RNA, 19 nt, Salmonella enterica enterica serovar Typhi
gauggcuuugcugucagaa

SEQ ID NO: 1700208 - RNA, 14 nt, Salmonella enterica enterica serovar Typhi
gauucaagcgggug

SEQ ID NO: 1700209 - RNA, 21 nt, Salmonella enterica enterica serovar Typhi
gauucaauauugaacauuuuu

SEQ ID NO: 1700210 - RNA, 17 nt, Salmonella enterica enterica serovar Typhi
gauucaccaacugcuga

SEQ ID NO: 1700211 - RNA, 14 nt, Salmonella enterica enterica serovar Typhi
gauucaccaccacc

SEQ ID NO: 1700212 - RNA, 18 nt, Salmonella enterica enterica serovar Typhi
gauucagcgcaggcaguu

SEQ ID NO: 1700213 - RNA, 20 nt, Salmonella enterica enterica serovar Typhi
gauucaaaaggugagaaaaa

SEQ ID NO: 1700214 - RNA, 22 nt, Salmonella enterica enterica serovar Typhi
gauucaacgcgugauccacagc

SEQ ID NO: 1700215 - RNA, 13 nt, Salmonella enterica enterica serovar Typhi
gauuagccccagc

SEQ ID NO: 1700216 - RNA, 16 nt, Salmonella enterica enterica serovar Typhi
gauuagcucauacgcu

SEQ ID NO: 1700217 - RNA, 17 nt, Salmonella enterica enterica serovar Typhi
gauucaugaucuuuccu

SEQ ID NO: 1700218 - RNA, 14 nt, Salmonella enterica enterica serovar Typhi
gauucgaaccugcg

SEQ ID NO: 1700219 - RNA, 16 nt, Salmonella enterica enterica serovar Typhi
gauuccgucaugguga

SEQ ID NO: 1700220 - RNA, 22 nt, Salmonella enterica enterica serovar Typhi
gauuccggacaacgcaaacugu

SEQ ID NO: 1700221 - RNA, 16 nt, Salmonella enterica enterica serovar Typhi
gauuccccaccaggaa

SEQ ID NO: 1700222 - RNA, 15 nt, Salmonella enterica enterica serovar Typhi
gauuuugagcacugu

SEQ ID NO: 1700223 - RNA, 20 nt, Salmonella enterica enterica serovar Typhi
gauuuucuuauuacaagaaa

SEQ ID NO: 1700224 - RNA, 12 nt, Salmonella enterica enterica serovar Typhi
gcaaaacauggc

SEQ ID NO: 1700225 - RNA, 22 nt, Salmonella enterica enterica serovar Typhi
gauuucggcgcuguuuuccgcu

SEQ ID NO: 1700226 - RNA, 19 nt, Salmonella enterica enterica serovar Typhi
gauuuccagcgaauaauga

SEQ ID NO: 1700227 - RNA, 20 nt, Salmonella enterica enterica serovar Typhi
gauuuguuuuuuauauuuuu

SEQ ID NO: 1700228 - RNA, 16 nt, Salmonella enterica enterica serovar Typhi
gauuuguuucaucgcc

SEQ ID NO: 1700229 - RNA, 12 nt, Salmonella enterica enterica serovar Typhi
gauuuguuaucu

SEQ ID NO: 1700230 - RNA, 23 nt, Salmonella enterica enterica serovar Typhi
gauuugcugcugcucgcuaugaa

SEQ ID NO: 1700231 - RNA, 20 nt, Salmonella enterica enterica serovar Typhi
gauugcccuccagccauaau

SEQ ID NO: 1700232 - RNA, 22 nt, Salmonella enterica enterica serovar Typhi
gauugccgccaucuuuacccug

SEQ ID NO: 1700233 - RNA, 20 nt, Salmonella enterica enterica serovar Typhi
gauugucacaccggcggagu

SEQ ID NO: 1700234 - RNA, 18 nt, Salmonella enterica enterica serovar Typhi
gauugucuuaaauaugaa

SEQ ID NO: 1700235 - RNA, 23 nt, Salmonella enterica enterica serovar Typhi
gauuuagcguuggcgucaucgac

SEQ ID NO: 1700236 - RNA, 21 nt, Salmonella enterica enterica serovar Typhi
gauuuauguaccgucaucgcc

SEQ ID NO: 1700237 - RNA, 22 nt, Salmonella enterica enterica serovar Typhi
gauuucaugcggugcaugaaua

SEQ ID NO: 1700238 - RNA, 24 nt, Salmonella enterica enterica serovar Typhi
gauuucaugcggugcaugaauauc

SEQ ID NO: 1700239 - RNA, 22 nt, Salmonella enterica enterica serovar Typhi
gauuuaucuucucuaucagcgc

SEQ ID NO: 1700240 - RNA, 15 nt, Salmonella enterica enterica serovar Typhi
gauuuagcguaaaua

SEQ ID NO: 1700241 - RNA, 14 nt, Salmonella enterica enterica serovar Typhi
gauucgcccacgga

SEQ ID NO: 1700242 - RNA, 14 nt, Salmonella enterica enterica serovar Typhi
gauucgggccgcac

SEQ ID NO: 1700243 - RNA, 14 nt, Salmonella enterica enterica serovar Typhi
gauucggacucaua

SEQ ID NO: 1700244 - RNA, 22 nt, Salmonella enterica enterica serovar Typhi
gauugcauaucgcuaaaccaaa

SEQ ID NO: 1700245 - RNA, 22 nt, Salmonella enterica enterica serovar Typhi
gauucuaucuguuuuaauuccu

SEQ ID NO: 1700246 - RNA, 13 nt, Salmonella enterica enterica serovar Typhi
gauucuacugguu

SEQ ID NO: 1700247 - RNA, 13 nt, Salmonella enterica enterica serovar Typhi
gaugcgccuguaa

SEQ ID NO: 1700248 - RNA, 16 nt, Salmonella enterica enterica serovar Typhi
gaugccgugaggcuga

SEQ ID NO: 1700249 - RNA, 21 nt, Salmonella enterica enterica serovar Typhi
gaugcggcaaaaauccuucuu

SEQ ID NO: 1700250 - RNA, 22 nt, Salmonella enterica enterica serovar Typhi
gaugcgcguuuagcgccagcag

SEQ ID NO: 1700251 - RNA, 17 nt, Salmonella enterica enterica serovar Typhi
gaugccgcuucgccacu

SEQ ID NO: 1700252 - RNA, 21 nt, Salmonella enterica enterica serovar Typhi
gaugccccaucucuuucagaa

SEQ ID NO: 1700253 - RNA, 21 nt, Salmonella enterica enterica serovar Typhi
gaugcccaccugaaaaagggu

SEQ ID NO: 1700254 - RNA, 17 nt, Salmonella enterica enterica serovar Typhi
gaugcugaauagccagc

SEQ ID NO: 1700255 - RNA, 18 nt, Salmonella enterica enterica serovar Typhi
gaugcugaauagccagcc

SEQ ID NO: 1700256 - RNA, 22 nt, Salmonella enterica enterica serovar Typhi
gaugcucgccgucggcagacug

SEQ ID NO: 1700257 - RNA, 18 nt, Salmonella enterica enterica serovar Typhi
gaugcugauguccgcagc

SEQ ID NO: 1700258 - RNA, 19 nt, Salmonella enterica enterica serovar Typhi
gaugcugauguccgcagcc

SEQ ID NO: 1700259 - RNA, 18 nt, Salmonella enterica enterica serovar Typhi
gaugcugauuaaugauuu

SEQ ID NO: 1700260 - RNA, 18 nt, Salmonella enterica enterica serovar Typhi
gaugcugccugccugaag

SEQ ID NO: 1700261 - RNA, 21 nt, Salmonella enterica enterica serovar Typhi
gaugcuaucgcggauaagccc

SEQ ID NO: 1700262 - RNA, 23 nt, Salmonella enterica enterica serovar Typhi
gaugcuaaccucuauaguaaauu

SEQ ID NO: 1700263 - RNA, 17 nt, Salmonella enterica enterica serovar Typhi
gauggccaaauaaccca

SEQ ID NO: 1700264 - RNA, 21 nt, Salmonella enterica enterica serovar Typhi
gaugcugcgcauccgcggcgc

SEQ ID NO: 1700265 - RNA, 16 nt, Salmonella enterica enterica serovar Typhi
gauggccagcaccagc

SEQ ID NO: 1700266 - RNA, 17 nt, Salmonella enterica enterica serovar Typhi
gauggcgucacauggcg

SEQ ID NO: 1700267 - RNA, 21 nt, Salmonella enterica enterica serovar Typhi
gauggcguaauuaaccgcgcc

SEQ ID NO: 1700268 - RNA, 16 nt, Salmonella enterica enterica serovar Typhi
gaugcaccuuucuccu

SEQ ID NO: 1700269 - RNA, 13 nt, Salmonella enterica enterica serovar Typhi
gaugcaaauguca

SEQ ID NO: 1700270 - RNA, 14 nt, Salmonella enterica enterica serovar Typhi
gaugauguacaggu

SEQ ID NO: 1700271 - RNA, 22 nt, Salmonella enterica enterica serovar Typhi
gaugaugcguuuguuggagauc

SEQ ID NO: 1700272 - RNA, 24 nt, Salmonella enterica enterica serovar Typhi
gaugauagccguugucauggcgcc

SEQ ID NO: 1700273 - RNA, 19 nt, Salmonella enterica enterica serovar Typhi
gaugauuggccuccaccgu

SEQ ID NO: 1700274 - RNA, 21 nt, Salmonella enterica enterica serovar Typhi
gaugauguuuaccugcaaaaa

SEQ ID NO: 1700275 - RNA, 16 nt, Salmonella enterica enterica serovar Typhi
gaugauuauuguuaaa

SEQ ID NO: 1700276 - RNA, 13 nt, Salmonella enterica enterica serovar Typhi
gaugauucacccu

SEQ ID NO: 1700277 - RNA, 22 nt, Salmonella enterica enterica serovar Typhi
gaugaggaccguuugugccggg

SEQ ID NO: 1700278 - RNA, 16 nt, Salmonella enterica enterica serovar Typhi
gaugacggcaggggcg

SEQ ID NO: 1700279 - RNA, 17 nt, Salmonella enterica enterica serovar Typhi
gaugaguauauagcgcu

SEQ ID NO: 1700280 - RNA, 19 nt, Salmonella enterica enterica serovar Typhi
gaugaggcgcagccgccau

SEQ ID NO: 1700281 - RNA, 23 nt, Salmonella enterica enterica serovar Typhi
gaugaacucuaugcaaaagaaaa

SEQ ID NO: 1700282 - RNA, 19 nt, Salmonella enterica enterica serovar Typhi
gaucugcgcaacauucugc

SEQ ID NO: 1700283 - RNA, 15 nt, Salmonella enterica enterica serovar Typhi
gaucuacaaucgucu

SEQ ID NO: 1700284 - RNA, 19 nt, Salmonella enterica enterica serovar Typhi
gauccccaacgacagcacu

SEQ ID NO: 1700285 - RNA, 13 nt, Salmonella enterica enterica serovar Typhi
gaucccccagaau

SEQ ID NO: 1700286 - RNA, 11 nt, Salmonella enterica enterica serovar Typhi
gaucccaccag

SEQ ID NO: 1700287 - RNA, 16 nt, Salmonella enterica enterica serovar Typhi
gaucccaggccggcau

SEQ ID NO: 1700288 - RNA, 14 nt, Salmonella enterica enterica serovar Typhi
gaucuaaagccagu

SEQ ID NO: 1700289 - RNA, 17 nt, Salmonella enterica enterica serovar Typhi
gaucuaaagccaguuuc

SEQ ID NO: 1700290 - RNA, 16 nt, Salmonella enterica enterica serovar Typhi
gaucccgacucugacg

SEQ ID NO: 1700291 - RNA, 22 nt, Salmonella enterica enterica serovar Typhi
gaugaacgacgcugauuugcca

SEQ ID NO: 1700292 - RNA, 22 nt, Salmonella enterica enterica serovar Typhi
gaugaaacaguccggcgaaaaa

SEQ ID NO: 1700293 - RNA, 20 nt, Salmonella enterica enterica serovar Typhi
gaugaaaaguacgcaaacag

SEQ ID NO: 1700294 - RNA, 23 nt, Salmonella enterica enterica serovar Typhi
gaugaaacugcauaucgccgcuu

SEQ ID NO: 1700295 - RNA, 22 nt, Salmonella enterica enterica serovar Typhi
gaugaaauaaacgaccacucuu

SEQ ID NO: 1700296 - RNA, 21 nt, Salmonella enterica enterica serovar Typhi
gaucuuuccuuuuucaggcac

SEQ ID NO: 1700297 - RNA, 14 nt, Salmonella enterica enterica serovar Typhi
gaucuuuuugcucc

SEQ ID NO: 1700298 - RNA, 23 nt, Salmonella enterica enterica serovar Typhi
gaucuuugccgcgcggauucucc

SEQ ID NO: 1700299 - RNA, 13 nt, Salmonella enterica enterica serovar Typhi
gaugaaaaagagg

SEQ ID NO: 1700300 - RNA, 12 nt, Salmonella enterica enterica serovar Typhi
gaucuuccacua

SEQ ID NO: 1700301 - RNA, 12 nt, Salmonella enterica enterica serovar Typhi
gaucuuccugcg

SEQ ID NO: 1700302 - RNA, 12 nt, Salmonella enterica enterica serovar Typhi
gaucuucauccc

SEQ ID NO: 1700303 - RNA, 18 nt, Salmonella enterica enterica serovar Typhi
gaucugcuuaugaucgcc

SEQ ID NO: 1700304 - RNA, 20 nt, Salmonella enterica enterica serovar Typhi
gaucugcuugagcaggcaga

SEQ ID NO: 1700305 - RNA, 15 nt, Salmonella enterica enterica serovar Typhi
gaucuggccgucugg

SEQ ID NO: 1700306 - RNA, 21 nt, Salmonella enterica enterica serovar Typhi
gaucaccugaaugcaaagaag

SEQ ID NO: 1700307 - RNA, 18 nt, Salmonella enterica enterica serovar Typhi
gaucacccacaucagcgg

SEQ ID NO: 1700308 - RNA, 13 nt, Salmonella enterica enterica serovar Typhi
gaucaaucacgcc

SEQ ID NO: 1700309 - RNA, 14 nt, Salmonella enterica enterica serovar Typhi
gaucaauuugccuu

SEQ ID NO: 1700310 - RNA, 21 nt, Salmonella enterica enterica serovar Typhi
gauauagcugcgauccagguc

SEQ ID NO: 1700311 - RNA, 21 nt, Salmonella enterica enterica serovar Typhi
gauauagcaacguccgcagcc

SEQ ID NO: 1700312 - RNA, 14 nt, Salmonella enterica enterica serovar Typhi
gauauauuuuccgu

SEQ ID NO: 1700313 - RNA, 13 nt, Salmonella enterica enterica serovar Typhi
gauauaugcaaaa

SEQ ID NO: 1700314 - RNA, 21 nt, Salmonella enterica enterica serovar Typhi
gauauuuuguuuuaaauucaa

SEQ ID NO: 1700315 - RNA, 19 nt, Salmonella enterica enterica serovar Typhi
gauauuucgccuaucaugc

SEQ ID NO: 1700316 - RNA, 18 nt, Salmonella enterica enterica serovar Typhi
gauauucccguuccagcu

SEQ ID NO: 1700317 - RNA, 15 nt, Salmonella enterica enterica serovar Typhi
gauauuccauacagu

SEQ ID NO: 1700318 - RNA, 15 nt, Salmonella enterica enterica serovar Typhi
gauauucgccugucu

SEQ ID NO: 1700319 - RNA, 20 nt, Salmonella enterica enterica serovar Typhi
gauccaucgguucucugcca

SEQ ID NO: 1700320 - RNA, 21 nt, Salmonella enterica enterica serovar Typhi
gauccaucgguucucugccau

SEQ ID NO: 1700321 - RNA, 16 nt, Salmonella enterica enterica serovar Typhi
gauccaggucuuccgc

SEQ ID NO: 1700322 - RNA, 13 nt, Salmonella enterica enterica serovar Typhi
gauccagcgggcc

SEQ ID NO: 1700323 - RNA, 13 nt, Salmonella enterica enterica serovar Typhi
gauccagcucuuc

SEQ ID NO: 1700324 - RNA, 19 nt, Salmonella enterica enterica serovar Typhi
gaucaucccgagauuguca

SEQ ID NO: 1700325 - RNA, 17 nt, Salmonella enterica enterica serovar Typhi
gaucaugaaaaauauaa

SEQ ID NO: 1700326 - RNA, 20 nt, Salmonella enterica enterica serovar Typhi
gaucaucuucacuucacaaa

SEQ ID NO: 1700327 - RNA, 12 nt, Salmonella enterica enterica serovar Typhi
gaucaucuuuua

SEQ ID NO: 1700328 - RNA, 21 nt, Salmonella enterica enterica serovar Typhi
gaucacuuccgccaccacgcc

SEQ ID NO: 1700329 - RNA, 12 nt, Salmonella enterica enterica serovar Typhi
gaucacuuguuu

SEQ ID NO: 1700330 - RNA, 19 nt, Salmonella enterica enterica serovar Typhi
gaucagacuuuggauaaag

SEQ ID NO: 1700331 - RNA, 19 nt, Salmonella enterica enterica serovar Typhi
gaucagacgcaucaggaac

SEQ ID NO: 1700332 - RNA, 15 nt, Salmonella enterica enterica serovar Typhi
gaucagaccaucggc

SEQ ID NO: 1700333 - RNA, 20 nt, Salmonella enterica enterica serovar Typhi
gaucacuaccgccaucaaac

SEQ ID NO: 1700334 - RNA, 14 nt, Salmonella enterica enterica serovar Typhi
gaucacggugguga

SEQ ID NO: 1700335 - RNA, 19 nt, Salmonella enterica enterica serovar Typhi
gaucacgccguccagcacc

SEQ ID NO: 1700336 - RNA, 20 nt, Salmonella enterica enterica serovar Typhi
gaucagauauuccagcgaca

SEQ ID NO: 1700337 - RNA, 15 nt, Salmonella enterica enterica serovar Typhi
gaucagcagaacaaa

SEQ ID NO: 1700338 - RNA, 21 nt, Salmonella enterica enterica serovar Typhi
gaucagcaccacgcccggauc

SEQ ID NO: 1700339 - RNA, 22 nt, Salmonella enterica enterica serovar Typhi
gauaggcgcgucauaaccgcag

SEQ ID NO: 1700340 - RNA, 23 nt, Salmonella enterica enterica serovar Typhi
gauagcuuguuguuuauccugca

SEQ ID NO: 1700341 - RNA, 14 nt, Salmonella enterica enterica serovar Typhi
gauagggcagcagu

SEQ ID NO: 1700342 - RNA, 15 nt, Salmonella enterica enterica serovar Typhi
gauagggcagcaguu

SEQ ID NO: 1700343 - RNA, 16 nt, Salmonella enterica enterica serovar Typhi
gauagggcagcaguuc

SEQ ID NO: 1700344 - RNA, 14 nt, Salmonella enterica enterica serovar Typhi
gauagcgauuuuug

SEQ ID NO: 1700345 - RNA, 16 nt, Salmonella enterica enterica serovar Typhi
gauagcgagcaagacu

SEQ ID NO: 1700346 - RNA, 18 nt, Salmonella enterica enterica serovar Typhi
gauagcgcagcacgguaa

SEQ ID NO: 1700347 - RNA, 19 nt, Salmonella enterica enterica serovar Typhi
gauagcgccauggagaaac

SEQ ID NO: 1700348 - RNA, 18 nt, Salmonella enterica enterica serovar Typhi
gauagcgcggaauaucaa

SEQ ID NO: 1700349 - RNA, 15 nt, Salmonella enterica enterica serovar Typhi
gauagcgucaacgcu

SEQ ID NO: 1700350 - RNA, 22 nt, Salmonella enterica enterica serovar Typhi
gauagucgcgauucgggccgca

SEQ ID NO: 1700351 - RNA, 12 nt, Salmonella enterica enterica serovar Typhi
gauagugcgugu

SEQ ID NO: 1700352 - RNA, 19 nt, Salmonella enterica enterica serovar Typhi
gauagugcugcgcaaauac

SEQ ID NO: 1700353 - RNA, 20 nt, Salmonella enterica enterica serovar Typhi
gauagugucgccauaaauca

SEQ ID NO: 1700354 - RNA, 19 nt, Salmonella enterica enterica serovar Typhi
gauaguguucgcggcuggu

SEQ ID NO: 1700355 - RNA, 16 nt, Salmonella enterica enterica serovar Typhi
gauaguuugccagaga

SEQ ID NO: 1700356 - RNA, 22 nt, Salmonella enterica enterica serovar Typhi
gauauaaaacgggccacugcug

SEQ ID NO: 1700357 - RNA, 20 nt, Salmonella enterica enterica serovar Typhi
gauauaauuuuauuauauuu

SEQ ID NO: 1700358 - RNA, 23 nt, Salmonella enterica enterica serovar Typhi
gauauagaguccagccauaauca

SEQ ID NO: 1700359 - RNA, 16 nt, Salmonella enterica enterica serovar Typhi
gauauaacccaguuca

SEQ ID NO: 1700360 - RNA, 17 nt, Salmonella enterica enterica serovar Typhi
gauauaacccucauccc

SEQ ID NO: 1700361 - RNA, 13 nt, Salmonella enterica enterica serovar Typhi
gauauaaagguua

SEQ ID NO: 1700362 - RNA, 21 nt, Salmonella enterica enterica serovar Typhi
gauaccguaauaaguaucagc

SEQ ID NO: 1700363 - RNA, 14 nt, Salmonella enterica enterica serovar Typhi
gauaccggccgccc

SEQ ID NO: 1700364 - RNA, 21 nt, Salmonella enterica enterica serovar Typhi
gauaccggcgcagcaucugcg

SEQ ID NO: 1700365 - RNA, 14 nt, Salmonella enterica enterica serovar Typhi
gauaccgcgccagc

SEQ ID NO: 1700366 - RNA, 22 nt, Salmonella enterica enterica serovar Typhi
gauaagguguuuacgccgccau

SEQ ID NO: 1700367 - RNA, 14 nt, Salmonella enterica enterica serovar Typhi
gauaccgccagccc

SEQ ID NO: 1700368 - RNA, 23 nt, Salmonella enterica enterica serovar Typhi
gauaaggcggagccgccauccgg

SEQ ID NO: 1700369 - RNA, 23 nt, Salmonella enterica enterica serovar Typhi
gauaaggccacgccgccauccgg

SEQ ID NO: 1700370 - RNA, 22 nt, Salmonella enterica enterica serovar Typhi
gauaagguaacgcgaaaaaaga

SEQ ID NO: 1700371 - RNA, 16 nt, Salmonella enterica enterica serovar Typhi
gauaaggcgugagcca

SEQ ID NO: 1700372 - RNA, 21 nt, Salmonella enterica enterica serovar Typhi
gauaagccugugcgccugcug

SEQ ID NO: 1700373 - RNA, 21 nt, Salmonella enterica enterica serovar Typhi
gauaagcgcagcgccaucagg

SEQ ID NO: 1700374 - RNA, 14 nt, Salmonella enterica enterica serovar Typhi
gauaagcacaugac

SEQ ID NO: 1700375 - RNA, 14 nt, Salmonella enterica enterica serovar Typhi
gauaagcacaggcc

SEQ ID NO: 1700376 - RNA, 14 nt, Salmonella enterica enterica serovar Typhi
gauacgucaucaug

SEQ ID NO: 1700377 - RNA, 18 nt, Salmonella enterica enterica serovar Typhi
gauacucagccccaggcc

SEQ ID NO: 1700378 - RNA, 17 nt, Salmonella enterica enterica serovar Typhi
gauacguuuaaaaugaa

SEQ ID NO: 1700379 - RNA, 19 nt, Salmonella enterica enterica serovar Typhi
gauagagaguuccuccugg

SEQ ID NO: 1700380 - RNA, 21 nt, Salmonella enterica enterica serovar Typhi
gauagacagcaccaucaugca

SEQ ID NO: 1700381 - RNA, 22 nt, Salmonella enterica enterica serovar Typhi
gaggggcuuugugccgcacaga

SEQ ID NO: 1700382 - RNA, 20 nt, Salmonella enterica enterica serovar Typhi
gagggggaggugcugguggu

SEQ ID NO: 1700383 - RNA, 20 nt, Salmonella enterica enterica serovar Typhi
gagggcgcgccguugaaauc

SEQ ID NO: 1700384 - RNA, 17 nt, Salmonella enterica enterica serovar Typhi
gagggcgaacuggcggu

SEQ ID NO: 1700385 - RNA, 21 nt, Salmonella enterica enterica serovar Typhi
gagggagguucgccucccuca

SEQ ID NO: 1700386 - RNA, 14 nt, Salmonella enterica enterica serovar Typhi
gaggcuaagccaga

SEQ ID NO: 1700387 - RNA, 13 nt, Salmonella enterica enterica serovar Typhi
gaggcguuuccag

SEQ ID NO: 1700388 - RNA, 20 nt, Salmonella enterica enterica serovar Typhi
gaggcuaauuaucugccagc

SEQ ID NO: 1700389 - RNA, 14 nt, Salmonella enterica enterica serovar Typhi
gaggcuacccagac

SEQ ID NO: 1700390 - RNA, 22 nt, Salmonella enterica enterica serovar Typhi
gaggcguugcuccagcagcgcc

SEQ ID NO: 1700391 - RNA, 20 nt, Salmonella enterica enterica serovar Typhi
gaggcguucccgaaaugggc

SEQ ID NO: 1700392 - RNA, 16 nt, Salmonella enterica enterica serovar Typhi
gaggugaauaaauccu

SEQ ID NO: 1700393 - RNA, 15 nt, Salmonella enterica enterica serovar Typhi
gaggugcucucccag

SEQ ID NO: 1700394 - RNA, 20 nt, Salmonella enterica enterica serovar Typhi
gaggugcucucccagcugag

SEQ ID NO: 1700395 - RNA, 19 nt, Salmonella enterica enterica serovar Typhi
gagguaguccugcucaugc

SEQ ID NO: 1700396 - RNA, 16 nt, Salmonella enterica enterica serovar Typhi
gaggucauuauucagg

SEQ ID NO: 1700397 - RNA, 23 nt, Salmonella enterica enterica serovar Typhi
gaggucugcauucaggccucugc

SEQ ID NO: 1700398 - RNA, 15 nt, Salmonella enterica enterica serovar Typhi
gaguaaagccugccc

SEQ ID NO: 1700399 - RNA, 18 nt, Salmonella enterica enterica serovar Typhi
gagguucccgccgccauu

SEQ ID NO: 1700400 - RNA, 18 nt, Salmonella enterica enterica serovar Typhi
gagguuucagcaccucca

SEQ ID NO: 1700401 - RNA, 13 nt, Salmonella enterica enterica serovar Typhi
gagguuucuucau

SEQ ID NO: 1700402 - RNA, 16 nt, Salmonella enterica enterica serovar Typhi
gagguuucuucaucaa

SEQ ID NO: 1700403 - RNA, 20 nt, Salmonella enterica enterica serovar Typhi
gaguaaucacuaacugacca

SEQ ID NO: 1700404 - RNA, 20 nt, Salmonella enterica enterica serovar Typhi
gaguaauguucaguuuuucc

SEQ ID NO: 1700405 - RNA, 23 nt, Salmonella enterica enterica serovar Typhi
gaguaauguucaguuuuuccagc

SEQ ID NO: 1700406 - RNA, 17 nt, Salmonella enterica enterica serovar Typhi
gaguaacgggcagcggc

SEQ ID NO: 1700407 - RNA, 22 nt, Salmonella enterica enterica serovar Typhi
gaguaagcccaaaggaaagguc

SEQ ID NO: 1700408 - RNA, 19 nt, Salmonella enterica enterica serovar Typhi
gaguaauaacaaaaaacau

SEQ ID NO: 1700409 - RNA, 19 nt, Salmonella enterica enterica serovar Typhi
gauaagaaguaaacagaau

SEQ ID NO: 1700410 - RNA, 13 nt, Salmonella enterica enterica serovar Typhi
gauaagagaaaau

SEQ ID NO: 1700411 - RNA, 15 nt, Salmonella enterica enterica serovar Typhi
gauaagagaaaauac

SEQ ID NO: 1700412 - RNA, 23 nt, Salmonella enterica enterica serovar Typhi
gauaacuuccuuugccuuucuua

SEQ ID NO: 1700413 - RNA, 23 nt, Salmonella enterica enterica serovar Typhi
gauaacugaagguuuuucccgga

SEQ ID NO: 1700414 - RNA, 13 nt, Salmonella enterica enterica serovar Typhi
gauaacucuucau

SEQ ID NO: 1700415 - RNA, 20 nt, Salmonella enterica enterica serovar Typhi
gauaacugaagguuuuuccc

SEQ ID NO: 1700416 - RNA, 16 nt, Salmonella enterica enterica serovar Typhi
gauaaccgcccgcggc

SEQ ID NO: 1700417 - RNA, 12 nt, Salmonella enterica enterica serovar Typhi
gauaaccagguc

SEQ ID NO: 1700418 - RNA, 20 nt, Salmonella enterica enterica serovar Typhi
gauaacaccagcgauccaga

SEQ ID NO: 1700419 - RNA, 20 nt, Salmonella enterica enterica serovar Typhi
gauaacaccgcauggcuggc

SEQ ID NO: 1700420 - RNA, 19 nt, Salmonella enterica enterica serovar Typhi
gauaaacgcgucuucauca

SEQ ID NO: 1700421 - RNA, 21 nt, Salmonella enterica enterica serovar Typhi
gauaaacccguaaagcauucc

SEQ ID NO: 1700422 - RNA, 18 nt, Salmonella enterica enterica serovar Typhi
gauaaacagguaaaacaa

SEQ ID NO: 1700423 - RNA, 16 nt, Salmonella enterica enterica serovar Typhi
gauaaacaccggaauu

SEQ ID NO: 1700424 - RNA, 11 nt, Salmonella enterica enterica serovar Typhi
gauaaaaaaag

SEQ ID NO: 1700425 - RNA, 10 nt, Salmonella enterica enterica serovar Typhi
gaguuuuaac

SEQ ID NO: 1700426 - RNA, 19 nt, Salmonella enterica enterica serovar Typhi
gaguccccucaaacaggcu

SEQ ID NO: 1700427 - RNA, 12 nt, Salmonella enterica enterica serovar Typhi
gaguagauguag

SEQ ID NO: 1700428 - RNA, 19 nt, Salmonella enterica enterica serovar Typhi
gaguagcugagcgucaggc

SEQ ID NO: 1700429 - RNA, 21 nt, Salmonella enterica enterica serovar Typhi
gagucgacugguaggccugau

SEQ ID NO: 1700430 - RNA, 18 nt, Salmonella enterica enterica serovar Typhi
gagucgauagaucgccac

SEQ ID NO: 1700431 - RNA, 14 nt, Salmonella enterica enterica serovar Typhi
gagugaaaugguug

SEQ ID NO: 1700432 - RNA, 23 nt, Salmonella enterica enterica serovar Typhi
gaguugcuuaaaagcggcaaggg

SEQ ID NO: 1700433 - RNA, 23 nt, Salmonella enterica enterica serovar Typhi
gaguuggcauucgaauccuccug

SEQ ID NO: 1700434 - RNA, 17 nt, Salmonella enterica enterica serovar Typhi
gaguggcgaaauuggua

SEQ ID NO: 1700435 - RNA, 16 nt, Salmonella enterica enterica serovar Typhi
gcagaauuuauuucug

SEQ ID NO: 1700436 - RNA, 19 nt, Salmonella enterica enterica serovar Typhi
gcagaauuaacucaucaca

SEQ ID NO: 1700437 - RNA, 19 nt, Salmonella enterica enterica serovar Typhi
gcagacaauuuucuucaug

SEQ ID NO: 1700438 - RNA, 15 nt, Salmonella enterica enterica serovar Typhi
gcagacacugccacc

SEQ ID NO: 1700439 - RNA, 17 nt, Salmonella enterica enterica serovar Typhi
gcagacauauuuucucu

SEQ ID NO: 1700440 - RNA, 19 nt, Salmonella enterica enterica serovar Typhi
gcagaccggcagccugccg

SEQ ID NO: 1700441 - RNA, 17 nt, Salmonella enterica enterica serovar Typhi
gcagaccggaugauggc

SEQ ID NO: 1700442 - RNA, 17 nt, Salmonella enterica enterica serovar Typhi
gcagaccggcagccugc

SEQ ID NO: 1700443 - RNA, 13 nt, Salmonella enterica enterica serovar Typhi
gcagacgccgcgg

SEQ ID NO: 1700444 - RNA, 14 nt, Salmonella enterica enterica serovar Typhi
gcagagaucaggag

SEQ ID NO: 1700445 - RNA, 19 nt, Salmonella enterica enterica serovar Typhi
gcagacugguaaccuguuc

SEQ ID NO: 1700446 - RNA, 13 nt, Salmonella enterica enterica serovar Typhi
gcagacuauaggu

SEQ ID NO: 1700447 - RNA, 18 nt, Salmonella enterica enterica serovar Typhi
gcagacucauggacaaaa

SEQ ID NO: 1700448 - RNA, 21 nt, Salmonella enterica enterica serovar Typhi
gcagacugguaaccuguuccu

SEQ ID NO: 1700449 - RNA, 22 nt, Salmonella enterica enterica serovar Typhi
gcagaguaugcugcuaaagcac

SEQ ID NO: 1700450 - RNA, 23 nt, Salmonella enterica enterica serovar Typhi
gcagagcgaacaguacggucagg

SEQ ID NO: 1700451 - RNA, 13 nt, Salmonella enterica enterica serovar Typhi
gcagagcccagcg

SEQ ID NO: 1700452 - RNA, 14 nt, Salmonella enterica enterica serovar Typhi
gcagagccggaacc

SEQ ID NO: 1700453 - RNA, 14 nt, Salmonella enterica enterica serovar Typhi
gcagagugagcagg

SEQ ID NO: 1700454 - RNA, 16 nt, Salmonella enterica enterica serovar Typhi
gcacuuuugccaggcg

SEQ ID NO: 1700455 - RNA, 16 nt, Salmonella enterica enterica serovar Typhi
gcagaaaaaucagcau

SEQ ID NO: 1700456 - RNA, 18 nt, Salmonella enterica enterica serovar Typhi
gcagaacaaacagaccgc

SEQ ID NO: 1700457 - RNA, 22 nt, Salmonella enterica enterica serovar Typhi
gcagaacaaacagaccgccaug

SEQ ID NO: 1700458 - RNA, 15 nt, Salmonella enterica enterica serovar Typhi
gcagaaaggugaaaa

SEQ ID NO: 1700459 - RNA, 15 nt, Salmonella enterica enterica serovar Typhi
gcagaagacagaagc

SEQ ID NO: 1700460 - RNA, 15 nt, Salmonella enterica enterica serovar Typhi
gcagaacggcgacgg

SEQ ID NO: 1700461 - RNA, 18 nt, Salmonella enterica enterica serovar Typhi
gcagaaucauuaauacac

SEQ ID NO: 1700462 - RNA, 19 nt, Salmonella enterica enterica serovar Typhi
gcagaaucaggcacaaccc

SEQ ID NO: 1700463 - RNA, 16 nt, Salmonella enterica enterica serovar Typhi
gcacuuucauugccgu

SEQ ID NO: 1700464 - RNA, 16 nt, Salmonella enterica enterica serovar Typhi
gcacuuucagaccacu

SEQ ID NO: 1700465 - RNA, 12 nt, Salmonella enterica enterica serovar Typhi
gcacuuucauug

SEQ ID NO: 1700466 - RNA, 15 nt, Salmonella enterica enterica serovar Typhi
gcacuuuuccagcca

SEQ ID NO: 1700467 - RNA, 18 nt, Salmonella enterica enterica serovar Typhi
gcacgcuaaagcgcuggc

SEQ ID NO: 1700468 - RNA, 17 nt, Salmonella enterica enterica serovar Typhi
gcacuuccucucccacu

SEQ ID NO: 1700469 - RNA, 17 nt, Salmonella enterica enterica serovar Typhi
gcacuugagaaauuauu

SEQ ID NO: 1700470 - RNA, 13 nt, Salmonella enterica enterica serovar Typhi
gcagccacgccga

SEQ ID NO: 1700471 - RNA, 23 nt, Salmonella enterica enterica serovar Typhi
gcagccagaaaaagggaaaagcc

SEQ ID NO: 1700472 - RNA, 13 nt, Salmonella enterica enterica serovar Typhi
gcagccacucccg

SEQ ID NO: 1700473 - RNA, 14 nt, Salmonella enterica enterica serovar Typhi
gcagccccagcgcc

SEQ ID NO: 1700474 - RNA, 23 nt, Salmonella enterica enterica serovar Typhi
gcagccccaguugguuguagcac

SEQ ID NO: 1700475 - RNA, 20 nt, Salmonella enterica enterica serovar Typhi
gcagccccauuugccgugcc

SEQ ID NO: 1700476 - RNA, 21 nt, Salmonella enterica enterica serovar Typhi
gcagccaggcaaagccccagu

SEQ ID NO: 1700477 - RNA, 13 nt, Salmonella enterica enterica serovar Typhi
gcagccaggccau

SEQ ID NO: 1700478 - RNA, 19 nt, Salmonella enterica enterica serovar Typhi
gcagccaggccauuuuuuc

SEQ ID NO: 1700479 - RNA, 14 nt, Salmonella enterica enterica serovar Typhi
gcagccucguccug

SEQ ID NO: 1700480 - RNA, 17 nt, Salmonella enterica enterica serovar Typhi
gcagcgacgcauugaga

SEQ ID NO: 1700481 - RNA, 16 nt, Salmonella enterica enterica serovar Typhi
gcagcgaaaauccagu

SEQ ID NO: 1700482 - RNA, 12 nt, Salmonella enterica enterica serovar Typhi
gcagccgccacc

SEQ ID NO: 1700483 - RNA, 14 nt, Salmonella enterica enterica serovar Typhi
gcagccgccaccac

SEQ ID NO: 1700484 - RNA, 17 nt, Salmonella enterica enterica serovar Typhi
gcagccgccauccggca

SEQ ID NO: 1700485 - RNA, 19 nt, Salmonella enterica enterica serovar Typhi
gcagccgguauccagcgcg

SEQ ID NO: 1700486 - RNA, 22 nt, Salmonella enterica enterica serovar Typhi
gcagaugcccgcagaucugucg

SEQ ID NO: 1700487 - RNA, 21 nt, Salmonella enterica enterica serovar Typhi
gcagaucggccuguuuuucug

SEQ ID NO: 1700488 - RNA, 23 nt, Salmonella enterica enterica serovar Typhi
gcagauccuuaacgucaaagcua

SEQ ID NO: 1700489 - RNA, 15 nt, Salmonella enterica enterica serovar Typhi
gcagaucguauccag

SEQ ID NO: 1700490 - RNA, 23 nt, Salmonella enterica enterica serovar Typhi
gcagaucugucgccaugaccugg

SEQ ID NO: 1700491 - RNA, 13 nt, Salmonella enterica enterica serovar Typhi
gcagauaccagcc

SEQ ID NO: 1700492 - RNA, 17 nt, Salmonella enterica enterica serovar Typhi
gcagauagcccgccagc

SEQ ID NO: 1700493 - RNA, 15 nt, Salmonella enterica enterica serovar Typhi
gcagauacugguaaa

SEQ ID NO: 1700494 - RNA, 21 nt, Salmonella enterica enterica serovar Typhi
gcagaucaagcgggggcgccu

SEQ ID NO: 1700495 - RNA, 15 nt, Salmonella enterica enterica serovar Typhi
gcagcaagaacagag

SEQ ID NO: 1700496 - RNA, 17 nt, Salmonella enterica enterica serovar Typhi
gcagcaacgucucgaca

SEQ ID NO: 1700497 - RNA, 16 nt, Salmonella enterica enterica serovar Typhi
gcagcaagcggcuguc

SEQ ID NO: 1700498 - RNA, 23 nt, Salmonella enterica enterica serovar Typhi
gcagcaaucagguauuuccugcu

SEQ ID NO: 1700499 - RNA, 20 nt, Salmonella enterica enterica serovar Typhi
gcagcaaugugcgccagaau

SEQ ID NO: 1700500 - RNA, 17 nt, Salmonella enterica enterica serovar Typhi
gcagcaccgguuuuucc

SEQ ID NO: 1700501 - RNA, 18 nt, Salmonella enterica enterica serovar Typhi
gcagcaccucaauaugaa

SEQ ID NO: 1700502 - RNA, 20 nt, Salmonella enterica enterica serovar Typhi
gcagcaccucaauaugaaau

SEQ ID NO: 1700503 - RNA, 12 nt, Salmonella enterica enterica serovar Typhi
gcagcagcuuca

SEQ ID NO: 1700504 - RNA, 16 nt, Salmonella enterica enterica serovar Typhi
gcaggcucuuuuucuc

SEQ ID NO: 1700505 - RNA, 24 nt, Salmonella enterica enterica serovar Typhi
gcaggcuugcccauucgccgacgc

SEQ ID NO: 1700506 - RNA, 23 nt, Salmonella enterica enterica serovar Typhi
gcaggcggcaaaaaaugcauuga

SEQ ID NO: 1700507 - RNA, 17 nt, Salmonella enterica enterica serovar Typhi
gcaggcucaccagccca

SEQ ID NO: 1700508 - RNA, 20 nt, Salmonella enterica enterica serovar Typhi
gcaggcgcgaccucaucaaa

SEQ ID NO: 1700509 - RNA, 16 nt, Salmonella enterica enterica serovar Typhi
gcaggaugcgcugcgc

SEQ ID NO: 1700510 - RNA, 23 nt, Salmonella enterica enterica serovar Typhi
gcaggaugucgauaauacagccu

SEQ ID NO: 1700511 - RNA, 19 nt, Salmonella enterica enterica serovar Typhi
gcaggagagccagaagaau

SEQ ID NO: 1700512 - RNA, 18 nt, Salmonella enterica enterica serovar Typhi
gcaggagcgcgacgacgg

SEQ ID NO: 1700513 - RNA, 21 nt, Salmonella enterica enterica serovar Typhi
gcaggauuuguaucacaauca

SEQ ID NO: 1700514 - RNA, 22 nt, Salmonella enterica enterica serovar Typhi
gcagcuccuuuuaauaaagaaa

SEQ ID NO: 1700515 - RNA, 21 nt, Salmonella enterica enterica serovar Typhi
gcagcuccuuuuaauaaagaa

SEQ ID NO: 1700516 - RNA, 23 nt, Salmonella enterica enterica serovar Typhi
gcagcguuugacggauuuuuuuc

SEQ ID NO: 1700517 - RNA, 16 nt, Salmonella enterica enterica serovar Typhi
gcagcgagcaccgauc

SEQ ID NO: 1700518 - RNA, 14 nt, Salmonella enterica enterica serovar Typhi
gcaggacagcgaca

SEQ ID NO: 1700519 - RNA, 12 nt, Salmonella enterica enterica serovar Typhi
gcaggacccgag

SEQ ID NO: 1700520 - RNA, 15 nt, Salmonella enterica enterica serovar Typhi
gcaggaaggcgugca

SEQ ID NO: 1700521 - RNA, 15 nt, Salmonella enterica enterica serovar Typhi
gcaggaaguuuucug

SEQ ID NO: 1700522 - RNA, 13 nt, Salmonella enterica enterica serovar Typhi
gcagcuucagcca

SEQ ID NO: 1700523 - RNA, 15 nt, Salmonella enterica enterica serovar Typhi
gcagcuuaucuuuuu

SEQ ID NO: 1700524 - RNA, 12 nt, Salmonella enterica enterica serovar Typhi
gcagcugggccu

SEQ ID NO: 1700525 - RNA, 15 nt, Salmonella enterica enterica serovar Typhi
gcagcuucugauacu

SEQ ID NO: 1700526 - RNA, 16 nt, Salmonella enterica enterica serovar Typhi
gcagucguuucuauua

SEQ ID NO: 1700527 - RNA, 15 nt, Salmonella enterica enterica serovar Typhi
gcagucuggcggcag

SEQ ID NO: 1700528 - RNA, 17 nt, Salmonella enterica enterica serovar Typhi
gcaguacacgcaucggg

SEQ ID NO: 1700529 - RNA, 16 nt, Salmonella enterica enterica serovar Typhi
gcagugacauuuaucu

SEQ ID NO: 1700530 - RNA, 19 nt, Salmonella enterica enterica serovar Typhi
gcagugaggauaaggcaag

SEQ ID NO: 1700531 - RNA, 14 nt, Salmonella enterica enterica serovar Typhi
gcaguguuaaucuc

SEQ ID NO: 1700532 - RNA, 17 nt, Salmonella enterica enterica serovar Typhi
gcaguugcagcguacgg

SEQ ID NO: 1700533 - RNA, 12 nt, Salmonella enterica enterica serovar Typhi
gcaguucaauau

SEQ ID NO: 1700534 - RNA, 15 nt, Salmonella enterica enterica serovar Typhi
gcaguuccccgccgc

SEQ ID NO: 1700535 - RNA, 13 nt, Salmonella enterica enterica serovar Typhi
gcauaacguacca

SEQ ID NO: 1700536 - RNA, 15 nt, Salmonella enterica enterica serovar Typhi
gcauaaagaacgugu

SEQ ID NO: 1700537 - RNA, 13 nt, Salmonella enterica enterica serovar Typhi
gcauaaauaaugc

SEQ ID NO: 1700538 - RNA, 22 nt, Salmonella enterica enterica serovar Typhi
gcaggggcuccugcgccggacg

SEQ ID NO: 1700539 - RNA, 21 nt, Salmonella enterica enterica serovar Typhi
gcagguaacgacuacuuccag

SEQ ID NO: 1700540 - RNA, 17 nt, Salmonella enterica enterica serovar Typhi
gcaggucaaagacgaaa

SEQ ID NO: 1700541 - RNA, 18 nt, Salmonella enterica enterica serovar Typhi
gcagguagucauauucac

SEQ ID NO: 1700542 - RNA, 15 nt, Salmonella enterica enterica serovar Typhi
gcaggugcggcuggg

SEQ ID NO: 1700543 - RNA, 18 nt, Salmonella enterica enterica serovar Typhi
gcaggucgcguagcuuuu

SEQ ID NO: 1700544 - RNA, 22 nt, Salmonella enterica enterica serovar Typhi
gcaguaacgcacuuuuccagcc

SEQ ID NO: 1700545 - RNA, 20 nt, Salmonella enterica enterica serovar Typhi
gcaguaacgcacuuuuccag

SEQ ID NO: 1700546 - RNA, 20 nt, Salmonella enterica enterica serovar Typhi
gcagguuacucacugccgcc

SEQ ID NO: 1700547 - RNA, 12 nt, Salmonella enterica enterica serovar Typhi
gcagguggccca

SEQ ID NO: 1700548 - RNA, 16 nt, Salmonella enterica enterica serovar Typhi
gcagguggaucugaau

SEQ ID NO: 1700549 - RNA, 19 nt, Salmonella enterica enterica serovar Typhi
gcaggugcggcugggcgag

SEQ ID NO: 1700550 - RNA, 16 nt, Salmonella enterica enterica serovar Typhi
gcacgcgauuugcagc

SEQ ID NO: 1700551 - RNA, 21 nt, Salmonella enterica enterica serovar Typhi
gcacgaugcauaugcacagcg

SEQ ID NO: 1700552 - RNA, 15 nt, Salmonella enterica enterica serovar Typhi
gcacgacacaaaagc

SEQ ID NO: 1700553 - RNA, 16 nt, Salmonella enterica enterica serovar Typhi
gcacgacacaaaagca

SEQ ID NO: 1700554 - RNA, 17 nt, Salmonella enterica enterica serovar Typhi
gcacgacacaaaagcau

SEQ ID NO: 1700555 - RNA, 17 nt, Salmonella enterica enterica serovar Typhi
gcacgacagagaucagg

SEQ ID NO: 1700556 - RNA, 13 nt, Salmonella enterica enterica serovar Typhi
gcacgacagugcu

SEQ ID NO: 1700557 - RNA, 16 nt, Salmonella enterica enterica serovar Typhi
gcacgacagugcuaua

SEQ ID NO: 1700558 - RNA, 18 nt, Salmonella enterica enterica serovar Typhi
gcaccuggagcgccuccc

SEQ ID NO: 1700559 - RNA, 18 nt, Salmonella enterica enterica serovar Typhi
gcaccucaauaugaaauu

SEQ ID NO: 1700560 - RNA, 21 nt, Salmonella enterica enterica serovar Typhi
gcaccucaauaugaaauucuu

SEQ ID NO: 1700561 - RNA, 18 nt, Salmonella enterica enterica serovar Typhi
gcacccuucgcuauccau

SEQ ID NO: 1700562 - RNA, 15 nt, Salmonella enterica enterica serovar Typhi
gcacccggagagaaa

SEQ ID NO: 1700563 - RNA, 20 nt, Salmonella enterica enterica serovar Typhi
gcaccgcuaaaaaacaggcg

SEQ ID NO: 1700564 - RNA, 20 nt, Salmonella enterica enterica serovar Typhi
gcaccgcgaccaguucaccg

SEQ ID NO: 1700565 - RNA, 16 nt, Salmonella enterica enterica serovar Typhi
gcacaggccuucauga

SEQ ID NO: 1700566 - RNA, 17 nt, Salmonella enterica enterica serovar Typhi
gcacagcgcuaucaggc

SEQ ID NO: 1700567 - RNA, 19 nt, Salmonella enterica enterica serovar Typhi
gcacagcgcuaucaggcac

SEQ ID NO: 1700568 - RNA, 21 nt, Salmonella enterica enterica serovar Typhi
gcacagguacaggccgccgcc

SEQ ID NO: 1700569 - RNA, 20 nt, Salmonella enterica enterica serovar Typhi
gcacagguacaggccgccgc

SEQ ID NO: 1700570 - RNA, 15 nt, Salmonella enterica enterica serovar Typhi
gcacagcacauagaa

SEQ ID NO: 1700571 - RNA, 20 nt, Salmonella enterica enterica serovar Typhi
gcacagcccuaccgccacca

SEQ ID NO: 1700572 - RNA, 14 nt, Salmonella enterica enterica serovar Typhi
gcacagcauaccgu

SEQ ID NO: 1700573 - RNA, 15 nt, Salmonella enterica enterica serovar Typhi
gcacagccaguaaga

SEQ ID NO: 1700574 - RNA, 15 nt, Salmonella enterica enterica serovar Typhi
gcacagccccagcac

SEQ ID NO: 1700575 - RNA, 19 nt, Salmonella enterica enterica serovar Typhi
gcacagccccagcaccaac

SEQ ID NO: 1700576 - RNA, 18 nt, Salmonella enterica enterica serovar Typhi
gcaaugccuaccggcggc

SEQ ID NO: 1700577 - RNA, 21 nt, Salmonella enterica enterica serovar Typhi
gcaaugccauauuuaccuuuu

SEQ ID NO: 1700578 - RNA, 18 nt, Salmonella enterica enterica serovar Typhi
gcaaugcccgguuuuuua

SEQ ID NO: 1700579 - RNA, 16 nt, Salmonella enterica enterica serovar Typhi
gcaaugcgaauaacau

SEQ ID NO: 1700580 - RNA, 13 nt, Salmonella enterica enterica serovar Typhi
gcacaacaggggg

SEQ ID NO: 1700581 - RNA, 16 nt, Salmonella enterica enterica serovar Typhi
gcacaacgaguccccu

SEQ ID NO: 1700582 - RNA, 15 nt, Salmonella enterica enterica serovar Typhi
gcacaacccaaaggc

SEQ ID NO: 1700583 - RNA, 18 nt, Salmonella enterica enterica serovar Typhi
gcacaacgaguccccuca

SEQ ID NO: 1700584 - RNA, 19 nt, Salmonella enterica enterica serovar Typhi
gcacaccgccguaaaggga

SEQ ID NO: 1700585 - RNA, 20 nt, Salmonella enterica enterica serovar Typhi
gcacaccggccauugccgcg

SEQ ID NO: 1700586 - RNA, 22 nt, Salmonella enterica enterica serovar Typhi
gcaccaucuuuuccggcagggu

SEQ ID NO: 1700587 - RNA, 18 nt, Salmonella enterica enterica serovar Typhi
gcaccauguggcgcggcc

SEQ ID NO: 1700588 - RNA, 24 nt, Salmonella enterica enterica serovar Typhi
gcaccaucaacgccggugauuuua

SEQ ID NO: 1700589 - RNA, 23 nt, Salmonella enterica enterica serovar Typhi
gcaccaguucacuccuaagagaa

SEQ ID NO: 1700590 - RNA, 20 nt, Salmonella enterica enterica serovar Typhi
gcaccauaccuauaaaaaug

SEQ ID NO: 1700591 - RNA, 15 nt, Salmonella enterica enterica serovar Typhi
gcaccaguuccccau

SEQ ID NO: 1700592 - RNA, 20 nt, Salmonella enterica enterica serovar Typhi
gcaccaguuccccauacuga

SEQ ID NO: 1700593 - RNA, 23 nt, Salmonella enterica enterica serovar Typhi
gcaccagccaggcgaucgcacag

SEQ ID NO: 1700594 - RNA, 13 nt, Salmonella enterica enterica serovar Typhi
gcaccagccaggc

SEQ ID NO: 1700595 - RNA, 17 nt, Salmonella enterica enterica serovar Typhi
gcacaucgccauuaaaa

SEQ ID NO: 1700596 - RNA, 18 nt, Salmonella enterica enterica serovar Typhi
gcacaucgccauuaaaag

SEQ ID NO: 1700597 - RNA, 14 nt, Salmonella enterica enterica serovar Typhi
gcacaugggcagga

SEQ ID NO: 1700598 - RNA, 15 nt, Salmonella enterica enterica serovar Typhi
gcaccagcaaugaua

SEQ ID NO: 1700599 - RNA, 18 nt, Salmonella enterica enterica serovar Typhi
gcaaggaaauauuaauua

SEQ ID NO: 1700600 - RNA, 19 nt, Salmonella enterica enterica serovar Typhi
gcaagcguaagagaacagg

SEQ ID NO: 1700601 - RNA, 15 nt, Salmonella enterica enterica serovar Typhi
gcaagcucagcggca

SEQ ID NO: 1700602 - RNA, 22 nt, Salmonella enterica enterica serovar Typhi
gcaacuguuuuaccaaaucaau

SEQ ID NO: 1700603 - RNA, 13 nt, Salmonella enterica enterica serovar Typhi
gcaagaaguuccg

SEQ ID NO: 1700604 - RNA, 18 nt, Salmonella enterica enterica serovar Typhi
gcaagacccgaaccugcg

SEQ ID NO: 1700605 - RNA, 14 nt, Salmonella enterica enterica serovar Typhi
gcaagaccuauccg

SEQ ID NO: 1700606 - RNA, 15 nt, Salmonella enterica enterica serovar Typhi
gcaagacgaaaaaug

SEQ ID NO: 1700607 - RNA, 15 nt, Salmonella enterica enterica serovar Typhi
gcaacguccgcagcc

SEQ ID NO: 1700608 - RNA, 22 nt, Salmonella enterica enterica serovar Typhi
gcaacguaaucccgccagccuu

SEQ ID NO: 1700609 - RNA, 15 nt, Salmonella enterica enterica serovar Typhi
gcaacguuuccgcua

SEQ ID NO: 1700610 - RNA, 21 nt, Salmonella enterica enterica serovar Typhi
gcaacguuucuuucaucagau

SEQ ID NO: 1700611 - RNA, 21 nt, Salmonella enterica enterica serovar Typhi
gcaacgugaacugcgccugca

SEQ ID NO: 1700612 - RNA, 14 nt, Salmonella enterica enterica serovar Typhi
gcaacucgcacuga

SEQ ID NO: 1700613 - RNA, 19 nt, Salmonella enterica enterica serovar Typhi
gcaacucucccacuuugcu

SEQ ID NO: 1700614 - RNA, 13 nt, Salmonella enterica enterica serovar Typhi
gcaacugcugcgc

SEQ ID NO: 1700615 - RNA, 11 nt, Salmonella enterica enterica serovar Typhi
gcaacugcgcc

SEQ ID NO: 1700616 - RNA, 17 nt, Salmonella enterica enterica serovar Typhi
gcaacugauuaaucugc

SEQ ID NO: 1700617 - RNA, 12 nt, Salmonella enterica enterica serovar Typhi
gcaacugaaacc

SEQ ID NO: 1700618 - RNA, 15 nt, Salmonella enterica enterica serovar Typhi
gcaacugaaaccagg

SEQ ID NO: 1700619 - RNA, 17 nt, Salmonella enterica enterica serovar Typhi
gcaacugccggcuuacc

SEQ ID NO: 1700620 - RNA, 19 nt, Salmonella enterica enterica serovar Typhi
gcaauaaaaauaucauuaa

SEQ ID NO: 1700621 - RNA, 22 nt, Salmonella enterica enterica serovar Typhi
gcaauaaacucccgcauauauu

SEQ ID NO: 1700622 - RNA, 24 nt, Salmonella enterica enterica serovar Typhi
gcaauaaacuaaguaaggaggaau

SEQ ID NO: 1700623 - RNA, 17 nt, Salmonella enterica enterica serovar Typhi
gcaauaacaccggcggc

SEQ ID NO: 1700624 - RNA, 18 nt, Salmonella enterica enterica serovar Typhi
gcaaguugcgccacugcc

SEQ ID NO: 1700625 - RNA, 13 nt, Salmonella enterica enterica serovar Typhi
gcaaggccgagcg

SEQ ID NO: 1700626 - RNA, 20 nt, Salmonella enterica enterica serovar Typhi
gcaaucgccugcaacgcuuu

SEQ ID NO: 1700627 - RNA, 14 nt, Salmonella enterica enterica serovar Typhi
gcaaucgagaucag

SEQ ID NO: 1700628 - RNA, 20 nt, Salmonella enterica enterica serovar Typhi
gcaaucaguacgcgcgcggc

SEQ ID NO: 1700629 - RNA, 21 nt, Salmonella enterica enterica serovar Typhi
gcaaucaguacgcgcgcggcg

SEQ ID NO: 1700630 - RNA, 19 nt, Salmonella enterica enterica serovar Typhi
gcaaaacgcauccagcgca

SEQ ID NO: 1700631 - RNA, 20 nt, Salmonella enterica enterica serovar Typhi
gcaaaacuaaacccggccug

SEQ ID NO: 1700632 - RNA, 13 nt, Salmonella enterica enterica serovar Typhi
gcaaaagaaaaaa

SEQ ID NO: 1700633 - RNA, 21 nt, Salmonella enterica enterica serovar Typhi
gcaaaacucucaccgaccugc

SEQ ID NO: 1700634 - RNA, 20 nt, Salmonella enterica enterica serovar Typhi
gcaacaacaaacacaaucac

SEQ ID NO: 1700635 - RNA, 23 nt, Salmonella enterica enterica serovar Typhi
gcaacagcaccagcaggugguac

SEQ ID NO: 1700636 - RNA, 22 nt, Salmonella enterica enterica serovar Typhi
gcaacagccauuuuaaaaauau

SEQ ID NO: 1700637 - RNA, 13 nt, Salmonella enterica enterica serovar Typhi
gcaacaccauccc

SEQ ID NO: 1700638 - RNA, 15 nt, Salmonella enterica enterica serovar Typhi
gcaacauuacugacc

SEQ ID NO: 1700639 - RNA, 17 nt, Salmonella enterica enterica serovar Typhi
gcaacaugaccagcgca

SEQ ID NO: 1700640 - RNA, 14 nt, Salmonella enterica enterica serovar Typhi
gcaacauggacacc

SEQ ID NO: 1700641 - RNA, 19 nt, Salmonella enterica enterica serovar Typhi
gcaacauucugcuuccaga

SEQ ID NO: 1700642 - RNA, 23 nt, Salmonella enterica enterica serovar Typhi
gcaacaguaccugauaaaauucc

SEQ ID NO: 1700643 - RNA, 21 nt, Salmonella enterica enterica serovar Typhi
gcaacagugggcuaugaagag

SEQ ID NO: 1700644 - RNA, 13 nt, Salmonella enterica enterica serovar Typhi
gcaacaugcccac

SEQ ID NO: 1700645 - RNA, 16 nt, Salmonella enterica enterica serovar Typhi
gcaacagucagcuccu

SEQ ID NO: 1700646 - RNA, 23 nt, Salmonella enterica enterica serovar Typhi
gcaacgccguacuccagcccauc

SEQ ID NO: 1700647 - RNA, 21 nt, Salmonella enterica enterica serovar Typhi
gcaacgccaucagcaaaauac

SEQ ID NO: 1700648 - RNA, 21 nt, Salmonella enterica enterica serovar Typhi
gcaacgaucccuaauaaaaua

SEQ ID NO: 1700649 - RNA, 22 nt, Salmonella enterica enterica serovar Typhi
gcaacgauucguaaauugacug

SEQ ID NO: 1700650 - RNA, 22 nt, Salmonella enterica enterica serovar Typhi
gcaacgcuuuagugccgccauu

SEQ ID NO: 1700651 - RNA, 15 nt, Salmonella enterica enterica serovar Typhi
gcaacgcuuccaccu

SEQ ID NO: 1700652 - RNA, 17 nt, Salmonella enterica enterica serovar Typhi
gcaacggccagcgcagg

SEQ ID NO: 1700653 - RNA, 19 nt, Salmonella enterica enterica serovar Typhi
gcaacggcauuccgcuggu

SEQ ID NO: 1700654 - RNA, 20 nt, Salmonella enterica enterica serovar Typhi
gcaacgcuucugagaauuug

SEQ ID NO: 1700655 - RNA, 20 nt, Salmonella enterica enterica serovar Typhi
gcaacggugagaccauugca

SEQ ID NO: 1700656 - RNA, 21 nt, Salmonella enterica enterica serovar Typhi
gcaacggguuagacucagcga

SEQ ID NO: 1700657 - RNA, 16 nt, Salmonella enterica enterica serovar Typhi
gcaacgggcaaugcca

SEQ ID NO: 1700658 - RNA, 15 nt, Salmonella enterica enterica serovar Typhi
gcaacgggcagucug

SEQ ID NO: 1700659 - RNA, 23 nt, Salmonella enterica enterica serovar Typhi
gcaacgggcagucuggcggcagc

SEQ ID NO: 1700660 - RNA, 16 nt, Salmonella enterica enterica serovar Typhi
gcaacggcgggauacu

SEQ ID NO: 1700661 - RNA, 16 nt, Salmonella enterica enterica serovar Typhi
gcaacgggacggcggc

SEQ ID NO: 1700662 - RNA, 19 nt, Salmonella enterica enterica serovar Typhi
gcaacggcgaggugcuggu

SEQ ID NO: 1700663 - RNA, 19 nt, Salmonella enterica enterica serovar Typhi
gcaacggccagcgcaggcu

SEQ ID NO: 1700664 - RNA, 14 nt, Salmonella enterica enterica serovar Typhi
gcaaccuuacguuu

SEQ ID NO: 1700665 - RNA, 18 nt, Salmonella enterica enterica serovar Typhi
gcaaccugacgcugcgcc

SEQ ID NO: 1700666 - RNA, 14 nt, Salmonella enterica enterica serovar Typhi
gcaaccugagcgcg

SEQ ID NO: 1700667 - RNA, 16 nt, Salmonella enterica enterica serovar Typhi
gcaaccguccgcucac

SEQ ID NO: 1700668 - RNA, 14 nt, Salmonella enterica enterica serovar Typhi
gcaaccggcguggu

SEQ ID NO: 1700669 - RNA, 13 nt, Salmonella enterica enterica serovar Typhi
gcaacccauacag

SEQ ID NO: 1700670 - RNA, 21 nt, Salmonella enterica enterica serovar Typhi
gcaacccugccgucucaacca

SEQ ID NO: 1700671 - RNA, 15 nt, Salmonella enterica enterica serovar Typhi
gcaacccgcuccaga

SEQ ID NO: 1700672 - RNA, 14 nt, Salmonella enterica enterica serovar Typhi
gcaaccgccugcac

SEQ ID NO: 1700673 - RNA, 17 nt, Salmonella enterica enterica serovar Typhi
gccccuuccgccacggc

SEQ ID NO: 1700674 - RNA, 23 nt, Salmonella enterica enterica serovar Typhi
gcccgacaggguuugccagcacc

SEQ ID NO: 1700675 - RNA, 18 nt, Salmonella enterica enterica serovar Typhi
gccccuguuucgcccgcu

SEQ ID NO: 1700676 - RNA, 14 nt, Salmonella enterica enterica serovar Typhi
gccccuuccgccac

SEQ ID NO: 1700677 - RNA, 23 nt, Salmonella enterica enterica serovar Typhi
gccccgggcgaccacccgcgacc

SEQ ID NO: 1700678 - RNA, 12 nt, Salmonella enterica enterica serovar Typhi
gccccgccgcgc

SEQ ID NO: 1700679 - RNA, 14 nt, Salmonella enterica enterica serovar Typhi
gccccggcgcgcgc

SEQ ID NO: 1700680 - RNA, 23 nt, Salmonella enterica enterica serovar Typhi
gcccgccaccagcacagcccagu

SEQ ID NO: 1700681 - RNA, 18 nt, Salmonella enterica enterica serovar Typhi
gcccgagcgacgcccugc

SEQ ID NO: 1700682 - RNA, 21 nt, Salmonella enterica enterica serovar Typhi
gcccgacgcgccacuuccagc

SEQ ID NO: 1700683 - RNA, 14 nt, Salmonella enterica enterica serovar Typhi
gcccgccagcacca

SEQ ID NO: 1700684 - RNA, 13 nt, Salmonella enterica enterica serovar Typhi
gcccgccagcacc

SEQ ID NO: 1700685 - RNA, 16 nt, Salmonella enterica enterica serovar Typhi
gcccgccgcaaaaaau

SEQ ID NO: 1700686 - RNA, 17 nt, Salmonella enterica enterica serovar Typhi
gcccgcguaacagcggu

SEQ ID NO: 1700687 - RNA, 15 nt, Salmonella enterica enterica serovar Typhi
gcccguaucacugau

SEQ ID NO: 1700688 - RNA, 21 nt, Salmonella enterica enterica serovar Typhi
gcccgucaucuucuaccugga

SEQ ID NO: 1700689 - RNA, 18 nt, Salmonella enterica enterica serovar Typhi
gcccggcggcacggcgcu

SEQ ID NO: 1700690 - RNA, 14 nt, Salmonella enterica enterica serovar Typhi
gcccggccggugcu

SEQ ID NO: 1700691 - RNA, 11 nt, Salmonella enterica enterica serovar Typhi
gcccggcggcg

SEQ ID NO: 1700692 - RNA, 21 nt, Salmonella enterica enterica serovar Typhi
gcccggcggcgcgaugccugc

SEQ ID NO: 1700693 - RNA, 22 nt, Salmonella enterica enterica serovar Typhi
gcccgcuucauuggcgucugcu

SEQ ID NO: 1700694 - RNA, 21 nt, Salmonella enterica enterica serovar Typhi
gcccgcuaucaccgcccaaug

SEQ ID NO: 1700695 - RNA, 15 nt, Salmonella enterica enterica serovar Typhi
gcccuaacaggcgca

SEQ ID NO: 1700696 - RNA, 17 nt, Salmonella enterica enterica serovar Typhi
gcccguugucacaggcu

SEQ ID NO: 1700697 - RNA, 15 nt, Salmonella enterica enterica serovar Typhi
gcccguuuuuuccag

SEQ ID NO: 1700698 - RNA, 17 nt, Salmonella enterica enterica serovar Typhi
gcccugcgccucaagcg

SEQ ID NO: 1700699 - RNA, 16 nt, Salmonella enterica enterica serovar Typhi
gcccugcucccacagc

SEQ ID NO: 1700700 - RNA, 19 nt, Salmonella enterica enterica serovar Typhi
gcccugaagggcggcugga

SEQ ID NO: 1700701 - RNA, 12 nt, Salmonella enterica enterica serovar Typhi
gcccucugucca

SEQ ID NO: 1700702 - RNA, 19 nt, Salmonella enterica enterica serovar Typhi
gcccucuuccagcgccaaa

SEQ ID NO: 1700703 - RNA, 19 nt, Salmonella enterica enterica serovar Typhi
gcccucuuuaucaaacaaa

SEQ ID NO: 1700704 - RNA, 16 nt, Salmonella enterica enterica serovar Typhi
gcccugaagggcggcu

SEQ ID NO: 1700705 - RNA, 15 nt, Salmonella enterica enterica serovar Typhi
gcccauauccagcuc

SEQ ID NO: 1700706 - RNA, 16 nt, Salmonella enterica enterica serovar Typhi
gcccauauucuuugcg

SEQ ID NO: 1700707 - RNA, 11 nt, Salmonella enterica enterica serovar Typhi
gcccauaucca

SEQ ID NO: 1700708 - RNA, 19 nt, Salmonella enterica enterica serovar Typhi
gcccaucagcgccagcccu

SEQ ID NO: 1700709 - RNA, 17 nt, Salmonella enterica enterica serovar Typhi
gcccaucaucaucggca

SEQ ID NO: 1700710 - RNA, 13 nt, Salmonella enterica enterica serovar Typhi
gcccauccagcac

SEQ ID NO: 1700711 - RNA, 14 nt, Salmonella enterica enterica serovar Typhi
gcccauccagagca

SEQ ID NO: 1700712 - RNA, 15 nt, Salmonella enterica enterica serovar Typhi
gcccauccgucagga

SEQ ID NO: 1700713 - RNA, 20 nt, Salmonella enterica enterica serovar Typhi
gcccagguagaaucccacca

SEQ ID NO: 1700714 - RNA, 13 nt, Salmonella enterica enterica serovar Typhi
gcccaggccugau

SEQ ID NO: 1700715 - RNA, 22 nt, Salmonella enterica enterica serovar Typhi
gcccaggccugaugagcgcagc

SEQ ID NO: 1700716 - RNA, 16 nt, Salmonella enterica enterica serovar Typhi
gcccagguuagcagcc

SEQ ID NO: 1700717 - RNA, 19 nt, Salmonella enterica enterica serovar Typhi
gccaugcuggcucuugguu

SEQ ID NO: 1700718 - RNA, 14 nt, Salmonella enterica enterica serovar Typhi
gccaugcucaucca

SEQ ID NO: 1700719 - RNA, 17 nt, Salmonella enterica enterica serovar Typhi
gcccacuguggcgccac

SEQ ID NO: 1700720 - RNA, 20 nt, Salmonella enterica enterica serovar Typhi
gcccacuauuuuucauggca

SEQ ID NO: 1700721 - RNA, 18 nt, Salmonella enterica enterica serovar Typhi
gcccagaaagaucagcag

SEQ ID NO: 1700722 - RNA, 10 nt, Salmonella enterica enterica serovar Typhi
gcccagcagc

SEQ ID NO: 1700723 - RNA, 21 nt, Salmonella enterica enterica serovar Typhi
gcccagcacggcaagcgcggc

SEQ ID NO: 1700724 - RNA, 18 nt, Salmonella enterica enterica serovar Typhi
gcccaggccaugcgccgc

SEQ ID NO: 1700725 - RNA, 22 nt, Salmonella enterica enterica serovar Typhi
gcccagcucaugauagggcagc

SEQ ID NO: 1700726 - RNA, 15 nt, Salmonella enterica enterica serovar Typhi
gcccagcuauuuuuc

SEQ ID NO: 1700727 - RNA, 15 nt, Salmonella enterica enterica serovar Typhi
gcccagcgcgguggc

SEQ ID NO: 1700728 - RNA, 14 nt, Salmonella enterica enterica serovar Typhi
gcccagcccggaaa

SEQ ID NO: 1700729 - RNA, 13 nt, Salmonella enterica enterica serovar Typhi
gcccagccugccu

SEQ ID NO: 1700730 - RNA, 20 nt, Salmonella enterica enterica serovar Typhi
gcccaugcaaccagugcgug

SEQ ID NO: 1700731 - RNA, 19 nt, Salmonella enterica enterica serovar Typhi
gcccaugauggugaacaga

SEQ ID NO: 1700732 - RNA, 14 nt, Salmonella enterica enterica serovar Typhi
gcccaucuccagcc

SEQ ID NO: 1700733 - RNA, 17 nt, Salmonella enterica enterica serovar Typhi
gcccauggaugcgccgc

SEQ ID NO: 1700734 - RNA, 21 nt, Salmonella enterica enterica serovar Typhi
gcccauucuucgucgucauca

SEQ ID NO: 1700735 - RNA, 16 nt, Salmonella enterica enterica serovar Typhi
gcccauugccacccau

SEQ ID NO: 1700736 - RNA, 16 nt, Salmonella enterica enterica serovar Typhi
gcccauuauugaucuc

SEQ ID NO: 1700737 - RNA, 14 nt, Salmonella enterica enterica serovar Typhi
gcccauuccgccug

SEQ ID NO: 1700738 - RNA, 17 nt, Salmonella enterica enterica serovar Typhi
gccccacacggccacca

SEQ ID NO: 1700739 - RNA, 13 nt, Salmonella enterica enterica serovar Typhi
gccccaacgcgcu

SEQ ID NO: 1700740 - RNA, 13 nt, Salmonella enterica enterica serovar Typhi
gccccagacgccc

SEQ ID NO: 1700741 - RNA, 11 nt, Salmonella enterica enterica serovar Typhi
gccccacuggc

SEQ ID NO: 1700742 - RNA, 20 nt, Salmonella enterica enterica serovar Typhi
gccccacgauacgccccugc

SEQ ID NO: 1700743 - RNA, 19 nt, Salmonella enterica enterica serovar Typhi
gccccagcaccaacgccgc

SEQ ID NO: 1700744 - RNA, 11 nt, Salmonella enterica enterica serovar Typhi
gccccagcccu

SEQ ID NO: 1700745 - RNA, 21 nt, Salmonella enterica enterica serovar Typhi
gccccagcaugagccagcccu

SEQ ID NO: 1700746 - RNA, 20 nt, Salmonella enterica enterica serovar Typhi
gccccagcaugagccagccc

SEQ ID NO: 1700747 - RNA, 22 nt, Salmonella enterica enterica serovar Typhi
gccccccgguagccacacccau

SEQ ID NO: 1700748 - RNA, 15 nt, Salmonella enterica enterica serovar Typhi
gccccccgcacagca

SEQ ID NO: 1700749 - RNA, 19 nt, Salmonella enterica enterica serovar Typhi
gcccccaugccgccugccg

SEQ ID NO: 1700750 - RNA, 23 nt, Salmonella enterica enterica serovar Typhi
gccccaggcuauccagcucaccg

SEQ ID NO: 1700751 - RNA, 16 nt, Salmonella enterica enterica serovar Typhi
gcccccugccagcgcu

SEQ ID NO: 1700752 - RNA, 17 nt, Salmonella enterica enterica serovar Typhi
gccccgacaaaacgggc

SEQ ID NO: 1700753 - RNA, 13 nt, Salmonella enterica enterica serovar Typhi
gcccccucggcag

SEQ ID NO: 1700754 - RNA, 19 nt, Salmonella enterica enterica serovar Typhi
gcccccgauucaaucuggu

SEQ ID NO: 1700755 - RNA, 14 nt, Salmonella enterica enterica serovar Typhi
gcccccgcgcaggc

SEQ ID NO: 1700756 - RNA, 22 nt, Salmonella enterica enterica serovar Typhi
gccagcgauccugcggcauuag

SEQ ID NO: 1700757 - RNA, 21 nt, Salmonella enterica enterica serovar Typhi
gccagccgcucugcuguuccu

SEQ ID NO: 1700758 - RNA, 18 nt, Salmonella enterica enterica serovar Typhi
gccagcagggucaggaac

SEQ ID NO: 1700759 - RNA, 17 nt, Salmonella enterica enterica serovar Typhi
gccagcagagcgaacag

SEQ ID NO: 1700760 - RNA, 14 nt, Salmonella enterica enterica serovar Typhi
gccagcagcauaaa

SEQ ID NO: 1700761 - RNA, 13 nt, Salmonella enterica enterica serovar Typhi
gccagcggcggcu

SEQ ID NO: 1700762 - RNA, 15 nt, Salmonella enterica enterica serovar Typhi
gccagcgggcgcagu

SEQ ID NO: 1700763 - RNA, 22 nt, Salmonella enterica enterica serovar Typhi
gccagcggucgcggagaucauc

SEQ ID NO: 1700764 - RNA, 23 nt, Salmonella enterica enterica serovar Typhi
gccagcgccaccaaagccaggcc

SEQ ID NO: 1700765 - RNA, 15 nt, Salmonella enterica enterica serovar Typhi
gccagcgccagcagc

SEQ ID NO: 1700766 - RNA, 14 nt, Salmonella enterica enterica serovar Typhi
gccagcgcauccac

SEQ ID NO: 1700767 - RNA, 22 nt, Salmonella enterica enterica serovar Typhi
gccaggcccgguggcgccacgc

SEQ ID NO: 1700768 - RNA, 18 nt, Salmonella enterica enterica serovar Typhi
gccaggucucauagcgcc

SEQ ID NO: 1700769 - RNA, 20 nt, Salmonella enterica enterica serovar Typhi
gccaggucucauagcgcccc

SEQ ID NO: 1700770 - RNA, 12 nt, Salmonella enterica enterica serovar Typhi
gccagggcggca

SEQ ID NO: 1700771 - RNA, 22 nt, Salmonella enterica enterica serovar Typhi
gccagggcggcaaaaucuuuuu

SEQ ID NO: 1700772 - RNA, 13 nt, Salmonella enterica enterica serovar Typhi
gccaggaauaaag

SEQ ID NO: 1700773 - RNA, 19 nt, Salmonella enterica enterica serovar Typhi
gccaggaagucagcuuccu

SEQ ID NO: 1700774 - RNA, 22 nt, Salmonella enterica enterica serovar Typhi
gccaggaaccgccgaugcacaa

SEQ ID NO: 1700775 - RNA, 23 nt, Salmonella enterica enterica serovar Typhi
gccaggaaccgcggucggcaggc

SEQ ID NO: 1700776 - RNA, 19 nt, Salmonella enterica enterica serovar Typhi
gccaggccauugcugagga

SEQ ID NO: 1700777 - RNA, 21 nt, Salmonella enterica enterica serovar Typhi
gccaggcauugauaaagcgcu

SEQ ID NO: 1700778 - RNA, 20 nt, Salmonella enterica enterica serovar Typhi
gccagcucaugcgcggcggg

SEQ ID NO: 1700779 - RNA, 13 nt, Salmonella enterica enterica serovar Typhi
gccagcuccgcgc

SEQ ID NO: 1700780 - RNA, 21 nt, Salmonella enterica enterica serovar Typhi
gccaguuaagcaacugauuaa

SEQ ID NO: 1700781 - RNA, 15 nt, Salmonella enterica enterica serovar Typhi
gccaguucacgccgc

SEQ ID NO: 1700782 - RNA, 19 nt, Salmonella enterica enterica serovar Typhi
gccaguucauuccgcccug

SEQ ID NO: 1700783 - RNA, 16 nt, Salmonella enterica enterica serovar Typhi
gccaguucacgccgcc

SEQ ID NO: 1700784 - RNA, 17 nt, Salmonella enterica enterica serovar Typhi
gccaguucacgccgccg

SEQ ID NO: 1700785 - RNA, 14 nt, Salmonella enterica enterica serovar Typhi
gccaguuuuccgcc

SEQ ID NO: 1700786 - RNA, 16 nt, Salmonella enterica enterica serovar Typhi
gccaguuuuccgccug

SEQ ID NO: 1700787 - RNA, 20 nt, Salmonella enterica enterica serovar Typhi
gccaguuuucgacauauuug

SEQ ID NO: 1700788 - RNA, 19 nt, Salmonella enterica enterica serovar Typhi
gccauaaaaacaauaaaua

SEQ ID NO: 1700789 - RNA, 21 nt, Salmonella enterica enterica serovar Typhi
gccauaaaccccgauaaacca

SEQ ID NO: 1700790 - RNA, 21 nt, Salmonella enterica enterica serovar Typhi
gccaguuguccgcuggucagc

SEQ ID NO: 1700791 - RNA, 17 nt, Salmonella enterica enterica serovar Typhi
gccaguuuagggaucau

SEQ ID NO: 1700792 - RNA, 21 nt, Salmonella enterica enterica serovar Typhi
gccaguuucucgucauaguga

SEQ ID NO: 1700793 - RNA, 20 nt, Salmonella enterica enterica serovar Typhi
gccaguuuccugacccgcuc

SEQ ID NO: 1700794 - RNA, 16 nt, Salmonella enterica enterica serovar Typhi
gccagucgccaggcaa

SEQ ID NO: 1700795 - RNA, 18 nt, Salmonella enterica enterica serovar Typhi
gccagucuuccauuacaa

SEQ ID NO: 1700796 - RNA, 18 nt, Salmonella enterica enterica serovar Typhi
gccagucuuugcaggagg

SEQ ID NO: 1700797 - RNA, 21 nt, Salmonella enterica enterica serovar Typhi
gccagugcgauaccggccgcc

SEQ ID NO: 1700798 - RNA, 22 nt, Salmonella enterica enterica serovar Typhi
gccagugcgauaccggccgccc

SEQ ID NO: 1700799 - RNA, 21 nt, Salmonella enterica enterica serovar Typhi
gccagugggcgucaaaauccc

SEQ ID NO: 1700800 - RNA, 17 nt, Salmonella enterica enterica serovar Typhi
gccaguaccgccgccgg

SEQ ID NO: 1700801 - RNA, 15 nt, Salmonella enterica enterica serovar Typhi
gccaguaccgccgcc

SEQ ID NO: 1700802 - RNA, 18 nt, Salmonella enterica enterica serovar Typhi
gccaguacagcacgccgg

SEQ ID NO: 1700803 - RNA, 14 nt, Salmonella enterica enterica serovar Typhi
gccaguccgcccgc

SEQ ID NO: 1700804 - RNA, 18 nt, Salmonella enterica enterica serovar Typhi
gccaguccugccaccagc

SEQ ID NO: 1700805 - RNA, 18 nt, Salmonella enterica enterica serovar Typhi
gccauauugccgcacaug

SEQ ID NO: 1700806 - RNA, 15 nt, Salmonella enterica enterica serovar Typhi
gccauaucgccgcca

SEQ ID NO: 1700807 - RNA, 19 nt, Salmonella enterica enterica serovar Typhi
gccauccacggccccgggc

SEQ ID NO: 1700808 - RNA, 20 nt, Salmonella enterica enterica serovar Typhi
gccauauauuuacugaauaa

SEQ ID NO: 1700809 - RNA, 16 nt, Salmonella enterica enterica serovar Typhi
gccaucccugacaaua

SEQ ID NO: 1700810 - RNA, 17 nt, Salmonella enterica enterica serovar Typhi
gccauccgacaaccggc

SEQ ID NO: 1700811 - RNA, 21 nt, Salmonella enterica enterica serovar Typhi
gccauaacggcuguccauccg

SEQ ID NO: 1700812 - RNA, 13 nt, Salmonella enterica enterica serovar Typhi
gccauaauuguuc

SEQ ID NO: 1700813 - RNA, 19 nt, Salmonella enterica enterica serovar Typhi
gccauaaucgcuuuuuccu

SEQ ID NO: 1700814 - RNA, 17 nt, Salmonella enterica enterica serovar Typhi
gccauaauggauuaggu

SEQ ID NO: 1700815 - RNA, 17 nt, Salmonella enterica enterica serovar Typhi
gccauaaucgcuuuuuc

SEQ ID NO: 1700816 - RNA, 18 nt, Salmonella enterica enterica serovar Typhi
gccauagacuuuggcgca

SEQ ID NO: 1700817 - RNA, 17 nt, Salmonella enterica enterica serovar Typhi
gccauacuuacugcugu

SEQ ID NO: 1700818 - RNA, 16 nt, Salmonella enterica enterica serovar Typhi
gccaugaugagcgcca

SEQ ID NO: 1700819 - RNA, 12 nt, Salmonella enterica enterica serovar Typhi
gccaugauucau

SEQ ID NO: 1700820 - RNA, 14 nt, Salmonella enterica enterica serovar Typhi
gccaugcauaugaa

SEQ ID NO: 1700821 - RNA, 14 nt, Salmonella enterica enterica serovar Typhi
gccaugccagcagu

SEQ ID NO: 1700822 - RNA, 15 nt, Salmonella enterica enterica serovar Typhi
gccaugccagcaguu

SEQ ID NO: 1700823 - RNA, 21 nt, Salmonella enterica enterica serovar Typhi
gccaucggcuaagccaaaaau

SEQ ID NO: 1700824 - RNA, 11 nt, Salmonella enterica enterica serovar Typhi
gccauccggca

SEQ ID NO: 1700825 - RNA, 16 nt, Salmonella enterica enterica serovar Typhi
gccauccggcaacaaa

SEQ ID NO: 1700826 - RNA, 16 nt, Salmonella enterica enterica serovar Typhi
gccauccggcaauuaa

SEQ ID NO: 1700827 - RNA, 20 nt, Salmonella enterica enterica serovar Typhi
gccauccggcacuacagcgu

SEQ ID NO: 1700828 - RNA, 22 nt, Salmonella enterica enterica serovar Typhi
gccacggcguguugaaauccuc

SEQ ID NO: 1700829 - RNA, 24 nt, Salmonella enterica enterica serovar Typhi
gccacggcuuucacgccauuggca

SEQ ID NO: 1700830 - RNA, 15 nt, Salmonella enterica enterica serovar Typhi
gccacggauggccuc

SEQ ID NO: 1700831 - RNA, 17 nt, Salmonella enterica enterica serovar Typhi
gccacgcucgcuggugc

SEQ ID NO: 1700832 - RNA, 19 nt, Salmonella enterica enterica serovar Typhi
gccacgcucgcuggugcca

SEQ ID NO: 1700833 - RNA, 13 nt, Salmonella enterica enterica serovar Typhi
gccacgcgcguca

SEQ ID NO: 1700834 - RNA, 14 nt, Salmonella enterica enterica serovar Typhi
gccacgcgccagcc

SEQ ID NO: 1700835 - RNA, 14 nt, Salmonella enterica enterica serovar Typhi
gccacgcgacgcca

SEQ ID NO: 1700836 - RNA, 16 nt, Salmonella enterica enterica serovar Typhi
gccacgccgcuccaca

SEQ ID NO: 1700837 - RNA, 16 nt, Salmonella enterica enterica serovar Typhi
gccacgccgcccgcgu

SEQ ID NO: 1700838 - RNA, 16 nt, Salmonella enterica enterica serovar Typhi
gccacgguacggcuuu

SEQ ID NO: 1700839 - RNA, 17 nt, Salmonella enterica enterica serovar Typhi
gccacgguuggcccagc

SEQ ID NO: 1700840 - RNA, 19 nt, Salmonella enterica enterica serovar Typhi
gccacgguguggcccagcg

SEQ ID NO: 1700841 - RNA, 16 nt, Salmonella enterica enterica serovar Typhi
gccacgguuggcccag

SEQ ID NO: 1700842 - RNA, 18 nt, Salmonella enterica enterica serovar Typhi
gccacucuggcgacgcca

SEQ ID NO: 1700843 - RNA, 19 nt, Salmonella enterica enterica serovar Typhi
gccacucuggcgacgccaa

SEQ ID NO: 1700844 - RNA, 16 nt, Salmonella enterica enterica serovar Typhi
gccacguuuuccugcg

SEQ ID NO: 1700845 - RNA, 23 nt, Salmonella enterica enterica serovar Typhi
gccacgucugaugcguggcugaa

SEQ ID NO: 1700846 - RNA, 17 nt, Salmonella enterica enterica serovar Typhi
gccagaaucaccucuuu

SEQ ID NO: 1700847 - RNA, 16 nt, Salmonella enterica enterica serovar Typhi
gccacugcccuggaag

SEQ ID NO: 1700848 - RNA, 16 nt, Salmonella enterica enterica serovar Typhi
gccagaccaauagaga

SEQ ID NO: 1700849 - RNA, 19 nt, Salmonella enterica enterica serovar Typhi
gccagaggcgugcaugggc

SEQ ID NO: 1700850 - RNA, 16 nt, Salmonella enterica enterica serovar Typhi
gccagaccgaaaagcc

SEQ ID NO: 1700851 - RNA, 22 nt, Salmonella enterica enterica serovar Typhi
gccagacagcccuauaacagcg

SEQ ID NO: 1700852 - RNA, 19 nt, Salmonella enterica enterica serovar Typhi
gccagacagauaacaccag

SEQ ID NO: 1700853 - RNA, 14 nt, Salmonella enterica enterica serovar Typhi
gccagaccaauaga

SEQ ID NO: 1700854 - RNA, 17 nt, Salmonella enterica enterica serovar Typhi
gccagaaugcccagcaa

SEQ ID NO: 1700855 - RNA, 15 nt, Salmonella enterica enterica serovar Typhi
gccagaugcagcggc

SEQ ID NO: 1700856 - RNA, 19 nt, Salmonella enterica enterica serovar Typhi
gccagaugguaagcauagc

SEQ ID NO: 1700857 - RNA, 19 nt, Salmonella enterica enterica serovar Typhi
gccagauggauaaccugcc

SEQ ID NO: 1700858 - RNA, 21 nt, Salmonella enterica enterica serovar Typhi
gccagauggauaaccugccgg

SEQ ID NO: 1700859 - RNA, 14 nt, Salmonella enterica enterica serovar Typhi
gccagauucaccac

SEQ ID NO: 1700860 - RNA, 19 nt, Salmonella enterica enterica serovar Typhi
gccagauaaagcagcgaca

SEQ ID NO: 1700861 - RNA, 18 nt, Salmonella enterica enterica serovar Typhi
gccagauaaagcagcgac

SEQ ID NO: 1700862 - RNA, 21 nt, Salmonella enterica enterica serovar Typhi
gccagauaaucgccgccagcu

SEQ ID NO: 1700863 - RNA, 15 nt, Salmonella enterica enterica serovar Typhi
gcauacagcuuuuac

SEQ ID NO: 1700864 - RNA, 22 nt, Salmonella enterica enterica serovar Typhi
gcauacacgccgggcacgcuga

SEQ ID NO: 1700865 - RNA, 18 nt, Salmonella enterica enterica serovar Typhi
gcauacacaucuucuaca

SEQ ID NO: 1700866 - RNA, 16 nt, Salmonella enterica enterica serovar Typhi
gcauagccccagcgca

SEQ ID NO: 1700867 - RNA, 20 nt, Salmonella enterica enterica serovar Typhi
gcauaccgugugcagugaca

SEQ ID NO: 1700868 - RNA, 13 nt, Salmonella enterica enterica serovar Typhi
gcauaccgcccaa

SEQ ID NO: 1700869 - RNA, 17 nt, Salmonella enterica enterica serovar Typhi
gcauaccgcccagaacg

SEQ ID NO: 1700870 - RNA, 17 nt, Salmonella enterica enterica serovar Typhi
gccacauagcauccaga

SEQ ID NO: 1700871 - RNA, 20 nt, Salmonella enterica enterica serovar Typhi
gcauagcgcgaaugauuuua

SEQ ID NO: 1700872 - RNA, 19 nt, Salmonella enterica enterica serovar Typhi
gcauagcgucaucaacaua

SEQ ID NO: 1700873 - RNA, 23 nt, Salmonella enterica enterica serovar Typhi
gcauagccggauaauuuauccag

SEQ ID NO: 1700874 - RNA, 22 nt, Salmonella enterica enterica serovar Typhi
gccacaugauguuguucgucuu

SEQ ID NO: 1700875 - RNA, 13 nt, Salmonella enterica enterica serovar Typhi
gccaccacucggc

SEQ ID NO: 1700876 - RNA, 15 nt, Salmonella enterica enterica serovar Typhi
gccaccacgcccaac

SEQ ID NO: 1700877 - RNA, 21 nt, Salmonella enterica enterica serovar Typhi
gccacgccaucggcuaagcca

SEQ ID NO: 1700878 - RNA, 14 nt, Salmonella enterica enterica serovar Typhi
gccacgccauugcu

SEQ ID NO: 1700879 - RNA, 15 nt, Salmonella enterica enterica serovar Typhi
gccacgcccacgcug

SEQ ID NO: 1700880 - RNA, 12 nt, Salmonella enterica enterica serovar Typhi
gccacgccgcca

SEQ ID NO: 1700881 - RNA, 14 nt, Salmonella enterica enterica serovar Typhi
gccacgcccgccgc

SEQ ID NO: 1700882 - RNA, 18 nt, Salmonella enterica enterica serovar Typhi
gccacgccgccauccggc

SEQ ID NO: 1700883 - RNA, 12 nt, Salmonella enterica enterica serovar Typhi
gccacgccgccc

SEQ ID NO: 1700884 - RNA, 14 nt, Salmonella enterica enterica serovar Typhi
gccacgccgcccgc

SEQ ID NO: 1700885 - RNA, 20 nt, Salmonella enterica enterica serovar Typhi
gccacgcagauaucuuccag

SEQ ID NO: 1700886 - RNA, 13 nt, Salmonella enterica enterica serovar Typhi
gccaccgccagcc

SEQ ID NO: 1700887 - RNA, 16 nt, Salmonella enterica enterica serovar Typhi
gccaccgcauuuucag

SEQ ID NO: 1700888 - RNA, 15 nt, Salmonella enterica enterica serovar Typhi
gccaccgcccagaga

SEQ ID NO: 1700889 - RNA, 22 nt, Salmonella enterica enterica serovar Typhi
gccaccgguauuaaagcgcggg

SEQ ID NO: 1700890 - RNA, 20 nt, Salmonella enterica enterica serovar Typhi
gccgccauaacgccggcgcu

SEQ ID NO: 1700891 - RNA, 14 nt, Salmonella enterica enterica serovar Typhi
gccgcccaaccagc

SEQ ID NO: 1700892 - RNA, 17 nt, Salmonella enterica enterica serovar Typhi
gccgccaggcaaauucu

SEQ ID NO: 1700893 - RNA, 12 nt, Salmonella enterica enterica serovar Typhi
gccgccagcgac

SEQ ID NO: 1700894 - RNA, 22 nt, Salmonella enterica enterica serovar Typhi
gccgccaguaauuuuucuccca

SEQ ID NO: 1700895 - RNA, 22 nt, Salmonella enterica enterica serovar Typhi
gccgcccauuaauaucagcccc

SEQ ID NO: 1700896 - RNA, 16 nt, Salmonella enterica enterica serovar Typhi
gccgcccaggccaugc

SEQ ID NO: 1700897 - RNA, 20 nt, Salmonella enterica enterica serovar Typhi
gccgcccaggccaugcgccg

SEQ ID NO: 1700898 - RNA, 18 nt, Salmonella enterica enterica serovar Typhi
gccgcccaaccagcccag

SEQ ID NO: 1700899 - RNA, 13 nt, Salmonella enterica enterica serovar Typhi
gccgccccccguc

SEQ ID NO: 1700900 - RNA, 23 nt, Salmonella enterica enterica serovar Typhi
gccgccuccggggaagcgcgcgc

SEQ ID NO: 1700901 - RNA, 14 nt, Salmonella enterica enterica serovar Typhi
gccgccucccccuc

SEQ ID NO: 1700902 - RNA, 18 nt, Salmonella enterica enterica serovar Typhi
gccgccuccagcauacug

SEQ ID NO: 1700903 - RNA, 22 nt, Salmonella enterica enterica serovar Typhi
gccgccugcacggcgucauuca

SEQ ID NO: 1700904 - RNA, 14 nt, Salmonella enterica enterica serovar Typhi
gccgccugaugcug

SEQ ID NO: 1700905 - RNA, 15 nt, Salmonella enterica enterica serovar Typhi
gccgccugaugcugg

SEQ ID NO: 1700906 - RNA, 20 nt, Salmonella enterica enterica serovar Typhi
gccgcgaacguucaaaauca

SEQ ID NO: 1700907 - RNA, 22 nt, Salmonella enterica enterica serovar Typhi
gccgcgaacguucaaaaucaaa

SEQ ID NO: 1700908 - RNA, 16 nt, Salmonella enterica enterica serovar Typhi
gccgcgacggcaggca

SEQ ID NO: 1700909 - RNA, 16 nt, Salmonella enterica enterica serovar Typhi
gccgcgacgcgcgagc

SEQ ID NO: 1700910 - RNA, 16 nt, Salmonella enterica enterica serovar Typhi
gccgccgcaggacagc

SEQ ID NO: 1700911 - RNA, 14 nt, Salmonella enterica enterica serovar Typhi
gccgccgcaggaca

SEQ ID NO: 1700912 - RNA, 11 nt, Salmonella enterica enterica serovar Typhi
gccgccgcagg

SEQ ID NO: 1700913 - RNA, 11 nt, Salmonella enterica enterica serovar Typhi
gccgcccugcg

SEQ ID NO: 1700914 - RNA, 11 nt, Salmonella enterica enterica serovar Typhi
gccgccgggca

SEQ ID NO: 1700915 - RNA, 15 nt, Salmonella enterica enterica serovar Typhi
gccgccaacgccagc

SEQ ID NO: 1700916 - RNA, 18 nt, Salmonella enterica enterica serovar Typhi
gccgccaacgccagcagc

SEQ ID NO: 1700917 - RNA, 16 nt, Salmonella enterica enterica serovar Typhi
gccgccaacgccagca

SEQ ID NO: 1700918 - RNA, 17 nt, Salmonella enterica enterica serovar Typhi
gccgccaacgccagcag

SEQ ID NO: 1700919 - RNA, 19 nt, Salmonella enterica enterica serovar Typhi
gccgccacauugcgcgccg

SEQ ID NO: 1700920 - RNA, 17 nt, Salmonella enterica enterica serovar Typhi
gccgccaauaggggcgg

SEQ ID NO: 1700921 - RNA, 17 nt, Salmonella enterica enterica serovar Typhi
gccgccaaagcgcccga

SEQ ID NO: 1700922 - RNA, 14 nt, Salmonella enterica enterica serovar Typhi
gccgccaaagcgcc

SEQ ID NO: 1700923 - RNA, 14 nt, Salmonella enterica enterica serovar Typhi
gccgccaccgccuc

SEQ ID NO: 1700924 - RNA, 20 nt, Salmonella enterica enterica serovar Typhi
gccgccagauuauccagucc

SEQ ID NO: 1700925 - RNA, 24 nt, Salmonella enterica enterica serovar Typhi
gccgccagaaucaccucuuucucc

SEQ ID NO: 1700926 - RNA, 20 nt, Salmonella enterica enterica serovar Typhi
gccgcagugaagaauggcgc

SEQ ID NO: 1700927 - RNA, 23 nt, Salmonella enterica enterica serovar Typhi
gccgcaucauaguuuuuccccau

SEQ ID NO: 1700928 - RNA, 15 nt, Salmonella enterica enterica serovar Typhi
gccgcagcccgccca

SEQ ID NO: 1700929 - RNA, 12 nt, Salmonella enterica enterica serovar Typhi
gccgcaggccau

SEQ ID NO: 1700930 - RNA, 20 nt, Salmonella enterica enterica serovar Typhi
gccgcaggaaagugccuggg

SEQ ID NO: 1700931 - RNA, 17 nt, Salmonella enterica enterica serovar Typhi
gccgcagcuccaugucu

SEQ ID NO: 1700932 - RNA, 21 nt, Salmonella enterica enterica serovar Typhi
gccgcaccagucggcaaagac

SEQ ID NO: 1700933 - RNA, 20 nt, Salmonella enterica enterica serovar Typhi
gccgauauugcggccuuccu

SEQ ID NO: 1700934 - RNA, 22 nt, Salmonella enterica enterica serovar Typhi
gccgauauugcggccuuccuga

SEQ ID NO: 1700935 - RNA, 22 nt, Salmonella enterica enterica serovar Typhi
gcccuggugagcuccagcccgc

SEQ ID NO: 1700936 - RNA, 19 nt, Salmonella enterica enterica serovar Typhi
gccgaucuuuaccucaggu

SEQ ID NO: 1700937 - RNA, 18 nt, Salmonella enterica enterica serovar Typhi
gccgaugacucccagucc

SEQ ID NO: 1700938 - RNA, 14 nt, Salmonella enterica enterica serovar Typhi
gccgaugccgccga

SEQ ID NO: 1700939 - RNA, 16 nt, Salmonella enterica enterica serovar Typhi
gccggcgaccaugcca

SEQ ID NO: 1700940 - RNA, 13 nt, Salmonella enterica enterica serovar Typhi
gccggggcgcugg

SEQ ID NO: 1700941 - RNA, 22 nt, Salmonella enterica enterica serovar Typhi
gccggggcucccacucuuccag

SEQ ID NO: 1700942 - RNA, 19 nt, Salmonella enterica enterica serovar Typhi
gccggcgcguaauuccgca

SEQ ID NO: 1700943 - RNA, 17 nt, Salmonella enterica enterica serovar Typhi
gccggaaagaauaaucg

SEQ ID NO: 1700944 - RNA, 22 nt, Salmonella enterica enterica serovar Typhi
gccggaaaacauauagcaguuu

SEQ ID NO: 1700945 - RNA, 22 nt, Salmonella enterica enterica serovar Typhi
gccggaaauagagagggccgca

SEQ ID NO: 1700946 - RNA, 16 nt, Salmonella enterica enterica serovar Typhi
gccggaaaucacccaa

SEQ ID NO: 1700947 - RNA, 17 nt, Salmonella enterica enterica serovar Typhi
gccgcugucgccagaau

SEQ ID NO: 1700948 - RNA, 17 nt, Salmonella enterica enterica serovar Typhi
gccggaggauauuuauu

SEQ ID NO: 1700949 - RNA, 16 nt, Salmonella enterica enterica serovar Typhi
gccggaaccguucuca

SEQ ID NO: 1700950 - RNA, 13 nt, Salmonella enterica enterica serovar Typhi
gccggacagcagc

SEQ ID NO: 1700951 - RNA, 16 nt, Salmonella enterica enterica serovar Typhi
gccggcaggcagcgcc

SEQ ID NO: 1700952 - RNA, 15 nt, Salmonella enterica enterica serovar Typhi
gccggcaucauucug

SEQ ID NO: 1700953 - RNA, 19 nt, Salmonella enterica enterica serovar Typhi
gccggcaucauucugcagg

SEQ ID NO: 1700954 - RNA, 20 nt, Salmonella enterica enterica serovar Typhi
gccggcaaagguugccgcaa

SEQ ID NO: 1700955 - RNA, 15 nt, Salmonella enterica enterica serovar Typhi
gccggauaagacgcu

SEQ ID NO: 1700956 - RNA, 22 nt, Salmonella enterica enterica serovar Typhi
gccggauaaggcggagccgcca

SEQ ID NO: 1700957 - RNA, 22 nt, Salmonella enterica enterica serovar Typhi
gccggauaagacgcgcagcggc

SEQ ID NO: 1700958 - RNA, 23 nt, Salmonella enterica enterica serovar Typhi
gccgcguuuaagucccuggcgcg

SEQ ID NO: 1700959 - RNA, 16 nt, Salmonella enterica enterica serovar Typhi
gccgcuagcggcggcc

SEQ ID NO: 1700960 - RNA, 22 nt, Salmonella enterica enterica serovar Typhi
gccgcuggauaauugcucugcc

SEQ ID NO: 1700961 - RNA, 16 nt, Salmonella enterica enterica serovar Typhi
gccgcugauauucacc

SEQ ID NO: 1700962 - RNA, 21 nt, Salmonella enterica enterica serovar Typhi
gccucguaucugucccagccu

SEQ ID NO: 1700963 - RNA, 17 nt, Salmonella enterica enterica serovar Typhi
gccucguccugcaauuu

SEQ ID NO: 1700964 - RNA, 17 nt, Salmonella enterica enterica serovar Typhi
gccucuacccaugaagc

SEQ ID NO: 1700965 - RNA, 18 nt, Salmonella enterica enterica serovar Typhi
gccucgcgcauccgggcc

SEQ ID NO: 1700966 - RNA, 16 nt, Salmonella enterica enterica serovar Typhi
gccucgccaaagcgcu

SEQ ID NO: 1700967 - RNA, 18 nt, Salmonella enterica enterica serovar Typhi
gccucgccaaagcgcugc

SEQ ID NO: 1700968 - RNA, 17 nt, Salmonella enterica enterica serovar Typhi
gccuccagcgggcuggc

SEQ ID NO: 1700969 - RNA, 18 nt, Salmonella enterica enterica serovar Typhi
gccuccgcguagcccagc

SEQ ID NO: 1700970 - RNA, 21 nt, Salmonella enterica enterica serovar Typhi
gccuccgcguagcccagcgcc

SEQ ID NO: 1700971 - RNA, 18 nt, Salmonella enterica enterica serovar Typhi
gccuccggaugacgccgc

SEQ ID NO: 1700972 - RNA, 19 nt, Salmonella enterica enterica serovar Typhi
gccuccggcggugaagcag

SEQ ID NO: 1700973 - RNA, 20 nt, Salmonella enterica enterica serovar Typhi
gccucaucgggacggcgguc

SEQ ID NO: 1700974 - RNA, 14 nt, Salmonella enterica enterica serovar Typhi
gccucaucugcuuc

SEQ ID NO: 1700975 - RNA, 21 nt, Salmonella enterica enterica serovar Typhi
gccucauccccugacgcgcgc

SEQ ID NO: 1700976 - RNA, 16 nt, Salmonella enterica enterica serovar Typhi
gccucacguagaucuu

SEQ ID NO: 1700977 - RNA, 16 nt, Salmonella enterica enterica serovar Typhi
gccuccacaaagcgcg

SEQ ID NO: 1700978 - RNA, 21 nt, Salmonella enterica enterica serovar Typhi
gccgugcccagcaucccgcug

SEQ ID NO: 1700979 - RNA, 23 nt, Salmonella enterica enterica serovar Typhi
gccgucguuaacaucaucaggcc

SEQ ID NO: 1700980 - RNA, 23 nt, Salmonella enterica enterica serovar Typhi
gccguuaacuggcgcaucugguc

SEQ ID NO: 1700981 - RNA, 18 nt, Salmonella enterica enterica serovar Typhi
gccguguucuuacccacu

SEQ ID NO: 1700982 - RNA, 20 nt, Salmonella enterica enterica serovar Typhi
gccgugucgaccggcaccau

SEQ ID NO: 1700983 - RNA, 16 nt, Salmonella enterica enterica serovar Typhi
gccguguucuuaccca

SEQ ID NO: 1700984 - RNA, 21 nt, Salmonella enterica enterica serovar Typhi
gccguggcggugacuuccuga

SEQ ID NO: 1700985 - RNA, 15 nt, Salmonella enterica enterica serovar Typhi
gccggguaaacgcag

SEQ ID NO: 1700986 - RNA, 17 nt, Salmonella enterica enterica serovar Typhi
gccggguuugccgugcg

SEQ ID NO: 1700987 - RNA, 13 nt, Salmonella enterica enterica serovar Typhi
gccgguaagaaga

SEQ ID NO: 1700988 - RNA, 21 nt, Salmonella enterica enterica serovar Typhi
gccgguaagaagaaccagcgc

SEQ ID NO: 1700989 - RNA, 22 nt, Salmonella enterica enterica serovar Typhi
gccucaauugccgccagcuccu

SEQ ID NO: 1700990 - RNA, 19 nt, Salmonella enterica enterica serovar Typhi
gccuaugcugucgcaauuu

SEQ ID NO: 1700991 - RNA, 21 nt, Salmonella enterica enterica serovar Typhi
gccucaaccaacggcgcuggc

SEQ ID NO: 1700992 - RNA, 18 nt, Salmonella enterica enterica serovar Typhi
gccuauuuucucuuccac

SEQ ID NO: 1700993 - RNA, 18 nt, Salmonella enterica enterica serovar Typhi
gccuagcgcgcgcaguuu

SEQ ID NO: 1700994 - RNA, 21 nt, Salmonella enterica enterica serovar Typhi
gccuagcugcguuuccagcca

SEQ ID NO: 1700995 - RNA, 12 nt, Salmonella enterica enterica serovar Typhi
gccuaucgccau

SEQ ID NO: 1700996 - RNA, 17 nt, Salmonella enterica enterica serovar Typhi
gccuaccugccgccaua

SEQ ID NO: 1700997 - RNA, 16 nt, Salmonella enterica enterica serovar Typhi
gccuacagaacugcac

SEQ ID NO: 1700998 - RNA, 21 nt, Salmonella enterica enterica serovar Typhi
gccuacaacucagcguaauug

SEQ ID NO: 1700999 - RNA, 18 nt, Salmonella enterica enterica serovar Typhi
gccuacaaggcauucagg

SEQ ID NO: 1701000 - RNA, 12 nt, Salmonella enterica enterica serovar Typhi
gccuacaaagcc

SEQ ID NO: 1701001 - RNA, 23 nt, Salmonella enterica enterica serovar Typhi
gccuaaugggccagauucuuagu

SEQ ID NO: 1701002 - RNA, 15 nt, Salmonella enterica enterica serovar Typhi
gccuaccugccgcca

SEQ ID NO: 1701003 - RNA, 14 nt, Salmonella enterica enterica serovar Typhi
gccuacauccggcu

SEQ ID NO: 1701004 - RNA, 15 nt, Salmonella enterica enterica serovar Typhi
gccuaccagucgacu

SEQ ID NO: 1701005 - RNA, 12 nt, Salmonella enterica enterica serovar Typhi
gccuaagcccac

SEQ ID NO: 1701006 - RNA, 15 nt, Salmonella enterica enterica serovar Typhi
gccuaacgccagcau

SEQ ID NO: 1701007 - RNA, 14 nt, Salmonella enterica enterica serovar Typhi
gccuaaauuuaacu

SEQ ID NO: 1701008 - RNA, 20 nt, Salmonella enterica enterica serovar Typhi
gccugccagcaacccaccug

SEQ ID NO: 1701009 - RNA, 18 nt, Salmonella enterica enterica serovar Typhi
gccugcauaauugcugac

SEQ ID NO: 1701010 - RNA, 21 nt, Salmonella enterica enterica serovar Typhi
gccugcauacguuucaccagc

SEQ ID NO: 1701011 - RNA, 19 nt, Salmonella enterica enterica serovar Typhi
gccugcaucaccucagaau

SEQ ID NO: 1701012 - RNA, 22 nt, Salmonella enterica enterica serovar Typhi
gccugcacggcgucauucacau

SEQ ID NO: 1701013 - RNA, 21 nt, Salmonella enterica enterica serovar Typhi
gccugccgucgcggcuuucag

SEQ ID NO: 1701014 - RNA, 13 nt, Salmonella enterica enterica serovar Typhi
gccugccgggccu

SEQ ID NO: 1701015 - RNA, 14 nt, Salmonella enterica enterica serovar Typhi
gccugccgcgcccg

SEQ ID NO: 1701016 - RNA, 16 nt, Salmonella enterica enterica serovar Typhi
gccugccgcgccgccg

SEQ ID NO: 1701017 - RNA, 19 nt, Salmonella enterica enterica serovar Typhi
gccugccgcauguccccag

SEQ ID NO: 1701018 - RNA, 18 nt, Salmonella enterica enterica serovar Typhi
gccugcgaaugcaggccg

SEQ ID NO: 1701019 - RNA, 18 nt, Salmonella enterica enterica serovar Typhi
gccugccgggccugcggc

SEQ ID NO: 1701020 - RNA, 15 nt, Salmonella enterica enterica serovar Typhi
gccugccugaagcgc

SEQ ID NO: 1701021 - RNA, 15 nt, Salmonella enterica enterica serovar Typhi
gccugcgccagcgcc

SEQ ID NO: 1701022 - RNA, 17 nt, Salmonella enterica enterica serovar Typhi
gccugcgcgauggaugc

SEQ ID NO: 1701023 - RNA, 19 nt, Salmonella enterica enterica serovar Typhi
gccugcgccuauuguucca

SEQ ID NO: 1701024 - RNA, 16 nt, Salmonella enterica enterica serovar Typhi
gccugauucauuccca

SEQ ID NO: 1701025 - RNA, 21 nt, Salmonella enterica enterica serovar Typhi
gccugauucgugacaucaagc

SEQ ID NO: 1701026 - RNA, 22 nt, Salmonella enterica enterica serovar Typhi
gccugauggucgcucuggucga

SEQ ID NO: 1701027 - RNA, 21 nt, Salmonella enterica enterica serovar Typhi
gccugauggcgcuacgccauc

SEQ ID NO: 1701028 - RNA, 16 nt, Salmonella enterica enterica serovar Typhi
gccugaucuuucuggu

SEQ ID NO: 1701029 - RNA, 24 nt, Salmonella enterica enterica serovar Typhi
gccugaugcgcguuuagcgccagc

SEQ ID NO: 1701030 - RNA, 23 nt, Salmonella enterica enterica serovar Typhi
gccugaugcugcgcauccgcggc

SEQ ID NO: 1701031 - RNA, 16 nt, Salmonella enterica enterica serovar Typhi
gccugaugagcgcagc

SEQ ID NO: 1701032 - RNA, 20 nt, Salmonella enterica enterica serovar Typhi
gccugaugagcgcagcgacu

SEQ ID NO: 1701033 - RNA, 13 nt, Salmonella enterica enterica serovar Typhi
gccugaugcgccg

SEQ ID NO: 1701034 - RNA, 15 nt, Salmonella enterica enterica serovar Typhi
gccugaugcgccgcc

SEQ ID NO: 1701035 - RNA, 19 nt, Salmonella enterica enterica serovar Typhi
gccugaugcgccgccuugg

SEQ ID NO: 1701036 - RNA, 20 nt, Salmonella enterica enterica serovar Typhi
gccugaugcgccgccuuggc

SEQ ID NO: 1701037 - RNA, 20 nt, Salmonella enterica enterica serovar Typhi
gccugacgaaagucauccag

SEQ ID NO: 1701038 - RNA, 17 nt, Salmonella enterica enterica serovar Typhi
gccugacagcaaugagc

SEQ ID NO: 1701039 - RNA, 18 nt, Salmonella enterica enterica serovar Typhi
gccugauagcacagcgcu

SEQ ID NO: 1701040 - RNA, 21 nt, Salmonella enterica enterica serovar Typhi
gccugauaaauaugucggccc

SEQ ID NO: 1701041 - RNA, 13 nt, Salmonella enterica enterica serovar Typhi
gccucuuucagau

SEQ ID NO: 1701042 - RNA, 18 nt, Salmonella enterica enterica serovar Typhi
gccucuuucagaucgccg

SEQ ID NO: 1701043 - RNA, 21 nt, Salmonella enterica enterica serovar Typhi
gccucuuuuuucgccacgcca

SEQ ID NO: 1701044 - RNA, 19 nt, Salmonella enterica enterica serovar Typhi
gccucuuuuuucgccacgc

SEQ ID NO: 1701045 - RNA, 18 nt, Salmonella enterica enterica serovar Typhi
gccugaaugcacugcuga

SEQ ID NO: 1701046 - RNA, 13 nt, Salmonella enterica enterica serovar Typhi
gccugaauaauga

SEQ ID NO: 1701047 - RNA, 14 nt, Salmonella enterica enterica serovar Typhi
gccucuuacagggc

SEQ ID NO: 1701048 - RNA, 14 nt, Salmonella enterica enterica serovar Typhi
gccucuuccgccug

SEQ ID NO: 1701049 - RNA, 21 nt, Salmonella enterica enterica serovar Typhi
gccucuucuggcucccgcagc

SEQ ID NO: 1701050 - RNA, 13 nt, Salmonella enterica enterica serovar Typhi
gccucucccgaac

SEQ ID NO: 1701051 - RNA, 16 nt, Salmonella enterica enterica serovar Typhi
gccucuaucuucucag

SEQ ID NO: 1701052 - RNA, 14 nt, Salmonella enterica enterica serovar Typhi
gccucuaucuucuc

SEQ ID NO: 1701053 - RNA, 13 nt, Salmonella enterica enterica serovar Typhi
gccucugauuuuu

SEQ ID NO: 1701054 - RNA, 18 nt, Salmonella enterica enterica serovar Typhi
gccucucguaagagaggc

SEQ ID NO: 1701055 - RNA, 21 nt, Salmonella enterica enterica serovar Typhi
gccugugcuuucgccaccagc

SEQ ID NO: 1701056 - RNA, 19 nt, Salmonella enterica enterica serovar Typhi
gccugugaucggagaaaua

SEQ ID NO: 1701057 - RNA, 18 nt, Salmonella enterica enterica serovar Typhi
gccuguuagggcgcggcu

SEQ ID NO: 1701058 - RNA, 15 nt, Salmonella enterica enterica serovar Typhi
gccugucuauuguuu

SEQ ID NO: 1701059 - RNA, 16 nt, Salmonella enterica enterica serovar Typhi
gccugucuccagcgcc

SEQ ID NO: 1701060 - RNA, 16 nt, Salmonella enterica enterica serovar Typhi
gccuguacuugcgccg

SEQ ID NO: 1701061 - RNA, 17 nt, Salmonella enterica enterica serovar Typhi
gccuguaguacaugcca

SEQ ID NO: 1701062 - RNA, 19 nt, Salmonella enterica enterica serovar Typhi
gccuguaaaacaacccccg

SEQ ID NO: 1701063 - RNA, 18 nt, Salmonella enterica enterica serovar Typhi
gccuguaaacguuccugc

SEQ ID NO: 1701064 - RNA, 19 nt, Salmonella enterica enterica serovar Typhi
gccuguaaacguuccugcc

SEQ ID NO: 1701065 - RNA, 17 nt, Salmonella enterica enterica serovar Typhi
gccuguaaggcucucuu

SEQ ID NO: 1701066 - RNA, 21 nt, Salmonella enterica enterica serovar Typhi
gccuguaaggucucagcgacc

SEQ ID NO: 1701067 - RNA, 17 nt, Salmonella enterica enterica serovar Typhi
gccuguaauggcgcucu

SEQ ID NO: 1701068 - RNA, 22 nt, Salmonella enterica enterica serovar Typhi
gccuguaauggcgcucuuuucc

SEQ ID NO: 1701069 - RNA, 18 nt, Salmonella enterica enterica serovar Typhi
gccuggcuuguuacugca

SEQ ID NO: 1701070 - RNA, 16 nt, Salmonella enterica enterica serovar Typhi
gccuggcugagaaaaa

SEQ ID NO: 1701071 - RNA, 13 nt, Salmonella enterica enterica serovar Typhi
gccuggcgcuggg

SEQ ID NO: 1701072 - RNA, 14 nt, Salmonella enterica enterica serovar Typhi
gccuggcgcugggu

SEQ ID NO: 1701073 - RNA, 22 nt, Salmonella enterica enterica serovar Typhi
gccuggugcccaaccugcgcag

SEQ ID NO: 1701074 - RNA, 21 nt, Salmonella enterica enterica serovar Typhi
gccugguuaacaauauugcgc

SEQ ID NO: 1701075 - RNA, 21 nt, Salmonella enterica enterica serovar Typhi
gccugguggcgacgcguggca

SEQ ID NO: 1701076 - RNA, 21 nt, Salmonella enterica enterica serovar Typhi
gccugcgcucauauacccugc

SEQ ID NO: 1701077 - RNA, 20 nt, Salmonella enterica enterica serovar Typhi
gccugcgguaaucgccgcga

SEQ ID NO: 1701078 - RNA, 14 nt, Salmonella enterica enterica serovar Typhi
gccugcugcgcaac

SEQ ID NO: 1701079 - RNA, 15 nt, Salmonella enterica enterica serovar Typhi
gccugcuccgccagg

SEQ ID NO: 1701080 - RNA, 14 nt, Salmonella enterica enterica serovar Typhi
gccugcgugcgccg

SEQ ID NO: 1701081 - RNA, 22 nt, Salmonella enterica enterica serovar Typhi
gccugcgguauauucccccugc

SEQ ID NO: 1701082 - RNA, 15 nt, Salmonella enterica enterica serovar Typhi
gccuggcauggugca

SEQ ID NO: 1701083 - RNA, 18 nt, Salmonella enterica enterica serovar Typhi
gccuggcauggugcagcc

SEQ ID NO: 1701084 - RNA, 19 nt, Salmonella enterica enterica serovar Typhi
gccuggcauggugcagccg

SEQ ID NO: 1701085 - RNA, 22 nt, Salmonella enterica enterica serovar Typhi
gccuggcauggugcagccgcca

SEQ ID NO: 1701086 - RNA, 20 nt, Salmonella enterica enterica serovar Typhi
gccugcugcgguaaggcagc

SEQ ID NO: 1701087 - RNA, 15 nt, Salmonella enterica enterica serovar Typhi
gccugcuguaaaaua

SEQ ID NO: 1701088 - RNA, 20 nt, Salmonella enterica enterica serovar Typhi
gccugcuguaaccccugcgc

SEQ ID NO: 1701089 - RNA, 22 nt, Salmonella enterica enterica serovar Typhi
gccugcuguacuuuugcuucca

SEQ ID NO: 1701090 - RNA, 16 nt, Salmonella enterica enterica serovar Typhi
gcgggcgaucggcugu

SEQ ID NO: 1701091 - RNA, 20 nt, Salmonella enterica enterica serovar Typhi
gcgggcgauagagaccgcuu

SEQ ID NO: 1701092 - RNA, 21 nt, Salmonella enterica enterica serovar Typhi
gcgggcuuuuuuugcccgcuc

SEQ ID NO: 1701093 - RNA, 15 nt, Salmonella enterica enterica serovar Typhi
gcgggccaauccagc

SEQ ID NO: 1701094 - RNA, 22 nt, Salmonella enterica enterica serovar Typhi
gcggggcaacagauacggcgcg

SEQ ID NO: 1701095 - RNA, 13 nt, Salmonella enterica enterica serovar Typhi
gcggggaaacucu

SEQ ID NO: 1701096 - RNA, 22 nt, Salmonella enterica enterica serovar Typhi
gcggcugacgcgaugacggcgc

SEQ ID NO: 1701097 - RNA, 16 nt, Salmonella enterica enterica serovar Typhi
gcggcugacacucauc

SEQ ID NO: 1701098 - RNA, 16 nt, Salmonella enterica enterica serovar Typhi
gcggcuguguccgcca

SEQ ID NO: 1701099 - RNA, 22 nt, Salmonella enterica enterica serovar Typhi
gcggcugaaccacccugaaaag

SEQ ID NO: 1701100 - RNA, 21 nt, Salmonella enterica enterica serovar Typhi
gcggcgcuuccagacuacgga

SEQ ID NO: 1701101 - RNA, 20 nt, Salmonella enterica enterica serovar Typhi
gcggcggacaacgcuccagc

SEQ ID NO: 1701102 - RNA, 13 nt, Salmonella enterica enterica serovar Typhi
gcggcggaaugcu

SEQ ID NO: 1701103 - RNA, 20 nt, Salmonella enterica enterica serovar Typhi
gcgggauaacgcaacaacag

SEQ ID NO: 1701104 - RNA, 20 nt, Salmonella enterica enterica serovar Typhi
gcgggauaucccacucuuca

SEQ ID NO: 1701105 - RNA, 22 nt, Salmonella enterica enterica serovar Typhi
gcgggauaucgcuggucggcug

SEQ ID NO: 1701106 - RNA, 18 nt, Salmonella enterica enterica serovar Typhi
gcgggauggccgccgagc

SEQ ID NO: 1701107 - RNA, 19 nt, Salmonella enterica enterica serovar Typhi
gcgggaugcguaauccggc

SEQ ID NO: 1701108 - RNA, 21 nt, Salmonella enterica enterica serovar Typhi
gcgggaugcuauaccgcccgc

SEQ ID NO: 1701109 - RNA, 15 nt, Salmonella enterica enterica serovar Typhi
gcggcuucacgccau

SEQ ID NO: 1701110 - RNA, 17 nt, Salmonella enterica enterica serovar Typhi
gcggcuucagcgacauc

SEQ ID NO: 1701111 - RNA, 19 nt, Salmonella enterica enterica serovar Typhi
gcggcuucgccagauccgg

SEQ ID NO: 1701112 - RNA, 22 nt, Salmonella enterica enterica serovar Typhi
gcggcuugaguuuuccgccauu

SEQ ID NO: 1701113 - RNA, 21 nt, Salmonella enterica enterica serovar Typhi
gcgggcauauucuggcgacgg

SEQ ID NO: 1701114 - RNA, 23 nt, Salmonella enterica enterica serovar Typhi
gcgggcaaaagggccauggcugg

SEQ ID NO: 1701115 - RNA, 16 nt, Salmonella enterica enterica serovar Typhi
gcgggcaauggcgcuc

SEQ ID NO: 1701116 - RNA, 17 nt, Salmonella enterica enterica serovar Typhi
gcggucaccuucggucc

SEQ ID NO: 1701117 - RNA, 14 nt, Salmonella enterica enterica serovar Typhi
gcggucagcggcgc

SEQ ID NO: 1701118 - RNA, 13 nt, Salmonella enterica enterica serovar Typhi
gcggucaggccag

SEQ ID NO: 1701119 - RNA, 14 nt, Salmonella enterica enterica serovar Typhi
gcggucgccgcaug

SEQ ID NO: 1701120 - RNA, 16 nt, Salmonella enterica enterica serovar Typhi
gcggucaaaagcugca

SEQ ID NO: 1701121 - RNA, 22 nt, Salmonella enterica enterica serovar Typhi
gcggucguauuuaccgcuggcg

SEQ ID NO: 1701122 - RNA, 16 nt, Salmonella enterica enterica serovar Typhi
gcggucggcaggcggu

SEQ ID NO: 1701123 - RNA, 15 nt, Salmonella enterica enterica serovar Typhi
gcgguggcgcacagu

SEQ ID NO: 1701124 - RNA, 19 nt, Salmonella enterica enterica serovar Typhi
gcguacuuucgccaguuca

SEQ ID NO: 1701125 - RNA, 15 nt, Salmonella enterica enterica serovar Typhi
gcguagucucccucc

SEQ ID NO: 1701126 - RNA, 12 nt, Salmonella enterica enterica serovar Typhi
gcguacccgcgg

SEQ ID NO: 1701127 - RNA, 15 nt, Salmonella enterica enterica serovar Typhi
gcguaccgcgcgccc

SEQ ID NO: 1701128 - RNA, 18 nt, Salmonella enterica enterica serovar Typhi
gcguaccgcuaucgccaa

SEQ ID NO: 1701129 - RNA, 14 nt, Salmonella enterica enterica serovar Typhi
gcguacagcgccau

SEQ ID NO: 1701130 - RNA, 15 nt, Salmonella enterica enterica serovar Typhi
gcguaccacgccgca

SEQ ID NO: 1701131 - RNA, 20 nt, Salmonella enterica enterica serovar Typhi
gcguaccagaaacagcgcgc

SEQ ID NO: 1701132 - RNA, 21 nt, Salmonella enterica enterica serovar Typhi
gcguaauccggccuggcgcag

SEQ ID NO: 1701133 - RNA, 16 nt, Salmonella enterica enterica serovar Typhi
gcguaaucagcuuuuc

SEQ ID NO: 1701134 - RNA, 22 nt, Salmonella enterica enterica serovar Typhi
gcguaauaugaauauccgccgc

SEQ ID NO: 1701135 - RNA, 21 nt, Salmonella enterica enterica serovar Typhi
gcguaaugcgccaggcagcac

SEQ ID NO: 1701136 - RNA, 22 nt, Salmonella enterica enterica serovar Typhi
gcguaauuuugccacccacuuc

SEQ ID NO: 1701137 - RNA, 18 nt, Salmonella enterica enterica serovar Typhi
gcguacaauggcaggcau

SEQ ID NO: 1701138 - RNA, 15 nt, Salmonella enterica enterica serovar Typhi
gcgguugcagcaaaa

SEQ ID NO: 1701139 - RNA, 23 nt, Salmonella enterica enterica serovar Typhi
gcgguuacagucuuuggaguaga

SEQ ID NO: 1701140 - RNA, 12 nt, Salmonella enterica enterica serovar Typhi
gcguaaagcugu

SEQ ID NO: 1701141 - RNA, 20 nt, Salmonella enterica enterica serovar Typhi
gcguaaaaaguuucaguggu

SEQ ID NO: 1701142 - RNA, 16 nt, Salmonella enterica enterica serovar Typhi
gcguaaacaggcgcgg

SEQ ID NO: 1701143 - RNA, 12 nt, Salmonella enterica enterica serovar Typhi
gcguaaacuucc

SEQ ID NO: 1701144 - RNA, 14 nt, Salmonella enterica enterica serovar Typhi
gcguaaaaauuuuc

SEQ ID NO: 1701145 - RNA, 22 nt, Salmonella enterica enterica serovar Typhi
gcguaaaagcgauaaagacagg

SEQ ID NO: 1701146 - RNA, 22 nt, Salmonella enterica enterica serovar Typhi
gcguaacagcgcuaucaggaag

SEQ ID NO: 1701147 - RNA, 18 nt, Salmonella enterica enterica serovar Typhi
gcguaacgccuccaccgu

SEQ ID NO: 1701148 - RNA, 18 nt, Salmonella enterica enterica serovar Typhi
gcgguuuacuucuucagu

SEQ ID NO: 1701149 - RNA, 19 nt, Salmonella enterica enterica serovar Typhi
gcgguuuucaauaauaaaa

SEQ ID NO: 1701150 - RNA, 13 nt, Salmonella enterica enterica serovar Typhi
gcggcgcgcccgg

SEQ ID NO: 1701151 - RNA, 18 nt, Salmonella enterica enterica serovar Typhi
gcggcgcucgccagcccg

SEQ ID NO: 1701152 - RNA, 15 nt, Salmonella enterica enterica serovar Typhi
gcggcgacaucgcca

SEQ ID NO: 1701153 - RNA, 22 nt, Salmonella enterica enterica serovar Typhi
gcggcgaauauagcuaaugcaa

SEQ ID NO: 1701154 - RNA, 18 nt, Salmonella enterica enterica serovar Typhi
gcggcgaagcaucuuucc

SEQ ID NO: 1701155 - RNA, 11 nt, Salmonella enterica enterica serovar Typhi
gcggccuugcc

SEQ ID NO: 1701156 - RNA, 21 nt, Salmonella enterica enterica serovar Typhi
gcggccuuuauccagcggcgc

SEQ ID NO: 1701157 - RNA, 20 nt, Salmonella enterica enterica serovar Typhi
gcggcgaaauauuaucgcca

SEQ ID NO: 1701158 - RNA, 16 nt, Salmonella enterica enterica serovar Typhi
gcggccgcuccgggcc

SEQ ID NO: 1701159 - RNA, 23 nt, Salmonella enterica enterica serovar Typhi
gcggcccgggagaacgccgggcc

SEQ ID NO: 1701160 - RNA, 22 nt, Salmonella enterica enterica serovar Typhi
gcggcaggauccccaucccaau

SEQ ID NO: 1701161 - RNA, 15 nt, Salmonella enterica enterica serovar Typhi
gcggcaggaucccca

SEQ ID NO: 1701162 - RNA, 14 nt, Salmonella enterica enterica serovar Typhi
gcggcagccaugcu

SEQ ID NO: 1701163 - RNA, 12 nt, Salmonella enterica enterica serovar Typhi
gcggcagggcag

SEQ ID NO: 1701164 - RNA, 18 nt, Salmonella enterica enterica serovar Typhi
gcggcagugggcuaugcu

SEQ ID NO: 1701165 - RNA, 21 nt, Salmonella enterica enterica serovar Typhi
gcggcaguacgagcauccaga

SEQ ID NO: 1701166 - RNA, 21 nt, Salmonella enterica enterica serovar Typhi
gcggcagucccaaugcggaaa

SEQ ID NO: 1701167 - RNA, 16 nt, Salmonella enterica enterica serovar Typhi
gcgcugucagugaaaa

SEQ ID NO: 1701168 - RNA, 16 nt, Salmonella enterica enterica serovar Typhi
gcgcuguacgccucuu

SEQ ID NO: 1701169 - RNA, 17 nt, Salmonella enterica enterica serovar Typhi
gcgcuguggucgucugg

SEQ ID NO: 1701170 - RNA, 15 nt, Salmonella enterica enterica serovar Typhi
gcgcugucugccggc

SEQ ID NO: 1701171 - RNA, 18 nt, Salmonella enterica enterica serovar Typhi
gcgcugguggccgggggc

SEQ ID NO: 1701172 - RNA, 19 nt, Salmonella enterica enterica serovar Typhi
gcgcugguggccgggggcg

SEQ ID NO: 1701173 - RNA, 14 nt, Salmonella enterica enterica serovar Typhi
gcgcuuaacgcgcu

SEQ ID NO: 1701174 - RNA, 23 nt, Salmonella enterica enterica serovar Typhi
gcgcuguuuauccacaggcgacu

SEQ ID NO: 1701175 - RNA, 18 nt, Salmonella enterica enterica serovar Typhi
gcgcuguguccgccugcu

SEQ ID NO: 1701176 - RNA, 17 nt, Salmonella enterica enterica serovar Typhi
gcgcuguucuugcugcu

SEQ ID NO: 1701177 - RNA, 22 nt, Salmonella enterica enterica serovar Typhi
gcgcuguucuugcugcugcuga

SEQ ID NO: 1701178 - RNA, 19 nt, Salmonella enterica enterica serovar Typhi
gcggcacuggcguagucuc

SEQ ID NO: 1701179 - RNA, 16 nt, Salmonella enterica enterica serovar Typhi
gcggccagcgggcguc

SEQ ID NO: 1701180 - RNA, 20 nt, Salmonella enterica enterica serovar Typhi
gcggccaugaucgccgccau

SEQ ID NO: 1701181 - RNA, 16 nt, Salmonella enterica enterica serovar Typhi
gcggccaugaucgccg

SEQ ID NO: 1701182 - RNA, 13 nt, Salmonella enterica enterica serovar Typhi
gcggccagauaag

SEQ ID NO: 1701183 - RNA, 18 nt, Salmonella enterica enterica serovar Typhi
gcggccaccgccaguucg

SEQ ID NO: 1701184 - RNA, 22 nt, Salmonella enterica enterica serovar Typhi
gcggcauuggcguuaccggcag

SEQ ID NO: 1701185 - RNA, 18 nt, Salmonella enterica enterica serovar Typhi
gcggccaaagggagcaga

SEQ ID NO: 1701186 - RNA, 19 nt, Salmonella enterica enterica serovar Typhi
gcggcaucucgccaaacca

SEQ ID NO: 1701187 - RNA, 15 nt, Salmonella enterica enterica serovar Typhi
gcucggcaauuucuu

SEQ ID NO: 1701188 - RNA, 20 nt, Salmonella enterica enterica serovar Typhi
gcucgcuuuuacucuuccug

SEQ ID NO: 1701189 - RNA, 23 nt, Salmonella enterica enterica serovar Typhi
gcucgcuaugaaaacgcagcccc

SEQ ID NO: 1701190 - RNA, 11 nt, Salmonella enterica enterica serovar Typhi
gcucgcggcgg

SEQ ID NO: 1701191 - RNA, 13 nt, Salmonella enterica enterica serovar Typhi
gcucgcggcggac

SEQ ID NO: 1701192 - RNA, 16 nt, Salmonella enterica enterica serovar Typhi
gcucgcauucgcgagc

SEQ ID NO: 1701193 - RNA, 18 nt, Salmonella enterica enterica serovar Typhi
gcucgcaggccauaaaac

SEQ ID NO: 1701194 - RNA, 12 nt, Salmonella enterica enterica serovar Typhi
gcuccgcacggu

SEQ ID NO: 1701195 - RNA, 20 nt, Salmonella enterica enterica serovar Typhi
gcuccgcaaagcccaucagc

SEQ ID NO: 1701196 - RNA, 14 nt, Salmonella enterica enterica serovar Typhi
gcuccgccagcaau

SEQ ID NO: 1701197 - RNA, 22 nt, Salmonella enterica enterica serovar Typhi
gcuccgccagcaaugccgccgc

SEQ ID NO: 1701198 - RNA, 21 nt, Salmonella enterica enterica serovar Typhi
gcuccaguuguuccagcagcu

SEQ ID NO: 1701199 - RNA, 18 nt, Salmonella enterica enterica serovar Typhi
gcuccauagaaaucagca

SEQ ID NO: 1701200 - RNA, 15 nt, Salmonella enterica enterica serovar Typhi
gcuccauagaaauca

SEQ ID NO: 1701201 - RNA, 19 nt, Salmonella enterica enterica serovar Typhi
gcuccaucacgguaaaccu

SEQ ID NO: 1701202 - RNA, 20 nt, Salmonella enterica enterica serovar Typhi
gcuccaucacgguaaaccug

SEQ ID NO: 1701203 - RNA, 20 nt, Salmonella enterica enterica serovar Typhi
gcuccgaauaauccuucccg

SEQ ID NO: 1701204 - RNA, 13 nt, Salmonella enterica enterica serovar Typhi
gcuccgaauaauc

SEQ ID NO: 1701205 - RNA, 15 nt, Salmonella enterica enterica serovar Typhi
gcuccaucuccggca

SEQ ID NO: 1701206 - RNA, 17 nt, Salmonella enterica enterica serovar Typhi
gcuccaucuccggcagc

SEQ ID NO: 1701207 - RNA, 12 nt, Salmonella enterica enterica serovar Typhi
gcucaauuuuuu

SEQ ID NO: 1701208 - RNA, 19 nt, Salmonella enterica enterica serovar Typhi
gcucaauuauacgcuggug

SEQ ID NO: 1701209 - RNA, 21 nt, Salmonella enterica enterica serovar Typhi
gcucaauccuucuaccuucac

SEQ ID NO: 1701210 - RNA, 13 nt, Salmonella enterica enterica serovar Typhi
gcuacugcaucug

SEQ ID NO: 1701211 - RNA, 16 nt, Salmonella enterica enterica serovar Typhi
gcuaggaacagugaca

SEQ ID NO: 1701212 - RNA, 15 nt, Salmonella enterica enterica serovar Typhi
gcuagggcaucagac

SEQ ID NO: 1701213 - RNA, 23 nt, Salmonella enterica enterica serovar Typhi
gcuagcugugguugcccgcaggc

SEQ ID NO: 1701214 - RNA, 18 nt, Salmonella enterica enterica serovar Typhi
gcucacuuuucuuuccug

SEQ ID NO: 1701215 - RNA, 15 nt, Salmonella enterica enterica serovar Typhi
gcucagaaauauuca

SEQ ID NO: 1701216 - RNA, 19 nt, Salmonella enterica enterica serovar Typhi
gcucaggagcgccugacag

SEQ ID NO: 1701217 - RNA, 23 nt, Salmonella enterica enterica serovar Typhi
gcucacccaguuuuuuucugcca

SEQ ID NO: 1701218 - RNA, 15 nt, Salmonella enterica enterica serovar Typhi
gcucaccagcccaac

SEQ ID NO: 1701219 - RNA, 20 nt, Salmonella enterica enterica serovar Typhi
gcucaccgagacugcccggc

SEQ ID NO: 1701220 - RNA, 22 nt, Salmonella enterica enterica serovar Typhi
gcucaccgagacugcccggcau

SEQ ID NO: 1701221 - RNA, 13 nt, Salmonella enterica enterica serovar Typhi
gcucauuucccaa

SEQ ID NO: 1701222 - RNA, 17 nt, Salmonella enterica enterica serovar Typhi
gcuccagcgccagcucc

SEQ ID NO: 1701223 - RNA, 18 nt, Salmonella enterica enterica serovar Typhi
gcuccagcgccagcucca

SEQ ID NO: 1701224 - RNA, 12 nt, Salmonella enterica enterica serovar Typhi
gcuccagccgcu

SEQ ID NO: 1701225 - RNA, 14 nt, Salmonella enterica enterica serovar Typhi
gcuccagcaucaca

SEQ ID NO: 1701226 - RNA, 9 nt, Salmonella enterica enterica serovar Typhi
gcuccagca

SEQ ID NO: 1701227 - RNA, 19 nt, Salmonella enterica enterica serovar Typhi
gcucaucagcgccauugcu

SEQ ID NO: 1701228 - RNA, 16 nt, Salmonella enterica enterica serovar Typhi
gcucauccagcaacag

SEQ ID NO: 1701229 - RNA, 16 nt, Salmonella enterica enterica serovar Typhi
gcucagggcauccgcc

SEQ ID NO: 1701230 - RNA, 19 nt, Salmonella enterica enterica serovar Typhi
gcucaggcgcgaauaaugc

SEQ ID NO: 1701231 - RNA, 20 nt, Salmonella enterica enterica serovar Typhi
gcuaauaugaauuauuuucu

SEQ ID NO: 1701232 - RNA, 16 nt, Salmonella enterica enterica serovar Typhi
gcuaauaugccaggcu

SEQ ID NO: 1701233 - RNA, 12 nt, Salmonella enterica enterica serovar Typhi
gcuaauaauucu

SEQ ID NO: 1701234 - RNA, 21 nt, Salmonella enterica enterica serovar Typhi
gcuaaucgugauaaauugcug

SEQ ID NO: 1701235 - RNA, 18 nt, Salmonella enterica enterica serovar Typhi
gcuaaucccgcucgccag

SEQ ID NO: 1701236 - RNA, 18 nt, Salmonella enterica enterica serovar Typhi
gcuaauccccccuuuuuu

SEQ ID NO: 1701237 - RNA, 18 nt, Salmonella enterica enterica serovar Typhi
gcuaaugauuaucuuuuu

SEQ ID NO: 1701238 - RNA, 18 nt, Salmonella enterica enterica serovar Typhi
gcuaaugaggaaaaagcc

SEQ ID NO: 1701239 - RNA, 17 nt, Salmonella enterica enterica serovar Typhi
gcuaacgcgccccaggu

SEQ ID NO: 1701240 - RNA, 20 nt, Salmonella enterica enterica serovar Typhi
gcuaagcgcccguagcucag

SEQ ID NO: 1701241 - RNA, 22 nt, Salmonella enterica enterica serovar Typhi
gcuaagcguuacggaaaaaaua

SEQ ID NO: 1701242 - RNA, 23 nt, Salmonella enterica enterica serovar Typhi
gcuaagcguuacggaaaaaauac

SEQ ID NO: 1701243 - RNA, 14 nt, Salmonella enterica enterica serovar Typhi
gcuaaagcgcuggc

SEQ ID NO: 1701244 - RNA, 18 nt, Salmonella enterica enterica serovar Typhi
gcuaaagcgcuggcggcg

SEQ ID NO: 1701245 - RNA, 18 nt, Salmonella enterica enterica serovar Typhi
gcuaaaccaaacuuaucu

SEQ ID NO: 1701246 - RNA, 19 nt, Salmonella enterica enterica serovar Typhi
gcuaaaccacaugaccagc

SEQ ID NO: 1701247 - RNA, 12 nt, Salmonella enterica enterica serovar Typhi
gcuaaaauaccc

SEQ ID NO: 1701248 - RNA, 20 nt, Salmonella enterica enterica serovar Typhi
gcuaaacaauuugcccagcg

SEQ ID NO: 1701249 - RNA, 21 nt, Salmonella enterica enterica serovar Typhi
gcuaaaacacccgcaaacuaa

SEQ ID NO: 1701250 - RNA, 16 nt, Salmonella enterica enterica serovar Typhi
gcuaaccuguucagcc

SEQ ID NO: 1701251 - RNA, 23 nt, Salmonella enterica enterica serovar Typhi
gcuaaaugacaaauagaagccac

SEQ ID NO: 1701252 - RNA, 14 nt, Salmonella enterica enterica serovar Typhi
gcuaccagcgcggc

SEQ ID NO: 1701253 - RNA, 23 nt, Salmonella enterica enterica serovar Typhi
gcuaccagcgcggcgccaguacu

SEQ ID NO: 1701254 - RNA, 20 nt, Salmonella enterica enterica serovar Typhi
gcuacagacaucuuugccaa

SEQ ID NO: 1701255 - RNA, 22 nt, Salmonella enterica enterica serovar Typhi
gcuacagacaucuuugccaaac

SEQ ID NO: 1701256 - RNA, 19 nt, Salmonella enterica enterica serovar Typhi
gcuacacgcgaauagccag

SEQ ID NO: 1701257 - RNA, 19 nt, Salmonella enterica enterica serovar Typhi
gcuacacgcguaaacuucc

SEQ ID NO: 1701258 - RNA, 11 nt, Salmonella enterica enterica serovar Typhi
gcuaauguacg

SEQ ID NO: 1701259 - RNA, 16 nt, Salmonella enterica enterica serovar Typhi
gcuaauggcuuauugg

SEQ ID NO: 1701260 - RNA, 18 nt, Salmonella enterica enterica serovar Typhi
gcuacgccuuauccggcc

SEQ ID NO: 1701261 - RNA, 22 nt, Salmonella enterica enterica serovar Typhi
gcuacgcugcgcguucugcucc

SEQ ID NO: 1701262 - RNA, 23 nt, Salmonella enterica enterica serovar Typhi
gcuacgcuuaucgggccuacgag

SEQ ID NO: 1701263 - RNA, 12 nt, Salmonella enterica enterica serovar Typhi
gcuacgggccgc

SEQ ID NO: 1701264 - RNA, 18 nt, Salmonella enterica enterica serovar Typhi
gcuacucaggagaucggc

SEQ ID NO: 1701265 - RNA, 15 nt, Salmonella enterica enterica serovar Typhi
gcuacguuuaucugg

SEQ ID NO: 1701266 - RNA, 12 nt, Salmonella enterica enterica serovar Typhi
gcuacccagaca

SEQ ID NO: 1701267 - RNA, 19 nt, Salmonella enterica enterica serovar Typhi
gcuacccgcugacgcugcc

SEQ ID NO: 1701268 - RNA, 17 nt, Salmonella enterica enterica serovar Typhi
gcuaccccggaaauaac

SEQ ID NO: 1701269 - RNA, 19 nt, Salmonella enterica enterica serovar Typhi
gcuaccgccacuuugcuuu

SEQ ID NO: 1701270 - RNA, 23 nt, Salmonella enterica enterica serovar Typhi
gcuacgauaaagcugaguaagga

SEQ ID NO: 1701271 - RNA, 20 nt, Salmonella enterica enterica serovar Typhi
gcuacgaccggucagccggu

SEQ ID NO: 1701272 - RNA, 22 nt, Salmonella enterica enterica serovar Typhi
gcuaccucguaucccgccuggc

SEQ ID NO: 1701273 - RNA, 21 nt, Salmonella enterica enterica serovar Typhi
gcuaccgucgacgucuuucuu

SEQ ID NO: 1701274 - RNA, 16 nt, Salmonella enterica enterica serovar Typhi
gcuaccguccaaauca

SEQ ID NO: 1701275 - RNA, 18 nt, Salmonella enterica enterica serovar Typhi
gcgucugagcaucccggu

SEQ ID NO: 1701276 - RNA, 13 nt, Salmonella enterica enterica serovar Typhi
gcgucugaguuaa

SEQ ID NO: 1701277 - RNA, 23 nt, Salmonella enterica enterica serovar Typhi
gcguaucucgcgguugacgcugc

SEQ ID NO: 1701278 - RNA, 17 nt, Salmonella enterica enterica serovar Typhi
gcgucugcgcgcuggug

SEQ ID NO: 1701279 - RNA, 15 nt, Salmonella enterica enterica serovar Typhi
gcgucuggagcgugc

SEQ ID NO: 1701280 - RNA, 23 nt, Salmonella enterica enterica serovar Typhi
gcgugaacgucuuauccggccug

SEQ ID NO: 1701281 - RNA, 17 nt, Salmonella enterica enterica serovar Typhi
gcgucuucaucagccag

SEQ ID NO: 1701282 - RNA, 19 nt, Salmonella enterica enterica serovar Typhi
gcgucuucaucagccagca

SEQ ID NO: 1701283 - RNA, 16 nt, Salmonella enterica enterica serovar Typhi
gcgugcgguuuuccug

SEQ ID NO: 1701284 - RNA, 15 nt, Salmonella enterica enterica serovar Typhi
gcgugcaugggcagc

SEQ ID NO: 1701285 - RNA, 15 nt, Salmonella enterica enterica serovar Typhi
gcgugcccaguaauu

SEQ ID NO: 1701286 - RNA, 14 nt, Salmonella enterica enterica serovar Typhi
gcgugaauaaaaua

SEQ ID NO: 1701287 - RNA, 17 nt, Salmonella enterica enterica serovar Typhi
gcgugggguugcuucug

SEQ ID NO: 1701288 - RNA, 15 nt, Salmonella enterica enterica serovar Typhi
gcgugcuggcggccg

SEQ ID NO: 1701289 - RNA, 17 nt, Salmonella enterica enterica serovar Typhi
gcguuauuugcauuuuc

SEQ ID NO: 1701290 - RNA, 20 nt, Salmonella enterica enterica serovar Typhi
gcguucgcgcaauucuucua

SEQ ID NO: 1701291 - RNA, 20 nt, Salmonella enterica enterica serovar Typhi
gcguucgcgcaguucaucca

SEQ ID NO: 1701292 - RNA, 21 nt, Salmonella enterica enterica serovar Typhi
gcgugguauuacaagcaguua

SEQ ID NO: 1701293 - RNA, 18 nt, Salmonella enterica enterica serovar Typhi
gcgugguuuccggcagcu

SEQ ID NO: 1701294 - RNA, 17 nt, Salmonella enterica enterica serovar Typhi
gcgugucaucaaaauca

SEQ ID NO: 1701295 - RNA, 22 nt, Salmonella enterica enterica serovar Typhi
gcguuaaugcgcgcuucuucau

SEQ ID NO: 1701296 - RNA, 20 nt, Salmonella enterica enterica serovar Typhi
gcguuacuggcgaccggcag

SEQ ID NO: 1701297 - RNA, 18 nt, Salmonella enterica enterica serovar Typhi
gcguuuuacguacccgcu

SEQ ID NO: 1701298 - RNA, 22 nt, Salmonella enterica enterica serovar Typhi
gcguuugucuucuuaguaacau

SEQ ID NO: 1701299 - RNA, 16 nt, Salmonella enterica enterica serovar Typhi
gcguuuuccagcaucc

SEQ ID NO: 1701300 - RNA, 13 nt, Salmonella enterica enterica serovar Typhi
gcguuucguaaug

SEQ ID NO: 1701301 - RNA, 18 nt, Salmonella enterica enterica serovar Typhi
gcguuucuagaugaugau

SEQ ID NO: 1701302 - RNA, 16 nt, Salmonella enterica enterica serovar Typhi
gcguuuuggcagacag

SEQ ID NO: 1701303 - RNA, 14 nt, Salmonella enterica enterica serovar Typhi
gcguucuuuccagu

SEQ ID NO: 1701304 - RNA, 19 nt, Salmonella enterica enterica serovar Typhi
gcguucugcgccauuucca

SEQ ID NO: 1701305 - RNA, 17 nt, Salmonella enterica enterica serovar Typhi
gcguucggguuuuccug

SEQ ID NO: 1701306 - RNA, 24 nt, Salmonella enterica enterica serovar Typhi
gcguugaccagccuaccugccgcc

SEQ ID NO: 1701307 - RNA, 17 nt, Salmonella enterica enterica serovar Typhi
gcguugaccagcgacgg

SEQ ID NO: 1701308 - RNA, 13 nt, Salmonella enterica enterica serovar Typhi
gcgcgccaugaga

SEQ ID NO: 1701309 - RNA, 12 nt, Salmonella enterica enterica serovar Typhi
gcgcgccagcgc

SEQ ID NO: 1701310 - RNA, 18 nt, Salmonella enterica enterica serovar Typhi
gcgcgccaaacggcagcu

SEQ ID NO: 1701311 - RNA, 15 nt, Salmonella enterica enterica serovar Typhi
gcgcgauacgcagca

SEQ ID NO: 1701312 - RNA, 18 nt, Salmonella enterica enterica serovar Typhi
gcgcgauacgcagcaccg

SEQ ID NO: 1701313 - RNA, 14 nt, Salmonella enterica enterica serovar Typhi
gcgcgacggcggcg

SEQ ID NO: 1701314 - RNA, 21 nt, Salmonella enterica enterica serovar Typhi
gcgcgacuuuaaucaccugcc

SEQ ID NO: 1701315 - RNA, 23 nt, Salmonella enterica enterica serovar Typhi
gcgcgaaaucaaagaccuccgcc

SEQ ID NO: 1701316 - RNA, 18 nt, Salmonella enterica enterica serovar Typhi
gcgcgaauuugccccaga

SEQ ID NO: 1701317 - RNA, 16 nt, Salmonella enterica enterica serovar Typhi
gcgcgaccaggaaacc

SEQ ID NO: 1701318 - RNA, 21 nt, Salmonella enterica enterica serovar Typhi
gcgcgaagaggaugaaaagua

SEQ ID NO: 1701319 - RNA, 15 nt, Salmonella enterica enterica serovar Typhi
gcgcgacgacgccag

SEQ ID NO: 1701320 - RNA, 13 nt, Salmonella enterica enterica serovar Typhi
gcgcggccagcgc

SEQ ID NO: 1701321 - RNA, 23 nt, Salmonella enterica enterica serovar Typhi
gcgcggcacacaacacggcggcu

SEQ ID NO: 1701322 - RNA, 13 nt, Salmonella enterica enterica serovar Typhi
gcgcggcagaccg

SEQ ID NO: 1701323 - RNA, 11 nt, Salmonella enterica enterica serovar Typhi
gcgcggcagca

SEQ ID NO: 1701324 - RNA, 16 nt, Salmonella enterica enterica serovar Typhi
gcgcggcagcgcgcac

SEQ ID NO: 1701325 - RNA, 23 nt, Salmonella enterica enterica serovar Typhi
gcgcggcaggccuuucggcagcg

SEQ ID NO: 1701326 - RNA, 19 nt, Salmonella enterica enterica serovar Typhi
gcgcggauauggcggcggc

SEQ ID NO: 1701327 - RNA, 21 nt, Salmonella enterica enterica serovar Typhi
gcgcgggauaucgcuggucgg

SEQ ID NO: 1701328 - RNA, 10 nt, Salmonella enterica enterica serovar Typhi
gcgcggcgga

SEQ ID NO: 1701329 - RNA, 16 nt, Salmonella enterica enterica serovar Typhi
gcgcgcugcgccugga

SEQ ID NO: 1701330 - RNA, 15 nt, Salmonella enterica enterica serovar Typhi
gcgcgcugccgcccu

SEQ ID NO: 1701331 - RNA, 13 nt, Salmonella enterica enterica serovar Typhi
gcgcgcuggcaag

SEQ ID NO: 1701332 - RNA, 22 nt, Salmonella enterica enterica serovar Typhi
gcgcggaacuuuaucaccagcg

SEQ ID NO: 1701333 - RNA, 24 nt, Salmonella enterica enterica serovar Typhi
gcgcggaaggcgccucgcgcggcg

SEQ ID NO: 1701334 - RNA, 18 nt, Salmonella enterica enterica serovar Typhi
gcgcgcuuucaccgccuc

SEQ ID NO: 1701335 - RNA, 15 nt, Salmonella enterica enterica serovar Typhi
gcgcgcuucuucaug

SEQ ID NO: 1701336 - RNA, 11 nt, Salmonella enterica enterica serovar Typhi
gcgcgccgcgc

SEQ ID NO: 1701337 - RNA, 12 nt, Salmonella enterica enterica serovar Typhi
gcgcgccgccug

SEQ ID NO: 1701338 - RNA, 13 nt, Salmonella enterica enterica serovar Typhi
gcgcgccgccaac

SEQ ID NO: 1701339 - RNA, 16 nt, Salmonella enterica enterica serovar Typhi
gcgcgcugagcggcuc

SEQ ID NO: 1701340 - RNA, 20 nt, Salmonella enterica enterica serovar Typhi
gcgcgccggugaucccacca

SEQ ID NO: 1701341 - RNA, 14 nt, Salmonella enterica enterica serovar Typhi
gcgcgcugccgccc

SEQ ID NO: 1701342 - RNA, 15 nt, Salmonella enterica enterica serovar Typhi
gcgcggggaacacag

SEQ ID NO: 1701343 - RNA, 18 nt, Salmonella enterica enterica serovar Typhi
gcgcgucuucccggcgcu

SEQ ID NO: 1701344 - RNA, 22 nt, Salmonella enterica enterica serovar Typhi
gcgcgugaccccaggcauagaa

SEQ ID NO: 1701345 - RNA, 13 nt, Salmonella enterica enterica serovar Typhi
gcgcguggcuucc

SEQ ID NO: 1701346 - RNA, 14 nt, Salmonella enterica enterica serovar Typhi
gcgcguucauccac

SEQ ID NO: 1701347 - RNA, 14 nt, Salmonella enterica enterica serovar Typhi
gcgcuaccagcgcg

SEQ ID NO: 1701348 - RNA, 20 nt, Salmonella enterica enterica serovar Typhi
gcgcuacgcuuaucgggccu

SEQ ID NO: 1701349 - RNA, 17 nt, Salmonella enterica enterica serovar Typhi
gcgcuagcuggcagggg

SEQ ID NO: 1701350 - RNA, 17 nt, Salmonella enterica enterica serovar Typhi
gcgcuaauguggauagu

SEQ ID NO: 1701351 - RNA, 13 nt, Salmonella enterica enterica serovar Typhi
gcgcuaccagcgc

SEQ ID NO: 1701352 - RNA, 16 nt, Salmonella enterica enterica serovar Typhi
gcgcuacauccgccag

SEQ ID NO: 1701353 - RNA, 20 nt, Salmonella enterica enterica serovar Typhi
gcgcuacauccgccagccgc

SEQ ID NO: 1701354 - RNA, 17 nt, Salmonella enterica enterica serovar Typhi
gcgcguuuaaucgagcc

SEQ ID NO: 1701355 - RNA, 20 nt, Salmonella enterica enterica serovar Typhi
gcgcguuuagcgccagcagc

SEQ ID NO: 1701356 - RNA, 22 nt, Salmonella enterica enterica serovar Typhi
gcgcuaagcgcccguagcucag

SEQ ID NO: 1701357 - RNA, 15 nt, Salmonella enterica enterica serovar Typhi
gcgcucacgcggcgc

SEQ ID NO: 1701358 - RNA, 16 nt, Salmonella enterica enterica serovar Typhi
gcgcucaggaucgccg

SEQ ID NO: 1701359 - RNA, 16 nt, Salmonella enterica enterica serovar Typhi
gcgcucauaaccgcga

SEQ ID NO: 1701360 - RNA, 13 nt, Salmonella enterica enterica serovar Typhi
gcgcucaagcgaa

SEQ ID NO: 1701361 - RNA, 18 nt, Salmonella enterica enterica serovar Typhi
gcgcuauuuucaugguau

SEQ ID NO: 1701362 - RNA, 23 nt, Salmonella enterica enterica serovar Typhi
gcgcuauucccaggcaaaugauu

SEQ ID NO: 1701363 - RNA, 16 nt, Salmonella enterica enterica serovar Typhi
gcgcuaucgguaucau

SEQ ID NO: 1701364 - RNA, 21 nt, Salmonella enterica enterica serovar Typhi
gcgcugauuuucuccagcaga

SEQ ID NO: 1701365 - RNA, 16 nt, Salmonella enterica enterica serovar Typhi
gcgcugaugugcggcc

SEQ ID NO: 1701366 - RNA, 16 nt, Salmonella enterica enterica serovar Typhi
gcgcucugccaguagc

SEQ ID NO: 1701367 - RNA, 19 nt, Salmonella enterica enterica serovar Typhi
gcgcucuaucaccgcccgc

SEQ ID NO: 1701368 - RNA, 22 nt, Salmonella enterica enterica serovar Typhi
gcgcucuaucaccgcccgccgg

SEQ ID NO: 1701369 - RNA, 13 nt, Salmonella enterica enterica serovar Typhi
gcgcugaugaaaa

SEQ ID NO: 1701370 - RNA, 18 nt, Salmonella enterica enterica serovar Typhi
gcgcugcacaaucgccag

SEQ ID NO: 1701371 - RNA, 15 nt, Salmonella enterica enterica serovar Typhi
gcgcugcgcggcgug

SEQ ID NO: 1701372 - RNA, 20 nt, Salmonella enterica enterica serovar Typhi
gcgcuggggguaggauaaaa

SEQ ID NO: 1701373 - RNA, 16 nt, Salmonella enterica enterica serovar Typhi
gcgcuccggcgcuggc

SEQ ID NO: 1701374 - RNA, 19 nt, Salmonella enterica enterica serovar Typhi
gcgcuccagaccaccagcg

SEQ ID NO: 1701375 - RNA, 18 nt, Salmonella enterica enterica serovar Typhi
gcgcuccugucaggcgag

SEQ ID NO: 1701376 - RNA, 20 nt, Salmonella enterica enterica serovar Typhi
gcgccgauaaauccuccggc

SEQ ID NO: 1701377 - RNA, 21 nt, Salmonella enterica enterica serovar Typhi
gcgccgagaaaaucagugaac

SEQ ID NO: 1701378 - RNA, 18 nt, Salmonella enterica enterica serovar Typhi
gcgccgaagcaggcggag

SEQ ID NO: 1701379 - RNA, 20 nt, Salmonella enterica enterica serovar Typhi
gcgccgacauagcugaacaa

SEQ ID NO: 1701380 - RNA, 16 nt, Salmonella enterica enterica serovar Typhi
gcgccgacaucgccac

SEQ ID NO: 1701381 - RNA, 20 nt, Salmonella enterica enterica serovar Typhi
gcgccggccgguuucaccau

SEQ ID NO: 1701382 - RNA, 17 nt, Salmonella enterica enterica serovar Typhi
gcgccgugcccagcauc

SEQ ID NO: 1701383 - RNA, 13 nt, Salmonella enterica enterica serovar Typhi
gcgccguaaacaa

SEQ ID NO: 1701384 - RNA, 13 nt, Salmonella enterica enterica serovar Typhi
gcgccgucauccg

SEQ ID NO: 1701385 - RNA, 15 nt, Salmonella enterica enterica serovar Typhi
gcgccguccauaaug

SEQ ID NO: 1701386 - RNA, 22 nt, Salmonella enterica enterica serovar Typhi
gcgccguaacgcgaugccuggc

SEQ ID NO: 1701387 - RNA, 17 nt, Salmonella enterica enterica serovar Typhi
gcgccguaaggcgccuu

SEQ ID NO: 1701388 - RNA, 17 nt, Salmonella enterica enterica serovar Typhi
gcgccggaugacggcag

SEQ ID NO: 1701389 - RNA, 19 nt, Salmonella enterica enterica serovar Typhi
gcgccggaucgggcuucca

SEQ ID NO: 1701390 - RNA, 18 nt, Salmonella enterica enterica serovar Typhi
gcgccggaucgggcuucc

SEQ ID NO: 1701391 - RNA, 21 nt, Salmonella enterica enterica serovar Typhi
gcgccgcucaucaccagcagc

SEQ ID NO: 1701392 - RNA, 12 nt, Salmonella enterica enterica serovar Typhi
gcgccgcucaca

SEQ ID NO: 1701393 - RNA, 13 nt, Salmonella enterica enterica serovar Typhi
gcgccgcggccuc

SEQ ID NO: 1701394 - RNA, 19 nt, Salmonella enterica enterica serovar Typhi
gcgcccgaucguccgccuc

SEQ ID NO: 1701395 - RNA, 17 nt, Salmonella enterica enterica serovar Typhi
gcgcccgagcgacgccc

SEQ ID NO: 1701396 - RNA, 21 nt, Salmonella enterica enterica serovar Typhi
gcgccccucuugcagcaagaa

SEQ ID NO: 1701397 - RNA, 19 nt, Salmonella enterica enterica serovar Typhi
gcgcccgccaucgcccggc

SEQ ID NO: 1701398 - RNA, 15 nt, Salmonella enterica enterica serovar Typhi
gcgcccgccaccagc

SEQ ID NO: 1701399 - RNA, 21 nt, Salmonella enterica enterica serovar Typhi
gcgcccgccaccagcacagcc

SEQ ID NO: 1701400 - RNA, 16 nt, Salmonella enterica enterica serovar Typhi
gcgcccaucuccagcc

SEQ ID NO: 1701401 - RNA, 23 nt, Salmonella enterica enterica serovar Typhi
gcgccccagcaugagccagcccu

SEQ ID NO: 1701402 - RNA, 13 nt, Salmonella enterica enterica serovar Typhi
gcgcccuauccag

SEQ ID NO: 1701403 - RNA, 16 nt, Salmonella enterica enterica serovar Typhi
gcgcccguccaugagu

SEQ ID NO: 1701404 - RNA, 15 nt, Salmonella enterica enterica serovar Typhi
gcgcccugcgggccg

SEQ ID NO: 1701405 - RNA, 13 nt, Salmonella enterica enterica serovar Typhi
gcgcccuccucca

SEQ ID NO: 1701406 - RNA, 22 nt, Salmonella enterica enterica serovar Typhi
gcgcccgccugcuguaaccccu

SEQ ID NO: 1701407 - RNA, 18 nt, Salmonella enterica enterica serovar Typhi
gcgccauuaacgcgguga

SEQ ID NO: 1701408 - RNA, 20 nt, Salmonella enterica enterica serovar Typhi
gcgccauggcuucuccuuca

SEQ ID NO: 1701409 - RNA, 22 nt, Salmonella enterica enterica serovar Typhi
gcgccauguucauaaagugcca

SEQ ID NO: 1701410 - RNA, 15 nt, Salmonella enterica enterica serovar Typhi
gcgccagcucaugca

SEQ ID NO: 1701411 - RNA, 22 nt, Salmonella enterica enterica serovar Typhi
gcgccagcucaucgggcgaagc

SEQ ID NO: 1701412 - RNA, 16 nt, Salmonella enterica enterica serovar Typhi
gcgccaguaaucggcg

SEQ ID NO: 1701413 - RNA, 16 nt, Salmonella enterica enterica serovar Typhi
gcgccagugacgccag

SEQ ID NO: 1701414 - RNA, 14 nt, Salmonella enterica enterica serovar Typhi
gcgccagacgccau

SEQ ID NO: 1701415 - RNA, 14 nt, Salmonella enterica enterica serovar Typhi
gcgccagacgcgca

SEQ ID NO: 1701416 - RNA, 16 nt, Salmonella enterica enterica serovar Typhi
gcgccacuucacuggc

SEQ ID NO: 1701417 - RNA, 15 nt, Salmonella enterica enterica serovar Typhi
gcgccacuuccagcg

SEQ ID NO: 1701418 - RNA, 16 nt, Salmonella enterica enterica serovar Typhi
gcgccacuuccagcgc

SEQ ID NO: 1701419 - RNA, 22 nt, Salmonella enterica enterica serovar Typhi
gcgccacuuccagcgcgccguc

SEQ ID NO: 1701420 - RNA, 18 nt, Salmonella enterica enterica serovar Typhi
gcgccagcgcuacccgcu

SEQ ID NO: 1701421 - RNA, 15 nt, Salmonella enterica enterica serovar Typhi
gcgccagcggcugcu

SEQ ID NO: 1701422 - RNA, 14 nt, Salmonella enterica enterica serovar Typhi
gcgccagcggcggc

SEQ ID NO: 1701423 - RNA, 13 nt, Salmonella enterica enterica serovar Typhi
gcgccagcgccac

SEQ ID NO: 1701424 - RNA, 20 nt, Salmonella enterica enterica serovar Typhi
gcgccagcgaccaccguccc

SEQ ID NO: 1701425 - RNA, 21 nt, Salmonella enterica enterica serovar Typhi
gcgauaucaacgucuugccgu

SEQ ID NO: 1701426 - RNA, 22 nt, Salmonella enterica enterica serovar Typhi
gcgauccacaaucgucgugccu

SEQ ID NO: 1701427 - RNA, 20 nt, Salmonella enterica enterica serovar Typhi
gcgauagagaguuccuccug

SEQ ID NO: 1701428 - RNA, 20 nt, Salmonella enterica enterica serovar Typhi
gcgauaccgugacugaccaa

SEQ ID NO: 1701429 - RNA, 19 nt, Salmonella enterica enterica serovar Typhi
gcgauaccgugacugacca

SEQ ID NO: 1701430 - RNA, 22 nt, Salmonella enterica enterica serovar Typhi
gcgauacgcgcguucguugaug

SEQ ID NO: 1701431 - RNA, 18 nt, Salmonella enterica enterica serovar Typhi
gcgauacucugcccgccg

SEQ ID NO: 1701432 - RNA, 17 nt, Salmonella enterica enterica serovar Typhi
gcgauaccgugacugac

SEQ ID NO: 1701433 - RNA, 15 nt, Salmonella enterica enterica serovar Typhi
gcgagggauuuccug

SEQ ID NO: 1701434 - RNA, 19 nt, Salmonella enterica enterica serovar Typhi
gcgagggauuuccuggcag

SEQ ID NO: 1701435 - RNA, 23 nt, Salmonella enterica enterica serovar Typhi
gcgaucgacuaauuuuaggaaga

SEQ ID NO: 1701436 - RNA, 21 nt, Salmonella enterica enterica serovar Typhi
gcgaucgccgucguucagcca

SEQ ID NO: 1701437 - RNA, 22 nt, Salmonella enterica enterica serovar Typhi
gcgaucccaguugaucggccag

SEQ ID NO: 1701438 - RNA, 21 nt, Salmonella enterica enterica serovar Typhi
gcgauccagccccagcgccag

SEQ ID NO: 1701439 - RNA, 12 nt, Salmonella enterica enterica serovar Typhi
gcgaugagcgcc

SEQ ID NO: 1701440 - RNA, 17 nt, Salmonella enterica enterica serovar Typhi
gcgaugaccaucaaaua

SEQ ID NO: 1701441 - RNA, 22 nt, Salmonella enterica enterica serovar Typhi
gcgaucgcgccggucgccagca

SEQ ID NO: 1701442 - RNA, 20 nt, Salmonella enterica enterica serovar Typhi
gcgagcaaaacccggugcgg

SEQ ID NO: 1701443 - RNA, 15 nt, Salmonella enterica enterica serovar Typhi
gcgagccuucaacaa

SEQ ID NO: 1701444 - RNA, 14 nt, Salmonella enterica enterica serovar Typhi
gcgagcgauagaga

SEQ ID NO: 1701445 - RNA, 12 nt, Salmonella enterica enterica serovar Typhi
gcgaggacugua

SEQ ID NO: 1701446 - RNA, 13 nt, Salmonella enterica enterica serovar Typhi
gcgaggcgcgcuc

SEQ ID NO: 1701447 - RNA, 18 nt, Salmonella enterica enterica serovar Typhi
gcgacuggaacgucauca

SEQ ID NO: 1701448 - RNA, 23 nt, Salmonella enterica enterica serovar Typhi
gcgagagaauuaacagcgcgacc

SEQ ID NO: 1701449 - RNA, 15 nt, Salmonella enterica enterica serovar Typhi
gcgagagaaaaaaau

SEQ ID NO: 1701450 - RNA, 16 nt, Salmonella enterica enterica serovar Typhi
gcgacuucgcuuccug

SEQ ID NO: 1701451 - RNA, 16 nt, Salmonella enterica enterica serovar Typhi
gcgagaguuugugaug

SEQ ID NO: 1701452 - RNA, 20 nt, Salmonella enterica enterica serovar Typhi
gcgacucuguauuuaauacc

SEQ ID NO: 1701453 - RNA, 13 nt, Salmonella enterica enterica serovar Typhi
gcgacgacgccag

SEQ ID NO: 1701454 - RNA, 19 nt, Salmonella enterica enterica serovar Typhi
gcgacgacgcuguuuaugc

SEQ ID NO: 1701455 - RNA, 22 nt, Salmonella enterica enterica serovar Typhi
gcgcaauaugcagaucgacggu

SEQ ID NO: 1701456 - RNA, 16 nt, Salmonella enterica enterica serovar Typhi
gcgcaauaugcggcgc

SEQ ID NO: 1701457 - RNA, 22 nt, Salmonella enterica enterica serovar Typhi
gcgcaaucgguaaaggucgccg

SEQ ID NO: 1701458 - RNA, 14 nt, Salmonella enterica enterica serovar Typhi
gcgcacgcgcgcgc

SEQ ID NO: 1701459 - RNA, 17 nt, Salmonella enterica enterica serovar Typhi
gcgcacggcgcguccuc

SEQ ID NO: 1701460 - RNA, 15 nt, Salmonella enterica enterica serovar Typhi
gcgcacucagaaaau

SEQ ID NO: 1701461 - RNA, 16 nt, Salmonella enterica enterica serovar Typhi
gcgcacucagaaaauu

SEQ ID NO: 1701462 - RNA, 22 nt, Salmonella enterica enterica serovar Typhi
gcgcagcgcuuuugccgcgccc

SEQ ID NO: 1701463 - RNA, 21 nt, Salmonella enterica enterica serovar Typhi
gcgcagcugggccugcuccgu

SEQ ID NO: 1701464 - RNA, 15 nt, Salmonella enterica enterica serovar Typhi
gcgcagcgucaucag

SEQ ID NO: 1701465 - RNA, 17 nt, Salmonella enterica enterica serovar Typhi
gcgcagccccagcgcca

SEQ ID NO: 1701466 - RNA, 15 nt, Salmonella enterica enterica serovar Typhi
gcgcagccccagcgc

SEQ ID NO: 1701467 - RNA, 15 nt, Salmonella enterica enterica serovar Typhi
gcgcagcgcgcgacc

SEQ ID NO: 1701468 - RNA, 13 nt, Salmonella enterica enterica serovar Typhi
gcgcagccccagc

SEQ ID NO: 1701469 - RNA, 18 nt, Salmonella enterica enterica serovar Typhi
gcgcagcaugaucggcug

SEQ ID NO: 1701470 - RNA, 20 nt, Salmonella enterica enterica serovar Typhi
gcgauguucuugccgccauc

SEQ ID NO: 1701471 - RNA, 17 nt, Salmonella enterica enterica serovar Typhi
gcgauuagcccgggacu

SEQ ID NO: 1701472 - RNA, 18 nt, Salmonella enterica enterica serovar Typhi
gcgauggggcaagcucag

SEQ ID NO: 1701473 - RNA, 13 nt, Salmonella enterica enterica serovar Typhi
gcgcaaaagcgcg

SEQ ID NO: 1701474 - RNA, 16 nt, Salmonella enterica enterica serovar Typhi
gcgcaaaagcgcgccc

SEQ ID NO: 1701475 - RNA, 21 nt, Salmonella enterica enterica serovar Typhi
gcgcaaacaguacgcccgccu

SEQ ID NO: 1701476 - RNA, 21 nt, Salmonella enterica enterica serovar Typhi
gcgcaaagcaauguaaaacug

SEQ ID NO: 1701477 - RNA, 24 nt, Salmonella enterica enterica serovar Typhi
gcgauuuuuuuccgcccgccuucu

SEQ ID NO: 1701478 - RNA, 17 nt, Salmonella enterica enterica serovar Typhi
gcgauuuucagcaccuu

SEQ ID NO: 1701479 - RNA, 14 nt, Salmonella enterica enterica serovar Typhi
gcgcaaaugccggu

SEQ ID NO: 1701480 - RNA, 12 nt, Salmonella enterica enterica serovar Typhi
gcgcaaauauua

SEQ ID NO: 1701481 - RNA, 18 nt, Salmonella enterica enterica serovar Typhi
gcgcaaaucgccaucagc

SEQ ID NO: 1701482 - RNA, 19 nt, Salmonella enterica enterica serovar Typhi
gcgcaacgcuuaaucccuu

SEQ ID NO: 1701483 - RNA, 18 nt, Salmonella enterica enterica serovar Typhi
gcgcaacgcuuccaccuc

SEQ ID NO: 1701484 - RNA, 22 nt, Salmonella enterica enterica serovar Typhi
gcgcaaccuccgcggggaucgg

SEQ ID NO: 1701485 - RNA, 16 nt, Salmonella enterica enterica serovar Typhi
gcgcaauaccuguaaa

SEQ ID NO: 1701486 - RNA, 12 nt, Salmonella enterica enterica serovar Typhi
gcgaaaaagccg

SEQ ID NO: 1701487 - RNA, 20 nt, Salmonella enterica enterica serovar Typhi
gccuuuuuuaauccaggaau

SEQ ID NO: 1701488 - RNA, 15 nt, Salmonella enterica enterica serovar Typhi
gccuuuuucccacug

SEQ ID NO: 1701489 - RNA, 15 nt, Salmonella enterica enterica serovar Typhi
gccuuuuuccgggau

SEQ ID NO: 1701490 - RNA, 23 nt, Salmonella enterica enterica serovar Typhi
gcgaaaacguugacuuaaaaagc

SEQ ID NO: 1701491 - RNA, 21 nt, Salmonella enterica enterica serovar Typhi
gcgaaaucaaagaccuccgcc

SEQ ID NO: 1701492 - RNA, 14 nt, Salmonella enterica enterica serovar Typhi
gcgaaauugguaga

SEQ ID NO: 1701493 - RNA, 20 nt, Salmonella enterica enterica serovar Typhi
gcgaaauuuaauauaugaac

SEQ ID NO: 1701494 - RNA, 14 nt, Salmonella enterica enterica serovar Typhi
gcgaacguccagcg

SEQ ID NO: 1701495 - RNA, 13 nt, Salmonella enterica enterica serovar Typhi
gcgaacuacaggc

SEQ ID NO: 1701496 - RNA, 19 nt, Salmonella enterica enterica serovar Typhi
gccuuugcguaccgcaaug

SEQ ID NO: 1701497 - RNA, 18 nt, Salmonella enterica enterica serovar Typhi
gccuuucuccauggucag

SEQ ID NO: 1701498 - RNA, 18 nt, Salmonella enterica enterica serovar Typhi
gccuuuucccccagcauu

SEQ ID NO: 1701499 - RNA, 23 nt, Salmonella enterica enterica serovar Typhi
gccuuuuaucaaugcacugacuu

SEQ ID NO: 1701500 - RNA, 14 nt, Salmonella enterica enterica serovar Typhi
gccuuuaugcaguu

SEQ ID NO: 1701501 - RNA, 13 nt, Salmonella enterica enterica serovar Typhi
gccuuuauccagc

SEQ ID NO: 1701502 - RNA, 18 nt, Salmonella enterica enterica serovar Typhi
gccuuuaugcaguuccgu

SEQ ID NO: 1701503 - RNA, 13 nt, Salmonella enterica enterica serovar Typhi
gccuuuccgcaug

SEQ ID NO: 1701504 - RNA, 20 nt, Salmonella enterica enterica serovar Typhi
gccuuucacgcguucaauau

SEQ ID NO: 1701505 - RNA, 14 nt, Salmonella enterica enterica serovar Typhi
gcgaauaaacacau

SEQ ID NO: 1701506 - RNA, 20 nt, Salmonella enterica enterica serovar Typhi
gcgaauuuuauuaagcaggc

SEQ ID NO: 1701507 - RNA, 19 nt, Salmonella enterica enterica serovar Typhi
gcgacacgcgcgcugcgcc

SEQ ID NO: 1701508 - RNA, 20 nt, Salmonella enterica enterica serovar Typhi
gcgacacgcgcgcugcgccu

SEQ ID NO: 1701509 - RNA, 22 nt, Salmonella enterica enterica serovar Typhi
gcgacaccagcgucgcaugggu

SEQ ID NO: 1701510 - RNA, 18 nt, Salmonella enterica enterica serovar Typhi
gcgaauaacauaauauuc

SEQ ID NO: 1701511 - RNA, 10 nt, Salmonella enterica enterica serovar Typhi
gcgacaagaa

SEQ ID NO: 1701512 - RNA, 15 nt, Salmonella enterica enterica serovar Typhi
gcgaccucaucaaac

SEQ ID NO: 1701513 - RNA, 21 nt, Salmonella enterica enterica serovar Typhi
gcgaccaguuauucggcauau

SEQ ID NO: 1701514 - RNA, 21 nt, Salmonella enterica enterica serovar Typhi
gcgacagagaaugcgccgccc

SEQ ID NO: 1701515 - RNA, 20 nt, Salmonella enterica enterica serovar Typhi
gccuucguuauaaggccugc

SEQ ID NO: 1701516 - RNA, 14 nt, Salmonella enterica enterica serovar Typhi
gccuugcaaaccgg

SEQ ID NO: 1701517 - RNA, 21 nt, Salmonella enterica enterica serovar Typhi
gccuugaaguuauccagcgcc

SEQ ID NO: 1701518 - RNA, 22 nt, Salmonella enterica enterica serovar Typhi
gccuucuuuggugcgacgccag

SEQ ID NO: 1701519 - RNA, 17 nt, Salmonella enterica enterica serovar Typhi
gccuugcggcgccagga

SEQ ID NO: 1701520 - RNA, 15 nt, Salmonella enterica enterica serovar Typhi
gccuugcggcggcgu

SEQ ID NO: 1701521 - RNA, 21 nt, Salmonella enterica enterica serovar Typhi
gccuugcuggccuguucaagu

SEQ ID NO: 1701522 - RNA, 21 nt, Salmonella enterica enterica serovar Typhi
gccuuguaggccugauagcac

SEQ ID NO: 1701523 - RNA, 19 nt, Salmonella enterica enterica serovar Typhi
gccuguucuucaguaauuu

SEQ ID NO: 1701524 - RNA, 16 nt, Salmonella enterica enterica serovar Typhi
gccuguuuaagcuuuu

SEQ ID NO: 1701525 - RNA, 13 nt, Salmonella enterica enterica serovar Typhi
gccuuacccgacc

SEQ ID NO: 1701526 - RNA, 15 nt, Salmonella enterica enterica serovar Typhi
gccuuacaggcgcau

SEQ ID NO: 1701527 - RNA, 23 nt, Salmonella enterica enterica serovar Typhi
gccuuacaggcgcaucagaaaaa

SEQ ID NO: 1701528 - RNA, 15 nt, Salmonella enterica enterica serovar Typhi
gccuguuuauauucu

SEQ ID NO: 1701529 - RNA, 23 nt, Salmonella enterica enterica serovar Typhi
gccuuauggccagggacaggaga

SEQ ID NO: 1701530 - RNA, 19 nt, Salmonella enterica enterica serovar Typhi
gccuuaucaggccuguggu

SEQ ID NO: 1701531 - RNA, 22 nt, Salmonella enterica enterica serovar Typhi
gccuuauccggccuacaacuca

SEQ ID NO: 1701532 - RNA, 13 nt, Salmonella enterica enterica serovar Typhi
gccuuauccggcg

SEQ ID NO: 1701533 - RNA, 15 nt, Salmonella enterica enterica serovar Typhi
gccuucaggcaucag

SEQ ID NO: 1701534 - RNA, 13 nt, Salmonella enterica enterica serovar Typhi
gccuuccagaaau

SEQ ID NO: 1701535 - RNA, 13 nt, Salmonella enterica enterica serovar Typhi
gccuucagguuuu

SEQ ID NO: 1701536 - RNA, 13 nt, Salmonella enterica enterica serovar Typhi
gccuucauaauga

SEQ ID NO: 1701537 - RNA, 22 nt, Salmonella enterica enterica serovar Typhi
gccuucccgauaaccgcguuca

SEQ ID NO: 1701538 - RNA, 14 nt, Salmonella enterica enterica serovar Typhi
gccuucgccgccgc

SEQ ID NO: 1701539 - RNA, 21 nt, Salmonella enterica enterica serovar Typhi
gccuuccucgucggcaagaau

SEQ ID NO: 1701540 - RNA, 20 nt, Salmonella enterica enterica serovar Typhi
gccuuccguccacaucgcga

SEQ ID NO: 1701541 - RNA, 19 nt, Salmonella enterica enterica serovar Typhi
gccuucggcgucgugcugg

SEQ ID NO: 1701542 - RNA, 15 nt, Salmonella enterica enterica serovar Typhi
gccuucggcgcuggg

SEQ ID NO: 1701543 - RNA, 19 nt, Salmonella enterica enterica serovar Typhi
gugcggcugggcgaggcca

SEQ ID NO: 1701544 - RNA, 20 nt, Salmonella enterica enterica serovar Typhi
gugcggcauauucaggagca

SEQ ID NO: 1701545 - RNA, 22 nt, Salmonella enterica enterica serovar Typhi
gugcggcauauucaggagcaug

SEQ ID NO: 1701546 - RNA, 20 nt, Salmonella enterica enterica serovar Typhi
gugcggccuaaaucgcugcu

SEQ ID NO: 1701547 - RNA, 15 nt, Salmonella enterica enterica serovar Typhi
gugcgcggcgaaaaa

SEQ ID NO: 1701548 - RNA, 15 nt, Salmonella enterica enterica serovar Typhi
gugcgcuguggucgu

SEQ ID NO: 1701549 - RNA, 16 nt, Salmonella enterica enterica serovar Typhi
gugcggcaaccaccag

SEQ ID NO: 1701550 - RNA, 18 nt, Salmonella enterica enterica serovar Typhi
gugcgccccuugcagcaa

SEQ ID NO: 1701551 - RNA, 14 nt, Salmonella enterica enterica serovar Typhi
gugccuuccgcaau

SEQ ID NO: 1701552 - RNA, 13 nt, Salmonella enterica enterica serovar Typhi
gugcuggcggccg

SEQ ID NO: 1701553 - RNA, 19 nt, Salmonella enterica enterica serovar Typhi
gugcugccacaucgccagc

SEQ ID NO: 1701554 - RNA, 17 nt, Salmonella enterica enterica serovar Typhi
gugcugcgcaaauacgu

SEQ ID NO: 1701555 - RNA, 18 nt, Salmonella enterica enterica serovar Typhi
gugcucgauauauuuucc

SEQ ID NO: 1701556 - RNA, 20 nt, Salmonella enterica enterica serovar Typhi
gugcucgaaauccucacggu

SEQ ID NO: 1701557 - RNA, 14 nt, Salmonella enterica enterica serovar Typhi
gugcucgcggcgga

SEQ ID NO: 1701558 - RNA, 13 nt, Salmonella enterica enterica serovar Typhi
gugcuacugcugg

SEQ ID NO: 1701559 - RNA, 22 nt, Salmonella enterica enterica serovar Typhi
gugcuauacaguaaaacgccaa

SEQ ID NO: 1701560 - RNA, 20 nt, Salmonella enterica enterica serovar Typhi
gugcuacgggcgcugucgcc

SEQ ID NO: 1701561 - RNA, 11 nt, Salmonella enterica enterica serovar Typhi
gugcuccagcg

SEQ ID NO: 1701562 - RNA, 16 nt, Salmonella enterica enterica serovar Typhi
gugcucagccccuggg

SEQ ID NO: 1701563 - RNA, 13 nt, Salmonella enterica enterica serovar Typhi
gugcguaaaauau

SEQ ID NO: 1701564 - RNA, 14 nt, Salmonella enterica enterica serovar Typhi
gugcguaaacaggc

SEQ ID NO: 1701565 - RNA, 13 nt, Salmonella enterica enterica serovar Typhi
gugcguucuucca

SEQ ID NO: 1701566 - RNA, 14 nt, Salmonella enterica enterica serovar Typhi
gugcguucuuccac

SEQ ID NO: 1701567 - RNA, 24 nt, Salmonella enterica enterica serovar Typhi
gugcgugacccacaguuucauauc

SEQ ID NO: 1701568 - RNA, 20 nt, Salmonella enterica enterica serovar Typhi
gugaugccagccauagccca

SEQ ID NO: 1701569 - RNA, 18 nt, Salmonella enterica enterica serovar Typhi
gugaugcaucagaacaaa

SEQ ID NO: 1701570 - RNA, 17 nt, Salmonella enterica enterica serovar Typhi
gugauggguauuagaau

SEQ ID NO: 1701571 - RNA, 20 nt, Salmonella enterica enterica serovar Typhi
gugaugggcaaugccauauu

SEQ ID NO: 1701572 - RNA, 16 nt, Salmonella enterica enterica serovar Typhi
gugauggguauuagaa

SEQ ID NO: 1701573 - RNA, 18 nt, Salmonella enterica enterica serovar Typhi
gugcaagcccaacuauuu

SEQ ID NO: 1701574 - RNA, 14 nt, Salmonella enterica enterica serovar Typhi
gugauuguccaacu

SEQ ID NO: 1701575 - RNA, 13 nt, Salmonella enterica enterica serovar Typhi
gugaugugccggu

SEQ ID NO: 1701576 - RNA, 13 nt, Salmonella enterica enterica serovar Typhi
gugaugugcuggc

SEQ ID NO: 1701577 - RNA, 13 nt, Salmonella enterica enterica serovar Typhi
gugauggugcagc

SEQ ID NO: 1701578 - RNA, 18 nt, Salmonella enterica enterica serovar Typhi
gugauggugcagccccgg

SEQ ID NO: 1701579 - RNA, 14 nt, Salmonella enterica enterica serovar Typhi
gugauucaucacgu

SEQ ID NO: 1701580 - RNA, 15 nt, Salmonella enterica enterica serovar Typhi
gugauucaucacguu

SEQ ID NO: 1701581 - RNA, 18 nt, Salmonella enterica enterica serovar Typhi
gugccaaucuccagcauc

SEQ ID NO: 1701582 - RNA, 21 nt, Salmonella enterica enterica serovar Typhi
gugccaauggcgauaaaaaua

SEQ ID NO: 1701583 - RNA, 12 nt, Salmonella enterica enterica serovar Typhi
gugccaccagcc

SEQ ID NO: 1701584 - RNA, 17 nt, Salmonella enterica enterica serovar Typhi
gugccaccagccggagc

SEQ ID NO: 1701585 - RNA, 22 nt, Salmonella enterica enterica serovar Typhi
gugccagaaacaagaagcacga

SEQ ID NO: 1701586 - RNA, 17 nt, Salmonella enterica enterica serovar Typhi
gugcagcaagcggcugu

SEQ ID NO: 1701587 - RNA, 15 nt, Salmonella enterica enterica serovar Typhi
gugcagacugcacuu

SEQ ID NO: 1701588 - RNA, 15 nt, Salmonella enterica enterica serovar Typhi
gugcagaccucugca

SEQ ID NO: 1701589 - RNA, 15 nt, Salmonella enterica enterica serovar Typhi
gugcauuccaggugu

SEQ ID NO: 1701590 - RNA, 18 nt, Salmonella enterica enterica serovar Typhi
gugcccgcgguuugacug

SEQ ID NO: 1701591 - RNA, 23 nt, Salmonella enterica enterica serovar Typhi
gugccgaagucaaaggccaguaa

SEQ ID NO: 1701592 - RNA, 19 nt, Salmonella enterica enterica serovar Typhi
gugcccauaaaaaucccaa

SEQ ID NO: 1701593 - RNA, 13 nt, Salmonella enterica enterica serovar Typhi
gugcuuccagcuc

SEQ ID NO: 1701594 - RNA, 18 nt, Salmonella enterica enterica serovar Typhi
gugcuguaccgcguccug

SEQ ID NO: 1701595 - RNA, 13 nt, Salmonella enterica enterica serovar Typhi
gugcugguggugg

SEQ ID NO: 1701596 - RNA, 14 nt, Salmonella enterica enterica serovar Typhi
gugcuuccagcucc

SEQ ID NO: 1701597 - RNA, 15 nt, Salmonella enterica enterica serovar Typhi
gugcuuccagcucca

SEQ ID NO: 1701598 - RNA, 16 nt, Salmonella enterica enterica serovar Typhi
gugcuuccagcuccau

SEQ ID NO: 1701599 - RNA, 16 nt, Salmonella enterica enterica serovar Typhi
gugcuugagcugcggu

SEQ ID NO: 1701600 - RNA, 19 nt, Salmonella enterica enterica serovar Typhi
gugcuugagcugcgguggu

SEQ ID NO: 1701601 - RNA, 17 nt, Salmonella enterica enterica serovar Typhi
gugcuugcguuucuaga

SEQ ID NO: 1701602 - RNA, 20 nt, Salmonella enterica enterica serovar Typhi
guggcgcaguuuacgcagcg

SEQ ID NO: 1701603 - RNA, 21 nt, Salmonella enterica enterica serovar Typhi
guggcgcuguucuugcugcug

SEQ ID NO: 1701604 - RNA, 15 nt, Salmonella enterica enterica serovar Typhi
guggcggaauuggua

SEQ ID NO: 1701605 - RNA, 18 nt, Salmonella enterica enterica serovar Typhi
guggcggauacgcuucca

SEQ ID NO: 1701606 - RNA, 21 nt, Salmonella enterica enterica serovar Typhi
guggcuauagcucaguuggua

SEQ ID NO: 1701607 - RNA, 20 nt, Salmonella enterica enterica serovar Typhi
guggcgacgcguggcaucuu

SEQ ID NO: 1701608 - RNA, 15 nt, Salmonella enterica enterica serovar Typhi
guggccaucuuccag

SEQ ID NO: 1701609 - RNA, 16 nt, Salmonella enterica enterica serovar Typhi
guggcccagcgcggug

SEQ ID NO: 1701610 - RNA, 18 nt, Salmonella enterica enterica serovar Typhi
guggcgaacaggcucagc

SEQ ID NO: 1701611 - RNA, 19 nt, Salmonella enterica enterica serovar Typhi
guggcccgcacugccgagu

SEQ ID NO: 1701612 - RNA, 18 nt, Salmonella enterica enterica serovar Typhi
guggcccagcgcgguggc

SEQ ID NO: 1701613 - RNA, 13 nt, Salmonella enterica enterica serovar Typhi
gugggguucccga

SEQ ID NO: 1701614 - RNA, 14 nt, Salmonella enterica enterica serovar Typhi
guggguaaauccgc

SEQ ID NO: 1701615 - RNA, 17 nt, Salmonella enterica enterica serovar Typhi
guggggcuaagugagca

SEQ ID NO: 1701616 - RNA, 18 nt, Salmonella enterica enterica serovar Typhi
guggggccuaaugagcca

SEQ ID NO: 1701617 - RNA, 18 nt, Salmonella enterica enterica serovar Typhi
guggcuuaccguaugcaa

SEQ ID NO: 1701618 - RNA, 22 nt, Salmonella enterica enterica serovar Typhi
guggucauauugucgcgcccgu

SEQ ID NO: 1701619 - RNA, 20 nt, Salmonella enterica enterica serovar Typhi
gugguggauauccagcauaa

SEQ ID NO: 1701620 - RNA, 21 nt, Salmonella enterica enterica serovar Typhi
gugguuaugaucgucaacgca

SEQ ID NO: 1701621 - RNA, 16 nt, Salmonella enterica enterica serovar Typhi
gugguuuccggcagcu

SEQ ID NO: 1701622 - RNA, 14 nt, Salmonella enterica enterica serovar Typhi
gugguuucuuuuaa

SEQ ID NO: 1701623 - RNA, 21 nt, Salmonella enterica enterica serovar Typhi
gugguggucauccgcccggca

SEQ ID NO: 1701624 - RNA, 15 nt, Salmonella enterica enterica serovar Typhi
gugguggucaacguu

SEQ ID NO: 1701625 - RNA, 18 nt, Salmonella enterica enterica serovar Typhi
gugguuaucgaauccagc

SEQ ID NO: 1701626 - RNA, 12 nt, Salmonella enterica enterica serovar Typhi
guggugugccug

SEQ ID NO: 1701627 - RNA, 18 nt, Salmonella enterica enterica serovar Typhi
guguuuucgauuucauuc

SEQ ID NO: 1701628 - RNA, 15 nt, Salmonella enterica enterica serovar Typhi
guguuugucggcucc

SEQ ID NO: 1701629 - RNA, 20 nt, Salmonella enterica enterica serovar Typhi
guguuguacagcaauaaaag

SEQ ID NO: 1701630 - RNA, 19 nt, Salmonella enterica enterica serovar Typhi
guguugguacacagcacaa

SEQ ID NO: 1701631 - RNA, 19 nt, Salmonella enterica enterica serovar Typhi
guguuucaucucaucaaug

SEQ ID NO: 1701632 - RNA, 21 nt, Salmonella enterica enterica serovar Typhi
guguugaaauaguuacuguuu

SEQ ID NO: 1701633 - RNA, 14 nt, Salmonella enterica enterica serovar Typhi
guguucguaaagca

SEQ ID NO: 1701634 - RNA, 18 nt, Salmonella enterica enterica serovar Typhi
guguguuuuuuaauauaa

SEQ ID NO: 1701635 - RNA, 21 nt, Salmonella enterica enterica serovar Typhi
guguuaccgccaccuuucugc

SEQ ID NO: 1701636 - RNA, 13 nt, Salmonella enterica enterica serovar Typhi
gugugaccagcag

SEQ ID NO: 1701637 - RNA, 12 nt, Salmonella enterica enterica serovar Typhi
gugugaccagcg

SEQ ID NO: 1701638 - RNA, 16 nt, Salmonella enterica enterica serovar Typhi
gugucugcuucgucug

SEQ ID NO: 1701639 - RNA, 15 nt, Salmonella enterica enterica serovar Typhi
guguaauguuuucug

SEQ ID NO: 1701640 - RNA, 14 nt, Salmonella enterica enterica serovar Typhi
guguaccagcagcg

SEQ ID NO: 1701641 - RNA, 12 nt, Salmonella enterica enterica serovar Typhi
guguacauccag

SEQ ID NO: 1701642 - RNA, 16 nt, Salmonella enterica enterica serovar Typhi
guguaaaagccagcaa

SEQ ID NO: 1701643 - RNA, 12 nt, Salmonella enterica enterica serovar Typhi
guguaacagcaa

SEQ ID NO: 1701644 - RNA, 23 nt, Salmonella enterica enterica serovar Typhi
guguaaccaccugggugagcguc

SEQ ID NO: 1701645 - RNA, 13 nt, Salmonella enterica enterica serovar Typhi
guguaaaaauuuu

SEQ ID NO: 1701646 - RNA, 14 nt, Salmonella enterica enterica serovar Typhi
guguaaaaauuuuu

SEQ ID NO: 1701647 - RNA, 14 nt, Salmonella enterica enterica serovar Typhi
guguguaccagcag

SEQ ID NO: 1701648 - RNA, 13 nt, Salmonella enterica enterica serovar Typhi
gugugccagcaga

SEQ ID NO: 1701649 - RNA, 14 nt, Salmonella enterica enterica serovar Typhi
gugugcagugacag

SEQ ID NO: 1701650 - RNA, 19 nt, Salmonella enterica enterica serovar Typhi
guuaccucguuucacgucc

SEQ ID NO: 1701651 - RNA, 16 nt, Salmonella enterica enterica serovar Typhi
guuaccguuuaacgca

SEQ ID NO: 1701652 - RNA, 18 nt, Salmonella enterica enterica serovar Typhi
guuaccguaaucaucgcg

SEQ ID NO: 1701653 - RNA, 14 nt, Salmonella enterica enterica serovar Typhi
guuacagacgcugc

SEQ ID NO: 1701654 - RNA, 14 nt, Salmonella enterica enterica serovar Typhi
guuacugguuuuuu

SEQ ID NO: 1701655 - RNA, 14 nt, Salmonella enterica enterica serovar Typhi
guuacucgauggca

SEQ ID NO: 1701656 - RNA, 17 nt, Salmonella enterica enterica serovar Typhi
guuacucuucugaccau

SEQ ID NO: 1701657 - RNA, 15 nt, Salmonella enterica enterica serovar Typhi
guuacuauuuuucac

SEQ ID NO: 1701658 - RNA, 12 nt, Salmonella enterica enterica serovar Typhi
guuaaauaccag

SEQ ID NO: 1701659 - RNA, 20 nt, Salmonella enterica enterica serovar Typhi
guuaaauagugacuucugcu

SEQ ID NO: 1701660 - RNA, 22 nt, Salmonella enterica enterica serovar Typhi
guuaaacguaaguuaaaacgcc

SEQ ID NO: 1701661 - RNA, 18 nt, Salmonella enterica enterica serovar Typhi
guuaaagcccugacagaa

SEQ ID NO: 1701662 - RNA, 15 nt, Salmonella enterica enterica serovar Typhi
guuaauauacauuca

SEQ ID NO: 1701663 - RNA, 11 nt, Salmonella enterica enterica serovar Typhi
guuaauacuga

SEQ ID NO: 1701664 - RNA, 19 nt, Salmonella enterica enterica serovar Typhi
guuaauacaguggaaagua

SEQ ID NO: 1701665 - RNA, 14 nt, Salmonella enterica enterica serovar Typhi
guuaauuugauuua

SEQ ID NO: 1701666 - RNA, 12 nt, Salmonella enterica enterica serovar Typhi
guuaauuuuccc

SEQ ID NO: 1701667 - RNA, 18 nt, Salmonella enterica enterica serovar Typhi
guuacaaauagcggcaca

SEQ ID NO: 1701668 - RNA, 16 nt, Salmonella enterica enterica serovar Typhi
guucgauacuauaacg

SEQ ID NO: 1701669 - RNA, 15 nt, Salmonella enterica enterica serovar Typhi
guucgccagugacaa

SEQ ID NO: 1701670 - RNA, 14 nt, Salmonella enterica enterica serovar Typhi
guucgccauccaga

SEQ ID NO: 1701671 - RNA, 21 nt, Salmonella enterica enterica serovar Typhi
guuccugcgggaacagauaaa

SEQ ID NO: 1701672 - RNA, 16 nt, Salmonella enterica enterica serovar Typhi
guuccugcuggcaaaa

SEQ ID NO: 1701673 - RNA, 16 nt, Salmonella enterica enterica serovar Typhi
guuccugagcagacau

SEQ ID NO: 1701674 - RNA, 15 nt, Salmonella enterica enterica serovar Typhi
guucggaagacugcu

SEQ ID NO: 1701675 - RNA, 13 nt, Salmonella enterica enterica serovar Typhi
guucgcggcuggu

SEQ ID NO: 1701676 - RNA, 20 nt, Salmonella enterica enterica serovar Typhi
guucgcccuucaucuuccag

SEQ ID NO: 1701677 - RNA, 17 nt, Salmonella enterica enterica serovar Typhi
guucgccggcaaucugu

SEQ ID NO: 1701678 - RNA, 15 nt, Salmonella enterica enterica serovar Typhi
guucgcgcauaccuu

SEQ ID NO: 1701679 - RNA, 16 nt, Salmonella enterica enterica serovar Typhi
guucgcgauuuucauc

SEQ ID NO: 1701680 - RNA, 15 nt, Salmonella enterica enterica serovar Typhi
guucgcgcaguucau

SEQ ID NO: 1701681 - RNA, 22 nt, Salmonella enterica enterica serovar Typhi
guuccccaacagcgaccacgcc

SEQ ID NO: 1701682 - RNA, 15 nt, Salmonella enterica enterica serovar Typhi
guucccgccugcugc

SEQ ID NO: 1701683 - RNA, 15 nt, Salmonella enterica enterica serovar Typhi
guucccaugcuucca

SEQ ID NO: 1701684 - RNA, 18 nt, Salmonella enterica enterica serovar Typhi
guuccaccgccaauaaaa

SEQ ID NO: 1701685 - RNA, 12 nt, Salmonella enterica enterica serovar Typhi
guuccaccugcg

SEQ ID NO: 1701686 - RNA, 20 nt, Salmonella enterica enterica serovar Typhi
guuccaccgucuaucgugga

SEQ ID NO: 1701687 - RNA, 12 nt, Salmonella enterica enterica serovar Typhi
guucagccgcca

SEQ ID NO: 1701688 - RNA, 18 nt, Salmonella enterica enterica serovar Typhi
guucagcgacaggcuguc

SEQ ID NO: 1701689 - RNA, 16 nt, Salmonella enterica enterica serovar Typhi
guucacuccuaagaga

SEQ ID NO: 1701690 - RNA, 17 nt, Salmonella enterica enterica serovar Typhi
guucacuccuaagagaa

SEQ ID NO: 1701691 - RNA, 22 nt, Salmonella enterica enterica serovar Typhi
guuagagcacaucacucauaau

SEQ ID NO: 1701692 - RNA, 17 nt, Salmonella enterica enterica serovar Typhi
guuagagauauaccagc

SEQ ID NO: 1701693 - RNA, 14 nt, Salmonella enterica enterica serovar Typhi
guuagcaacacaga

SEQ ID NO: 1701694 - RNA, 17 nt, Salmonella enterica enterica serovar Typhi
guucacuaacgcggcau

SEQ ID NO: 1701695 - RNA, 13 nt, Salmonella enterica enterica serovar Typhi
guucagguuuuuu

SEQ ID NO: 1701696 - RNA, 17 nt, Salmonella enterica enterica serovar Typhi
guucaggcggcaaaaaa

SEQ ID NO: 1701697 - RNA, 19 nt, Salmonella enterica enterica serovar Typhi
guucagcuacuucaggcug

SEQ ID NO: 1701698 - RNA, 16 nt, Salmonella enterica enterica serovar Typhi
guucaguaugaucaug

SEQ ID NO: 1701699 - RNA, 12 nt, Salmonella enterica enterica serovar Typhi
guucaguuucaa

SEQ ID NO: 1701700 - RNA, 20 nt, Salmonella enterica enterica serovar Typhi
guucaguuaaauaaacaaaa

SEQ ID NO: 1701701 - RNA, 16 nt, Salmonella enterica enterica serovar Typhi
guucauaagucaucca

SEQ ID NO: 1701702 - RNA, 18 nt, Salmonella enterica enterica serovar Typhi
guucauaagucauccaga

SEQ ID NO: 1701703 - RNA, 20 nt, Salmonella enterica enterica serovar Typhi
guucauucccgccaauaacc

SEQ ID NO: 1701704 - RNA, 16 nt, Salmonella enterica enterica serovar Typhi
guucaugcuggucagc

SEQ ID NO: 1701705 - RNA, 14 nt, Salmonella enterica enterica serovar Typhi
guucauggcaaaag

SEQ ID NO: 1701706 - RNA, 15 nt, Salmonella enterica enterica serovar Typhi
guucaugcgcggcgg

SEQ ID NO: 1701707 - RNA, 12 nt, Salmonella enterica enterica serovar Typhi
guucaguuuuuc

SEQ ID NO: 1701708 - RNA, 14 nt, Salmonella enterica enterica serovar Typhi
guucuaacaggaag

SEQ ID NO: 1701709 - RNA, 18 nt, Salmonella enterica enterica serovar Typhi
guucuaaacguucaucuu

SEQ ID NO: 1701710 - RNA, 13 nt, Salmonella enterica enterica serovar Typhi
guucuuucaccau

SEQ ID NO: 1701711 - RNA, 13 nt, Salmonella enterica enterica serovar Typhi
guucuuucauuuu

SEQ ID NO: 1701712 - RNA, 14 nt, Salmonella enterica enterica serovar Typhi
guucuuuccaguuc

SEQ ID NO: 1701713 - RNA, 14 nt, Salmonella enterica enterica serovar Typhi
guugaacauuucau

SEQ ID NO: 1701714 - RNA, 20 nt, Salmonella enterica enterica serovar Typhi
guugaagcgaccagcgcgcc

SEQ ID NO: 1701715 - RNA, 16 nt, Salmonella enterica enterica serovar Typhi
guucuuuucuuucagc

SEQ ID NO: 1701716 - RNA, 18 nt, Salmonella enterica enterica serovar Typhi
guugaauaucgcuuuuuc

SEQ ID NO: 1701717 - RNA, 19 nt, Salmonella enterica enterica serovar Typhi
guugaauaucgcuuuuucu

SEQ ID NO: 1701718 - RNA, 12 nt, Salmonella enterica enterica serovar Typhi
guugaccacauc

SEQ ID NO: 1701719 - RNA, 20 nt, Salmonella enterica enterica serovar Typhi
guugauaaaacacucuuuuu

SEQ ID NO: 1701720 - RNA, 16 nt, Salmonella enterica enterica serovar Typhi
guugaucggccagcaa

SEQ ID NO: 1701721 - RNA, 14 nt, Salmonella enterica enterica serovar Typhi
guugagauuggccc

SEQ ID NO: 1701722 - RNA, 16 nt, Salmonella enterica enterica serovar Typhi
guugaggaaauucuga

SEQ ID NO: 1701723 - RNA, 17 nt, Salmonella enterica enterica serovar Typhi
guugagcgcuugcugcg

SEQ ID NO: 1701724 - RNA, 15 nt, Salmonella enterica enterica serovar Typhi
guugagcgcauuugc

SEQ ID NO: 1701725 - RNA, 21 nt, Salmonella enterica enterica serovar Typhi
guugacgccccauguggccag

SEQ ID NO: 1701726 - RNA, 18 nt, Salmonella enterica enterica serovar Typhi
guugacugcgcuccgacu

SEQ ID NO: 1701727 - RNA, 16 nt, Salmonella enterica enterica serovar Typhi
guugcagcccaccggc

SEQ ID NO: 1701728 - RNA, 18 nt, Salmonella enterica enterica serovar Typhi
guugauuuuaugaugcau

SEQ ID NO: 1701729 - RNA, 13 nt, Salmonella enterica enterica serovar Typhi
guugauggagguu

SEQ ID NO: 1701730 - RNA, 17 nt, Salmonella enterica enterica serovar Typhi
guugcgucaccgggcug

SEQ ID NO: 1701731 - RNA, 15 nt, Salmonella enterica enterica serovar Typhi
guugcguaaauaaau

SEQ ID NO: 1701732 - RNA, 21 nt, Salmonella enterica enterica serovar Typhi
guugcuccuguaagucaggua

SEQ ID NO: 1701733 - RNA, 16 nt, Salmonella enterica enterica serovar Typhi
guugcgcccaggccaa

SEQ ID NO: 1701734 - RNA, 13 nt, Salmonella enterica enterica serovar Typhi
guugcgccgccag

SEQ ID NO: 1701735 - RNA, 17 nt, Salmonella enterica enterica serovar Typhi
guugccuuugucaucca

SEQ ID NO: 1701736 - RNA, 16 nt, Salmonella enterica enterica serovar Typhi
guugcgaauaaacaca

SEQ ID NO: 1701737 - RNA, 20 nt, Salmonella enterica enterica serovar Typhi
guugcccauuuuccucccau

SEQ ID NO: 1701738 - RNA, 18 nt, Salmonella enterica enterica serovar Typhi
guugccaguacagcagcg

SEQ ID NO: 1701739 - RNA, 21 nt, Salmonella enterica enterica serovar Typhi
guugccaggguucaaccugau

SEQ ID NO: 1701740 - RNA, 18 nt, Salmonella enterica enterica serovar Typhi
guugccaugauccaucuc

SEQ ID NO: 1701741 - RNA, 14 nt, Salmonella enterica enterica serovar Typhi
guugccaguacagc

SEQ ID NO: 1701742 - RNA, 17 nt, Salmonella enterica enterica serovar Typhi
guugccgaugacuccca

SEQ ID NO: 1701743 - RNA, 19 nt, Salmonella enterica enterica serovar Typhi
guuggcgacauacgcgcuc

SEQ ID NO: 1701744 - RNA, 17 nt, Salmonella enterica enterica serovar Typhi
guuggcauccugcgggu

SEQ ID NO: 1701745 - RNA, 19 nt, Salmonella enterica enterica serovar Typhi
guuggcauggucagcauaa

SEQ ID NO: 1701746 - RNA, 23 nt, Salmonella enterica enterica serovar Typhi
guuggcauucuuacgauacccca

SEQ ID NO: 1701747 - RNA, 16 nt, Salmonella enterica enterica serovar Typhi
guuggaguaauguuca

SEQ ID NO: 1701748 - RNA, 16 nt, Salmonella enterica enterica serovar Typhi
guugcuuuauaaaaag

SEQ ID NO: 1701749 - RNA, 13 nt, Salmonella enterica enterica serovar Typhi
guugcuucugucc

SEQ ID NO: 1701750 - RNA, 18 nt, Salmonella enterica enterica serovar Typhi
guugcuguuccagccgcc

SEQ ID NO: 1701751 - RNA, 14 nt, Salmonella enterica enterica serovar Typhi
guugguuguagcac

SEQ ID NO: 1701752 - RNA, 23 nt, Salmonella enterica enterica serovar Typhi
guuggucacaaaggccagcagca

SEQ ID NO: 1701753 - RNA, 13 nt, Salmonella enterica enterica serovar Typhi
guugguauucaac

SEQ ID NO: 1701754 - RNA, 23 nt, Salmonella enterica enterica serovar Typhi
guugggcuuccgucggcuggaag

SEQ ID NO: 1701755 - RNA, 19 nt, Salmonella enterica enterica serovar Typhi
guuggcugcgcucagaaac

SEQ ID NO: 1701756 - RNA, 18 nt, Salmonella enterica enterica serovar Typhi
guuggcgccaaaaccgcu

SEQ ID NO: 1701757 - RNA, 20 nt, Salmonella enterica enterica serovar Typhi
guuucccauugggccagcag

SEQ ID NO: 1701758 - RNA, 21 nt, Salmonella enterica enterica serovar Typhi
guuucccgcgcggaaggcgcc

SEQ ID NO: 1701759 - RNA, 19 nt, Salmonella enterica enterica serovar Typhi
guuuccguuuguaacauau

SEQ ID NO: 1701760 - RNA, 17 nt, Salmonella enterica enterica serovar Typhi
guuuccgcuagggcauc

SEQ ID NO: 1701761 - RNA, 21 nt, Salmonella enterica enterica serovar Typhi
guuuccguuuguaacauauuu

SEQ ID NO: 1701762 - RNA, 17 nt, Salmonella enterica enterica serovar Typhi
guuucgacgggagguga

SEQ ID NO: 1701763 - RNA, 13 nt, Salmonella enterica enterica serovar Typhi
guuuauccggcac

SEQ ID NO: 1701764 - RNA, 21 nt, Salmonella enterica enterica serovar Typhi
guuuaucuggcuuacaggcac

SEQ ID NO: 1701765 - RNA, 17 nt, Salmonella enterica enterica serovar Typhi
guuuaucugaugccuga

SEQ ID NO: 1701766 - RNA, 16 nt, Salmonella enterica enterica serovar Typhi
guuuauuaggccuaca

SEQ ID NO: 1701767 - RNA, 13 nt, Salmonella enterica enterica serovar Typhi
guuucgccaggcc

SEQ ID NO: 1701768 - RNA, 13 nt, Salmonella enterica enterica serovar Typhi
guuucgccagcgc

SEQ ID NO: 1701769 - RNA, 19 nt, Salmonella enterica enterica serovar Typhi
guuucucuuccgccagcgc

SEQ ID NO: 1701770 - RNA, 22 nt, Salmonella enterica enterica serovar Typhi
guuucucuugugcuuccagcuc

SEQ ID NO: 1701771 - RNA, 21 nt, Salmonella enterica enterica serovar Typhi
guuucucgccgguagccagcc

SEQ ID NO: 1701772 - RNA, 22 nt, Salmonella enterica enterica serovar Typhi
guuuacgagccauuaaugcagg

SEQ ID NO: 1701773 - RNA, 21 nt, Salmonella enterica enterica serovar Typhi
guuuacgagugcguucuucca

SEQ ID NO: 1701774 - RNA, 14 nt, Salmonella enterica enterica serovar Typhi
guuuauauaaaaau

SEQ ID NO: 1701775 - RNA, 20 nt, Salmonella enterica enterica serovar Typhi
guuuaccauuacgcuauaaa

SEQ ID NO: 1701776 - RNA, 16 nt, Salmonella enterica enterica serovar Typhi
guuuaccugcaaaaac

SEQ ID NO: 1701777 - RNA, 21 nt, Salmonella enterica enterica serovar Typhi
guuuaaccguuccaacgcguu

SEQ ID NO: 1701778 - RNA, 16 nt, Salmonella enterica enterica serovar Typhi
guuguaggcucaaagu

SEQ ID NO: 1701779 - RNA, 15 nt, Salmonella enterica enterica serovar Typhi
guuguaguuaucgcc

SEQ ID NO: 1701780 - RNA, 15 nt, Salmonella enterica enterica serovar Typhi
guuuaaaagcggaua

SEQ ID NO: 1701781 - RNA, 18 nt, Salmonella enterica enterica serovar Typhi
uaaaaagaccaugaacac

SEQ ID NO: 1701782 - RNA, 16 nt, Salmonella enterica enterica serovar Typhi
uaaaaacccugccgaa

SEQ ID NO: 1701783 - RNA, 20 nt, Salmonella enterica enterica serovar Typhi
uaaaaaccagaauuuccaga

SEQ ID NO: 1701784 - RNA, 15 nt, Salmonella enterica enterica serovar Typhi
uaaaaacccaccagc

SEQ ID NO: 1701785 - RNA, 21 nt, Salmonella enterica enterica serovar Typhi
guuugaggaaaccuuucuucu

SEQ ID NO: 1701786 - RNA, 18 nt, Salmonella enterica enterica serovar Typhi
uaaaaagccagcguaaau

SEQ ID NO: 1701787 - RNA, 22 nt, Salmonella enterica enterica serovar Typhi
uaaaaagcacaucagcaaauga

SEQ ID NO: 1701788 - RNA, 21 nt, Salmonella enterica enterica serovar Typhi
uaaaaaggugagcgcaaugcu

SEQ ID NO: 1701789 - RNA, 11 nt, Salmonella enterica enterica serovar Typhi
uaaaaaggaca

SEQ ID NO: 1701790 - RNA, 10 nt, Salmonella enterica enterica serovar Typhi
uaaaaaggaa

SEQ ID NO: 1701791 - RNA, 16 nt, Salmonella enterica enterica serovar Typhi
uaaaaagcugcauaau

SEQ ID NO: 1701792 - RNA, 11 nt, Salmonella enterica enterica serovar Typhi
uaaaaaggaaa

SEQ ID NO: 1701793 - RNA, 17 nt, Salmonella enterica enterica serovar Typhi
uaaaaagcguacaaaaa

SEQ ID NO: 1701794 - RNA, 17 nt, Salmonella enterica enterica serovar Typhi
uaaaaagcgucaguaaa

SEQ ID NO: 1701795 - RNA, 19 nt, Salmonella enterica enterica serovar Typhi
uaaaaagcgucaguaaaag

SEQ ID NO: 1701796 - RNA, 22 nt, Salmonella enterica enterica serovar Typhi
uaaaacgcauacugagcaucca

SEQ ID NO: 1701797 - RNA, 17 nt, Salmonella enterica enterica serovar Typhi
uaaaaauuguuccugua

SEQ ID NO: 1701798 - RNA, 20 nt, Salmonella enterica enterica serovar Typhi
uaaacaccggggcauuucca

SEQ ID NO: 1701799 - RNA, 16 nt, Salmonella enterica enterica serovar Typhi
uaaacagacaauuagc

SEQ ID NO: 1701800 - RNA, 15 nt, Salmonella enterica enterica serovar Typhi
uaaacaaaacaacaa

SEQ ID NO: 1701801 - RNA, 17 nt, Salmonella enterica enterica serovar Typhi
uaaaauugcucagccaa

SEQ ID NO: 1701802 - RNA, 21 nt, Salmonella enterica enterica serovar Typhi
uaaaauuauuuuuacuuaaaa

SEQ ID NO: 1701803 - RNA, 22 nt, Salmonella enterica enterica serovar Typhi
uaaaauuauuuuuacuuaaaau

SEQ ID NO: 1701804 - RNA, 19 nt, Salmonella enterica enterica serovar Typhi
uaaaauccggcugccugcc

SEQ ID NO: 1701805 - RNA, 20 nt, Salmonella enterica enterica serovar Typhi
uaaaauccugguaacggcac

SEQ ID NO: 1701806 - RNA, 17 nt, Salmonella enterica enterica serovar Typhi
uaaaauccuuuuucaug

SEQ ID NO: 1701807 - RNA, 20 nt, Salmonella enterica enterica serovar Typhi
uaaaaucggggucuuccagc

SEQ ID NO: 1701808 - RNA, 15 nt, Salmonella enterica enterica serovar Typhi
uaaaaugucuuuucg

SEQ ID NO: 1701809 - RNA, 23 nt, Salmonella enterica enterica serovar Typhi
uaaaauguuuuuguuguuaauuu

SEQ ID NO: 1701810 - RNA, 20 nt, Salmonella enterica enterica serovar Typhi
uaaaauauccaugcuuucaa

SEQ ID NO: 1701811 - RNA, 21 nt, Salmonella enterica enterica serovar Typhi
uaaauccaauagacuucacuu

SEQ ID NO: 1701812 - RNA, 14 nt, Salmonella enterica enterica serovar Typhi
uaaauccuucgccg

SEQ ID NO: 1701813 - RNA, 19 nt, Salmonella enterica enterica serovar Typhi
uaaauccguuaagcccuga

SEQ ID NO: 1701814 - RNA, 19 nt, Salmonella enterica enterica serovar Typhi
uaaaucgcgcaaauauuac

SEQ ID NO: 1701815 - RNA, 21 nt, Salmonella enterica enterica serovar Typhi
uaaaucgcgcaaauauuacaa

SEQ ID NO: 1701816 - RNA, 14 nt, Salmonella enterica enterica serovar Typhi
uaaaucgcggcgcu

SEQ ID NO: 1701817 - RNA, 16 nt, Salmonella enterica enterica serovar Typhi
uaaaucgcuaagcaga

SEQ ID NO: 1701818 - RNA, 18 nt, Salmonella enterica enterica serovar Typhi
uaaauauaagaucuauuu

SEQ ID NO: 1701819 - RNA, 17 nt, Salmonella enterica enterica serovar Typhi
uaaauauucaucaaaau

SEQ ID NO: 1701820 - RNA, 20 nt, Salmonella enterica enterica serovar Typhi
uaaauauucaucaaaaugca

SEQ ID NO: 1701821 - RNA, 20 nt, Salmonella enterica enterica serovar Typhi
uaaauauuggcggcaaagaa

SEQ ID NO: 1701822 - RNA, 10 nt, Salmonella enterica enterica serovar Typhi
uaaaucagcc

SEQ ID NO: 1701823 - RNA, 15 nt, Salmonella enterica enterica serovar Typhi
uaaaucaggaaaaag

SEQ ID NO: 1701824 - RNA, 17 nt, Salmonella enterica enterica serovar Typhi
uaaaucaggccaagcaa

SEQ ID NO: 1701825 - RNA, 17 nt, Salmonella enterica enterica serovar Typhi
uaaaucauccugcggca

SEQ ID NO: 1701826 - RNA, 19 nt, Salmonella enterica enterica serovar Typhi
uaaaucauuacuuauauuu

SEQ ID NO: 1701827 - RNA, 19 nt, Salmonella enterica enterica serovar Typhi
uaaaucauuuguacaaaaa

SEQ ID NO: 1701828 - RNA, 16 nt, Salmonella enterica enterica serovar Typhi
uaaauaguaaauagaa

SEQ ID NO: 1701829 - RNA, 16 nt, Salmonella enterica enterica serovar Typhi
uaaauaggcgccgccg

SEQ ID NO: 1701830 - RNA, 14 nt, Salmonella enterica enterica serovar Typhi
uaaauaggcggcau

SEQ ID NO: 1701831 - RNA, 17 nt, Salmonella enterica enterica serovar Typhi
uaaauacgccgccagca

SEQ ID NO: 1701832 - RNA, 20 nt, Salmonella enterica enterica serovar Typhi
uaaauaccuucgugaugugg

SEQ ID NO: 1701833 - RNA, 18 nt, Salmonella enterica enterica serovar Typhi
uaaauaccgcaauaaaca

SEQ ID NO: 1701834 - RNA, 15 nt, Salmonella enterica enterica serovar Typhi
uaaauaccaggcacu

SEQ ID NO: 1701835 - RNA, 15 nt, Salmonella enterica enterica serovar Typhi
uaaaguguuaucaug

SEQ ID NO: 1701836 - RNA, 20 nt, Salmonella enterica enterica serovar Typhi
uaaauaacauuucagucuaa

SEQ ID NO: 1701837 - RNA, 13 nt, Salmonella enterica enterica serovar Typhi
uaaagucucaggg

SEQ ID NO: 1701838 - RNA, 19 nt, Salmonella enterica enterica serovar Typhi
uaaacccgauucugccagu

SEQ ID NO: 1701839 - RNA, 16 nt, Salmonella enterica enterica serovar Typhi
uaaaccauuucuccug

SEQ ID NO: 1701840 - RNA, 19 nt, Salmonella enterica enterica serovar Typhi
uaaacccccuggccggaaa

SEQ ID NO: 1701841 - RNA, 16 nt, Salmonella enterica enterica serovar Typhi
uaaacagcuugucgcc

SEQ ID NO: 1701842 - RNA, 15 nt, Salmonella enterica enterica serovar Typhi
uaaacaggcaggccc

SEQ ID NO: 1701843 - RNA, 22 nt, Salmonella enterica enterica serovar Typhi
uaaacggcucugcaucauuccu

SEQ ID NO: 1701844 - RNA, 13 nt, Salmonella enterica enterica serovar Typhi
uaaacuaucgucu

SEQ ID NO: 1701845 - RNA, 21 nt, Salmonella enterica enterica serovar Typhi
uaaacggcagccgccaccaca

SEQ ID NO: 1701846 - RNA, 12 nt, Salmonella enterica enterica serovar Typhi
uaaacgccggau

SEQ ID NO: 1701847 - RNA, 19 nt, Salmonella enterica enterica serovar Typhi
uaaacuccauuaaauuacu

SEQ ID NO: 1701848 - RNA, 13 nt, Salmonella enterica enterica serovar Typhi
uaaacugccuucg

SEQ ID NO: 1701849 - RNA, 19 nt, Salmonella enterica enterica serovar Typhi
uaaacucuguguuaugaau

SEQ ID NO: 1701850 - RNA, 14 nt, Salmonella enterica enterica serovar Typhi
uaaagauuggcauc

SEQ ID NO: 1701851 - RNA, 23 nt, Salmonella enterica enterica serovar Typhi
uaaagauuagcguuuuuaucuuu

SEQ ID NO: 1701852 - RNA, 15 nt, Salmonella enterica enterica serovar Typhi
uaaagauuguuucgg

SEQ ID NO: 1701853 - RNA, 23 nt, Salmonella enterica enterica serovar Typhi
uaaaggacaggugcgcugugguc

SEQ ID NO: 1701854 - RNA, 16 nt, Salmonella enterica enterica serovar Typhi
uaaaggauaauagugu

SEQ ID NO: 1701855 - RNA, 13 nt, Salmonella enterica enterica serovar Typhi
uaaagauaagcac

SEQ ID NO: 1701856 - RNA, 13 nt, Salmonella enterica enterica serovar Typhi
uaaagaaauuuaa

SEQ ID NO: 1701857 - RNA, 12 nt, Salmonella enterica enterica serovar Typhi
uaaagaaaaacg

SEQ ID NO: 1701858 - RNA, 22 nt, Salmonella enterica enterica serovar Typhi
uaaacuguccaguuuuugcauu

SEQ ID NO: 1701859 - RNA, 15 nt, Salmonella enterica enterica serovar Typhi
uaaacuguuuccagu

SEQ ID NO: 1701860 - RNA, 17 nt, Salmonella enterica enterica serovar Typhi
uaacaauagaccugaaa

SEQ ID NO: 1701861 - RNA, 18 nt, Salmonella enterica enterica serovar Typhi
uaacaauauuaaauaaau

SEQ ID NO: 1701862 - RNA, 15 nt, Salmonella enterica enterica serovar Typhi
uaacaacuguuuuuc

SEQ ID NO: 1701863 - RNA, 16 nt, Salmonella enterica enterica serovar Typhi
uaacaacuguuuuuca

SEQ ID NO: 1701864 - RNA, 17 nt, Salmonella enterica enterica serovar Typhi
uaacaacuguuuuucac

SEQ ID NO: 1701865 - RNA, 21 nt, Salmonella enterica enterica serovar Typhi
uaacaauauuaaauaaauagu

SEQ ID NO: 1701866 - RNA, 17 nt, Salmonella enterica enterica serovar Typhi
uaacaccguuggcguca

SEQ ID NO: 1701867 - RNA, 14 nt, Salmonella enterica enterica serovar Typhi
uaacacggcuggca

SEQ ID NO: 1701868 - RNA, 13 nt, Salmonella enterica enterica serovar Typhi
uaaaugucaggau

SEQ ID NO: 1701869 - RNA, 13 nt, Salmonella enterica enterica serovar Typhi
uaacaaaaaacau

SEQ ID NO: 1701870 - RNA, 16 nt, Salmonella enterica enterica serovar Typhi
uaacaacauugaggcu

SEQ ID NO: 1701871 - RNA, 17 nt, Salmonella enterica enterica serovar Typhi
uaacaaccagaauaaug

SEQ ID NO: 1701872 - RNA, 21 nt, Salmonella enterica enterica serovar Typhi
uaacagggugauggugucaau

SEQ ID NO: 1701873 - RNA, 19 nt, Salmonella enterica enterica serovar Typhi
uaacaggcgccggggcagc

SEQ ID NO: 1701874 - RNA, 21 nt, Salmonella enterica enterica serovar Typhi
uaacaggcgccggggcagcaa

SEQ ID NO: 1701875 - RNA, 21 nt, Salmonella enterica enterica serovar Typhi
uaacagcgcugguagcaccga

SEQ ID NO: 1701876 - RNA, 18 nt, Salmonella enterica enterica serovar Typhi
uaacauaucgacauaagu

SEQ ID NO: 1701877 - RNA, 23 nt, Salmonella enterica enterica serovar Typhi
uaacauaucgacauaaguaaaua

SEQ ID NO: 1701878 - RNA, 14 nt, Salmonella enterica enterica serovar Typhi
uaacaucaaguaca

SEQ ID NO: 1701879 - RNA, 18 nt, Salmonella enterica enterica serovar Typhi
uaacaucaaguacagcuu

SEQ ID NO: 1701880 - RNA, 14 nt, Salmonella enterica enterica serovar Typhi
uaacauacaaaaag

SEQ ID NO: 1701881 - RNA, 23 nt, Salmonella enterica enterica serovar Typhi
uaacauaaauaguauuaguugau

SEQ ID NO: 1701882 - RNA, 17 nt, Salmonella enterica enterica serovar Typhi
uaacauaaauaguauua

SEQ ID NO: 1701883 - RNA, 16 nt, Salmonella enterica enterica serovar Typhi
uaaccaaagcaccauu

SEQ ID NO: 1701884 - RNA, 17 nt, Salmonella enterica enterica serovar Typhi
uaacaucaccuuucauu

SEQ ID NO: 1701885 - RNA, 16 nt, Salmonella enterica enterica serovar Typhi
uaacaucguaaaucaa

SEQ ID NO: 1701886 - RNA, 21 nt, Salmonella enterica enterica serovar Typhi
uaaccagaaaaccgacagcaa

SEQ ID NO: 1701887 - RNA, 23 nt, Salmonella enterica enterica serovar Typhi
uaaccaccggcgcgccagcgcau

SEQ ID NO: 1701888 - RNA, 15 nt, Salmonella enterica enterica serovar Typhi
uaacuggcaaucaug

SEQ ID NO: 1701889 - RNA, 12 nt, Salmonella enterica enterica serovar Typhi
uaacugcugcuc

SEQ ID NO: 1701890 - RNA, 21 nt, Salmonella enterica enterica serovar Typhi
uaacuggaaaaagaccaauac

SEQ ID NO: 1701891 - RNA, 19 nt, Salmonella enterica enterica serovar Typhi
uaacugcauuacauucaua

SEQ ID NO: 1701892 - RNA, 17 nt, Salmonella enterica enterica serovar Typhi
uaacucuuaauuauaaa

SEQ ID NO: 1701893 - RNA, 19 nt, Salmonella enterica enterica serovar Typhi
uaacucuuuuucagcaaau

SEQ ID NO: 1701894 - RNA, 23 nt, Salmonella enterica enterica serovar Typhi
uaacucuuuuucagcaaauacag

SEQ ID NO: 1701895 - RNA, 21 nt, Salmonella enterica enterica serovar Typhi
uaacugcaaaucuucggcaaa

SEQ ID NO: 1701896 - RNA, 23 nt, Salmonella enterica enterica serovar Typhi
uaacugaacuuccguaaaaagaa

SEQ ID NO: 1701897 - RNA, 16 nt, Salmonella enterica enterica serovar Typhi
uaacugacucugccuc

SEQ ID NO: 1701898 - RNA, 14 nt, Salmonella enterica enterica serovar Typhi
uaacucguccuguu

SEQ ID NO: 1701899 - RNA, 21 nt, Salmonella enterica enterica serovar Typhi
uaacuccccgccccagcagca

SEQ ID NO: 1701900 - RNA, 22 nt, Salmonella enterica enterica serovar Typhi
uaacuccuucuaauuccaggau

SEQ ID NO: 1701901 - RNA, 18 nt, Salmonella enterica enterica serovar Typhi
uaacucaauagcggugcu

SEQ ID NO: 1701902 - RNA, 19 nt, Salmonella enterica enterica serovar Typhi
uaacucaagcgaauccaga

SEQ ID NO: 1701903 - RNA, 16 nt, Salmonella enterica enterica serovar Typhi
uaacuacaauacucac

SEQ ID NO: 1701904 - RNA, 21 nt, Salmonella enterica enterica serovar Typhi
uaacuaauggcaauaauacag

SEQ ID NO: 1701905 - RNA, 23 nt, Salmonella enterica enterica serovar Typhi
uaacuaauuguuuguagaaagug

SEQ ID NO: 1701906 - RNA, 23 nt, Salmonella enterica enterica serovar Typhi
uaacuauuucuaucagguaacau

SEQ ID NO: 1701907 - RNA, 19 nt, Salmonella enterica enterica serovar Typhi
uaacguacagguugugcau

SEQ ID NO: 1701908 - RNA, 17 nt, Salmonella enterica enterica serovar Typhi
uaacguuuuacgcugcc

SEQ ID NO: 1701909 - RNA, 13 nt, Salmonella enterica enterica serovar Typhi
uaacguuuucagu

SEQ ID NO: 1701910 - RNA, 15 nt, Salmonella enterica enterica serovar Typhi
uaacuaaacucaucu

SEQ ID NO: 1701911 - RNA, 15 nt, Salmonella enterica enterica serovar Typhi
uaacgggacacugcc

SEQ ID NO: 1701912 - RNA, 23 nt, Salmonella enterica enterica serovar Typhi
uaacgcgcuggaugcgcaaaugc

SEQ ID NO: 1701913 - RNA, 18 nt, Salmonella enterica enterica serovar Typhi
uaacgccgauuaaugcuc

SEQ ID NO: 1701914 - RNA, 18 nt, Salmonella enterica enterica serovar Typhi
uaacgcguaaucuuccac

SEQ ID NO: 1701915 - RNA, 13 nt, Salmonella enterica enterica serovar Typhi
uaacgcgccaucu

SEQ ID NO: 1701916 - RNA, 17 nt, Salmonella enterica enterica serovar Typhi
uaaccuguaaauaauag

SEQ ID NO: 1701917 - RNA, 18 nt, Salmonella enterica enterica serovar Typhi
uaacgcauacauucuguu

SEQ ID NO: 1701918 - RNA, 21 nt, Salmonella enterica enterica serovar Typhi
uaaccuucuucguuaugaaug

SEQ ID NO: 1701919 - RNA, 19 nt, Salmonella enterica enterica serovar Typhi
uaacccaguucaaaucgau

SEQ ID NO: 1701920 - RNA, 18 nt, Salmonella enterica enterica serovar Typhi
uaaccucuauaguaaauu

SEQ ID NO: 1701921 - RNA, 18 nt, Salmonella enterica enterica serovar Typhi
uaaggaaacgaaagcuca

SEQ ID NO: 1701922 - RNA, 20 nt, Salmonella enterica enterica serovar Typhi
uaagcuuuaaccacagccuu

SEQ ID NO: 1701923 - RNA, 18 nt, Salmonella enterica enterica serovar Typhi
uaagcuuaggauaagaau

SEQ ID NO: 1701924 - RNA, 20 nt, Salmonella enterica enterica serovar Typhi
uaagcugcgaagccaccgga

SEQ ID NO: 1701925 - RNA, 16 nt, Salmonella enterica enterica serovar Typhi
uaagcuaguaaagaaa

SEQ ID NO: 1701926 - RNA, 16 nt, Salmonella enterica enterica serovar Typhi
uaagcuauuccuguau

SEQ ID NO: 1701927 - RNA, 14 nt, Salmonella enterica enterica serovar Typhi
uaagcgaaugcugu

SEQ ID NO: 1701928 - RNA, 16 nt, Salmonella enterica enterica serovar Typhi
uaagccgucauaaaau

SEQ ID NO: 1701929 - RNA, 14 nt, Salmonella enterica enterica serovar Typhi
uaagcgcccgucca

SEQ ID NO: 1701930 - RNA, 13 nt, Salmonella enterica enterica serovar Typhi
uaagcgccgcuga

SEQ ID NO: 1701931 - RNA, 20 nt, Salmonella enterica enterica serovar Typhi
uaagcgcagcgccauugagc

SEQ ID NO: 1701932 - RNA, 16 nt, Salmonella enterica enterica serovar Typhi
uaagcgcgaaauuuau

SEQ ID NO: 1701933 - RNA, 17 nt, Salmonella enterica enterica serovar Typhi
uaagcggguugcacauu

SEQ ID NO: 1701934 - RNA, 15 nt, Salmonella enterica enterica serovar Typhi
uaagcggcagcgcca

SEQ ID NO: 1701935 - RNA, 16 nt, Salmonella enterica enterica serovar Typhi
uaagcggcagcgccau

SEQ ID NO: 1701936 - RNA, 11 nt, Salmonella enterica enterica serovar Typhi
uaagcguucag

SEQ ID NO: 1701937 - RNA, 23 nt, Salmonella enterica enterica serovar Typhi
uaagcuaguaaagaaauuuugca

SEQ ID NO: 1701938 - RNA, 14 nt, Salmonella enterica enterica serovar Typhi
uaagcgugcaaccc

SEQ ID NO: 1701939 - RNA, 17 nt, Salmonella enterica enterica serovar Typhi
uaagcguuacggaaaaa

SEQ ID NO: 1701940 - RNA, 13 nt, Salmonella enterica enterica serovar Typhi
uaagcguagcgcc

SEQ ID NO: 1701941 - RNA, 21 nt, Salmonella enterica enterica serovar Typhi
uaagcccauggcaggcagcac

SEQ ID NO: 1701942 - RNA, 23 nt, Salmonella enterica enterica serovar Typhi
uaagcccauggcaggcagcacaa

SEQ ID NO: 1701943 - RNA, 16 nt, Salmonella enterica enterica serovar Typhi
uaagccgauugaauaa

SEQ ID NO: 1701944 - RNA, 14 nt, Salmonella enterica enterica serovar Typhi
uaagccagcgauga

SEQ ID NO: 1701945 - RNA, 20 nt, Salmonella enterica enterica serovar Typhi
uaagcccauggcaggcagca

SEQ ID NO: 1701946 - RNA, 21 nt, Salmonella enterica enterica serovar Typhi
uaagcaacugauuaaucugcc

SEQ ID NO: 1701947 - RNA, 13 nt, Salmonella enterica enterica serovar Typhi
uaagcacaccauu

SEQ ID NO: 1701948 - RNA, 20 nt, Salmonella enterica enterica serovar Typhi
uaagcagcugcuuaacuucu

SEQ ID NO: 1701949 - RNA, 19 nt, Salmonella enterica enterica serovar Typhi
uaagcacggggguuuugug

SEQ ID NO: 1701950 - RNA, 23 nt, Salmonella enterica enterica serovar Typhi
uaagauucccccgcaugaaaugc

SEQ ID NO: 1701951 - RNA, 12 nt, Salmonella enterica enterica serovar Typhi
uaagauguuuua

SEQ ID NO: 1701952 - RNA, 19 nt, Salmonella enterica enterica serovar Typhi
uaagaucggguggccuaac

SEQ ID NO: 1701953 - RNA, 16 nt, Salmonella enterica enterica serovar Typhi
uaagauuuacaacaga

SEQ ID NO: 1701954 - RNA, 16 nt, Salmonella enterica enterica serovar Typhi
uaagauuuaaaacaag

SEQ ID NO: 1701955 - RNA, 18 nt, Salmonella enterica enterica serovar Typhi
uaagauuuaaaacaagca

SEQ ID NO: 1701956 - RNA, 14 nt, Salmonella enterica enterica serovar Typhi
uaagcaauauggcu

SEQ ID NO: 1701957 - RNA, 19 nt, Salmonella enterica enterica serovar Typhi
uaagaaguaaacagaauca

SEQ ID NO: 1701958 - RNA, 13 nt, Salmonella enterica enterica serovar Typhi
uaagaacgagaac

SEQ ID NO: 1701959 - RNA, 16 nt, Salmonella enterica enterica serovar Typhi
uaagaaagauaaaaua

SEQ ID NO: 1701960 - RNA, 20 nt, Salmonella enterica enterica serovar Typhi
uaagaaaaaacuggugcagg

SEQ ID NO: 1701961 - RNA, 22 nt, Salmonella enterica enterica serovar Typhi
uaacuuaaacgccggauuccag

SEQ ID NO: 1701962 - RNA, 19 nt, Salmonella enterica enterica serovar Typhi
uaacuuagcaacugccggc

SEQ ID NO: 1701963 - RNA, 15 nt, Salmonella enterica enterica serovar Typhi
uaacuucugcaggga

SEQ ID NO: 1701964 - RNA, 16 nt, Salmonella enterica enterica serovar Typhi
uaacuucggccagcga

SEQ ID NO: 1701965 - RNA, 14 nt, Salmonella enterica enterica serovar Typhi
uaacuucuccgcca

SEQ ID NO: 1701966 - RNA, 18 nt, Salmonella enterica enterica serovar Typhi
uaacuucgcgguuagaaa

SEQ ID NO: 1701967 - RNA, 20 nt, Salmonella enterica enterica serovar Typhi
uaagacgcuuacaucgccau

SEQ ID NO: 1701968 - RNA, 12 nt, Salmonella enterica enterica serovar Typhi
uaagaauuaaca

SEQ ID NO: 1701969 - RNA, 19 nt, Salmonella enterica enterica serovar Typhi
uaagaauuauuaccaauga

SEQ ID NO: 1701970 - RNA, 21 nt, Salmonella enterica enterica serovar Typhi
uaagaaucagaugcucaucaa

SEQ ID NO: 1701971 - RNA, 21 nt, Salmonella enterica enterica serovar Typhi
uaagaaugcgcgucaggccag

SEQ ID NO: 1701972 - RNA, 13 nt, Salmonella enterica enterica serovar Typhi
uaagaaucgaugu

SEQ ID NO: 1701973 - RNA, 19 nt, Salmonella enterica enterica serovar Typhi
uaagaguccauucggccug

SEQ ID NO: 1701974 - RNA, 20 nt, Salmonella enterica enterica serovar Typhi
uaagaggguggcgagcaacu

SEQ ID NO: 1701975 - RNA, 19 nt, Salmonella enterica enterica serovar Typhi
uaagagaccgguuauugag

SEQ ID NO: 1701976 - RNA, 22 nt, Salmonella enterica enterica serovar Typhi
uaagagagccuuacaggcgcau

SEQ ID NO: 1701977 - RNA, 13 nt, Salmonella enterica enterica serovar Typhi
uauagcccacgca

SEQ ID NO: 1701978 - RNA, 16 nt, Salmonella enterica enterica serovar Typhi
uauagcaacuuaauaa

SEQ ID NO: 1701979 - RNA, 14 nt, Salmonella enterica enterica serovar Typhi
uauagcaaacccuc

SEQ ID NO: 1701980 - RNA, 15 nt, Salmonella enterica enterica serovar Typhi
uauagaucagacgac

SEQ ID NO: 1701981 - RNA, 12 nt, Salmonella enterica enterica serovar Typhi
uauagaugaugg

SEQ ID NO: 1701982 - RNA, 18 nt, Salmonella enterica enterica serovar Typhi
uauagaugucagauccuu

SEQ ID NO: 1701983 - RNA, 16 nt, Salmonella enterica enterica serovar Typhi
uauagaauacuuccug

SEQ ID NO: 1701984 - RNA, 13 nt, Salmonella enterica enterica serovar Typhi
uauacauucauuu

SEQ ID NO: 1701985 - RNA, 16 nt, Salmonella enterica enterica serovar Typhi
uauacauucauuuuau

SEQ ID NO: 1701986 - RNA, 15 nt, Salmonella enterica enterica serovar Typhi
uauaccaugcugcca

SEQ ID NO: 1701987 - RNA, 21 nt, Salmonella enterica enterica serovar Typhi
uauaccauaaaugaaaccuca

SEQ ID NO: 1701988 - RNA, 21 nt, Salmonella enterica enterica serovar Typhi
uauaccaugcugccauuuuau

SEQ ID NO: 1701989 - RNA, 13 nt, Salmonella enterica enterica serovar Typhi
uauacugugacga

SEQ ID NO: 1701990 - RNA, 13 nt, Salmonella enterica enterica serovar Typhi
uauacugauaaac

SEQ ID NO: 1701991 - RNA, 19 nt, Salmonella enterica enterica serovar Typhi
uauacuccgcgacgaccug

SEQ ID NO: 1701992 - RNA, 17 nt, Salmonella enterica enterica serovar Typhi
uauacaguaaaacgcca

SEQ ID NO: 1701993 - RNA, 18 nt, Salmonella enterica enterica serovar Typhi
uauaauugcuuuuuucca

SEQ ID NO: 1701994 - RNA, 20 nt, Salmonella enterica enterica serovar Typhi
uauaauugcccgcaaucucu

SEQ ID NO: 1701995 - RNA, 17 nt, Salmonella enterica enterica serovar Typhi
uauaauuuuauuauauu

SEQ ID NO: 1701996 - RNA, 14 nt, Salmonella enterica enterica serovar Typhi
uauaauuaacauuu

SEQ ID NO: 1701997 - RNA, 14 nt, Salmonella enterica enterica serovar Typhi
uauaauuauuuguu

SEQ ID NO: 1701998 - RNA, 20 nt, Salmonella enterica enterica serovar Typhi
uauaauucgucaauaccuaa

SEQ ID NO: 1701999 - RNA, 12 nt, Salmonella enterica enterica serovar Typhi
uaggucagcgau

SEQ ID NO: 1702000 - RNA, 16 nt, Salmonella enterica enterica serovar Typhi
uagucggcaaugcucu

SEQ ID NO: 1702001 - RNA, 22 nt, Salmonella enterica enterica serovar Typhi
uagguacggggcaucuauuuaa

SEQ ID NO: 1702002 - RNA, 15 nt, Salmonella enterica enterica serovar Typhi
uagucgucuauuucc

SEQ ID NO: 1702003 - RNA, 15 nt, Salmonella enterica enterica serovar Typhi
uagucucccuccugc

SEQ ID NO: 1702004 - RNA, 17 nt, Salmonella enterica enterica serovar Typhi
uagucucccuccugcuc

SEQ ID NO: 1702005 - RNA, 22 nt, Salmonella enterica enterica serovar Typhi
uagucuuaauuugcuguuuuuu

SEQ ID NO: 1702006 - RNA, 13 nt, Salmonella enterica enterica serovar Typhi
uaguguaauucuc

SEQ ID NO: 1702007 - RNA, 12 nt, Salmonella enterica enterica serovar Typhi
uaguggaacugu

SEQ ID NO: 1702008 - RNA, 20 nt, Salmonella enterica enterica serovar Typhi
uagugcuucucuucaaacuc

SEQ ID NO: 1702009 - RNA, 21 nt, Salmonella enterica enterica serovar Typhi
uaguuauaaauuuauuuuuug

SEQ ID NO: 1702010 - RNA, 11 nt, Salmonella enterica enterica serovar Typhi
uaguuaaaaaa

SEQ ID NO: 1702011 - RNA, 18 nt, Salmonella enterica enterica serovar Typhi
uaguuaaaggugguguua

SEQ ID NO: 1702012 - RNA, 20 nt, Salmonella enterica enterica serovar Typhi
uauaaaaaaugguuuuauuu

SEQ ID NO: 1702013 - RNA, 12 nt, Salmonella enterica enterica serovar Typhi
uauaaaucaaua

SEQ ID NO: 1702014 - RNA, 13 nt, Salmonella enterica enterica serovar Typhi
uauaaauauuaau

SEQ ID NO: 1702015 - RNA, 12 nt, Salmonella enterica enterica serovar Typhi
uauaaauaucau

SEQ ID NO: 1702016 - RNA, 14 nt, Salmonella enterica enterica serovar Typhi
uaguuucuauuaaa

SEQ ID NO: 1702017 - RNA, 19 nt, Salmonella enterica enterica serovar Typhi
uaguuucuauuaaaucaga

SEQ ID NO: 1702018 - RNA, 22 nt, Salmonella enterica enterica serovar Typhi
uaguuuccgccgcgguauucau

SEQ ID NO: 1702019 - RNA, 14 nt, Salmonella enterica enterica serovar Typhi
uaguuucaccuucu

SEQ ID NO: 1702020 - RNA, 14 nt, Salmonella enterica enterica serovar Typhi
uaguuugcauaacc

SEQ ID NO: 1702021 - RNA, 14 nt, Salmonella enterica enterica serovar Typhi
uaucaggccgacaa

SEQ ID NO: 1702022 - RNA, 18 nt, Salmonella enterica enterica serovar Typhi
uaucaggccgacaaauga

SEQ ID NO: 1702023 - RNA, 20 nt, Salmonella enterica enterica serovar Typhi
uaucaggccgacaaaugacg

SEQ ID NO: 1702024 - RNA, 19 nt, Salmonella enterica enterica serovar Typhi
uaucagggcuuuuuucucg

SEQ ID NO: 1702025 - RNA, 23 nt, Salmonella enterica enterica serovar Typhi
uaucaggcugagcgacgguuuua

SEQ ID NO: 1702026 - RNA, 17 nt, Salmonella enterica enterica serovar Typhi
uaucaggccuacaaggc

SEQ ID NO: 1702027 - RNA, 14 nt, Salmonella enterica enterica serovar Typhi
uaucaggccuacac

SEQ ID NO: 1702028 - RNA, 17 nt, Salmonella enterica enterica serovar Typhi
uaucaggccuaccaguc

SEQ ID NO: 1702029 - RNA, 19 nt, Salmonella enterica enterica serovar Typhi
uaucaccaaguagacagag

SEQ ID NO: 1702030 - RNA, 16 nt, Salmonella enterica enterica serovar Typhi
uaucaauuucauauua

SEQ ID NO: 1702031 - RNA, 17 nt, Salmonella enterica enterica serovar Typhi
uaucaauuucauauuau

SEQ ID NO: 1702032 - RNA, 22 nt, Salmonella enterica enterica serovar Typhi
uaucacacauaucgccagccau

SEQ ID NO: 1702033 - RNA, 11 nt, Salmonella enterica enterica serovar Typhi
uaucacacccg

SEQ ID NO: 1702034 - RNA, 21 nt, Salmonella enterica enterica serovar Typhi
uauauucgcgaugcucaacca

SEQ ID NO: 1702035 - RNA, 15 nt, Salmonella enterica enterica serovar Typhi
uauauugaaaaggga

SEQ ID NO: 1702036 - RNA, 15 nt, Salmonella enterica enterica serovar Typhi
uauauuccagccagg

SEQ ID NO: 1702037 - RNA, 19 nt, Salmonella enterica enterica serovar Typhi
uauauuccgcaggcaagaa

SEQ ID NO: 1702038 - RNA, 15 nt, Salmonella enterica enterica serovar Typhi
uauauucaugauagu

SEQ ID NO: 1702039 - RNA, 13 nt, Salmonella enterica enterica serovar Typhi
uauauuacuggcu

SEQ ID NO: 1702040 - RNA, 14 nt, Salmonella enterica enterica serovar Typhi
uauaugagcgggcc

SEQ ID NO: 1702041 - RNA, 13 nt, Salmonella enterica enterica serovar Typhi
uauauuaguguua

SEQ ID NO: 1702042 - RNA, 18 nt, Salmonella enterica enterica serovar Typhi
uauauuaguguuauauaa

SEQ ID NO: 1702043 - RNA, 15 nt, Salmonella enterica enterica serovar Typhi
uauaucgcgauaaac

SEQ ID NO: 1702044 - RNA, 13 nt, Salmonella enterica enterica serovar Typhi
uauaggaaaauga

SEQ ID NO: 1702045 - RNA, 21 nt, Salmonella enterica enterica serovar Typhi
uauagcccagaaucaccccaa

SEQ ID NO: 1702046 - RNA, 18 nt, Salmonella enterica enterica serovar Typhi
uauagccuuuauugauga

SEQ ID NO: 1702047 - RNA, 15 nt, Salmonella enterica enterica serovar Typhi
uauagccuuuuucuu

SEQ ID NO: 1702048 - RNA, 23 nt, Salmonella enterica enterica serovar Typhi
uaucgaaggucaggccacugccc

SEQ ID NO: 1702049 - RNA, 22 nt, Salmonella enterica enterica serovar Typhi
uaucgaauggggaaauaaauau

SEQ ID NO: 1702050 - RNA, 14 nt, Salmonella enterica enterica serovar Typhi
uaucgaaagagcaa

SEQ ID NO: 1702051 - RNA, 14 nt, Salmonella enterica enterica serovar Typhi
uaucccuauucuga

SEQ ID NO: 1702052 - RNA, 19 nt, Salmonella enterica enterica serovar Typhi
uauccagucagcguuacug

SEQ ID NO: 1702053 - RNA, 14 nt, Salmonella enterica enterica serovar Typhi
uauccaguugauga

SEQ ID NO: 1702054 - RNA, 13 nt, Salmonella enterica enterica serovar Typhi
uauccaguuucug

SEQ ID NO: 1702055 - RNA, 15 nt, Salmonella enterica enterica serovar Typhi
uauccgcauucuaaa

SEQ ID NO: 1702056 - RNA, 16 nt, Salmonella enterica enterica serovar Typhi
uauccgacgcaacuca

SEQ ID NO: 1702057 - RNA, 18 nt, Salmonella enterica enterica serovar Typhi
uauccgcaacugaaacca

SEQ ID NO: 1702058 - RNA, 22 nt, Salmonella enterica enterica serovar Typhi
uauccccgcuggcgcggggauc

SEQ ID NO: 1702059 - RNA, 20 nt, Salmonella enterica enterica serovar Typhi
uaucccuuccucauuuuugc

SEQ ID NO: 1702060 - RNA, 15 nt, Salmonella enterica enterica serovar Typhi
uaucccuuucaaaaa

SEQ ID NO: 1702061 - RNA, 18 nt, Salmonella enterica enterica serovar Typhi
uauccagcggcaaaggca

SEQ ID NO: 1702062 - RNA, 17 nt, Salmonella enterica enterica serovar Typhi
uauccaggccagcuccg

SEQ ID NO: 1702063 - RNA, 16 nt, Salmonella enterica enterica serovar Typhi
uauccagcaguaaaua

SEQ ID NO: 1702064 - RNA, 20 nt, Salmonella enterica enterica serovar Typhi
uauccagcgcguaaauaccu

SEQ ID NO: 1702065 - RNA, 20 nt, Salmonella enterica enterica serovar Typhi
uaucaugugaucuauauauu

SEQ ID NO: 1702066 - RNA, 16 nt, Salmonella enterica enterica serovar Typhi
uauccagauagcgauc

SEQ ID NO: 1702067 - RNA, 20 nt, Salmonella enterica enterica serovar Typhi
uaucucuauugcuuauuaga

SEQ ID NO: 1702068 - RNA, 22 nt, Salmonella enterica enterica serovar Typhi
uaucugaaaguaagcuauuccu

SEQ ID NO: 1702069 - RNA, 14 nt, Salmonella enterica enterica serovar Typhi
uaucugaugaacua

SEQ ID NO: 1702070 - RNA, 17 nt, Salmonella enterica enterica serovar Typhi
uaucugucccagccuuc

SEQ ID NO: 1702071 - RNA, 23 nt, Salmonella enterica enterica serovar Typhi
uaucugucugcuguaauuuauaa

SEQ ID NO: 1702072 - RNA, 19 nt, Salmonella enterica enterica serovar Typhi
uaucuguaauuauaaauau

SEQ ID NO: 1702073 - RNA, 18 nt, Salmonella enterica enterica serovar Typhi
uaucgcacuggcgccugc

SEQ ID NO: 1702074 - RNA, 13 nt, Salmonella enterica enterica serovar Typhi
uaucgauaaucaa

SEQ ID NO: 1702075 - RNA, 18 nt, Salmonella enterica enterica serovar Typhi
uagccguuaccgccgagc

SEQ ID NO: 1702076 - RNA, 15 nt, Salmonella enterica enterica serovar Typhi
uagccguucaugcac

SEQ ID NO: 1702077 - RNA, 21 nt, Salmonella enterica enterica serovar Typhi
uagccucaagagaugcagaca

SEQ ID NO: 1702078 - RNA, 21 nt, Salmonella enterica enterica serovar Typhi
uagccuaaugacggacgcaga

SEQ ID NO: 1702079 - RNA, 18 nt, Salmonella enterica enterica serovar Typhi
uagccuguuauucaauuc

SEQ ID NO: 1702080 - RNA, 22 nt, Salmonella enterica enterica serovar Typhi
uagccuucccggggaacagaag

SEQ ID NO: 1702081 - RNA, 20 nt, Salmonella enterica enterica serovar Typhi
uagcgaaacugccuaaauug

SEQ ID NO: 1702082 - RNA, 15 nt, Salmonella enterica enterica serovar Typhi
uagcgaaacaguugg

SEQ ID NO: 1702083 - RNA, 19 nt, Salmonella enterica enterica serovar Typhi
uagcgaaacugccuaaauu

SEQ ID NO: 1702084 - RNA, 14 nt, Salmonella enterica enterica serovar Typhi
uagccuuuauugau

SEQ ID NO: 1702085 - RNA, 22 nt, Salmonella enterica enterica serovar Typhi
uagccagccauggcccuuuugc

SEQ ID NO: 1702086 - RNA, 16 nt, Salmonella enterica enterica serovar Typhi
uagccaguuuuccgcc

SEQ ID NO: 1702087 - RNA, 19 nt, Salmonella enterica enterica serovar Typhi
uagccgcgcgucagcgugu

SEQ ID NO: 1702088 - RNA, 19 nt, Salmonella enterica enterica serovar Typhi
uagccgcgcucaagcuggg

SEQ ID NO: 1702089 - RNA, 21 nt, Salmonella enterica enterica serovar Typhi
uagccgcgcgccgccucuuca

SEQ ID NO: 1702090 - RNA, 19 nt, Salmonella enterica enterica serovar Typhi
uagccaucaaaguagaugu

SEQ ID NO: 1702091 - RNA, 12 nt, Salmonella enterica enterica serovar Typhi
uagcaccagacc

SEQ ID NO: 1702092 - RNA, 12 nt, Salmonella enterica enterica serovar Typhi
uagcacagcgcu

SEQ ID NO: 1702093 - RNA, 16 nt, Salmonella enterica enterica serovar Typhi
uagcauuuuuacucag

SEQ ID NO: 1702094 - RNA, 12 nt, Salmonella enterica enterica serovar Typhi
uagcaucaccag

SEQ ID NO: 1702095 - RNA, 17 nt, Salmonella enterica enterica serovar Typhi
uagcaucaggacauggu

SEQ ID NO: 1702096 - RNA, 19 nt, Salmonella enterica enterica serovar Typhi
uagcauaacguuuccuuau

SEQ ID NO: 1702097 - RNA, 13 nt, Salmonella enterica enterica serovar Typhi
uagcacaaagaau

SEQ ID NO: 1702098 - RNA, 14 nt, Salmonella enterica enterica serovar Typhi
uagcaauuaauaaa

SEQ ID NO: 1702099 - RNA, 23 nt, Salmonella enterica enterica serovar Typhi
uagcaauuauauugcguaaaaac

SEQ ID NO: 1702100 - RNA, 15 nt, Salmonella enterica enterica serovar Typhi
uagcaaucucgccaa

SEQ ID NO: 1702101 - RNA, 23 nt, Salmonella enterica enterica serovar Typhi
uagcucagcuggauagagcgcug

SEQ ID NO: 1702102 - RNA, 22 nt, Salmonella enterica enterica serovar Typhi
uagcucaguugguagagcccug

SEQ ID NO: 1702103 - RNA, 13 nt, Salmonella enterica enterica serovar Typhi
uagcucagcgcgg

SEQ ID NO: 1702104 - RNA, 19 nt, Salmonella enterica enterica serovar Typhi
uagcguuuaaaaagcugca

SEQ ID NO: 1702105 - RNA, 16 nt, Salmonella enterica enterica serovar Typhi
uagcguuucgaacucu

SEQ ID NO: 1702106 - RNA, 14 nt, Salmonella enterica enterica serovar Typhi
uagcguuuuccagc

SEQ ID NO: 1702107 - RNA, 12 nt, Salmonella enterica enterica serovar Typhi
uagcgugccauu

SEQ ID NO: 1702108 - RNA, 14 nt, Salmonella enterica enterica serovar Typhi
uagcgacugauaag

SEQ ID NO: 1702109 - RNA, 22 nt, Salmonella enterica enterica serovar Typhi
uagcucuuucauuucugccugc

SEQ ID NO: 1702110 - RNA, 21 nt, Salmonella enterica enterica serovar Typhi
uagcucuuucauuucugccug

SEQ ID NO: 1702111 - RNA, 20 nt, Salmonella enterica enterica serovar Typhi
uagcucuucaucuuuuucau

SEQ ID NO: 1702112 - RNA, 16 nt, Salmonella enterica enterica serovar Typhi
uagcucgucuguuuug

SEQ ID NO: 1702113 - RNA, 16 nt, Salmonella enterica enterica serovar Typhi
uaggaaaggcagagaa

SEQ ID NO: 1702114 - RNA, 13 nt, Salmonella enterica enterica serovar Typhi
uagggcaucagac

SEQ ID NO: 1702115 - RNA, 15 nt, Salmonella enterica enterica serovar Typhi
uaggguggcuuucua

SEQ ID NO: 1702116 - RNA, 18 nt, Salmonella enterica enterica serovar Typhi
uaggccugauaagcguag

SEQ ID NO: 1702117 - RNA, 17 nt, Salmonella enterica enterica serovar Typhi
uaggcgaggaaaacauu

SEQ ID NO: 1702118 - RNA, 17 nt, Salmonella enterica enterica serovar Typhi
uaggaucaaccaccuuc

SEQ ID NO: 1702119 - RNA, 12 nt, Salmonella enterica enterica serovar Typhi
uaggauaaaauc

SEQ ID NO: 1702120 - RNA, 21 nt, Salmonella enterica enterica serovar Typhi
uagaccacgccaucaacagcg

SEQ ID NO: 1702121 - RNA, 16 nt, Salmonella enterica enterica serovar Typhi
uagaccagcggcccgc

SEQ ID NO: 1702122 - RNA, 22 nt, Salmonella enterica enterica serovar Typhi
uagaccugaaaucagccugcua

SEQ ID NO: 1702123 - RNA, 22 nt, Salmonella enterica enterica serovar Typhi
uagaccugcuccaugacguuca

SEQ ID NO: 1702124 - RNA, 19 nt, Salmonella enterica enterica serovar Typhi
uagacagcaccaucaugca

SEQ ID NO: 1702125 - RNA, 20 nt, Salmonella enterica enterica serovar Typhi
uagacagcggcuaauuuauu

SEQ ID NO: 1702126 - RNA, 21 nt, Salmonella enterica enterica serovar Typhi
uagacaacaucccagaaaaug

SEQ ID NO: 1702127 - RNA, 21 nt, Salmonella enterica enterica serovar Typhi
uagacaauugcugcguaacug

SEQ ID NO: 1702128 - RNA, 15 nt, Salmonella enterica enterica serovar Typhi
uagacgaugcaggcc

SEQ ID NO: 1702129 - RNA, 17 nt, Salmonella enterica enterica serovar Typhi
uagacgccggucaugcc

SEQ ID NO: 1702130 - RNA, 21 nt, Salmonella enterica enterica serovar Typhi
uagacuggcgccgucacguuc

SEQ ID NO: 1702131 - RNA, 16 nt, Salmonella enterica enterica serovar Typhi
uagacuucacuuuccc

SEQ ID NO: 1702132 - RNA, 15 nt, Salmonella enterica enterica serovar Typhi
uagagaacagcauca

SEQ ID NO: 1702133 - RNA, 21 nt, Salmonella enterica enterica serovar Typhi
uagagaacagcaucaccggcc

SEQ ID NO: 1702134 - RNA, 21 nt, Salmonella enterica enterica serovar Typhi
uagacuuuggcgcagucacag

SEQ ID NO: 1702135 - RNA, 13 nt, Salmonella enterica enterica serovar Typhi
uagagaaaauaac

SEQ ID NO: 1702136 - RNA, 13 nt, Salmonella enterica enterica serovar Typhi
uagagaaaucaac

SEQ ID NO: 1702137 - RNA, 20 nt, Salmonella enterica enterica serovar Typhi
uagagcaggucaaagacgaa

SEQ ID NO: 1702138 - RNA, 18 nt, Salmonella enterica enterica serovar Typhi
uagagcaggucaaagacg

SEQ ID NO: 1702139 - RNA, 20 nt, Salmonella enterica enterica serovar Typhi
uagagaguaaaaccggcaca

SEQ ID NO: 1702140 - RNA, 16 nt, Salmonella enterica enterica serovar Typhi
uagagguguuauggca

SEQ ID NO: 1702141 - RNA, 21 nt, Salmonella enterica enterica serovar Typhi
uagagugauccaccaccagca

SEQ ID NO: 1702142 - RNA, 14 nt, Salmonella enterica enterica serovar Typhi
uagaacccaaagcc

SEQ ID NO: 1702143 - RNA, 22 nt, Salmonella enterica enterica serovar Typhi
uagaaagauuucaucaggcuga

SEQ ID NO: 1702144 - RNA, 19 nt, Salmonella enterica enterica serovar Typhi
uagaaaguggcauaucaug

SEQ ID NO: 1702145 - RNA, 16 nt, Salmonella enterica enterica serovar Typhi
uagaauagaaucaauu

SEQ ID NO: 1702146 - RNA, 16 nt, Salmonella enterica enterica serovar Typhi
uagaacggaaguugca

SEQ ID NO: 1702147 - RNA, 18 nt, Salmonella enterica enterica serovar Typhi
uagaaucugguuguuucg

SEQ ID NO: 1702148 - RNA, 13 nt, Salmonella enterica enterica serovar Typhi
uagaaucuauuau

SEQ ID NO: 1702149 - RNA, 18 nt, Salmonella enterica enterica serovar Typhi
uagaaucccaccaauugc

SEQ ID NO: 1702150 - RNA, 20 nt, Salmonella enterica enterica serovar Typhi
uagacaacaucccagaaaau

SEQ ID NO: 1702151 - RNA, 14 nt, Salmonella enterica enterica serovar Typhi
uagaauuuucacuu

SEQ ID NO: 1702152 - RNA, 19 nt, Salmonella enterica enterica serovar Typhi
uagaauuuucacuuauaaa

SEQ ID NO: 1702153 - RNA, 15 nt, Salmonella enterica enterica serovar Typhi
uagaaugcuucuucg

SEQ ID NO: 1702154 - RNA, 21 nt, Salmonella enterica enterica serovar Typhi
uacagaauccggcgcucauca

SEQ ID NO: 1702155 - RNA, 15 nt, Salmonella enterica enterica serovar Typhi
uacacacucggugca

SEQ ID NO: 1702156 - RNA, 19 nt, Salmonella enterica enterica serovar Typhi
uacaauuucuggccccuga

SEQ ID NO: 1702157 - RNA, 17 nt, Salmonella enterica enterica serovar Typhi
uacagcaauaaaaggaa

SEQ ID NO: 1702158 - RNA, 21 nt, Salmonella enterica enterica serovar Typhi
uacagccgacuauuccgcaaa

SEQ ID NO: 1702159 - RNA, 19 nt, Salmonella enterica enterica serovar Typhi
uacaaagggcaauauauua

SEQ ID NO: 1702160 - RNA, 20 nt, Salmonella enterica enterica serovar Typhi
uacaaagggcaauauauuau

SEQ ID NO: 1702161 - RNA, 22 nt, Salmonella enterica enterica serovar Typhi
uacaauaagggcauguuucaug

SEQ ID NO: 1702162 - RNA, 21 nt, Salmonella enterica enterica serovar Typhi
uacaacgacuacguucaucag

SEQ ID NO: 1702163 - RNA, 13 nt, Salmonella enterica enterica serovar Typhi
uacaaccgcaccg

SEQ ID NO: 1702164 - RNA, 22 nt, Salmonella enterica enterica serovar Typhi
uacaaucgucuucagcaauuac

SEQ ID NO: 1702165 - RNA, 15 nt, Salmonella enterica enterica serovar Typhi
uaccaacguaaauua

SEQ ID NO: 1702166 - RNA, 15 nt, Salmonella enterica enterica serovar Typhi
uaccaaauauuucuu

SEQ ID NO: 1702167 - RNA, 19 nt, Salmonella enterica enterica serovar Typhi
uaccaaacccuuuggcaaa

SEQ ID NO: 1702168 - RNA, 19 nt, Salmonella enterica enterica serovar Typhi
uaccaaagugguuccaggc

SEQ ID NO: 1702169 - RNA, 17 nt, Salmonella enterica enterica serovar Typhi
uaccaaagucaucaauu

SEQ ID NO: 1702170 - RNA, 16 nt, Salmonella enterica enterica serovar Typhi
uaccaaaacagaaaag

SEQ ID NO: 1702171 - RNA, 18 nt, Salmonella enterica enterica serovar Typhi
uaccaaaacagaaaagau

SEQ ID NO: 1702172 - RNA, 22 nt, Salmonella enterica enterica serovar Typhi
uaccacaaauuuugauaaaaac

SEQ ID NO: 1702173 - RNA, 21 nt, Salmonella enterica enterica serovar Typhi
uaccaauaagaacuuuaucac

SEQ ID NO: 1702174 - RNA, 14 nt, Salmonella enterica enterica serovar Typhi
uaccaauacccagc

SEQ ID NO: 1702175 - RNA, 15 nt, Salmonella enterica enterica serovar Typhi
uaccaauacccagcg

SEQ ID NO: 1702176 - RNA, 22 nt, Salmonella enterica enterica serovar Typhi
uacauuuuguauucgcagggcu

SEQ ID NO: 1702177 - RNA, 21 nt, Salmonella enterica enterica serovar Typhi
uacauuuuuacaguuaccaca

SEQ ID NO: 1702178 - RNA, 22 nt, Salmonella enterica enterica serovar Typhi
uacauuuucguaaaauauauau

SEQ ID NO: 1702179 - RNA, 24 nt, Salmonella enterica enterica serovar Typhi
uacauuuucguaaaauauauauuu

SEQ ID NO: 1702180 - RNA, 22 nt, Salmonella enterica enterica serovar Typhi
uacauuucacccuauaagcugc

SEQ ID NO: 1702181 - RNA, 18 nt, Salmonella enterica enterica serovar Typhi
uacauuucgucaucgcuu

SEQ ID NO: 1702182 - RNA, 22 nt, Salmonella enterica enterica serovar Typhi
uacauuugaauaauucuguacc

SEQ ID NO: 1702183 - RNA, 14 nt, Salmonella enterica enterica serovar Typhi
uacauucuguuuuc

SEQ ID NO: 1702184 - RNA, 18 nt, Salmonella enterica enterica serovar Typhi
uacauucgcucaggacag

SEQ ID NO: 1702185 - RNA, 16 nt, Salmonella enterica enterica serovar Typhi
uacaugcccgucuggg

SEQ ID NO: 1702186 - RNA, 17 nt, Salmonella enterica enterica serovar Typhi
uacaugccguuaauaau

SEQ ID NO: 1702187 - RNA, 16 nt, Salmonella enterica enterica serovar Typhi
uacaugaggauuuuga

SEQ ID NO: 1702188 - RNA, 15 nt, Salmonella enterica enterica serovar Typhi
uacaugaauaauaau

SEQ ID NO: 1702189 - RNA, 18 nt, Salmonella enterica enterica serovar Typhi
uacaucuacuucagcacg

SEQ ID NO: 1702190 - RNA, 18 nt, Salmonella enterica enterica serovar Typhi
uacauccggcucaagagu

SEQ ID NO: 1702191 - RNA, 14 nt, Salmonella enterica enterica serovar Typhi
uacaucgucugcuu

SEQ ID NO: 1702192 - RNA, 21 nt, Salmonella enterica enterica serovar Typhi
uacauccagaaggcaaaaugc

SEQ ID NO: 1702193 - RNA, 18 nt, Salmonella enterica enterica serovar Typhi
uacauccaucacuccuua

SEQ ID NO: 1702194 - RNA, 18 nt, Salmonella enterica enterica serovar Typhi
uacauccaugccauccag

SEQ ID NO: 1702195 - RNA, 17 nt, Salmonella enterica enterica serovar Typhi
uacaggcgcaucagaaa

SEQ ID NO: 1702196 - RNA, 19 nt, Salmonella enterica enterica serovar Typhi
uacaggcgcaucagaaaaa

SEQ ID NO: 1702197 - RNA, 20 nt, Salmonella enterica enterica serovar Typhi
uacaggcgcaucagaaaaac

SEQ ID NO: 1702198 - RNA, 22 nt, Salmonella enterica enterica serovar Typhi
uacaggcgcaucagaaaaaccu

SEQ ID NO: 1702199 - RNA, 13 nt, Salmonella enterica enterica serovar Typhi
uacaggcaucuuc

SEQ ID NO: 1702200 - RNA, 17 nt, Salmonella enterica enterica serovar Typhi
uacaggcaucuuccagc

SEQ ID NO: 1702201 - RNA, 14 nt, Salmonella enterica enterica serovar Typhi
uacaggcgcagggc

SEQ ID NO: 1702202 - RNA, 15 nt, Salmonella enterica enterica serovar Typhi
uacaggcggaaauca

SEQ ID NO: 1702203 - RNA, 18 nt, Salmonella enterica enterica serovar Typhi
uacaggcuuaacacccgg

SEQ ID NO: 1702204 - RNA, 22 nt, Salmonella enterica enterica serovar Typhi
uacauaguucuggcuuugcgcc

SEQ ID NO: 1702205 - RNA, 15 nt, Salmonella enterica enterica serovar Typhi
uacauaucuauauuu

SEQ ID NO: 1702206 - RNA, 16 nt, Salmonella enterica enterica serovar Typhi
uacaucagaaaacagc

SEQ ID NO: 1702207 - RNA, 15 nt, Salmonella enterica enterica serovar Typhi
uacaucagaguaauu

SEQ ID NO: 1702208 - RNA, 22 nt, Salmonella enterica enterica serovar Typhi
uacauauuauuaugucauagca

SEQ ID NO: 1702209 - RNA, 18 nt, Salmonella enterica enterica serovar Typhi
uacauauuguuuucuauu

SEQ ID NO: 1702210 - RNA, 17 nt, Salmonella enterica enterica serovar Typhi
uaccggcaacgccgggg

SEQ ID NO: 1702211 - RNA, 14 nt, Salmonella enterica enterica serovar Typhi
uaccggcacaccgg

SEQ ID NO: 1702212 - RNA, 20 nt, Salmonella enterica enterica serovar Typhi
uaccggaucgaucccggcaa

SEQ ID NO: 1702213 - RNA, 20 nt, Salmonella enterica enterica serovar Typhi
uaccgugugcagugacagag

SEQ ID NO: 1702214 - RNA, 19 nt, Salmonella enterica enterica serovar Typhi
uaccguccagacuccuuuu

SEQ ID NO: 1702215 - RNA, 22 nt, Salmonella enterica enterica serovar Typhi
uaccgacguuaaaugucugaau

SEQ ID NO: 1702216 - RNA, 16 nt, Salmonella enterica enterica serovar Typhi
uaccgacacaucaucg

SEQ ID NO: 1702217 - RNA, 17 nt, Salmonella enterica enterica serovar Typhi
uaccgauagcgcggaau

SEQ ID NO: 1702218 - RNA, 23 nt, Salmonella enterica enterica serovar Typhi
uaccgcugggaugaccugaaauc

SEQ ID NO: 1702219 - RNA, 15 nt, Salmonella enterica enterica serovar Typhi
uaccgauagcgcgga

SEQ ID NO: 1702220 - RNA, 19 nt, Salmonella enterica enterica serovar Typhi
uaccgauaauuaagccggu

SEQ ID NO: 1702221 - RNA, 21 nt, Salmonella enterica enterica serovar Typhi
uaccgaggacgggacuugaac

SEQ ID NO: 1702222 - RNA, 16 nt, Salmonella enterica enterica serovar Typhi
uaccugaagccauccu

SEQ ID NO: 1702223 - RNA, 19 nt, Salmonella enterica enterica serovar Typhi
uaccugauccagcucuucu

SEQ ID NO: 1702224 - RNA, 18 nt, Salmonella enterica enterica serovar Typhi
uaccugaugagcaggcca

SEQ ID NO: 1702225 - RNA, 18 nt, Salmonella enterica enterica serovar Typhi
uaccugaugucauucuuu

SEQ ID NO: 1702226 - RNA, 22 nt, Salmonella enterica enterica serovar Typhi
uaccugcacuuuaagcggcagc

SEQ ID NO: 1702227 - RNA, 18 nt, Salmonella enterica enterica serovar Typhi
uaccugcgcaaucaugac

SEQ ID NO: 1702228 - RNA, 19 nt, Salmonella enterica enterica serovar Typhi
uaccuccuggcguuaucau

SEQ ID NO: 1702229 - RNA, 22 nt, Salmonella enterica enterica serovar Typhi
uaccucagguaucauaugugcc

SEQ ID NO: 1702230 - RNA, 22 nt, Salmonella enterica enterica serovar Typhi
uaccuauuuuaaauucccagcg

SEQ ID NO: 1702231 - RNA, 21 nt, Salmonella enterica enterica serovar Typhi
uaccguugaugauuacugcug

SEQ ID NO: 1702232 - RNA, 18 nt, Salmonella enterica enterica serovar Typhi
uaccacacaugcaaaaaa

SEQ ID NO: 1702233 - RNA, 17 nt, Salmonella enterica enterica serovar Typhi
uaccacccagccagacg

SEQ ID NO: 1702234 - RNA, 19 nt, Salmonella enterica enterica serovar Typhi
uaccacccgcuaugaagac

SEQ ID NO: 1702235 - RNA, 17 nt, Salmonella enterica enterica serovar Typhi
uaccagugcuaaaauua

SEQ ID NO: 1702236 - RNA, 21 nt, Salmonella enterica enterica serovar Typhi
uaccagugcuaaaauuauaca

SEQ ID NO: 1702237 - RNA, 20 nt, Salmonella enterica enterica serovar Typhi
uaccagucgacaguauagaa

SEQ ID NO: 1702238 - RNA, 17 nt, Salmonella enterica enterica serovar Typhi
uaccaguaccgaaacca

SEQ ID NO: 1702239 - RNA, 21 nt, Salmonella enterica enterica serovar Typhi
uaccauaucgccgcugccgcu

SEQ ID NO: 1702240 - RNA, 16 nt, Salmonella enterica enterica serovar Typhi
uaccauccauuaaaau

SEQ ID NO: 1702241 - RNA, 18 nt, Salmonella enterica enterica serovar Typhi
uacccgccgcuggcuguu

SEQ ID NO: 1702242 - RNA, 21 nt, Salmonella enterica enterica serovar Typhi
uacccgcacgcuuucuucguu

SEQ ID NO: 1702243 - RNA, 20 nt, Salmonella enterica enterica serovar Typhi
uacccauuucuucuucaagc

SEQ ID NO: 1702244 - RNA, 21 nt, Salmonella enterica enterica serovar Typhi
uacccgguguaaaaaaugggu

SEQ ID NO: 1702245 - RNA, 18 nt, Salmonella enterica enterica serovar Typhi
uacccauaguagcuaaug

SEQ ID NO: 1702246 - RNA, 22 nt, Salmonella enterica enterica serovar Typhi
uacccagcgccaacgccacugc

SEQ ID NO: 1702247 - RNA, 16 nt, Salmonella enterica enterica serovar Typhi
uacgccaucaggcaug

SEQ ID NO: 1702248 - RNA, 22 nt, Salmonella enterica enterica serovar Typhi
uacgcccagccgugaaugguca

SEQ ID NO: 1702249 - RNA, 18 nt, Salmonella enterica enterica serovar Typhi
uacgccaucuuucuuuuc

SEQ ID NO: 1702250 - RNA, 13 nt, Salmonella enterica enterica serovar Typhi
uacgcaaggaaau

SEQ ID NO: 1702251 - RNA, 17 nt, Salmonella enterica enterica serovar Typhi
uacgcaaggaaauauua

SEQ ID NO: 1702252 - RNA, 14 nt, Salmonella enterica enterica serovar Typhi
uacgccucuuucag

SEQ ID NO: 1702253 - RNA, 13 nt, Salmonella enterica enterica serovar Typhi
uacgccugccugg

SEQ ID NO: 1702254 - RNA, 16 nt, Salmonella enterica enterica serovar Typhi
uacgccuuauccggcc

SEQ ID NO: 1702255 - RNA, 21 nt, Salmonella enterica enterica serovar Typhi
uacgcgaugagauaauaaaug

SEQ ID NO: 1702256 - RNA, 20 nt, Salmonella enterica enterica serovar Typhi
uacgcccaucagcccgcaaa

SEQ ID NO: 1702257 - RNA, 20 nt, Salmonella enterica enterica serovar Typhi
uacgccgccgcccagauguu

SEQ ID NO: 1702258 - RNA, 15 nt, Salmonella enterica enterica serovar Typhi
uacgccgccgcccag

SEQ ID NO: 1702259 - RNA, 17 nt, Salmonella enterica enterica serovar Typhi
uacgacgcgccaccauc

SEQ ID NO: 1702260 - RNA, 16 nt, Salmonella enterica enterica serovar Typhi
uacgaccgcagaaaca

SEQ ID NO: 1702261 - RNA, 16 nt, Salmonella enterica enterica serovar Typhi
uacgacugcacccauc

SEQ ID NO: 1702262 - RNA, 23 nt, Salmonella enterica enterica serovar Typhi
uacgaggugggcucagcgaccug

SEQ ID NO: 1702263 - RNA, 17 nt, Salmonella enterica enterica serovar Typhi
uacgcaaaaaaagccau

SEQ ID NO: 1702264 - RNA, 15 nt, Salmonella enterica enterica serovar Typhi
uaccuuaaugaugug

SEQ ID NO: 1702265 - RNA, 14 nt, Salmonella enterica enterica serovar Typhi
uaccuguuuaucug

SEQ ID NO: 1702266 - RNA, 22 nt, Salmonella enterica enterica serovar Typhi
uaccuguauuuucguuugcauu

SEQ ID NO: 1702267 - RNA, 20 nt, Salmonella enterica enterica serovar Typhi
uacgcugaagauuuuuauuc

SEQ ID NO: 1702268 - RNA, 14 nt, Salmonella enterica enterica serovar Typhi
uacguaauaaaauu

SEQ ID NO: 1702269 - RNA, 12 nt, Salmonella enterica enterica serovar Typhi
uacguaaauaua

SEQ ID NO: 1702270 - RNA, 21 nt, Salmonella enterica enterica serovar Typhi
uacguaacugcgguaaauaau

SEQ ID NO: 1702271 - RNA, 14 nt, Salmonella enterica enterica serovar Typhi
uacgguacugccca

SEQ ID NO: 1702272 - RNA, 21 nt, Salmonella enterica enterica serovar Typhi
uacgguccguuuucgccccca

SEQ ID NO: 1702273 - RNA, 20 nt, Salmonella enterica enterica serovar Typhi
uacuacugguggaauaaaua

SEQ ID NO: 1702274 - RNA, 21 nt, Salmonella enterica enterica serovar Typhi
uacuacugguggaauaaauau

SEQ ID NO: 1702275 - RNA, 17 nt, Salmonella enterica enterica serovar Typhi
uacuaauaaaauucacu

SEQ ID NO: 1702276 - RNA, 13 nt, Salmonella enterica enterica serovar Typhi
uacuaauaaauau

SEQ ID NO: 1702277 - RNA, 14 nt, Salmonella enterica enterica serovar Typhi
uacuaauaaauauu

SEQ ID NO: 1702278 - RNA, 16 nt, Salmonella enterica enterica serovar Typhi
uacuaaugaauuuaau

SEQ ID NO: 1702279 - RNA, 13 nt, Salmonella enterica enterica serovar Typhi
uacguuccagcag

SEQ ID NO: 1702280 - RNA, 13 nt, Salmonella enterica enterica serovar Typhi
uacguucaaauug

SEQ ID NO: 1702281 - RNA, 19 nt, Salmonella enterica enterica serovar Typhi
uaauacguaaaccgcucac

SEQ ID NO: 1702282 - RNA, 15 nt, Salmonella enterica enterica serovar Typhi
uaauacauugccgca

SEQ ID NO: 1702283 - RNA, 19 nt, Salmonella enterica enterica serovar Typhi
uaauaccaucuccaucggg

SEQ ID NO: 1702284 - RNA, 23 nt, Salmonella enterica enterica serovar Typhi
uaauacgucgugacccacacaua

SEQ ID NO: 1702285 - RNA, 15 nt, Salmonella enterica enterica serovar Typhi
uaauacuggcgccuu

SEQ ID NO: 1702286 - RNA, 22 nt, Salmonella enterica enterica serovar Typhi
uaauacuggcgccuuuuggcag

SEQ ID NO: 1702287 - RNA, 13 nt, Salmonella enterica enterica serovar Typhi
uaauacugccgca

SEQ ID NO: 1702288 - RNA, 20 nt, Salmonella enterica enterica serovar Typhi
uaauacacgguaaauucuuu

SEQ ID NO: 1702289 - RNA, 20 nt, Salmonella enterica enterica serovar Typhi
uaauacaccgccauauauuu

SEQ ID NO: 1702290 - RNA, 17 nt, Salmonella enterica enterica serovar Typhi
uaauacaucaugcuugc

SEQ ID NO: 1702291 - RNA, 13 nt, Salmonella enterica enterica serovar Typhi
uaauacaggguuu

SEQ ID NO: 1702292 - RNA, 15 nt, Salmonella enterica enterica serovar Typhi
uaauacauaucauuu

SEQ ID NO: 1702293 - RNA, 19 nt, Salmonella enterica enterica serovar Typhi
uaauacaucacuuuaugac

SEQ ID NO: 1702294 - RNA, 17 nt, Salmonella enterica enterica serovar Typhi
uaauacaucagaaaaca

SEQ ID NO: 1702295 - RNA, 21 nt, Salmonella enterica enterica serovar Typhi
uaauaauugcgguggcgcaaa

SEQ ID NO: 1702296 - RNA, 13 nt, Salmonella enterica enterica serovar Typhi
uaauaauauaaag

SEQ ID NO: 1702297 - RNA, 13 nt, Salmonella enterica enterica serovar Typhi
uaauaaucauaua

SEQ ID NO: 1702298 - RNA, 22 nt, Salmonella enterica enterica serovar Typhi
uaauaauacaccgccauauauu

SEQ ID NO: 1702299 - RNA, 20 nt, Salmonella enterica enterica serovar Typhi
uaauaaccccagcugcggca

SEQ ID NO: 1702300 - RNA, 9 nt, Salmonella enterica enterica serovar Typhi
uaauaacgg

SEQ ID NO: 1702301 - RNA, 11 nt, Salmonella enterica enterica serovar Typhi
uaauaaagaaa

SEQ ID NO: 1702302 - RNA, 17 nt, Salmonella enterica enterica serovar Typhi
uaaguuggacaaggcac

SEQ ID NO: 1702303 - RNA, 16 nt, Salmonella enterica enterica serovar Typhi
uaaguuuuucucuuau

SEQ ID NO: 1702304 - RNA, 16 nt, Salmonella enterica enterica serovar Typhi
uaaguucaaacucauu

SEQ ID NO: 1702305 - RNA, 14 nt, Salmonella enterica enterica serovar Typhi
uaagugcaggcuga

SEQ ID NO: 1702306 - RNA, 20 nt, Salmonella enterica enterica serovar Typhi
uaaguaucagcgcgcuuuuu

SEQ ID NO: 1702307 - RNA, 18 nt, Salmonella enterica enterica serovar Typhi
uaagucaaccaugaucac

SEQ ID NO: 1702308 - RNA, 14 nt, Salmonella enterica enterica serovar Typhi
uaagucauccagac

SEQ ID NO: 1702309 - RNA, 20 nt, Salmonella enterica enterica serovar Typhi
uaagucaucuguucaacuuu

SEQ ID NO: 1702310 - RNA, 19 nt, Salmonella enterica enterica serovar Typhi
uaagguuacaggugccugg

SEQ ID NO: 1702311 - RNA, 18 nt, Salmonella enterica enterica serovar Typhi
uaagguucgcuuaaucuc

SEQ ID NO: 1702312 - RNA, 15 nt, Salmonella enterica enterica serovar Typhi
uaagguucuggcauu

SEQ ID NO: 1702313 - RNA, 19 nt, Salmonella enterica enterica serovar Typhi
uaaggucgcuauccagcag

SEQ ID NO: 1702314 - RNA, 20 nt, Salmonella enterica enterica serovar Typhi
uaagguaacgcgaaaaaaga

SEQ ID NO: 1702315 - RNA, 16 nt, Salmonella enterica enterica serovar Typhi
uaaguaaggaggaauc

SEQ ID NO: 1702316 - RNA, 16 nt, Salmonella enterica enterica serovar Typhi
uaagggcuggaaaauc

SEQ ID NO: 1702317 - RNA, 22 nt, Salmonella enterica enterica serovar Typhi
uaaggggcaggcgucaaaacag

SEQ ID NO: 1702318 - RNA, 21 nt, Salmonella enterica enterica serovar Typhi
uaaggcgauaccuaaucccug

SEQ ID NO: 1702319 - RNA, 13 nt, Salmonella enterica enterica serovar Typhi
uaaggcgccuuuu

SEQ ID NO: 1702320 - RNA, 13 nt, Salmonella enterica enterica serovar Typhi
uaaggcaggcaaa

SEQ ID NO: 1702321 - RNA, 18 nt, Salmonella enterica enterica serovar Typhi
uaaggcaugaugccacga

SEQ ID NO: 1702322 - RNA, 23 nt, Salmonella enterica enterica serovar Typhi
uaaggcaucguugagaaaaccau

SEQ ID NO: 1702323 - RNA, 12 nt, Salmonella enterica enterica serovar Typhi
uaaggcagccau

SEQ ID NO: 1702324 - RNA, 14 nt, Salmonella enterica enterica serovar Typhi
uaaggaucggaaga

SEQ ID NO: 1702325 - RNA, 22 nt, Salmonella enterica enterica serovar Typhi
uaaggaugaacucuaugcaaaa

SEQ ID NO: 1702326 - RNA, 18 nt, Salmonella enterica enterica serovar Typhi
uaaucaggagggcugccc

SEQ ID NO: 1702327 - RNA, 13 nt, Salmonella enterica enterica serovar Typhi
uaaucagcacauu

SEQ ID NO: 1702328 - RNA, 16 nt, Salmonella enterica enterica serovar Typhi
uaaucaggacaucaaa

SEQ ID NO: 1702329 - RNA, 17 nt, Salmonella enterica enterica serovar Typhi
uaaucaggcauccugcc

SEQ ID NO: 1702330 - RNA, 19 nt, Salmonella enterica enterica serovar Typhi
uaaucaggcgagagaagaa

SEQ ID NO: 1702331 - RNA, 22 nt, Salmonella enterica enterica serovar Typhi
uaaucaggcgagagaagaauuc

SEQ ID NO: 1702332 - RNA, 21 nt, Salmonella enterica enterica serovar Typhi
uaauccagaggguaauuucuu

SEQ ID NO: 1702333 - RNA, 20 nt, Salmonella enterica enterica serovar Typhi
uaaucaucaccguuuuccag

SEQ ID NO: 1702334 - RNA, 20 nt, Salmonella enterica enterica serovar Typhi
uaaucauauaagaaauaguu

SEQ ID NO: 1702335 - RNA, 19 nt, Salmonella enterica enterica serovar Typhi
uaaucaauguauuuaaguc

SEQ ID NO: 1702336 - RNA, 20 nt, Salmonella enterica enterica serovar Typhi
uaaucaauaaguuuuuucuu

SEQ ID NO: 1702337 - RNA, 14 nt, Salmonella enterica enterica serovar Typhi
uaauauuaagcagc

SEQ ID NO: 1702338 - RNA, 16 nt, Salmonella enterica enterica serovar Typhi
uaauauuaagcagcuu

SEQ ID NO: 1702339 - RNA, 14 nt, Salmonella enterica enterica serovar Typhi
uaauagauugcgcc

SEQ ID NO: 1702340 - RNA, 17 nt, Salmonella enterica enterica serovar Typhi
uaauaugcgcaaucacc

SEQ ID NO: 1702341 - RNA, 13 nt, Salmonella enterica enterica serovar Typhi
uaauaugccaggc

SEQ ID NO: 1702342 - RNA, 19 nt, Salmonella enterica enterica serovar Typhi
uaauaugcgcaaucaccuc

SEQ ID NO: 1702343 - RNA, 18 nt, Salmonella enterica enterica serovar Typhi
uaauccaggaauuuuccc

SEQ ID NO: 1702344 - RNA, 18 nt, Salmonella enterica enterica serovar Typhi
uaaucgauauaauuuuau

SEQ ID NO: 1702345 - RNA, 15 nt, Salmonella enterica enterica serovar Typhi
uaaucgauacuaaaa

SEQ ID NO: 1702346 - RNA, 21 nt, Salmonella enterica enterica serovar Typhi
uaaucgcgauacugccgccca

SEQ ID NO: 1702347 - RNA, 15 nt, Salmonella enterica enterica serovar Typhi
uaaucgccugccagc

SEQ ID NO: 1702348 - RNA, 17 nt, Salmonella enterica enterica serovar Typhi
uaaucggcgucauuuuc

SEQ ID NO: 1702349 - RNA, 13 nt, Salmonella enterica enterica serovar Typhi
uaaucuacaaacg

SEQ ID NO: 1702350 - RNA, 18 nt, Salmonella enterica enterica serovar Typhi
uaaucuaaaauuauuuuu

SEQ ID NO: 1702351 - RNA, 23 nt, Salmonella enterica enterica serovar Typhi
uaaucguuagcgagguucccgcc

SEQ ID NO: 1702352 - RNA, 18 nt, Salmonella enterica enterica serovar Typhi
uaaucugaauaccuugau

SEQ ID NO: 1702353 - RNA, 15 nt, Salmonella enterica enterica serovar Typhi
uaaucugccagcuua

SEQ ID NO: 1702354 - RNA, 14 nt, Salmonella enterica enterica serovar Typhi
uaaucuuauccagc

SEQ ID NO: 1702355 - RNA, 23 nt, Salmonella enterica enterica serovar Typhi
uaaucuuauccagcguuaaaaua

SEQ ID NO: 1702356 - RNA, 21 nt, Salmonella enterica enterica serovar Typhi
uaaucugugauugaauucacc

SEQ ID NO: 1702357 - RNA, 16 nt, Salmonella enterica enterica serovar Typhi
uaauguaaaacaagag

SEQ ID NO: 1702358 - RNA, 18 nt, Salmonella enterica enterica serovar Typhi
uaauguaaaacaagagaa

SEQ ID NO: 1702359 - RNA, 18 nt, Salmonella enterica enterica serovar Typhi
uaauguaaaaaaauaaaa

SEQ ID NO: 1702360 - RNA, 13 nt, Salmonella enterica enterica serovar Typhi
uaaugucaucauc

SEQ ID NO: 1702361 - RNA, 14 nt, Salmonella enterica enterica serovar Typhi
uaaucuuuucauau

SEQ ID NO: 1702362 - RNA, 17 nt, Salmonella enterica enterica serovar Typhi
uaaugcuuuaaaugccu

SEQ ID NO: 1702363 - RNA, 20 nt, Salmonella enterica enterica serovar Typhi
uaauguugguaaauuuaugg

SEQ ID NO: 1702364 - RNA, 17 nt, Salmonella enterica enterica serovar Typhi
uaaugugccgguaagaa

SEQ ID NO: 1702365 - RNA, 16 nt, Salmonella enterica enterica serovar Typhi
uaaugucuggugcagc

SEQ ID NO: 1702366 - RNA, 19 nt, Salmonella enterica enterica serovar Typhi
uaauuaacgccgcgaggau

SEQ ID NO: 1702367 - RNA, 12 nt, Salmonella enterica enterica serovar Typhi
uaauuaaaugcu

SEQ ID NO: 1702368 - RNA, 13 nt, Salmonella enterica enterica serovar Typhi
uaauuggcuuacc

SEQ ID NO: 1702369 - RNA, 16 nt, Salmonella enterica enterica serovar Typhi
uaauugcugaagauaa

SEQ ID NO: 1702370 - RNA, 20 nt, Salmonella enterica enterica serovar Typhi
uaauugcugacgcgcuuuuu

SEQ ID NO: 1702371 - RNA, 17 nt, Salmonella enterica enterica serovar Typhi
uaauuccucagaauccg

SEQ ID NO: 1702372 - RNA, 16 nt, Salmonella enterica enterica serovar Typhi
uaauuccgaauauuua

SEQ ID NO: 1702373 - RNA, 17 nt, Salmonella enterica enterica serovar Typhi
uaauuccgcaucauuca

SEQ ID NO: 1702374 - RNA, 15 nt, Salmonella enterica enterica serovar Typhi
uaauuccgcaucauu

SEQ ID NO: 1702375 - RNA, 13 nt, Salmonella enterica enterica serovar Typhi
uaauuagagacau

SEQ ID NO: 1702376 - RNA, 14 nt, Salmonella enterica enterica serovar Typhi
uaauuauaaauauu

SEQ ID NO: 1702377 - RNA, 14 nt, Salmonella enterica enterica serovar Typhi
uaauucaugcugua

SEQ ID NO: 1702378 - RNA, 13 nt, Salmonella enterica enterica serovar Typhi
ggcuauuuuauuc

SEQ ID NO: 1702379 - RNA, 21 nt, Salmonella enterica enterica serovar Typhi
ggcuauuuuuugcuggcggca

SEQ ID NO: 1702380 - RNA, 16 nt, Salmonella enterica enterica serovar Typhi
ggcucaaacggccugc

SEQ ID NO: 1702381 - RNA, 22 nt, Salmonella enterica enterica serovar Typhi
ggcucaaacggccugcgcugga

SEQ ID NO: 1702382 - RNA, 21 nt, Salmonella enterica enterica serovar Typhi
ggcucaggaaaacaaauugca

SEQ ID NO: 1702383 - RNA, 13 nt, Salmonella enterica enterica serovar Typhi
ggcuccaaguauu

SEQ ID NO: 1702384 - RNA, 17 nt, Salmonella enterica enterica serovar Typhi
ggcucgcagaugcccgc

SEQ ID NO: 1702385 - RNA, 20 nt, Salmonella enterica enterica serovar Typhi
ggcuccagcgccagcuccau

SEQ ID NO: 1702386 - RNA, 18 nt, Salmonella enterica enterica serovar Typhi
ggcuccgaccaucgccgc

SEQ ID NO: 1702387 - RNA, 18 nt, Salmonella enterica enterica serovar Typhi
ggcuccagcgccagcucc

SEQ ID NO: 1702388 - RNA, 13 nt, Salmonella enterica enterica serovar Typhi
ggcucuaaaaagg

SEQ ID NO: 1702389 - RNA, 16 nt, Salmonella enterica enterica serovar Typhi
ggcucuaaaaaggaaa

SEQ ID NO: 1702390 - RNA, 15 nt, Salmonella enterica enterica serovar Typhi
ggcugaaagcgccuu

SEQ ID NO: 1702391 - RNA, 16 nt, Salmonella enterica enterica serovar Typhi
ggcugaacgccaggcc

SEQ ID NO: 1702392 - RNA, 22 nt, Salmonella enterica enterica serovar Typhi
ggcugacguuacgcggcgcgcc

SEQ ID NO: 1702393 - RNA, 15 nt, Salmonella enterica enterica serovar Typhi
ggcugagaaaaauac

SEQ ID NO: 1702394 - RNA, 13 nt, Salmonella enterica enterica serovar Typhi
ggcugagaaaaau

SEQ ID NO: 1702395 - RNA, 14 nt, Salmonella enterica enterica serovar Typhi
ggcugagaaaaaua

SEQ ID NO: 1702396 - RNA, 20 nt, Salmonella enterica enterica serovar Typhi
ggcugagcguagaccgccca

SEQ ID NO: 1702397 - RNA, 23 nt, Salmonella enterica enterica serovar Typhi
ggcugauaggccuggauagacga

SEQ ID NO: 1702398 - RNA, 18 nt, Salmonella enterica enterica serovar Typhi
ggcugcguaaaaucagca

SEQ ID NO: 1702399 - RNA, 22 nt, Salmonella enterica enterica serovar Typhi
ggcugcguaaaaucagcauccu

SEQ ID NO: 1702400 - RNA, 11 nt, Salmonella enterica enterica serovar Typhi
ggcugcucggg

SEQ ID NO: 1702401 - RNA, 18 nt, Salmonella enterica enterica serovar Typhi
ggcugcgcgggagauggc

SEQ ID NO: 1702402 - RNA, 13 nt, Salmonella enterica enterica serovar Typhi
ggcugcccugcgg

SEQ ID NO: 1702403 - RNA, 12 nt, Salmonella enterica enterica serovar Typhi
ggcuggccacug

SEQ ID NO: 1702404 - RNA, 14 nt, Salmonella enterica enterica serovar Typhi
ggcuggccagggca

SEQ ID NO: 1702405 - RNA, 15 nt, Salmonella enterica enterica serovar Typhi
ggcugggcgaggcca

SEQ ID NO: 1702406 - RNA, 13 nt, Salmonella enterica enterica serovar Typhi
ggcuggggaaguu

SEQ ID NO: 1702407 - RNA, 23 nt, Salmonella enterica enterica serovar Typhi
ggcuguauguaggguacagcgcg

SEQ ID NO: 1702408 - RNA, 12 nt, Salmonella enterica enterica serovar Typhi
ggcuguggcugu

SEQ ID NO: 1702409 - RNA, 21 nt, Salmonella enterica enterica serovar Typhi
ggcuggucagcguacccgcgg

SEQ ID NO: 1702410 - RNA, 15 nt, Salmonella enterica enterica serovar Typhi
ggcuguguucauccc

SEQ ID NO: 1702411 - RNA, 13 nt, Salmonella enterica enterica serovar Typhi
ggcuuaccugcuc

SEQ ID NO: 1702412 - RNA, 19 nt, Salmonella enterica enterica serovar Typhi
ggcuuccggcacuuucaga

SEQ ID NO: 1702413 - RNA, 16 nt, Salmonella enterica enterica serovar Typhi
ggcuucgauuacagga

SEQ ID NO: 1702414 - RNA, 13 nt, Salmonella enterica enterica serovar Typhi
gggaaaaccccac

SEQ ID NO: 1702415 - RNA, 12 nt, Salmonella enterica enterica serovar Typhi
gggaaaagaagu

SEQ ID NO: 1702416 - RNA, 20 nt, Salmonella enterica enterica serovar Typhi
gggaaaaauguguugcggcc

SEQ ID NO: 1702417 - RNA, 16 nt, Salmonella enterica enterica serovar Typhi
gggcguauagccaggc

SEQ ID NO: 1702418 - RNA, 21 nt, Salmonella enterica enterica serovar Typhi
gggcgucaaaaucccggcugg

SEQ ID NO: 1702419 - RNA, 17 nt, Salmonella enterica enterica serovar Typhi
gggcguauagccaggca

SEQ ID NO: 1702420 - RNA, 15 nt, Salmonella enterica enterica serovar Typhi
gggcguccacuuucu

SEQ ID NO: 1702421 - RNA, 15 nt, Salmonella enterica enterica serovar Typhi
gggcgugacgcgcca

SEQ ID NO: 1702422 - RNA, 17 nt, Salmonella enterica enterica serovar Typhi
ggggaauguuuggcgcc

SEQ ID NO: 1702423 - RNA, 23 nt, Salmonella enterica enterica serovar Typhi
ggggaacacuaaaacaccgguug

SEQ ID NO: 1702424 - RNA, 23 nt, Salmonella enterica enterica serovar Typhi
gggcuuucccguuucagccccuu

SEQ ID NO: 1702425 - RNA, 23 nt, Salmonella enterica enterica serovar Typhi
gggcgaaaacggcgcaggcaaau

SEQ ID NO: 1702426 - RNA, 18 nt, Salmonella enterica enterica serovar Typhi
gggccggaagagcgcaga

SEQ ID NO: 1702427 - RNA, 22 nt, Salmonella enterica enterica serovar Typhi
gggcgcaaaaucgcaaacgcca

SEQ ID NO: 1702428 - RNA, 23 nt, Salmonella enterica enterica serovar Typhi
gggcgauaaaccagccccacggu

SEQ ID NO: 1702429 - RNA, 13 nt, Salmonella enterica enterica serovar Typhi
gggcgauaaacca

SEQ ID NO: 1702430 - RNA, 15 nt, Salmonella enterica enterica serovar Typhi
gggcgauaaaccagc

SEQ ID NO: 1702431 - RNA, 12 nt, Salmonella enterica enterica serovar Typhi
gggcgcggcugg

SEQ ID NO: 1702432 - RNA, 12 nt, Salmonella enterica enterica serovar Typhi
gggcgcgcgccg

SEQ ID NO: 1702433 - RNA, 15 nt, Salmonella enterica enterica serovar Typhi
gggaaagccccuacc

SEQ ID NO: 1702434 - RNA, 18 nt, Salmonella enterica enterica serovar Typhi
gggaaacggauucucuaa

SEQ ID NO: 1702435 - RNA, 19 nt, Salmonella enterica enterica serovar Typhi
gggaaaucucccuggcagu

SEQ ID NO: 1702436 - RNA, 12 nt, Salmonella enterica enterica serovar Typhi
gggaacacuaaa

SEQ ID NO: 1702437 - RNA, 16 nt, Salmonella enterica enterica serovar Typhi
gggaacaugcauauua

SEQ ID NO: 1702438 - RNA, 16 nt, Salmonella enterica enterica serovar Typhi
gggaggcggcgagcgg

SEQ ID NO: 1702439 - RNA, 19 nt, Salmonella enterica enterica serovar Typhi
gggauaucuuccgggcggg

SEQ ID NO: 1702440 - RNA, 13 nt, Salmonella enterica enterica serovar Typhi
gggauauaaaauu

SEQ ID NO: 1702441 - RNA, 18 nt, Salmonella enterica enterica serovar Typhi
gggauaaugacauccaga

SEQ ID NO: 1702442 - RNA, 16 nt, Salmonella enterica enterica serovar Typhi
gggaugguuaaauuca

SEQ ID NO: 1702443 - RNA, 14 nt, Salmonella enterica enterica serovar Typhi
gggccagcagccag

SEQ ID NO: 1702444 - RNA, 23 nt, Salmonella enterica enterica serovar Typhi
gggccagaaguagcagagaaaag

SEQ ID NO: 1702445 - RNA, 22 nt, Salmonella enterica enterica serovar Typhi
gggcaguaaauuaaacagcugu

SEQ ID NO: 1702446 - RNA, 15 nt, Salmonella enterica enterica serovar Typhi
gggcauggcucuccg

SEQ ID NO: 1702447 - RNA, 20 nt, Salmonella enterica enterica serovar Typhi
ggguagccguuuaaaagcgg

SEQ ID NO: 1702448 - RNA, 13 nt, Salmonella enterica enterica serovar Typhi
ggguaggccggau

SEQ ID NO: 1702449 - RNA, 15 nt, Salmonella enterica enterica serovar Typhi
ggguagaaaaaggua

SEQ ID NO: 1702450 - RNA, 18 nt, Salmonella enterica enterica serovar Typhi
ggguagaucacgccagcg

SEQ ID NO: 1702451 - RNA, 20 nt, Salmonella enterica enterica serovar Typhi
ggguauugcuucguggcaau

SEQ ID NO: 1702452 - RNA, 16 nt, Salmonella enterica enterica serovar Typhi
ggguauugaauccaua

SEQ ID NO: 1702453 - RNA, 23 nt, Salmonella enterica enterica serovar Typhi
ggguaucccgacgcacgagaucc

SEQ ID NO: 1702454 - RNA, 13 nt, Salmonella enterica enterica serovar Typhi
ggguaugcagugg

SEQ ID NO: 1702455 - RNA, 19 nt, Salmonella enterica enterica serovar Typhi
gggucguacuaaagagcgc

SEQ ID NO: 1702456 - RNA, 11 nt, Salmonella enterica enterica serovar Typhi
gggucuuccag

SEQ ID NO: 1702457 - RNA, 24 nt, Salmonella enterica enterica serovar Typhi
ggguuccaggcggagaccacggua

SEQ ID NO: 1702458 - RNA, 13 nt, Salmonella enterica enterica serovar Typhi
ggguucacugcca

SEQ ID NO: 1702459 - RNA, 19 nt, Salmonella enterica enterica serovar Typhi
ggguuaugauuucaggcau

SEQ ID NO: 1702460 - RNA, 13 nt, Salmonella enterica enterica serovar Typhi
ggguuaaaccagc

SEQ ID NO: 1702461 - RNA, 22 nt, Salmonella enterica enterica serovar Typhi
ggguugcacauuguugcaggga

SEQ ID NO: 1702462 - RNA, 15 nt, Salmonella enterica enterica serovar Typhi
ggguugccggaaagg

SEQ ID NO: 1702463 - RNA, 22 nt, Salmonella enterica enterica serovar Typhi
gguaaaauccaccacguuaccg

SEQ ID NO: 1702464 - RNA, 14 nt, Salmonella enterica enterica serovar Typhi
gguaaauccacaac

SEQ ID NO: 1702465 - RNA, 21 nt, Salmonella enterica enterica serovar Typhi
gguaaacgcuccggcaggcaa

SEQ ID NO: 1702466 - RNA, 12 nt, Salmonella enterica enterica serovar Typhi
gguaaacgugcu

SEQ ID NO: 1702467 - RNA, 17 nt, Salmonella enterica enterica serovar Typhi
gguaaacucacccaggc

SEQ ID NO: 1702468 - RNA, 14 nt, Salmonella enterica enterica serovar Typhi
gguaagaauaauaa

SEQ ID NO: 1702469 - RNA, 20 nt, Salmonella enterica enterica serovar Typhi
gguaagagcguuacccagac

SEQ ID NO: 1702470 - RNA, 13 nt, Salmonella enterica enterica serovar Typhi
gguaagauguucu

SEQ ID NO: 1702471 - RNA, 14 nt, Salmonella enterica enterica serovar Typhi
gguaagcaauaugg

SEQ ID NO: 1702472 - RNA, 22 nt, Salmonella enterica enterica serovar Typhi
gguaagcccauggcaggcagca

SEQ ID NO: 1702473 - RNA, 13 nt, Salmonella enterica enterica serovar Typhi
gguaacaccgcgg

SEQ ID NO: 1702474 - RNA, 19 nt, Salmonella enterica enterica serovar Typhi
gguaaccuuaauuugugau

SEQ ID NO: 1702475 - RNA, 14 nt, Salmonella enterica enterica serovar Typhi
gguaacgcgaaaaa

SEQ ID NO: 1702476 - RNA, 16 nt, Salmonella enterica enterica serovar Typhi
gguagagcaucgcggc

SEQ ID NO: 1702477 - RNA, 22 nt, Salmonella enterica enterica serovar Typhi
gguagacgcgcuagcuucaggu

SEQ ID NO: 1702478 - RNA, 15 nt, Salmonella enterica enterica serovar Typhi
gguacucaacaucau

SEQ ID NO: 1702479 - RNA, 21 nt, Salmonella enterica enterica serovar Typhi
gguacucgucccgauauaaag

SEQ ID NO: 1702480 - RNA, 13 nt, Salmonella enterica enterica serovar Typhi
gguacgcuccagg

SEQ ID NO: 1702481 - RNA, 21 nt, Salmonella enterica enterica serovar Typhi
gguacccggucccuggcuggu

SEQ ID NO: 1702482 - RNA, 22 nt, Salmonella enterica enterica serovar Typhi
gguaauuucaaagggcccgugg

SEQ ID NO: 1702483 - RNA, 16 nt, Salmonella enterica enterica serovar Typhi
gguaaugucauccagc

SEQ ID NO: 1702484 - RNA, 17 nt, Salmonella enterica enterica serovar Typhi
gguaauuagaucggcaa

SEQ ID NO: 1702485 - RNA, 19 nt, Salmonella enterica enterica serovar Typhi
gguacaccaggaguuaaac

SEQ ID NO: 1702486 - RNA, 14 nt, Salmonella enterica enterica serovar Typhi
gguaauauggucgu

SEQ ID NO: 1702487 - RNA, 22 nt, Salmonella enterica enterica serovar Typhi
gguaauacuaaucucacccaua

SEQ ID NO: 1702488 - RNA, 19 nt, Salmonella enterica enterica serovar Typhi
gguaauaacugacagacuc

SEQ ID NO: 1702489 - RNA, 13 nt, Salmonella enterica enterica serovar Typhi
gguaaguugaaag

SEQ ID NO: 1702490 - RNA, 14 nt, Salmonella enterica enterica serovar Typhi
gguaaguuuuucuc

SEQ ID NO: 1702491 - RNA, 17 nt, Salmonella enterica enterica serovar Typhi
gguaauuaaaggcagcg

SEQ ID NO: 1702492 - RNA, 16 nt, Salmonella enterica enterica serovar Typhi
gguaauggcgacugug

SEQ ID NO: 1702493 - RNA, 15 nt, Salmonella enterica enterica serovar Typhi
gguaaugacuuuuaa

SEQ ID NO: 1702494 - RNA, 16 nt, Salmonella enterica enterica serovar Typhi
gguaaugacuuuuaaa

SEQ ID NO: 1702495 - RNA, 19 nt, Salmonella enterica enterica serovar Typhi
gguaggguuaugauuucag

SEQ ID NO: 1702496 - RNA, 15 nt, Salmonella enterica enterica serovar Typhi
gguaguccugcucau

SEQ ID NO: 1702497 - RNA, 21 nt, Salmonella enterica enterica serovar Typhi
gguagucaaauuccagcaaug

SEQ ID NO: 1702498 - RNA, 14 nt, Salmonella enterica enterica serovar Typhi
gguagucacggaga

SEQ ID NO: 1702499 - RNA, 19 nt, Salmonella enterica enterica serovar Typhi
gguagucacggagagucgc

SEQ ID NO: 1702500 - RNA, 15 nt, Salmonella enterica enterica serovar Typhi
gguaguccaaauaag

SEQ ID NO: 1702501 - RNA, 15 nt, Salmonella enterica enterica serovar Typhi
ggucaccugaaaaug

SEQ ID NO: 1702502 - RNA, 23 nt, Salmonella enterica enterica serovar Typhi
ggucagcauuucauccauuaaac

SEQ ID NO: 1702503 - RNA, 17 nt, Salmonella enterica enterica serovar Typhi
ggucagcauuucaucca

SEQ ID NO: 1702504 - RNA, 12 nt, Salmonella enterica enterica serovar Typhi
gguaugaaacau

SEQ ID NO: 1702505 - RNA, 19 nt, Salmonella enterica enterica serovar Typhi
gguaugaacgccggcggcg

SEQ ID NO: 1702506 - RNA, 19 nt, Salmonella enterica enterica serovar Typhi
gguaugccuuccagaaaua

SEQ ID NO: 1702507 - RNA, 23 nt, Salmonella enterica enterica serovar Typhi
gguauuacaugccguuaauaaug

SEQ ID NO: 1702508 - RNA, 21 nt, Salmonella enterica enterica serovar Typhi
gguauucaacgccaucuuccu

SEQ ID NO: 1702509 - RNA, 14 nt, Salmonella enterica enterica serovar Typhi
gguggugggcggca

SEQ ID NO: 1702510 - RNA, 17 nt, Salmonella enterica enterica serovar Typhi
gguggugggcggcacca

SEQ ID NO: 1702511 - RNA, 20 nt, Salmonella enterica enterica serovar Typhi
gguggucaucgcggccagca

SEQ ID NO: 1702512 - RNA, 22 nt, Salmonella enterica enterica serovar Typhi
ggugcguccgguagagaacgaa

SEQ ID NO: 1702513 - RNA, 17 nt, Salmonella enterica enterica serovar Typhi
gguggcgccacgccacc

SEQ ID NO: 1702514 - RNA, 18 nt, Salmonella enterica enterica serovar Typhi
gguggaucccccuggccc

SEQ ID NO: 1702515 - RNA, 15 nt, Salmonella enterica enterica serovar Typhi
gguggaaagugcuga

SEQ ID NO: 1702516 - RNA, 15 nt, Salmonella enterica enterica serovar Typhi
ggugcagaacaucaa

SEQ ID NO: 1702517 - RNA, 17 nt, Salmonella enterica enterica serovar Typhi
ggugcagcccgucggcg

SEQ ID NO: 1702518 - RNA, 15 nt, Salmonella enterica enterica serovar Typhi
ggugccgacgccagc

SEQ ID NO: 1702519 - RNA, 20 nt, Salmonella enterica enterica serovar Typhi
ggugcagaccucugcaaaca

SEQ ID NO: 1702520 - RNA, 17 nt, Salmonella enterica enterica serovar Typhi
ggugccgaaaucaucaa

SEQ ID NO: 1702521 - RNA, 23 nt, Salmonella enterica enterica serovar Typhi
ggugcgcagccccagcgccagcc

SEQ ID NO: 1702522 - RNA, 15 nt, Salmonella enterica enterica serovar Typhi
ggugcgcagccccag

SEQ ID NO: 1702523 - RNA, 20 nt, Salmonella enterica enterica serovar Typhi
ggugcgauucagcgcaggca

SEQ ID NO: 1702524 - RNA, 21 nt, Salmonella enterica enterica serovar Typhi
ggugcgccccagcaugagcca

SEQ ID NO: 1702525 - RNA, 12 nt, Salmonella enterica enterica serovar Typhi
ggucgccagcau

SEQ ID NO: 1702526 - RNA, 17 nt, Salmonella enterica enterica serovar Typhi
ggucgcgacggccagca

SEQ ID NO: 1702527 - RNA, 21 nt, Salmonella enterica enterica serovar Typhi
ggucagcucacgcgccagcac

SEQ ID NO: 1702528 - RNA, 13 nt, Salmonella enterica enterica serovar Typhi
ggucaggccagcc

SEQ ID NO: 1702529 - RNA, 22 nt, Salmonella enterica enterica serovar Typhi
ggucagggugaauaccagcggc

SEQ ID NO: 1702530 - RNA, 20 nt, Salmonella enterica enterica serovar Typhi
ggucaggcugcggacauuaa

SEQ ID NO: 1702531 - RNA, 21 nt, Salmonella enterica enterica serovar Typhi
ggucgacguuguccggcgacc

SEQ ID NO: 1702532 - RNA, 23 nt, Salmonella enterica enterica serovar Typhi
ggucaguacgcgcguauccgccg

SEQ ID NO: 1702533 - RNA, 15 nt, Salmonella enterica enterica serovar Typhi
ggucaguacgcgcgu

SEQ ID NO: 1702534 - RNA, 16 nt, Salmonella enterica enterica serovar Typhi
ggugaaauaggggaga

SEQ ID NO: 1702535 - RNA, 21 nt, Salmonella enterica enterica serovar Typhi
ggugaacaaaggcagccaaca

SEQ ID NO: 1702536 - RNA, 22 nt, Salmonella enterica enterica serovar Typhi
ggugaagcauccgggauauaaa

SEQ ID NO: 1702537 - RNA, 19 nt, Salmonella enterica enterica serovar Typhi
ggugaagaaaaagaagcca

SEQ ID NO: 1702538 - RNA, 14 nt, Salmonella enterica enterica serovar Typhi
ggugauagcccguu

SEQ ID NO: 1702539 - RNA, 13 nt, Salmonella enterica enterica serovar Typhi
ggugauagcgcgc

SEQ ID NO: 1702540 - RNA, 19 nt, Salmonella enterica enterica serovar Typhi
ggugacgccaugcaaaaaa

SEQ ID NO: 1702541 - RNA, 17 nt, Salmonella enterica enterica serovar Typhi
ggugacggaaaccagca

SEQ ID NO: 1702542 - RNA, 16 nt, Salmonella enterica enterica serovar Typhi
ggugacggaaaccagc

SEQ ID NO: 1702543 - RNA, 22 nt, Salmonella enterica enterica serovar Typhi
ggugaaacguucggugaagaaa

SEQ ID NO: 1702544 - RNA, 16 nt, Salmonella enterica enterica serovar Typhi
ggugaaaaaucauuau

SEQ ID NO: 1702545 - RNA, 20 nt, Salmonella enterica enterica serovar Typhi
ggugaaaaaucauuaucacu

SEQ ID NO: 1702546 - RNA, 13 nt, Salmonella enterica enterica serovar Typhi
ggucuuuuucgca

SEQ ID NO: 1702547 - RNA, 20 nt, Salmonella enterica enterica serovar Typhi
ggucuguaugacaacauaaa

SEQ ID NO: 1702548 - RNA, 22 nt, Salmonella enterica enterica serovar Typhi
ggucgucuggaguacgggcaga

SEQ ID NO: 1702549 - RNA, 16 nt, Salmonella enterica enterica serovar Typhi
guaagcgccaagcggc

SEQ ID NO: 1702550 - RNA, 15 nt, Salmonella enterica enterica serovar Typhi
guaagcgccugcugc

SEQ ID NO: 1702551 - RNA, 18 nt, Salmonella enterica enterica serovar Typhi
guaagcggcggaccagcg

SEQ ID NO: 1702552 - RNA, 23 nt, Salmonella enterica enterica serovar Typhi
guaagcggguauacuuaacccug

SEQ ID NO: 1702553 - RNA, 16 nt, Salmonella enterica enterica serovar Typhi
guaagcuauuacaaaa

SEQ ID NO: 1702554 - RNA, 16 nt, Salmonella enterica enterica serovar Typhi
guaagcuauuccugua

SEQ ID NO: 1702555 - RNA, 15 nt, Salmonella enterica enterica serovar Typhi
guaagcgcagcgcca

SEQ ID NO: 1702556 - RNA, 17 nt, Salmonella enterica enterica serovar Typhi
guaagcgcccguccaug

SEQ ID NO: 1702557 - RNA, 21 nt, Salmonella enterica enterica serovar Typhi
guaagggaggugcucucccag

SEQ ID NO: 1702558 - RNA, 22 nt, Salmonella enterica enterica serovar Typhi
guaagggaggugcucucccagc

SEQ ID NO: 1702559 - RNA, 15 nt, Salmonella enterica enterica serovar Typhi
guaaggcaaauaugc

SEQ ID NO: 1702560 - RNA, 20 nt, Salmonella enterica enterica serovar Typhi
guaaggcauuaauauccagu

SEQ ID NO: 1702561 - RNA, 23 nt, Salmonella enterica enterica serovar Typhi
guaaucaaacauacgccuuuacc

SEQ ID NO: 1702562 - RNA, 12 nt, Salmonella enterica enterica serovar Typhi
guaauauuaaaa

SEQ ID NO: 1702563 - RNA, 22 nt, Salmonella enterica enterica serovar Typhi
guaauaugugcgccacgcagcg

SEQ ID NO: 1702564 - RNA, 14 nt, Salmonella enterica enterica serovar Typhi
guaauaguuucgac

SEQ ID NO: 1702565 - RNA, 17 nt, Salmonella enterica enterica serovar Typhi
guaauaugaauauccgc

SEQ ID NO: 1702566 - RNA, 21 nt, Salmonella enterica enterica serovar Typhi
guaagucgaccaguccuuccg

SEQ ID NO: 1702567 - RNA, 21 nt, Salmonella enterica enterica serovar Typhi
guaauaacaaaaaacauauau

SEQ ID NO: 1702568 - RNA, 23 nt, Salmonella enterica enterica serovar Typhi
guaauaacaaaaaacauauaucu

SEQ ID NO: 1702569 - RNA, 16 nt, Salmonella enterica enterica serovar Typhi
guaagaggcauaaaaa

SEQ ID NO: 1702570 - RNA, 15 nt, Salmonella enterica enterica serovar Typhi
guaagagagccuuac

SEQ ID NO: 1702571 - RNA, 23 nt, Salmonella enterica enterica serovar Typhi
guaagagcguuacccagacagca

SEQ ID NO: 1702572 - RNA, 22 nt, Salmonella enterica enterica serovar Typhi
guaagaauuauuaccaaugagc

SEQ ID NO: 1702573 - RNA, 14 nt, Salmonella enterica enterica serovar Typhi
guaacugucagauc

SEQ ID NO: 1702574 - RNA, 11 nt, Salmonella enterica enterica serovar Typhi
guaacuuacaa

SEQ ID NO: 1702575 - RNA, 13 nt, Salmonella enterica enterica serovar Typhi
guaacuuauccac

SEQ ID NO: 1702576 - RNA, 15 nt, Salmonella enterica enterica serovar Typhi
guaacucaucgccag

SEQ ID NO: 1702577 - RNA, 14 nt, Salmonella enterica enterica serovar Typhi
guaacuauuucuau

SEQ ID NO: 1702578 - RNA, 17 nt, Salmonella enterica enterica serovar Typhi
guaacguuguccagcag

SEQ ID NO: 1702579 - RNA, 16 nt, Salmonella enterica enterica serovar Typhi
guaacggacucaggcc

SEQ ID NO: 1702580 - RNA, 21 nt, Salmonella enterica enterica serovar Typhi
guaacgccuggcgcauuuuaa

SEQ ID NO: 1702581 - RNA, 16 nt, Salmonella enterica enterica serovar Typhi
guaaccuauuuuacaa

SEQ ID NO: 1702582 - RNA, 18 nt, Salmonella enterica enterica serovar Typhi
guaaccuauuuuacaaaa

SEQ ID NO: 1702583 - RNA, 15 nt, Salmonella enterica enterica serovar Typhi
guaacgcauaagcgc

SEQ ID NO: 1702584 - RNA, 23 nt, Salmonella enterica enterica serovar Typhi
guaacgccaaaguuuuuaaacaa

SEQ ID NO: 1702585 - RNA, 16 nt, Salmonella enterica enterica serovar Typhi
guaacgauaaaaugca

SEQ ID NO: 1702586 - RNA, 17 nt, Salmonella enterica enterica serovar Typhi
guaaccccugcccgcga

SEQ ID NO: 1702587 - RNA, 17 nt, Salmonella enterica enterica serovar Typhi
guaacccgauacccuga

SEQ ID NO: 1702588 - RNA, 14 nt, Salmonella enterica enterica serovar Typhi
guaacauauuuuua

SEQ ID NO: 1702589 - RNA, 16 nt, Salmonella enterica enterica serovar Typhi
guaaaggggagcccag

SEQ ID NO: 1702590 - RNA, 16 nt, Salmonella enterica enterica serovar Typhi
guaaaguuauucacgu

SEQ ID NO: 1702591 - RNA, 17 nt, Salmonella enterica enterica serovar Typhi
guaaauagagaaaucaa

SEQ ID NO: 1702592 - RNA, 18 nt, Salmonella enterica enterica serovar Typhi
guaaauagagaaaucaac

SEQ ID NO: 1702593 - RNA, 13 nt, Salmonella enterica enterica serovar Typhi
guaaauacccagg

SEQ ID NO: 1702594 - RNA, 15 nt, Salmonella enterica enterica serovar Typhi
guaaauauugauuaa

SEQ ID NO: 1702595 - RNA, 22 nt, Salmonella enterica enterica serovar Typhi
guaaaucugccgucaucgacuu

SEQ ID NO: 1702596 - RNA, 22 nt, Salmonella enterica enterica serovar Typhi
guaaaucauuuguacaaaaaau

SEQ ID NO: 1702597 - RNA, 16 nt, Salmonella enterica enterica serovar Typhi
guaaauccaauagacu

SEQ ID NO: 1702598 - RNA, 20 nt, Salmonella enterica enterica serovar Typhi
guaaaucaggccaagcaaca

SEQ ID NO: 1702599 - RNA, 13 nt, Salmonella enterica enterica serovar Typhi
guaacaaccagaa

SEQ ID NO: 1702600 - RNA, 22 nt, Salmonella enterica enterica serovar Typhi
guaacagacgcaucuuuuuccc

SEQ ID NO: 1702601 - RNA, 16 nt, Salmonella enterica enterica serovar Typhi
guaacaggcaccagcg

SEQ ID NO: 1702602 - RNA, 17 nt, Salmonella enterica enterica serovar Typhi
guaaauuccuuguuuua

SEQ ID NO: 1702603 - RNA, 14 nt, Salmonella enterica enterica serovar Typhi
guaaauugacugga

SEQ ID NO: 1702604 - RNA, 20 nt, Salmonella enterica enterica serovar Typhi
guaaaugccacuauagauga

SEQ ID NO: 1702605 - RNA, 21 nt, Salmonella enterica enterica serovar Typhi
guaaacccgauucugccaguu

SEQ ID NO: 1702606 - RNA, 17 nt, Salmonella enterica enterica serovar Typhi
guaaaccggucucuuaa

SEQ ID NO: 1702607 - RNA, 15 nt, Salmonella enterica enterica serovar Typhi
guaaacgcgaccagc

SEQ ID NO: 1702608 - RNA, 23 nt, Salmonella enterica enterica serovar Typhi
guaaaccucaaggcucagcagag

SEQ ID NO: 1702609 - RNA, 19 nt, Salmonella enterica enterica serovar Typhi
guaaaccauuucuccugca

SEQ ID NO: 1702610 - RNA, 14 nt, Salmonella enterica enterica serovar Typhi
guaaaccaggccag

SEQ ID NO: 1702611 - RNA, 15 nt, Salmonella enterica enterica serovar Typhi
guaaacaggcaggcc

SEQ ID NO: 1702612 - RNA, 14 nt, Salmonella enterica enterica serovar Typhi
guaaagcauggcug

SEQ ID NO: 1702613 - RNA, 18 nt, Salmonella enterica enterica serovar Typhi
guaaagcagugcaguauu

SEQ ID NO: 1702614 - RNA, 14 nt, Salmonella enterica enterica serovar Typhi
guaaagcagugcag

SEQ ID NO: 1702615 - RNA, 13 nt, Salmonella enterica enterica serovar Typhi
guaaagaucuggc

SEQ ID NO: 1702616 - RNA, 16 nt, Salmonella enterica enterica serovar Typhi
guaaacguuccugcca

SEQ ID NO: 1702617 - RNA, 23 nt, Salmonella enterica enterica serovar Typhi
guaaacgugcuggauggcagaca

SEQ ID NO: 1702618 - RNA, 15 nt, Salmonella enterica enterica serovar Typhi
guaaacggaaccaaa

SEQ ID NO: 1702619 - RNA, 19 nt, Salmonella enterica enterica serovar Typhi
guaaagaaauuuaaagaua

SEQ ID NO: 1702620 - RNA, 22 nt, Salmonella enterica enterica serovar Typhi
guaaagacaccguucuggcugc

SEQ ID NO: 1702621 - RNA, 21 nt, Salmonella enterica enterica serovar Typhi
gguuaaacacauccggcggcg

SEQ ID NO: 1702622 - RNA, 15 nt, Salmonella enterica enterica serovar Typhi
ggugugccugcgcuu

SEQ ID NO: 1702623 - RNA, 17 nt, Salmonella enterica enterica serovar Typhi
gguuaaauagcaggcaa

SEQ ID NO: 1702624 - RNA, 12 nt, Salmonella enterica enterica serovar Typhi
gguuaacucuuu

SEQ ID NO: 1702625 - RNA, 15 nt, Salmonella enterica enterica serovar Typhi
gguuaacgucagauu

SEQ ID NO: 1702626 - RNA, 15 nt, Salmonella enterica enterica serovar Typhi
guaaaaucaacagca

SEQ ID NO: 1702627 - RNA, 16 nt, Salmonella enterica enterica serovar Typhi
guaaaaucaacagcaa

SEQ ID NO: 1702628 - RNA, 21 nt, Salmonella enterica enterica serovar Typhi
guaaaauccggcaggcagccg

SEQ ID NO: 1702629 - RNA, 17 nt, Salmonella enterica enterica serovar Typhi
guaaaauccuuuuucau

SEQ ID NO: 1702630 - RNA, 13 nt, Salmonella enterica enterica serovar Typhi
guaaucgccguau

SEQ ID NO: 1702631 - RNA, 14 nt, Salmonella enterica enterica serovar Typhi
guaaucgccugaau

SEQ ID NO: 1702632 - RNA, 13 nt, Salmonella enterica enterica serovar Typhi
guaaucuaaaauu

SEQ ID NO: 1702633 - RNA, 13 nt, Salmonella enterica enterica serovar Typhi
guaauggccuaca

SEQ ID NO: 1702634 - RNA, 14 nt, Salmonella enterica enterica serovar Typhi
guaaucuauucagc

SEQ ID NO: 1702635 - RNA, 17 nt, Salmonella enterica enterica serovar Typhi
guaccaaaacagaaaag

SEQ ID NO: 1702636 - RNA, 20 nt, Salmonella enterica enterica serovar Typhi
guacauguccagaucuucac

SEQ ID NO: 1702637 - RNA, 22 nt, Salmonella enterica enterica serovar Typhi
guaauguugcugcaucuccagc

SEQ ID NO: 1702638 - RNA, 21 nt, Salmonella enterica enterica serovar Typhi
guaauggcgggaaaagguuuc

SEQ ID NO: 1702639 - RNA, 18 nt, Salmonella enterica enterica serovar Typhi
guaaugucuggugcagca

SEQ ID NO: 1702640 - RNA, 23 nt, Salmonella enterica enterica serovar Typhi
guaccauaccggugcgccccagc

SEQ ID NO: 1702641 - RNA, 14 nt, Salmonella enterica enterica serovar Typhi
guaccaauacccag

SEQ ID NO: 1702642 - RNA, 13 nt, Salmonella enterica enterica serovar Typhi
guaccauugucaa

SEQ ID NO: 1702643 - RNA, 15 nt, Salmonella enterica enterica serovar Typhi
guaccccgccugacg

SEQ ID NO: 1702644 - RNA, 17 nt, Salmonella enterica enterica serovar Typhi
guacccgcaggccuggc

SEQ ID NO: 1702645 - RNA, 13 nt, Salmonella enterica enterica serovar Typhi
guaccgggcagac

SEQ ID NO: 1702646 - RNA, 19 nt, Salmonella enterica enterica serovar Typhi
guaccgcuaucgccaaacu

SEQ ID NO: 1702647 - RNA, 16 nt, Salmonella enterica enterica serovar Typhi
guaccgccgccgggcc

SEQ ID NO: 1702648 - RNA, 22 nt, Salmonella enterica enterica serovar Typhi
guacuggaucaccugaaugcaa

SEQ ID NO: 1702649 - RNA, 19 nt, Salmonella enterica enterica serovar Typhi
guagagcgcggucagguuc

SEQ ID NO: 1702650 - RNA, 17 nt, Salmonella enterica enterica serovar Typhi
guagagaucgacaaacc

SEQ ID NO: 1702651 - RNA, 13 nt, Salmonella enterica enterica serovar Typhi
guagacucaggcg

SEQ ID NO: 1702652 - RNA, 17 nt, Salmonella enterica enterica serovar Typhi
guacggggcaucuauuu

SEQ ID NO: 1702653 - RNA, 23 nt, Salmonella enterica enterica serovar Typhi
guaccgggcaggaaaagacuacu

SEQ ID NO: 1702654 - RNA, 13 nt, Salmonella enterica enterica serovar Typhi
guacggcgcgcca

SEQ ID NO: 1702655 - RNA, 18 nt, Salmonella enterica enterica serovar Typhi
guacgcuuuggcaggccu

SEQ ID NO: 1702656 - RNA, 19 nt, Salmonella enterica enterica serovar Typhi
guacggcuuucuuucucca

SEQ ID NO: 1702657 - RNA, 17 nt, Salmonella enterica enterica serovar Typhi
guaccugaagccauccu

SEQ ID NO: 1702658 - RNA, 13 nt, Salmonella enterica enterica serovar Typhi
guaggcuucaacc

SEQ ID NO: 1702659 - RNA, 21 nt, Salmonella enterica enterica serovar Typhi
guaggcucuccgguugcugau

SEQ ID NO: 1702660 - RNA, 16 nt, Salmonella enterica enterica serovar Typhi
guagguauccagcaga

SEQ ID NO: 1702661 - RNA, 20 nt, Salmonella enterica enterica serovar Typhi
guaggucgcgaauagcuuuu

SEQ ID NO: 1702662 - RNA, 15 nt, Salmonella enterica enterica serovar Typhi
guaggguacagcgcg

SEQ ID NO: 1702663 - RNA, 21 nt, Salmonella enterica enterica serovar Typhi
guaggcccgguaagcgcagcg

SEQ ID NO: 1702664 - RNA, 13 nt, Salmonella enterica enterica serovar Typhi
guaggccaggcau

SEQ ID NO: 1702665 - RNA, 14 nt, Salmonella enterica enterica serovar Typhi
guagcuccagaccu

SEQ ID NO: 1702666 - RNA, 14 nt, Salmonella enterica enterica serovar Typhi
guagcgcggcagcg

SEQ ID NO: 1702667 - RNA, 21 nt, Salmonella enterica enterica serovar Typhi
guagcgucucaucaaaaaggc

SEQ ID NO: 1702668 - RNA, 23 nt, Salmonella enterica enterica serovar Typhi
guagcguuucacgcgcgccugcc

SEQ ID NO: 1702669 - RNA, 16 nt, Salmonella enterica enterica serovar Typhi
guagcucauaacucgc

SEQ ID NO: 1702670 - RNA, 16 nt, Salmonella enterica enterica serovar Typhi
guagaucacgccagcg

SEQ ID NO: 1702671 - RNA, 12 nt, Salmonella enterica enterica serovar Typhi
guagaucaccag

SEQ ID NO: 1702672 - RNA, 14 nt, Salmonella enterica enterica serovar Typhi
guaguccuguaucu

SEQ ID NO: 1702673 - RNA, 17 nt, Salmonella enterica enterica serovar Typhi
guagucuuacacuuagc

SEQ ID NO: 1702674 - RNA, 19 nt, Salmonella enterica enterica serovar Typhi
guagugcuucucuucaaac

SEQ ID NO: 1702675 - RNA, 15 nt, Salmonella enterica enterica serovar Typhi
guaguaauauuaaaa

SEQ ID NO: 1702676 - RNA, 14 nt, Salmonella enterica enterica serovar Typhi
guaguaucauccau

SEQ ID NO: 1702677 - RNA, 19 nt, Salmonella enterica enterica serovar Typhi
guaguuccuguagcgugac

SEQ ID NO: 1702678 - RNA, 14 nt, Salmonella enterica enterica serovar Typhi
guaguuuauucauc

SEQ ID NO: 1702679 - RNA, 15 nt, Salmonella enterica enterica serovar Typhi
guaguuaaaaaaggu

SEQ ID NO: 1702680 - RNA, 20 nt, Salmonella enterica enterica serovar Typhi
guaguguuuaagcgucaggc

SEQ ID NO: 1702681 - RNA, 18 nt, Salmonella enterica enterica serovar Typhi
guauaaauuuccgcagcc

SEQ ID NO: 1702682 - RNA, 19 nt, Salmonella enterica enterica serovar Typhi
guauaaaucccggugggga

SEQ ID NO: 1702683 - RNA, 16 nt, Salmonella enterica enterica serovar Typhi
guauaaaauggcaaag

SEQ ID NO: 1702684 - RNA, 19 nt, Salmonella enterica enterica serovar Typhi
guauaaaauggcaaagucg

SEQ ID NO: 1702685 - RNA, 17 nt, Salmonella enterica enterica serovar Typhi
guauaaacucagcaaua

SEQ ID NO: 1702686 - RNA, 12 nt, Salmonella enterica enterica serovar Typhi
gucgccgcccgu

SEQ ID NO: 1702687 - RNA, 11 nt, Salmonella enterica enterica serovar Typhi
gucgccgccgu

SEQ ID NO: 1702688 - RNA, 16 nt, Salmonella enterica enterica serovar Typhi
gucgcccagccauaau

SEQ ID NO: 1702689 - RNA, 13 nt, Salmonella enterica enterica serovar Typhi
gucgcauccggca

SEQ ID NO: 1702690 - RNA, 16 nt, Salmonella enterica enterica serovar Typhi
gucgccaagcugugga

SEQ ID NO: 1702691 - RNA, 18 nt, Salmonella enterica enterica serovar Typhi
gucgccaagcuguggaaa

SEQ ID NO: 1702692 - RNA, 13 nt, Salmonella enterica enterica serovar Typhi
gucgcgcgcgcca

SEQ ID NO: 1702693 - RNA, 21 nt, Salmonella enterica enterica serovar Typhi
guccuuaaccagcucgcugau

SEQ ID NO: 1702694 - RNA, 16 nt, Salmonella enterica enterica serovar Typhi
guccugucccugccag

SEQ ID NO: 1702695 - RNA, 17 nt, Salmonella enterica enterica serovar Typhi
guccuucacaaacuucu

SEQ ID NO: 1702696 - RNA, 18 nt, Salmonella enterica enterica serovar Typhi
gucgagcucaguccagcc

SEQ ID NO: 1702697 - RNA, 17 nt, Salmonella enterica enterica serovar Typhi
guccuugcgaagaccgc

SEQ ID NO: 1702698 - RNA, 14 nt, Salmonella enterica enterica serovar Typhi
gucgaggaagcugc

SEQ ID NO: 1702699 - RNA, 14 nt, Salmonella enterica enterica serovar Typhi
gucgcacuccucug

SEQ ID NO: 1702700 - RNA, 16 nt, Salmonella enterica enterica serovar Typhi
gucgcagcaaacggca

SEQ ID NO: 1702701 - RNA, 13 nt, Salmonella enterica enterica serovar Typhi
gucgcauacuucc

SEQ ID NO: 1702702 - RNA, 22 nt, Salmonella enterica enterica serovar Typhi
gucgcagccacccuggcauaug

SEQ ID NO: 1702703 - RNA, 17 nt, Salmonella enterica enterica serovar Typhi
gucgauaaaauccucua

SEQ ID NO: 1702704 - RNA, 16 nt, Salmonella enterica enterica serovar Typhi
gucgaucacgguggug

SEQ ID NO: 1702705 - RNA, 15 nt, Salmonella enterica enterica serovar Typhi
gucgaucucggccac

SEQ ID NO: 1702706 - RNA, 22 nt, Salmonella enterica enterica serovar Typhi
gucgcaagacgaaaaaugaaua

SEQ ID NO: 1702707 - RNA, 17 nt, Salmonella enterica enterica serovar Typhi
gucauugaccggaaaaa

SEQ ID NO: 1702708 - RNA, 18 nt, Salmonella enterica enterica serovar Typhi
gucauuugaaucugcggu

SEQ ID NO: 1702709 - RNA, 17 nt, Salmonella enterica enterica serovar Typhi
guccaugacgaccacag

SEQ ID NO: 1702710 - RNA, 13 nt, Salmonella enterica enterica serovar Typhi
guccauauucagu

SEQ ID NO: 1702711 - RNA, 21 nt, Salmonella enterica enterica serovar Typhi
gucauuuucuuucaucaaacg

SEQ ID NO: 1702712 - RNA, 18 nt, Salmonella enterica enterica serovar Typhi
guccccauaucccgcgcc

SEQ ID NO: 1702713 - RNA, 17 nt, Salmonella enterica enterica serovar Typhi
guccccggcgacgugaa

SEQ ID NO: 1702714 - RNA, 21 nt, Salmonella enterica enterica serovar Typhi
gucccaggauaguacugacca

SEQ ID NO: 1702715 - RNA, 12 nt, Salmonella enterica enterica serovar Typhi
gucccaggccag

SEQ ID NO: 1702716 - RNA, 16 nt, Salmonella enterica enterica serovar Typhi
gucccagugucaacug

SEQ ID NO: 1702717 - RNA, 23 nt, Salmonella enterica enterica serovar Typhi
gucccaucguaacgccgucgaca

SEQ ID NO: 1702718 - RNA, 16 nt, Salmonella enterica enterica serovar Typhi
gucccagccuuccugg

SEQ ID NO: 1702719 - RNA, 22 nt, Salmonella enterica enterica serovar Typhi
gucccagccccacauuggaaaa

SEQ ID NO: 1702720 - RNA, 11 nt, Salmonella enterica enterica serovar Typhi
gucccagccuu

SEQ ID NO: 1702721 - RNA, 20 nt, Salmonella enterica enterica serovar Typhi
guccgcaaagacaacgacca

SEQ ID NO: 1702722 - RNA, 15 nt, Salmonella enterica enterica serovar Typhi
guccgcacgccugca

SEQ ID NO: 1702723 - RNA, 16 nt, Salmonella enterica enterica serovar Typhi
guccggcacgcgcagc

SEQ ID NO: 1702724 - RNA, 17 nt, Salmonella enterica enterica serovar Typhi
guccggagcagcuuagc

SEQ ID NO: 1702725 - RNA, 23 nt, Salmonella enterica enterica serovar Typhi
guccggcgaacaaacucuuucac

SEQ ID NO: 1702726 - RNA, 19 nt, Salmonella enterica enterica serovar Typhi
guccggcgaaaaccgagca

SEQ ID NO: 1702727 - RNA, 18 nt, Salmonella enterica enterica serovar Typhi
guccugccgcuacuccgc

SEQ ID NO: 1702728 - RNA, 14 nt, Salmonella enterica enterica serovar Typhi
guccugauccggcu

SEQ ID NO: 1702729 - RNA, 17 nt, Salmonella enterica enterica serovar Typhi
guccuccaacgugcaga

SEQ ID NO: 1702730 - RNA, 22 nt, Salmonella enterica enterica serovar Typhi
guccuauugcaacgccgaugcu

SEQ ID NO: 1702731 - RNA, 21 nt, Salmonella enterica enterica serovar Typhi
guccucacacugauggcagac

SEQ ID NO: 1702732 - RNA, 18 nt, Salmonella enterica enterica serovar Typhi
gucaaaaaaucagcaauc

SEQ ID NO: 1702733 - RNA, 19 nt, Salmonella enterica enterica serovar Typhi
gucaaaaaguugucuuccu

SEQ ID NO: 1702734 - RNA, 12 nt, Salmonella enterica enterica serovar Typhi
gucaaaagcugc

SEQ ID NO: 1702735 - RNA, 20 nt, Salmonella enterica enterica serovar Typhi
gucaaaaccaaacagcgaca

SEQ ID NO: 1702736 - RNA, 14 nt, Salmonella enterica enterica serovar Typhi
gucaaaacuuauuu

SEQ ID NO: 1702737 - RNA, 22 nt, Salmonella enterica enterica serovar Typhi
gucaaaacuuauuuuauuuuua

SEQ ID NO: 1702738 - RNA, 20 nt, Salmonella enterica enterica serovar Typhi
guauaucuuucuuaucccac

SEQ ID NO: 1702739 - RNA, 23 nt, Salmonella enterica enterica serovar Typhi
guauacauacauaccacgcagcg

SEQ ID NO: 1702740 - RNA, 18 nt, Salmonella enterica enterica serovar Typhi
guauaaucccgcggcgga

SEQ ID NO: 1702741 - RNA, 15 nt, Salmonella enterica enterica serovar Typhi
gucaacguuuuucag

SEQ ID NO: 1702742 - RNA, 16 nt, Salmonella enterica enterica serovar Typhi
gucaagaucccucacc

SEQ ID NO: 1702743 - RNA, 17 nt, Salmonella enterica enterica serovar Typhi
gucaagaucgcgcagca

SEQ ID NO: 1702744 - RNA, 22 nt, Salmonella enterica enterica serovar Typhi
gucaacauagcuauauuuagcc

SEQ ID NO: 1702745 - RNA, 13 nt, Salmonella enterica enterica serovar Typhi
gucaacaucaucc

SEQ ID NO: 1702746 - RNA, 17 nt, Salmonella enterica enterica serovar Typhi
gucaacacgcagaccca

SEQ ID NO: 1702747 - RNA, 23 nt, Salmonella enterica enterica serovar Typhi
gucaacgcacuguaacgcacugg

SEQ ID NO: 1702748 - RNA, 17 nt, Salmonella enterica enterica serovar Typhi
gucaacugcucuaccaa

SEQ ID NO: 1702749 - RNA, 17 nt, Salmonella enterica enterica serovar Typhi
gucagaugcguuuucug

SEQ ID NO: 1702750 - RNA, 19 nt, Salmonella enterica enterica serovar Typhi
gucagaugcguuuucugca

SEQ ID NO: 1702751 - RNA, 23 nt, Salmonella enterica enterica serovar Typhi
gucagaccuucaacccagcagca

SEQ ID NO: 1702752 - RNA, 18 nt, Salmonella enterica enterica serovar Typhi
gucacuccggcugcacca

SEQ ID NO: 1702753 - RNA, 19 nt, Salmonella enterica enterica serovar Typhi
gucacuuacuuucuugcca

SEQ ID NO: 1702754 - RNA, 20 nt, Salmonella enterica enterica serovar Typhi
gucacaaaggccagcagcag

SEQ ID NO: 1702755 - RNA, 19 nt, Salmonella enterica enterica serovar Typhi
gucacccgccggcagcagc

SEQ ID NO: 1702756 - RNA, 20 nt, Salmonella enterica enterica serovar Typhi
gucacccgccggcagcagcu

SEQ ID NO: 1702757 - RNA, 16 nt, Salmonella enterica enterica serovar Typhi
gucaggcgagcgccuu

SEQ ID NO: 1702758 - RNA, 12 nt, Salmonella enterica enterica serovar Typhi
gucaggcuaaau

SEQ ID NO: 1702759 - RNA, 22 nt, Salmonella enterica enterica serovar Typhi
gucaggcuacccgcaauaccaa

SEQ ID NO: 1702760 - RNA, 18 nt, Salmonella enterica enterica serovar Typhi
gucaggccgccgcaaaag

SEQ ID NO: 1702761 - RNA, 20 nt, Salmonella enterica enterica serovar Typhi
gucaggccgccgcacaggcg

SEQ ID NO: 1702762 - RNA, 15 nt, Salmonella enterica enterica serovar Typhi
gucaggcagaaauaa

SEQ ID NO: 1702763 - RNA, 22 nt, Salmonella enterica enterica serovar Typhi
gucaggccacugcccuggaaga

SEQ ID NO: 1702764 - RNA, 15 nt, Salmonella enterica enterica serovar Typhi
gucagcuccgguauc

SEQ ID NO: 1702765 - RNA, 22 nt, Salmonella enterica enterica serovar Typhi
gucagcucgguggcgguaucaa

SEQ ID NO: 1702766 - RNA, 22 nt, Salmonella enterica enterica serovar Typhi
gucaggaagcggacuaccugcc

SEQ ID NO: 1702767 - RNA, 14 nt, Salmonella enterica enterica serovar Typhi
gucaggauuuucgc

SEQ ID NO: 1702768 - RNA, 13 nt, Salmonella enterica enterica serovar Typhi
gucaggaugcuga

SEQ ID NO: 1702769 - RNA, 12 nt, Salmonella enterica enterica serovar Typhi
gucaggcaacag

SEQ ID NO: 1702770 - RNA, 21 nt, Salmonella enterica enterica serovar Typhi
gucagcgggguucagaccaga

SEQ ID NO: 1702771 - RNA, 22 nt, Salmonella enterica enterica serovar Typhi
gucagcggcugacacucaucca

SEQ ID NO: 1702772 - RNA, 18 nt, Salmonella enterica enterica serovar Typhi
gucagccccguacaaggu

SEQ ID NO: 1702773 - RNA, 22 nt, Salmonella enterica enterica serovar Typhi
gucagccccguacaaggucggc

SEQ ID NO: 1702774 - RNA, 16 nt, Salmonella enterica enterica serovar Typhi
gucagcauuucaucca

SEQ ID NO: 1702775 - RNA, 16 nt, Salmonella enterica enterica serovar Typhi
gucauagcaaugauua

SEQ ID NO: 1702776 - RNA, 14 nt, Salmonella enterica enterica serovar Typhi
gucaucugccaguu

SEQ ID NO: 1702777 - RNA, 23 nt, Salmonella enterica enterica serovar Typhi
gucauacuucaaguugcaggugu

SEQ ID NO: 1702778 - RNA, 14 nt, Salmonella enterica enterica serovar Typhi
gucauaauuaaaaa

SEQ ID NO: 1702779 - RNA, 13 nt, Salmonella enterica enterica serovar Typhi
gucauaauuaaaa

SEQ ID NO: 1702780 - RNA, 22 nt, Salmonella enterica enterica serovar Typhi
gucauaaauacacgaggccacg

SEQ ID NO: 1702781 - RNA, 12 nt, Salmonella enterica enterica serovar Typhi
gucauaaaacug

SEQ ID NO: 1702782 - RNA, 17 nt, Salmonella enterica enterica serovar Typhi
gucaugacgcuggaagu

SEQ ID NO: 1702783 - RNA, 18 nt, Salmonella enterica enterica serovar Typhi
gucaugauguuugucuuu

SEQ ID NO: 1702784 - RNA, 23 nt, Salmonella enterica enterica serovar Typhi
gucaugauguuugucuuuuccag

SEQ ID NO: 1702785 - RNA, 17 nt, Salmonella enterica enterica serovar Typhi
gucaugccaucauuaau

SEQ ID NO: 1702786 - RNA, 19 nt, Salmonella enterica enterica serovar Typhi
gucaugccaucauuaauuu

SEQ ID NO: 1702787 - RNA, 19 nt, Salmonella enterica enterica serovar Typhi
gucauuacgguauuuauca

SEQ ID NO: 1702788 - RNA, 20 nt, Salmonella enterica enterica serovar Typhi
gucauuaacgggaaacuguu

SEQ ID NO: 1702789 - RNA, 12 nt, Salmonella enterica enterica serovar Typhi
gucaguuccaua

SEQ ID NO: 1702790 - RNA, 14 nt, Salmonella enterica enterica serovar Typhi
gucaguccaccugu

SEQ ID NO: 1702791 - RNA, 22 nt, Salmonella enterica enterica serovar Typhi
gucagucgcucuaucgccugga

SEQ ID NO: 1702792 - RNA, 15 nt, Salmonella enterica enterica serovar Typhi
gucagguuuucuauc

SEQ ID NO: 1702793 - RNA, 13 nt, Salmonella enterica enterica serovar Typhi
gucagguuuuuug

SEQ ID NO: 1702794 - RNA, 19 nt, Salmonella enterica enterica serovar Typhi
gucaguagcguucuuucca

SEQ ID NO: 1702795 - RNA, 22 nt, Salmonella enterica enterica serovar Typhi
ggcggauuccaguagcgcgccc

SEQ ID NO: 1702796 - RNA, 19 nt, Salmonella enterica enterica serovar Typhi
ggcggcaagggagugaguc

SEQ ID NO: 1702797 - RNA, 12 nt, Salmonella enterica enterica serovar Typhi
ggcggcaaaaaa

SEQ ID NO: 1702798 - RNA, 21 nt, Salmonella enterica enterica serovar Typhi
ggcggauacagcggcgcgcca

SEQ ID NO: 1702799 - RNA, 19 nt, Salmonella enterica enterica serovar Typhi
ggcggaggugacggaggcg

SEQ ID NO: 1702800 - RNA, 16 nt, Salmonella enterica enterica serovar Typhi
ggcggagggauuuuaa

SEQ ID NO: 1702801 - RNA, 22 nt, Salmonella enterica enterica serovar Typhi
ggcggaagucaaagguaauauc

SEQ ID NO: 1702802 - RNA, 21 nt, Salmonella enterica enterica serovar Typhi
ggcggacccaaaagaaguggc

SEQ ID NO: 1702803 - RNA, 18 nt, Salmonella enterica enterica serovar Typhi
ggcggcccacucauccag

SEQ ID NO: 1702804 - RNA, 16 nt, Salmonella enterica enterica serovar Typhi
ggcggcgaaaugccuu

SEQ ID NO: 1702805 - RNA, 20 nt, Salmonella enterica enterica serovar Typhi
ggcggcgacuggcuaaacaa

SEQ ID NO: 1702806 - RNA, 12 nt, Salmonella enterica enterica serovar Typhi
ggcggcgcagcg

SEQ ID NO: 1702807 - RNA, 14 nt, Salmonella enterica enterica serovar Typhi
ggcggcggcgggaa

SEQ ID NO: 1702808 - RNA, 14 nt, Salmonella enterica enterica serovar Typhi
ggcggcgugcgccc

SEQ ID NO: 1702809 - RNA, 19 nt, Salmonella enterica enterica serovar Typhi
ggcgcgucacaacagccgg

SEQ ID NO: 1702810 - RNA, 16 nt, Salmonella enterica enterica serovar Typhi
ggcgcguagcuggccu

SEQ ID NO: 1702811 - RNA, 22 nt, Salmonella enterica enterica serovar Typhi
ggcgcgucuucccggcgcucgg

SEQ ID NO: 1702812 - RNA, 20 nt, Salmonella enterica enterica serovar Typhi
ggcgcgguauuucgccgccg

SEQ ID NO: 1702813 - RNA, 15 nt, Salmonella enterica enterica serovar Typhi
ggcgcggggaacaca

SEQ ID NO: 1702814 - RNA, 21 nt, Salmonella enterica enterica serovar Typhi
ggcgcgcucauuuuauugaua

SEQ ID NO: 1702815 - RNA, 13 nt, Salmonella enterica enterica serovar Typhi
ggcgcgcguacug

SEQ ID NO: 1702816 - RNA, 13 nt, Salmonella enterica enterica serovar Typhi
ggcgcggaaggga

SEQ ID NO: 1702817 - RNA, 11 nt, Salmonella enterica enterica serovar Typhi
ggcgcgcuggc

SEQ ID NO: 1702818 - RNA, 12 nt, Salmonella enterica enterica serovar Typhi
ggcgcgcccggc

SEQ ID NO: 1702819 - RNA, 18 nt, Salmonella enterica enterica serovar Typhi
ggcggaaaauagccagaa

SEQ ID NO: 1702820 - RNA, 12 nt, Salmonella enterica enterica serovar Typhi
ggcggaagaggc

SEQ ID NO: 1702821 - RNA, 14 nt, Salmonella enterica enterica serovar Typhi
ggcggaauggcggg

SEQ ID NO: 1702822 - RNA, 13 nt, Salmonella enterica enterica serovar Typhi
ggcgcuguucuug

SEQ ID NO: 1702823 - RNA, 23 nt, Salmonella enterica enterica serovar Typhi
ggcgcuuuacaugacgcucuccg

SEQ ID NO: 1702824 - RNA, 17 nt, Salmonella enterica enterica serovar Typhi
ggcgcugucgccgcgca

SEQ ID NO: 1702825 - RNA, 18 nt, Salmonella enterica enterica serovar Typhi
ggcgcugucgccgcgcac

SEQ ID NO: 1702826 - RNA, 17 nt, Salmonella enterica enterica serovar Typhi
ggcgcuuaccuaaguca

SEQ ID NO: 1702827 - RNA, 14 nt, Salmonella enterica enterica serovar Typhi
ggcgcuuccugcag

SEQ ID NO: 1702828 - RNA, 15 nt, Salmonella enterica enterica serovar Typhi
ggcgcuuccugcagu

SEQ ID NO: 1702829 - RNA, 18 nt, Salmonella enterica enterica serovar Typhi
ggcgcuggcuugaccgcu

SEQ ID NO: 1702830 - RNA, 23 nt, Salmonella enterica enterica serovar Typhi
ggcgcugcgcuuaccgggccuac

SEQ ID NO: 1702831 - RNA, 22 nt, Salmonella enterica enterica serovar Typhi
ggcgcguuuacuggcgacgacc

SEQ ID NO: 1702832 - RNA, 19 nt, Salmonella enterica enterica serovar Typhi
ggcgcuacgccaucaggca

SEQ ID NO: 1702833 - RNA, 18 nt, Salmonella enterica enterica serovar Typhi
ggcgcuaagccagccaaa

SEQ ID NO: 1702834 - RNA, 15 nt, Salmonella enterica enterica serovar Typhi
ggcgcucaaucagaa

SEQ ID NO: 1702835 - RNA, 14 nt, Salmonella enterica enterica serovar Typhi
ggcgcugaagccug

SEQ ID NO: 1702836 - RNA, 18 nt, Salmonella enterica enterica serovar Typhi
ggcgggugcgcagcccca

SEQ ID NO: 1702837 - RNA, 20 nt, Salmonella enterica enterica serovar Typhi
ggcgguaaauacgcggcacg

SEQ ID NO: 1702838 - RNA, 16 nt, Salmonella enterica enterica serovar Typhi
ggcggggcagaaccug

SEQ ID NO: 1702839 - RNA, 20 nt, Salmonella enterica enterica serovar Typhi
ggcgggcgauagagaccgcu

SEQ ID NO: 1702840 - RNA, 15 nt, Salmonella enterica enterica serovar Typhi
ggcgggaucggggcg

SEQ ID NO: 1702841 - RNA, 16 nt, Salmonella enterica enterica serovar Typhi
ggcgucauccugcagg

SEQ ID NO: 1702842 - RNA, 22 nt, Salmonella enterica enterica serovar Typhi
ggcgucauagccgcgcgucagc

SEQ ID NO: 1702843 - RNA, 22 nt, Salmonella enterica enterica serovar Typhi
ggcgucagcaugguguguuccc

SEQ ID NO: 1702844 - RNA, 19 nt, Salmonella enterica enterica serovar Typhi
ggcgucacguucgucgccg

SEQ ID NO: 1702845 - RNA, 21 nt, Salmonella enterica enterica serovar Typhi
ggcguacuaaauaggcggcau

SEQ ID NO: 1702846 - RNA, 13 nt, Salmonella enterica enterica serovar Typhi
ggcguagccgccg

SEQ ID NO: 1702847 - RNA, 17 nt, Salmonella enterica enterica serovar Typhi
ggcguagccgccgagcg

SEQ ID NO: 1702848 - RNA, 14 nt, Salmonella enterica enterica serovar Typhi
ggcgucaaaauccc

SEQ ID NO: 1702849 - RNA, 20 nt, Salmonella enterica enterica serovar Typhi
ggcgucaccaccgcaggcag

SEQ ID NO: 1702850 - RNA, 22 nt, Salmonella enterica enterica serovar Typhi
ggcgucaccaccgcaggcagcg

SEQ ID NO: 1702851 - RNA, 16 nt, Salmonella enterica enterica serovar Typhi
ggcguauagccaggca

SEQ ID NO: 1702852 - RNA, 17 nt, Salmonella enterica enterica serovar Typhi
ggcguauagccaggcag

SEQ ID NO: 1702853 - RNA, 19 nt, Salmonella enterica enterica serovar Typhi
ggcguauagccaggcagau

SEQ ID NO: 1702854 - RNA, 17 nt, Salmonella enterica enterica serovar Typhi
ggcguauagccgccccc

SEQ ID NO: 1702855 - RNA, 12 nt, Salmonella enterica enterica serovar Typhi
ggcguaccagaa

SEQ ID NO: 1702856 - RNA, 15 nt, Salmonella enterica enterica serovar Typhi
ggcguaauggcggga

SEQ ID NO: 1702857 - RNA, 13 nt, Salmonella enterica enterica serovar Typhi
ggcguaagaaaag

SEQ ID NO: 1702858 - RNA, 16 nt, Salmonella enterica enterica serovar Typhi
ggcguaagaucgcggg

SEQ ID NO: 1702859 - RNA, 13 nt, Salmonella enterica enterica serovar Typhi
ggcguaaaacugg

SEQ ID NO: 1702860 - RNA, 17 nt, Salmonella enterica enterica serovar Typhi
ggcguaaaaaggcgcau

SEQ ID NO: 1702861 - RNA, 18 nt, Salmonella enterica enterica serovar Typhi
ggcgguuugacggcugca

SEQ ID NO: 1702862 - RNA, 20 nt, Salmonella enterica enterica serovar Typhi
ggcggugaagacgacgggaa

SEQ ID NO: 1702863 - RNA, 17 nt, Salmonella enterica enterica serovar Typhi
ggcguguugaaauccuc

SEQ ID NO: 1702864 - RNA, 17 nt, Salmonella enterica enterica serovar Typhi
ggcgugucgccggggcg

SEQ ID NO: 1702865 - RNA, 23 nt, Salmonella enterica enterica serovar Typhi
ggcguuaaugcgcgcuucuucau

SEQ ID NO: 1702866 - RNA, 13 nt, Salmonella enterica enterica serovar Typhi
ggcguguggcugu

SEQ ID NO: 1702867 - RNA, 13 nt, Salmonella enterica enterica serovar Typhi
ggcguggugucuc

SEQ ID NO: 1702868 - RNA, 12 nt, Salmonella enterica enterica serovar Typhi
ggcguguaacug

SEQ ID NO: 1702869 - RNA, 17 nt, Salmonella enterica enterica serovar Typhi
ggcgugccgggcuggcg

SEQ ID NO: 1702870 - RNA, 19 nt, Salmonella enterica enterica serovar Typhi
ggcgugauaaaacauucca

SEQ ID NO: 1702871 - RNA, 19 nt, Salmonella enterica enterica serovar Typhi
ggcgugacaccgguuugcg

SEQ ID NO: 1702872 - RNA, 16 nt, Salmonella enterica enterica serovar Typhi
ggcgucuuaaugcucu

SEQ ID NO: 1702873 - RNA, 21 nt, Salmonella enterica enterica serovar Typhi
ggcguccggccacuauuucgg

SEQ ID NO: 1702874 - RNA, 23 nt, Salmonella enterica enterica serovar Typhi
ggcguuacuggcgaccggcagcc

SEQ ID NO: 1702875 - RNA, 17 nt, Salmonella enterica enterica serovar Typhi
ggcguuaucuugacaug

SEQ ID NO: 1702876 - RNA, 20 nt, Salmonella enterica enterica serovar Typhi
ggcguugcgccgccaggcau

SEQ ID NO: 1702877 - RNA, 13 nt, Salmonella enterica enterica serovar Typhi
ggcguuccgcaca

SEQ ID NO: 1702878 - RNA, 21 nt, Salmonella enterica enterica serovar Typhi
ggcguuccgcacauaaucacc

SEQ ID NO: 1702879 - RNA, 21 nt, Salmonella enterica enterica serovar Typhi
ggcguugcgccgccaggcaug

SEQ ID NO: 1702880 - RNA, 18 nt, Salmonella enterica enterica serovar Typhi
ggcguuucaacaaacuca

SEQ ID NO: 1702881 - RNA, 17 nt, Salmonella enterica enterica serovar Typhi
ggcuaagccaaaaauaa

SEQ ID NO: 1702882 - RNA, 17 nt, Salmonella enterica enterica serovar Typhi
ggcuaagccagaagaua

SEQ ID NO: 1702883 - RNA, 17 nt, Salmonella enterica enterica serovar Typhi
ggcuaauaugccaggcu

SEQ ID NO: 1702884 - RNA, 15 nt, Salmonella enterica enterica serovar Typhi
ggcuaugaagagaaa

SEQ ID NO: 1702885 - RNA, 19 nt, Salmonella enterica enterica serovar Typhi
ggcuaugaagagaaacaua

SEQ ID NO: 1702886 - RNA, 21 nt, Salmonella enterica enterica serovar Typhi
ggcuaugaagcuggagccaca

SEQ ID NO: 1702887 - RNA, 17 nt, Salmonella enterica enterica serovar Typhi
ggcuauuaccggcugga

SEQ ID NO: 1702888 - RNA, 13 nt, Salmonella enterica enterica serovar Typhi
ggcuauagcucag

SEQ ID NO: 1702889 - RNA, 18 nt, Salmonella enterica enterica serovar Typhi
ggccuuuuuccgucagca

SEQ ID NO: 1702890 - RNA, 21 nt, Salmonella enterica enterica serovar Typhi
ggccuuguagcgcuguccaau

SEQ ID NO: 1702891 - RNA, 13 nt, Salmonella enterica enterica serovar Typhi
ggcgaaagaagcg

SEQ ID NO: 1702892 - RNA, 14 nt, Salmonella enterica enterica serovar Typhi
ggcgaaagaaaauu

SEQ ID NO: 1702893 - RNA, 15 nt, Salmonella enterica enterica serovar Typhi
ggcgaaaauccuuuu

SEQ ID NO: 1702894 - RNA, 19 nt, Salmonella enterica enterica serovar Typhi
ggcgaaaaucggcaggccg

SEQ ID NO: 1702895 - RNA, 14 nt, Salmonella enterica enterica serovar Typhi
ggcgaacagcccgc

SEQ ID NO: 1702896 - RNA, 12 nt, Salmonella enterica enterica serovar Typhi
ggcgaacauaag

SEQ ID NO: 1702897 - RNA, 16 nt, Salmonella enterica enterica serovar Typhi
ggcgaacucggucagg

SEQ ID NO: 1702898 - RNA, 18 nt, Salmonella enterica enterica serovar Typhi
ggcgaacuucauccacgc

SEQ ID NO: 1702899 - RNA, 15 nt, Salmonella enterica enterica serovar Typhi
ggcgacaagaauaug

SEQ ID NO: 1702900 - RNA, 18 nt, Salmonella enterica enterica serovar Typhi
ggcgaauuuacgggcgcg

SEQ ID NO: 1702901 - RNA, 13 nt, Salmonella enterica enterica serovar Typhi
ggcgacagccgcg

SEQ ID NO: 1702902 - RNA, 12 nt, Salmonella enterica enterica serovar Typhi
ggcgacaggcgc

SEQ ID NO: 1702903 - RNA, 15 nt, Salmonella enterica enterica serovar Typhi
ggcgaauaaaauuca

SEQ ID NO: 1702904 - RNA, 21 nt, Salmonella enterica enterica serovar Typhi
ggcgaauauagcuaaugcaau

SEQ ID NO: 1702905 - RNA, 19 nt, Salmonella enterica enterica serovar Typhi
ggcgacgcgauagcgcagc

SEQ ID NO: 1702906 - RNA, 16 nt, Salmonella enterica enterica serovar Typhi
ggcgacgauacaacuc

SEQ ID NO: 1702907 - RNA, 17 nt, Salmonella enterica enterica serovar Typhi
ggcgaccgggcagacau

SEQ ID NO: 1702908 - RNA, 20 nt, Salmonella enterica enterica serovar Typhi
ggcgacgacgcuguuuaugc

SEQ ID NO: 1702909 - RNA, 19 nt, Salmonella enterica enterica serovar Typhi
ggcgacuggaacaggccaa

SEQ ID NO: 1702910 - RNA, 18 nt, Salmonella enterica enterica serovar Typhi
ggcgacuagucgcccgcu

SEQ ID NO: 1702911 - RNA, 20 nt, Salmonella enterica enterica serovar Typhi
ggcgagauguuuuaccagua

SEQ ID NO: 1702912 - RNA, 22 nt, Salmonella enterica enterica serovar Typhi
ggcgagagcauugccugauucg

SEQ ID NO: 1702913 - RNA, 22 nt, Salmonella enterica enterica serovar Typhi
ggcgagagaauuaacagcgcga

SEQ ID NO: 1702914 - RNA, 15 nt, Salmonella enterica enterica serovar Typhi
ggcgagcacugccca

SEQ ID NO: 1702915 - RNA, 14 nt, Salmonella enterica enterica serovar Typhi
ggccugcaucaaca

SEQ ID NO: 1702916 - RNA, 17 nt, Salmonella enterica enterica serovar Typhi
ggccugccggguuuaau

SEQ ID NO: 1702917 - RNA, 19 nt, Salmonella enterica enterica serovar Typhi
ggccugcacaagaaacaug

SEQ ID NO: 1702918 - RNA, 16 nt, Salmonella enterica enterica serovar Typhi
ggccugcagagcggca

SEQ ID NO: 1702919 - RNA, 16 nt, Salmonella enterica enterica serovar Typhi
ggccuggagaucagca

SEQ ID NO: 1702920 - RNA, 19 nt, Salmonella enterica enterica serovar Typhi
ggccugcuuaaacaguauu

SEQ ID NO: 1702921 - RNA, 12 nt, Salmonella enterica enterica serovar Typhi
ggccugcuccgu

SEQ ID NO: 1702922 - RNA, 19 nt, Salmonella enterica enterica serovar Typhi
ggccuucugcuaucaggau

SEQ ID NO: 1702923 - RNA, 17 nt, Salmonella enterica enterica serovar Typhi
ggccuugccagcgagaa

SEQ ID NO: 1702924 - RNA, 15 nt, Salmonella enterica enterica serovar Typhi
ggccuucaaucagca

SEQ ID NO: 1702925 - RNA, 14 nt, Salmonella enterica enterica serovar Typhi
ggccuuauuuuuca

SEQ ID NO: 1702926 - RNA, 17 nt, Salmonella enterica enterica serovar Typhi
ggccuggcugagaaaaa

SEQ ID NO: 1702927 - RNA, 23 nt, Salmonella enterica enterica serovar Typhi
ggccugucccuucgcccggcgcg

SEQ ID NO: 1702928 - RNA, 22 nt, Salmonella enterica enterica serovar Typhi
ggccugugacguuaacgcagca

SEQ ID NO: 1702929 - RNA, 20 nt, Salmonella enterica enterica serovar Typhi
ggccuacggauucgcugcug

SEQ ID NO: 1702930 - RNA, 15 nt, Salmonella enterica enterica serovar Typhi
ggccuauagacaccu

SEQ ID NO: 1702931 - RNA, 23 nt, Salmonella enterica enterica serovar Typhi
ggccguuggcuuuaugcacgccg

SEQ ID NO: 1702932 - RNA, 15 nt, Salmonella enterica enterica serovar Typhi
ggccguuuucaugca

SEQ ID NO: 1702933 - RNA, 16 nt, Salmonella enterica enterica serovar Typhi
ggccuacauucauuaa

SEQ ID NO: 1702934 - RNA, 18 nt, Salmonella enterica enterica serovar Typhi
ggccuacagaacugcacg

SEQ ID NO: 1702935 - RNA, 17 nt, Salmonella enterica enterica serovar Typhi
ggccucuucacgcagcg

SEQ ID NO: 1702936 - RNA, 20 nt, Salmonella enterica enterica serovar Typhi
ggccucuucacgcagcgccu

SEQ ID NO: 1702937 - RNA, 12 nt, Salmonella enterica enterica serovar Typhi
ggccuccugacg

SEQ ID NO: 1702938 - RNA, 18 nt, Salmonella enterica enterica serovar Typhi
ggccuccugacgaagggc

SEQ ID NO: 1702939 - RNA, 14 nt, Salmonella enterica enterica serovar Typhi
ggccucauccgcau

SEQ ID NO: 1702940 - RNA, 18 nt, Salmonella enterica enterica serovar Typhi
ggccuccuuuccugugcu

SEQ ID NO: 1702941 - RNA, 14 nt, Salmonella enterica enterica serovar Typhi
ggccuccggcgggu

SEQ ID NO: 1702942 - RNA, 15 nt, Salmonella enterica enterica serovar Typhi
ggcgcgaaagcgccu

SEQ ID NO: 1702943 - RNA, 18 nt, Salmonella enterica enterica serovar Typhi
ggcgcgaaaacagcuggc

SEQ ID NO: 1702944 - RNA, 18 nt, Salmonella enterica enterica serovar Typhi
ggcgcgaaacugcugccg

SEQ ID NO: 1702945 - RNA, 15 nt, Salmonella enterica enterica serovar Typhi
ggcgccaucgccucc

SEQ ID NO: 1702946 - RNA, 18 nt, Salmonella enterica enterica serovar Typhi
ggcgccauuggcucggcg

SEQ ID NO: 1702947 - RNA, 22 nt, Salmonella enterica enterica serovar Typhi
ggcgcccauuucguuaaugcug

SEQ ID NO: 1702948 - RNA, 17 nt, Salmonella enterica enterica serovar Typhi
ggcgccgaagcaggcgg

SEQ ID NO: 1702949 - RNA, 18 nt, Salmonella enterica enterica serovar Typhi
ggcgcacaauaccgagaa

SEQ ID NO: 1702950 - RNA, 19 nt, Salmonella enterica enterica serovar Typhi
ggcgcacauuuacgccagc

SEQ ID NO: 1702951 - RNA, 22 nt, Salmonella enterica enterica serovar Typhi
ggcgcacauuuacgccagccag

SEQ ID NO: 1702952 - RNA, 15 nt, Salmonella enterica enterica serovar Typhi
ggcgcaauaacgaua

SEQ ID NO: 1702953 - RNA, 21 nt, Salmonella enterica enterica serovar Typhi
ggcgcaauccgcgccgcaucu

SEQ ID NO: 1702954 - RNA, 16 nt, Salmonella enterica enterica serovar Typhi
ggcgcagcgcccagca

SEQ ID NO: 1702955 - RNA, 19 nt, Salmonella enterica enterica serovar Typhi
ggcgcacuuccucucccac

SEQ ID NO: 1702956 - RNA, 14 nt, Salmonella enterica enterica serovar Typhi
ggcgcaguggcggg

SEQ ID NO: 1702957 - RNA, 20 nt, Salmonella enterica enterica serovar Typhi
ggcgcaggcauuaaaaaaac

SEQ ID NO: 1702958 - RNA, 13 nt, Salmonella enterica enterica serovar Typhi
ggcgcagcgcggg

SEQ ID NO: 1702959 - RNA, 14 nt, Salmonella enterica enterica serovar Typhi
ggcgcaucagaaaa

SEQ ID NO: 1702960 - RNA, 15 nt, Salmonella enterica enterica serovar Typhi
ggcgcauaucgcccu

SEQ ID NO: 1702961 - RNA, 18 nt, Salmonella enterica enterica serovar Typhi
ggcgcauacgaucugaca

SEQ ID NO: 1702962 - RNA, 16 nt, Salmonella enterica enterica serovar Typhi
ggcgccaaucaccgcc

SEQ ID NO: 1702963 - RNA, 21 nt, Salmonella enterica enterica serovar Typhi
ggcgauacugcuccgccggag

SEQ ID NO: 1702964 - RNA, 14 nt, Salmonella enterica enterica serovar Typhi
ggcgauagccccag

SEQ ID NO: 1702965 - RNA, 17 nt, Salmonella enterica enterica serovar Typhi
ggcgauagcgccccaaa

SEQ ID NO: 1702966 - RNA, 16 nt, Salmonella enterica enterica serovar Typhi
ggcgauagugucgcca

SEQ ID NO: 1702967 - RNA, 16 nt, Salmonella enterica enterica serovar Typhi
ggcgaucagacgcugg

SEQ ID NO: 1702968 - RNA, 21 nt, Salmonella enterica enterica serovar Typhi
ggcgauaaaccaacagccgcc

SEQ ID NO: 1702969 - RNA, 17 nt, Salmonella enterica enterica serovar Typhi
ggcgauaaaccagcccc

SEQ ID NO: 1702970 - RNA, 13 nt, Salmonella enterica enterica serovar Typhi
ggcgauaccagua

SEQ ID NO: 1702971 - RNA, 16 nt, Salmonella enterica enterica serovar Typhi
ggcgaggggcaggcgu

SEQ ID NO: 1702972 - RNA, 16 nt, Salmonella enterica enterica serovar Typhi
ggcgcaaccgacgggc

SEQ ID NO: 1702973 - RNA, 19 nt, Salmonella enterica enterica serovar Typhi
ggcgcaaacaguacgcccg

SEQ ID NO: 1702974 - RNA, 22 nt, Salmonella enterica enterica serovar Typhi
ggcgcaaacgcgugcugguguc

SEQ ID NO: 1702975 - RNA, 19 nt, Salmonella enterica enterica serovar Typhi
ggcgauuuauagagcagca

SEQ ID NO: 1702976 - RNA, 18 nt, Salmonella enterica enterica serovar Typhi
ggcgauuuucagcaccuu

SEQ ID NO: 1702977 - RNA, 22 nt, Salmonella enterica enterica serovar Typhi
ggcgauuuuuaggccaaacuua

SEQ ID NO: 1702978 - RNA, 16 nt, Salmonella enterica enterica serovar Typhi
ggccggaugaggcgca

SEQ ID NO: 1702979 - RNA, 19 nt, Salmonella enterica enterica serovar Typhi
ggccggauaagcggcagcg

SEQ ID NO: 1702980 - RNA, 12 nt, Salmonella enterica enterica serovar Typhi
ggccgcucgccu

SEQ ID NO: 1702981 - RNA, 16 nt, Salmonella enterica enterica serovar Typhi
ggccgcuauccucgcc

SEQ ID NO: 1702982 - RNA, 23 nt, Salmonella enterica enterica serovar Typhi
ggccgcuuaauaauaagcggccu

SEQ ID NO: 1702983 - RNA, 21 nt, Salmonella enterica enterica serovar Typhi
ggccgcuuugcgaacagcgca

SEQ ID NO: 1702984 - RNA, 14 nt, Salmonella enterica enterica serovar Typhi
ggccgcggcuguaa

SEQ ID NO: 1702985 - RNA, 20 nt, Salmonella enterica enterica serovar Typhi
ggccgcgugcucgcggcgga

SEQ ID NO: 1702986 - RNA, 21 nt, Salmonella enterica enterica serovar Typhi
ggccgucccacgcgccgccga

SEQ ID NO: 1702987 - RNA, 22 nt, Salmonella enterica enterica serovar Typhi
ggccgucacuuuaucacuccuu

SEQ ID NO: 1702988 - RNA, 21 nt, Salmonella enterica enterica serovar Typhi
ggccgucagacauauacucuu

SEQ ID NO: 1702989 - RNA, 19 nt, Salmonella enterica enterica serovar Typhi
ggccgucaaaccggcgguc

SEQ ID NO: 1702990 - RNA, 16 nt, Salmonella enterica enterica serovar Typhi
ggccgccgcacaggcg

SEQ ID NO: 1702991 - RNA, 18 nt, Salmonella enterica enterica serovar Typhi
ggccgccaaugacaauaa

SEQ ID NO: 1702992 - RNA, 14 nt, Salmonella enterica enterica serovar Typhi
ggccgagaggcuga

SEQ ID NO: 1702993 - RNA, 14 nt, Salmonella enterica enterica serovar Typhi
ggcccgcggcgacg

SEQ ID NO: 1702994 - RNA, 22 nt, Salmonella enterica enterica serovar Typhi
ggcccgauacgcggaucggcac

SEQ ID NO: 1702995 - RNA, 17 nt, Salmonella enterica enterica serovar Typhi
ggcccuaacgggcucgu

SEQ ID NO: 1702996 - RNA, 21 nt, Salmonella enterica enterica serovar Typhi
ggcccgguaagcgcuagcgcc

SEQ ID NO: 1702997 - RNA, 16 nt, Salmonella enterica enterica serovar Typhi
ggcccguaucgcucag

SEQ ID NO: 1702998 - RNA, 17 nt, Salmonella enterica enterica serovar Typhi
ggcccgguugucccggu

SEQ ID NO: 1702999 - RNA, 18 nt, Salmonella enterica enterica serovar Typhi
ggccacagcgccagacac

SEQ ID NO: 1703000 - RNA, 22 nt, Salmonella enterica enterica serovar Typhi
ggccaaugccgccuuuaucgac

SEQ ID NO: 1703001 - RNA, 21 nt, Salmonella enterica enterica serovar Typhi
ggccaauccagcuacuggcca

SEQ ID NO: 1703002 - RNA, 12 nt, Salmonella enterica enterica serovar Typhi
ggccaccacaua

SEQ ID NO: 1703003 - RNA, 20 nt, Salmonella enterica enterica serovar Typhi
ggccagaaaccggucgccgu

SEQ ID NO: 1703004 - RNA, 20 nt, Salmonella enterica enterica serovar Typhi
ggccagaaguagcagagaaa

SEQ ID NO: 1703005 - RNA, 21 nt, Salmonella enterica enterica serovar Typhi
ggccagccgacgcucuuccuc

SEQ ID NO: 1703006 - RNA, 19 nt, Salmonella enterica enterica serovar Typhi
ggccagcgaaaaccagcgc

SEQ ID NO: 1703007 - RNA, 16 nt, Salmonella enterica enterica serovar Typhi
ggccagcgcaggcugg

SEQ ID NO: 1703008 - RNA, 17 nt, Salmonella enterica enterica serovar Typhi
ggccaucuuccagcauc

SEQ ID NO: 1703009 - RNA, 14 nt, Salmonella enterica enterica serovar Typhi
ggccagugccaagc

SEQ ID NO: 1703010 - RNA, 16 nt, Salmonella enterica enterica serovar Typhi
ggccagugccaagcaa

SEQ ID NO: 1703011 - RNA, 15 nt, Salmonella enterica enterica serovar Typhi
ggccagucgcagaug

SEQ ID NO: 1703012 - RNA, 16 nt, Salmonella enterica enterica serovar Typhi
ggccaguagcgggggc

SEQ ID NO: 1703013 - RNA, 19 nt, Salmonella enterica enterica serovar Typhi
ggccaguagcgggggccgg

SEQ ID NO: 1703014 - RNA, 21 nt, Salmonella enterica enterica serovar Typhi
ggccaguagcgggggccggcu

SEQ ID NO: 1703015 - RNA, 23 nt, Salmonella enterica enterica serovar Typhi
ggccaugauccugguccggcagg

SEQ ID NO: 1703016 - RNA, 16 nt, Salmonella enterica enterica serovar Typhi
ggccagggacaggaga

SEQ ID NO: 1703017 - RNA, 19 nt, Salmonella enterica enterica serovar Typhi
ggccagcguggaugaacuc

SEQ ID NO: 1703018 - RNA, 12 nt, Salmonella enterica enterica serovar Typhi
ggccagcuccgc

SEQ ID NO: 1703019 - RNA, 15 nt, Salmonella enterica enterica serovar Typhi
ggccaaccgccacaa

SEQ ID NO: 1703020 - RNA, 21 nt, Salmonella enterica enterica serovar Typhi
ggccaagcgccuguucaacau

SEQ ID NO: 1703021 - RNA, 17 nt, Salmonella enterica enterica serovar Typhi
ggcauuucugucugacg

SEQ ID NO: 1703022 - RNA, 15 nt, Salmonella enterica enterica serovar Typhi
ggcauuucaggcacu

SEQ ID NO: 1703023 - RNA, 22 nt, Salmonella enterica enterica serovar Typhi
ggcauuucaccgucaauaacgg

SEQ ID NO: 1703024 - RNA, 14 nt, Salmonella enterica enterica serovar Typhi
ggccaaauaaccca

SEQ ID NO: 1703025 - RNA, 13 nt, Salmonella enterica enterica serovar Typhi
ggcaucucgccaa

SEQ ID NO: 1703026 - RNA, 15 nt, Salmonella enterica enterica serovar Typhi
ggcaugaagaaaaua

SEQ ID NO: 1703027 - RNA, 21 nt, Salmonella enterica enterica serovar Typhi
ggcaucugcaauucggcggca

SEQ ID NO: 1703028 - RNA, 18 nt, Salmonella enterica enterica serovar Typhi
ggcauccgugaccugcug

SEQ ID NO: 1703029 - RNA, 19 nt, Salmonella enterica enterica serovar Typhi
ggcaugacuuuaccgguuu

SEQ ID NO: 1703030 - RNA, 16 nt, Salmonella enterica enterica serovar Typhi
ggcaugauuaaagcca

SEQ ID NO: 1703031 - RNA, 17 nt, Salmonella enterica enterica serovar Typhi
ggcauuagccgccaucc

SEQ ID NO: 1703032 - RNA, 22 nt, Salmonella enterica enterica serovar Typhi
ggcauucgcagaggacauuaaa

SEQ ID NO: 1703033 - RNA, 18 nt, Salmonella enterica enterica serovar Typhi
ggcauucgaauccuccug

SEQ ID NO: 1703034 - RNA, 18 nt, Salmonella enterica enterica serovar Typhi
ggcauuggcaucugucau

SEQ ID NO: 1703035 - RNA, 20 nt, Salmonella enterica enterica serovar Typhi
ggcauugccggaaaccaacc

SEQ ID NO: 1703036 - RNA, 23 nt, Salmonella enterica enterica serovar Typhi
ggcacuuuccgguuuccauggca

SEQ ID NO: 1703037 - RNA, 21 nt, Salmonella enterica enterica serovar Typhi
ggcagaaaaaguagaaaaggu

SEQ ID NO: 1703038 - RNA, 18 nt, Salmonella enterica enterica serovar Typhi
ggcagaaaaaucagcauu

SEQ ID NO: 1703039 - RNA, 23 nt, Salmonella enterica enterica serovar Typhi
ggcagggaauacccgcccgguuu

SEQ ID NO: 1703040 - RNA, 18 nt, Salmonella enterica enterica serovar Typhi
ggcagggaugacagaaag

SEQ ID NO: 1703041 - RNA, 11 nt, Salmonella enterica enterica serovar Typhi
ggcagaauaaa

SEQ ID NO: 1703042 - RNA, 14 nt, Salmonella enterica enterica serovar Typhi
ggcaggggaaagcu

SEQ ID NO: 1703043 - RNA, 19 nt, Salmonella enterica enterica serovar Typhi
ggcaguaaagaucuggccg

SEQ ID NO: 1703044 - RNA, 23 nt, Salmonella enterica enterica serovar Typhi
ggcagguuuuuuuauaacauaaa

SEQ ID NO: 1703045 - RNA, 15 nt, Salmonella enterica enterica serovar Typhi
ggcaguguuucccaa

SEQ ID NO: 1703046 - RNA, 16 nt, Salmonella enterica enterica serovar Typhi
ggcaucaauaaaauca

SEQ ID NO: 1703047 - RNA, 17 nt, Salmonella enterica enterica serovar Typhi
ggcauaaaaagccaucc

SEQ ID NO: 1703048 - RNA, 18 nt, Salmonella enterica enterica serovar Typhi
ggcaguuuauccggcgcc

SEQ ID NO: 1703049 - RNA, 14 nt, Salmonella enterica enterica serovar Typhi
ggcaguuuauucag

SEQ ID NO: 1703050 - RNA, 16 nt, Salmonella enterica enterica serovar Typhi
ggcaucauaaaaggca

SEQ ID NO: 1703051 - RNA, 13 nt, Salmonella enterica enterica serovar Typhi
ggcaucacgccgg

SEQ ID NO: 1703052 - RNA, 19 nt, Salmonella enterica enterica serovar Typhi
ggcaucagacgguggccga

SEQ ID NO: 1703053 - RNA, 17 nt, Salmonella enterica enterica serovar Typhi
ggcauccaguuucuucg

SEQ ID NO: 1703054 - RNA, 20 nt, Salmonella enterica enterica serovar Typhi
ggacagacuucauuuuccac

SEQ ID NO: 1703055 - RNA, 20 nt, Salmonella enterica enterica serovar Typhi
ggacgaauuuccagcgggcg

SEQ ID NO: 1703056 - RNA, 14 nt, Salmonella enterica enterica serovar Typhi
ggaauaaaaauaaa

SEQ ID NO: 1703057 - RNA, 18 nt, Salmonella enterica enterica serovar Typhi
ggaauaaaggucacauca

SEQ ID NO: 1703058 - RNA, 15 nt, Salmonella enterica enterica serovar Typhi
ggaauaaauauaaga

SEQ ID NO: 1703059 - RNA, 20 nt, Salmonella enterica enterica serovar Typhi
ggaauaagggugagagggga

SEQ ID NO: 1703060 - RNA, 15 nt, Salmonella enterica enterica serovar Typhi
ggaaguccuucuccu

SEQ ID NO: 1703061 - RNA, 18 nt, Salmonella enterica enterica serovar Typhi
ggaaguauacauccacug

SEQ ID NO: 1703062 - RNA, 20 nt, Salmonella enterica enterica serovar Typhi
ggaagucagcuuccugcacg

SEQ ID NO: 1703063 - RNA, 15 nt, Salmonella enterica enterica serovar Typhi
ggaagucagcuuccu

SEQ ID NO: 1703064 - RNA, 13 nt, Salmonella enterica enterica serovar Typhi
gcucgguggcggu

SEQ ID NO: 1703065 - RNA, 15 nt, Salmonella enterica enterica serovar Typhi
gcucggcgucauccc

SEQ ID NO: 1703066 - RNA, 19 nt, Salmonella enterica enterica serovar Typhi
ggaauagacagugauuuac

SEQ ID NO: 1703067 - RNA, 18 nt, Salmonella enterica enterica serovar Typhi
ggaauagauaaguccuaa

SEQ ID NO: 1703068 - RNA, 23 nt, Salmonella enterica enterica serovar Typhi
ggaauaagggugagaggggaucu

SEQ ID NO: 1703069 - RNA, 15 nt, Salmonella enterica enterica serovar Typhi
ggaaucgucacagac

SEQ ID NO: 1703070 - RNA, 14 nt, Salmonella enterica enterica serovar Typhi
ggaaucgcgaucca

SEQ ID NO: 1703071 - RNA, 23 nt, Salmonella enterica enterica serovar Typhi
ggaaugaauguuagcgucugcgg

SEQ ID NO: 1703072 - RNA, 20 nt, Salmonella enterica enterica serovar Typhi
ggacgauaaccaugcucagc

SEQ ID NO: 1703073 - RNA, 13 nt, Salmonella enterica enterica serovar Typhi
ggacgcacccugu

SEQ ID NO: 1703074 - RNA, 15 nt, Salmonella enterica enterica serovar Typhi
ggacgccaccacgcc

SEQ ID NO: 1703075 - RNA, 21 nt, Salmonella enterica enterica serovar Typhi
ggacgccagucuuugcaggag

SEQ ID NO: 1703076 - RNA, 21 nt, Salmonella enterica enterica serovar Typhi
ggacggcuaauaugccaggcu

SEQ ID NO: 1703077 - RNA, 19 nt, Salmonella enterica enterica serovar Typhi
ggacgggauacggcgagac

SEQ ID NO: 1703078 - RNA, 20 nt, Salmonella enterica enterica serovar Typhi
ggacggguauuacugauaaa

SEQ ID NO: 1703079 - RNA, 13 nt, Salmonella enterica enterica serovar Typhi
ggacugccuaacu

SEQ ID NO: 1703080 - RNA, 16 nt, Salmonella enterica enterica serovar Typhi
ggacugcggccugcaa

SEQ ID NO: 1703081 - RNA, 13 nt, Salmonella enterica enterica serovar Typhi
ggacugggcugau

SEQ ID NO: 1703082 - RNA, 17 nt, Salmonella enterica enterica serovar Typhi
ggacuuucgcuucacga

SEQ ID NO: 1703083 - RNA, 12 nt, Salmonella enterica enterica serovar Typhi
ggacuuucgcuu

SEQ ID NO: 1703084 - RNA, 13 nt, Salmonella enterica enterica serovar Typhi
ggagaucagcaug

SEQ ID NO: 1703085 - RNA, 16 nt, Salmonella enterica enterica serovar Typhi
ggagauauggcgggga

SEQ ID NO: 1703086 - RNA, 16 nt, Salmonella enterica enterica serovar Typhi
ggaggccugaauaaug

SEQ ID NO: 1703087 - RNA, 16 nt, Salmonella enterica enterica serovar Typhi
ggaggcgcguuuacug

SEQ ID NO: 1703088 - RNA, 14 nt, Salmonella enterica enterica serovar Typhi
ggagguucaccacc

SEQ ID NO: 1703089 - RNA, 23 nt, Salmonella enterica enterica serovar Typhi
ggaguaguguaauaccacugccc

SEQ ID NO: 1703090 - RNA, 22 nt, Salmonella enterica enterica serovar Typhi
ggaguauuuaccuacuguggug

SEQ ID NO: 1703091 - RNA, 14 nt, Salmonella enterica enterica serovar Typhi
ggauagcgaccagc

SEQ ID NO: 1703092 - RNA, 12 nt, Salmonella enterica enterica serovar Typhi
ggauagcaaucu

SEQ ID NO: 1703093 - RNA, 15 nt, Salmonella enterica enterica serovar Typhi
ggauagaugaagaca

SEQ ID NO: 1703094 - RNA, 17 nt, Salmonella enterica enterica serovar Typhi
ggauagaugaagacaac

SEQ ID NO: 1703095 - RNA, 18 nt, Salmonella enterica enterica serovar Typhi
ggauacuguuuuugcuuu

SEQ ID NO: 1703096 - RNA, 21 nt, Salmonella enterica enterica serovar Typhi
ggauacuaaagggaucuuccu

SEQ ID NO: 1703097 - RNA, 17 nt, Salmonella enterica enterica serovar Typhi
ggagucugaaaauaauu

SEQ ID NO: 1703098 - RNA, 13 nt, Salmonella enterica enterica serovar Typhi
ggagugcgcggcg

SEQ ID NO: 1703099 - RNA, 16 nt, Salmonella enterica enterica serovar Typhi
ggaguggcgaaauugg

SEQ ID NO: 1703100 - RNA, 12 nt, Salmonella enterica enterica serovar Typhi
ggagugaacacg

SEQ ID NO: 1703101 - RNA, 23 nt, Salmonella enterica enterica serovar Typhi
ggcacgcuccugcuccugcggcg

SEQ ID NO: 1703102 - RNA, 23 nt, Salmonella enterica enterica serovar Typhi
ggcacugcgcuuauccggccuac

SEQ ID NO: 1703103 - RNA, 19 nt, Salmonella enterica enterica serovar Typhi
ggcaccuggagcgccuccc

SEQ ID NO: 1703104 - RNA, 14 nt, Salmonella enterica enterica serovar Typhi
ggcacacagcacua

SEQ ID NO: 1703105 - RNA, 21 nt, Salmonella enterica enterica serovar Typhi
ggcacaaccuggcuugccggg

SEQ ID NO: 1703106 - RNA, 17 nt, Salmonella enterica enterica serovar Typhi
ggcacaauagcgcuaaa

SEQ ID NO: 1703107 - RNA, 19 nt, Salmonella enterica enterica serovar Typhi
ggcacaauagcgcuaaaca

SEQ ID NO: 1703108 - RNA, 14 nt, Salmonella enterica enterica serovar Typhi
ggcacaaccuggcu

SEQ ID NO: 1703109 - RNA, 19 nt, Salmonella enterica enterica serovar Typhi
ggcacaaccuggcuugccg

SEQ ID NO: 1703110 - RNA, 21 nt, Salmonella enterica enterica serovar Typhi
ggcaauucgcguucagaaaug

SEQ ID NO: 1703111 - RNA, 12 nt, Salmonella enterica enterica serovar Typhi
ggcaaugccccc

SEQ ID NO: 1703112 - RNA, 19 nt, Salmonella enterica enterica serovar Typhi
ggcaauaugcuguuuaugg

SEQ ID NO: 1703113 - RNA, 23 nt, Salmonella enterica enterica serovar Typhi
ggcaauagaccagcggcccgcgc

SEQ ID NO: 1703114 - RNA, 14 nt, Salmonella enterica enterica serovar Typhi
ggcaauaaaguuua

SEQ ID NO: 1703115 - RNA, 13 nt, Salmonella enterica enterica serovar Typhi
ggcaaucaaaucc

SEQ ID NO: 1703116 - RNA, 17 nt, Salmonella enterica enterica serovar Typhi
ggcaaucgccugcaacg

SEQ ID NO: 1703117 - RNA, 12 nt, Salmonella enterica enterica serovar Typhi
ggcaaugccacc

SEQ ID NO: 1703118 - RNA, 20 nt, Salmonella enterica enterica serovar Typhi
ggcaaggcggcaagaaagug

SEQ ID NO: 1703119 - RNA, 15 nt, Salmonella enterica enterica serovar Typhi
ggcaagcucagcggc

SEQ ID NO: 1703120 - RNA, 23 nt, Salmonella enterica enterica serovar Typhi
ggcaacgggacggcggccagcau

SEQ ID NO: 1703121 - RNA, 19 nt, Salmonella enterica enterica serovar Typhi
ggcaacguaagccaguucu

SEQ ID NO: 1703122 - RNA, 17 nt, Salmonella enterica enterica serovar Typhi
ggcaagaauuucaauca

SEQ ID NO: 1703123 - RNA, 15 nt, Salmonella enterica enterica serovar Typhi
ggcaagaauuaaaua

SEQ ID NO: 1703124 - RNA, 17 nt, Salmonella enterica enterica serovar Typhi
ggcaagaugcccgucgg

SEQ ID NO: 1703125 - RNA, 19 nt, Salmonella enterica enterica serovar Typhi
ggcaagauuaaccagcagu

SEQ ID NO: 1703126 - RNA, 17 nt, Salmonella enterica enterica serovar Typhi
ggcaaagccccagucau

SEQ ID NO: 1703127 - RNA, 11 nt, Salmonella enterica enterica serovar Typhi
ggcaaagguug

SEQ ID NO: 1703128 - RNA, 14 nt, Salmonella enterica enterica serovar Typhi
ggcaaaucaacauu

SEQ ID NO: 1703129 - RNA, 11 nt, Salmonella enterica enterica serovar Typhi
ggcaaauagcg

SEQ ID NO: 1703130 - RNA, 16 nt, Salmonella enterica enterica serovar Typhi
ggcaaagcacugcugc

SEQ ID NO: 1703131 - RNA, 11 nt, Salmonella enterica enterica serovar Typhi
ggcaaagaccg

SEQ ID NO: 1703132 - RNA, 20 nt, Salmonella enterica enterica serovar Typhi
ggcaaaaauccuucuuccau

SEQ ID NO: 1703133 - RNA, 21 nt, Salmonella enterica enterica serovar Typhi
ggcaaaacgccgcagaaaaug

SEQ ID NO: 1703134 - RNA, 20 nt, Salmonella enterica enterica serovar Typhi
ggcaaaaaucagccaaagcg

SEQ ID NO: 1703135 - RNA, 15 nt, Salmonella enterica enterica serovar Typhi
ggauuguuuuuuagc

SEQ ID NO: 1703136 - RNA, 20 nt, Salmonella enterica enterica serovar Typhi
ggauuuuccguuaagcugga

SEQ ID NO: 1703137 - RNA, 19 nt, Salmonella enterica enterica serovar Typhi
ggcaacggccagcgcaggc

SEQ ID NO: 1703138 - RNA, 20 nt, Salmonella enterica enterica serovar Typhi
ggcaacggccagcgcaggcu

SEQ ID NO: 1703139 - RNA, 20 nt, Salmonella enterica enterica serovar Typhi
ggcaacgccagagcgucuca

SEQ ID NO: 1703140 - RNA, 23 nt, Salmonella enterica enterica serovar Typhi
ggcaacgccguacuccagcccau

SEQ ID NO: 1703141 - RNA, 16 nt, Salmonella enterica enterica serovar Typhi
ggcaacgccgccagcu

SEQ ID NO: 1703142 - RNA, 17 nt, Salmonella enterica enterica serovar Typhi
ggcaacccgcuccagaa

SEQ ID NO: 1703143 - RNA, 23 nt, Salmonella enterica enterica serovar Typhi
ggcaacagccauuuuaaaaauau

SEQ ID NO: 1703144 - RNA, 22 nt, Salmonella enterica enterica serovar Typhi
ggcaacagccauuuuaaaaaua

SEQ ID NO: 1703145 - RNA, 14 nt, Salmonella enterica enterica serovar Typhi
ggcaacauaaauaa

SEQ ID NO: 1703146 - RNA, 15 nt, Salmonella enterica enterica serovar Typhi
ggcaacacccgccga

SEQ ID NO: 1703147 - RNA, 20 nt, Salmonella enterica enterica serovar Typhi
ggcaaauccuccauaaauaa

SEQ ID NO: 1703148 - RNA, 16 nt, Salmonella enterica enterica serovar Typhi
ggaugcauaaaaaaac

SEQ ID NO: 1703149 - RNA, 22 nt, Salmonella enterica enterica serovar Typhi
ggaucugcuuaugaucgcccag

SEQ ID NO: 1703150 - RNA, 19 nt, Salmonella enterica enterica serovar Typhi
ggaucaaacgugccuggau

SEQ ID NO: 1703151 - RNA, 16 nt, Salmonella enterica enterica serovar Typhi
ggaucaauuuuucgcc

SEQ ID NO: 1703152 - RNA, 14 nt, Salmonella enterica enterica serovar Typhi
ggauggccagcacc

SEQ ID NO: 1703153 - RNA, 20 nt, Salmonella enterica enterica serovar Typhi
ggauggccagcaccagcauu

SEQ ID NO: 1703154 - RNA, 23 nt, Salmonella enterica enterica serovar Typhi
ggauggccagcaccagcauuagc

SEQ ID NO: 1703155 - RNA, 15 nt, Salmonella enterica enterica serovar Typhi
ggauggccucugcca

SEQ ID NO: 1703156 - RNA, 19 nt, Salmonella enterica enterica serovar Typhi
ggaugcaucaugcuaaaag

SEQ ID NO: 1703157 - RNA, 12 nt, Salmonella enterica enterica serovar Typhi
ggauggcggcga

SEQ ID NO: 1703158 - RNA, 21 nt, Salmonella enterica enterica serovar Typhi
ggauuggauaaaucggucauu

SEQ ID NO: 1703159 - RNA, 15 nt, Salmonella enterica enterica serovar Typhi
cucuuggguuauuuc

SEQ ID NO: 1703160 - RNA, 20 nt, Salmonella enterica enterica serovar Typhi
cucuuuaaugauguccagaa

SEQ ID NO: 1703161 - RNA, 13 nt, Salmonella enterica enterica serovar Typhi
cucuucuuuuaau

SEQ ID NO: 1703162 - RNA, 17 nt, Salmonella enterica enterica serovar Typhi
cucuucuuuuacaagaa

SEQ ID NO: 1703163 - RNA, 22 nt, Salmonella enterica enterica serovar Typhi
cucuugcauaauauccaggagc

SEQ ID NO: 1703164 - RNA, 11 nt, Salmonella enterica enterica serovar Typhi
cucuucugcug

SEQ ID NO: 1703165 - RNA, 21 nt, Salmonella enterica enterica serovar Typhi
cucuucguucauccgucuggc

SEQ ID NO: 1703166 - RNA, 21 nt, Salmonella enterica enterica serovar Typhi
cucuucgccauuacaggacag

SEQ ID NO: 1703167 - RNA, 12 nt, Salmonella enterica enterica serovar Typhi
cucuucggcuuc

SEQ ID NO: 1703168 - RNA, 15 nt, Salmonella enterica enterica serovar Typhi
cucuuccuccccagg

SEQ ID NO: 1703169 - RNA, 18 nt, Salmonella enterica enterica serovar Typhi
cucuuccgguacacgcag

SEQ ID NO: 1703170 - RNA, 17 nt, Salmonella enterica enterica serovar Typhi
cucuuccggcauaaaaa

SEQ ID NO: 1703171 - RNA, 15 nt, Salmonella enterica enterica serovar Typhi
cucuuccaucagcca

SEQ ID NO: 1703172 - RNA, 20 nt, Salmonella enterica enterica serovar Typhi
cucuuccccggucaguccca

SEQ ID NO: 1703173 - RNA, 20 nt, Salmonella enterica enterica serovar Typhi
cucuuccgcgguccagccgg

SEQ ID NO: 1703174 - RNA, 13 nt, Salmonella enterica enterica serovar Typhi
cucuuccaccauc

SEQ ID NO: 1703175 - RNA, 20 nt, Salmonella enterica enterica serovar Typhi
cucugcuuuucucacaauaa

SEQ ID NO: 1703176 - RNA, 13 nt, Salmonella enterica enterica serovar Typhi
cucugcuuuuuca

SEQ ID NO: 1703177 - RNA, 20 nt, Salmonella enterica enterica serovar Typhi
cucugguaguuguaauaaac

SEQ ID NO: 1703178 - RNA, 22 nt, Salmonella enterica enterica serovar Typhi
cucugguugcagcgccagagau

SEQ ID NO: 1703179 - RNA, 16 nt, Salmonella enterica enterica serovar Typhi
cucugguuucccugcc

SEQ ID NO: 1703180 - RNA, 14 nt, Salmonella enterica enterica serovar Typhi
cucugucgccgccc

SEQ ID NO: 1703181 - RNA, 15 nt, Salmonella enterica enterica serovar Typhi
cucugucgccgcccg

SEQ ID NO: 1703182 - RNA, 18 nt, Salmonella enterica enterica serovar Typhi
cucuucagcguccggaaa

SEQ ID NO: 1703183 - RNA, 20 nt, Salmonella enterica enterica serovar Typhi
cucuucaguaaccagggagg

SEQ ID NO: 1703184 - RNA, 17 nt, Salmonella enterica enterica serovar Typhi
cucuucaucgcgccucc

SEQ ID NO: 1703185 - RNA, 23 nt, Salmonella enterica enterica serovar Typhi
cucuucaucgcgccuccccugcc

SEQ ID NO: 1703186 - RNA, 18 nt, Salmonella enterica enterica serovar Typhi
cucuuaccgcuaaaauac

SEQ ID NO: 1703187 - RNA, 18 nt, Salmonella enterica enterica serovar Typhi
cucuuauucaaucaauuu

SEQ ID NO: 1703188 - RNA, 22 nt, Salmonella enterica enterica serovar Typhi
cugaaauacccgacucuuuuuu

SEQ ID NO: 1703189 - RNA, 23 nt, Salmonella enterica enterica serovar Typhi
cugaacauacuuucucuccuuca

SEQ ID NO: 1703190 - RNA, 15 nt, Salmonella enterica enterica serovar Typhi
cugaaauuucuuuuc

SEQ ID NO: 1703191 - RNA, 19 nt, Salmonella enterica enterica serovar Typhi
cugaaauuucuuuuccaga

SEQ ID NO: 1703192 - RNA, 21 nt, Salmonella enterica enterica serovar Typhi
cugaacuuccguaaaaagaac

SEQ ID NO: 1703193 - RNA, 23 nt, Salmonella enterica enterica serovar Typhi
cugaacucuuccagauacggguu

SEQ ID NO: 1703194 - RNA, 19 nt, Salmonella enterica enterica serovar Typhi
cugaacgggugguuucccu

SEQ ID NO: 1703195 - RNA, 14 nt, Salmonella enterica enterica serovar Typhi
cugaaccugccuuu

SEQ ID NO: 1703196 - RNA, 15 nt, Salmonella enterica enterica serovar Typhi
cugaaccugccuuug

SEQ ID NO: 1703197 - RNA, 11 nt, Salmonella enterica enterica serovar Typhi
cugaacgcugc

SEQ ID NO: 1703198 - RNA, 17 nt, Salmonella enterica enterica serovar Typhi
cugaagaaaaggaaugc

SEQ ID NO: 1703199 - RNA, 13 nt, Salmonella enterica enterica serovar Typhi
cugaacuguaacc

SEQ ID NO: 1703200 - RNA, 13 nt, Salmonella enterica enterica serovar Typhi
cugaagccccaac

SEQ ID NO: 1703201 - RNA, 17 nt, Salmonella enterica enterica serovar Typhi
cucuuucgguagccaca

SEQ ID NO: 1703202 - RNA, 20 nt, Salmonella enterica enterica serovar Typhi
cucuuucagccgacuaucuu

SEQ ID NO: 1703203 - RNA, 16 nt, Salmonella enterica enterica serovar Typhi
cucuuugaacagccag

SEQ ID NO: 1703204 - RNA, 21 nt, Salmonella enterica enterica serovar Typhi
cucuuugaacagccagaagcc

SEQ ID NO: 1703205 - RNA, 20 nt, Salmonella enterica enterica serovar Typhi
cucuuucgguagccacagau

SEQ ID NO: 1703206 - RNA, 13 nt, Salmonella enterica enterica serovar Typhi
cucuuucagacca

SEQ ID NO: 1703207 - RNA, 15 nt, Salmonella enterica enterica serovar Typhi
cucuuuaucaaacaa

SEQ ID NO: 1703208 - RNA, 21 nt, Salmonella enterica enterica serovar Typhi
cucuuuaaugauguccagaau

SEQ ID NO: 1703209 - RNA, 11 nt, Salmonella enterica enterica serovar Typhi
cucuuuuucau

SEQ ID NO: 1703210 - RNA, 20 nt, Salmonella enterica enterica serovar Typhi
cucuuuuucauagaaccacu

SEQ ID NO: 1703211 - RNA, 17 nt, Salmonella enterica enterica serovar Typhi
cucuuuuaauuuucugu

SEQ ID NO: 1703212 - RNA, 15 nt, Salmonella enterica enterica serovar Typhi
cucuuuguuggcugc

SEQ ID NO: 1703213 - RNA, 22 nt, Salmonella enterica enterica serovar Typhi
cugaaaaugugguauuaaccca

SEQ ID NO: 1703214 - RNA, 13 nt, Salmonella enterica enterica serovar Typhi
cugaaaaugcccg

SEQ ID NO: 1703215 - RNA, 16 nt, Salmonella enterica enterica serovar Typhi
cugaaagaagacgaaa

SEQ ID NO: 1703216 - RNA, 21 nt, Salmonella enterica enterica serovar Typhi
cugaaaauaauugauaauaac

SEQ ID NO: 1703217 - RNA, 12 nt, Salmonella enterica enterica serovar Typhi
cugaaaaagaac

SEQ ID NO: 1703218 - RNA, 13 nt, Salmonella enterica enterica serovar Typhi
cugaaaaaucccc

SEQ ID NO: 1703219 - RNA, 12 nt, Salmonella enterica enterica serovar Typhi
cugaaaaagggu

SEQ ID NO: 1703220 - RNA, 13 nt, Salmonella enterica enterica serovar Typhi
cugaaaaaauucc

SEQ ID NO: 1703221 - RNA, 17 nt, Salmonella enterica enterica serovar Typhi
cugagacgugugauugu

SEQ ID NO: 1703222 - RNA, 13 nt, Salmonella enterica enterica serovar Typhi
cugagaucaaaca

SEQ ID NO: 1703223 - RNA, 16 nt, Salmonella enterica enterica serovar Typhi
cugagaauuuccaguu

SEQ ID NO: 1703224 - RNA, 19 nt, Salmonella enterica enterica serovar Typhi
cugacugcauaauggugga

SEQ ID NO: 1703225 - RNA, 18 nt, Salmonella enterica enterica serovar Typhi
cugacugcaaaucugccg

SEQ ID NO: 1703226 - RNA, 20 nt, Salmonella enterica enterica serovar Typhi
cugagaaaagggcgcaccaa

SEQ ID NO: 1703227 - RNA, 21 nt, Salmonella enterica enterica serovar Typhi
cugacugaucgauccacuucc

SEQ ID NO: 1703228 - RNA, 16 nt, Salmonella enterica enterica serovar Typhi
cugacggcgcugucac

SEQ ID NO: 1703229 - RNA, 19 nt, Salmonella enterica enterica serovar Typhi
cugacuacgguugccuuuc

SEQ ID NO: 1703230 - RNA, 13 nt, Salmonella enterica enterica serovar Typhi
cugacuauccaca

SEQ ID NO: 1703231 - RNA, 19 nt, Salmonella enterica enterica serovar Typhi
cugacgaagaacuuaggau

SEQ ID NO: 1703232 - RNA, 18 nt, Salmonella enterica enterica serovar Typhi
cugaccuuuuucauccuc

SEQ ID NO: 1703233 - RNA, 17 nt, Salmonella enterica enterica serovar Typhi
cugacgaauagcgcgcu

SEQ ID NO: 1703234 - RNA, 13 nt, Salmonella enterica enterica serovar Typhi
cugacgcgcagcg

SEQ ID NO: 1703235 - RNA, 13 nt, Salmonella enterica enterica serovar Typhi
cugacgcgccugg

SEQ ID NO: 1703236 - RNA, 22 nt, Salmonella enterica enterica serovar Typhi
cugacgcguuuuuucaugaauc

SEQ ID NO: 1703237 - RNA, 16 nt, Salmonella enterica enterica serovar Typhi
cugacgcugcgccugg

SEQ ID NO: 1703238 - RNA, 13 nt, Salmonella enterica enterica serovar Typhi
cugaccuuaaucc

SEQ ID NO: 1703239 - RNA, 19 nt, Salmonella enterica enterica serovar Typhi
cugaccaagcgucagcaug

SEQ ID NO: 1703240 - RNA, 19 nt, Salmonella enterica enterica serovar Typhi
cugaccaacgucagcaucu

SEQ ID NO: 1703241 - RNA, 17 nt, Salmonella enterica enterica serovar Typhi
cugaccaacaacagaua

SEQ ID NO: 1703242 - RNA, 15 nt, Salmonella enterica enterica serovar Typhi
cugaccacauuuucu

SEQ ID NO: 1703243 - RNA, 17 nt, Salmonella enterica enterica serovar Typhi
cugaccaccggcccggu

SEQ ID NO: 1703244 - RNA, 14 nt, Salmonella enterica enterica serovar Typhi
cugaccaugccaca

SEQ ID NO: 1703245 - RNA, 18 nt, Salmonella enterica enterica serovar Typhi
cugaccauugauuuccgc

SEQ ID NO: 1703246 - RNA, 16 nt, Salmonella enterica enterica serovar Typhi
cugacaaacccuguau

SEQ ID NO: 1703247 - RNA, 22 nt, Salmonella enterica enterica serovar Typhi
cugacaacacauccgcagcgaa

SEQ ID NO: 1703248 - RNA, 21 nt, Salmonella enterica enterica serovar Typhi
cugacauuugcaucaaacuuc

SEQ ID NO: 1703249 - RNA, 21 nt, Salmonella enterica enterica serovar Typhi
cugacagaauauaggagagcg

SEQ ID NO: 1703250 - RNA, 21 nt, Salmonella enterica enterica serovar Typhi
cugacagaaauagccgguaac

SEQ ID NO: 1703251 - RNA, 20 nt, Salmonella enterica enterica serovar Typhi
cugaagcgcgacgggaagga

SEQ ID NO: 1703252 - RNA, 16 nt, Salmonella enterica enterica serovar Typhi
cugaagcccuuuagug

SEQ ID NO: 1703253 - RNA, 14 nt, Salmonella enterica enterica serovar Typhi
cugaagcguaaaaa

SEQ ID NO: 1703254 - RNA, 22 nt, Salmonella enterica enterica serovar Typhi
cugaagcugccgucccagcgga

SEQ ID NO: 1703255 - RNA, 17 nt, Salmonella enterica enterica serovar Typhi
cugaaggacaagcugcg

SEQ ID NO: 1703256 - RNA, 16 nt, Salmonella enterica enterica serovar Typhi
cugaaggcguaugaau

SEQ ID NO: 1703257 - RNA, 15 nt, Salmonella enterica enterica serovar Typhi
cugaagguuuuuccc

SEQ ID NO: 1703258 - RNA, 17 nt, Salmonella enterica enterica serovar Typhi
cugagugacgggcuggc

SEQ ID NO: 1703259 - RNA, 22 nt, Salmonella enterica enterica serovar Typhi
cugaguuacgaucguuugccca

SEQ ID NO: 1703260 - RNA, 17 nt, Salmonella enterica enterica serovar Typhi
cugaguuuagccagcag

SEQ ID NO: 1703261 - RNA, 12 nt, Salmonella enterica enterica serovar Typhi
cugagucauccu

SEQ ID NO: 1703262 - RNA, 23 nt, Salmonella enterica enterica serovar Typhi
cugagccgcccggcgcgcuggag

SEQ ID NO: 1703263 - RNA, 20 nt, Salmonella enterica enterica serovar Typhi
cugauacgcaccagcucuac

SEQ ID NO: 1703264 - RNA, 17 nt, Salmonella enterica enterica serovar Typhi
cugauaccccagcgauc

SEQ ID NO: 1703265 - RNA, 20 nt, Salmonella enterica enterica serovar Typhi
cugauauuacuaauaaaauu

SEQ ID NO: 1703266 - RNA, 22 nt, Salmonella enterica enterica serovar Typhi
cugauauuacuaauaaaauuca

SEQ ID NO: 1703267 - RNA, 16 nt, Salmonella enterica enterica serovar Typhi
cugauaagguaaagcc

SEQ ID NO: 1703268 - RNA, 19 nt, Salmonella enterica enterica serovar Typhi
cugaguuucucccgccaga

SEQ ID NO: 1703269 - RNA, 16 nt, Salmonella enterica enterica serovar Typhi
cugauaaucgagacug

SEQ ID NO: 1703270 - RNA, 12 nt, Salmonella enterica enterica serovar Typhi
cugauaauaaga

SEQ ID NO: 1703271 - RNA, 17 nt, Salmonella enterica enterica serovar Typhi
cugauauuuuacuuuuu

SEQ ID NO: 1703272 - RNA, 15 nt, Salmonella enterica enterica serovar Typhi
cugaucggccagcgu

SEQ ID NO: 1703273 - RNA, 19 nt, Salmonella enterica enterica serovar Typhi
cugaucggccagcgucgcu

SEQ ID NO: 1703274 - RNA, 16 nt, Salmonella enterica enterica serovar Typhi
cugaucgcgcagacag

SEQ ID NO: 1703275 - RNA, 22 nt, Salmonella enterica enterica serovar Typhi
cugaucgcgcagacaguggcca

SEQ ID NO: 1703276 - RNA, 19 nt, Salmonella enterica enterica serovar Typhi
cugaucgccaacgaccggc

SEQ ID NO: 1703277 - RNA, 14 nt, Salmonella enterica enterica serovar Typhi
cugaucgugcccac

SEQ ID NO: 1703278 - RNA, 17 nt, Salmonella enterica enterica serovar Typhi
cugaucguuuuugucca

SEQ ID NO: 1703279 - RNA, 20 nt, Salmonella enterica enterica serovar Typhi
cugaucgacgaaaucccggc

SEQ ID NO: 1703280 - RNA, 23 nt, Salmonella enterica enterica serovar Typhi
cugaucgaggacggccugacggu

SEQ ID NO: 1703281 - RNA, 18 nt, Salmonella enterica enterica serovar Typhi
cugaucgaggucgccaaa

SEQ ID NO: 1703282 - RNA, 17 nt, Salmonella enterica enterica serovar Typhi
cugaucgauccacuucc

SEQ ID NO: 1703283 - RNA, 20 nt, Salmonella enterica enterica serovar Typhi
cugauccggaauagagauag

SEQ ID NO: 1703284 - RNA, 15 nt, Salmonella enterica enterica serovar Typhi
cugaucccgcgcgcc

SEQ ID NO: 1703285 - RNA, 18 nt, Salmonella enterica enterica serovar Typhi
cugauccuguaaaaaauc

SEQ ID NO: 1703286 - RNA, 15 nt, Salmonella enterica enterica serovar Typhi
cugauucguuuuuac

SEQ ID NO: 1703287 - RNA, 17 nt, Salmonella enterica enterica serovar Typhi
cugauugccggaugucg

SEQ ID NO: 1703288 - RNA, 19 nt, Salmonella enterica enterica serovar Typhi
cugauuuaaucgcuucaau

SEQ ID NO: 1703289 - RNA, 13 nt, Salmonella enterica enterica serovar Typhi
cugcaaaagagga

SEQ ID NO: 1703290 - RNA, 22 nt, Salmonella enterica enterica serovar Typhi
cugaugccauaaaaugcugggc

SEQ ID NO: 1703291 - RNA, 13 nt, Salmonella enterica enterica serovar Typhi
cugaugccgucga

SEQ ID NO: 1703292 - RNA, 22 nt, Salmonella enterica enterica serovar Typhi
cugaugcguuguaccguuuucc

SEQ ID NO: 1703293 - RNA, 24 nt, Salmonella enterica enterica serovar Typhi
cugaugcgcguuuagcgccagcag

SEQ ID NO: 1703294 - RNA, 18 nt, Salmonella enterica enterica serovar Typhi
cugaugauuggccuccac

SEQ ID NO: 1703295 - RNA, 21 nt, Salmonella enterica enterica serovar Typhi
cugaugauggaacagacgccu

SEQ ID NO: 1703296 - RNA, 13 nt, Salmonella enterica enterica serovar Typhi
cugcaaaauuugu

SEQ ID NO: 1703297 - RNA, 18 nt, Salmonella enterica enterica serovar Typhi
cugcaacggcgaggugcu

SEQ ID NO: 1703298 - RNA, 14 nt, Salmonella enterica enterica serovar Typhi
cugcaacgccagau

SEQ ID NO: 1703299 - RNA, 16 nt, Salmonella enterica enterica serovar Typhi
cugcaaauacugcuuu

SEQ ID NO: 1703300 - RNA, 19 nt, Salmonella enterica enterica serovar Typhi
cugcaaauaccacaucaga

SEQ ID NO: 1703301 - RNA, 20 nt, Salmonella enterica enterica serovar Typhi
cugcaagagaaauaacaccu

SEQ ID NO: 1703302 - RNA, 17 nt, Salmonella enterica enterica serovar Typhi
cugcaacuccugggcaa

SEQ ID NO: 1703303 - RNA, 14 nt, Salmonella enterica enterica serovar Typhi
cugcaacucuccca

SEQ ID NO: 1703304 - RNA, 15 nt, Salmonella enterica enterica serovar Typhi
cugcuuucugucacc

SEQ ID NO: 1703305 - RNA, 14 nt, Salmonella enterica enterica serovar Typhi
cugcuucaccgcgc

SEQ ID NO: 1703306 - RNA, 22 nt, Salmonella enterica enterica serovar Typhi
cugcuuaucgauaucugccugc

SEQ ID NO: 1703307 - RNA, 22 nt, Salmonella enterica enterica serovar Typhi
cugcuuaugaucgcccagccac

SEQ ID NO: 1703308 - RNA, 12 nt, Salmonella enterica enterica serovar Typhi
cugcuggaaagg

SEQ ID NO: 1703309 - RNA, 18 nt, Salmonella enterica enterica serovar Typhi
cugcuggaaaucuuucuc

SEQ ID NO: 1703310 - RNA, 15 nt, Salmonella enterica enterica serovar Typhi
cugcugcuggguuga

SEQ ID NO: 1703311 - RNA, 21 nt, Salmonella enterica enterica serovar Typhi
cugcugcuugcuuuucaucac

SEQ ID NO: 1703312 - RNA, 23 nt, Salmonella enterica enterica serovar Typhi
cugcuuuuugauacagcagcacc

SEQ ID NO: 1703313 - RNA, 21 nt, Salmonella enterica enterica serovar Typhi
cuggaccccagauaauagcug

SEQ ID NO: 1703314 - RNA, 20 nt, Salmonella enterica enterica serovar Typhi
cuggacauguuccgccccgc

SEQ ID NO: 1703315 - RNA, 20 nt, Salmonella enterica enterica serovar Typhi
cuggacauauuccagaagcg

SEQ ID NO: 1703316 - RNA, 18 nt, Salmonella enterica enterica serovar Typhi
cuggacaugauaauaauu

SEQ ID NO: 1703317 - RNA, 16 nt, Salmonella enterica enterica serovar Typhi
cuggaauuuuuccagc

SEQ ID NO: 1703318 - RNA, 17 nt, Salmonella enterica enterica serovar Typhi
cuggacaaaccacagug

SEQ ID NO: 1703319 - RNA, 18 nt, Salmonella enterica enterica serovar Typhi
cuggaacaggccaaaccc

SEQ ID NO: 1703320 - RNA, 20 nt, Salmonella enterica enterica serovar Typhi
cuggaacaaaccgacuuuca

SEQ ID NO: 1703321 - RNA, 18 nt, Salmonella enterica enterica serovar Typhi
cuggcauggcucgccgcu

SEQ ID NO: 1703322 - RNA, 16 nt, Salmonella enterica enterica serovar Typhi
cuggcauggugcagcc

SEQ ID NO: 1703323 - RNA, 19 nt, Salmonella enterica enterica serovar Typhi
cuggcauuacgcuggcccc

SEQ ID NO: 1703324 - RNA, 16 nt, Salmonella enterica enterica serovar Typhi
cuggcauuacgcuggc

SEQ ID NO: 1703325 - RNA, 14 nt, Salmonella enterica enterica serovar Typhi
cuggcaacagccau

SEQ ID NO: 1703326 - RNA, 22 nt, Salmonella enterica enterica serovar Typhi
cuggcaagaccgauagagacug

SEQ ID NO: 1703327 - RNA, 17 nt, Salmonella enterica enterica serovar Typhi
cuggcaaaacgcaucca

SEQ ID NO: 1703328 - RNA, 14 nt, Salmonella enterica enterica serovar Typhi
cuggccacagcaaa

SEQ ID NO: 1703329 - RNA, 23 nt, Salmonella enterica enterica serovar Typhi
cuggccacgccgaggcauucagc

SEQ ID NO: 1703330 - RNA, 17 nt, Salmonella enterica enterica serovar Typhi
cuggccacggagugcgc

SEQ ID NO: 1703331 - RNA, 14 nt, Salmonella enterica enterica serovar Typhi
cuggccaguuucaa

SEQ ID NO: 1703332 - RNA, 21 nt, Salmonella enterica enterica serovar Typhi
cuggccaguuucaaugcccag

SEQ ID NO: 1703333 - RNA, 14 nt, Salmonella enterica enterica serovar Typhi
cugcucguaaagca

SEQ ID NO: 1703334 - RNA, 14 nt, Salmonella enterica enterica serovar Typhi
cugcucgguaucgu

SEQ ID NO: 1703335 - RNA, 17 nt, Salmonella enterica enterica serovar Typhi
cugcucgguaaaaaguu

SEQ ID NO: 1703336 - RNA, 17 nt, Salmonella enterica enterica serovar Typhi
cugcucucgggcagguu

SEQ ID NO: 1703337 - RNA, 20 nt, Salmonella enterica enterica serovar Typhi
cugcucuccuugcggugaga

SEQ ID NO: 1703338 - RNA, 20 nt, Salmonella enterica enterica serovar Typhi
cugcucguuaaauccuccca

SEQ ID NO: 1703339 - RNA, 21 nt, Salmonella enterica enterica serovar Typhi
cugcucguuaaauccucccau

SEQ ID NO: 1703340 - RNA, 22 nt, Salmonella enterica enterica serovar Typhi
cugcuccggcuuaaugcccggc

SEQ ID NO: 1703341 - RNA, 15 nt, Salmonella enterica enterica serovar Typhi
cugcuccgccagcaa

SEQ ID NO: 1703342 - RNA, 16 nt, Salmonella enterica enterica serovar Typhi
cugcucccucacgcgu

SEQ ID NO: 1703343 - RNA, 20 nt, Salmonella enterica enterica serovar Typhi
cugcucagaaauauucagua

SEQ ID NO: 1703344 - RNA, 23 nt, Salmonella enterica enterica serovar Typhi
cugcuccugccagauuuucuuua

SEQ ID NO: 1703345 - RNA, 18 nt, Salmonella enterica enterica serovar Typhi
cugcucgaagaugaggag

SEQ ID NO: 1703346 - RNA, 19 nt, Salmonella enterica enterica serovar Typhi
cugcugaaagccgcgacgg

SEQ ID NO: 1703347 - RNA, 20 nt, Salmonella enterica enterica serovar Typhi
cugcugaaaaagaacaauaa

SEQ ID NO: 1703348 - RNA, 19 nt, Salmonella enterica enterica serovar Typhi
aaacuauuuuuagcccuug

SEQ ID NO: 1703349 - RNA, 14 nt, Salmonella enterica enterica serovar Typhi
aaacucaaucaggc

SEQ ID NO: 1703350 - RNA, 14 nt, Salmonella enterica enterica serovar Typhi
cugcugccagccgc

SEQ ID NO: 1703351 - RNA, 18 nt, Salmonella enterica enterica serovar Typhi
cugcugccagcgccgccg

SEQ ID NO: 1703352 - RNA, 18 nt, Salmonella enterica enterica serovar Typhi
cugcugccagccgccgcc

SEQ ID NO: 1703353 - RNA, 16 nt, Salmonella enterica enterica serovar Typhi
cugcugcgcuuugaca

SEQ ID NO: 1703354 - RNA, 14 nt, Salmonella enterica enterica serovar Typhi
cugcugcgcgugcu

SEQ ID NO: 1703355 - RNA, 15 nt, Salmonella enterica enterica serovar Typhi
cugcugccgcagcac

SEQ ID NO: 1703356 - RNA, 12 nt, Salmonella enterica enterica serovar Typhi
cugcugcgccuu

SEQ ID NO: 1703357 - RNA, 16 nt, Salmonella enterica enterica serovar Typhi
cugcugcgccuuuacc

SEQ ID NO: 1703358 - RNA, 15 nt, Salmonella enterica enterica serovar Typhi
cugcggcgucugccu

SEQ ID NO: 1703359 - RNA, 15 nt, Salmonella enterica enterica serovar Typhi
cugcggcucgccaau

SEQ ID NO: 1703360 - RNA, 20 nt, Salmonella enterica enterica serovar Typhi
cugcggcuauauaaaaucgg

SEQ ID NO: 1703361 - RNA, 23 nt, Salmonella enterica enterica serovar Typhi
cugcggcggcggaaaauagccag

SEQ ID NO: 1703362 - RNA, 19 nt, Salmonella enterica enterica serovar Typhi
cugcgcguucugcuccaga

SEQ ID NO: 1703363 - RNA, 21 nt, Salmonella enterica enterica serovar Typhi
cugcgcuucgaugcguucaaa

SEQ ID NO: 1703364 - RNA, 18 nt, Salmonella enterica enterica serovar Typhi
cugcgcuucuauccacug

SEQ ID NO: 1703365 - RNA, 19 nt, Salmonella enterica enterica serovar Typhi
cugcgcuuaucaggccuac

SEQ ID NO: 1703366 - RNA, 24 nt, Salmonella enterica enterica serovar Typhi
cugcgcuuaucaggccuaccagcc

SEQ ID NO: 1703367 - RNA, 18 nt, Salmonella enterica enterica serovar Typhi
cugcgcuuaccgggccua

SEQ ID NO: 1703368 - RNA, 18 nt, Salmonella enterica enterica serovar Typhi
cugcgcuuaucaggccua

SEQ ID NO: 1703369 - RNA, 17 nt, Salmonella enterica enterica serovar Typhi
cugcgcugacggcggca

SEQ ID NO: 1703370 - RNA, 22 nt, Salmonella enterica enterica serovar Typhi
cugcucaagaauacccuuuaca

SEQ ID NO: 1703371 - RNA, 20 nt, Salmonella enterica enterica serovar Typhi
cugcguugcucgccagccug

SEQ ID NO: 1703372 - RNA, 22 nt, Salmonella enterica enterica serovar Typhi
cugcgucacgcgcaaagcugcg

SEQ ID NO: 1703373 - RNA, 17 nt, Salmonella enterica enterica serovar Typhi
cugcguaaaaucagcau

SEQ ID NO: 1703374 - RNA, 15 nt, Salmonella enterica enterica serovar Typhi
cugcauuugcugccg

SEQ ID NO: 1703375 - RNA, 20 nt, Salmonella enterica enterica serovar Typhi
cugcauucaggccucugcuu

SEQ ID NO: 1703376 - RNA, 16 nt, Salmonella enterica enterica serovar Typhi
cugcaucuuacugacc

SEQ ID NO: 1703377 - RNA, 21 nt, Salmonella enterica enterica serovar Typhi
cugcacaacauuccgcuucca

SEQ ID NO: 1703378 - RNA, 19 nt, Salmonella enterica enterica serovar Typhi
cugcacaaucgccagcccc

SEQ ID NO: 1703379 - RNA, 20 nt, Salmonella enterica enterica serovar Typhi
cugcaaugguaaaacgcugg

SEQ ID NO: 1703380 - RNA, 17 nt, Salmonella enterica enterica serovar Typhi
cugcacaauaccaauaa

SEQ ID NO: 1703381 - RNA, 22 nt, Salmonella enterica enterica serovar Typhi
cugcaggguuugcgcagacugc

SEQ ID NO: 1703382 - RNA, 14 nt, Salmonella enterica enterica serovar Typhi
cugcaggucacgau

SEQ ID NO: 1703383 - RNA, 11 nt, Salmonella enterica enterica serovar Typhi
cugcccgccgc

SEQ ID NO: 1703384 - RNA, 13 nt, Salmonella enterica enterica serovar Typhi
cugcccgccgccg

SEQ ID NO: 1703385 - RNA, 17 nt, Salmonella enterica enterica serovar Typhi
cugcccgccgccaccau

SEQ ID NO: 1703386 - RNA, 13 nt, Salmonella enterica enterica serovar Typhi
cugcccgccaggg

SEQ ID NO: 1703387 - RNA, 16 nt, Salmonella enterica enterica serovar Typhi
cugcccgcguuuccac

SEQ ID NO: 1703388 - RNA, 23 nt, Salmonella enterica enterica serovar Typhi
cugccgaugaaagagcgcgcgcg

SEQ ID NO: 1703389 - RNA, 17 nt, Salmonella enterica enterica serovar Typhi
cugccgcaaacgccugc

SEQ ID NO: 1703390 - RNA, 15 nt, Salmonella enterica enterica serovar Typhi
cugccccagacgccc

SEQ ID NO: 1703391 - RNA, 22 nt, Salmonella enterica enterica serovar Typhi
cugcccaucuaaccgggccuga

SEQ ID NO: 1703392 - RNA, 15 nt, Salmonella enterica enterica serovar Typhi
cugccaucauccagu

SEQ ID NO: 1703393 - RNA, 13 nt, Salmonella enterica enterica serovar Typhi
cugcccaccuucg

SEQ ID NO: 1703394 - RNA, 12 nt, Salmonella enterica enterica serovar Typhi
cugccaucaucc

SEQ ID NO: 1703395 - RNA, 22 nt, Salmonella enterica enterica serovar Typhi
cugccagcagaagacggaaacc

SEQ ID NO: 1703396 - RNA, 20 nt, Salmonella enterica enterica serovar Typhi
cugccaaugaaauaauugug

SEQ ID NO: 1703397 - RNA, 13 nt, Salmonella enterica enterica serovar Typhi
cugccacaacggc

SEQ ID NO: 1703398 - RNA, 23 nt, Salmonella enterica enterica serovar Typhi
cugccacaacggcaauuuuuaca

SEQ ID NO: 1703399 - RNA, 17 nt, Salmonella enterica enterica serovar Typhi
cugccacacucucucca

SEQ ID NO: 1703400 - RNA, 14 nt, Salmonella enterica enterica serovar Typhi
cugccacaggccaa

SEQ ID NO: 1703401 - RNA, 20 nt, Salmonella enterica enterica serovar Typhi
cugcgcauacgucaugccuu

SEQ ID NO: 1703402 - RNA, 17 nt, Salmonella enterica enterica serovar Typhi
cugcgcauccgcggcgc

SEQ ID NO: 1703403 - RNA, 20 nt, Salmonella enterica enterica serovar Typhi
cugcgcaacauucugcuucc

SEQ ID NO: 1703404 - RNA, 14 nt, Salmonella enterica enterica serovar Typhi
cugcgcaaucauga

SEQ ID NO: 1703405 - RNA, 13 nt, Salmonella enterica enterica serovar Typhi
cugccugcagacc

SEQ ID NO: 1703406 - RNA, 12 nt, Salmonella enterica enterica serovar Typhi
cugccugcuuca

SEQ ID NO: 1703407 - RNA, 13 nt, Salmonella enterica enterica serovar Typhi
cugccugcuucag

SEQ ID NO: 1703408 - RNA, 22 nt, Salmonella enterica enterica serovar Typhi
cugccuggcucauucuccggga

SEQ ID NO: 1703409 - RNA, 18 nt, Salmonella enterica enterica serovar Typhi
cugccuguuuacggcagg

SEQ ID NO: 1703410 - RNA, 17 nt, Salmonella enterica enterica serovar Typhi
cugccuuauccggccug

SEQ ID NO: 1703411 - RNA, 18 nt, Salmonella enterica enterica serovar Typhi
cugccgggguaucauaaa

SEQ ID NO: 1703412 - RNA, 23 nt, Salmonella enterica enterica serovar Typhi
cugccggcuuaccagcgggccgc

SEQ ID NO: 1703413 - RNA, 16 nt, Salmonella enterica enterica serovar Typhi
cugccgggagcagauu

SEQ ID NO: 1703414 - RNA, 16 nt, Salmonella enterica enterica serovar Typhi
cugccgggacuuuaaa

SEQ ID NO: 1703415 - RNA, 14 nt, Salmonella enterica enterica serovar Typhi
cugccgccacgccg

SEQ ID NO: 1703416 - RNA, 22 nt, Salmonella enterica enterica serovar Typhi
cugccgccauaacgccggcgcu

SEQ ID NO: 1703417 - RNA, 15 nt, Salmonella enterica enterica serovar Typhi
cugccgcagccgcuc

SEQ ID NO: 1703418 - RNA, 16 nt, Salmonella enterica enterica serovar Typhi
cugccuaaauugacgc

SEQ ID NO: 1703419 - RNA, 23 nt, Salmonella enterica enterica serovar Typhi
cugccucaacaaguccuucuucc

SEQ ID NO: 1703420 - RNA, 19 nt, Salmonella enterica enterica serovar Typhi
cugccguuaaucuggccua

SEQ ID NO: 1703421 - RNA, 19 nt, Salmonella enterica enterica serovar Typhi
cugccggucggcgucugau

SEQ ID NO: 1703422 - RNA, 15 nt, Salmonella enterica enterica serovar Typhi
cugcgccugcucagc

SEQ ID NO: 1703423 - RNA, 22 nt, Salmonella enterica enterica serovar Typhi
cugcgccuggaaaaaagcgccc

SEQ ID NO: 1703424 - RNA, 17 nt, Salmonella enterica enterica serovar Typhi
cugcgcgucccucucca

SEQ ID NO: 1703425 - RNA, 15 nt, Salmonella enterica enterica serovar Typhi
cugcgcggccugcgc

SEQ ID NO: 1703426 - RNA, 20 nt, Salmonella enterica enterica serovar Typhi
cugcgcggcaaugagcggcc

SEQ ID NO: 1703427 - RNA, 20 nt, Salmonella enterica enterica serovar Typhi
cugcgcgcgaugcugcucca

SEQ ID NO: 1703428 - RNA, 15 nt, Salmonella enterica enterica serovar Typhi
cugcgcgccugcgcu

SEQ ID NO: 1703429 - RNA, 12 nt, Salmonella enterica enterica serovar Typhi
cugcgcgccgga

SEQ ID NO: 1703430 - RNA, 13 nt, Salmonella enterica enterica serovar Typhi
cugcgccagcaug

SEQ ID NO: 1703431 - RNA, 14 nt, Salmonella enterica enterica serovar Typhi
cugcgccagaucag

SEQ ID NO: 1703432 - RNA, 16 nt, Salmonella enterica enterica serovar Typhi
cugcgccagccugcug

SEQ ID NO: 1703433 - RNA, 14 nt, Salmonella enterica enterica serovar Typhi
cugcgccagcucau

SEQ ID NO: 1703434 - RNA, 15 nt, Salmonella enterica enterica serovar Typhi
cugcgccagcggcac

SEQ ID NO: 1703435 - RNA, 22 nt, Salmonella enterica enterica serovar Typhi
cugcgccauauccucgcugggc

SEQ ID NO: 1703436 - RNA, 18 nt, Salmonella enterica enterica serovar Typhi
cugcgccauugcgggagc

SEQ ID NO: 1703437 - RNA, 23 nt, Salmonella enterica enterica serovar Typhi
cugcgccauugcgggagcuugcc

SEQ ID NO: 1703438 - RNA, 13 nt, Salmonella enterica enterica serovar Typhi
cugcgccgccagc

SEQ ID NO: 1703439 - RNA, 16 nt, Salmonella enterica enterica serovar Typhi
cugcgccgcaucgcca

SEQ ID NO: 1703440 - RNA, 16 nt, Salmonella enterica enterica serovar Typhi
cugcgcccgcaagcug

SEQ ID NO: 1703441 - RNA, 14 nt, Salmonella enterica enterica serovar Typhi
cugcgcccgccugc

SEQ ID NO: 1703442 - RNA, 16 nt, Salmonella enterica enterica serovar Typhi
cuaccuucuucccaua

SEQ ID NO: 1703443 - RNA, 13 nt, Salmonella enterica enterica serovar Typhi
cuacuacauaucu

SEQ ID NO: 1703444 - RNA, 23 nt, Salmonella enterica enterica serovar Typhi
cuaacagucgcgccgugcccagc

SEQ ID NO: 1703445 - RNA, 22 nt, Salmonella enterica enterica serovar Typhi
cuaacaucauucccguaucuuc

SEQ ID NO: 1703446 - RNA, 23 nt, Salmonella enterica enterica serovar Typhi
cuacucguaaucuaaaauuauuu

SEQ ID NO: 1703447 - RNA, 21 nt, Salmonella enterica enterica serovar Typhi
cuagaugaugauuuaugaaua

SEQ ID NO: 1703448 - RNA, 14 nt, Salmonella enterica enterica serovar Typhi
cuacuuuuacccuu

SEQ ID NO: 1703449 - RNA, 17 nt, Salmonella enterica enterica serovar Typhi
cuacuucaauuuuccag

SEQ ID NO: 1703450 - RNA, 16 nt, Salmonella enterica enterica serovar Typhi
cuagcgucccggcaau

SEQ ID NO: 1703451 - RNA, 14 nt, Salmonella enterica enterica serovar Typhi
cuagcugcagcgcu

SEQ ID NO: 1703452 - RNA, 20 nt, Salmonella enterica enterica serovar Typhi
cuagcacuacggcaaacaca

SEQ ID NO: 1703453 - RNA, 18 nt, Salmonella enterica enterica serovar Typhi
cuagauuuuagaaaauaa

SEQ ID NO: 1703454 - RNA, 20 nt, Salmonella enterica enterica serovar Typhi
cuagauuuuagaaaauaauu

SEQ ID NO: 1703455 - RNA, 23 nt, Salmonella enterica enterica serovar Typhi
cuaggcgcugcuggcagcgcuga

SEQ ID NO: 1703456 - RNA, 19 nt, Salmonella enterica enterica serovar Typhi
cuaggccagugccaagcaa

SEQ ID NO: 1703457 - RNA, 15 nt, Salmonella enterica enterica serovar Typhi
cuagggcaucagacg

SEQ ID NO: 1703458 - RNA, 19 nt, Salmonella enterica enterica serovar Typhi
cuaguaaagaaauuuugca

SEQ ID NO: 1703459 - RNA, 18 nt, Salmonella enterica enterica serovar Typhi
cuauacgguaaaucauuu

SEQ ID NO: 1703460 - RNA, 12 nt, Salmonella enterica enterica serovar Typhi
cuauacaguaaa

SEQ ID NO: 1703461 - RNA, 15 nt, Salmonella enterica enterica serovar Typhi
cuauaugcaggcaua

SEQ ID NO: 1703462 - RNA, 20 nt, Salmonella enterica enterica serovar Typhi
cuauaugcaggcauaaaaaa

SEQ ID NO: 1703463 - RNA, 17 nt, Salmonella enterica enterica serovar Typhi
cuauauggcgcaagugu

SEQ ID NO: 1703464 - RNA, 12 nt, Salmonella enterica enterica serovar Typhi
cuaugguacaca

SEQ ID NO: 1703465 - RNA, 22 nt, Salmonella enterica enterica serovar Typhi
cuaugguacggcguguuuaacu

SEQ ID NO: 1703466 - RNA, 20 nt, Salmonella enterica enterica serovar Typhi
cuauguaaagaaugaaaaaa

SEQ ID NO: 1703467 - RNA, 18 nt, Salmonella enterica enterica serovar Typhi
cuauguacgccaagcugc

SEQ ID NO: 1703468 - RNA, 19 nt, Salmonella enterica enterica serovar Typhi
cuauguacgccaagcugca

SEQ ID NO: 1703469 - RNA, 16 nt, Salmonella enterica enterica serovar Typhi
cuauguuugcugagaa

SEQ ID NO: 1703470 - RNA, 22 nt, Salmonella enterica enterica serovar Typhi
cuaugauggccgacuggcacca

SEQ ID NO: 1703471 - RNA, 16 nt, Salmonella enterica enterica serovar Typhi
cuaugcaaaagaaaaa

SEQ ID NO: 1703472 - RNA, 20 nt, Salmonella enterica enterica serovar Typhi
cuaucggcaaaccaugaucg

SEQ ID NO: 1703473 - RNA, 19 nt, Salmonella enterica enterica serovar Typhi
cuaucaguagcuuuuccgc

SEQ ID NO: 1703474 - RNA, 16 nt, Salmonella enterica enterica serovar Typhi
cuaucagaaaaaauua

SEQ ID NO: 1703475 - RNA, 22 nt, Salmonella enterica enterica serovar Typhi
cuaucaccgcgaugaccaucaa

SEQ ID NO: 1703476 - RNA, 11 nt, Salmonella enterica enterica serovar Typhi
cuauccacgca

SEQ ID NO: 1703477 - RNA, 17 nt, Salmonella enterica enterica serovar Typhi
cuauccagcaguaaaua

SEQ ID NO: 1703478 - RNA, 21 nt, Salmonella enterica enterica serovar Typhi
cuauccgccgccagccauaaa

SEQ ID NO: 1703479 - RNA, 22 nt, Salmonella enterica enterica serovar Typhi
cuauccguccucuuucccuuuu

SEQ ID NO: 1703480 - RNA, 18 nt, Salmonella enterica enterica serovar Typhi
cuauccgaugaagccugg

SEQ ID NO: 1703481 - RNA, 22 nt, Salmonella enterica enterica serovar Typhi
cuaucgcccaaauaguccagca

SEQ ID NO: 1703482 - RNA, 16 nt, Salmonella enterica enterica serovar Typhi
cuaucgccaaacuggu

SEQ ID NO: 1703483 - RNA, 12 nt, Salmonella enterica enterica serovar Typhi
cuaucgccgccc

SEQ ID NO: 1703484 - RNA, 15 nt, Salmonella enterica enterica serovar Typhi
cuaucgccuggagcu

SEQ ID NO: 1703485 - RNA, 17 nt, Salmonella enterica enterica serovar Typhi
cuauccguuuugacgac

SEQ ID NO: 1703486 - RNA, 14 nt, Salmonella enterica enterica serovar Typhi
cucacauaacaaaa

SEQ ID NO: 1703487 - RNA, 15 nt, Salmonella enterica enterica serovar Typhi
cucaccccuucuuua

SEQ ID NO: 1703488 - RNA, 19 nt, Salmonella enterica enterica serovar Typhi
cucaauaaaaugucuguuu

SEQ ID NO: 1703489 - RNA, 16 nt, Salmonella enterica enterica serovar Typhi
cucacguuccccagca

SEQ ID NO: 1703490 - RNA, 13 nt, Salmonella enterica enterica serovar Typhi
cucaccucccccg

SEQ ID NO: 1703491 - RNA, 17 nt, Salmonella enterica enterica serovar Typhi
cucaccugguaagcgcc

SEQ ID NO: 1703492 - RNA, 14 nt, Salmonella enterica enterica serovar Typhi
cucaccugaugcga

SEQ ID NO: 1703493 - RNA, 19 nt, Salmonella enterica enterica serovar Typhi
cucacgauaacgcagcgcg

SEQ ID NO: 1703494 - RNA, 22 nt, Salmonella enterica enterica serovar Typhi
cucacgaaguuuacguugguau

SEQ ID NO: 1703495 - RNA, 15 nt, Salmonella enterica enterica serovar Typhi
cucaccgaccugccu

SEQ ID NO: 1703496 - RNA, 18 nt, Salmonella enterica enterica serovar Typhi
cucaacauacgccgccag

SEQ ID NO: 1703497 - RNA, 13 nt, Salmonella enterica enterica serovar Typhi
cucaacaucauua

SEQ ID NO: 1703498 - RNA, 14 nt, Salmonella enterica enterica serovar Typhi
cucaacaucauuaa

SEQ ID NO: 1703499 - RNA, 16 nt, Salmonella enterica enterica serovar Typhi
cucaaccgguuuguca

SEQ ID NO: 1703500 - RNA, 18 nt, Salmonella enterica enterica serovar Typhi
cucaaccugaggaaaaag

SEQ ID NO: 1703501 - RNA, 21 nt, Salmonella enterica enterica serovar Typhi
cucaaccaccaccgauaaacg

SEQ ID NO: 1703502 - RNA, 23 nt, Salmonella enterica enterica serovar Typhi
cucaaccaugauaaccagccccg

SEQ ID NO: 1703503 - RNA, 21 nt, Salmonella enterica enterica serovar Typhi
cucaacauugccggcaucauu

SEQ ID NO: 1703504 - RNA, 13 nt, Salmonella enterica enterica serovar Typhi
cuauuacaaaaau

SEQ ID NO: 1703505 - RNA, 18 nt, Salmonella enterica enterica serovar Typhi
cuauuaaucugugagcac

SEQ ID NO: 1703506 - RNA, 13 nt, Salmonella enterica enterica serovar Typhi
cuauuaaucaccu

SEQ ID NO: 1703507 - RNA, 16 nt, Salmonella enterica enterica serovar Typhi
cucaagcggcaccaca

SEQ ID NO: 1703508 - RNA, 21 nt, Salmonella enterica enterica serovar Typhi
cucaaggcuauuagccaaagc

SEQ ID NO: 1703509 - RNA, 20 nt, Salmonella enterica enterica serovar Typhi
cucaagguagcgugucuacc

SEQ ID NO: 1703510 - RNA, 22 nt, Salmonella enterica enterica serovar Typhi
cucaagguagcgugucuaccaa

SEQ ID NO: 1703511 - RNA, 15 nt, Salmonella enterica enterica serovar Typhi
cucaaggucugucag

SEQ ID NO: 1703512 - RNA, 13 nt, Salmonella enterica enterica serovar Typhi
cucaacgcccugc

SEQ ID NO: 1703513 - RNA, 15 nt, Salmonella enterica enterica serovar Typhi
cucaacgcccugcuc

SEQ ID NO: 1703514 - RNA, 23 nt, Salmonella enterica enterica serovar Typhi
cucaacgcgcccagauuggugau

SEQ ID NO: 1703515 - RNA, 13 nt, Salmonella enterica enterica serovar Typhi
cucauccagcaac

SEQ ID NO: 1703516 - RNA, 21 nt, Salmonella enterica enterica serovar Typhi
cucauccagauguuauaaacu

SEQ ID NO: 1703517 - RNA, 24 nt, Salmonella enterica enterica serovar Typhi
cucauccaacugcgccugaagaua

SEQ ID NO: 1703518 - RNA, 15 nt, Salmonella enterica enterica serovar Typhi
cucaucagaccguga

SEQ ID NO: 1703519 - RNA, 15 nt, Salmonella enterica enterica serovar Typhi
cucaucacccagucg

SEQ ID NO: 1703520 - RNA, 22 nt, Salmonella enterica enterica serovar Typhi
cucaucaauucuuuaauuugug

SEQ ID NO: 1703521 - RNA, 17 nt, Salmonella enterica enterica serovar Typhi
cucaucacagccacacu

SEQ ID NO: 1703522 - RNA, 16 nt, Salmonella enterica enterica serovar Typhi
cucaucaaacagcggc

SEQ ID NO: 1703523 - RNA, 17 nt, Salmonella enterica enterica serovar Typhi
cucaucuucuuuuuccg

SEQ ID NO: 1703524 - RNA, 19 nt, Salmonella enterica enterica serovar Typhi
cucaucuucuuuuuccgga

SEQ ID NO: 1703525 - RNA, 14 nt, Salmonella enterica enterica serovar Typhi
cucaucuugcagga

SEQ ID NO: 1703526 - RNA, 17 nt, Salmonella enterica enterica serovar Typhi
cucaucggucgcaucca

SEQ ID NO: 1703527 - RNA, 19 nt, Salmonella enterica enterica serovar Typhi
cucaguugguuagagcaca

SEQ ID NO: 1703528 - RNA, 16 nt, Salmonella enterica enterica serovar Typhi
cucaguccagccgccg

SEQ ID NO: 1703529 - RNA, 14 nt, Salmonella enterica enterica serovar Typhi
cucagucagucccg

SEQ ID NO: 1703530 - RNA, 16 nt, Salmonella enterica enterica serovar Typhi
cucauagccgcuuucc

SEQ ID NO: 1703531 - RNA, 16 nt, Salmonella enterica enterica serovar Typhi
cucauaaugauggggu

SEQ ID NO: 1703532 - RNA, 17 nt, Salmonella enterica enterica serovar Typhi
cucauaaaacauuccug

SEQ ID NO: 1703533 - RNA, 22 nt, Salmonella enterica enterica serovar Typhi
cucauaaaacauuccugacauu

SEQ ID NO: 1703534 - RNA, 22 nt, Salmonella enterica enterica serovar Typhi
cucagguuauacugugacgaca

SEQ ID NO: 1703535 - RNA, 21 nt, Salmonella enterica enterica serovar Typhi
cucaggguuuuacgcuggaca

SEQ ID NO: 1703536 - RNA, 18 nt, Salmonella enterica enterica serovar Typhi
cucagggcaaaaaugauc

SEQ ID NO: 1703537 - RNA, 24 nt, Salmonella enterica enterica serovar Typhi
cucagcaaaaucacgcacacgucu

SEQ ID NO: 1703538 - RNA, 17 nt, Salmonella enterica enterica serovar Typhi
cucagaucggcagacag

SEQ ID NO: 1703539 - RNA, 19 nt, Salmonella enterica enterica serovar Typhi
cucagaccauauucacgca

SEQ ID NO: 1703540 - RNA, 22 nt, Salmonella enterica enterica serovar Typhi
cucagaccgaucucaugcaacu

SEQ ID NO: 1703541 - RNA, 23 nt, Salmonella enterica enterica serovar Typhi
cuccgcaaagcccaucagcgcca

SEQ ID NO: 1703542 - RNA, 21 nt, Salmonella enterica enterica serovar Typhi
cuccgaaacaaucaccugaug

SEQ ID NO: 1703543 - RNA, 21 nt, Salmonella enterica enterica serovar Typhi
cuccgccgcuuuaucguaacc

SEQ ID NO: 1703544 - RNA, 16 nt, Salmonella enterica enterica serovar Typhi
cuccgcgagcagccaa

SEQ ID NO: 1703545 - RNA, 14 nt, Salmonella enterica enterica serovar Typhi
cuccgcgcuggcaa

SEQ ID NO: 1703546 - RNA, 21 nt, Salmonella enterica enterica serovar Typhi
cuccgcgcauguaaccaaagc

SEQ ID NO: 1703547 - RNA, 19 nt, Salmonella enterica enterica serovar Typhi
cuccgcgcauguaaccaaa

SEQ ID NO: 1703548 - RNA, 15 nt, Salmonella enterica enterica serovar Typhi
cuccgcgcuggcaau

SEQ ID NO: 1703549 - RNA, 21 nt, Salmonella enterica enterica serovar Typhi
cucccgcugcggcguggagca

SEQ ID NO: 1703550 - RNA, 13 nt, Salmonella enterica enterica serovar Typhi
cucccuccugcuc

SEQ ID NO: 1703551 - RNA, 18 nt, Salmonella enterica enterica serovar Typhi
cucccugagucuugccug

SEQ ID NO: 1703552 - RNA, 17 nt, Salmonella enterica enterica serovar Typhi
cucccugccuaaagaaa

SEQ ID NO: 1703553 - RNA, 22 nt, Salmonella enterica enterica serovar Typhi
cuccccugucguuaaugggauc

SEQ ID NO: 1703554 - RNA, 13 nt, Salmonella enterica enterica serovar Typhi
cucccagcugagc

SEQ ID NO: 1703555 - RNA, 20 nt, Salmonella enterica enterica serovar Typhi
cucccacucuuccagcaccg

SEQ ID NO: 1703556 - RNA, 23 nt, Salmonella enterica enterica serovar Typhi
cucccaacagacgaucuacggua

SEQ ID NO: 1703557 - RNA, 15 nt, Salmonella enterica enterica serovar Typhi
cucccaaauuuuuuu

SEQ ID NO: 1703558 - RNA, 22 nt, Salmonella enterica enterica serovar Typhi
cuccagcgggcuggcauucauu

SEQ ID NO: 1703559 - RNA, 16 nt, Salmonella enterica enterica serovar Typhi
cuccaggccaagcgcc

SEQ ID NO: 1703560 - RNA, 14 nt, Salmonella enterica enterica serovar Typhi
cucaugcguaaauc

SEQ ID NO: 1703561 - RNA, 19 nt, Salmonella enterica enterica serovar Typhi
cucaugccguagaacagca

SEQ ID NO: 1703562 - RNA, 11 nt, Salmonella enterica enterica serovar Typhi
cucaugccucg

SEQ ID NO: 1703563 - RNA, 18 nt, Salmonella enterica enterica serovar Typhi
cucauguaaaggcgugug

SEQ ID NO: 1703564 - RNA, 15 nt, Salmonella enterica enterica serovar Typhi
cucauggacaaaaaa

SEQ ID NO: 1703565 - RNA, 15 nt, Salmonella enterica enterica serovar Typhi
cucauguucgcuucu

SEQ ID NO: 1703566 - RNA, 18 nt, Salmonella enterica enterica serovar Typhi
cuccagcgccagcuccau

SEQ ID NO: 1703567 - RNA, 21 nt, Salmonella enterica enterica serovar Typhi
cucaugugcagcauccagcuc

SEQ ID NO: 1703568 - RNA, 15 nt, Salmonella enterica enterica serovar Typhi
cucauguucaagcug

SEQ ID NO: 1703569 - RNA, 16 nt, Salmonella enterica enterica serovar Typhi
cucaugugcagcaucc

SEQ ID NO: 1703570 - RNA, 13 nt, Salmonella enterica enterica serovar Typhi
cuccaucgcuuua

SEQ ID NO: 1703571 - RNA, 18 nt, Salmonella enterica enterica serovar Typhi
cuccaucgccagcacguu

SEQ ID NO: 1703572 - RNA, 19 nt, Salmonella enterica enterica serovar Typhi
cuccauaaauaacauuuca

SEQ ID NO: 1703573 - RNA, 12 nt, Salmonella enterica enterica serovar Typhi
cuccaguugaua

SEQ ID NO: 1703574 - RNA, 13 nt, Salmonella enterica enterica serovar Typhi
cuccauaauuuga

SEQ ID NO: 1703575 - RNA, 20 nt, Salmonella enterica enterica serovar Typhi
cuccauacccuauuuacaga

SEQ ID NO: 1703576 - RNA, 16 nt, Salmonella enterica enterica serovar Typhi
cuccaggcgaaucccc

SEQ ID NO: 1703577 - RNA, 16 nt, Salmonella enterica enterica serovar Typhi
cuccaggcguuuauga

SEQ ID NO: 1703578 - RNA, 17 nt, Salmonella enterica enterica serovar Typhi
cuccaguaauucccggc

SEQ ID NO: 1703579 - RNA, 12 nt, Salmonella enterica enterica serovar Typhi
cuccugcauuug

SEQ ID NO: 1703580 - RNA, 23 nt, Salmonella enterica enterica serovar Typhi
cuccugccugacaaugacgcuuc

SEQ ID NO: 1703581 - RNA, 20 nt, Salmonella enterica enterica serovar Typhi
cuccugcaucgauuccccac

SEQ ID NO: 1703582 - RNA, 20 nt, Salmonella enterica enterica serovar Typhi
cuccugccagauuuucuuua

SEQ ID NO: 1703583 - RNA, 20 nt, Salmonella enterica enterica serovar Typhi
cuccugacauagcucacgca

SEQ ID NO: 1703584 - RNA, 22 nt, Salmonella enterica enterica serovar Typhi
cuccugaauagcuuucaccggu

SEQ ID NO: 1703585 - RNA, 15 nt, Salmonella enterica enterica serovar Typhi
cuccuggcauggcuc

SEQ ID NO: 1703586 - RNA, 22 nt, Salmonella enterica enterica serovar Typhi
cuccuggcauggcucgccgcug

SEQ ID NO: 1703587 - RNA, 21 nt, Salmonella enterica enterica serovar Typhi
cuccugcggccuugccgccag

SEQ ID NO: 1703588 - RNA, 13 nt, Salmonella enterica enterica serovar Typhi
cuccggcaggcaa

SEQ ID NO: 1703589 - RNA, 18 nt, Salmonella enterica enterica serovar Typhi
cuccggcaggcaaaucug

SEQ ID NO: 1703590 - RNA, 15 nt, Salmonella enterica enterica serovar Typhi
cuccggccagcgcca

SEQ ID NO: 1703591 - RNA, 17 nt, Salmonella enterica enterica serovar Typhi
cuccggcgcgcgcgcca

SEQ ID NO: 1703592 - RNA, 17 nt, Salmonella enterica enterica serovar Typhi
cucgaauuguuaaaagc

SEQ ID NO: 1703593 - RNA, 16 nt, Salmonella enterica enterica serovar Typhi
cucgaaacgcugcgcu

SEQ ID NO: 1703594 - RNA, 23 nt, Salmonella enterica enterica serovar Typhi
cuccuuguaagggaggugcucuc

SEQ ID NO: 1703595 - RNA, 19 nt, Salmonella enterica enterica serovar Typhi
cuccuguugaagauuagcc

SEQ ID NO: 1703596 - RNA, 16 nt, Salmonella enterica enterica serovar Typhi
cuccuuguaagggagg

SEQ ID NO: 1703597 - RNA, 21 nt, Salmonella enterica enterica serovar Typhi
cuccuuguaagggaggugcuc

SEQ ID NO: 1703598 - RNA, 23 nt, Salmonella enterica enterica serovar Typhi
cuccuugcggugagaaacgcgcc

SEQ ID NO: 1703599 - RNA, 23 nt, Salmonella enterica enterica serovar Typhi
cuccuucuucgccgucauaaaac

SEQ ID NO: 1703600 - RNA, 21 nt, Salmonella enterica enterica serovar Typhi
cucgacguuuuccaucaccau

SEQ ID NO: 1703601 - RNA, 16 nt, Salmonella enterica enterica serovar Typhi
cucgacguccagcgcg

SEQ ID NO: 1703602 - RNA, 23 nt, Salmonella enterica enterica serovar Typhi
cucgauaucagggcuuuuuucuc

SEQ ID NO: 1703603 - RNA, 23 nt, Salmonella enterica enterica serovar Typhi
cucuccaguuugcguucacagca

SEQ ID NO: 1703604 - RNA, 14 nt, Salmonella enterica enterica serovar Typhi
cucucccagcugag

SEQ ID NO: 1703605 - RNA, 16 nt, Salmonella enterica enterica serovar Typhi
cucucccaggcauccu

SEQ ID NO: 1703606 - RNA, 17 nt, Salmonella enterica enterica serovar Typhi
cucucaccaguagcgcg

SEQ ID NO: 1703607 - RNA, 16 nt, Salmonella enterica enterica serovar Typhi
cucucaccgccuaggc

SEQ ID NO: 1703608 - RNA, 23 nt, Salmonella enterica enterica serovar Typhi
cucucaggcaguaacucaauauc

SEQ ID NO: 1703609 - RNA, 14 nt, Salmonella enterica enterica serovar Typhi
cucuccugaagcca

SEQ ID NO: 1703610 - RNA, 21 nt, Salmonella enterica enterica serovar Typhi
cucgucggcaagaauuucaau

SEQ ID NO: 1703611 - RNA, 18 nt, Salmonella enterica enterica serovar Typhi
cucuauaccauaaaugaa

SEQ ID NO: 1703612 - RNA, 20 nt, Salmonella enterica enterica serovar Typhi
cucuaucuuuucaaucaggu

SEQ ID NO: 1703613 - RNA, 18 nt, Salmonella enterica enterica serovar Typhi
cucuaugaaugccggaug

SEQ ID NO: 1703614 - RNA, 17 nt, Salmonella enterica enterica serovar Typhi
cucuaucagcgccuccg

SEQ ID NO: 1703615 - RNA, 14 nt, Salmonella enterica enterica serovar Typhi
cucuaucagcgccu

SEQ ID NO: 1703616 - RNA, 19 nt, Salmonella enterica enterica serovar Typhi
cucuauugauuggcaagaa

SEQ ID NO: 1703617 - RNA, 21 nt, Salmonella enterica enterica serovar Typhi
cucugcaaagaaauugggcuu

SEQ ID NO: 1703618 - RNA, 20 nt, Salmonella enterica enterica serovar Typhi
cucugauuucgacgauaaaa

SEQ ID NO: 1703619 - RNA, 23 nt, Salmonella enterica enterica serovar Typhi
cucugauuucgacgauaaaaaaa

SEQ ID NO: 1703620 - RNA, 18 nt, Salmonella enterica enterica serovar Typhi
cucugccgguugaccggc

SEQ ID NO: 1703621 - RNA, 19 nt, Salmonella enterica enterica serovar Typhi
cucugccgguugaccggcc

SEQ ID NO: 1703622 - RNA, 14 nt, Salmonella enterica enterica serovar Typhi
cucugccagcgccc

SEQ ID NO: 1703623 - RNA, 13 nt, Salmonella enterica enterica serovar Typhi
cucugccucagca

SEQ ID NO: 1703624 - RNA, 20 nt, Salmonella enterica enterica serovar Typhi
cucucgauaucggcaauauu

SEQ ID NO: 1703625 - RNA, 19 nt, Salmonella enterica enterica serovar Typhi
cucucgccgcgcuccauca

SEQ ID NO: 1703626 - RNA, 19 nt, Salmonella enterica enterica serovar Typhi
cucucucaaacuauuuuua

SEQ ID NO: 1703627 - RNA, 16 nt, Salmonella enterica enterica serovar Typhi
cucugaaucucuuccc

SEQ ID NO: 1703628 - RNA, 21 nt, Salmonella enterica enterica serovar Typhi
cucucuggcgcauuccagacc

SEQ ID NO: 1703629 - RNA, 19 nt, Salmonella enterica enterica serovar Typhi
cucucuuucaccagcgcca

SEQ ID NO: 1703630 - RNA, 20 nt, Salmonella enterica enterica serovar Typhi
cucucuuucaccagcgccag

SEQ ID NO: 1703631 - RNA, 21 nt, Salmonella enterica enterica serovar Typhi
cucggcagcaauacgcccgcc

SEQ ID NO: 1703632 - RNA, 18 nt, Salmonella enterica enterica serovar Typhi
cucggcauacaccgccag

SEQ ID NO: 1703633 - RNA, 13 nt, Salmonella enterica enterica serovar Typhi
cucgaucgccugg

SEQ ID NO: 1703634 - RNA, 14 nt, Salmonella enterica enterica serovar Typhi
cucgcguccccagc

SEQ ID NO: 1703635 - RNA, 23 nt, Salmonella enterica enterica serovar Typhi
cucgcguccccagccgaugaccc

SEQ ID NO: 1703636 - RNA, 11 nt, Salmonella enterica enterica serovar Typhi
cucgcuuguug

SEQ ID NO: 1703637 - RNA, 17 nt, Salmonella enterica enterica serovar Typhi
cucgcuuugccgccauc

SEQ ID NO: 1703638 - RNA, 16 nt, Salmonella enterica enterica serovar Typhi
cucgcucccuuccccc

SEQ ID NO: 1703639 - RNA, 17 nt, Salmonella enterica enterica serovar Typhi
cucgcucgcccaucacu

SEQ ID NO: 1703640 - RNA, 16 nt, Salmonella enterica enterica serovar Typhi
cucgcuacgcucgccc

SEQ ID NO: 1703641 - RNA, 23 nt, Salmonella enterica enterica serovar Typhi
cucguaucugucccagccuuccu

SEQ ID NO: 1703642 - RNA, 12 nt, Salmonella enterica enterica serovar Typhi
cucguauuauug

SEQ ID NO: 1703643 - RNA, 13 nt, Salmonella enterica enterica serovar Typhi
cucggcgagcagu

SEQ ID NO: 1703644 - RNA, 23 nt, Salmonella enterica enterica serovar Typhi
cucgggccuguuccggcgaggac

SEQ ID NO: 1703645 - RNA, 21 nt, Salmonella enterica enterica serovar Typhi
cgucgacaaagccgacgccac

SEQ ID NO: 1703646 - RNA, 20 nt, Salmonella enterica enterica serovar Typhi
cguccuucacguuauucgga

SEQ ID NO: 1703647 - RNA, 21 nt, Salmonella enterica enterica serovar Typhi
cguccugaaucgcuugcgcgu

SEQ ID NO: 1703648 - RNA, 16 nt, Salmonella enterica enterica serovar Typhi
cgucgacgccuuccac

SEQ ID NO: 1703649 - RNA, 14 nt, Salmonella enterica enterica serovar Typhi
cgucgaucagcgcg

SEQ ID NO: 1703650 - RNA, 16 nt, Salmonella enterica enterica serovar Typhi
cguccauaagcgcggc

SEQ ID NO: 1703651 - RNA, 12 nt, Salmonella enterica enterica serovar Typhi
cguccaggcucg

SEQ ID NO: 1703652 - RNA, 19 nt, Salmonella enterica enterica serovar Typhi
cguccagcgcgugaaccgu

SEQ ID NO: 1703653 - RNA, 18 nt, Salmonella enterica enterica serovar Typhi
cguccagccgcucuguau

SEQ ID NO: 1703654 - RNA, 16 nt, Salmonella enterica enterica serovar Typhi
cguccggcacgcgcag

SEQ ID NO: 1703655 - RNA, 23 nt, Salmonella enterica enterica serovar Typhi
cgucccacgcgccgccgaacaga

SEQ ID NO: 1703656 - RNA, 22 nt, Salmonella enterica enterica serovar Typhi
cguccgcuaaucucgaccuggc

SEQ ID NO: 1703657 - RNA, 14 nt, Salmonella enterica enterica serovar Typhi
cguccccagccaga

SEQ ID NO: 1703658 - RNA, 15 nt, Salmonella enterica enterica serovar Typhi
cguaguggcauggca

SEQ ID NO: 1703659 - RNA, 14 nt, Salmonella enterica enterica serovar Typhi
cguaugcagccagg

SEQ ID NO: 1703660 - RNA, 15 nt, Salmonella enterica enterica serovar Typhi
cguauaauccagcuu

SEQ ID NO: 1703661 - RNA, 22 nt, Salmonella enterica enterica serovar Typhi
cguaugacguggccagcaugcc

SEQ ID NO: 1703662 - RNA, 18 nt, Salmonella enterica enterica serovar Typhi
cgucaaaacuuauuuuau

SEQ ID NO: 1703663 - RNA, 15 nt, Salmonella enterica enterica serovar Typhi
cgucaaaacgcgcau

SEQ ID NO: 1703664 - RNA, 16 nt, Salmonella enterica enterica serovar Typhi
cgucaaacaguuccug

SEQ ID NO: 1703665 - RNA, 16 nt, Salmonella enterica enterica serovar Typhi
cguauucaccucccug

SEQ ID NO: 1703666 - RNA, 20 nt, Salmonella enterica enterica serovar Typhi
cguauuacaaguaauaaaau

SEQ ID NO: 1703667 - RNA, 13 nt, Salmonella enterica enterica serovar Typhi
cguauuagauaag

SEQ ID NO: 1703668 - RNA, 18 nt, Salmonella enterica enterica serovar Typhi
cguaaggauacucagcga

SEQ ID NO: 1703669 - RNA, 18 nt, Salmonella enterica enterica serovar Typhi
cguaaguuaaaacgccau

SEQ ID NO: 1703670 - RNA, 17 nt, Salmonella enterica enterica serovar Typhi
cguaauaaaauuuccca

SEQ ID NO: 1703671 - RNA, 17 nt, Salmonella enterica enterica serovar Typhi
cguaauauacgccaccu

SEQ ID NO: 1703672 - RNA, 15 nt, Salmonella enterica enterica serovar Typhi
cguaaucccgccagc

SEQ ID NO: 1703673 - RNA, 15 nt, Salmonella enterica enterica serovar Typhi
cguaauccggccugg

SEQ ID NO: 1703674 - RNA, 18 nt, Salmonella enterica enterica serovar Typhi
cguagcgagaaggcuuug

SEQ ID NO: 1703675 - RNA, 23 nt, Salmonella enterica enterica serovar Typhi
cguagcgaauaaucccggcgcca

SEQ ID NO: 1703676 - RNA, 14 nt, Salmonella enterica enterica serovar Typhi
cguaaucggccugu

SEQ ID NO: 1703677 - RNA, 19 nt, Salmonella enterica enterica serovar Typhi
cguagcgaauaaucccggc

SEQ ID NO: 1703678 - RNA, 13 nt, Salmonella enterica enterica serovar Typhi
cguagcuccagac

SEQ ID NO: 1703679 - RNA, 15 nt, Salmonella enterica enterica serovar Typhi
cguagcgcguucagg

SEQ ID NO: 1703680 - RNA, 17 nt, Salmonella enterica enterica serovar Typhi
cguagcguugccaaaag

SEQ ID NO: 1703681 - RNA, 14 nt, Salmonella enterica enterica serovar Typhi
cgucacagaccccg

SEQ ID NO: 1703682 - RNA, 13 nt, Salmonella enterica enterica serovar Typhi
cgucaccagcagg

SEQ ID NO: 1703683 - RNA, 22 nt, Salmonella enterica enterica serovar Typhi
cgucaccacgguguaccccgcc

SEQ ID NO: 1703684 - RNA, 18 nt, Salmonella enterica enterica serovar Typhi
cgucaccaccgcaggcag

SEQ ID NO: 1703685 - RNA, 16 nt, Salmonella enterica enterica serovar Typhi
cgucacccgccggcag

SEQ ID NO: 1703686 - RNA, 17 nt, Salmonella enterica enterica serovar Typhi
cgucacccgccggcagc

SEQ ID NO: 1703687 - RNA, 23 nt, Salmonella enterica enterica serovar Typhi
cgucacccgccggcagcagcuuc

SEQ ID NO: 1703688 - RNA, 14 nt, Salmonella enterica enterica serovar Typhi
cgucaacgaccaga

SEQ ID NO: 1703689 - RNA, 20 nt, Salmonella enterica enterica serovar Typhi
cgucaaauucacccguuauu

SEQ ID NO: 1703690 - RNA, 21 nt, Salmonella enterica enterica serovar Typhi
cgucaaauagagaaaauaaca

SEQ ID NO: 1703691 - RNA, 14 nt, Salmonella enterica enterica serovar Typhi
cgucaagaucgcgc

SEQ ID NO: 1703692 - RNA, 21 nt, Salmonella enterica enterica serovar Typhi
cgucaaucaggaaagagccgc

SEQ ID NO: 1703693 - RNA, 19 nt, Salmonella enterica enterica serovar Typhi
cgucaauaaucgcgcgcgu

SEQ ID NO: 1703694 - RNA, 13 nt, Salmonella enterica enterica serovar Typhi
cgucagcgcgucg

SEQ ID NO: 1703695 - RNA, 19 nt, Salmonella enterica enterica serovar Typhi
cgucagcgcauaccggcca

SEQ ID NO: 1703696 - RNA, 15 nt, Salmonella enterica enterica serovar Typhi
cgucaguaaaagccc

SEQ ID NO: 1703697 - RNA, 18 nt, Salmonella enterica enterica serovar Typhi
cgucaguaaaagcccgcc

SEQ ID NO: 1703698 - RNA, 20 nt, Salmonella enterica enterica serovar Typhi
cgucagccacuucuuccagc

SEQ ID NO: 1703699 - RNA, 23 nt, Salmonella enterica enterica serovar Typhi
cgucagccacuucuuccagcggc

SEQ ID NO: 1703700 - RNA, 21 nt, Salmonella enterica enterica serovar Typhi
cgucacgccgacgaccggcag

SEQ ID NO: 1703701 - RNA, 13 nt, Salmonella enterica enterica serovar Typhi
cgguggcgcugcg

SEQ ID NO: 1703702 - RNA, 16 nt, Salmonella enterica enterica serovar Typhi
cgguggcgcugcgcuu

SEQ ID NO: 1703703 - RNA, 21 nt, Salmonella enterica enterica serovar Typhi
cggugcuuucgauaaucugac

SEQ ID NO: 1703704 - RNA, 20 nt, Salmonella enterica enterica serovar Typhi
cggugcuguagcugcccgga

SEQ ID NO: 1703705 - RNA, 17 nt, Salmonella enterica enterica serovar Typhi
cggugugaucaccgccc

SEQ ID NO: 1703706 - RNA, 19 nt, Salmonella enterica enterica serovar Typhi
cgguggugucaauggaugu

SEQ ID NO: 1703707 - RNA, 19 nt, Salmonella enterica enterica serovar Typhi
cggugucaaagcgccagau

SEQ ID NO: 1703708 - RNA, 16 nt, Salmonella enterica enterica serovar Typhi
cggugcucaauaaaag

SEQ ID NO: 1703709 - RNA, 16 nt, Salmonella enterica enterica serovar Typhi
cggugcggucacaggc

SEQ ID NO: 1703710 - RNA, 23 nt, Salmonella enterica enterica serovar Typhi
cggugccguuaauuuucacgcac

SEQ ID NO: 1703711 - RNA, 16 nt, Salmonella enterica enterica serovar Typhi
cggugccugccgccuc

SEQ ID NO: 1703712 - RNA, 19 nt, Salmonella enterica enterica serovar Typhi
cggugccauuccagccggu

SEQ ID NO: 1703713 - RNA, 23 nt, Salmonella enterica enterica serovar Typhi
cggugauauugccgaccgccagc

SEQ ID NO: 1703714 - RNA, 13 nt, Salmonella enterica enterica serovar Typhi
cggugaucccagg

SEQ ID NO: 1703715 - RNA, 14 nt, Salmonella enterica enterica serovar Typhi
cggugaucccacca

SEQ ID NO: 1703716 - RNA, 22 nt, Salmonella enterica enterica serovar Typhi
cggugaugcgccugucuccagc

SEQ ID NO: 1703717 - RNA, 18 nt, Salmonella enterica enterica serovar Typhi
cguaacuugauuccuggc

SEQ ID NO: 1703718 - RNA, 11 nt, Salmonella enterica enterica serovar Typhi
cguaagaaaag

SEQ ID NO: 1703719 - RNA, 14 nt, Salmonella enterica enterica serovar Typhi
cguaagaucccagg

SEQ ID NO: 1703720 - RNA, 21 nt, Salmonella enterica enterica serovar Typhi
cguaagcgcuaugcccaccgc

SEQ ID NO: 1703721 - RNA, 16 nt, Salmonella enterica enterica serovar Typhi
cguaacgcgcaucuuc

SEQ ID NO: 1703722 - RNA, 20 nt, Salmonella enterica enterica serovar Typhi
cguaacggcugacgcccauc

SEQ ID NO: 1703723 - RNA, 15 nt, Salmonella enterica enterica serovar Typhi
cguaacucggcagcg

SEQ ID NO: 1703724 - RNA, 21 nt, Salmonella enterica enterica serovar Typhi
cguaacugcgguaaauaaugc

SEQ ID NO: 1703725 - RNA, 15 nt, Salmonella enterica enterica serovar Typhi
cguaacguagcaauc

SEQ ID NO: 1703726 - RNA, 16 nt, Salmonella enterica enterica serovar Typhi
cguaacgucguaaauu

SEQ ID NO: 1703727 - RNA, 14 nt, Salmonella enterica enterica serovar Typhi
cguaaccgcaaaug

SEQ ID NO: 1703728 - RNA, 13 nt, Salmonella enterica enterica serovar Typhi
cguaacaggucac

SEQ ID NO: 1703729 - RNA, 12 nt, Salmonella enterica enterica serovar Typhi
cguaaagcuggc

SEQ ID NO: 1703730 - RNA, 15 nt, Salmonella enterica enterica serovar Typhi
cguaaaguucccagc

SEQ ID NO: 1703731 - RNA, 21 nt, Salmonella enterica enterica serovar Typhi
cguaaauaccaccugccaaag

SEQ ID NO: 1703732 - RNA, 14 nt, Salmonella enterica enterica serovar Typhi
cguaaauacccagg

SEQ ID NO: 1703733 - RNA, 17 nt, Salmonella enterica enterica serovar Typhi
cguaaauucccuccaga

SEQ ID NO: 1703734 - RNA, 20 nt, Salmonella enterica enterica serovar Typhi
cguaaauuccuuguuuuaac

SEQ ID NO: 1703735 - RNA, 14 nt, Salmonella enterica enterica serovar Typhi
cguaaaaacccuuu

SEQ ID NO: 1703736 - RNA, 14 nt, Salmonella enterica enterica serovar Typhi
cgguuuuccggguc

SEQ ID NO: 1703737 - RNA, 13 nt, Salmonella enterica enterica serovar Typhi
cgguuuugcgcug

SEQ ID NO: 1703738 - RNA, 19 nt, Salmonella enterica enterica serovar Typhi
cgguuuguaagugcccgga

SEQ ID NO: 1703739 - RNA, 20 nt, Salmonella enterica enterica serovar Typhi
cgguuugggcgcgaaacugc

SEQ ID NO: 1703740 - RNA, 21 nt, Salmonella enterica enterica serovar Typhi
cgguuuuauuaacgugcugcc

SEQ ID NO: 1703741 - RNA, 17 nt, Salmonella enterica enterica serovar Typhi
cgguuuuauccccuuca

SEQ ID NO: 1703742 - RNA, 22 nt, Salmonella enterica enterica serovar Typhi
cgguuuuauaguagcgcgcgcu

SEQ ID NO: 1703743 - RNA, 18 nt, Salmonella enterica enterica serovar Typhi
cguaaacacguuaucuga

SEQ ID NO: 1703744 - RNA, 16 nt, Salmonella enterica enterica serovar Typhi
cguaaacggcagccgc

SEQ ID NO: 1703745 - RNA, 18 nt, Salmonella enterica enterica serovar Typhi
cguaaagcaucagacuac

SEQ ID NO: 1703746 - RNA, 16 nt, Salmonella enterica enterica serovar Typhi
cguaaagcgcauccag

SEQ ID NO: 1703747 - RNA, 22 nt, Salmonella enterica enterica serovar Typhi
cguaaaaauuguuccuguaaag

SEQ ID NO: 1703748 - RNA, 16 nt, Salmonella enterica enterica serovar Typhi
cgguuuuuauggaagg

SEQ ID NO: 1703749 - RNA, 18 nt, Salmonella enterica enterica serovar Typhi
cguaaaacugcaccaacg

SEQ ID NO: 1703750 - RNA, 22 nt, Salmonella enterica enterica serovar Typhi
cguaaaauauauauuuucucaa

SEQ ID NO: 1703751 - RNA, 16 nt, Salmonella enterica enterica serovar Typhi
cguaaacacguuaucu

SEQ ID NO: 1703752 - RNA, 21 nt, Salmonella enterica enterica serovar Typhi
cgguuucaacuuccaccaccu

SEQ ID NO: 1703753 - RNA, 17 nt, Salmonella enterica enterica serovar Typhi
cgguuucuaccacccag

SEQ ID NO: 1703754 - RNA, 15 nt, Salmonella enterica enterica serovar Typhi
cgguuucugcgcgcu

SEQ ID NO: 1703755 - RNA, 14 nt, Salmonella enterica enterica serovar Typhi
cgguuuccauggca

SEQ ID NO: 1703756 - RNA, 14 nt, Salmonella enterica enterica serovar Typhi
cgguuguucagugc

SEQ ID NO: 1703757 - RNA, 13 nt, Salmonella enterica enterica serovar Typhi
cgguuccagcggc

SEQ ID NO: 1703758 - RNA, 14 nt, Salmonella enterica enterica serovar Typhi
cgguucaaucacgc

SEQ ID NO: 1703759 - RNA, 13 nt, Salmonella enterica enterica serovar Typhi
cgguucaggcuua

SEQ ID NO: 1703760 - RNA, 17 nt, Salmonella enterica enterica serovar Typhi
cgguuauccuccggguc

SEQ ID NO: 1703761 - RNA, 14 nt, Salmonella enterica enterica serovar Typhi
cgguuauaauaaua

SEQ ID NO: 1703762 - RNA, 13 nt, Salmonella enterica enterica serovar Typhi
cgguuacuccuua

SEQ ID NO: 1703763 - RNA, 16 nt, Salmonella enterica enterica serovar Typhi
cgguucucccggcaua

SEQ ID NO: 1703764 - RNA, 16 nt, Salmonella enterica enterica serovar Typhi
cgguucaucuucgccu

SEQ ID NO: 1703765 - RNA, 17 nt, Salmonella enterica enterica serovar Typhi
cgucuucaucuucgucu

SEQ ID NO: 1703766 - RNA, 19 nt, Salmonella enterica enterica serovar Typhi
cgucuucaggucauucagg

SEQ ID NO: 1703767 - RNA, 13 nt, Salmonella enterica enterica serovar Typhi
cgucuucaucuuc

SEQ ID NO: 1703768 - RNA, 14 nt, Salmonella enterica enterica serovar Typhi
cgucuuagaacugg

SEQ ID NO: 1703769 - RNA, 18 nt, Salmonella enterica enterica serovar Typhi
cgucuucaucagccagca

SEQ ID NO: 1703770 - RNA, 17 nt, Salmonella enterica enterica serovar Typhi
cgucuuuugcugcuuug

SEQ ID NO: 1703771 - RNA, 22 nt, Salmonella enterica enterica serovar Typhi
cgucuuuuauccccaccaccgc

SEQ ID NO: 1703772 - RNA, 22 nt, Salmonella enterica enterica serovar Typhi
cgugaaaaugcguccagaggau

SEQ ID NO: 1703773 - RNA, 16 nt, Salmonella enterica enterica serovar Typhi
cgugaacaaugccauu

SEQ ID NO: 1703774 - RNA, 16 nt, Salmonella enterica enterica serovar Typhi
cgugaaccagcauccc

SEQ ID NO: 1703775 - RNA, 14 nt, Salmonella enterica enterica serovar Typhi
cgugacgcgccagc

SEQ ID NO: 1703776 - RNA, 17 nt, Salmonella enterica enterica serovar Typhi
cgugacgcgccagcgga

SEQ ID NO: 1703777 - RNA, 15 nt, Salmonella enterica enterica serovar Typhi
cgugaccaccgccau

SEQ ID NO: 1703778 - RNA, 22 nt, Salmonella enterica enterica serovar Typhi
cgucugcacguuuugcucuucu

SEQ ID NO: 1703779 - RNA, 20 nt, Salmonella enterica enterica serovar Typhi
cgucugaagaaguucuucug

SEQ ID NO: 1703780 - RNA, 12 nt, Salmonella enterica enterica serovar Typhi
cgucuuaaaauu

SEQ ID NO: 1703781 - RNA, 21 nt, Salmonella enterica enterica serovar Typhi
cgucuuaaaauugcucagcca

SEQ ID NO: 1703782 - RNA, 17 nt, Salmonella enterica enterica serovar Typhi
cgucuuaaugcucucca

SEQ ID NO: 1703783 - RNA, 23 nt, Salmonella enterica enterica serovar Typhi
cgucuuaaugguggucgcggcca

SEQ ID NO: 1703784 - RNA, 19 nt, Salmonella enterica enterica serovar Typhi
cgucgcgaauaauuauuuu

SEQ ID NO: 1703785 - RNA, 17 nt, Salmonella enterica enterica serovar Typhi
cgucgcgcauggcaggg

SEQ ID NO: 1703786 - RNA, 15 nt, Salmonella enterica enterica serovar Typhi
cgucucucauuuucu

SEQ ID NO: 1703787 - RNA, 23 nt, Salmonella enterica enterica serovar Typhi
cgucgccggugcuguagcugccc

SEQ ID NO: 1703788 - RNA, 17 nt, Salmonella enterica enterica serovar Typhi
cgugcggcggacgccgg

SEQ ID NO: 1703789 - RNA, 19 nt, Salmonella enterica enterica serovar Typhi
cgugcgcucagggucagaa

SEQ ID NO: 1703790 - RNA, 21 nt, Salmonella enterica enterica serovar Typhi
cgugcgccgugaaauauccuc

SEQ ID NO: 1703791 - RNA, 15 nt, Salmonella enterica enterica serovar Typhi
cgugccauuaacgca

SEQ ID NO: 1703792 - RNA, 18 nt, Salmonella enterica enterica serovar Typhi
cgugccaugaccauucac

SEQ ID NO: 1703793 - RNA, 22 nt, Salmonella enterica enterica serovar Typhi
cgugcaugggauacgccagcag

SEQ ID NO: 1703794 - RNA, 21 nt, Salmonella enterica enterica serovar Typhi
cgugcaugggcagcuugccgc

SEQ ID NO: 1703795 - RNA, 14 nt, Salmonella enterica enterica serovar Typhi
cgugcaaugucaug

SEQ ID NO: 1703796 - RNA, 19 nt, Salmonella enterica enterica serovar Typhi
cgugaguggcggcgcgcag

SEQ ID NO: 1703797 - RNA, 22 nt, Salmonella enterica enterica serovar Typhi
cgugauaaacgguucagucagc

SEQ ID NO: 1703798 - RNA, 23 nt, Salmonella enterica enterica serovar Typhi
cgugauaaacgguucagucagcg

SEQ ID NO: 1703799 - RNA, 20 nt, Salmonella enterica enterica serovar Typhi
cgugauaaagguauagugga

SEQ ID NO: 1703800 - RNA, 16 nt, Salmonella enterica enterica serovar Typhi
cgugaucgccaaagcg

SEQ ID NO: 1703801 - RNA, 15 nt, Salmonella enterica enterica serovar Typhi
cgugcaaccccuugc

SEQ ID NO: 1703802 - RNA, 16 nt, Salmonella enterica enterica serovar Typhi
cguggcggcagagcca

SEQ ID NO: 1703803 - RNA, 16 nt, Salmonella enterica enterica serovar Typhi
cguggcgggaugcccc

SEQ ID NO: 1703804 - RNA, 22 nt, Salmonella enterica enterica serovar Typhi
cguggcguuuucauuagccgcc

SEQ ID NO: 1703805 - RNA, 20 nt, Salmonella enterica enterica serovar Typhi
cguggguucgaaucccauua

SEQ ID NO: 1703806 - RNA, 17 nt, Salmonella enterica enterica serovar Typhi
cguggaacugcagcgcg

SEQ ID NO: 1703807 - RNA, 12 nt, Salmonella enterica enterica serovar Typhi
cguggaaaagag

SEQ ID NO: 1703808 - RNA, 15 nt, Salmonella enterica enterica serovar Typhi
cguggacgcuggguu

SEQ ID NO: 1703809 - RNA, 20 nt, Salmonella enterica enterica serovar Typhi
cguggaucucgucgccggug

SEQ ID NO: 1703810 - RNA, 13 nt, Salmonella enterica enterica serovar Typhi
cguggccuccggc

SEQ ID NO: 1703811 - RNA, 13 nt, Salmonella enterica enterica serovar Typhi
cguggcgcaucuc

SEQ ID NO: 1703812 - RNA, 21 nt, Salmonella enterica enterica serovar Typhi
cgugguuuguugcgcgacgac

SEQ ID NO: 1703813 - RNA, 16 nt, Salmonella enterica enterica serovar Typhi
cguguaaacagaugcu

SEQ ID NO: 1703814 - RNA, 17 nt, Salmonella enterica enterica serovar Typhi
cguguaaacagaugcuc

SEQ ID NO: 1703815 - RNA, 17 nt, Salmonella enterica enterica serovar Typhi
cguguagccaguacgcg

SEQ ID NO: 1703816 - RNA, 17 nt, Salmonella enterica enterica serovar Typhi
cguguaaggcuuccggc

SEQ ID NO: 1703817 - RNA, 21 nt, Salmonella enterica enterica serovar Typhi
cguguccaaacuggcugugcc

SEQ ID NO: 1703818 - RNA, 20 nt, Salmonella enterica enterica serovar Typhi
cguguauuccagucgcucca

SEQ ID NO: 1703819 - RNA, 22 nt, Salmonella enterica enterica serovar Typhi
cguguauuccagucgcuccacc

SEQ ID NO: 1703820 - RNA, 22 nt, Salmonella enterica enterica serovar Typhi
cguguaguuauaaauuuauuuu

SEQ ID NO: 1703821 - RNA, 14 nt, Salmonella enterica enterica serovar Typhi
cguggugggguucc

SEQ ID NO: 1703822 - RNA, 13 nt, Salmonella enterica enterica serovar Typhi
cgugguauuacaa

SEQ ID NO: 1703823 - RNA, 17 nt, Salmonella enterica enterica serovar Typhi
cguuaaaauaccgccug

SEQ ID NO: 1703824 - RNA, 13 nt, Salmonella enterica enterica serovar Typhi
cguguuguccggc

SEQ ID NO: 1703825 - RNA, 21 nt, Salmonella enterica enterica serovar Typhi
cguguuauuuucaaaaacaag

SEQ ID NO: 1703826 - RNA, 13 nt, Salmonella enterica enterica serovar Typhi
cguguuauuuuca

SEQ ID NO: 1703827 - RNA, 21 nt, Salmonella enterica enterica serovar Typhi
cguguuacugacgaccggcag

SEQ ID NO: 1703828 - RNA, 11 nt, Salmonella enterica enterica serovar Typhi
cguguggcugu

SEQ ID NO: 1703829 - RNA, 16 nt, Salmonella enterica enterica serovar Typhi
cguguggccugcucua

SEQ ID NO: 1703830 - RNA, 20 nt, Salmonella enterica enterica serovar Typhi
cguguggcggaaugaccuga

SEQ ID NO: 1703831 - RNA, 21 nt, Salmonella enterica enterica serovar Typhi
cguguggucgcggcucaccag

SEQ ID NO: 1703832 - RNA, 22 nt, Salmonella enterica enterica serovar Typhi
cguucggaaucggacacuugca

SEQ ID NO: 1703833 - RNA, 21 nt, Salmonella enterica enterica serovar Typhi
cguucggaagacugcuccggc

SEQ ID NO: 1703834 - RNA, 19 nt, Salmonella enterica enterica serovar Typhi
cguucgcguucuggaagug

SEQ ID NO: 1703835 - RNA, 11 nt, Salmonella enterica enterica serovar Typhi
cguucuuccug

SEQ ID NO: 1703836 - RNA, 15 nt, Salmonella enterica enterica serovar Typhi
cguucuuccagaacg

SEQ ID NO: 1703837 - RNA, 13 nt, Salmonella enterica enterica serovar Typhi
cguugaaauccuc

SEQ ID NO: 1703838 - RNA, 22 nt, Salmonella enterica enterica serovar Typhi
cguugaccgcuucgccuucgcc

SEQ ID NO: 1703839 - RNA, 15 nt, Salmonella enterica enterica serovar Typhi
cguugacgugagaga

SEQ ID NO: 1703840 - RNA, 13 nt, Salmonella enterica enterica serovar Typhi
cguuccagcagcg

SEQ ID NO: 1703841 - RNA, 22 nt, Salmonella enterica enterica serovar Typhi
cguuccauuccagaaucuggcc

SEQ ID NO: 1703842 - RNA, 22 nt, Salmonella enterica enterica serovar Typhi
cguucgauagcguuuuccagcu

SEQ ID NO: 1703843 - RNA, 19 nt, Salmonella enterica enterica serovar Typhi
cguucgcgaauuucacgca

SEQ ID NO: 1703844 - RNA, 19 nt, Salmonella enterica enterica serovar Typhi
cguuaacaucaucaggccu

SEQ ID NO: 1703845 - RNA, 14 nt, Salmonella enterica enterica serovar Typhi
cguuaacccggcau

SEQ ID NO: 1703846 - RNA, 15 nt, Salmonella enterica enterica serovar Typhi
cguuaacccggcauu

SEQ ID NO: 1703847 - RNA, 14 nt, Salmonella enterica enterica serovar Typhi
cguuaaccagcggc

SEQ ID NO: 1703848 - RNA, 16 nt, Salmonella enterica enterica serovar Typhi
cguuaaauaccagcac

SEQ ID NO: 1703849 - RNA, 22 nt, Salmonella enterica enterica serovar Typhi
cguuaaggugcauuccgcgcaa

SEQ ID NO: 1703850 - RNA, 20 nt, Salmonella enterica enterica serovar Typhi
cguugccuggccuccggcgg

SEQ ID NO: 1703851 - RNA, 17 nt, Salmonella enterica enterica serovar Typhi
cguugcgaaucagguac

SEQ ID NO: 1703852 - RNA, 15 nt, Salmonella enterica enterica serovar Typhi
cguugcgccgccagg

SEQ ID NO: 1703853 - RNA, 21 nt, Salmonella enterica enterica serovar Typhi
cguugccgcaggcaacggccc

SEQ ID NO: 1703854 - RNA, 16 nt, Salmonella enterica enterica serovar Typhi
cguugccgcaggcaac

SEQ ID NO: 1703855 - RNA, 20 nt, Salmonella enterica enterica serovar Typhi
cguuggaagugcguuaaccc

SEQ ID NO: 1703856 - RNA, 12 nt, Salmonella enterica enterica serovar Typhi
cguugcuuuaua

SEQ ID NO: 1703857 - RNA, 21 nt, Salmonella enterica enterica serovar Typhi
cguugcuguaaccggaauaga

SEQ ID NO: 1703858 - RNA, 18 nt, Salmonella enterica enterica serovar Typhi
cguuuaccggugcagacc

SEQ ID NO: 1703859 - RNA, 15 nt, Salmonella enterica enterica serovar Typhi
cguuuacgccgccau

SEQ ID NO: 1703860 - RNA, 14 nt, Salmonella enterica enterica serovar Typhi
cguuuacaccuauu

SEQ ID NO: 1703861 - RNA, 13 nt, Salmonella enterica enterica serovar Typhi
cguuuauucuuuu

SEQ ID NO: 1703862 - RNA, 17 nt, Salmonella enterica enterica serovar Typhi
cguuuauguuugcugau

SEQ ID NO: 1703863 - RNA, 23 nt, Salmonella enterica enterica serovar Typhi
cguuuauauaaaaauagcuggcu

SEQ ID NO: 1703864 - RNA, 15 nt, Salmonella enterica enterica serovar Typhi
cguuuaugccgccau

SEQ ID NO: 1703865 - RNA, 19 nt, Salmonella enterica enterica serovar Typhi
cguuuauguucuuugugau

SEQ ID NO: 1703866 - RNA, 14 nt, Salmonella enterica enterica serovar Typhi
cguuggggaaaaua

SEQ ID NO: 1703867 - RNA, 16 nt, Salmonella enterica enterica serovar Typhi
cguuuaagcaugguga

SEQ ID NO: 1703868 - RNA, 15 nt, Salmonella enterica enterica serovar Typhi
cguuucauguaaaug

SEQ ID NO: 1703869 - RNA, 14 nt, Salmonella enterica enterica serovar Typhi
cguuucagccccuu

SEQ ID NO: 1703870 - RNA, 14 nt, Salmonella enterica enterica serovar Typhi
cguuugcagccaga

SEQ ID NO: 1703871 - RNA, 23 nt, Salmonella enterica enterica serovar Typhi
cguuugaaauaccaggcggcuuu

SEQ ID NO: 1703872 - RNA, 12 nt, Salmonella enterica enterica serovar Typhi
cguuucucuugu

SEQ ID NO: 1703873 - RNA, 15 nt, Salmonella enterica enterica serovar Typhi
cguuucuuucaucag

SEQ ID NO: 1703874 - RNA, 22 nt, Salmonella enterica enterica serovar Typhi
cuaaaaaucaaucuacuguuau

SEQ ID NO: 1703875 - RNA, 21 nt, Salmonella enterica enterica serovar Typhi
cuaaaaaccagaauuuccaga

SEQ ID NO: 1703876 - RNA, 15 nt, Salmonella enterica enterica serovar Typhi
cguuugcgccgccau

SEQ ID NO: 1703877 - RNA, 15 nt, Salmonella enterica enterica serovar Typhi
cguuugcgcgcgcca

SEQ ID NO: 1703878 - RNA, 21 nt, Salmonella enterica enterica serovar Typhi
cuaaacguucaucuucccgaa

SEQ ID NO: 1703879 - RNA, 18 nt, Salmonella enterica enterica serovar Typhi
cuaaacucaacugggcga

SEQ ID NO: 1703880 - RNA, 19 nt, Salmonella enterica enterica serovar Typhi
cuaaaauuauuuuuacuua

SEQ ID NO: 1703881 - RNA, 16 nt, Salmonella enterica enterica serovar Typhi
cuaaaauacccgaccc

SEQ ID NO: 1703882 - RNA, 21 nt, Salmonella enterica enterica serovar Typhi
cuaaagccaguuucucuucuu

SEQ ID NO: 1703883 - RNA, 18 nt, Salmonella enterica enterica serovar Typhi
cuaaacucaucuuuauuc

SEQ ID NO: 1703884 - RNA, 13 nt, Salmonella enterica enterica serovar Typhi
cuaaacucaucuu

SEQ ID NO: 1703885 - RNA, 17 nt, Salmonella enterica enterica serovar Typhi
cuaaaguaaaggaauaa

SEQ ID NO: 1703886 - RNA, 17 nt, Salmonella enterica enterica serovar Typhi
cuaaagggaucuuccug

SEQ ID NO: 1703887 - RNA, 20 nt, Salmonella enterica enterica serovar Typhi
cuaaagcgcugguggccggg

SEQ ID NO: 1703888 - RNA, 20 nt, Salmonella enterica enterica serovar Typhi
cuaaaguuuauuuaggauuu

SEQ ID NO: 1703889 - RNA, 17 nt, Salmonella enterica enterica serovar Typhi
cuaaaugcauagcccca

SEQ ID NO: 1703890 - RNA, 18 nt, Salmonella enterica enterica serovar Typhi
cuaaaugcauagccccag

SEQ ID NO: 1703891 - RNA, 21 nt, Salmonella enterica enterica serovar Typhi
cuaaauggcauagccugauau

SEQ ID NO: 1703892 - RNA, 19 nt, Salmonella enterica enterica serovar Typhi
cuaaaucuuuuugugcaau

SEQ ID NO: 1703893 - RNA, 16 nt, Salmonella enterica enterica serovar Typhi
cuaaaugaacuuacac

SEQ ID NO: 1703894 - RNA, 19 nt, Salmonella enterica enterica serovar Typhi
cuaaaugaccgccuuuuuu

SEQ ID NO: 1703895 - RNA, 20 nt, Salmonella enterica enterica serovar Typhi
cuaaauccguuaagcccuga

SEQ ID NO: 1703896 - RNA, 14 nt, Salmonella enterica enterica serovar Typhi
cuaaaucauaccag

SEQ ID NO: 1703897 - RNA, 15 nt, Salmonella enterica enterica serovar Typhi
cuaaaucauaccagc

SEQ ID NO: 1703898 - RNA, 13 nt, Salmonella enterica enterica serovar Typhi
cggcugccugccg

SEQ ID NO: 1703899 - RNA, 23 nt, Salmonella enterica enterica serovar Typhi
cggcugccuuuuuuaauggcgcu

SEQ ID NO: 1703900 - RNA, 16 nt, Salmonella enterica enterica serovar Typhi
cggcugcgcugccagc

SEQ ID NO: 1703901 - RNA, 15 nt, Salmonella enterica enterica serovar Typhi
cggcugcucccccag

SEQ ID NO: 1703902 - RNA, 22 nt, Salmonella enterica enterica serovar Typhi
cggcuggacgucaugccgccac

SEQ ID NO: 1703903 - RNA, 13 nt, Salmonella enterica enterica serovar Typhi
cggcugcauauac

SEQ ID NO: 1703904 - RNA, 16 nt, Salmonella enterica enterica serovar Typhi
cggcugcacaaaauac

SEQ ID NO: 1703905 - RNA, 18 nt, Salmonella enterica enterica serovar Typhi
cggcugacgcccaucagc

SEQ ID NO: 1703906 - RNA, 14 nt, Salmonella enterica enterica serovar Typhi
cggcugaaccaccc

SEQ ID NO: 1703907 - RNA, 22 nt, Salmonella enterica enterica serovar Typhi
cggcuuacaacauuguuauguu

SEQ ID NO: 1703908 - RNA, 22 nt, Salmonella enterica enterica serovar Typhi
cggcuuaucguuaaggccugcg

SEQ ID NO: 1703909 - RNA, 20 nt, Salmonella enterica enterica serovar Typhi
cggcuuacugcuucgcgccu

SEQ ID NO: 1703910 - RNA, 23 nt, Salmonella enterica enterica serovar Typhi
cggcuuacugcuucgcgccuucu

SEQ ID NO: 1703911 - RNA, 18 nt, Salmonella enterica enterica serovar Typhi
cggcuuaaugcccggccc

SEQ ID NO: 1703912 - RNA, 19 nt, Salmonella enterica enterica serovar Typhi
cggcuuaaugcccggcccg

SEQ ID NO: 1703913 - RNA, 16 nt, Salmonella enterica enterica serovar Typhi
cggcuuaaauggcgcu

SEQ ID NO: 1703914 - RNA, 15 nt, Salmonella enterica enterica serovar Typhi
cggcuguugguuuau

SEQ ID NO: 1703915 - RNA, 13 nt, Salmonella enterica enterica serovar Typhi
cggcugucaucaa

SEQ ID NO: 1703916 - RNA, 14 nt, Salmonella enterica enterica serovar Typhi
cggcugguaagaga

SEQ ID NO: 1703917 - RNA, 19 nt, Salmonella enterica enterica serovar Typhi
cggcuugaguuuuccgcca

SEQ ID NO: 1703918 - RNA, 15 nt, Salmonella enterica enterica serovar Typhi
cggcuuccucgcagu

SEQ ID NO: 1703919 - RNA, 22 nt, Salmonella enterica enterica serovar Typhi
cgggaagaugugccacuccgcc

SEQ ID NO: 1703920 - RNA, 15 nt, Salmonella enterica enterica serovar Typhi
cgggaacagauaaau

SEQ ID NO: 1703921 - RNA, 22 nt, Salmonella enterica enterica serovar Typhi
cgggaaaacggccagugaaaua

SEQ ID NO: 1703922 - RNA, 15 nt, Salmonella enterica enterica serovar Typhi
cggcuuuauuacuuc

SEQ ID NO: 1703923 - RNA, 19 nt, Salmonella enterica enterica serovar Typhi
cggcuuugcgccggcaguc

SEQ ID NO: 1703924 - RNA, 17 nt, Salmonella enterica enterica serovar Typhi
cggcuuuuugccgggcg

SEQ ID NO: 1703925 - RNA, 15 nt, Salmonella enterica enterica serovar Typhi
cggcuuuuuucucca

SEQ ID NO: 1703926 - RNA, 22 nt, Salmonella enterica enterica serovar Typhi
cggcgucauaguuuuccagccc

SEQ ID NO: 1703927 - RNA, 21 nt, Salmonella enterica enterica serovar Typhi
cggcguagccgccgagcgccg

SEQ ID NO: 1703928 - RNA, 15 nt, Salmonella enterica enterica serovar Typhi
cggcgucgccugucc

SEQ ID NO: 1703929 - RNA, 12 nt, Salmonella enterica enterica serovar Typhi
cggcgucauccc

SEQ ID NO: 1703930 - RNA, 14 nt, Salmonella enterica enterica serovar Typhi
cggcguccgccagc

SEQ ID NO: 1703931 - RNA, 22 nt, Salmonella enterica enterica serovar Typhi
cggcguguaaacagaugcucac

SEQ ID NO: 1703932 - RNA, 16 nt, Salmonella enterica enterica serovar Typhi
cggcguguuucaucuc

SEQ ID NO: 1703933 - RNA, 22 nt, Salmonella enterica enterica serovar Typhi
cggcguguuguaaaacgcgccc

SEQ ID NO: 1703934 - RNA, 14 nt, Salmonella enterica enterica serovar Typhi
cggcgugcgcugca

SEQ ID NO: 1703935 - RNA, 16 nt, Salmonella enterica enterica serovar Typhi
cggcguggaaccgccg

SEQ ID NO: 1703936 - RNA, 17 nt, Salmonella enterica enterica serovar Typhi
cggcgugaauaaaauag

SEQ ID NO: 1703937 - RNA, 14 nt, Salmonella enterica enterica serovar Typhi
cggcgugaaucccc

SEQ ID NO: 1703938 - RNA, 15 nt, Salmonella enterica enterica serovar Typhi
cggcuagucaauaaa

SEQ ID NO: 1703939 - RNA, 14 nt, Salmonella enterica enterica serovar Typhi
cggcuaacgccuga

SEQ ID NO: 1703940 - RNA, 16 nt, Salmonella enterica enterica serovar Typhi
cggcuaacgccugauc

SEQ ID NO: 1703941 - RNA, 17 nt, Salmonella enterica enterica serovar Typhi
cggcguuuuaauauccu

SEQ ID NO: 1703942 - RNA, 22 nt, Salmonella enterica enterica serovar Typhi
cggcguuuuaauauccuggcga

SEQ ID NO: 1703943 - RNA, 17 nt, Salmonella enterica enterica serovar Typhi
cggcuaaucaccaccuc

SEQ ID NO: 1703944 - RNA, 16 nt, Salmonella enterica enterica serovar Typhi
cggcguuuauauaaaa

SEQ ID NO: 1703945 - RNA, 22 nt, Salmonella enterica enterica serovar Typhi
cggcguuauacgccugccuggu

SEQ ID NO: 1703946 - RNA, 12 nt, Salmonella enterica enterica serovar Typhi
cggcucccauuu

SEQ ID NO: 1703947 - RNA, 17 nt, Salmonella enterica enterica serovar Typhi
cggcuccagguugcuca

SEQ ID NO: 1703948 - RNA, 16 nt, Salmonella enterica enterica serovar Typhi
cggcuccagcgccagc

SEQ ID NO: 1703949 - RNA, 13 nt, Salmonella enterica enterica serovar Typhi
cggcucagcaauc

SEQ ID NO: 1703950 - RNA, 16 nt, Salmonella enterica enterica serovar Typhi
cgggccagcagccagg

SEQ ID NO: 1703951 - RNA, 21 nt, Salmonella enterica enterica serovar Typhi
cgggccgccaucuccggcagc

SEQ ID NO: 1703952 - RNA, 12 nt, Salmonella enterica enterica serovar Typhi
cgggccugugcc

SEQ ID NO: 1703953 - RNA, 23 nt, Salmonella enterica enterica serovar Typhi
cgggccuacaaaaucgcccaggc

SEQ ID NO: 1703954 - RNA, 17 nt, Salmonella enterica enterica serovar Typhi
cgggccugagcgcgcag

SEQ ID NO: 1703955 - RNA, 18 nt, Salmonella enterica enterica serovar Typhi
cgggccugagcgcgcagc

SEQ ID NO: 1703956 - RNA, 21 nt, Salmonella enterica enterica serovar Typhi
cgggccguaaaguucccagcg

SEQ ID NO: 1703957 - RNA, 19 nt, Salmonella enterica enterica serovar Typhi
cgggccguccggcaaaccc

SEQ ID NO: 1703958 - RNA, 20 nt, Salmonella enterica enterica serovar Typhi
cgggccgcgcugcgccugcu

SEQ ID NO: 1703959 - RNA, 13 nt, Salmonella enterica enterica serovar Typhi
cgggccgcgcugc

SEQ ID NO: 1703960 - RNA, 17 nt, Salmonella enterica enterica serovar Typhi
cgggcguuugcgcgcgc

SEQ ID NO: 1703961 - RNA, 22 nt, Salmonella enterica enterica serovar Typhi
cgggcgguauuauccgccgcaa

SEQ ID NO: 1703962 - RNA, 20 nt, Salmonella enterica enterica serovar Typhi
cgggcggcgcagcgcgcgac

SEQ ID NO: 1703963 - RNA, 17 nt, Salmonella enterica enterica serovar Typhi
cgggcggcugucccaga

SEQ ID NO: 1703964 - RNA, 23 nt, Salmonella enterica enterica serovar Typhi
cgggcggaaagcauucgcagcag

SEQ ID NO: 1703965 - RNA, 23 nt, Salmonella enterica enterica serovar Typhi
cgggcgauaaccucucaccgccu

SEQ ID NO: 1703966 - RNA, 12 nt, Salmonella enterica enterica serovar Typhi
cgggcgccacgu

SEQ ID NO: 1703967 - RNA, 15 nt, Salmonella enterica enterica serovar Typhi
cgggaugguuaaauu

SEQ ID NO: 1703968 - RNA, 17 nt, Salmonella enterica enterica serovar Typhi
cgggaucgcagaaauau

SEQ ID NO: 1703969 - RNA, 16 nt, Salmonella enterica enterica serovar Typhi
cgggauccugcaaaau

SEQ ID NO: 1703970 - RNA, 15 nt, Salmonella enterica enterica serovar Typhi
cgggaucgaaccgcc

SEQ ID NO: 1703971 - RNA, 23 nt, Salmonella enterica enterica serovar Typhi
cgggaucgaaccgccgacccccu

SEQ ID NO: 1703972 - RNA, 15 nt, Salmonella enterica enterica serovar Typhi
cgggauaaccaccgc

SEQ ID NO: 1703973 - RNA, 15 nt, Salmonella enterica enterica serovar Typhi
cgggaggggcuuucc

SEQ ID NO: 1703974 - RNA, 12 nt, Salmonella enterica enterica serovar Typhi
cgggagcuugcc

SEQ ID NO: 1703975 - RNA, 18 nt, Salmonella enterica enterica serovar Typhi
cgggauccccugcuccug

SEQ ID NO: 1703976 - RNA, 23 nt, Salmonella enterica enterica serovar Typhi
cgggagcucuaccagaccacgca

SEQ ID NO: 1703977 - RNA, 12 nt, Salmonella enterica enterica serovar Typhi
cgggagcaaaau

SEQ ID NO: 1703978 - RNA, 22 nt, Salmonella enterica enterica serovar Typhi
cgggacuucaggcauccagacc

SEQ ID NO: 1703979 - RNA, 17 nt, Salmonella enterica enterica serovar Typhi
cgggacugacugagcca

SEQ ID NO: 1703980 - RNA, 23 nt, Salmonella enterica enterica serovar Typhi
cgggacugguggcgagauaagcc

SEQ ID NO: 1703981 - RNA, 14 nt, Salmonella enterica enterica serovar Typhi
cgggcaacacacgc

SEQ ID NO: 1703982 - RNA, 18 nt, Salmonella enterica enterica serovar Typhi
cgggcauacucuccucca

SEQ ID NO: 1703983 - RNA, 12 nt, Salmonella enterica enterica serovar Typhi
cgggcagggcug

SEQ ID NO: 1703984 - RNA, 19 nt, Salmonella enterica enterica serovar Typhi
cgggcagucuggcggcagc

SEQ ID NO: 1703985 - RNA, 18 nt, Salmonella enterica enterica serovar Typhi
cgggcagcggcaagacag

SEQ ID NO: 1703986 - RNA, 23 nt, Salmonella enterica enterica serovar Typhi
cgggcagacauucgcgcacggcg

SEQ ID NO: 1703987 - RNA, 22 nt, Salmonella enterica enterica serovar Typhi
cgggcagacaugaccgcacagc

SEQ ID NO: 1703988 - RNA, 13 nt, Salmonella enterica enterica serovar Typhi
cgggcagcagcag

SEQ ID NO: 1703989 - RNA, 23 nt, Salmonella enterica enterica serovar Typhi
cggucguaaacacgacgccgccg

SEQ ID NO: 1703990 - RNA, 21 nt, Salmonella enterica enterica serovar Typhi
cggucucuuaaugccagcggc

SEQ ID NO: 1703991 - RNA, 13 nt, Salmonella enterica enterica serovar Typhi
cggucugacggcc

SEQ ID NO: 1703992 - RNA, 15 nt, Salmonella enterica enterica serovar Typhi
cggucuuuuucgcag

SEQ ID NO: 1703993 - RNA, 15 nt, Salmonella enterica enterica serovar Typhi
cggucuucacucacc

SEQ ID NO: 1703994 - RNA, 13 nt, Salmonella enterica enterica serovar Typhi
cggugaagacgac

SEQ ID NO: 1703995 - RNA, 17 nt, Salmonella enterica enterica serovar Typhi
cggugaauagguaugua

SEQ ID NO: 1703996 - RNA, 14 nt, Salmonella enterica enterica serovar Typhi
cggugagcgccgcg

SEQ ID NO: 1703997 - RNA, 17 nt, Salmonella enterica enterica serovar Typhi
cggugagaaacgcgcca

SEQ ID NO: 1703998 - RNA, 19 nt, Salmonella enterica enterica serovar Typhi
cggugacggaaaccagcau

SEQ ID NO: 1703999 - RNA, 22 nt, Salmonella enterica enterica serovar Typhi
cggucgagcuuuugcugcgcca

SEQ ID NO: 1704000 - RNA, 21 nt, Salmonella enterica enterica serovar Typhi
cgguccguuuucgcccccagc

SEQ ID NO: 1704001 - RNA, 20 nt, Salmonella enterica enterica serovar Typhi
cggucgcuuuuugcgccagc

SEQ ID NO: 1704002 - RNA, 17 nt, Salmonella enterica enterica serovar Typhi
cggucgcggagaucauc

SEQ ID NO: 1704003 - RNA, 22 nt, Salmonella enterica enterica serovar Typhi
cggucauucauugucuuuuucu

SEQ ID NO: 1704004 - RNA, 22 nt, Salmonella enterica enterica serovar Typhi
cggucaggaagcggacuaccug

SEQ ID NO: 1704005 - RNA, 19 nt, Salmonella enterica enterica serovar Typhi
cggucagggugaaucccgc

SEQ ID NO: 1704006 - RNA, 22 nt, Salmonella enterica enterica serovar Typhi
cggucagggugaaucccgccau

SEQ ID NO: 1704007 - RNA, 17 nt, Salmonella enterica enterica serovar Typhi
cgguaagcacaacgcau

SEQ ID NO: 1704008 - RNA, 19 nt, Salmonella enterica enterica serovar Typhi
cgguaagagcguuacccag

SEQ ID NO: 1704009 - RNA, 15 nt, Salmonella enterica enterica serovar Typhi
cgguaagccaccaga

SEQ ID NO: 1704010 - RNA, 20 nt, Salmonella enterica enterica serovar Typhi
cgguaagcuguuccggcuuc

SEQ ID NO: 1704011 - RNA, 18 nt, Salmonella enterica enterica serovar Typhi
cgguaacgauacccacca

SEQ ID NO: 1704012 - RNA, 21 nt, Salmonella enterica enterica serovar Typhi
cgguaacguaacuugauuccu

SEQ ID NO: 1704013 - RNA, 19 nt, Salmonella enterica enterica serovar Typhi
cgguacaaaccccacccac

SEQ ID NO: 1704014 - RNA, 23 nt, Salmonella enterica enterica serovar Typhi
cgguaauauauuucacuucauca

SEQ ID NO: 1704015 - RNA, 16 nt, Salmonella enterica enterica serovar Typhi
cgguaaucagacuggc

SEQ ID NO: 1704016 - RNA, 22 nt, Salmonella enterica enterica serovar Typhi
cgguaaucgaucccgccgcauc

SEQ ID NO: 1704017 - RNA, 18 nt, Salmonella enterica enterica serovar Typhi
cgguaaucugccagcuua

SEQ ID NO: 1704018 - RNA, 13 nt, Salmonella enterica enterica serovar Typhi
cgguagguuuaaa

SEQ ID NO: 1704019 - RNA, 16 nt, Salmonella enterica enterica serovar Typhi
cgguagcuccagacag

SEQ ID NO: 1704020 - RNA, 17 nt, Salmonella enterica enterica serovar Typhi
cgguagcuuuuuaaaua

SEQ ID NO: 1704021 - RNA, 14 nt, Salmonella enterica enterica serovar Typhi
cgguagccacaccc

SEQ ID NO: 1704022 - RNA, 17 nt, Salmonella enterica enterica serovar Typhi
cgguagcacuuuaaaca

SEQ ID NO: 1704023 - RNA, 19 nt, Salmonella enterica enterica serovar Typhi
cgguagagcgcggucaggu

SEQ ID NO: 1704024 - RNA, 11 nt, Salmonella enterica enterica serovar Typhi
cgguacuucug

SEQ ID NO: 1704025 - RNA, 13 nt, Salmonella enterica enterica serovar Typhi
cgguaccggcauu

SEQ ID NO: 1704026 - RNA, 17 nt, Salmonella enterica enterica serovar Typhi
cgguacgcagcaggcag

SEQ ID NO: 1704027 - RNA, 15 nt, Salmonella enterica enterica serovar Typhi
cgguacuccccuuuu

SEQ ID NO: 1704028 - RNA, 14 nt, Salmonella enterica enterica serovar Typhi
cgguacgccgccau

SEQ ID NO: 1704029 - RNA, 17 nt, Salmonella enterica enterica serovar Typhi
cgguacgcaucaccagg

SEQ ID NO: 1704030 - RNA, 16 nt, Salmonella enterica enterica serovar Typhi
cgguacggaacgucca

SEQ ID NO: 1704031 - RNA, 21 nt, Salmonella enterica enterica serovar Typhi
cgguauaaauuuccgcagcca

SEQ ID NO: 1704032 - RNA, 15 nt, Salmonella enterica enterica serovar Typhi
cgguauuauccgccg

SEQ ID NO: 1704033 - RNA, 15 nt, Salmonella enterica enterica serovar Typhi
cgguaugccuuccag

SEQ ID NO: 1704034 - RNA, 22 nt, Salmonella enterica enterica serovar Typhi
cgguaucgacaaccgccugcgu

SEQ ID NO: 1704035 - RNA, 20 nt, Salmonella enterica enterica serovar Typhi
cgguaucgaucacgcgcagg

SEQ ID NO: 1704036 - RNA, 15 nt, Salmonella enterica enterica serovar Typhi
cggucaauacaucac

SEQ ID NO: 1704037 - RNA, 16 nt, Salmonella enterica enterica serovar Typhi
cggucacaggcauaca

SEQ ID NO: 1704038 - RNA, 20 nt, Salmonella enterica enterica serovar Typhi
cggucaacguuaacugcugc

SEQ ID NO: 1704039 - RNA, 16 nt, Salmonella enterica enterica serovar Typhi
cggucaacguuucccc

SEQ ID NO: 1704040 - RNA, 16 nt, Salmonella enterica enterica serovar Typhi
cggucaacgcgccgcc

SEQ ID NO: 1704041 - RNA, 12 nt, Salmonella enterica enterica serovar Typhi
cggucagccaca

SEQ ID NO: 1704042 - RNA, 12 nt, Salmonella enterica enterica serovar Typhi
cggucagccagc

SEQ ID NO: 1704043 - RNA, 23 nt, Salmonella enterica enterica serovar Typhi
aaacuaauccucuucucugaaaa

SEQ ID NO: 1704044 - RNA, 14 nt, Salmonella enterica enterica serovar Typhi
cggggugcuguucu

SEQ ID NO: 1704045 - RNA, 21 nt, Salmonella enterica enterica serovar Typhi
cgggguuagcguuucaaccgc

SEQ ID NO: 1704046 - RNA, 14 nt, Salmonella enterica enterica serovar Typhi
cggguaaacaaaca

SEQ ID NO: 1704047 - RNA, 23 nt, Salmonella enterica enterica serovar Typhi
cggguaaaugcgcgcggcuaccg

SEQ ID NO: 1704048 - RNA, 21 nt, Salmonella enterica enterica serovar Typhi
cggguaaacaaacacagccau

SEQ ID NO: 1704049 - RNA, 13 nt, Salmonella enterica enterica serovar Typhi
cggguaacgucga

SEQ ID NO: 1704050 - RNA, 16 nt, Salmonella enterica enterica serovar Typhi
cgggggcgaucagcag

SEQ ID NO: 1704051 - RNA, 16 nt, Salmonella enterica enterica serovar Typhi
cgggggcgacagcccc

SEQ ID NO: 1704052 - RNA, 15 nt, Salmonella enterica enterica serovar Typhi
cgggguaaaauggac

SEQ ID NO: 1704053 - RNA, 16 nt, Salmonella enterica enterica serovar Typhi
cggggguuauucagcg

SEQ ID NO: 1704054 - RNA, 22 nt, Salmonella enterica enterica serovar Typhi
cggggcucccacucuuccagca

SEQ ID NO: 1704055 - RNA, 22 nt, Salmonella enterica enterica serovar Typhi
cggggcguuaaucaccggcgcg

SEQ ID NO: 1704056 - RNA, 17 nt, Salmonella enterica enterica serovar Typhi
cgggggacgcgacgccc

SEQ ID NO: 1704057 - RNA, 13 nt, Salmonella enterica enterica serovar Typhi
cggggcgcaaaau

SEQ ID NO: 1704058 - RNA, 20 nt, Salmonella enterica enterica serovar Typhi
cgggcugccccagacgcccu

SEQ ID NO: 1704059 - RNA, 19 nt, Salmonella enterica enterica serovar Typhi
cgggcuaaaugcccacggc

SEQ ID NO: 1704060 - RNA, 18 nt, Salmonella enterica enterica serovar Typhi
cgggcuuuuagccgcgcc

SEQ ID NO: 1704061 - RNA, 15 nt, Salmonella enterica enterica serovar Typhi
cggggaagcgcgcgc

SEQ ID NO: 1704062 - RNA, 23 nt, Salmonella enterica enterica serovar Typhi
cgggcuuccaguacgcugacgaa

SEQ ID NO: 1704063 - RNA, 20 nt, Salmonella enterica enterica serovar Typhi
cggggauuuuuuugcccggu

SEQ ID NO: 1704064 - RNA, 16 nt, Salmonella enterica enterica serovar Typhi
cggggauaaucagcag

SEQ ID NO: 1704065 - RNA, 18 nt, Salmonella enterica enterica serovar Typhi
cggggauaaucagcagcg

SEQ ID NO: 1704066 - RNA, 14 nt, Salmonella enterica enterica serovar Typhi
cgggugcgcagcaa

SEQ ID NO: 1704067 - RNA, 13 nt, Salmonella enterica enterica serovar Typhi
cggguucaucgcc

SEQ ID NO: 1704068 - RNA, 19 nt, Salmonella enterica enterica serovar Typhi
cgguaaaggucgccgcauc

SEQ ID NO: 1704069 - RNA, 22 nt, Salmonella enterica enterica serovar Typhi
cgguaaaugcuuaucugaugaa

SEQ ID NO: 1704070 - RNA, 19 nt, Salmonella enterica enterica serovar Typhi
cgguaaacgugcuggaugg

SEQ ID NO: 1704071 - RNA, 18 nt, Salmonella enterica enterica serovar Typhi
cgguaaacgugccacagu

SEQ ID NO: 1704072 - RNA, 21 nt, Salmonella enterica enterica serovar Typhi
cgguaaauuucuugaucaauc

SEQ ID NO: 1704073 - RNA, 12 nt, Salmonella enterica enterica serovar Typhi
cggguugcugau

SEQ ID NO: 1704074 - RNA, 16 nt, Salmonella enterica enterica serovar Typhi
cgggucgcgcgccgca

SEQ ID NO: 1704075 - RNA, 14 nt, Salmonella enterica enterica serovar Typhi
cgggucgcgcgccg

SEQ ID NO: 1704076 - RNA, 21 nt, Salmonella enterica enterica serovar Typhi
cgggugcauuuucaccuggau

SEQ ID NO: 1704077 - RNA, 14 nt, Salmonella enterica enterica serovar Typhi
cggguagucccagg

SEQ ID NO: 1704078 - RNA, 18 nt, Salmonella enterica enterica serovar Typhi
cggguagucccaggauag

SEQ ID NO: 1704079 - RNA, 17 nt, Salmonella enterica enterica serovar Typhi
cggguagaaauuccuuc

SEQ ID NO: 1704080 - RNA, 15 nt, Salmonella enterica enterica serovar Typhi
cggguagagcuuuuc

SEQ ID NO: 1704081 - RNA, 19 nt, Salmonella enterica enterica serovar Typhi
cggguauccauugccagau

SEQ ID NO: 1704082 - RNA, 14 nt, Salmonella enterica enterica serovar Typhi
cgggucagcggggu

SEQ ID NO: 1704083 - RNA, 20 nt, Salmonella enterica enterica serovar Typhi
cuucugauuauugacauuca

SEQ ID NO: 1704084 - RNA, 23 nt, Salmonella enterica enterica serovar Typhi
cuucugacccaaucagacgccgg

SEQ ID NO: 1704085 - RNA, 16 nt, Salmonella enterica enterica serovar Typhi
cuucugacucgcugau

SEQ ID NO: 1704086 - RNA, 21 nt, Salmonella enterica enterica serovar Typhi
cuucucugucgagcaucucca

SEQ ID NO: 1704087 - RNA, 12 nt, Salmonella enterica enterica serovar Typhi
cuucugaaaacc

SEQ ID NO: 1704088 - RNA, 15 nt, Salmonella enterica enterica serovar Typhi
cuucugccgcgcggu

SEQ ID NO: 1704089 - RNA, 22 nt, Salmonella enterica enterica serovar Typhi
cuucugcgcaggaggcuuccgc

SEQ ID NO: 1704090 - RNA, 12 nt, Salmonella enterica enterica serovar Typhi
cuucuggaauuc

SEQ ID NO: 1704091 - RNA, 21 nt, Salmonella enterica enterica serovar Typhi
cuucucccaacagacgaucua

SEQ ID NO: 1704092 - RNA, 13 nt, Salmonella enterica enterica serovar Typhi
cuucuccccuuca

SEQ ID NO: 1704093 - RNA, 23 nt, Salmonella enterica enterica serovar Typhi
cuucuccccuucaucaguaacug

SEQ ID NO: 1704094 - RNA, 19 nt, Salmonella enterica enterica serovar Typhi
cuucucaggcgagcccugu

SEQ ID NO: 1704095 - RNA, 21 nt, Salmonella enterica enterica serovar Typhi
cuucucacggauccagaacug

SEQ ID NO: 1704096 - RNA, 18 nt, Salmonella enterica enterica serovar Typhi
cuucucaauuucuuaucu

SEQ ID NO: 1704097 - RNA, 17 nt, Salmonella enterica enterica serovar Typhi
cuucucuaucagcgccu

SEQ ID NO: 1704098 - RNA, 17 nt, Salmonella enterica enterica serovar Typhi
cuucgucaaugcugcuu

SEQ ID NO: 1704099 - RNA, 14 nt, Salmonella enterica enterica serovar Typhi
cuucgucuuuauuc

SEQ ID NO: 1704100 - RNA, 19 nt, Salmonella enterica enterica serovar Typhi
cuucguggaacugcagcgc

SEQ ID NO: 1704101 - RNA, 18 nt, Salmonella enterica enterica serovar Typhi
cuucguuauaaggccugc

SEQ ID NO: 1704102 - RNA, 19 nt, Salmonella enterica enterica serovar Typhi
cuucguuauuuuccugaaa

SEQ ID NO: 1704103 - RNA, 15 nt, Salmonella enterica enterica serovar Typhi
cuucguuauuuuccu

SEQ ID NO: 1704104 - RNA, 15 nt, Salmonella enterica enterica serovar Typhi
cuucguuaagcgguu

SEQ ID NO: 1704105 - RNA, 14 nt, Salmonella enterica enterica serovar Typhi
cuucguucuguauc

SEQ ID NO: 1704106 - RNA, 14 nt, Salmonella enterica enterica serovar Typhi
cuucuaccgcuucg

SEQ ID NO: 1704107 - RNA, 13 nt, Salmonella enterica enterica serovar Typhi
cuucuaauuuuuc

SEQ ID NO: 1704108 - RNA, 18 nt, Salmonella enterica enterica serovar Typhi
cuucuaauuuuuccagca

SEQ ID NO: 1704109 - RNA, 19 nt, Salmonella enterica enterica serovar Typhi
cuucuaacgcaacggaagg

SEQ ID NO: 1704110 - RNA, 16 nt, Salmonella enterica enterica serovar Typhi
cuucuaauuccaggau

SEQ ID NO: 1704111 - RNA, 18 nt, Salmonella enterica enterica serovar Typhi
cuucuaccuucaccccca

SEQ ID NO: 1704112 - RNA, 19 nt, Salmonella enterica enterica serovar Typhi
cuucuauuaccgcagcgcg

SEQ ID NO: 1704113 - RNA, 15 nt, Salmonella enterica enterica serovar Typhi
cuucuucuaccaccu

SEQ ID NO: 1704114 - RNA, 18 nt, Salmonella enterica enterica serovar Typhi
cuucuucuaccaccuuau

SEQ ID NO: 1704115 - RNA, 15 nt, Salmonella enterica enterica serovar Typhi
cuucuucgcggccgc

SEQ ID NO: 1704116 - RNA, 12 nt, Salmonella enterica enterica serovar Typhi
cuucuuccagcg

SEQ ID NO: 1704117 - RNA, 13 nt, Salmonella enterica enterica serovar Typhi
cuucuucaucuuc

SEQ ID NO: 1704118 - RNA, 14 nt, Salmonella enterica enterica serovar Typhi
cuucuucaucuuca

SEQ ID NO: 1704119 - RNA, 17 nt, Salmonella enterica enterica serovar Typhi
cuucuucaguuccgcca

SEQ ID NO: 1704120 - RNA, 19 nt, Salmonella enterica enterica serovar Typhi
cuucuucaguuccgccaga

SEQ ID NO: 1704121 - RNA, 15 nt, Salmonella enterica enterica serovar Typhi
cuucuucacuaaaaa

SEQ ID NO: 1704122 - RNA, 17 nt, Salmonella enterica enterica serovar Typhi
cuucuucaagccaggcu

SEQ ID NO: 1704123 - RNA, 18 nt, Salmonella enterica enterica serovar Typhi
cuucuggcgucccuuucc

SEQ ID NO: 1704124 - RNA, 22 nt, Salmonella enterica enterica serovar Typhi
cuucugucagccuugcaucuca

SEQ ID NO: 1704125 - RNA, 20 nt, Salmonella enterica enterica serovar Typhi
cuucugucugcgugaagaca

SEQ ID NO: 1704126 - RNA, 17 nt, Salmonella enterica enterica serovar Typhi
cuucuuuaucuucugcu

SEQ ID NO: 1704127 - RNA, 21 nt, Salmonella enterica enterica serovar Typhi
cuucuuuaucuucugcugcuc

SEQ ID NO: 1704128 - RNA, 19 nt, Salmonella enterica enterica serovar Typhi
cuucuuuauccugaagaug

SEQ ID NO: 1704129 - RNA, 21 nt, Salmonella enterica enterica serovar Typhi
cuucuuuauucgcgaugcacc

SEQ ID NO: 1704130 - RNA, 14 nt, Salmonella enterica enterica serovar Typhi
cuucuuuagauaau

SEQ ID NO: 1704131 - RNA, 15 nt, Salmonella enterica enterica serovar Typhi
cuucuuugcgauuug

SEQ ID NO: 1704132 - RNA, 17 nt, Salmonella enterica enterica serovar Typhi
cuucuuuggcuuaauca

SEQ ID NO: 1704133 - RNA, 13 nt, Salmonella enterica enterica serovar Typhi
cuucuuuuacugc

SEQ ID NO: 1704134 - RNA, 15 nt, Salmonella enterica enterica serovar Typhi
cuugaaagcaguccc

SEQ ID NO: 1704135 - RNA, 15 nt, Salmonella enterica enterica serovar Typhi
cuugaauaacauaaa

SEQ ID NO: 1704136 - RNA, 17 nt, Salmonella enterica enterica serovar Typhi
cuugauccuguaacgca

SEQ ID NO: 1704137 - RNA, 16 nt, Salmonella enterica enterica serovar Typhi
cuugauacggcuuuca

SEQ ID NO: 1704138 - RNA, 17 nt, Salmonella enterica enterica serovar Typhi
cuugauaaauaucaaga

SEQ ID NO: 1704139 - RNA, 22 nt, Salmonella enterica enterica serovar Typhi
cuugaguuuuccgccauuggcg

SEQ ID NO: 1704140 - RNA, 17 nt, Salmonella enterica enterica serovar Typhi
cuugacuuugcucuccu

SEQ ID NO: 1704141 - RNA, 20 nt, Salmonella enterica enterica serovar Typhi
cuugagaaauuauuuuaaau

SEQ ID NO: 1704142 - RNA, 18 nt, Salmonella enterica enterica serovar Typhi
cuugacgcuuugcauuau

SEQ ID NO: 1704143 - RNA, 16 nt, Salmonella enterica enterica serovar Typhi
cuugaucgcgcagcaa

SEQ ID NO: 1704144 - RNA, 14 nt, Salmonella enterica enterica serovar Typhi
cuugaucggcuggc

SEQ ID NO: 1704145 - RNA, 23 nt, Salmonella enterica enterica serovar Typhi
cuugaugauucacccucgucuuu

SEQ ID NO: 1704146 - RNA, 19 nt, Salmonella enterica enterica serovar Typhi
cuugaugugucuauuuauu

SEQ ID NO: 1704147 - RNA, 12 nt, Salmonella enterica enterica serovar Typhi
cuugauuccugg

SEQ ID NO: 1704148 - RNA, 15 nt, Salmonella enterica enterica serovar Typhi
cuugcaauuuaucca

SEQ ID NO: 1704149 - RNA, 23 nt, Salmonella enterica enterica serovar Typhi
cuugcaaugaaaaauccccgcaa

SEQ ID NO: 1704150 - RNA, 13 nt, Salmonella enterica enterica serovar Typhi
cuugccagcgaga

SEQ ID NO: 1704151 - RNA, 23 nt, Salmonella enterica enterica serovar Typhi
cuugcauuuuacguagccgcaga

SEQ ID NO: 1704152 - RNA, 19 nt, Salmonella enterica enterica serovar Typhi
cuugccacuacgcagcucc

SEQ ID NO: 1704153 - RNA, 13 nt, Salmonella enterica enterica serovar Typhi
cuugccacuggcc

SEQ ID NO: 1704154 - RNA, 14 nt, Salmonella enterica enterica serovar Typhi
cuugccacuggccu

SEQ ID NO: 1704155 - RNA, 22 nt, Salmonella enterica enterica serovar Typhi
cuugcagccagaacucaucuuc

SEQ ID NO: 1704156 - RNA, 19 nt, Salmonella enterica enterica serovar Typhi
cuugcacgccaaaaaguga

SEQ ID NO: 1704157 - RNA, 18 nt, Salmonella enterica enterica serovar Typhi
cuugcacaauacuuuuug

SEQ ID NO: 1704158 - RNA, 15 nt, Salmonella enterica enterica serovar Typhi
cuugccgggggcgcu

SEQ ID NO: 1704159 - RNA, 18 nt, Salmonella enterica enterica serovar Typhi
cuugccgaguggaaucag

SEQ ID NO: 1704160 - RNA, 15 nt, Salmonella enterica enterica serovar Typhi
cuugccgccagcgcg

SEQ ID NO: 1704161 - RNA, 21 nt, Salmonella enterica enterica serovar Typhi
cuugccgcaucuucgcccggc

SEQ ID NO: 1704162 - RNA, 23 nt, Salmonella enterica enterica serovar Typhi
cuugccgcaucuucgcccggcgu

SEQ ID NO: 1704163 - RNA, 20 nt, Salmonella enterica enterica serovar Typhi
cuugcgaccacuccggcaua

SEQ ID NO: 1704164 - RNA, 19 nt, Salmonella enterica enterica serovar Typhi
cuugccugcuuuuucauca

SEQ ID NO: 1704165 - RNA, 18 nt, Salmonella enterica enterica serovar Typhi
cuugcccgcgccagaggc

SEQ ID NO: 1704166 - RNA, 17 nt, Salmonella enterica enterica serovar Typhi
cuugccgaauuuacugu

SEQ ID NO: 1704167 - RNA, 13 nt, Salmonella enterica enterica serovar Typhi
aaacuuuuaaauu

SEQ ID NO: 1704168 - RNA, 22 nt, Salmonella enterica enterica serovar Typhi
cuugcucaaaaagcucaagcgc

SEQ ID NO: 1704169 - RNA, 14 nt, Salmonella enterica enterica serovar Typhi
cuugcucucaggca

SEQ ID NO: 1704170 - RNA, 20 nt, Salmonella enterica enterica serovar Typhi
cuugcuggccuguucaagug

SEQ ID NO: 1704171 - RNA, 15 nt, Salmonella enterica enterica serovar Typhi
cuugcugcugcugau

SEQ ID NO: 1704172 - RNA, 19 nt, Salmonella enterica enterica serovar Typhi
cuugcugcggcacgaaaaa

SEQ ID NO: 1704173 - RNA, 18 nt, Salmonella enterica enterica serovar Typhi
cuugcuuuucaucaccau

SEQ ID NO: 1704174 - RNA, 17 nt, Salmonella enterica enterica serovar Typhi
cuugcuuuucaucacca

SEQ ID NO: 1704175 - RNA, 18 nt, Salmonella enterica enterica serovar Typhi
cuugcggcgccaggacaa

SEQ ID NO: 1704176 - RNA, 17 nt, Salmonella enterica enterica serovar Typhi
cuugcggggagaaugcg

SEQ ID NO: 1704177 - RNA, 21 nt, Salmonella enterica enterica serovar Typhi
cuugcgccaucauccggcaac

SEQ ID NO: 1704178 - RNA, 13 nt, Salmonella enterica enterica serovar Typhi
cuugcgccauucu

SEQ ID NO: 1704179 - RNA, 17 nt, Salmonella enterica enterica serovar Typhi
cuugcgcaucgcaucag

SEQ ID NO: 1704180 - RNA, 13 nt, Salmonella enterica enterica serovar Typhi
cuugcgccgccau

SEQ ID NO: 1704181 - RNA, 22 nt, Salmonella enterica enterica serovar Typhi
cuugcgccgccauccggccugu

SEQ ID NO: 1704182 - RNA, 17 nt, Salmonella enterica enterica serovar Typhi
cuguuucgccaggccgc

SEQ ID NO: 1704183 - RNA, 21 nt, Salmonella enterica enterica serovar Typhi
cuguuucugauagcccuauuc

SEQ ID NO: 1704184 - RNA, 14 nt, Salmonella enterica enterica serovar Typhi
cuguuuccaguuac

SEQ ID NO: 1704185 - RNA, 17 nt, Salmonella enterica enterica serovar Typhi
cuguuuaagcuuuuucu

SEQ ID NO: 1704186 - RNA, 22 nt, Salmonella enterica enterica serovar Typhi
cuguuuaaugcuuucaauacuc

SEQ ID NO: 1704187 - RNA, 20 nt, Salmonella enterica enterica serovar Typhi
cuguucggggaauucaaaga

SEQ ID NO: 1704188 - RNA, 17 nt, Salmonella enterica enterica serovar Typhi
cuguuuaagcgccucca

SEQ ID NO: 1704189 - RNA, 19 nt, Salmonella enterica enterica serovar Typhi
cuguuuaagcgccuccaca

SEQ ID NO: 1704190 - RNA, 21 nt, Salmonella enterica enterica serovar Typhi
cuguuuaagcgccuccacaaa

SEQ ID NO: 1704191 - RNA, 19 nt, Salmonella enterica enterica serovar Typhi
cuguuauucagggcuuuau

SEQ ID NO: 1704192 - RNA, 19 nt, Salmonella enterica enterica serovar Typhi
cuguuccgaaauaaaucga

SEQ ID NO: 1704193 - RNA, 20 nt, Salmonella enterica enterica serovar Typhi
cuguuaugcacgcgcggcgc

SEQ ID NO: 1704194 - RNA, 15 nt, Salmonella enterica enterica serovar Typhi
cuguuaugaaacccg

SEQ ID NO: 1704195 - RNA, 19 nt, Salmonella enterica enterica serovar Typhi
cuguuaucuggauguaaau

SEQ ID NO: 1704196 - RNA, 22 nt, Salmonella enterica enterica serovar Typhi
cuguuauauauuuuucagcuuc

SEQ ID NO: 1704197 - RNA, 15 nt, Salmonella enterica enterica serovar Typhi
cuggccgaauagcug

SEQ ID NO: 1704198 - RNA, 21 nt, Salmonella enterica enterica serovar Typhi
cuuaaccgggaucgggacaug

SEQ ID NO: 1704199 - RNA, 13 nt, Salmonella enterica enterica serovar Typhi
cuuaaucaccagc

SEQ ID NO: 1704200 - RNA, 14 nt, Salmonella enterica enterica serovar Typhi
cuuaauaucaauau

SEQ ID NO: 1704201 - RNA, 17 nt, Salmonella enterica enterica serovar Typhi
cuuaauaucaauauaau

SEQ ID NO: 1704202 - RNA, 18 nt, Salmonella enterica enterica serovar Typhi
cuuaauaucaauauaauu

SEQ ID NO: 1704203 - RNA, 22 nt, Salmonella enterica enterica serovar Typhi
cuuaauauccaguugcgccagc

SEQ ID NO: 1704204 - RNA, 15 nt, Salmonella enterica enterica serovar Typhi
aaacuggccacagca

SEQ ID NO: 1704205 - RNA, 16 nt, Salmonella enterica enterica serovar Typhi
aaacuggaaaacaagu

SEQ ID NO: 1704206 - RNA, 14 nt, Salmonella enterica enterica serovar Typhi
aaacuggaagaaga

SEQ ID NO: 1704207 - RNA, 14 nt, Salmonella enterica enterica serovar Typhi
aaacugcugacaau

SEQ ID NO: 1704208 - RNA, 15 nt, Salmonella enterica enterica serovar Typhi
aaacugcugccgcag

SEQ ID NO: 1704209 - RNA, 15 nt, Salmonella enterica enterica serovar Typhi
cuuaacagaauugcg

SEQ ID NO: 1704210 - RNA, 22 nt, Salmonella enterica enterica serovar Typhi
cuguuucuccguuguugcacca

SEQ ID NO: 1704211 - RNA, 23 nt, Salmonella enterica enterica serovar Typhi
cuguuucuccguuguugcaccac

SEQ ID NO: 1704212 - RNA, 23 nt, Salmonella enterica enterica serovar Typhi
cuguuuuuggaaacuaugcaaaa

SEQ ID NO: 1704213 - RNA, 14 nt, Salmonella enterica enterica serovar Typhi
cuuaaaaaauccug

SEQ ID NO: 1704214 - RNA, 14 nt, Salmonella enterica enterica serovar Typhi
cuuaccaucuggcc

SEQ ID NO: 1704215 - RNA, 23 nt, Salmonella enterica enterica serovar Typhi
cuuacagggcgaugccucacccc

SEQ ID NO: 1704216 - RNA, 19 nt, Salmonella enterica enterica serovar Typhi
cuuacaggcgcaucagaaa

SEQ ID NO: 1704217 - RNA, 16 nt, Salmonella enterica enterica serovar Typhi
cuuaaugcucugcugu

SEQ ID NO: 1704218 - RNA, 18 nt, Salmonella enterica enterica serovar Typhi
cuuaauggcuucaccguu

SEQ ID NO: 1704219 - RNA, 17 nt, Salmonella enterica enterica serovar Typhi
cuuaauuaacgccgcga

SEQ ID NO: 1704220 - RNA, 23 nt, Salmonella enterica enterica serovar Typhi
cuuaccuauuuuaaauucccagc

SEQ ID NO: 1704221 - RNA, 15 nt, Salmonella enterica enterica serovar Typhi
cuuaccgggcaucug

SEQ ID NO: 1704222 - RNA, 15 nt, Salmonella enterica enterica serovar Typhi
cuuaccuaagucagu

SEQ ID NO: 1704223 - RNA, 23 nt, Salmonella enterica enterica serovar Typhi
cuuagcacccaccaucacuucca

SEQ ID NO: 1704224 - RNA, 14 nt, Salmonella enterica enterica serovar Typhi
cuuaggcagccagg

SEQ ID NO: 1704225 - RNA, 16 nt, Salmonella enterica enterica serovar Typhi
cuuaggauaauucccc

SEQ ID NO: 1704226 - RNA, 18 nt, Salmonella enterica enterica serovar Typhi
cuuaggauaauuccccca

SEQ ID NO: 1704227 - RNA, 19 nt, Salmonella enterica enterica serovar Typhi
cuuagcgcccgguuuuuuu

SEQ ID NO: 1704228 - RNA, 12 nt, Salmonella enterica enterica serovar Typhi
cuuauauuuauu

SEQ ID NO: 1704229 - RNA, 19 nt, Salmonella enterica enterica serovar Typhi
cuuauccggccuauagcua

SEQ ID NO: 1704230 - RNA, 17 nt, Salmonella enterica enterica serovar Typhi
cuuauccggccuccaaa

SEQ ID NO: 1704231 - RNA, 11 nt, Salmonella enterica enterica serovar Typhi
cuuaucagaac

SEQ ID NO: 1704232 - RNA, 19 nt, Salmonella enterica enterica serovar Typhi
cuuauccgcuuuuaaacgg

SEQ ID NO: 1704233 - RNA, 20 nt, Salmonella enterica enterica serovar Typhi
cuuaucaaaccagcuuuuca

SEQ ID NO: 1704234 - RNA, 14 nt, Salmonella enterica enterica serovar Typhi
cuuaucaagcgaua

SEQ ID NO: 1704235 - RNA, 21 nt, Salmonella enterica enterica serovar Typhi
cuuaugaucgcccagccacuc

SEQ ID NO: 1704236 - RNA, 20 nt, Salmonella enterica enterica serovar Typhi
cuuauccggcuuacggcuau

SEQ ID NO: 1704237 - RNA, 23 nt, Salmonella enterica enterica serovar Typhi
cuuauccggcuuauccggccugc

SEQ ID NO: 1704238 - RNA, 22 nt, Salmonella enterica enterica serovar Typhi
cuuauccggccugcaaaccgcc

SEQ ID NO: 1704239 - RNA, 20 nt, Salmonella enterica enterica serovar Typhi
cuuauccggccuaccgucuc

SEQ ID NO: 1704240 - RNA, 22 nt, Salmonella enterica enterica serovar Typhi
cuuaucggcguguuucaucuca

SEQ ID NO: 1704241 - RNA, 19 nt, Salmonella enterica enterica serovar Typhi
cuuaucgagugucaauaag

SEQ ID NO: 1704242 - RNA, 16 nt, Salmonella enterica enterica serovar Typhi
cuuaucgccaaagaua

SEQ ID NO: 1704243 - RNA, 15 nt, Salmonella enterica enterica serovar Typhi
cuuauuucuccugcg

SEQ ID NO: 1704244 - RNA, 13 nt, Salmonella enterica enterica serovar Typhi
cuuauuuguauug

SEQ ID NO: 1704245 - RNA, 16 nt, Salmonella enterica enterica serovar Typhi
cuuauugucgccgccg

SEQ ID NO: 1704246 - RNA, 22 nt, Salmonella enterica enterica serovar Typhi
cuuccaguucgcugaggcguug

SEQ ID NO: 1704247 - RNA, 10 nt, Salmonella enterica enterica serovar Typhi
cuuccaguac

SEQ ID NO: 1704248 - RNA, 23 nt, Salmonella enterica enterica serovar Typhi
cuucccgcaccgcgaugcugcuc

SEQ ID NO: 1704249 - RNA, 13 nt, Salmonella enterica enterica serovar Typhi
cuuccaguugcuu

SEQ ID NO: 1704250 - RNA, 12 nt, Salmonella enterica enterica serovar Typhi
cuucccggcgga

SEQ ID NO: 1704251 - RNA, 19 nt, Salmonella enterica enterica serovar Typhi
cuucccggcggaagcgaau

SEQ ID NO: 1704252 - RNA, 19 nt, Salmonella enterica enterica serovar Typhi
cuucccgcgcagugcagcg

SEQ ID NO: 1704253 - RNA, 19 nt, Salmonella enterica enterica serovar Typhi
cuuccgcuuuaagcgcugc

SEQ ID NO: 1704254 - RNA, 18 nt, Salmonella enterica enterica serovar Typhi
cuuccggcacucuucuuc

SEQ ID NO: 1704255 - RNA, 16 nt, Salmonella enterica enterica serovar Typhi
cuuccggcgagagaau

SEQ ID NO: 1704256 - RNA, 21 nt, Salmonella enterica enterica serovar Typhi
aaacuucaauucagaaaguua

SEQ ID NO: 1704257 - RNA, 22 nt, Salmonella enterica enterica serovar Typhi
aaacuuccacacggcauucacg

SEQ ID NO: 1704258 - RNA, 20 nt, Salmonella enterica enterica serovar Typhi
aaacuucccgcgcagugcag

SEQ ID NO: 1704259 - RNA, 12 nt, Salmonella enterica enterica serovar Typhi
cuuccagcucca

SEQ ID NO: 1704260 - RNA, 24 nt, Salmonella enterica enterica serovar Typhi
cuuccagcgcgccgucaucgcuca

SEQ ID NO: 1704261 - RNA, 18 nt, Salmonella enterica enterica serovar Typhi
cuuccagcgcguccagcc

SEQ ID NO: 1704262 - RNA, 13 nt, Salmonella enterica enterica serovar Typhi
cuuccagcggcag

SEQ ID NO: 1704263 - RNA, 23 nt, Salmonella enterica enterica serovar Typhi
cuuccagaauucguacguuuuuc

SEQ ID NO: 1704264 - RNA, 17 nt, Salmonella enterica enterica serovar Typhi
cuuccacgcacgccggc

SEQ ID NO: 1704265 - RNA, 16 nt, Salmonella enterica enterica serovar Typhi
cuuccacccgcgcgcu

SEQ ID NO: 1704266 - RNA, 19 nt, Salmonella enterica enterica serovar Typhi
cuucggcgucgugcugggc

SEQ ID NO: 1704267 - RNA, 16 nt, Salmonella enterica enterica serovar Typhi
cuucgcggaauuucag

SEQ ID NO: 1704268 - RNA, 13 nt, Salmonella enterica enterica serovar Typhi
cuucgcggccgcu

SEQ ID NO: 1704269 - RNA, 21 nt, Salmonella enterica enterica serovar Typhi
cuucgcgccuucuaccgcuuc

SEQ ID NO: 1704270 - RNA, 12 nt, Salmonella enterica enterica serovar Typhi
cuucgauaaacg

SEQ ID NO: 1704271 - RNA, 21 nt, Salmonella enterica enterica serovar Typhi
cuucgccuaaaucaagcagug

SEQ ID NO: 1704272 - RNA, 22 nt, Salmonella enterica enterica serovar Typhi
cuucgaggauaaaaucgccaaa

SEQ ID NO: 1704273 - RNA, 12 nt, Salmonella enterica enterica serovar Typhi
cuuccugcugcg

SEQ ID NO: 1704274 - RNA, 14 nt, Salmonella enterica enterica serovar Typhi
cuuccugcacgccu

SEQ ID NO: 1704275 - RNA, 18 nt, Salmonella enterica enterica serovar Typhi
cuucgacaaucagcacca

SEQ ID NO: 1704276 - RNA, 18 nt, Salmonella enterica enterica serovar Typhi
cuucgaccgucagcagca

SEQ ID NO: 1704277 - RNA, 18 nt, Salmonella enterica enterica serovar Typhi
cuuccuucguuacuuuca

SEQ ID NO: 1704278 - RNA, 22 nt, Salmonella enterica enterica serovar Typhi
cuuccgggcgacgauacaacuc

SEQ ID NO: 1704279 - RNA, 15 nt, Salmonella enterica enterica serovar Typhi
cuuccgggcgggcgc

SEQ ID NO: 1704280 - RNA, 20 nt, Salmonella enterica enterica serovar Typhi
cuuccgguugaccgcauaau

SEQ ID NO: 1704281 - RNA, 23 nt, Salmonella enterica enterica serovar Typhi
cuuccgucaaaaaaucgaccaac

SEQ ID NO: 1704282 - RNA, 14 nt, Salmonella enterica enterica serovar Typhi
cuuccgucagcgaa

SEQ ID NO: 1704283 - RNA, 16 nt, Salmonella enterica enterica serovar Typhi
cuuccguaaaaagaac

SEQ ID NO: 1704284 - RNA, 14 nt, Salmonella enterica enterica serovar Typhi
cuuccguccccagc

SEQ ID NO: 1704285 - RNA, 22 nt, Salmonella enterica enterica serovar Typhi
cuuccuccagcaucagguggaa

SEQ ID NO: 1704286 - RNA, 18 nt, Salmonella enterica enterica serovar Typhi
cuuccucauuuuugccca

SEQ ID NO: 1704287 - RNA, 19 nt, Salmonella enterica enterica serovar Typhi
cuuccucaccguagcucca

SEQ ID NO: 1704288 - RNA, 14 nt, Salmonella enterica enterica serovar Typhi
cuuccucacagccu

SEQ ID NO: 1704289 - RNA, 13 nt, Salmonella enterica enterica serovar Typhi
cuucagagcaggu

SEQ ID NO: 1704290 - RNA, 18 nt, Salmonella enterica enterica serovar Typhi
cuucagaggccuuuugca

SEQ ID NO: 1704291 - RNA, 21 nt, Salmonella enterica enterica serovar Typhi
cuucagagcugaaaauguggu

SEQ ID NO: 1704292 - RNA, 19 nt, Salmonella enterica enterica serovar Typhi
cuucagcaucaucucccag

SEQ ID NO: 1704293 - RNA, 14 nt, Salmonella enterica enterica serovar Typhi
cuucagcaucaucu

SEQ ID NO: 1704294 - RNA, 20 nt, Salmonella enterica enterica serovar Typhi
cuucaggagaccuaaagucu

SEQ ID NO: 1704295 - RNA, 12 nt, Salmonella enterica enterica serovar Typhi
cuucaguaacca

SEQ ID NO: 1704296 - RNA, 19 nt, Salmonella enterica enterica serovar Typhi
cuucaguaaccagggagga

SEQ ID NO: 1704297 - RNA, 15 nt, Salmonella enterica enterica serovar Typhi
cuucaguaagcgagu

SEQ ID NO: 1704298 - RNA, 19 nt, Salmonella enterica enterica serovar Typhi
cuucagucuacuacacacu

SEQ ID NO: 1704299 - RNA, 18 nt, Salmonella enterica enterica serovar Typhi
cuucaguucagccgccag

SEQ ID NO: 1704300 - RNA, 14 nt, Salmonella enterica enterica serovar Typhi
cuucaucagccagc

SEQ ID NO: 1704301 - RNA, 17 nt, Salmonella enterica enterica serovar Typhi
cuucaucaguaacugac

SEQ ID NO: 1704302 - RNA, 15 nt, Salmonella enterica enterica serovar Typhi
cuucauccagauagg

SEQ ID NO: 1704303 - RNA, 14 nt, Salmonella enterica enterica serovar Typhi
cuucauccacgccg

SEQ ID NO: 1704304 - RNA, 15 nt, Salmonella enterica enterica serovar Typhi
cuucaucccacucaa

SEQ ID NO: 1704305 - RNA, 21 nt, Salmonella enterica enterica serovar Typhi
cuucaaccguuucuuuuucga

SEQ ID NO: 1704306 - RNA, 19 nt, Salmonella enterica enterica serovar Typhi
cuuauuuuccguuagccaa

SEQ ID NO: 1704307 - RNA, 20 nt, Salmonella enterica enterica serovar Typhi
cuuauuuuauuuuuauauuc

SEQ ID NO: 1704308 - RNA, 19 nt, Salmonella enterica enterica serovar Typhi
cuucaacgcaggcgaaauc

SEQ ID NO: 1704309 - RNA, 15 nt, Salmonella enterica enterica serovar Typhi
cuucaacgccgcgcu

SEQ ID NO: 1704310 - RNA, 13 nt, Salmonella enterica enterica serovar Typhi
cuucaacgcgccg

SEQ ID NO: 1704311 - RNA, 18 nt, Salmonella enterica enterica serovar Typhi
cuucaagccaggcuuuaa

SEQ ID NO: 1704312 - RNA, 14 nt, Salmonella enterica enterica serovar Typhi
cuucaagccaggcu

SEQ ID NO: 1704313 - RNA, 18 nt, Salmonella enterica enterica serovar Typhi
cuucaccgagaaauuuag

SEQ ID NO: 1704314 - RNA, 16 nt, Salmonella enterica enterica serovar Typhi
cuucacguuuuccagg

SEQ ID NO: 1704315 - RNA, 21 nt, Salmonella enterica enterica serovar Typhi
cuucacguugacgcaaacugc

SEQ ID NO: 1704316 - RNA, 13 nt, Salmonella enterica enterica serovar Typhi
cuucaccacgcca

SEQ ID NO: 1704317 - RNA, 19 nt, Salmonella enterica enterica serovar Typhi
cuucacccagacugugaug

SEQ ID NO: 1704318 - RNA, 14 nt, Salmonella enterica enterica serovar Typhi
cuucaccacgccau

SEQ ID NO: 1704319 - RNA, 16 nt, Salmonella enterica enterica serovar Typhi
cuuuaaagcccagcac

SEQ ID NO: 1704320 - RNA, 13 nt, Salmonella enterica enterica serovar Typhi
cuuguucuuuuca

SEQ ID NO: 1704321 - RNA, 15 nt, Salmonella enterica enterica serovar Typhi
cuuguucuuccauug

SEQ ID NO: 1704322 - RNA, 12 nt, Salmonella enterica enterica serovar Typhi
aaagaaauuuaa

SEQ ID NO: 1704323 - RNA, 12 nt, Salmonella enterica enterica serovar Typhi
aaagaaaucacc

SEQ ID NO: 1704324 - RNA, 16 nt, Salmonella enterica enterica serovar Typhi
aaagaacaauaaucau

SEQ ID NO: 1704325 - RNA, 18 nt, Salmonella enterica enterica serovar Typhi
aaagaacguguuuuucca

SEQ ID NO: 1704326 - RNA, 21 nt, Salmonella enterica enterica serovar Typhi
aaagaagaaaccgcagaaaaa

SEQ ID NO: 1704327 - RNA, 23 nt, Salmonella enterica enterica serovar Typhi
aaagaagaaaccgcagaaaaagc

SEQ ID NO: 1704328 - RNA, 12 nt, Salmonella enterica enterica serovar Typhi
aaagaagaauaa

SEQ ID NO: 1704329 - RNA, 18 nt, Salmonella enterica enterica serovar Typhi
aaagaaaacuuucauuuc

SEQ ID NO: 1704330 - RNA, 19 nt, Salmonella enterica enterica serovar Typhi
aaagaaaacuuucauuuca

SEQ ID NO: 1704331 - RNA, 14 nt, Salmonella enterica enterica serovar Typhi
aaagaaaaugccag

SEQ ID NO: 1704332 - RNA, 14 nt, Salmonella enterica enterica serovar Typhi
cuuguucgcagguc

SEQ ID NO: 1704333 - RNA, 20 nt, Salmonella enterica enterica serovar Typhi
cuuguuauccaucagccagg

SEQ ID NO: 1704334 - RNA, 18 nt, Salmonella enterica enterica serovar Typhi
cuugguaccaaacagcag

SEQ ID NO: 1704335 - RNA, 12 nt, Salmonella enterica enterica serovar Typhi
cuuggucauaau

SEQ ID NO: 1704336 - RNA, 14 nt, Salmonella enterica enterica serovar Typhi
cuugucagcuuucu

SEQ ID NO: 1704337 - RNA, 15 nt, Salmonella enterica enterica serovar Typhi
cuugucauccugcuc

SEQ ID NO: 1704338 - RNA, 23 nt, Salmonella enterica enterica serovar Typhi
cuuguauuacguguaguuauaaa

SEQ ID NO: 1704339 - RNA, 17 nt, Salmonella enterica enterica serovar Typhi
cuuuuaagguuaauucu

SEQ ID NO: 1704340 - RNA, 14 nt, Salmonella enterica enterica serovar Typhi
cuuuggcgcccauu

SEQ ID NO: 1704341 - RNA, 21 nt, Salmonella enterica enterica serovar Typhi
cuuuggcgcgcgguuuauccc

SEQ ID NO: 1704342 - RNA, 21 nt, Salmonella enterica enterica serovar Typhi
cuuuggcuuaaucauugcuca

SEQ ID NO: 1704343 - RNA, 15 nt, Salmonella enterica enterica serovar Typhi
cuuuggcaaaaaagg

SEQ ID NO: 1704344 - RNA, 18 nt, Salmonella enterica enterica serovar Typhi
cuuuggcaaacggcgcca

SEQ ID NO: 1704345 - RNA, 19 nt, Salmonella enterica enterica serovar Typhi
cuuuggacggcaucaggaa

SEQ ID NO: 1704346 - RNA, 23 nt, Salmonella enterica enterica serovar Typhi
cuuugagcaucaaacuuuuaaau

SEQ ID NO: 1704347 - RNA, 15 nt, Salmonella enterica enterica serovar Typhi
cuuugaggaucaauu

SEQ ID NO: 1704348 - RNA, 22 nt, Salmonella enterica enterica serovar Typhi
cuuugccguucucugacaaaau

SEQ ID NO: 1704349 - RNA, 19 nt, Salmonella enterica enterica serovar Typhi
cuuugccuucuguuuuuug

SEQ ID NO: 1704350 - RNA, 13 nt, Salmonella enterica enterica serovar Typhi
cuuugccuuucuu

SEQ ID NO: 1704351 - RNA, 20 nt, Salmonella enterica enterica serovar Typhi
cuuugcgccggcaguuuaag

SEQ ID NO: 1704352 - RNA, 21 nt, Salmonella enterica enterica serovar Typhi
cuuugccuuuuucccacugcg

SEQ ID NO: 1704353 - RNA, 15 nt, Salmonella enterica enterica serovar Typhi
cuuugcgauuugucc

SEQ ID NO: 1704354 - RNA, 19 nt, Salmonella enterica enterica serovar Typhi
cuuugcgauagcccggcau

SEQ ID NO: 1704355 - RNA, 20 nt, Salmonella enterica enterica serovar Typhi
cuuugcuuuguaaagcgcca

SEQ ID NO: 1704356 - RNA, 21 nt, Salmonella enterica enterica serovar Typhi
cuuuccugaucaaucaacucu

SEQ ID NO: 1704357 - RNA, 18 nt, Salmonella enterica enterica serovar Typhi
cuuuccuuuuucaggcac

SEQ ID NO: 1704358 - RNA, 21 nt, Salmonella enterica enterica serovar Typhi
cuuucgaagccgaccaccauc

SEQ ID NO: 1704359 - RNA, 18 nt, Salmonella enterica enterica serovar Typhi
cuuuccuuauuaaagccc

SEQ ID NO: 1704360 - RNA, 23 nt, Salmonella enterica enterica serovar Typhi
cuuuccuuauuaaagccccuucc

SEQ ID NO: 1704361 - RNA, 17 nt, Salmonella enterica enterica serovar Typhi
cuuuccggcgcuuccug

SEQ ID NO: 1704362 - RNA, 14 nt, Salmonella enterica enterica serovar Typhi
cuuucgccaguuca

SEQ ID NO: 1704363 - RNA, 21 nt, Salmonella enterica enterica serovar Typhi
cuuucgcaacauccgaaagcu

SEQ ID NO: 1704364 - RNA, 19 nt, Salmonella enterica enterica serovar Typhi
cuuucuuccagguuaaccc

SEQ ID NO: 1704365 - RNA, 14 nt, Salmonella enterica enterica serovar Typhi
cuuucuucaauggc

SEQ ID NO: 1704366 - RNA, 22 nt, Salmonella enterica enterica serovar Typhi
cuuucgucguccacucuuccgg

SEQ ID NO: 1704367 - RNA, 16 nt, Salmonella enterica enterica serovar Typhi
cuuucggacuuccugu

SEQ ID NO: 1704368 - RNA, 17 nt, Salmonella enterica enterica serovar Typhi
cuuucggacuuccugua

SEQ ID NO: 1704369 - RNA, 19 nt, Salmonella enterica enterica serovar Typhi
cuuucggcaaagcacugcu

SEQ ID NO: 1704370 - RNA, 22 nt, Salmonella enterica enterica serovar Typhi
cuuucggcaaagcacugcugcu

SEQ ID NO: 1704371 - RNA, 22 nt, Salmonella enterica enterica serovar Typhi
cuuucggucguuugccgugcau

SEQ ID NO: 1704372 - RNA, 22 nt, Salmonella enterica enterica serovar Typhi
cuuucggguugcccugcuuguc

SEQ ID NO: 1704373 - RNA, 13 nt, Salmonella enterica enterica serovar Typhi
aaagaagggcagg

SEQ ID NO: 1704374 - RNA, 16 nt, Salmonella enterica enterica serovar Typhi
aaagacagcaggcuuu

SEQ ID NO: 1704375 - RNA, 16 nt, Salmonella enterica enterica serovar Typhi
cuuuaagcaccgcuuu

SEQ ID NO: 1704376 - RNA, 20 nt, Salmonella enterica enterica serovar Typhi
cuuuaagccgauugaauaau

SEQ ID NO: 1704377 - RNA, 13 nt, Salmonella enterica enterica serovar Typhi
cuuuaaccucuuu

SEQ ID NO: 1704378 - RNA, 15 nt, Salmonella enterica enterica serovar Typhi
cuuuaaccgccugcu

SEQ ID NO: 1704379 - RNA, 16 nt, Salmonella enterica enterica serovar Typhi
cuuuaaccucuuuuuc

SEQ ID NO: 1704380 - RNA, 18 nt, Salmonella enterica enterica serovar Typhi
cuuuacgcuuguuguaaa

SEQ ID NO: 1704381 - RNA, 19 nt, Salmonella enterica enterica serovar Typhi
cuuuacugcgccagccugc

SEQ ID NO: 1704382 - RNA, 16 nt, Salmonella enterica enterica serovar Typhi
cuuuaccaaugugcaa

SEQ ID NO: 1704383 - RNA, 13 nt, Salmonella enterica enterica serovar Typhi
cuuuacaccccac

SEQ ID NO: 1704384 - RNA, 17 nt, Salmonella enterica enterica serovar Typhi
cuuuaucguaaccgaug

SEQ ID NO: 1704385 - RNA, 20 nt, Salmonella enterica enterica serovar Typhi
cuuuaucuuuuagcgcgccg

SEQ ID NO: 1704386 - RNA, 20 nt, Salmonella enterica enterica serovar Typhi
cuuuaucuucugcugcuccc

SEQ ID NO: 1704387 - RNA, 20 nt, Salmonella enterica enterica serovar Typhi
cuuuagaaaaagaaaccucc

SEQ ID NO: 1704388 - RNA, 23 nt, Salmonella enterica enterica serovar Typhi
cuuuauaaaaagcacaucagcaa

SEQ ID NO: 1704389 - RNA, 19 nt, Salmonella enterica enterica serovar Typhi
cuuuccagcuccagccgcu

SEQ ID NO: 1704390 - RNA, 14 nt, Salmonella enterica enterica serovar Typhi
cuuuccagcuccag

SEQ ID NO: 1704391 - RNA, 15 nt, Salmonella enterica enterica serovar Typhi
cuuuccagcuccagc

SEQ ID NO: 1704392 - RNA, 14 nt, Salmonella enterica enterica serovar Typhi
cuuuccagcagcca

SEQ ID NO: 1704393 - RNA, 20 nt, Salmonella enterica enterica serovar Typhi
cuuuccagcaacugacgcgc

SEQ ID NO: 1704394 - RNA, 13 nt, Salmonella enterica enterica serovar Typhi
cuuuccagcagcc

SEQ ID NO: 1704395 - RNA, 23 nt, Salmonella enterica enterica serovar Typhi
cuuuccacaaucccggcaacugc

SEQ ID NO: 1704396 - RNA, 21 nt, Salmonella enterica enterica serovar Typhi
cuuucagaccaaauucagcgu

SEQ ID NO: 1704397 - RNA, 14 nt, Salmonella enterica enterica serovar Typhi
cuuuccacaaucaa

SEQ ID NO: 1704398 - RNA, 13 nt, Salmonella enterica enterica serovar Typhi
cuuuccaaccugu

SEQ ID NO: 1704399 - RNA, 16 nt, Salmonella enterica enterica serovar Typhi
cuuucagaugcagcgg

SEQ ID NO: 1704400 - RNA, 18 nt, Salmonella enterica enterica serovar Typhi
cuuucagagcccgggaga

SEQ ID NO: 1704401 - RNA, 18 nt, Salmonella enterica enterica serovar Typhi
gaaaauauuagcggcggc

SEQ ID NO: 1704402 - RNA, 21 nt, Salmonella enterica enterica serovar Typhi
gaaaauuguccacggggcggc

SEQ ID NO: 1704403 - RNA, 17 nt, Salmonella enterica enterica serovar Typhi
gaaaagucauuuucaug

SEQ ID NO: 1704404 - RNA, 23 nt, Salmonella enterica enterica serovar Typhi
gaaaauaaacgcuugacucugaa

SEQ ID NO: 1704405 - RNA, 13 nt, Salmonella enterica enterica serovar Typhi
gaaaauaucggcc

SEQ ID NO: 1704406 - RNA, 18 nt, Salmonella enterica enterica serovar Typhi
gaaaauaucggccugaau

SEQ ID NO: 1704407 - RNA, 13 nt, Salmonella enterica enterica serovar Typhi
gaaaauauaaucu

SEQ ID NO: 1704408 - RNA, 15 nt, Salmonella enterica enterica serovar Typhi
gaaaauauaugacaa

SEQ ID NO: 1704409 - RNA, 19 nt, Salmonella enterica enterica serovar Typhi
gaaaauauuagcggcggca

SEQ ID NO: 1704410 - RNA, 22 nt, Salmonella enterica enterica serovar Typhi
gaaaauaugagguugucuuugc

SEQ ID NO: 1704411 - RNA, 17 nt, Salmonella enterica enterica serovar Typhi
gaaaaggucgucaggcc

SEQ ID NO: 1704412 - RNA, 23 nt, Salmonella enterica enterica serovar Typhi
gaaaaggccuggcugagaaaaau

SEQ ID NO: 1704413 - RNA, 21 nt, Salmonella enterica enterica serovar Typhi
gaaaaggccuggcugagaaaa

SEQ ID NO: 1704414 - RNA, 11 nt, Salmonella enterica enterica serovar Typhi
gaaaagcuggu

SEQ ID NO: 1704415 - RNA, 20 nt, Salmonella enterica enterica serovar Typhi
gaaaaggaagaauaaauaac

SEQ ID NO: 1704416 - RNA, 20 nt, Salmonella enterica enterica serovar Typhi
gaaaagcgggggcgacagcc

SEQ ID NO: 1704417 - RNA, 13 nt, Salmonella enterica enterica serovar Typhi
gaaaaauguguug

SEQ ID NO: 1704418 - RNA, 16 nt, Salmonella enterica enterica serovar Typhi
gaaaaaugaauaccaa

SEQ ID NO: 1704419 - RNA, 20 nt, Salmonella enterica enterica serovar Typhi
gaaaaagaaguuagauauua

SEQ ID NO: 1704420 - RNA, 13 nt, Salmonella enterica enterica serovar Typhi
gaaacauacuguc

SEQ ID NO: 1704421 - RNA, 12 nt, Salmonella enterica enterica serovar Typhi
gaaacaccagaa

SEQ ID NO: 1704422 - RNA, 23 nt, Salmonella enterica enterica serovar Typhi
gaaacaacacaaaucgggcgggc

SEQ ID NO: 1704423 - RNA, 17 nt, Salmonella enterica enterica serovar Typhi
gaaacccgcucgcccgc

SEQ ID NO: 1704424 - RNA, 12 nt, Salmonella enterica enterica serovar Typhi
gaaaccuccgca

SEQ ID NO: 1704425 - RNA, 16 nt, Salmonella enterica enterica serovar Typhi
gaaaccgcagaaaaag

SEQ ID NO: 1704426 - RNA, 15 nt, Salmonella enterica enterica serovar Typhi
gaaaccgcagaaaaa

SEQ ID NO: 1704427 - RNA, 21 nt, Salmonella enterica enterica serovar Typhi
gaaaccggcgcgccuuccagc

SEQ ID NO: 1704428 - RNA, 12 nt, Salmonella enterica enterica serovar Typhi
cuuuuucaggca

SEQ ID NO: 1704429 - RNA, 20 nt, Salmonella enterica enterica serovar Typhi
cuuuuucauagaaccacuua

SEQ ID NO: 1704430 - RNA, 15 nt, Salmonella enterica enterica serovar Typhi
cuuuuucccacugcg

SEQ ID NO: 1704431 - RNA, 17 nt, Salmonella enterica enterica serovar Typhi
cuuuuugugcaaucaca

SEQ ID NO: 1704432 - RNA, 20 nt, Salmonella enterica enterica serovar Typhi
cuuuuugcauucgcuccuca

SEQ ID NO: 1704433 - RNA, 11 nt, Salmonella enterica enterica serovar Typhi
cuuuuuuucaa

SEQ ID NO: 1704434 - RNA, 17 nt, Salmonella enterica enterica serovar Typhi
cuuuuuuuaugccuggg

SEQ ID NO: 1704435 - RNA, 14 nt, Salmonella enterica enterica serovar Typhi
gaaaaaauuaaaaa

SEQ ID NO: 1704436 - RNA, 13 nt, Salmonella enterica enterica serovar Typhi
gaaaaaauuacag

SEQ ID NO: 1704437 - RNA, 18 nt, Salmonella enterica enterica serovar Typhi
gaaaaagaaaccuccgca

SEQ ID NO: 1704438 - RNA, 20 nt, Salmonella enterica enterica serovar Typhi
gaaaaacucaccgcuaugaa

SEQ ID NO: 1704439 - RNA, 17 nt, Salmonella enterica enterica serovar Typhi
cuuuugguggcaacaga

SEQ ID NO: 1704440 - RNA, 15 nt, Salmonella enterica enterica serovar Typhi
cuuuugguuuuucaa

SEQ ID NO: 1704441 - RNA, 19 nt, Salmonella enterica enterica serovar Typhi
cuuuugguuuuucaaccac

SEQ ID NO: 1704442 - RNA, 15 nt, Salmonella enterica enterica serovar Typhi
cuuuuuaaaaugacc

SEQ ID NO: 1704443 - RNA, 22 nt, Salmonella enterica enterica serovar Typhi
cuuuuuaaccauaaugucuucc

SEQ ID NO: 1704444 - RNA, 16 nt, Salmonella enterica enterica serovar Typhi
cuuuuuauuacuuucu

SEQ ID NO: 1704445 - RNA, 17 nt, Salmonella enterica enterica serovar Typhi
cuuuuuauuuacugccg

SEQ ID NO: 1704446 - RNA, 22 nt, Salmonella enterica enterica serovar Typhi
cuuuuuagcacagcucuaauug

SEQ ID NO: 1704447 - RNA, 16 nt, Salmonella enterica enterica serovar Typhi
cuuuuuauauaagcau

SEQ ID NO: 1704448 - RNA, 18 nt, Salmonella enterica enterica serovar Typhi
cuuuuuaggcuauaaaaa

SEQ ID NO: 1704449 - RNA, 20 nt, Salmonella enterica enterica serovar Typhi
cuuuuggcguaauggcggga

SEQ ID NO: 1704450 - RNA, 18 nt, Salmonella enterica enterica serovar Typhi
cuuuugauacucugcuuu

SEQ ID NO: 1704451 - RNA, 21 nt, Salmonella enterica enterica serovar Typhi
cuuuugauacucugcuuuuuc

SEQ ID NO: 1704452 - RNA, 12 nt, Salmonella enterica enterica serovar Typhi
cuuuugagcagc

SEQ ID NO: 1704453 - RNA, 16 nt, Salmonella enterica enterica serovar Typhi
cuuuuauccccaccac

SEQ ID NO: 1704454 - RNA, 22 nt, Salmonella enterica enterica serovar Typhi
cuuuuaauuuuuaugucauuua

SEQ ID NO: 1704455 - RNA, 19 nt, Salmonella enterica enterica serovar Typhi
cuuuuaguuacgcacgcca

SEQ ID NO: 1704456 - RNA, 14 nt, Salmonella enterica enterica serovar Typhi
cuuuuaguauuuac

SEQ ID NO: 1704457 - RNA, 16 nt, Salmonella enterica enterica serovar Typhi
cuuuuaguauuuacaa

SEQ ID NO: 1704458 - RNA, 23 nt, Salmonella enterica enterica serovar Typhi
gaaaucugcacguaccugcucca

SEQ ID NO: 1704459 - RNA, 15 nt, Salmonella enterica enterica serovar Typhi
gaaaucuguuccagc

SEQ ID NO: 1704460 - RNA, 20 nt, Salmonella enterica enterica serovar Typhi
gaaaucuguuccagcgagca

SEQ ID NO: 1704461 - RNA, 21 nt, Salmonella enterica enterica serovar Typhi
gaaaugcccauaaagaaauau

SEQ ID NO: 1704462 - RNA, 17 nt, Salmonella enterica enterica serovar Typhi
gaaaugccggauggcgu

SEQ ID NO: 1704463 - RNA, 18 nt, Salmonella enterica enterica serovar Typhi
gaaaugccgggcaaaaaa

SEQ ID NO: 1704464 - RNA, 17 nt, Salmonella enterica enterica serovar Typhi
gaaaugcccauaaagaa

SEQ ID NO: 1704465 - RNA, 14 nt, Salmonella enterica enterica serovar Typhi
gaaaucuaucugua

SEQ ID NO: 1704466 - RNA, 18 nt, Salmonella enterica enterica serovar Typhi
gaaaucgugcgccccagg

SEQ ID NO: 1704467 - RNA, 22 nt, Salmonella enterica enterica serovar Typhi
gaaaucgucagacggcuccagc

SEQ ID NO: 1704468 - RNA, 17 nt, Salmonella enterica enterica serovar Typhi
gaaaucucccuggcagu

SEQ ID NO: 1704469 - RNA, 17 nt, Salmonella enterica enterica serovar Typhi
gaaaugcgaauccggcg

SEQ ID NO: 1704470 - RNA, 17 nt, Salmonella enterica enterica serovar Typhi
gaaaugcgacaucucag

SEQ ID NO: 1704471 - RNA, 17 nt, Salmonella enterica enterica serovar Typhi
gaaaugccuuauccggc

SEQ ID NO: 1704472 - RNA, 15 nt, Salmonella enterica enterica serovar Typhi
gaaauguauucuccc

SEQ ID NO: 1704473 - RNA, 17 nt, Salmonella enterica enterica serovar Typhi
gaaauggguaucuucau

SEQ ID NO: 1704474 - RNA, 12 nt, Salmonella enterica enterica serovar Typhi
gaaauuauccac

SEQ ID NO: 1704475 - RNA, 17 nt, Salmonella enterica enterica serovar Typhi
gaaauuauccacaaacu

SEQ ID NO: 1704476 - RNA, 21 nt, Salmonella enterica enterica serovar Typhi
gaaauuuaaagauagcugcuu

SEQ ID NO: 1704477 - RNA, 13 nt, Salmonella enterica enterica serovar Typhi
gaaauuuauucau

SEQ ID NO: 1704478 - RNA, 19 nt, Salmonella enterica enterica serovar Typhi
aaagagcguaucgccggcg

SEQ ID NO: 1704479 - RNA, 16 nt, Salmonella enterica enterica serovar Typhi
aaagaggaauguccag

SEQ ID NO: 1704480 - RNA, 21 nt, Salmonella enterica enterica serovar Typhi
gaacagaaaaaaugcaccgcc

SEQ ID NO: 1704481 - RNA, 21 nt, Salmonella enterica enterica serovar Typhi
gaacagaacagugaguuaaga

SEQ ID NO: 1704482 - RNA, 23 nt, Salmonella enterica enterica serovar Typhi
gaacaguguaaacgccagauaau

SEQ ID NO: 1704483 - RNA, 22 nt, Salmonella enterica enterica serovar Typhi
gaacagucccaccagcgcggca

SEQ ID NO: 1704484 - RNA, 13 nt, Salmonella enterica enterica serovar Typhi
gaacagcggcagg

SEQ ID NO: 1704485 - RNA, 16 nt, Salmonella enterica enterica serovar Typhi
gaacagcggcaggcgg

SEQ ID NO: 1704486 - RNA, 18 nt, Salmonella enterica enterica serovar Typhi
gaacaggcuucccaauac

SEQ ID NO: 1704487 - RNA, 15 nt, Salmonella enterica enterica serovar Typhi
gaacagggcgggcga

SEQ ID NO: 1704488 - RNA, 21 nt, Salmonella enterica enterica serovar Typhi
gaacagggcgggcgauagaga

SEQ ID NO: 1704489 - RNA, 15 nt, Salmonella enterica enterica serovar Typhi
gaacagacggcggcu

SEQ ID NO: 1704490 - RNA, 20 nt, Salmonella enterica enterica serovar Typhi
gaacagcaaugcccaaaaua

SEQ ID NO: 1704491 - RNA, 18 nt, Salmonella enterica enterica serovar Typhi
gaaagccucuuccgccug

SEQ ID NO: 1704492 - RNA, 18 nt, Salmonella enterica enterica serovar Typhi
gaaagccccggcucaagc

SEQ ID NO: 1704493 - RNA, 22 nt, Salmonella enterica enterica serovar Typhi
gaaagcgacucauccacauacu

SEQ ID NO: 1704494 - RNA, 16 nt, Salmonella enterica enterica serovar Typhi
gaaagauagcaggccc

SEQ ID NO: 1704495 - RNA, 13 nt, Salmonella enterica enterica serovar Typhi
gaaagauaaaaua

SEQ ID NO: 1704496 - RNA, 12 nt, Salmonella enterica enterica serovar Typhi
gaaagaagaggc

SEQ ID NO: 1704497 - RNA, 17 nt, Salmonella enterica enterica serovar Typhi
gaaagaccugccgaccu

SEQ ID NO: 1704498 - RNA, 19 nt, Salmonella enterica enterica serovar Typhi
gaaacgccgaccacuucaa

SEQ ID NO: 1704499 - RNA, 21 nt, Salmonella enterica enterica serovar Typhi
gaaacgcgccacgcgccagcc

SEQ ID NO: 1704500 - RNA, 18 nt, Salmonella enterica enterica serovar Typhi
gaaacgcuuguggauagu

SEQ ID NO: 1704501 - RNA, 20 nt, Salmonella enterica enterica serovar Typhi
gaaacgcuuuccggggugaa

SEQ ID NO: 1704502 - RNA, 15 nt, Salmonella enterica enterica serovar Typhi
gaaauaggggagacu

SEQ ID NO: 1704503 - RNA, 14 nt, Salmonella enterica enterica serovar Typhi
gaaaguuugaagug

SEQ ID NO: 1704504 - RNA, 13 nt, Salmonella enterica enterica serovar Typhi
gaaaucagcaggu

SEQ ID NO: 1704505 - RNA, 15 nt, Salmonella enterica enterica serovar Typhi
gaaaucauagcccug

SEQ ID NO: 1704506 - RNA, 23 nt, Salmonella enterica enterica serovar Typhi
gaaauccgcgaauaccuucccgc

SEQ ID NO: 1704507 - RNA, 23 nt, Salmonella enterica enterica serovar Typhi
gaaaguuacuuuccauauacucu

SEQ ID NO: 1704508 - RNA, 24 nt, Salmonella enterica enterica serovar Typhi
gaaaguuacuuuccauauacucuu

SEQ ID NO: 1704509 - RNA, 19 nt, Salmonella enterica enterica serovar Typhi
gaaaguugcgccgugccug

SEQ ID NO: 1704510 - RNA, 20 nt, Salmonella enterica enterica serovar Typhi
gaaagucuuuuguuuuucuc

SEQ ID NO: 1704511 - RNA, 14 nt, Salmonella enterica enterica serovar Typhi
gaaaggaagcgggc

SEQ ID NO: 1704512 - RNA, 16 nt, Salmonella enterica enterica serovar Typhi
gaagaccguuuaaacg

SEQ ID NO: 1704513 - RNA, 18 nt, Salmonella enterica enterica serovar Typhi
gaagagagauaguugagc

SEQ ID NO: 1704514 - RNA, 16 nt, Salmonella enterica enterica serovar Typhi
gaagaucguuauccag

SEQ ID NO: 1704515 - RNA, 17 nt, Salmonella enterica enterica serovar Typhi
gaagaucgggagaaggc

SEQ ID NO: 1704516 - RNA, 19 nt, Salmonella enterica enterica serovar Typhi
gaagagcucgaccaacaua

SEQ ID NO: 1704517 - RNA, 18 nt, Salmonella enterica enterica serovar Typhi
gaagagcucgaccaacau

SEQ ID NO: 1704518 - RNA, 22 nt, Salmonella enterica enterica serovar Typhi
gaagacaacgucgcucuuuuca

SEQ ID NO: 1704519 - RNA, 17 nt, Salmonella enterica enterica serovar Typhi
gaacaugccgacggaga

SEQ ID NO: 1704520 - RNA, 15 nt, Salmonella enterica enterica serovar Typhi
gaacaugccgacgga

SEQ ID NO: 1704521 - RNA, 16 nt, Salmonella enterica enterica serovar Typhi
gaacaucgacccccac

SEQ ID NO: 1704522 - RNA, 12 nt, Salmonella enterica enterica serovar Typhi
gaacaugcauau

SEQ ID NO: 1704523 - RNA, 21 nt, Salmonella enterica enterica serovar Typhi
gaagcuacuugaucggcuggc

SEQ ID NO: 1704524 - RNA, 23 nt, Salmonella enterica enterica serovar Typhi
gaagcucaugugcagcauccagc

SEQ ID NO: 1704525 - RNA, 22 nt, Salmonella enterica enterica serovar Typhi
gaagcucaugugcagcauccag

SEQ ID NO: 1704526 - RNA, 19 nt, Salmonella enterica enterica serovar Typhi
gaagcgaccggcgucauca

SEQ ID NO: 1704527 - RNA, 18 nt, Salmonella enterica enterica serovar Typhi
gaagcguuucucuugugc

SEQ ID NO: 1704528 - RNA, 19 nt, Salmonella enterica enterica serovar Typhi
gaagcaucuuuccggaacg

SEQ ID NO: 1704529 - RNA, 21 nt, Salmonella enterica enterica serovar Typhi
gaagcccucggcgaacaggcg

SEQ ID NO: 1704530 - RNA, 14 nt, Salmonella enterica enterica serovar Typhi
gaagccagcgcagu

SEQ ID NO: 1704531 - RNA, 21 nt, Salmonella enterica enterica serovar Typhi
gaagccaccggauugccuucu

SEQ ID NO: 1704532 - RNA, 17 nt, Salmonella enterica enterica serovar Typhi
gaagauuuuuauucccg

SEQ ID NO: 1704533 - RNA, 14 nt, Salmonella enterica enterica serovar Typhi
gaagauuagcagag

SEQ ID NO: 1704534 - RNA, 16 nt, Salmonella enterica enterica serovar Typhi
gaagauuagcagagcg

SEQ ID NO: 1704535 - RNA, 22 nt, Salmonella enterica enterica serovar Typhi
gaaggcucuacucgcggacgac

SEQ ID NO: 1704536 - RNA, 20 nt, Salmonella enterica enterica serovar Typhi
gaaggucaggccacugcccu

SEQ ID NO: 1704537 - RNA, 14 nt, Salmonella enterica enterica serovar Typhi
gaagggcaggggaa

SEQ ID NO: 1704538 - RNA, 17 nt, Salmonella enterica enterica serovar Typhi
gaagggcaauaucauga

SEQ ID NO: 1704539 - RNA, 17 nt, Salmonella enterica enterica serovar Typhi
gaagggcagaucgagga

SEQ ID NO: 1704540 - RNA, 17 nt, Salmonella enterica enterica serovar Typhi
gaagcugccgucccagc

SEQ ID NO: 1704541 - RNA, 14 nt, Salmonella enterica enterica serovar Typhi
gaagcugagaaaag

SEQ ID NO: 1704542 - RNA, 21 nt, Salmonella enterica enterica serovar Typhi
gaagcugaccagggcaaauua

SEQ ID NO: 1704543 - RNA, 14 nt, Salmonella enterica enterica serovar Typhi
gaagcugaccaggg

SEQ ID NO: 1704544 - RNA, 21 nt, Salmonella enterica enterica serovar Typhi
gaaguccguauuauccacccc

SEQ ID NO: 1704545 - RNA, 19 nt, Salmonella enterica enterica serovar Typhi
gaagugcagcguuuccagc

SEQ ID NO: 1704546 - RNA, 20 nt, Salmonella enterica enterica serovar Typhi
gaagugauccuucaacgucu

SEQ ID NO: 1704547 - RNA, 14 nt, Salmonella enterica enterica serovar Typhi
gaagugccagguuu

SEQ ID NO: 1704548 - RNA, 16 nt, Salmonella enterica enterica serovar Typhi
gaagucaaaggccagu

SEQ ID NO: 1704549 - RNA, 16 nt, Salmonella enterica enterica serovar Typhi
gaauaauuucggcggc

SEQ ID NO: 1704550 - RNA, 17 nt, Salmonella enterica enterica serovar Typhi
gaauaccuugauaacug

SEQ ID NO: 1704551 - RNA, 19 nt, Salmonella enterica enterica serovar Typhi
gaauacggaaggauagccg

SEQ ID NO: 1704552 - RNA, 23 nt, Salmonella enterica enterica serovar Typhi
gaauaaaugaauuauuuuuucau

SEQ ID NO: 1704553 - RNA, 21 nt, Salmonella enterica enterica serovar Typhi
gaauaaauauaagaucuauuu

SEQ ID NO: 1704554 - RNA, 17 nt, Salmonella enterica enterica serovar Typhi
gaauaaaggauuguacu

SEQ ID NO: 1704555 - RNA, 16 nt, Salmonella enterica enterica serovar Typhi
gaauaaagguggugcg

SEQ ID NO: 1704556 - RNA, 17 nt, Salmonella enterica enterica serovar Typhi
gaauaaugaccagcgcc

SEQ ID NO: 1704557 - RNA, 15 nt, Salmonella enterica enterica serovar Typhi
gaauaauccuucccg

SEQ ID NO: 1704558 - RNA, 14 nt, Salmonella enterica enterica serovar Typhi
gaauaaccaucgga

SEQ ID NO: 1704559 - RNA, 16 nt, Salmonella enterica enterica serovar Typhi
gaauaaccacugaugg

SEQ ID NO: 1704560 - RNA, 13 nt, Salmonella enterica enterica serovar Typhi
gaaguuauccagc

SEQ ID NO: 1704561 - RNA, 20 nt, Salmonella enterica enterica serovar Typhi
gaaguuaucgaaggucaggc

SEQ ID NO: 1704562 - RNA, 15 nt, Salmonella enterica enterica serovar Typhi
aaagauaaucugaau

SEQ ID NO: 1704563 - RNA, 14 nt, Salmonella enterica enterica serovar Typhi
aaagauaaucugaa

SEQ ID NO: 1704564 - RNA, 22 nt, Salmonella enterica enterica serovar Typhi
gaauaaaggauuguacuuauua

SEQ ID NO: 1704565 - RNA, 16 nt, Salmonella enterica enterica serovar Typhi
gaaguuuaauucuuug

SEQ ID NO: 1704566 - RNA, 19 nt, Salmonella enterica enterica serovar Typhi
gaaguuuaauucuuugagc

SEQ ID NO: 1704567 - RNA, 15 nt, Salmonella enterica enterica serovar Typhi
gaaguugcuuccagu

SEQ ID NO: 1704568 - RNA, 17 nt, Salmonella enterica enterica serovar Typhi
gaaugcguuuuuucacc

SEQ ID NO: 1704569 - RNA, 14 nt, Salmonella enterica enterica serovar Typhi
gaaugcuauaugca

SEQ ID NO: 1704570 - RNA, 23 nt, Salmonella enterica enterica serovar Typhi
gaaugcugacggauucuuccucu

SEQ ID NO: 1704571 - RNA, 17 nt, Salmonella enterica enterica serovar Typhi
gaaugcuauaugcaggc

SEQ ID NO: 1704572 - RNA, 23 nt, Salmonella enterica enterica serovar Typhi
gaaugauugccggauggcggcgu

SEQ ID NO: 1704573 - RNA, 21 nt, Salmonella enterica enterica serovar Typhi
gaaugcaaagaagggcagggg

SEQ ID NO: 1704574 - RNA, 22 nt, Salmonella enterica enterica serovar Typhi
gaaugcaagcagcauaaugaau

SEQ ID NO: 1704575 - RNA, 15 nt, Salmonella enterica enterica serovar Typhi
gaaugcacuguuucu

SEQ ID NO: 1704576 - RNA, 18 nt, Salmonella enterica enterica serovar Typhi
gaaucuauuauuaaucug

SEQ ID NO: 1704577 - RNA, 22 nt, Salmonella enterica enterica serovar Typhi
gaaucucgaaacaauagcugug

SEQ ID NO: 1704578 - RNA, 14 nt, Salmonella enterica enterica serovar Typhi
gaauccgucagguu

SEQ ID NO: 1704579 - RNA, 18 nt, Salmonella enterica enterica serovar Typhi
gaauccucccggaugcac

SEQ ID NO: 1704580 - RNA, 15 nt, Salmonella enterica enterica serovar Typhi
gaaucgccgucagug

SEQ ID NO: 1704581 - RNA, 21 nt, Salmonella enterica enterica serovar Typhi
gaaucgccuggcuugccggca

SEQ ID NO: 1704582 - RNA, 15 nt, Salmonella enterica enterica serovar Typhi
gaaucgcgauccagc

SEQ ID NO: 1704583 - RNA, 18 nt, Salmonella enterica enterica serovar Typhi
gaaucgcuuccuggguua

SEQ ID NO: 1704584 - RNA, 24 nt, Salmonella enterica enterica serovar Typhi
gaaucguccagauugagacaaaua

SEQ ID NO: 1704585 - RNA, 14 nt, Salmonella enterica enterica serovar Typhi
gaauccggcggcuu

SEQ ID NO: 1704586 - RNA, 21 nt, Salmonella enterica enterica serovar Typhi
gaauccccggcuuccagcggc

SEQ ID NO: 1704587 - RNA, 17 nt, Salmonella enterica enterica serovar Typhi
gaaucacuuacuaaggu

SEQ ID NO: 1704588 - RNA, 16 nt, Salmonella enterica enterica serovar Typhi
gaaucagauuacccuc

SEQ ID NO: 1704589 - RNA, 12 nt, Salmonella enterica enterica serovar Typhi
gaauaucgccaa

SEQ ID NO: 1704590 - RNA, 19 nt, Salmonella enterica enterica serovar Typhi
gaauauccccugacagagc

SEQ ID NO: 1704591 - RNA, 15 nt, Salmonella enterica enterica serovar Typhi
gaauaucuucccgac

SEQ ID NO: 1704592 - RNA, 23 nt, Salmonella enterica enterica serovar Typhi
gaauaugagauugugcuuuagcu

SEQ ID NO: 1704593 - RNA, 18 nt, Salmonella enterica enterica serovar Typhi
gaauaugauuuaaaaaag

SEQ ID NO: 1704594 - RNA, 20 nt, Salmonella enterica enterica serovar Typhi
gaauaugccaggggaagccg

SEQ ID NO: 1704595 - RNA, 16 nt, Salmonella enterica enterica serovar Typhi
gaauauucauuuccag

SEQ ID NO: 1704596 - RNA, 21 nt, Salmonella enterica enterica serovar Typhi
gaauauugacaguaauaaugu

SEQ ID NO: 1704597 - RNA, 19 nt, Salmonella enterica enterica serovar Typhi
gaauaggccgccaaugaca

SEQ ID NO: 1704598 - RNA, 15 nt, Salmonella enterica enterica serovar Typhi
gaauaguuuugccca

SEQ ID NO: 1704599 - RNA, 15 nt, Salmonella enterica enterica serovar Typhi
gaauaguuucaccuu

SEQ ID NO: 1704600 - RNA, 16 nt, Salmonella enterica enterica serovar Typhi
gacaaagagcucccca

SEQ ID NO: 1704601 - RNA, 21 nt, Salmonella enterica enterica serovar Typhi
gaauuuuccgccgugauucau

SEQ ID NO: 1704602 - RNA, 17 nt, Salmonella enterica enterica serovar Typhi
gacaacaaaaagauauu

SEQ ID NO: 1704603 - RNA, 18 nt, Salmonella enterica enterica serovar Typhi
gacaaucaccaucccaug

SEQ ID NO: 1704604 - RNA, 18 nt, Salmonella enterica enterica serovar Typhi
gacaaucacucucuugua

SEQ ID NO: 1704605 - RNA, 20 nt, Salmonella enterica enterica serovar Typhi
gacaauccgcgaaugguuca

SEQ ID NO: 1704606 - RNA, 14 nt, Salmonella enterica enterica serovar Typhi
gacaaucagcacca

SEQ ID NO: 1704607 - RNA, 22 nt, Salmonella enterica enterica serovar Typhi
gacaacguaaacggcagccgcc

SEQ ID NO: 1704608 - RNA, 18 nt, Salmonella enterica enterica serovar Typhi
gacaacuagaauuuucac

SEQ ID NO: 1704609 - RNA, 15 nt, Salmonella enterica enterica serovar Typhi
gacaacuauugcugc

SEQ ID NO: 1704610 - RNA, 18 nt, Salmonella enterica enterica serovar Typhi
gacaagcugauuuuucgc

SEQ ID NO: 1704611 - RNA, 11 nt, Salmonella enterica enterica serovar Typhi
gacaauagcgg

SEQ ID NO: 1704612 - RNA, 19 nt, Salmonella enterica enterica serovar Typhi
gaauggggaaauaaauaug

SEQ ID NO: 1704613 - RNA, 18 nt, Salmonella enterica enterica serovar Typhi
gaauggcgauuaacgcau

SEQ ID NO: 1704614 - RNA, 19 nt, Salmonella enterica enterica serovar Typhi
gaauggauaacgaaaaggg

SEQ ID NO: 1704615 - RNA, 21 nt, Salmonella enterica enterica serovar Typhi
gaaugcuucuucgccagcuuc

SEQ ID NO: 1704616 - RNA, 23 nt, Salmonella enterica enterica serovar Typhi
gaaugcuucgccacgaccuacac

SEQ ID NO: 1704617 - RNA, 18 nt, Salmonella enterica enterica serovar Typhi
gaauucaccgcaugacaa

SEQ ID NO: 1704618 - RNA, 16 nt, Salmonella enterica enterica serovar Typhi
gaauuccaguccuuuc

SEQ ID NO: 1704619 - RNA, 16 nt, Salmonella enterica enterica serovar Typhi
gaauggcugcuuuugc

SEQ ID NO: 1704620 - RNA, 18 nt, Salmonella enterica enterica serovar Typhi
gaaugguauuaccucgcg

SEQ ID NO: 1704621 - RNA, 20 nt, Salmonella enterica enterica serovar Typhi
gaauuuuauuaagcaggccg

SEQ ID NO: 1704622 - RNA, 19 nt, Salmonella enterica enterica serovar Typhi
gaauuucgcgaauaaucug

SEQ ID NO: 1704623 - RNA, 15 nt, Salmonella enterica enterica serovar Typhi
gaauucguacguuuu

SEQ ID NO: 1704624 - RNA, 16 nt, Salmonella enterica enterica serovar Typhi
gaauugauaaagaucu

SEQ ID NO: 1704625 - RNA, 12 nt, Salmonella enterica enterica serovar Typhi
gaauucuucugu

SEQ ID NO: 1704626 - RNA, 20 nt, Salmonella enterica enterica serovar Typhi
gaccaguugccccugcguca

SEQ ID NO: 1704627 - RNA, 14 nt, Salmonella enterica enterica serovar Typhi
gaccaguuaagcaa

SEQ ID NO: 1704628 - RNA, 18 nt, Salmonella enterica enterica serovar Typhi
gaccagucggacagcgac

SEQ ID NO: 1704629 - RNA, 18 nt, Salmonella enterica enterica serovar Typhi
gaccagugaacgucugca

SEQ ID NO: 1704630 - RNA, 15 nt, Salmonella enterica enterica serovar Typhi
gacccgcaucagacc

SEQ ID NO: 1704631 - RNA, 18 nt, Salmonella enterica enterica serovar Typhi
gacccgcaucgccgcggc

SEQ ID NO: 1704632 - RNA, 16 nt, Salmonella enterica enterica serovar Typhi
gacccacuuucagcuc

SEQ ID NO: 1704633 - RNA, 17 nt, Salmonella enterica enterica serovar Typhi
gacccacgccagcagcu

SEQ ID NO: 1704634 - RNA, 22 nt, Salmonella enterica enterica serovar Typhi
gacccaccugacuguucacgca

SEQ ID NO: 1704635 - RNA, 23 nt, Salmonella enterica enterica serovar Typhi
gacccacaguuucauauccgaca

SEQ ID NO: 1704636 - RNA, 22 nt, Salmonella enterica enterica serovar Typhi
gacccgcaaaccaggucugcgc

SEQ ID NO: 1704637 - RNA, 17 nt, Salmonella enterica enterica serovar Typhi
gacccgccgccagcacc

SEQ ID NO: 1704638 - RNA, 19 nt, Salmonella enterica enterica serovar Typhi
gacccgcuuccaguuuugc

SEQ ID NO: 1704639 - RNA, 21 nt, Salmonella enterica enterica serovar Typhi
gacccgcuuccaguuuugcca

SEQ ID NO: 1704640 - RNA, 19 nt, Salmonella enterica enterica serovar Typhi
gacccgggacuucaggcau

SEQ ID NO: 1704641 - RNA, 18 nt, Salmonella enterica enterica serovar Typhi
gaccagcgacgaugaaau

SEQ ID NO: 1704642 - RNA, 15 nt, Salmonella enterica enterica serovar Typhi
gaccaggaucagacc

SEQ ID NO: 1704643 - RNA, 11 nt, Salmonella enterica enterica serovar Typhi
gaccagcgccc

SEQ ID NO: 1704644 - RNA, 20 nt, Salmonella enterica enterica serovar Typhi
gaccaggauuuaauggucuc

SEQ ID NO: 1704645 - RNA, 14 nt, Salmonella enterica enterica serovar Typhi
gaccaggauggcca

SEQ ID NO: 1704646 - RNA, 21 nt, Salmonella enterica enterica serovar Typhi
gaccaggauggccagcaccag

SEQ ID NO: 1704647 - RNA, 17 nt, Salmonella enterica enterica serovar Typhi
gaccaggauggccagca

SEQ ID NO: 1704648 - RNA, 18 nt, Salmonella enterica enterica serovar Typhi
gaccaggcgacuauccac

SEQ ID NO: 1704649 - RNA, 15 nt, Salmonella enterica enterica serovar Typhi
gaccagcagcaucac

SEQ ID NO: 1704650 - RNA, 11 nt, Salmonella enterica enterica serovar Typhi
gaccagcaccu

SEQ ID NO: 1704651 - RNA, 17 nt, Salmonella enterica enterica serovar Typhi
gaccagaugcagcaacg

SEQ ID NO: 1704652 - RNA, 16 nt, Salmonella enterica enterica serovar Typhi
gaccagcaugugccgg

SEQ ID NO: 1704653 - RNA, 17 nt, Salmonella enterica enterica serovar Typhi
gaccagcaugugccgga

SEQ ID NO: 1704654 - RNA, 18 nt, Salmonella enterica enterica serovar Typhi
gaccagcaucagaauaau

SEQ ID NO: 1704655 - RNA, 13 nt, Salmonella enterica enterica serovar Typhi
gaccagcaucagc

SEQ ID NO: 1704656 - RNA, 17 nt, Salmonella enterica enterica serovar Typhi
gaccaacaccuacgaua

SEQ ID NO: 1704657 - RNA, 19 nt, Salmonella enterica enterica serovar Typhi
gaccaaagcgaauacucac

SEQ ID NO: 1704658 - RNA, 12 nt, Salmonella enterica enterica serovar Typhi
gacauucccugc

SEQ ID NO: 1704659 - RNA, 16 nt, Salmonella enterica enterica serovar Typhi
gacauucugacggccc

SEQ ID NO: 1704660 - RNA, 18 nt, Salmonella enterica enterica serovar Typhi
gaccaacuuuuguagaga

SEQ ID NO: 1704661 - RNA, 13 nt, Salmonella enterica enterica serovar Typhi
gaccaagcgucag

SEQ ID NO: 1704662 - RNA, 14 nt, Salmonella enterica enterica serovar Typhi
gaccaacaccagcc

SEQ ID NO: 1704663 - RNA, 17 nt, Salmonella enterica enterica serovar Typhi
gaccaacguuuuuccuu

SEQ ID NO: 1704664 - RNA, 15 nt, Salmonella enterica enterica serovar Typhi
gaccaacguuuuucc

SEQ ID NO: 1704665 - RNA, 18 nt, Salmonella enterica enterica serovar Typhi
gacacuugcaacucgcac

SEQ ID NO: 1704666 - RNA, 20 nt, Salmonella enterica enterica serovar Typhi
gacacuuuccgacguuuuuc

SEQ ID NO: 1704667 - RNA, 11 nt, Salmonella enterica enterica serovar Typhi
gacagcaagau

SEQ ID NO: 1704668 - RNA, 13 nt, Salmonella enterica enterica serovar Typhi
gacagaacaggau

SEQ ID NO: 1704669 - RNA, 17 nt, Salmonella enterica enterica serovar Typhi
gacagccuauuaaucac

SEQ ID NO: 1704670 - RNA, 14 nt, Salmonella enterica enterica serovar Typhi
gacagcaaugagca

SEQ ID NO: 1704671 - RNA, 16 nt, Salmonella enterica enterica serovar Typhi
gacagcaagauuucaa

SEQ ID NO: 1704672 - RNA, 18 nt, Salmonella enterica enterica serovar Typhi
gacagcaaguugcgccac

SEQ ID NO: 1704673 - RNA, 22 nt, Salmonella enterica enterica serovar Typhi
gacagcaaguugcgccacugcc

SEQ ID NO: 1704674 - RNA, 15 nt, Salmonella enterica enterica serovar Typhi
gacacaguaaaaaaa

SEQ ID NO: 1704675 - RNA, 21 nt, Salmonella enterica enterica serovar Typhi
gacacagcguacaauggcagg

SEQ ID NO: 1704676 - RNA, 21 nt, Salmonella enterica enterica serovar Typhi
gacacgcuaccuugagguggu

SEQ ID NO: 1704677 - RNA, 21 nt, Salmonella enterica enterica serovar Typhi
gacacgcgcgcugcgccugga

SEQ ID NO: 1704678 - RNA, 20 nt, Salmonella enterica enterica serovar Typhi
gacacugaaacuccgcagcc

SEQ ID NO: 1704679 - RNA, 11 nt, Salmonella enterica enterica serovar Typhi
gacacucaucc

SEQ ID NO: 1704680 - RNA, 17 nt, Salmonella enterica enterica serovar Typhi
gacacucauccagacca

SEQ ID NO: 1704681 - RNA, 14 nt, Salmonella enterica enterica serovar Typhi
gacaggacgccagc

SEQ ID NO: 1704682 - RNA, 22 nt, Salmonella enterica enterica serovar Typhi
gacagcggauuacgcgccugcc

SEQ ID NO: 1704683 - RNA, 16 nt, Salmonella enterica enterica serovar Typhi
gacagcguaaugcgcc

SEQ ID NO: 1704684 - RNA, 22 nt, Salmonella enterica enterica serovar Typhi
gacagcgcccaacgcuucacaa

SEQ ID NO: 1704685 - RNA, 21 nt, Salmonella enterica enterica serovar Typhi
gacagcgccugaaaagagcga

SEQ ID NO: 1704686 - RNA, 22 nt, Salmonella enterica enterica serovar Typhi
gacauaaaacaguacgccgagg

SEQ ID NO: 1704687 - RNA, 13 nt, Salmonella enterica enterica serovar Typhi
gacauacaggaau

SEQ ID NO: 1704688 - RNA, 15 nt, Salmonella enterica enterica serovar Typhi
gacauaaucaugaac

SEQ ID NO: 1704689 - RNA, 15 nt, Salmonella enterica enterica serovar Typhi
gacauaagaguccau

SEQ ID NO: 1704690 - RNA, 14 nt, Salmonella enterica enterica serovar Typhi
gacaugaaaauaug

SEQ ID NO: 1704691 - RNA, 17 nt, Salmonella enterica enterica serovar Typhi
gacaucucaucggcuuu

SEQ ID NO: 1704692 - RNA, 12 nt, Salmonella enterica enterica serovar Typhi
gacauuacccau

SEQ ID NO: 1704693 - RNA, 15 nt, Salmonella enterica enterica serovar Typhi
gacauuaaagucgcg

SEQ ID NO: 1704694 - RNA, 19 nt, Salmonella enterica enterica serovar Typhi
gacauuaacaaugccuuau

SEQ ID NO: 1704695 - RNA, 17 nt, Salmonella enterica enterica serovar Typhi
gacauagcauaauaaug

SEQ ID NO: 1704696 - RNA, 21 nt, Salmonella enterica enterica serovar Typhi
gacauaguacccucugcacca

SEQ ID NO: 1704697 - RNA, 13 nt, Salmonella enterica enterica serovar Typhi
gacaucggcacgc

SEQ ID NO: 1704698 - RNA, 21 nt, Salmonella enterica enterica serovar Typhi
gacaucgcucccggcaccagg

SEQ ID NO: 1704699 - RNA, 20 nt, Salmonella enterica enterica serovar Typhi
gacgguggucaucuggucaa

SEQ ID NO: 1704700 - RNA, 16 nt, Salmonella enterica enterica serovar Typhi
gacgguuauuuuucag

SEQ ID NO: 1704701 - RNA, 16 nt, Salmonella enterica enterica serovar Typhi
gacgguaagaauaaua

SEQ ID NO: 1704702 - RNA, 19 nt, Salmonella enterica enterica serovar Typhi
gacgguaccugaagccauc

SEQ ID NO: 1704703 - RNA, 13 nt, Salmonella enterica enterica serovar Typhi
gacgguuuucacu

SEQ ID NO: 1704704 - RNA, 18 nt, Salmonella enterica enterica serovar Typhi
gacguaaacgucggccuu

SEQ ID NO: 1704705 - RNA, 11 nt, Salmonella enterica enterica serovar Typhi
gacguccagac

SEQ ID NO: 1704706 - RNA, 14 nt, Salmonella enterica enterica serovar Typhi
gacgugaccgguug

SEQ ID NO: 1704707 - RNA, 19 nt, Salmonella enterica enterica serovar Typhi
gacgucgguaaucacauca

SEQ ID NO: 1704708 - RNA, 20 nt, Salmonella enterica enterica serovar Typhi
gacggcagcgccauccggca

SEQ ID NO: 1704709 - RNA, 14 nt, Salmonella enterica enterica serovar Typhi
gacggcagccacgc

SEQ ID NO: 1704710 - RNA, 22 nt, Salmonella enterica enterica serovar Typhi
gacggcaauagaacgucgcgcg

SEQ ID NO: 1704711 - RNA, 15 nt, Salmonella enterica enterica serovar Typhi
gacggcaaaaagcau

SEQ ID NO: 1704712 - RNA, 23 nt, Salmonella enterica enterica serovar Typhi
gacggcagucgcuacaaccagcg

SEQ ID NO: 1704713 - RNA, 15 nt, Salmonella enterica enterica serovar Typhi
gacggcuucacugcc

SEQ ID NO: 1704714 - RNA, 18 nt, Salmonella enterica enterica serovar Typhi
gacgggacgaauuuccag

SEQ ID NO: 1704715 - RNA, 23 nt, Salmonella enterica enterica serovar Typhi
gacgggacgaauuuccagcgggc

SEQ ID NO: 1704716 - RNA, 20 nt, Salmonella enterica enterica serovar Typhi
gacgggaaaucucccuggca

SEQ ID NO: 1704717 - RNA, 13 nt, Salmonella enterica enterica serovar Typhi
gacgggccaggcg

SEQ ID NO: 1704718 - RNA, 20 nt, Salmonella enterica enterica serovar Typhi
gacgggcggcgacagagaau

SEQ ID NO: 1704719 - RNA, 21 nt, Salmonella enterica enterica serovar Typhi
gacgggauuaaaugacgcccu

SEQ ID NO: 1704720 - RNA, 22 nt, Salmonella enterica enterica serovar Typhi
gacgggcaagguuaugcagcau

SEQ ID NO: 1704721 - RNA, 23 nt, Salmonella enterica enterica serovar Typhi
gacgggaugugaccuuugugcag

SEQ ID NO: 1704722 - RNA, 14 nt, Salmonella enterica enterica serovar Typhi
gacgggauuaaaug

SEQ ID NO: 1704723 - RNA, 22 nt, Salmonella enterica enterica serovar Typhi
gacgggaucgaaccgccgaccc

SEQ ID NO: 1704724 - RNA, 15 nt, Salmonella enterica enterica serovar Typhi
gacgcagacaauaaa

SEQ ID NO: 1704725 - RNA, 21 nt, Salmonella enterica enterica serovar Typhi
gacgcgacuuuuuucacccag

SEQ ID NO: 1704726 - RNA, 16 nt, Salmonella enterica enterica serovar Typhi
gacgcgcuccagcaac

SEQ ID NO: 1704727 - RNA, 17 nt, Salmonella enterica enterica serovar Typhi
gacgcgggccgcauugc

SEQ ID NO: 1704728 - RNA, 13 nt, Salmonella enterica enterica serovar Typhi
gacgcgcaggccg

SEQ ID NO: 1704729 - RNA, 15 nt, Salmonella enterica enterica serovar Typhi
gacgcgguacccacc

SEQ ID NO: 1704730 - RNA, 14 nt, Salmonella enterica enterica serovar Typhi
gacgcguuaauauc

SEQ ID NO: 1704731 - RNA, 19 nt, Salmonella enterica enterica serovar Typhi
gacgcguguugccggacca

SEQ ID NO: 1704732 - RNA, 13 nt, Salmonella enterica enterica serovar Typhi
gacgcuauuuuuc

SEQ ID NO: 1704733 - RNA, 19 nt, Salmonella enterica enterica serovar Typhi
gacgcugcgccuggaugaa

SEQ ID NO: 1704734 - RNA, 15 nt, Salmonella enterica enterica serovar Typhi
gacgcuggaaaauuu

SEQ ID NO: 1704735 - RNA, 16 nt, Salmonella enterica enterica serovar Typhi
gacgcuggcacuggca

SEQ ID NO: 1704736 - RNA, 12 nt, Salmonella enterica enterica serovar Typhi
gacgcugguugu

SEQ ID NO: 1704737 - RNA, 16 nt, Salmonella enterica enterica serovar Typhi
gacgcugcaacucucc

SEQ ID NO: 1704738 - RNA, 12 nt, Salmonella enterica enterica serovar Typhi
gacgcugccaca

SEQ ID NO: 1704739 - RNA, 15 nt, Salmonella enterica enterica serovar Typhi
gacgcucuuccucaa

SEQ ID NO: 1704740 - RNA, 22 nt, Salmonella enterica enterica serovar Typhi
gacgaggauuagacuucuucca

SEQ ID NO: 1704741 - RNA, 14 nt, Salmonella enterica enterica serovar Typhi
gacgagcgaaaaac

SEQ ID NO: 1704742 - RNA, 16 nt, Salmonella enterica enterica serovar Typhi
gacgauucguaccauc

SEQ ID NO: 1704743 - RNA, 17 nt, Salmonella enterica enterica serovar Typhi
gaccuuaucccgcugac

SEQ ID NO: 1704744 - RNA, 14 nt, Salmonella enterica enterica serovar Typhi
gaccuuaauccagc

SEQ ID NO: 1704745 - RNA, 17 nt, Salmonella enterica enterica serovar Typhi
gacgacaucuuuuccug

SEQ ID NO: 1704746 - RNA, 14 nt, Salmonella enterica enterica serovar Typhi
gacgacaagcagaa

SEQ ID NO: 1704747 - RNA, 17 nt, Salmonella enterica enterica serovar Typhi
gacgaauaccugaaaga

SEQ ID NO: 1704748 - RNA, 16 nt, Salmonella enterica enterica serovar Typhi
gacgaaucuggauagu

SEQ ID NO: 1704749 - RNA, 17 nt, Salmonella enterica enterica serovar Typhi
gaccuaaaguaaaggaa

SEQ ID NO: 1704750 - RNA, 14 nt, Salmonella enterica enterica serovar Typhi
gaccuacaggccga

SEQ ID NO: 1704751 - RNA, 13 nt, Salmonella enterica enterica serovar Typhi
gaccuccgccauc

SEQ ID NO: 1704752 - RNA, 21 nt, Salmonella enterica enterica serovar Typhi
gaccucauccaucagcgcggg

SEQ ID NO: 1704753 - RNA, 13 nt, Salmonella enterica enterica serovar Typhi
gaccucaauccgu

SEQ ID NO: 1704754 - RNA, 18 nt, Salmonella enterica enterica serovar Typhi
gaccggugaugugcuggc

SEQ ID NO: 1704755 - RNA, 21 nt, Salmonella enterica enterica serovar Typhi
gaccggugaugugcuggcgga

SEQ ID NO: 1704756 - RNA, 16 nt, Salmonella enterica enterica serovar Typhi
gaccggucagccgguu

SEQ ID NO: 1704757 - RNA, 21 nt, Salmonella enterica enterica serovar Typhi
gaccgggggcuggccacugga

SEQ ID NO: 1704758 - RNA, 19 nt, Salmonella enterica enterica serovar Typhi
gaccgguaagcccauggca

SEQ ID NO: 1704759 - RNA, 15 nt, Salmonella enterica enterica serovar Typhi
gaccgcacagcagac

SEQ ID NO: 1704760 - RNA, 13 nt, Salmonella enterica enterica serovar Typhi
gaccgcaaaccga

SEQ ID NO: 1704761 - RNA, 18 nt, Salmonella enterica enterica serovar Typhi
gaccgcagcuuauuccag

SEQ ID NO: 1704762 - RNA, 14 nt, Salmonella enterica enterica serovar Typhi
gacccuugcgacca

SEQ ID NO: 1704763 - RNA, 13 nt, Salmonella enterica enterica serovar Typhi
gaccgagucuaca

SEQ ID NO: 1704764 - RNA, 14 nt, Salmonella enterica enterica serovar Typhi
gaccgauaaauacc

SEQ ID NO: 1704765 - RNA, 22 nt, Salmonella enterica enterica serovar Typhi
gaccgaucucaugcaacuggca

SEQ ID NO: 1704766 - RNA, 22 nt, Salmonella enterica enterica serovar Typhi
gaccgauagagacugccgccgu

SEQ ID NO: 1704767 - RNA, 20 nt, Salmonella enterica enterica serovar Typhi
gacugguggcgagauaagcc

SEQ ID NO: 1704768 - RNA, 22 nt, Salmonella enterica enterica serovar Typhi
gacugguuuuucgccgaccauc

SEQ ID NO: 1704769 - RNA, 18 nt, Salmonella enterica enterica serovar Typhi
gacuguaaaucugccguc

SEQ ID NO: 1704770 - RNA, 21 nt, Salmonella enterica enterica serovar Typhi
gacuggcuaaacaauuugccc

SEQ ID NO: 1704771 - RNA, 16 nt, Salmonella enterica enterica serovar Typhi
gacugugauggcgguc

SEQ ID NO: 1704772 - RNA, 15 nt, Salmonella enterica enterica serovar Typhi
gacuguucacaucca

SEQ ID NO: 1704773 - RNA, 19 nt, Salmonella enterica enterica serovar Typhi
gacugucgaaaccagcaua

SEQ ID NO: 1704774 - RNA, 11 nt, Salmonella enterica enterica serovar Typhi
gacugaacaua

SEQ ID NO: 1704775 - RNA, 14 nt, Salmonella enterica enterica serovar Typhi
gacugauacccagc

SEQ ID NO: 1704776 - RNA, 20 nt, Salmonella enterica enterica serovar Typhi
gacugaguauuggcaagaau

SEQ ID NO: 1704777 - RNA, 24 nt, Salmonella enterica enterica serovar Typhi
gacugauaccgcguuugcgcaaca

SEQ ID NO: 1704778 - RNA, 13 nt, Salmonella enterica enterica serovar Typhi
gacugaucccacu

SEQ ID NO: 1704779 - RNA, 19 nt, Salmonella enterica enterica serovar Typhi
gacugaucccacuuaggca

SEQ ID NO: 1704780 - RNA, 16 nt, Salmonella enterica enterica serovar Typhi
gacugcaaaucugccg

SEQ ID NO: 1704781 - RNA, 16 nt, Salmonella enterica enterica serovar Typhi
gacugaugcuggcgcc

SEQ ID NO: 1704782 - RNA, 14 nt, Salmonella enterica enterica serovar Typhi
gacugccgcagacc

SEQ ID NO: 1704783 - RNA, 12 nt, Salmonella enterica enterica serovar Typhi
gacugcggccug

SEQ ID NO: 1704784 - RNA, 19 nt, Salmonella enterica enterica serovar Typhi
gacugccguauaauccagc

SEQ ID NO: 1704785 - RNA, 19 nt, Salmonella enterica enterica serovar Typhi
gacugccuaacuggaaaaa

SEQ ID NO: 1704786 - RNA, 22 nt, Salmonella enterica enterica serovar Typhi
gacucccaggcgcgcagcugcc

SEQ ID NO: 1704787 - RNA, 23 nt, Salmonella enterica enterica serovar Typhi
gacuccccacaaucccgccagac

SEQ ID NO: 1704788 - RNA, 14 nt, Salmonella enterica enterica serovar Typhi
gacuccggcagcau

SEQ ID NO: 1704789 - RNA, 13 nt, Salmonella enterica enterica serovar Typhi
gacuccggcagca

SEQ ID NO: 1704790 - RNA, 22 nt, Salmonella enterica enterica serovar Typhi
gacuaaaaagcgcguccccggu

SEQ ID NO: 1704791 - RNA, 19 nt, Salmonella enterica enterica serovar Typhi
gacgugcggcagggcgguc

SEQ ID NO: 1704792 - RNA, 19 nt, Salmonella enterica enterica serovar Typhi
gacguucgcgaugcagcac

SEQ ID NO: 1704793 - RNA, 18 nt, Salmonella enterica enterica serovar Typhi
gacguugaaaaaacgggc

SEQ ID NO: 1704794 - RNA, 14 nt, Salmonella enterica enterica serovar Typhi
gacugaaaaucaaa

SEQ ID NO: 1704795 - RNA, 18 nt, Salmonella enterica enterica serovar Typhi
gacugaaaaucaaaaaca

SEQ ID NO: 1704796 - RNA, 15 nt, Salmonella enterica enterica serovar Typhi
gacucuguuauauau

SEQ ID NO: 1704797 - RNA, 19 nt, Salmonella enterica enterica serovar Typhi
gacucuguggccgcgcaug

SEQ ID NO: 1704798 - RNA, 18 nt, Salmonella enterica enterica serovar Typhi
gacucugaagcgggaaag

SEQ ID NO: 1704799 - RNA, 19 nt, Salmonella enterica enterica serovar Typhi
gacucugaagcgggaaagc

SEQ ID NO: 1704800 - RNA, 18 nt, Salmonella enterica enterica serovar Typhi
gacucgcuacgcucgccc

SEQ ID NO: 1704801 - RNA, 18 nt, Salmonella enterica enterica serovar Typhi
gacuugucggcaaucuca

SEQ ID NO: 1704802 - RNA, 11 nt, Salmonella enterica enterica serovar Typhi
gacuucuucag

SEQ ID NO: 1704803 - RNA, 16 nt, Salmonella enterica enterica serovar Typhi
gacuuugaccagcauc

SEQ ID NO: 1704804 - RNA, 21 nt, Salmonella enterica enterica serovar Typhi
gacuuugcccuuuuugcauuc

SEQ ID NO: 1704805 - RNA, 22 nt, Salmonella enterica enterica serovar Typhi
gacuuuaaacuuauccgccauc

SEQ ID NO: 1704806 - RNA, 22 nt, Salmonella enterica enterica serovar Typhi
gacuuaaaguacuucacaauca

SEQ ID NO: 1704807 - RNA, 23 nt, Salmonella enterica enterica serovar Typhi
gacuguuucauuacucguccuuc

SEQ ID NO: 1704808 - RNA, 16 nt, Salmonella enterica enterica serovar Typhi
gacuguucagcugaca

SEQ ID NO: 1704809 - RNA, 12 nt, Salmonella enterica enterica serovar Typhi
gacuguugaaag

SEQ ID NO: 1704810 - RNA, 16 nt, Salmonella enterica enterica serovar Typhi
gacuguucacauccag

SEQ ID NO: 1704811 - RNA, 17 nt, Salmonella enterica enterica serovar Typhi
gacuguucacauccagc

SEQ ID NO: 1704812 - RNA, 17 nt, Salmonella enterica enterica serovar Typhi
gacuguucagcugacaa

SEQ ID NO: 1704813 - RNA, 19 nt, Salmonella enterica enterica serovar Typhi
gacuuacggaaaaaugucg

SEQ ID NO: 1704814 - RNA, 15 nt, Salmonella enterica enterica serovar Typhi
gacuuauuaaaaaua

SEQ ID NO: 1704815 - RNA, 16 nt, Salmonella enterica enterica serovar Typhi
gacuuauugcaccauu

SEQ ID NO: 1704816 - RNA, 14 nt, Salmonella enterica enterica serovar Typhi
gacuucacuuuccc

SEQ ID NO: 1704817 - RNA, 14 nt, Salmonella enterica enterica serovar Typhi
gacuucaccucagc

SEQ ID NO: 1704818 - RNA, 11 nt, Salmonella enterica enterica serovar Typhi
gacuucaccuc

SEQ ID NO: 1704819 - RNA, 20 nt, Salmonella enterica enterica serovar Typhi
gagaaaauaccgcacaucac

SEQ ID NO: 1704820 - RNA, 15 nt, Salmonella enterica enterica serovar Typhi
gagaaaauagaggaa

SEQ ID NO: 1704821 - RNA, 16 nt, Salmonella enterica enterica serovar Typhi
gagaaaacgcggccug

SEQ ID NO: 1704822 - RNA, 22 nt, Salmonella enterica enterica serovar Typhi
gagaaaaauacgccagauaacg

SEQ ID NO: 1704823 - RNA, 19 nt, Salmonella enterica enterica serovar Typhi
gagaaaagggcgcaccaaa

SEQ ID NO: 1704824 - RNA, 19 nt, Salmonella enterica enterica serovar Typhi
gagaaaauaccgcacauca

SEQ ID NO: 1704825 - RNA, 20 nt, Salmonella enterica enterica serovar Typhi
gagaaaaagcaauaauccgc

SEQ ID NO: 1704826 - RNA, 20 nt, Salmonella enterica enterica serovar Typhi
gacuuuuuugccuuucagau

SEQ ID NO: 1704827 - RNA, 17 nt, Salmonella enterica enterica serovar Typhi
gagaaaaaaauccagua

SEQ ID NO: 1704828 - RNA, 17 nt, Salmonella enterica enterica serovar Typhi
gacuuuuugaaaucacg

SEQ ID NO: 1704829 - RNA, 23 nt, Salmonella enterica enterica serovar Typhi
gagaaaucaacgaaaucagagac

SEQ ID NO: 1704830 - RNA, 17 nt, Salmonella enterica enterica serovar Typhi
gagaaagugguggguga

SEQ ID NO: 1704831 - RNA, 12 nt, Salmonella enterica enterica serovar Typhi
gagaaaguggug

SEQ ID NO: 1704832 - RNA, 12 nt, Salmonella enterica enterica serovar Typhi
gagaacagcauc

SEQ ID NO: 1704833 - RNA, 20 nt, Salmonella enterica enterica serovar Typhi
gagaacgccgggccugccag

SEQ ID NO: 1704834 - RNA, 18 nt, Salmonella enterica enterica serovar Typhi
aaagcaaucgccagcgcc

SEQ ID NO: 1704835 - RNA, 18 nt, Salmonella enterica enterica serovar Typhi
gagaaauuuagcaguaac

SEQ ID NO: 1704836 - RNA, 19 nt, Salmonella enterica enterica serovar Typhi
gagaaugucgccauaucuu

SEQ ID NO: 1704837 - RNA, 13 nt, Salmonella enterica enterica serovar Typhi
gagaauuuccagu

SEQ ID NO: 1704838 - RNA, 16 nt, Salmonella enterica enterica serovar Typhi
gagacaugccgccaga

SEQ ID NO: 1704839 - RNA, 16 nt, Salmonella enterica enterica serovar Typhi
gagacauugccuucca

SEQ ID NO: 1704840 - RNA, 22 nt, Salmonella enterica enterica serovar Typhi
gagacaggccagaauucagcau

SEQ ID NO: 1704841 - RNA, 18 nt, Salmonella enterica enterica serovar Typhi
gagacagcgggcaauggc

SEQ ID NO: 1704842 - RNA, 16 nt, Salmonella enterica enterica serovar Typhi
gagacagagaaccuga

SEQ ID NO: 1704843 - RNA, 18 nt, Salmonella enterica enterica serovar Typhi
gagacgcuggaaaauuuc

SEQ ID NO: 1704844 - RNA, 20 nt, Salmonella enterica enterica serovar Typhi
gagaccgggcuuuguugucu

SEQ ID NO: 1704845 - RNA, 15 nt, Salmonella enterica enterica serovar Typhi
gagaccaucaacagc

SEQ ID NO: 1704846 - RNA, 18 nt, Salmonella enterica enterica serovar Typhi
gagacauugccuuccagg

SEQ ID NO: 1704847 - RNA, 21 nt, Salmonella enterica enterica serovar Typhi
gagacauugguuucaugcauc

SEQ ID NO: 1704848 - RNA, 16 nt, Salmonella enterica enterica serovar Typhi
gagaagcgcgccugcc

SEQ ID NO: 1704849 - RNA, 14 nt, Salmonella enterica enterica serovar Typhi
gagaagaagaauua

SEQ ID NO: 1704850 - RNA, 21 nt, Salmonella enterica enterica serovar Typhi
gagaacguugccgcaggcaac

SEQ ID NO: 1704851 - RNA, 18 nt, Salmonella enterica enterica serovar Typhi
gagaaucaccuggcagcc

SEQ ID NO: 1704852 - RNA, 15 nt, Salmonella enterica enterica serovar Typhi
gagagcagcgccagc

SEQ ID NO: 1704853 - RNA, 13 nt, Salmonella enterica enterica serovar Typhi
gagagcaacuggc

SEQ ID NO: 1704854 - RNA, 17 nt, Salmonella enterica enterica serovar Typhi
gagagccuuacaggcgc

SEQ ID NO: 1704855 - RNA, 23 nt, Salmonella enterica enterica serovar Typhi
gagagccuuacaggcgcaucaga

SEQ ID NO: 1704856 - RNA, 18 nt, Salmonella enterica enterica serovar Typhi
gagagcaucaucugccau

SEQ ID NO: 1704857 - RNA, 14 nt, Salmonella enterica enterica serovar Typhi
gagacucagcagcg

SEQ ID NO: 1704858 - RNA, 22 nt, Salmonella enterica enterica serovar Typhi
gagagacguucauuucuuccag

SEQ ID NO: 1704859 - RNA, 14 nt, Salmonella enterica enterica serovar Typhi
gagagaaacaacac

SEQ ID NO: 1704860 - RNA, 18 nt, Salmonella enterica enterica serovar Typhi
gagagaaaaaaauccagu

SEQ ID NO: 1704861 - RNA, 12 nt, Salmonella enterica enterica serovar Typhi
gagagaaaaaaa

SEQ ID NO: 1704862 - RNA, 18 nt, Salmonella enterica enterica serovar Typhi
gagaucaucggaacggau

SEQ ID NO: 1704863 - RNA, 18 nt, Salmonella enterica enterica serovar Typhi
gagagcguauccagcacc

SEQ ID NO: 1704864 - RNA, 15 nt, Salmonella enterica enterica serovar Typhi
gagagcgucaugaaa

SEQ ID NO: 1704865 - RNA, 15 nt, Salmonella enterica enterica serovar Typhi
gagcaccacgcgggc

SEQ ID NO: 1704866 - RNA, 18 nt, Salmonella enterica enterica serovar Typhi
gagaugaucguuuccagc

SEQ ID NO: 1704867 - RNA, 18 nt, Salmonella enterica enterica serovar Typhi
gagaugcagacaauuucc

SEQ ID NO: 1704868 - RNA, 15 nt, Salmonella enterica enterica serovar Typhi
gagcaauggcguggc

SEQ ID NO: 1704869 - RNA, 16 nt, Salmonella enterica enterica serovar Typhi
gagcacugcccaggac

SEQ ID NO: 1704870 - RNA, 21 nt, Salmonella enterica enterica serovar Typhi
gagcagacuguaaaucugccg

SEQ ID NO: 1704871 - RNA, 17 nt, Salmonella enterica enterica serovar Typhi
gagcagaacaaguucuu

SEQ ID NO: 1704872 - RNA, 19 nt, Salmonella enterica enterica serovar Typhi
gagcagucguugcgccugu

SEQ ID NO: 1704873 - RNA, 13 nt, Salmonella enterica enterica serovar Typhi
gagcaggggccgg

SEQ ID NO: 1704874 - RNA, 22 nt, Salmonella enterica enterica serovar Typhi
gagcaggggcuccugcgccgga

SEQ ID NO: 1704875 - RNA, 19 nt, Salmonella enterica enterica serovar Typhi
gagcagguuacucuuccac

SEQ ID NO: 1704876 - RNA, 19 nt, Salmonella enterica enterica serovar Typhi
gagccauuaaugcaggcag

SEQ ID NO: 1704877 - RNA, 20 nt, Salmonella enterica enterica serovar Typhi
gagcaucaucugccauuucu

SEQ ID NO: 1704878 - RNA, 23 nt, Salmonella enterica enterica serovar Typhi
aaagcagugaauccccagaauuu

SEQ ID NO: 1704879 - RNA, 22 nt, Salmonella enterica enterica serovar Typhi
gauaccggaggagugcgccagu

SEQ ID NO: 1704880 - RNA, 16 nt, Salmonella enterica enterica serovar Typhi
gauacccccuaucugg

SEQ ID NO: 1704881 - RNA, 17 nt, Salmonella enterica enterica serovar Typhi
gauacccgcccagauca

SEQ ID NO: 1704882 - RNA, 19 nt, Salmonella enterica enterica serovar Typhi
gauacccagcgucccggcg

SEQ ID NO: 1704883 - RNA, 12 nt, Salmonella enterica enterica serovar Typhi
gauaccagauua

SEQ ID NO: 1704884 - RNA, 20 nt, Salmonella enterica enterica serovar Typhi
gauacccagcgucccggcgu

SEQ ID NO: 1704885 - RNA, 20 nt, Salmonella enterica enterica serovar Typhi
gauacaggacugacugcugu

SEQ ID NO: 1704886 - RNA, 15 nt, Salmonella enterica enterica serovar Typhi
gauacagaaaaccgg

SEQ ID NO: 1704887 - RNA, 18 nt, Salmonella enterica enterica serovar Typhi
gauacagaaaaccggcaa

SEQ ID NO: 1704888 - RNA, 13 nt, Salmonella enterica enterica serovar Typhi
gauacauuuuuug

SEQ ID NO: 1704889 - RNA, 19 nt, Salmonella enterica enterica serovar Typhi
gauaaggucgcuauccagc

SEQ ID NO: 1704890 - RNA, 13 nt, Salmonella enterica enterica serovar Typhi
gauaaggcagcaa

SEQ ID NO: 1704891 - RNA, 14 nt, Salmonella enterica enterica serovar Typhi
gauaaggccacgcc

SEQ ID NO: 1704892 - RNA, 22 nt, Salmonella enterica enterica serovar Typhi
gauaaggucgcuauccagcagu

SEQ ID NO: 1704893 - RNA, 23 nt, Salmonella enterica enterica serovar Typhi
gauaagucccggaccgauugacu

SEQ ID NO: 1704894 - RNA, 16 nt, Salmonella enterica enterica serovar Typhi
gauaaguccuaacacc

SEQ ID NO: 1704895 - RNA, 17 nt, Salmonella enterica enterica serovar Typhi
gauaauaccucaaaugc

SEQ ID NO: 1704896 - RNA, 17 nt, Salmonella enterica enterica serovar Typhi
gauaauacauugccgca

SEQ ID NO: 1704897 - RNA, 16 nt, Salmonella enterica enterica serovar Typhi
gauaauagaaccgaau

SEQ ID NO: 1704898 - RNA, 14 nt, Salmonella enterica enterica serovar Typhi
gauaauaaucauau

SEQ ID NO: 1704899 - RNA, 15 nt, Salmonella enterica enterica serovar Typhi
gauaaugacauccag

SEQ ID NO: 1704900 - RNA, 20 nt, Salmonella enterica enterica serovar Typhi
gauaauggcgccgauaacac

SEQ ID NO: 1704901 - RNA, 13 nt, Salmonella enterica enterica serovar Typhi
gauaauucugacu

SEQ ID NO: 1704902 - RNA, 16 nt, Salmonella enterica enterica serovar Typhi
gauaauucccccagua

SEQ ID NO: 1704903 - RNA, 19 nt, Salmonella enterica enterica serovar Typhi
gauaauucugacuugcugu

SEQ ID NO: 1704904 - RNA, 20 nt, Salmonella enterica enterica serovar Typhi
gauaauguuggauuauacau

SEQ ID NO: 1704905 - RNA, 18 nt, Salmonella enterica enterica serovar Typhi
gauaauguugguaaauuu

SEQ ID NO: 1704906 - RNA, 21 nt, Salmonella enterica enterica serovar Typhi
gauaaucgguagcacuuuaaa

SEQ ID NO: 1704907 - RNA, 18 nt, Salmonella enterica enterica serovar Typhi
gauaaucgccgccagcuc

SEQ ID NO: 1704908 - RNA, 14 nt, Salmonella enterica enterica serovar Typhi
gauaaucagcagcg

SEQ ID NO: 1704909 - RNA, 20 nt, Salmonella enterica enterica serovar Typhi
gauacgucauaucauccagc

SEQ ID NO: 1704910 - RNA, 13 nt, Salmonella enterica enterica serovar Typhi
gauacguuccagc

SEQ ID NO: 1704911 - RNA, 14 nt, Salmonella enterica enterica serovar Typhi
gauacguuccagca

SEQ ID NO: 1704912 - RNA, 23 nt, Salmonella enterica enterica serovar Typhi
gauacggcugucaggagccaccg

SEQ ID NO: 1704913 - RNA, 17 nt, Salmonella enterica enterica serovar Typhi
gauacgggaucgauaau

SEQ ID NO: 1704914 - RNA, 12 nt, Salmonella enterica enterica serovar Typhi
gauagcauuuuu

SEQ ID NO: 1704915 - RNA, 14 nt, Salmonella enterica enterica serovar Typhi
gauagccauuauag

SEQ ID NO: 1704916 - RNA, 22 nt, Salmonella enterica enterica serovar Typhi
gauagcccgccagcaccagcag

SEQ ID NO: 1704917 - RNA, 17 nt, Salmonella enterica enterica serovar Typhi
gauagcccauccagcac

SEQ ID NO: 1704918 - RNA, 20 nt, Salmonella enterica enterica serovar Typhi
gauagccauacgauucaggu

SEQ ID NO: 1704919 - RNA, 16 nt, Salmonella enterica enterica serovar Typhi
gauauauucagcaaau

SEQ ID NO: 1704920 - RNA, 23 nt, Salmonella enterica enterica serovar Typhi
gauauaccacccgcuaugaagac

SEQ ID NO: 1704921 - RNA, 15 nt, Salmonella enterica enterica serovar Typhi
gauaucaaugcgaaa

SEQ ID NO: 1704922 - RNA, 17 nt, Salmonella enterica enterica serovar Typhi
gauaucaacccaguuuu

SEQ ID NO: 1704923 - RNA, 12 nt, Salmonella enterica enterica serovar Typhi
gauauaaaaugg

SEQ ID NO: 1704924 - RNA, 15 nt, Salmonella enterica enterica serovar Typhi
gauagcguuuuccag

SEQ ID NO: 1704925 - RNA, 22 nt, Salmonella enterica enterica serovar Typhi
gauagcuaucacacauaucgcc

SEQ ID NO: 1704926 - RNA, 20 nt, Salmonella enterica enterica serovar Typhi
gauaguuuaaauccagcgcg

SEQ ID NO: 1704927 - RNA, 22 nt, Salmonella enterica enterica serovar Typhi
gauagcgccgguuucuccagcc

SEQ ID NO: 1704928 - RNA, 19 nt, Salmonella enterica enterica serovar Typhi
gauagcgcuuuccaguccc

SEQ ID NO: 1704929 - RNA, 11 nt, Salmonella enterica enterica serovar Typhi
gauagccuuau

SEQ ID NO: 1704930 - RNA, 16 nt, Salmonella enterica enterica serovar Typhi
gaucaauugcgguggc

SEQ ID NO: 1704931 - RNA, 14 nt, Salmonella enterica enterica serovar Typhi
gauauuuugcugca

SEQ ID NO: 1704932 - RNA, 15 nt, Salmonella enterica enterica serovar Typhi
gauauucugcacgca

SEQ ID NO: 1704933 - RNA, 20 nt, Salmonella enterica enterica serovar Typhi
gauauugugcauacugauuu

SEQ ID NO: 1704934 - RNA, 13 nt, Salmonella enterica enterica serovar Typhi
gauauuccauaca

SEQ ID NO: 1704935 - RNA, 13 nt, Salmonella enterica enterica serovar Typhi
gauauucaucgcc

SEQ ID NO: 1704936 - RNA, 20 nt, Salmonella enterica enterica serovar Typhi
gauauccaccaccugauucu

SEQ ID NO: 1704937 - RNA, 22 nt, Salmonella enterica enterica serovar Typhi
gauauccgcgcucaacacauaa

SEQ ID NO: 1704938 - RNA, 23 nt, Salmonella enterica enterica serovar Typhi
gauaucgucauuaacgggaaacu

SEQ ID NO: 1704939 - RNA, 14 nt, Salmonella enterica enterica serovar Typhi
gagucuacaucaag

SEQ ID NO: 1704940 - RNA, 20 nt, Salmonella enterica enterica serovar Typhi
gagucuuauccgacugacca

SEQ ID NO: 1704941 - RNA, 14 nt, Salmonella enterica enterica serovar Typhi
gaguccauuuccuc

SEQ ID NO: 1704942 - RNA, 20 nt, Salmonella enterica enterica serovar Typhi
gaguccauauccguacauaa

SEQ ID NO: 1704943 - RNA, 15 nt, Salmonella enterica enterica serovar Typhi
gaguccagcggcagc

SEQ ID NO: 1704944 - RNA, 23 nt, Salmonella enterica enterica serovar Typhi
gagucguuauccagaucuucaga

SEQ ID NO: 1704945 - RNA, 19 nt, Salmonella enterica enterica serovar Typhi
gagguucgccucccucacc

SEQ ID NO: 1704946 - RNA, 21 nt, Salmonella enterica enterica serovar Typhi
gaguagcgcagcuugguagcg

SEQ ID NO: 1704947 - RNA, 20 nt, Salmonella enterica enterica serovar Typhi
gaguaaaaccggcacaucca

SEQ ID NO: 1704948 - RNA, 16 nt, Salmonella enterica enterica serovar Typhi
gaguaguuaaaaaagg

SEQ ID NO: 1704949 - RNA, 17 nt, Salmonella enterica enterica serovar Typhi
gaguuaguggucauauu

SEQ ID NO: 1704950 - RNA, 17 nt, Salmonella enterica enterica serovar Typhi
gaguggagcggucgaca

SEQ ID NO: 1704951 - RNA, 22 nt, Salmonella enterica enterica serovar Typhi
gaguggaugacaucgcaaugcc

SEQ ID NO: 1704952 - RNA, 14 nt, Salmonella enterica enterica serovar Typhi
gauaaauucugucu

SEQ ID NO: 1704953 - RNA, 18 nt, Salmonella enterica enterica serovar Typhi
gauaaagguacuuucccc

SEQ ID NO: 1704954 - RNA, 16 nt, Salmonella enterica enterica serovar Typhi
gauaaagugacgaggc

SEQ ID NO: 1704955 - RNA, 13 nt, Salmonella enterica enterica serovar Typhi
gauaaaaaaagua

SEQ ID NO: 1704956 - RNA, 18 nt, Salmonella enterica enterica serovar Typhi
gauaaaaacacccgcacc

SEQ ID NO: 1704957 - RNA, 17 nt, Salmonella enterica enterica serovar Typhi
gaguuuuuuauggcaga

SEQ ID NO: 1704958 - RNA, 22 nt, Salmonella enterica enterica serovar Typhi
gauaaagcgcucaugccacgcc

SEQ ID NO: 1704959 - RNA, 20 nt, Salmonella enterica enterica serovar Typhi
gauaaagcgaccgaucauca

SEQ ID NO: 1704960 - RNA, 14 nt, Salmonella enterica enterica serovar Typhi
gauaaagcgaauaa

SEQ ID NO: 1704961 - RNA, 13 nt, Salmonella enterica enterica serovar Typhi
gaggucucagguu

SEQ ID NO: 1704962 - RNA, 12 nt, Salmonella enterica enterica serovar Typhi
gaggugauaauc

SEQ ID NO: 1704963 - RNA, 18 nt, Salmonella enterica enterica serovar Typhi
gaggugacggaggcgggc

SEQ ID NO: 1704964 - RNA, 14 nt, Salmonella enterica enterica serovar Typhi
gaggugcugguggu

SEQ ID NO: 1704965 - RNA, 15 nt, Salmonella enterica enterica serovar Typhi
gaggcguaucccagu

SEQ ID NO: 1704966 - RNA, 21 nt, Salmonella enterica enterica serovar Typhi
gaggcaggggcucuaaaaagg

SEQ ID NO: 1704967 - RNA, 15 nt, Salmonella enterica enterica serovar Typhi
gagggaaauagccua

SEQ ID NO: 1704968 - RNA, 18 nt, Salmonella enterica enterica serovar Typhi
gaggaucgcccagaugaa

SEQ ID NO: 1704969 - RNA, 21 nt, Salmonella enterica enterica serovar Typhi
gaggaugaaaaguauggcggu

SEQ ID NO: 1704970 - RNA, 15 nt, Salmonella enterica enterica serovar Typhi
gaggaugccugcgca

SEQ ID NO: 1704971 - RNA, 14 nt, Salmonella enterica enterica serovar Typhi
gaggaauucuccac

SEQ ID NO: 1704972 - RNA, 21 nt, Salmonella enterica enterica serovar Typhi
gagcgacaaugaaccagccca

SEQ ID NO: 1704973 - RNA, 20 nt, Salmonella enterica enterica serovar Typhi
gagcgaacaguacggucagg

SEQ ID NO: 1704974 - RNA, 23 nt, Salmonella enterica enterica serovar Typhi
gagcgaacggcuuuccagcagcc

SEQ ID NO: 1704975 - RNA, 23 nt, Salmonella enterica enterica serovar Typhi
ggccgggccugagcgcgcagcug

SEQ ID NO: 1704976 - RNA, 17 nt, Salmonella enterica enterica serovar Typhi
ggccggcuucuccacca

SEQ ID NO: 1704977 - RNA, 20 nt, Salmonella enterica enterica serovar Typhi
ggccgcuuacugugccgccg

SEQ ID NO: 1704978 - RNA, 19 nt, Salmonella enterica enterica serovar Typhi
ggccggcaccagccaggaa

SEQ ID NO: 1704979 - RNA, 18 nt, Salmonella enterica enterica serovar Typhi
ggccggauaagcgcagcg

SEQ ID NO: 1704980 - RNA, 21 nt, Salmonella enterica enterica serovar Typhi
ggccggauaaggcgcuagccg

SEQ ID NO: 1704981 - RNA, 18 nt, Salmonella enterica enterica serovar Typhi
ggccggauaaggcgcuug

SEQ ID NO: 1704982 - RNA, 20 nt, Salmonella enterica enterica serovar Typhi
ggccgcgcugaugugcggcc

SEQ ID NO: 1704983 - RNA, 15 nt, Salmonella enterica enterica serovar Typhi
aaaguugcaucaaga

SEQ ID NO: 1704984 - RNA, 22 nt, Salmonella enterica enterica serovar Typhi
ggccgcucgccauaucuucuac

SEQ ID NO: 1704985 - RNA, 14 nt, Salmonella enterica enterica serovar Typhi
ggccgcucgccugc

SEQ ID NO: 1704986 - RNA, 21 nt, Salmonella enterica enterica serovar Typhi
ggccgauauugcggccuuccu

SEQ ID NO: 1704987 - RNA, 22 nt, Salmonella enterica enterica serovar Typhi
aaagugccagggcggaagcaga

SEQ ID NO: 1704988 - RNA, 15 nt, Salmonella enterica enterica serovar Typhi
ggccauuugucucuu

SEQ ID NO: 1704989 - RNA, 13 nt, Salmonella enterica enterica serovar Typhi
ggcccaaacgaug

SEQ ID NO: 1704990 - RNA, 23 nt, Salmonella enterica enterica serovar Typhi
aaagugccagggcggaagcagau

SEQ ID NO: 1704991 - RNA, 18 nt, Salmonella enterica enterica serovar Typhi
ggccgcaaccgccaauaa

SEQ ID NO: 1704992 - RNA, 13 nt, Salmonella enterica enterica serovar Typhi
ggccgccgagcug

SEQ ID NO: 1704993 - RNA, 17 nt, Salmonella enterica enterica serovar Typhi
ggccgcccggacccgcu

SEQ ID NO: 1704994 - RNA, 12 nt, Salmonella enterica enterica serovar Typhi
ggccgccagggg

SEQ ID NO: 1704995 - RNA, 16 nt, Salmonella enterica enterica serovar Typhi
aaaguuauuuuuucuu

SEQ ID NO: 1704996 - RNA, 12 nt, Salmonella enterica enterica serovar Typhi
aaaguuauuaca

SEQ ID NO: 1704997 - RNA, 13 nt, Salmonella enterica enterica serovar Typhi
ggccgccagcaac

SEQ ID NO: 1704998 - RNA, 12 nt, Salmonella enterica enterica serovar Typhi
ggccgccagcgc

SEQ ID NO: 1704999 - RNA, 18 nt, Salmonella enterica enterica serovar Typhi
aaaguguguaccagcagc

SEQ ID NO: 1705000 - RNA, 14 nt, Salmonella enterica enterica serovar Typhi
ggccgucggcgcca

SEQ ID NO: 1705001 - RNA, 17 nt, Salmonella enterica enterica serovar Typhi
ggccgguuggcuccagu

SEQ ID NO: 1705002 - RNA, 13 nt, Salmonella enterica enterica serovar Typhi
aaauaaaaaaacc

SEQ ID NO: 1705003 - RNA, 23 nt, Salmonella enterica enterica serovar Typhi
ggccguucauucgccccagcaua

SEQ ID NO: 1705004 - RNA, 15 nt, Salmonella enterica enterica serovar Typhi
ggccguuaaaccaaa

SEQ ID NO: 1705005 - RNA, 23 nt, Salmonella enterica enterica serovar Typhi
ggccuacaaaaucgcccaggccu

SEQ ID NO: 1705006 - RNA, 15 nt, Salmonella enterica enterica serovar Typhi
ggccguuuucccggc

SEQ ID NO: 1705007 - RNA, 23 nt, Salmonella enterica enterica serovar Typhi
ggccuacauuuuuacaguuacca

SEQ ID NO: 1705008 - RNA, 17 nt, Salmonella enterica enterica serovar Typhi
ggccuacagacuguacc

SEQ ID NO: 1705009 - RNA, 18 nt, Salmonella enterica enterica serovar Typhi
ggccuacaaggcauucag

SEQ ID NO: 1705010 - RNA, 20 nt, Salmonella enterica enterica serovar Typhi
ggccuacacucugcgcgcga

SEQ ID NO: 1705011 - RNA, 13 nt, Salmonella enterica enterica serovar Typhi
ggccuccuggcuu

SEQ ID NO: 1705012 - RNA, 13 nt, Salmonella enterica enterica serovar Typhi
ggccuccggcggg

SEQ ID NO: 1705013 - RNA, 22 nt, Salmonella enterica enterica serovar Typhi
ggccugaaugcagaccucugcu

SEQ ID NO: 1705014 - RNA, 20 nt, Salmonella enterica enterica serovar Typhi
ggccugaauaaugaccucca

SEQ ID NO: 1705015 - RNA, 19 nt, Salmonella enterica enterica serovar Typhi
ggccuggcuuguuacugca

SEQ ID NO: 1705016 - RNA, 18 nt, Salmonella enterica enterica serovar Typhi
ggccuggcugagaaaaau

SEQ ID NO: 1705017 - RNA, 15 nt, Salmonella enterica enterica serovar Typhi
aaauaaaaaaggcag

SEQ ID NO: 1705018 - RNA, 23 nt, Salmonella enterica enterica serovar Typhi
aaauaaaaaccgccucaggcgca

SEQ ID NO: 1705019 - RNA, 14 nt, Salmonella enterica enterica serovar Typhi
aaauaaaaauuccc

SEQ ID NO: 1705020 - RNA, 17 nt, Salmonella enterica enterica serovar Typhi
aaauaaaaggggccugc

SEQ ID NO: 1705021 - RNA, 12 nt, Salmonella enterica enterica serovar Typhi
aaauaaaauacg

SEQ ID NO: 1705022 - RNA, 16 nt, Salmonella enterica enterica serovar Typhi
aaauaaaauacuucca

SEQ ID NO: 1705023 - RNA, 13 nt, Salmonella enterica enterica serovar Typhi
aaauaaacaccau

SEQ ID NO: 1705024 - RNA, 21 nt, Salmonella enterica enterica serovar Typhi
aaauaaacgcuugacucugaa

SEQ ID NO: 1705025 - RNA, 12 nt, Salmonella enterica enterica serovar Typhi
ggccuggagauc

SEQ ID NO: 1705026 - RNA, 15 nt, Salmonella enterica enterica serovar Typhi
ggccugcggaaaaag

SEQ ID NO: 1705027 - RNA, 15 nt, Salmonella enterica enterica serovar Typhi
ggccugccguccuga

SEQ ID NO: 1705028 - RNA, 16 nt, Salmonella enterica enterica serovar Typhi
ggccugauagcacagc

SEQ ID NO: 1705029 - RNA, 22 nt, Salmonella enterica enterica serovar Typhi
ggccugauaagacgcaucgcgu

SEQ ID NO: 1705030 - RNA, 18 nt, Salmonella enterica enterica serovar Typhi
ggccugauaagcgcagcg

SEQ ID NO: 1705031 - RNA, 22 nt, Salmonella enterica enterica serovar Typhi
ggccugcagagcggcaaauuca

SEQ ID NO: 1705032 - RNA, 17 nt, Salmonella enterica enterica serovar Typhi
ggccuguuucuuaccac

SEQ ID NO: 1705033 - RNA, 23 nt, Salmonella enterica enterica serovar Typhi
ggccugugccugacagcaaugag

SEQ ID NO: 1705034 - RNA, 15 nt, Salmonella enterica enterica serovar Typhi
ggccugucaggccug

SEQ ID NO: 1705035 - RNA, 16 nt, Salmonella enterica enterica serovar Typhi
ggccugucacguaaaa

SEQ ID NO: 1705036 - RNA, 22 nt, Salmonella enterica enterica serovar Typhi
ggccugucacguaaaauuagac

SEQ ID NO: 1705037 - RNA, 17 nt, Salmonella enterica enterica serovar Typhi
aaauaaagguucauauu

SEQ ID NO: 1705038 - RNA, 21 nt, Salmonella enterica enterica serovar Typhi
aaauaaagugcugaacaauaa

SEQ ID NO: 1705039 - RNA, 18 nt, Salmonella enterica enterica serovar Typhi
aaauaaaguguuaucaug

SEQ ID NO: 1705040 - RNA, 21 nt, Salmonella enterica enterica serovar Typhi
aaauaaauauguuauuuacaa

SEQ ID NO: 1705041 - RNA, 18 nt, Salmonella enterica enterica serovar Typhi
aaauaaaugauauuuaaa

SEQ ID NO: 1705042 - RNA, 22 nt, Salmonella enterica enterica serovar Typhi
aaauaaauaguaaauagaaaau

SEQ ID NO: 1705043 - RNA, 16 nt, Salmonella enterica enterica serovar Typhi
ggcgaauccuaaacuc

SEQ ID NO: 1705044 - RNA, 14 nt, Salmonella enterica enterica serovar Typhi
ggcgaaucgccugu

SEQ ID NO: 1705045 - RNA, 15 nt, Salmonella enterica enterica serovar Typhi
ggcgaaggcggcggc

SEQ ID NO: 1705046 - RNA, 23 nt, Salmonella enterica enterica serovar Typhi
ggcgaacguuuuuucgcacgccu

SEQ ID NO: 1705047 - RNA, 17 nt, Salmonella enterica enterica serovar Typhi
ggcgaacguuggcuggg

SEQ ID NO: 1705048 - RNA, 22 nt, Salmonella enterica enterica serovar Typhi
ggccuugaaguuauccagcgcc

SEQ ID NO: 1705049 - RNA, 12 nt, Salmonella enterica enterica serovar Typhi
ggccuucugcua

SEQ ID NO: 1705050 - RNA, 14 nt, Salmonella enterica enterica serovar Typhi
aaauacugauuaau

SEQ ID NO: 1705051 - RNA, 13 nt, Salmonella enterica enterica serovar Typhi
ggcgcgcgcgcca

SEQ ID NO: 1705052 - RNA, 21 nt, Salmonella enterica enterica serovar Typhi
ggcgcugaacgcauacaggcu

SEQ ID NO: 1705053 - RNA, 20 nt, Salmonella enterica enterica serovar Typhi
ggcgcugcuggcagcgcuga

SEQ ID NO: 1705054 - RNA, 23 nt, Salmonella enterica enterica serovar Typhi
ggcgcucggaugugcauugacua

SEQ ID NO: 1705055 - RNA, 13 nt, Salmonella enterica enterica serovar Typhi
ggcgcuaaugcuu

SEQ ID NO: 1705056 - RNA, 14 nt, Salmonella enterica enterica serovar Typhi
ggcgcuauucccag

SEQ ID NO: 1705057 - RNA, 17 nt, Salmonella enterica enterica serovar Typhi
ggcgcucaauagccaga

SEQ ID NO: 1705058 - RNA, 19 nt, Salmonella enterica enterica serovar Typhi
ggcgccggagucgacggcg

SEQ ID NO: 1705059 - RNA, 23 nt, Salmonella enterica enterica serovar Typhi
ggcgccggauggcggcugcgccu

SEQ ID NO: 1705060 - RNA, 12 nt, Salmonella enterica enterica serovar Typhi
ggcgccggcgcg

SEQ ID NO: 1705061 - RNA, 16 nt, Salmonella enterica enterica serovar Typhi
ggcgccgcaaaccaga

SEQ ID NO: 1705062 - RNA, 15 nt, Salmonella enterica enterica serovar Typhi
ggcgccgaucauccc

SEQ ID NO: 1705063 - RNA, 16 nt, Salmonella enterica enterica serovar Typhi
ggcgcgauauccacca

SEQ ID NO: 1705064 - RNA, 15 nt, Salmonella enterica enterica serovar Typhi
ggcgccucgcgcggc

SEQ ID NO: 1705065 - RNA, 14 nt, Salmonella enterica enterica serovar Typhi
ggcgcagagugagc

SEQ ID NO: 1705066 - RNA, 17 nt, Salmonella enterica enterica serovar Typhi
ggcgcagcauacgcugc

SEQ ID NO: 1705067 - RNA, 13 nt, Salmonella enterica enterica serovar Typhi
aaauaccgcacau

SEQ ID NO: 1705068 - RNA, 16 nt, Salmonella enterica enterica serovar Typhi
ggcgcaguucgccgcc

SEQ ID NO: 1705069 - RNA, 20 nt, Salmonella enterica enterica serovar Typhi
ggcgcaguucgccgccagga

SEQ ID NO: 1705070 - RNA, 21 nt, Salmonella enterica enterica serovar Typhi
ggcgcaguauggcgaccagga

SEQ ID NO: 1705071 - RNA, 23 nt, Salmonella enterica enterica serovar Typhi
ggcgcauaaugacguccaggccg

SEQ ID NO: 1705072 - RNA, 19 nt, Salmonella enterica enterica serovar Typhi
ggcgcauaaugacguccag

SEQ ID NO: 1705073 - RNA, 22 nt, Salmonella enterica enterica serovar Typhi
ggcgcaguuuacgcagcgccuu

SEQ ID NO: 1705074 - RNA, 15 nt, Salmonella enterica enterica serovar Typhi
ggcgcaucagaaaaa

SEQ ID NO: 1705075 - RNA, 12 nt, Salmonella enterica enterica serovar Typhi
ggcgcaucagaa

SEQ ID NO: 1705076 - RNA, 23 nt, Salmonella enterica enterica serovar Typhi
ggcgcaucagaaaaaccuccggc

SEQ ID NO: 1705077 - RNA, 21 nt, Salmonella enterica enterica serovar Typhi
ggcgcauuuucggcagcgcga

SEQ ID NO: 1705078 - RNA, 19 nt, Salmonella enterica enterica serovar Typhi
ggcgcauucucugucgccg

SEQ ID NO: 1705079 - RNA, 22 nt, Salmonella enterica enterica serovar Typhi
ggcgccaucgccuccagacugg

SEQ ID NO: 1705080 - RNA, 15 nt, Salmonella enterica enterica serovar Typhi
ggcgcccauccgccc

SEQ ID NO: 1705081 - RNA, 23 nt, Salmonella enterica enterica serovar Typhi
aaauacagagucgcuuaucugcu

SEQ ID NO: 1705082 - RNA, 16 nt, Salmonella enterica enterica serovar Typhi
ggcgacaaacagcgcc

SEQ ID NO: 1705083 - RNA, 19 nt, Salmonella enterica enterica serovar Typhi
ggcgaucagcgccaccaca

SEQ ID NO: 1705084 - RNA, 16 nt, Salmonella enterica enterica serovar Typhi
ggcgauaacccgcgca

SEQ ID NO: 1705085 - RNA, 20 nt, Salmonella enterica enterica serovar Typhi
ggcgaguuuggugcccgcgu

SEQ ID NO: 1705086 - RNA, 22 nt, Salmonella enterica enterica serovar Typhi
ggcgauaaaccaacagccgccu

SEQ ID NO: 1705087 - RNA, 23 nt, Salmonella enterica enterica serovar Typhi
ggcgauaaaccaacagccgccug

SEQ ID NO: 1705088 - RNA, 17 nt, Salmonella enterica enterica serovar Typhi
ggcgaguucucgcucuu

SEQ ID NO: 1705089 - RNA, 17 nt, Salmonella enterica enterica serovar Typhi
ggcgaguagcgcagcuu

SEQ ID NO: 1705090 - RNA, 20 nt, Salmonella enterica enterica serovar Typhi
ggcgcaacguuugccagcgu

SEQ ID NO: 1705091 - RNA, 20 nt, Salmonella enterica enterica serovar Typhi
ggcgauguaacgccuuugcc

SEQ ID NO: 1705092 - RNA, 13 nt, Salmonella enterica enterica serovar Typhi
ggcgcacagcgcc

SEQ ID NO: 1705093 - RNA, 19 nt, Salmonella enterica enterica serovar Typhi
ggcgcaaucuuugccgcaa

SEQ ID NO: 1705094 - RNA, 15 nt, Salmonella enterica enterica serovar Typhi
ggcgauggcucgccc

SEQ ID NO: 1705095 - RNA, 22 nt, Salmonella enterica enterica serovar Typhi
ggcgugguggauauccagcaua

SEQ ID NO: 1705096 - RNA, 23 nt, Salmonella enterica enterica serovar Typhi
ggcguuacuccgcgguagagcgc

SEQ ID NO: 1705097 - RNA, 18 nt, Salmonella enterica enterica serovar Typhi
ggcguuaucuugacauga

SEQ ID NO: 1705098 - RNA, 18 nt, Salmonella enterica enterica serovar Typhi
ggcguuacccgucuggcg

SEQ ID NO: 1705099 - RNA, 19 nt, Salmonella enterica enterica serovar Typhi
ggcguuaccggcaggcugg

SEQ ID NO: 1705100 - RNA, 17 nt, Salmonella enterica enterica serovar Typhi
ggcguuacagacgcugc

SEQ ID NO: 1705101 - RNA, 22 nt, Salmonella enterica enterica serovar Typhi
ggcguuaaucaccggcgcgggc

SEQ ID NO: 1705102 - RNA, 21 nt, Salmonella enterica enterica serovar Typhi
ggcgugucaucaaaaucgggc

SEQ ID NO: 1705103 - RNA, 21 nt, Salmonella enterica enterica serovar Typhi
ggcgucgugcugggcgcgccu

SEQ ID NO: 1705104 - RNA, 20 nt, Salmonella enterica enterica serovar Typhi
ggcguuguaagguuaagccu

SEQ ID NO: 1705105 - RNA, 19 nt, Salmonella enterica enterica serovar Typhi
ggcguugcgcccaggccaa

SEQ ID NO: 1705106 - RNA, 19 nt, Salmonella enterica enterica serovar Typhi
ggcguucugcgccauuucc

SEQ ID NO: 1705107 - RNA, 19 nt, Salmonella enterica enterica serovar Typhi
ggcguuuauauaaaaauag

SEQ ID NO: 1705108 - RNA, 13 nt, Salmonella enterica enterica serovar Typhi
ggcuacccagaca

SEQ ID NO: 1705109 - RNA, 12 nt, Salmonella enterica enterica serovar Typhi
ggcuacccauga

SEQ ID NO: 1705110 - RNA, 15 nt, Salmonella enterica enterica serovar Typhi
ggcuaucaauguuua

SEQ ID NO: 1705111 - RNA, 21 nt, Salmonella enterica enterica serovar Typhi
ggcuaucgcacuggcgccugc

SEQ ID NO: 1705112 - RNA, 21 nt, Salmonella enterica enterica serovar Typhi
ggcuacguacacagucaaaca

SEQ ID NO: 1705113 - RNA, 12 nt, Salmonella enterica enterica serovar Typhi
ggcucaccagcc

SEQ ID NO: 1705114 - RNA, 12 nt, Salmonella enterica enterica serovar Typhi
ggcucaaauugg

SEQ ID NO: 1705115 - RNA, 18 nt, Salmonella enterica enterica serovar Typhi
ggcucagcauagcgcuga

SEQ ID NO: 1705116 - RNA, 23 nt, Salmonella enterica enterica serovar Typhi
ggcggaaagcauucgcagcagac

SEQ ID NO: 1705117 - RNA, 17 nt, Salmonella enterica enterica serovar Typhi
ggcgcuuuuccagcacg

SEQ ID NO: 1705118 - RNA, 13 nt, Salmonella enterica enterica serovar Typhi
ggcggaaaucaac

SEQ ID NO: 1705119 - RNA, 18 nt, Salmonella enterica enterica serovar Typhi
ggcggaaaugcggguccu

SEQ ID NO: 1705120 - RNA, 20 nt, Salmonella enterica enterica serovar Typhi
ggcgcuggcagggacgcugc

SEQ ID NO: 1705121 - RNA, 17 nt, Salmonella enterica enterica serovar Typhi
ggcgcuuccugcagugg

SEQ ID NO: 1705122 - RNA, 15 nt, Salmonella enterica enterica serovar Typhi
ggcgcuuacgggcga

SEQ ID NO: 1705123 - RNA, 14 nt, Salmonella enterica enterica serovar Typhi
ggcggcguccggca

SEQ ID NO: 1705124 - RNA, 14 nt, Salmonella enterica enterica serovar Typhi
ggcggcguaaacac

SEQ ID NO: 1705125 - RNA, 14 nt, Salmonella enterica enterica serovar Typhi
ggcggcgcgcaggc

SEQ ID NO: 1705126 - RNA, 14 nt, Salmonella enterica enterica serovar Typhi
ggcggcuuggcugu

SEQ ID NO: 1705127 - RNA, 18 nt, Salmonella enterica enterica serovar Typhi
ggcggugauuuaaggcug

SEQ ID NO: 1705128 - RNA, 21 nt, Salmonella enterica enterica serovar Typhi
ggcguaaaagcgauaaagaca

SEQ ID NO: 1705129 - RNA, 21 nt, Salmonella enterica enterica serovar Typhi
ggcguaaaugugcgccagccu

SEQ ID NO: 1705130 - RNA, 20 nt, Salmonella enterica enterica serovar Typhi
ggcgucacccgccggcagca

SEQ ID NO: 1705131 - RNA, 17 nt, Salmonella enterica enterica serovar Typhi
ggcgucagcauggugug

SEQ ID NO: 1705132 - RNA, 17 nt, Salmonella enterica enterica serovar Typhi
ggccauuaacacacaau

SEQ ID NO: 1705133 - RNA, 21 nt, Salmonella enterica enterica serovar Typhi
ggccaucgacgaaauggugug

SEQ ID NO: 1705134 - RNA, 22 nt, Salmonella enterica enterica serovar Typhi
ggccaucgccgcagagaauaac

SEQ ID NO: 1705135 - RNA, 15 nt, Salmonella enterica enterica serovar Typhi
ggccagucgacagac

SEQ ID NO: 1705136 - RNA, 20 nt, Salmonella enterica enterica serovar Typhi
ggccagcguggaugaacuca

SEQ ID NO: 1705137 - RNA, 17 nt, Salmonella enterica enterica serovar Typhi
ggccagcguaccugcgg

SEQ ID NO: 1705138 - RNA, 16 nt, Salmonella enterica enterica serovar Typhi
ggccaggcauugauaa

SEQ ID NO: 1705139 - RNA, 21 nt, Salmonella enterica enterica serovar Typhi
ggccaggcacguuaaacaccu

SEQ ID NO: 1705140 - RNA, 22 nt, Salmonella enterica enterica serovar Typhi
ggccaccgauaaaaagcaaaga

SEQ ID NO: 1705141 - RNA, 22 nt, Salmonella enterica enterica serovar Typhi
ggccaccgaagaauuuaucaau

SEQ ID NO: 1705142 - RNA, 21 nt, Salmonella enterica enterica serovar Typhi
ggccacgguguggcccagcgc

SEQ ID NO: 1705143 - RNA, 22 nt, Salmonella enterica enterica serovar Typhi
ggccagccguaacgagugagga

SEQ ID NO: 1705144 - RNA, 20 nt, Salmonella enterica enterica serovar Typhi
ggccagcgaaaaccagcgcc

SEQ ID NO: 1705145 - RNA, 22 nt, Salmonella enterica enterica serovar Typhi
ggcaugauguccagcgcgccgg

SEQ ID NO: 1705146 - RNA, 22 nt, Salmonella enterica enterica serovar Typhi
ggcauggggucaggugggacca

SEQ ID NO: 1705147 - RNA, 21 nt, Salmonella enterica enterica serovar Typhi
ggcauguccggcgacuccaga

SEQ ID NO: 1705148 - RNA, 20 nt, Salmonella enterica enterica serovar Typhi
ggccaaaacccaccagcagg

SEQ ID NO: 1705149 - RNA, 15 nt, Salmonella enterica enterica serovar Typhi
ggccaaacagcggcu

SEQ ID NO: 1705150 - RNA, 17 nt, Salmonella enterica enterica serovar Typhi
ggcauuaauauccagug

SEQ ID NO: 1705151 - RNA, 18 nt, Salmonella enterica enterica serovar Typhi
ggcauuaagucauaccug

SEQ ID NO: 1705152 - RNA, 19 nt, Salmonella enterica enterica serovar Typhi
ggccaaaaccacagugacc

SEQ ID NO: 1705153 - RNA, 18 nt, Salmonella enterica enterica serovar Typhi
ggcauuuuauuaccuggu

SEQ ID NO: 1705154 - RNA, 19 nt, Salmonella enterica enterica serovar Typhi
ggccacaauugccagcagg

SEQ ID NO: 1705155 - RNA, 22 nt, Salmonella enterica enterica serovar Typhi
ggccaacgcgcccucugagcug

SEQ ID NO: 1705156 - RNA, 21 nt, Salmonella enterica enterica serovar Typhi
ggccaacauagcggcaaggaa

SEQ ID NO: 1705157 - RNA, 14 nt, Salmonella enterica enterica serovar Typhi
ggccacagcgccag

SEQ ID NO: 1705158 - RNA, 23 nt, Salmonella enterica enterica serovar Typhi
ggccacauugaaugccgaauggc

SEQ ID NO: 1705159 - RNA, 17 nt, Salmonella enterica enterica serovar Typhi
ggccaccaggccugagc

SEQ ID NO: 1705160 - RNA, 13 nt, Salmonella enterica enterica serovar Typhi
ggcauaaaaaaag

SEQ ID NO: 1705161 - RNA, 20 nt, Salmonella enterica enterica serovar Typhi
ggcaguuuaagcgccgauaa

SEQ ID NO: 1705162 - RNA, 12 nt, Salmonella enterica enterica serovar Typhi
ggcaguucccua

SEQ ID NO: 1705163 - RNA, 22 nt, Salmonella enterica enterica serovar Typhi
ggcaguucagucgggaucgcca

SEQ ID NO: 1705164 - RNA, 23 nt, Salmonella enterica enterica serovar Typhi
ggcagucgcuacaaccagcgcgg

SEQ ID NO: 1705165 - RNA, 21 nt, Salmonella enterica enterica serovar Typhi
ggcagucgcuacaaccagcgc

SEQ ID NO: 1705166 - RNA, 22 nt, Salmonella enterica enterica serovar Typhi
ggcagucccaaugcggaaacca

SEQ ID NO: 1705167 - RNA, 20 nt, Salmonella enterica enterica serovar Typhi
ggcagcgucggcuucaucac

SEQ ID NO: 1705168 - RNA, 18 nt, Salmonella enterica enterica serovar Typhi
ggcauccggcccgugcca

SEQ ID NO: 1705169 - RNA, 19 nt, Salmonella enterica enterica serovar Typhi
ggcaucuuaaagcgggcuu

SEQ ID NO: 1705170 - RNA, 16 nt, Salmonella enterica enterica serovar Typhi
ggcaucgccgcccagu

SEQ ID NO: 1705171 - RNA, 17 nt, Salmonella enterica enterica serovar Typhi
ggcauacucuccuccau

SEQ ID NO: 1705172 - RNA, 15 nt, Salmonella enterica enterica serovar Typhi
ggcauagacauccag

SEQ ID NO: 1705173 - RNA, 18 nt, Salmonella enterica enterica serovar Typhi
ggcauccaguuucuucgg

SEQ ID NO: 1705174 - RNA, 14 nt, Salmonella enterica enterica serovar Typhi
ggcauacacgccgg

SEQ ID NO: 1705175 - RNA, 19 nt, Salmonella enterica enterica serovar Typhi
ggcauaaacacagcaaaca

SEQ ID NO: 1705176 - RNA, 16 nt, Salmonella enterica enterica serovar Typhi
ggcauaaacacagcaa

SEQ ID NO: 1705177 - RNA, 19 nt, Salmonella enterica enterica serovar Typhi
ggcauaaaaaagaggaaug

SEQ ID NO: 1705178 - RNA, 18 nt, Salmonella enterica enterica serovar Typhi
ggcacggucaaucaucag

SEQ ID NO: 1705179 - RNA, 13 nt, Salmonella enterica enterica serovar Typhi
ggcacgccaaaau

SEQ ID NO: 1705180 - RNA, 19 nt, Salmonella enterica enterica serovar Typhi
ggcaccucguccagauggg

SEQ ID NO: 1705181 - RNA, 15 nt, Salmonella enterica enterica serovar Typhi
ggcaccgguuuuuga

SEQ ID NO: 1705182 - RNA, 18 nt, Salmonella enterica enterica serovar Typhi
ggcagcacccggcccggc

SEQ ID NO: 1705183 - RNA, 20 nt, Salmonella enterica enterica serovar Typhi
ggcacugacucuuccgggcg

SEQ ID NO: 1705184 - RNA, 24 nt, Salmonella enterica enterica serovar Typhi
ggcacguuaaacaccucaccggcu

SEQ ID NO: 1705185 - RNA, 19 nt, Salmonella enterica enterica serovar Typhi
ggcagcgcgaacaggcugg

SEQ ID NO: 1705186 - RNA, 16 nt, Salmonella enterica enterica serovar Typhi
aaaguacuucacaauc

SEQ ID NO: 1705187 - RNA, 18 nt, Salmonella enterica enterica serovar Typhi
aaaguacuucacaaucag

SEQ ID NO: 1705188 - RNA, 21 nt, Salmonella enterica enterica serovar Typhi
ggcaauuuuuacaaauuuaaa

SEQ ID NO: 1705189 - RNA, 22 nt, Salmonella enterica enterica serovar Typhi
ggcaauuugacuacaaagcugg

SEQ ID NO: 1705190 - RNA, 17 nt, Salmonella enterica enterica serovar Typhi
ggcacaacggccagcaa

SEQ ID NO: 1705191 - RNA, 14 nt, Salmonella enterica enterica serovar Typhi
ggcacaauagcgcu

SEQ ID NO: 1705192 - RNA, 23 nt, Salmonella enterica enterica serovar Typhi
ggcacacaggccgccgggucagc

SEQ ID NO: 1705193 - RNA, 21 nt, Salmonella enterica enterica serovar Typhi
ggcacauauuccggcgcuggc

SEQ ID NO: 1705194 - RNA, 17 nt, Salmonella enterica enterica serovar Typhi
ggcaaugacgguaagca

SEQ ID NO: 1705195 - RNA, 23 nt, Salmonella enterica enterica serovar Typhi
ggcaauggccagaugaaacugca

SEQ ID NO: 1705196 - RNA, 23 nt, Salmonella enterica enterica serovar Typhi
ggcaauucaaucacuugaagccu

SEQ ID NO: 1705197 - RNA, 13 nt, Salmonella enterica enterica serovar Typhi
ggcaauuaacauu

SEQ ID NO: 1705198 - RNA, 12 nt, Salmonella enterica enterica serovar Typhi
ggcaauaaacuc

SEQ ID NO: 1705199 - RNA, 22 nt, Salmonella enterica enterica serovar Typhi
ggcaaucauaccgucagauucu

SEQ ID NO: 1705200 - RNA, 18 nt, Salmonella enterica enterica serovar Typhi
ggcaauccauuaauggcg

SEQ ID NO: 1705201 - RNA, 17 nt, Salmonella enterica enterica serovar Typhi
ggcaauauuaaaugacg

SEQ ID NO: 1705202 - RNA, 16 nt, Salmonella enterica enterica serovar Typhi
ggcaauauuaauguca

SEQ ID NO: 1705203 - RNA, 14 nt, Salmonella enterica enterica serovar Typhi
ggcaauaucaugaa

SEQ ID NO: 1705204 - RNA, 13 nt, Salmonella enterica enterica serovar Typhi
ggcaauauguuua

SEQ ID NO: 1705205 - RNA, 15 nt, Salmonella enterica enterica serovar Typhi
ggcaauauguuuaaa

SEQ ID NO: 1705206 - RNA, 12 nt, Salmonella enterica enterica serovar Typhi
ggcaaaccagca

SEQ ID NO: 1705207 - RNA, 14 nt, Salmonella enterica enterica serovar Typhi
ggauuggucugauu

SEQ ID NO: 1705208 - RNA, 17 nt, Salmonella enterica enterica serovar Typhi
ggauuuaaaccgccccg

SEQ ID NO: 1705209 - RNA, 11 nt, Salmonella enterica enterica serovar Typhi
ggauugucuua

SEQ ID NO: 1705210 - RNA, 20 nt, Salmonella enterica enterica serovar Typhi
ggauuuaaaccgccccgacu

SEQ ID NO: 1705211 - RNA, 22 nt, Salmonella enterica enterica serovar Typhi
ggauugaaccuaaaaaccagaa

SEQ ID NO: 1705212 - RNA, 22 nt, Salmonella enterica enterica serovar Typhi
ggcaaagcucaacgcaggcugg

SEQ ID NO: 1705213 - RNA, 16 nt, Salmonella enterica enterica serovar Typhi
ggcaaaggaaugcuuu

SEQ ID NO: 1705214 - RNA, 18 nt, Salmonella enterica enterica serovar Typhi
ggcaaacgguuaauacug

SEQ ID NO: 1705215 - RNA, 22 nt, Salmonella enterica enterica serovar Typhi
ggcaaauagcguguguuuuccu

SEQ ID NO: 1705216 - RNA, 19 nt, Salmonella enterica enterica serovar Typhi
ggcaaauuaucccuuccuc

SEQ ID NO: 1705217 - RNA, 16 nt, Salmonella enterica enterica serovar Typhi
ggcaacggcgacaaga

SEQ ID NO: 1705218 - RNA, 18 nt, Salmonella enterica enterica serovar Typhi
ggcaacgacccgaagggc

SEQ ID NO: 1705219 - RNA, 18 nt, Salmonella enterica enterica serovar Typhi
ggcaaccugucaguacgu

SEQ ID NO: 1705220 - RNA, 21 nt, Salmonella enterica enterica serovar Typhi
aaaggggagggcaacaaacau

SEQ ID NO: 1705221 - RNA, 14 nt, Salmonella enterica enterica serovar Typhi
aaaggggagggcaa

SEQ ID NO: 1705222 - RNA, 18 nt, Salmonella enterica enterica serovar Typhi
aaaggggaucguguaaca

SEQ ID NO: 1705223 - RNA, 22 nt, Salmonella enterica enterica serovar Typhi
aaaggggagucgguacuccccu

SEQ ID NO: 1705224 - RNA, 12 nt, Salmonella enterica enterica serovar Typhi
ggaccagcacaa

SEQ ID NO: 1705225 - RNA, 15 nt, Salmonella enterica enterica serovar Typhi
ggaccagcacaaaaa

SEQ ID NO: 1705226 - RNA, 18 nt, Salmonella enterica enterica serovar Typhi
ggaccaugauaucgccaa

SEQ ID NO: 1705227 - RNA, 11 nt, Salmonella enterica enterica serovar Typhi
ggacaucaucc

SEQ ID NO: 1705228 - RNA, 12 nt, Salmonella enterica enterica serovar Typhi
ggacaucgccau

SEQ ID NO: 1705229 - RNA, 17 nt, Salmonella enterica enterica serovar Typhi
ggacauaaacgccucau

SEQ ID NO: 1705230 - RNA, 14 nt, Salmonella enterica enterica serovar Typhi
ggacaucaaaggca

SEQ ID NO: 1705231 - RNA, 24 nt, Salmonella enterica enterica serovar Typhi
ggaaucggacacuugcaacucgca

SEQ ID NO: 1705232 - RNA, 14 nt, Salmonella enterica enterica serovar Typhi
ggaauccccgccgc

SEQ ID NO: 1705233 - RNA, 23 nt, Salmonella enterica enterica serovar Typhi
ggacguugagcguuacgggaaca

SEQ ID NO: 1705234 - RNA, 15 nt, Salmonella enterica enterica serovar Typhi
ggacggcggccagca

SEQ ID NO: 1705235 - RNA, 18 nt, Salmonella enterica enterica serovar Typhi
ggacgcaccagccaggcg

SEQ ID NO: 1705236 - RNA, 17 nt, Salmonella enterica enterica serovar Typhi
ggacuaucgaaagagca

SEQ ID NO: 1705237 - RNA, 17 nt, Salmonella enterica enterica serovar Typhi
ggacuauaggcaaugau

SEQ ID NO: 1705238 - RNA, 14 nt, Salmonella enterica enterica serovar Typhi
ggacuauaggcaau

SEQ ID NO: 1705239 - RNA, 16 nt, Salmonella enterica enterica serovar Typhi
ggacucgccuuucucc

SEQ ID NO: 1705240 - RNA, 18 nt, Salmonella enterica enterica serovar Typhi
ggacuccugacgcugaga

SEQ ID NO: 1705241 - RNA, 15 nt, Salmonella enterica enterica serovar Typhi
ggagaacgccgggcc

SEQ ID NO: 1705242 - RNA, 16 nt, Salmonella enterica enterica serovar Typhi
ggagaagacgccgccg

SEQ ID NO: 1705243 - RNA, 23 nt, Salmonella enterica enterica serovar Typhi
ggaggcgugagcgaacaggucgc

SEQ ID NO: 1705244 - RNA, 19 nt, Salmonella enterica enterica serovar Typhi
ggagcugacugcaaaucug

SEQ ID NO: 1705245 - RNA, 22 nt, Salmonella enterica enterica serovar Typhi
ggagcgugcucauuugcggcgu

SEQ ID NO: 1705246 - RNA, 19 nt, Salmonella enterica enterica serovar Typhi
ggagccucuucuggcuccc

SEQ ID NO: 1705247 - RNA, 22 nt, Salmonella enterica enterica serovar Typhi
ggagcgaagaauucgcaaugug

SEQ ID NO: 1705248 - RNA, 14 nt, Salmonella enterica enterica serovar Typhi
ggagcgcuucgcuu

SEQ ID NO: 1705249 - RNA, 19 nt, Salmonella enterica enterica serovar Typhi
ggagauauggcggggaggu

SEQ ID NO: 1705250 - RNA, 23 nt, Salmonella enterica enterica serovar Typhi
ggagaguuuugccgucacagaga

SEQ ID NO: 1705251 - RNA, 13 nt, Salmonella enterica enterica serovar Typhi
ggagaguuuugcc

SEQ ID NO: 1705252 - RNA, 20 nt, Salmonella enterica enterica serovar Typhi
ggaucagcagauccaucgcc

SEQ ID NO: 1705253 - RNA, 22 nt, Salmonella enterica enterica serovar Typhi
ggaucagaaauucgcagcgcag

SEQ ID NO: 1705254 - RNA, 20 nt, Salmonella enterica enterica serovar Typhi
ggaucaccugaaugcaaaga

SEQ ID NO: 1705255 - RNA, 22 nt, Salmonella enterica enterica serovar Typhi
ggaucaccugaaugcaaagaag

SEQ ID NO: 1705256 - RNA, 16 nt, Salmonella enterica enterica serovar Typhi
ggauauacuucaucag

SEQ ID NO: 1705257 - RNA, 23 nt, Salmonella enterica enterica serovar Typhi
ggaggucauuauucaggccuccu

SEQ ID NO: 1705258 - RNA, 19 nt, Salmonella enterica enterica serovar Typhi
ggagguauccuccugccag

SEQ ID NO: 1705259 - RNA, 23 nt, Salmonella enterica enterica serovar Typhi
ggaggugcugguggugggcggca

SEQ ID NO: 1705260 - RNA, 19 nt, Salmonella enterica enterica serovar Typhi
ggaguccagcaacugcgcg

SEQ ID NO: 1705261 - RNA, 22 nt, Salmonella enterica enterica serovar Typhi
ggagucauuacccaauaaugaa

SEQ ID NO: 1705262 - RNA, 13 nt, Salmonella enterica enterica serovar Typhi
ggaguccagcaac

SEQ ID NO: 1705263 - RNA, 13 nt, Salmonella enterica enterica serovar Typhi
ggagucugaaaau

SEQ ID NO: 1705264 - RNA, 12 nt, Salmonella enterica enterica serovar Typhi
ggauagucuuca

SEQ ID NO: 1705265 - RNA, 19 nt, Salmonella enterica enterica serovar Typhi
ggauagugccugccgucgc

SEQ ID NO: 1705266 - RNA, 14 nt, Salmonella enterica enterica serovar Typhi
ggaaaacuccagca

SEQ ID NO: 1705267 - RNA, 21 nt, Salmonella enterica enterica serovar Typhi
ggaaaacuggaagaagaaagg

SEQ ID NO: 1705268 - RNA, 15 nt, Salmonella enterica enterica serovar Typhi
ggaaaagcuguagca

SEQ ID NO: 1705269 - RNA, 16 nt, Salmonella enterica enterica serovar Typhi
ggaaacccgcucgccc

SEQ ID NO: 1705270 - RNA, 21 nt, Salmonella enterica enterica serovar Typhi
ggaaaccgucguuacccuccu

SEQ ID NO: 1705271 - RNA, 24 nt, Salmonella enterica enterica serovar Typhi
ggaaagaaacgccgcgcaaagcaa

SEQ ID NO: 1705272 - RNA, 23 nt, Salmonella enterica enterica serovar Typhi
ggaaaccuuucuucucuucuuca

SEQ ID NO: 1705273 - RNA, 21 nt, Salmonella enterica enterica serovar Typhi
ggaaagauuacuucaggcugc

SEQ ID NO: 1705274 - RNA, 15 nt, Salmonella enterica enterica serovar Typhi
ggaaacucuuuuccc

SEQ ID NO: 1705275 - RNA, 17 nt, Salmonella enterica enterica serovar Typhi
ggaaacuaugcaaaacg

SEQ ID NO: 1705276 - RNA, 22 nt, Salmonella enterica enterica serovar Typhi
ggaaaguaccaaaacagaaaag

SEQ ID NO: 1705277 - RNA, 13 nt, Salmonella enterica enterica serovar Typhi
ggaaaggcagaga

SEQ ID NO: 1705278 - RNA, 15 nt, Salmonella enterica enterica serovar Typhi
ggaaauaauuaaucc

SEQ ID NO: 1705279 - RNA, 13 nt, Salmonella enterica enterica serovar Typhi
ggaaauagagcag

SEQ ID NO: 1705280 - RNA, 11 nt, Salmonella enterica enterica serovar Typhi
ggaaauaacgu

SEQ ID NO: 1705281 - RNA, 19 nt, Salmonella enterica enterica serovar Typhi
ggaaaucaacaaucccuua

SEQ ID NO: 1705282 - RNA, 20 nt, Salmonella enterica enterica serovar Typhi
ggaaaucaaaccaucccagg

SEQ ID NO: 1705283 - RNA, 22 nt, Salmonella enterica enterica serovar Typhi
ggaaaucuguuccagcgagcag

SEQ ID NO: 1705284 - RNA, 19 nt, Salmonella enterica enterica serovar Typhi
ggaaauguagccccaggcc

SEQ ID NO: 1705285 - RNA, 19 nt, Salmonella enterica enterica serovar Typhi
ggaaaugccgggcaaaaaa

SEQ ID NO: 1705286 - RNA, 17 nt, Salmonella enterica enterica serovar Typhi
ggaaauuaaacugccuu

SEQ ID NO: 1705287 - RNA, 22 nt, Salmonella enterica enterica serovar Typhi
ggaaucaauuucccuucaauca

SEQ ID NO: 1705288 - RNA, 12 nt, Salmonella enterica enterica serovar Typhi
ggaauauuggua

SEQ ID NO: 1705289 - RNA, 15 nt, Salmonella enterica enterica serovar Typhi
ggaauaugauuuaaa

SEQ ID NO: 1705290 - RNA, 14 nt, Salmonella enterica enterica serovar Typhi
ggaauaucaauuca

SEQ ID NO: 1705291 - RNA, 17 nt, Salmonella enterica enterica serovar Typhi
ggaaggcuaccgcuggg

SEQ ID NO: 1705292 - RNA, 16 nt, Salmonella enterica enterica serovar Typhi
ggaaggaagggcgcug

SEQ ID NO: 1705293 - RNA, 15 nt, Salmonella enterica enterica serovar Typhi
ggaaggaaauaacgu

SEQ ID NO: 1705294 - RNA, 15 nt, Salmonella enterica enterica serovar Typhi
ggaagaccguuuaaa

SEQ ID NO: 1705295 - RNA, 17 nt, Salmonella enterica enterica serovar Typhi
ggaagacugcuccggca

SEQ ID NO: 1705296 - RNA, 15 nt, Salmonella enterica enterica serovar Typhi
ggaagacguuuacac

SEQ ID NO: 1705297 - RNA, 14 nt, Salmonella enterica enterica serovar Typhi
ggaagacuggcgca

SEQ ID NO: 1705298 - RNA, 20 nt, Salmonella enterica enterica serovar Typhi
ggaagauaagaaaaaacugg

SEQ ID NO: 1705299 - RNA, 16 nt, Salmonella enterica enterica serovar Typhi
ggaagaacuggaugac

SEQ ID NO: 1705300 - RNA, 22 nt, Salmonella enterica enterica serovar Typhi
ggaaauucugacgcagcuucug

SEQ ID NO: 1705301 - RNA, 14 nt, Salmonella enterica enterica serovar Typhi
ggaacccaggcacc

SEQ ID NO: 1705302 - RNA, 19 nt, Salmonella enterica enterica serovar Typhi
ggaaccggguugcggaagc

SEQ ID NO: 1705303 - RNA, 18 nt, Salmonella enterica enterica serovar Typhi
gcuuuguuuuccagauuc

SEQ ID NO: 1705304 - RNA, 19 nt, Salmonella enterica enterica serovar Typhi
gcuuuguuuccacugagcu

SEQ ID NO: 1705305 - RNA, 17 nt, Salmonella enterica enterica serovar Typhi
gcuuugcaagcaugaua

SEQ ID NO: 1705306 - RNA, 19 nt, Salmonella enterica enterica serovar Typhi
gcuuugcaauguucaauau

SEQ ID NO: 1705307 - RNA, 15 nt, Salmonella enterica enterica serovar Typhi
gcuuugcgccacuuc

SEQ ID NO: 1705308 - RNA, 16 nt, Salmonella enterica enterica serovar Typhi
gcuuugcgccaucggg

SEQ ID NO: 1705309 - RNA, 21 nt, Salmonella enterica enterica serovar Typhi
gcuuugcgauagcccggcaug

SEQ ID NO: 1705310 - RNA, 12 nt, Salmonella enterica enterica serovar Typhi
gcuuucucaccc

SEQ ID NO: 1705311 - RNA, 13 nt, Salmonella enterica enterica serovar Typhi
gcuuucuggauga

SEQ ID NO: 1705312 - RNA, 20 nt, Salmonella enterica enterica serovar Typhi
gcuuucugaauuucacgcuu

SEQ ID NO: 1705313 - RNA, 14 nt, Salmonella enterica enterica serovar Typhi
gcuuucuguugaua

SEQ ID NO: 1705314 - RNA, 13 nt, Salmonella enterica enterica serovar Typhi
gcuuucuucuuca

SEQ ID NO: 1705315 - RNA, 16 nt, Salmonella enterica enterica serovar Typhi
gcuguggccaggcacg

SEQ ID NO: 1705316 - RNA, 16 nt, Salmonella enterica enterica serovar Typhi
gcugugccaauaacgc

SEQ ID NO: 1705317 - RNA, 18 nt, Salmonella enterica enterica serovar Typhi
gcugugcgagaccaucaa

SEQ ID NO: 1705318 - RNA, 19 nt, Salmonella enterica enterica serovar Typhi
gcuuuuuucucugcuuucg

SEQ ID NO: 1705319 - RNA, 14 nt, Salmonella enterica enterica serovar Typhi
gcuuuuuuaucuau

SEQ ID NO: 1705320 - RNA, 20 nt, Salmonella enterica enterica serovar Typhi
gcuuuuuuaacgauuucccc

SEQ ID NO: 1705321 - RNA, 23 nt, Salmonella enterica enterica serovar Typhi
ggaaaacggccagugaaauaaau

SEQ ID NO: 1705322 - RNA, 13 nt, Salmonella enterica enterica serovar Typhi
ggaaaacgcuucu

SEQ ID NO: 1705323 - RNA, 13 nt, Salmonella enterica enterica serovar Typhi
ggaaaacgcgcug

SEQ ID NO: 1705324 - RNA, 17 nt, Salmonella enterica enterica serovar Typhi
ggaaaacagcgccggca

SEQ ID NO: 1705325 - RNA, 21 nt, Salmonella enterica enterica serovar Typhi
ggaaaacagcgccggcagcag

SEQ ID NO: 1705326 - RNA, 15 nt, Salmonella enterica enterica serovar Typhi
gcuuuuuaaauacug

SEQ ID NO: 1705327 - RNA, 18 nt, Salmonella enterica enterica serovar Typhi
gcuuuugcgcacugcucg

SEQ ID NO: 1705328 - RNA, 20 nt, Salmonella enterica enterica serovar Typhi
gcuuuugguuuuucaaccac

SEQ ID NO: 1705329 - RNA, 22 nt, Salmonella enterica enterica serovar Typhi
gcuuuuucauucugcuuaccag

SEQ ID NO: 1705330 - RNA, 21 nt, Salmonella enterica enterica serovar Typhi
gcuuuuaguuguacaaacugu

SEQ ID NO: 1705331 - RNA, 20 nt, Salmonella enterica enterica serovar Typhi
gcuuuuauguuacccagccu

SEQ ID NO: 1705332 - RNA, 14 nt, Salmonella enterica enterica serovar Typhi
gcuuuucauuuguu

SEQ ID NO: 1705333 - RNA, 12 nt, Salmonella enterica enterica serovar Typhi
gcuuuucaggcu

SEQ ID NO: 1705334 - RNA, 18 nt, Salmonella enterica enterica serovar Typhi
gcuaaacguagcauuucc

SEQ ID NO: 1705335 - RNA, 13 nt, Salmonella enterica enterica serovar Typhi
gcuaaagcacggg

SEQ ID NO: 1705336 - RNA, 17 nt, Salmonella enterica enterica serovar Typhi
gcuaaagcgcuggcggc

SEQ ID NO: 1705337 - RNA, 14 nt, Salmonella enterica enterica serovar Typhi
gcuaaagcaucggg

SEQ ID NO: 1705338 - RNA, 19 nt, Salmonella enterica enterica serovar Typhi
gcuaaagcgacuuauccgg

SEQ ID NO: 1705339 - RNA, 19 nt, Salmonella enterica enterica serovar Typhi
gcuaaaccgucauuuacca

SEQ ID NO: 1705340 - RNA, 17 nt, Salmonella enterica enterica serovar Typhi
gcuaaacaauuugccca

SEQ ID NO: 1705341 - RNA, 18 nt, Salmonella enterica enterica serovar Typhi
gcuaaaacccaccaccuc

SEQ ID NO: 1705342 - RNA, 15 nt, Salmonella enterica enterica serovar Typhi
gcuaaaacagauaac

SEQ ID NO: 1705343 - RNA, 13 nt, Salmonella enterica enterica serovar Typhi
gcuaacagugaaa

SEQ ID NO: 1705344 - RNA, 15 nt, Salmonella enterica enterica serovar Typhi
gcuaaauaaaaauaa

SEQ ID NO: 1705345 - RNA, 15 nt, Salmonella enterica enterica serovar Typhi
gcuaaaucagugaug

SEQ ID NO: 1705346 - RNA, 16 nt, Salmonella enterica enterica serovar Typhi
gcuaacgcgccccagg

SEQ ID NO: 1705347 - RNA, 16 nt, Salmonella enterica enterica serovar Typhi
gcuaaccuguaucugc

SEQ ID NO: 1705348 - RNA, 18 nt, Salmonella enterica enterica serovar Typhi
gcuaaccuguaucugcug

SEQ ID NO: 1705349 - RNA, 19 nt, Salmonella enterica enterica serovar Typhi
gcuaacggcaccagcaaca

SEQ ID NO: 1705350 - RNA, 17 nt, Salmonella enterica enterica serovar Typhi
gcuaagcaacaguucac

SEQ ID NO: 1705351 - RNA, 11 nt, Salmonella enterica enterica serovar Typhi
gcuaauaucca

SEQ ID NO: 1705352 - RNA, 13 nt, Salmonella enterica enterica serovar Typhi
gcuaaucaccacc

SEQ ID NO: 1705353 - RNA, 20 nt, Salmonella enterica enterica serovar Typhi
gcuaaucaggacaucaaagg

SEQ ID NO: 1705354 - RNA, 14 nt, Salmonella enterica enterica serovar Typhi
gcuaaugauuaucu

SEQ ID NO: 1705355 - RNA, 14 nt, Salmonella enterica enterica serovar Typhi
gcuacgcagcggcg

SEQ ID NO: 1705356 - RNA, 21 nt, Salmonella enterica enterica serovar Typhi
gcuacgccaucaggcauggca

SEQ ID NO: 1705357 - RNA, 16 nt, Salmonella enterica enterica serovar Typhi
gcuaccgucgccgaca

SEQ ID NO: 1705358 - RNA, 17 nt, Salmonella enterica enterica serovar Typhi
gcuaccuucuucccaua

SEQ ID NO: 1705359 - RNA, 22 nt, Salmonella enterica enterica serovar Typhi
gcuacgauaaagcugaguaagg

SEQ ID NO: 1705360 - RNA, 16 nt, Salmonella enterica enterica serovar Typhi
gcuaccgggcaaacau

SEQ ID NO: 1705361 - RNA, 14 nt, Salmonella enterica enterica serovar Typhi
gcuacgguuuuaau

SEQ ID NO: 1705362 - RNA, 21 nt, Salmonella enterica enterica serovar Typhi
gcuacgucgucgaucgcgcca

SEQ ID NO: 1705363 - RNA, 19 nt, Salmonella enterica enterica serovar Typhi
gcuacguuuaucuggcuua

SEQ ID NO: 1705364 - RNA, 20 nt, Salmonella enterica enterica serovar Typhi
gcuacggaguucgccgccgg

SEQ ID NO: 1705365 - RNA, 17 nt, Salmonella enterica enterica serovar Typhi
gcuacgggccgcggcgg

SEQ ID NO: 1705366 - RNA, 14 nt, Salmonella enterica enterica serovar Typhi
gcuacgcgucgcca

SEQ ID NO: 1705367 - RNA, 17 nt, Salmonella enterica enterica serovar Typhi
gcuacgcuuaucaggcc

SEQ ID NO: 1705368 - RNA, 16 nt, Salmonella enterica enterica serovar Typhi
gcuaauuggcuuaccu

SEQ ID NO: 1705369 - RNA, 17 nt, Salmonella enterica enterica serovar Typhi
gcuaauuuucagggugg

SEQ ID NO: 1705370 - RNA, 20 nt, Salmonella enterica enterica serovar Typhi
gcuaauguacgccuaaaaau

SEQ ID NO: 1705371 - RNA, 17 nt, Salmonella enterica enterica serovar Typhi
gcuaccaggcaaagcuc

SEQ ID NO: 1705372 - RNA, 18 nt, Salmonella enterica enterica serovar Typhi
gcuaccagcgcggcgcca

SEQ ID NO: 1705373 - RNA, 21 nt, Salmonella enterica enterica serovar Typhi
gcuaccagcgcggcgccagua

SEQ ID NO: 1705374 - RNA, 22 nt, Salmonella enterica enterica serovar Typhi
gcuacauccgccagccgccauu

SEQ ID NO: 1705375 - RNA, 17 nt, Salmonella enterica enterica serovar Typhi
gcguugcgcccaggcca

SEQ ID NO: 1705376 - RNA, 19 nt, Salmonella enterica enterica serovar Typhi
gcguugcgccgccaggcau

SEQ ID NO: 1705377 - RNA, 21 nt, Salmonella enterica enterica serovar Typhi
gcguuguaauaaugucggaug

SEQ ID NO: 1705378 - RNA, 14 nt, Salmonella enterica enterica serovar Typhi
gcguuggcgggcug

SEQ ID NO: 1705379 - RNA, 13 nt, Salmonella enterica enterica serovar Typhi
gcguucuuccacu

SEQ ID NO: 1705380 - RNA, 13 nt, Salmonella enterica enterica serovar Typhi
gcguucuggaagu

SEQ ID NO: 1705381 - RNA, 18 nt, Salmonella enterica enterica serovar Typhi
gcguuuuuucaucggcag

SEQ ID NO: 1705382 - RNA, 20 nt, Salmonella enterica enterica serovar Typhi
gcguuugggcgcaacaguca

SEQ ID NO: 1705383 - RNA, 13 nt, Salmonella enterica enterica serovar Typhi
gcguuuuccagcu

SEQ ID NO: 1705384 - RNA, 18 nt, Salmonella enterica enterica serovar Typhi
gcguuucacaucgccagu

SEQ ID NO: 1705385 - RNA, 19 nt, Salmonella enterica enterica serovar Typhi
gcguuuccacgcugacugc

SEQ ID NO: 1705386 - RNA, 15 nt, Salmonella enterica enterica serovar Typhi
gcguuugcgccgcca

SEQ ID NO: 1705387 - RNA, 17 nt, Salmonella enterica enterica serovar Typhi
gcguuucacaucgccag

SEQ ID NO: 1705388 - RNA, 20 nt, Salmonella enterica enterica serovar Typhi
gcguuuaauuccaucggcau

SEQ ID NO: 1705389 - RNA, 16 nt, Salmonella enterica enterica serovar Typhi
gcgugucgcccggcgg

SEQ ID NO: 1705390 - RNA, 21 nt, Salmonella enterica enterica serovar Typhi
gcgugguggauauccagcaua

SEQ ID NO: 1705391 - RNA, 24 nt, Salmonella enterica enterica serovar Typhi
gcguggugucucgucgccagggcg

SEQ ID NO: 1705392 - RNA, 18 nt, Salmonella enterica enterica serovar Typhi
gcguguugaaauccucua

SEQ ID NO: 1705393 - RNA, 20 nt, Salmonella enterica enterica serovar Typhi
gcguguuucaucucaucaau

SEQ ID NO: 1705394 - RNA, 13 nt, Salmonella enterica enterica serovar Typhi
gcguguggugagg

SEQ ID NO: 1705395 - RNA, 14 nt, Salmonella enterica enterica serovar Typhi
gcguuaaaauaccg

SEQ ID NO: 1705396 - RNA, 15 nt, Salmonella enterica enterica serovar Typhi
gcguucacgccgcca

SEQ ID NO: 1705397 - RNA, 18 nt, Salmonella enterica enterica serovar Typhi
gcguucauccaccgcccg

SEQ ID NO: 1705398 - RNA, 16 nt, Salmonella enterica enterica serovar Typhi
gcguuaucuguaauug

SEQ ID NO: 1705399 - RNA, 22 nt, Salmonella enterica enterica serovar Typhi
gcguucggaagacugcuccggc

SEQ ID NO: 1705400 - RNA, 22 nt, Salmonella enterica enterica serovar Typhi
gcucacugcuaaggagauaacu

SEQ ID NO: 1705401 - RNA, 19 nt, Salmonella enterica enterica serovar Typhi
gcucagaccauauucacgc

SEQ ID NO: 1705402 - RNA, 21 nt, Salmonella enterica enterica serovar Typhi
gcucaggaucgccggauuguu

SEQ ID NO: 1705403 - RNA, 20 nt, Salmonella enterica enterica serovar Typhi
gcucagcuggauagagcgcu

SEQ ID NO: 1705404 - RNA, 14 nt, Salmonella enterica enterica serovar Typhi
gcucaggcgcgcgc

SEQ ID NO: 1705405 - RNA, 13 nt, Salmonella enterica enterica serovar Typhi
gcucagcgcggca

SEQ ID NO: 1705406 - RNA, 13 nt, Salmonella enterica enterica serovar Typhi
gcucagcggcggc

SEQ ID NO: 1705407 - RNA, 14 nt, Salmonella enterica enterica serovar Typhi
gcucaauccaggug

SEQ ID NO: 1705408 - RNA, 22 nt, Salmonella enterica enterica serovar Typhi
gcucaauguagcgucagccggc

SEQ ID NO: 1705409 - RNA, 14 nt, Salmonella enterica enterica serovar Typhi
gcucaauuuuuuuc

SEQ ID NO: 1705410 - RNA, 13 nt, Salmonella enterica enterica serovar Typhi
gcucaccagccca

SEQ ID NO: 1705411 - RNA, 15 nt, Salmonella enterica enterica serovar Typhi
gcucaccgacuccuc

SEQ ID NO: 1705412 - RNA, 18 nt, Salmonella enterica enterica serovar Typhi
gcucaccgacuccucaac

SEQ ID NO: 1705413 - RNA, 16 nt, Salmonella enterica enterica serovar Typhi
gcucaccggucccgga

SEQ ID NO: 1705414 - RNA, 20 nt, Salmonella enterica enterica serovar Typhi
gcuccagaccaccagcgaca

SEQ ID NO: 1705415 - RNA, 17 nt, Salmonella enterica enterica serovar Typhi
gcuccagacaggacgcc

SEQ ID NO: 1705416 - RNA, 21 nt, Salmonella enterica enterica serovar Typhi
gcuccagaagcacuucuccac

SEQ ID NO: 1705417 - RNA, 22 nt, Salmonella enterica enterica serovar Typhi
gcuccagggauugauggccagc

SEQ ID NO: 1705418 - RNA, 23 nt, Salmonella enterica enterica serovar Typhi
gcuccagggauugauggccagcc

SEQ ID NO: 1705419 - RNA, 23 nt, Salmonella enterica enterica serovar Typhi
gcuccaguggucguuagccagau

SEQ ID NO: 1705420 - RNA, 23 nt, Salmonella enterica enterica serovar Typhi
gcuccagggcugcuggccuucca

SEQ ID NO: 1705421 - RNA, 22 nt, Salmonella enterica enterica serovar Typhi
gcucaugcgcgucccggcagug

SEQ ID NO: 1705422 - RNA, 15 nt, Salmonella enterica enterica serovar Typhi
gcucaugcgccuggc

SEQ ID NO: 1705423 - RNA, 16 nt, Salmonella enterica enterica serovar Typhi
gcucaugcgcggcggg

SEQ ID NO: 1705424 - RNA, 15 nt, Salmonella enterica enterica serovar Typhi
gcucaguugguuaga

SEQ ID NO: 1705425 - RNA, 21 nt, Salmonella enterica enterica serovar Typhi
gcucaugauagggcagcaguu

SEQ ID NO: 1705426 - RNA, 15 nt, Salmonella enterica enterica serovar Typhi
gcucauuugcggcgu

SEQ ID NO: 1705427 - RNA, 23 nt, Salmonella enterica enterica serovar Typhi
gcucaugugcagcauccagcuca

SEQ ID NO: 1705428 - RNA, 15 nt, Salmonella enterica enterica serovar Typhi
gcucauuauuuggau

SEQ ID NO: 1705429 - RNA, 13 nt, Salmonella enterica enterica serovar Typhi
gcucagggucaga

SEQ ID NO: 1705430 - RNA, 22 nt, Salmonella enterica enterica serovar Typhi
gcucagugaaucgcaucauaaa

SEQ ID NO: 1705431 - RNA, 18 nt, Salmonella enterica enterica serovar Typhi
gcucaguccagccgccgc

SEQ ID NO: 1705432 - RNA, 23 nt, Salmonella enterica enterica serovar Typhi
gcucagggucagaauacagaauc

SEQ ID NO: 1705433 - RNA, 14 nt, Salmonella enterica enterica serovar Typhi
gcuaugccggagga

SEQ ID NO: 1705434 - RNA, 22 nt, Salmonella enterica enterica serovar Typhi
gcuaugccggaggauauuuauu

SEQ ID NO: 1705435 - RNA, 17 nt, Salmonella enterica enterica serovar Typhi
gcuauggcaacaaagcc

SEQ ID NO: 1705436 - RNA, 16 nt, Salmonella enterica enterica serovar Typhi
gcuauggcaacaaagc

SEQ ID NO: 1705437 - RNA, 16 nt, Salmonella enterica enterica serovar Typhi
gcuaucugacagccaa

SEQ ID NO: 1705438 - RNA, 20 nt, Salmonella enterica enterica serovar Typhi
gcuauuccaaaauaauaaaa

SEQ ID NO: 1705439 - RNA, 16 nt, Salmonella enterica enterica serovar Typhi
gcuauucugcuguucc

SEQ ID NO: 1705440 - RNA, 18 nt, Salmonella enterica enterica serovar Typhi
gcuauuuaacccugguuu

SEQ ID NO: 1705441 - RNA, 15 nt, Salmonella enterica enterica serovar Typhi
gcuauuuccagaaau

SEQ ID NO: 1705442 - RNA, 15 nt, Salmonella enterica enterica serovar Typhi
gcucaaaaaagagua

SEQ ID NO: 1705443 - RNA, 17 nt, Salmonella enterica enterica serovar Typhi
gcucaaaguuaccggca

SEQ ID NO: 1705444 - RNA, 13 nt, Salmonella enterica enterica serovar Typhi
gcucaaauaugau

SEQ ID NO: 1705445 - RNA, 20 nt, Salmonella enterica enterica serovar Typhi
gcucaaauaugauaugugua

SEQ ID NO: 1705446 - RNA, 16 nt, Salmonella enterica enterica serovar Typhi
gcucaaccgcgcggcg

SEQ ID NO: 1705447 - RNA, 21 nt, Salmonella enterica enterica serovar Typhi
gcucaaccgcgcggcguucug

SEQ ID NO: 1705448 - RNA, 22 nt, Salmonella enterica enterica serovar Typhi
gcucaaccgcgcggcguucugc

SEQ ID NO: 1705449 - RNA, 20 nt, Salmonella enterica enterica serovar Typhi
gcucaacgcccucaaguaaa

SEQ ID NO: 1705450 - RNA, 14 nt, Salmonella enterica enterica serovar Typhi
gcucaacuggauga

SEQ ID NO: 1705451 - RNA, 18 nt, Salmonella enterica enterica serovar Typhi
gcucaagaguaggccgga

SEQ ID NO: 1705452 - RNA, 15 nt, Salmonella enterica enterica serovar Typhi
gcucaagcgaaaaaa

SEQ ID NO: 1705453 - RNA, 22 nt, Salmonella enterica enterica serovar Typhi
gcuauaugauagaaguuaugca

SEQ ID NO: 1705454 - RNA, 15 nt, Salmonella enterica enterica serovar Typhi
gcuauauuuauaaaa

SEQ ID NO: 1705455 - RNA, 21 nt, Salmonella enterica enterica serovar Typhi
gcuauaccaggguucgcuggc

SEQ ID NO: 1705456 - RNA, 22 nt, Salmonella enterica enterica serovar Typhi
gcuauagccgcguuugaguagc

SEQ ID NO: 1705457 - RNA, 21 nt, Salmonella enterica enterica serovar Typhi
gcuaucgcgccggacagcagc

SEQ ID NO: 1705458 - RNA, 19 nt, Salmonella enterica enterica serovar Typhi
gcuaucgcuuuaacgcugc

SEQ ID NO: 1705459 - RNA, 23 nt, Salmonella enterica enterica serovar Typhi
gcuaucggaaacuauccuggccu

SEQ ID NO: 1705460 - RNA, 21 nt, Salmonella enterica enterica serovar Typhi
gcuaucgggcguuaaaaguac

SEQ ID NO: 1705461 - RNA, 17 nt, Salmonella enterica enterica serovar Typhi
gcuaucgagaaugguuu

SEQ ID NO: 1705462 - RNA, 20 nt, Salmonella enterica enterica serovar Typhi
gcuauccaucgccgcgccgu

SEQ ID NO: 1705463 - RNA, 16 nt, Salmonella enterica enterica serovar Typhi
gcuauccggcaucaca

SEQ ID NO: 1705464 - RNA, 20 nt, Salmonella enterica enterica serovar Typhi
gcuaucacacauaucgccag

SEQ ID NO: 1705465 - RNA, 20 nt, Salmonella enterica enterica serovar Typhi
gcuaucaauaccgcuaauac

SEQ ID NO: 1705466 - RNA, 12 nt, Salmonella enterica enterica serovar Typhi
gcuauccccauu

SEQ ID NO: 1705467 - RNA, 17 nt, Salmonella enterica enterica serovar Typhi
gcuauccagcaguaaau

SEQ ID NO: 1705468 - RNA, 19 nt, Salmonella enterica enterica serovar Typhi
gcuauccagcaguaaauaa

SEQ ID NO: 1705469 - RNA, 18 nt, Salmonella enterica enterica serovar Typhi
gcuauccacgcagacgcc

SEQ ID NO: 1705470 - RNA, 13 nt, Salmonella enterica enterica serovar Typhi
gcuagcuucaggu

SEQ ID NO: 1705471 - RNA, 13 nt, Salmonella enterica enterica serovar Typhi
gcuagcugcagcg

SEQ ID NO: 1705472 - RNA, 16 nt, Salmonella enterica enterica serovar Typhi
gcucggaugugcauug

SEQ ID NO: 1705473 - RNA, 20 nt, Salmonella enterica enterica serovar Typhi
gcucgcggcggaccgcaacg

SEQ ID NO: 1705474 - RNA, 12 nt, Salmonella enterica enterica serovar Typhi
gcucgcggcgga

SEQ ID NO: 1705475 - RNA, 23 nt, Salmonella enterica enterica serovar Typhi
gcucgcggcagauaucgcugacc

SEQ ID NO: 1705476 - RNA, 14 nt, Salmonella enterica enterica serovar Typhi
gcucuaaaaaggaa

SEQ ID NO: 1705477 - RNA, 20 nt, Salmonella enterica enterica serovar Typhi
gcucgggaauaaaaauaaau

SEQ ID NO: 1705478 - RNA, 19 nt, Salmonella enterica enterica serovar Typhi
gcucugccaguagcugcuc

SEQ ID NO: 1705479 - RNA, 19 nt, Salmonella enterica enterica serovar Typhi
gcucugaaucucuucccag

SEQ ID NO: 1705480 - RNA, 16 nt, Salmonella enterica enterica serovar Typhi
gcucucuuuucuuacu

SEQ ID NO: 1705481 - RNA, 19 nt, Salmonella enterica enterica serovar Typhi
gcucucuuucaccagcgcc

SEQ ID NO: 1705482 - RNA, 16 nt, Salmonella enterica enterica serovar Typhi
gcucucccagcugagc

SEQ ID NO: 1705483 - RNA, 13 nt, Salmonella enterica enterica serovar Typhi
gcucucccagcug

SEQ ID NO: 1705484 - RNA, 15 nt, Salmonella enterica enterica serovar Typhi
gcucucccgccacug

SEQ ID NO: 1705485 - RNA, 18 nt, Salmonella enterica enterica serovar Typhi
gcucuccggcacauucac

SEQ ID NO: 1705486 - RNA, 19 nt, Salmonella enterica enterica serovar Typhi
gcucucccagcugagcuaa

SEQ ID NO: 1705487 - RNA, 21 nt, Salmonella enterica enterica serovar Typhi
gcucucuucgugacccgccag

SEQ ID NO: 1705488 - RNA, 18 nt, Salmonella enterica enterica serovar Typhi
gcucuucaauuuccaucu

SEQ ID NO: 1705489 - RNA, 15 nt, Salmonella enterica enterica serovar Typhi
gcucuguggggggaa

SEQ ID NO: 1705490 - RNA, 12 nt, Salmonella enterica enterica serovar Typhi
gcugacugccgu

SEQ ID NO: 1705491 - RNA, 18 nt, Salmonella enterica enterica serovar Typhi
gcugacguuacgcggcgc

SEQ ID NO: 1705492 - RNA, 17 nt, Salmonella enterica enterica serovar Typhi
gcugagcuaaucaccca

SEQ ID NO: 1705493 - RNA, 17 nt, Salmonella enterica enterica serovar Typhi
gcugagcgucaggcgca

SEQ ID NO: 1705494 - RNA, 19 nt, Salmonella enterica enterica serovar Typhi
gcugaguuuagccagcagc

SEQ ID NO: 1705495 - RNA, 14 nt, Salmonella enterica enterica serovar Typhi
gcugaguuucuccc

SEQ ID NO: 1705496 - RNA, 19 nt, Salmonella enterica enterica serovar Typhi
gcucuucuccgccugcggu

SEQ ID NO: 1705497 - RNA, 17 nt, Salmonella enterica enterica serovar Typhi
gcucuuucaacuuccgc

SEQ ID NO: 1705498 - RNA, 22 nt, Salmonella enterica enterica serovar Typhi
gcucuuuaaugauguccagaau

SEQ ID NO: 1705499 - RNA, 22 nt, Salmonella enterica enterica serovar Typhi
gcugacaucgcgauuguuggug

SEQ ID NO: 1705500 - RNA, 16 nt, Salmonella enterica enterica serovar Typhi
gcugacgcgaucgccg

SEQ ID NO: 1705501 - RNA, 12 nt, Salmonella enterica enterica serovar Typhi
gcugaugguuuc

SEQ ID NO: 1705502 - RNA, 21 nt, Salmonella enterica enterica serovar Typhi
gcugaugccagauggcaagau

SEQ ID NO: 1705503 - RNA, 13 nt, Salmonella enterica enterica serovar Typhi
gcugaugacgcgc

SEQ ID NO: 1705504 - RNA, 13 nt, Salmonella enterica enterica serovar Typhi
gcugaugcagaua

SEQ ID NO: 1705505 - RNA, 17 nt, Salmonella enterica enterica serovar Typhi
gcugaugauuggccucc

SEQ ID NO: 1705506 - RNA, 17 nt, Salmonella enterica enterica serovar Typhi
gcugcacgccaucggcu

SEQ ID NO: 1705507 - RNA, 15 nt, Salmonella enterica enterica serovar Typhi
gcugcauccgcgcuu

SEQ ID NO: 1705508 - RNA, 15 nt, Salmonella enterica enterica serovar Typhi
gcugccccagacgcc

SEQ ID NO: 1705509 - RNA, 15 nt, Salmonella enterica enterica serovar Typhi
gcugcccgccgccgg

SEQ ID NO: 1705510 - RNA, 23 nt, Salmonella enterica enterica serovar Typhi
gcugugacggcaacugaaaacag

SEQ ID NO: 1705511 - RNA, 20 nt, Salmonella enterica enterica serovar Typhi
gcugucgacaauaaauugcg

SEQ ID NO: 1705512 - RNA, 18 nt, Salmonella enterica enterica serovar Typhi
gcuguccuuaaccagcuc

SEQ ID NO: 1705513 - RNA, 12 nt, Salmonella enterica enterica serovar Typhi
gcugucgccaga

SEQ ID NO: 1705514 - RNA, 16 nt, Salmonella enterica enterica serovar Typhi
gcuguacauauccagu

SEQ ID NO: 1705515 - RNA, 13 nt, Salmonella enterica enterica serovar Typhi
gcugguggccggg

SEQ ID NO: 1705516 - RNA, 21 nt, Salmonella enterica enterica serovar Typhi
aaaggaaagauuacuucaggc

SEQ ID NO: 1705517 - RNA, 18 nt, Salmonella enterica enterica serovar Typhi
gcuguaaaucgcgcccga

SEQ ID NO: 1705518 - RNA, 15 nt, Salmonella enterica enterica serovar Typhi
gcuguaacccgccgc

SEQ ID NO: 1705519 - RNA, 23 nt, Salmonella enterica enterica serovar Typhi
gcuguaaauguuguuccagagug

SEQ ID NO: 1705520 - RNA, 16 nt, Salmonella enterica enterica serovar Typhi
gcugguuggcgcgcuu

SEQ ID NO: 1705521 - RNA, 17 nt, Salmonella enterica enterica serovar Typhi
gcugggaugaccugaaa

SEQ ID NO: 1705522 - RNA, 21 nt, Salmonella enterica enterica serovar Typhi
gcuggcugccguuaaucuggc

SEQ ID NO: 1705523 - RNA, 17 nt, Salmonella enterica enterica serovar Typhi
gcuggcuggccagggca

SEQ ID NO: 1705524 - RNA, 14 nt, Salmonella enterica enterica serovar Typhi
gcuggcuggcgguc

SEQ ID NO: 1705525 - RNA, 14 nt, Salmonella enterica enterica serovar Typhi
gcuggcuuaacuca

SEQ ID NO: 1705526 - RNA, 19 nt, Salmonella enterica enterica serovar Typhi
gcuggcguuaucguccguc

SEQ ID NO: 1705527 - RNA, 10 nt, Salmonella enterica enterica serovar Typhi
gcuggcuggc

SEQ ID NO: 1705528 - RNA, 20 nt, Salmonella enterica enterica serovar Typhi
gcuggcgucccgggucagga

SEQ ID NO: 1705529 - RNA, 21 nt, Salmonella enterica enterica serovar Typhi
gcuggcgucuguccggcgcuc

SEQ ID NO: 1705530 - RNA, 22 nt, Salmonella enterica enterica serovar Typhi
gcuggcgugacguguggcgcug

SEQ ID NO: 1705531 - RNA, 18 nt, Salmonella enterica enterica serovar Typhi
gcuggguuucgguauaaa

SEQ ID NO: 1705532 - RNA, 16 nt, Salmonella enterica enterica serovar Typhi
gcuggguucauccagc

SEQ ID NO: 1705533 - RNA, 19 nt, Salmonella enterica enterica serovar Typhi
aaagcugguauugaauauu

SEQ ID NO: 1705534 - RNA, 22 nt, Salmonella enterica enterica serovar Typhi
gcugguaguccucuaucuuuuc

SEQ ID NO: 1705535 - RNA, 19 nt, Salmonella enterica enterica serovar Typhi
aaagcuguugugucccggc

SEQ ID NO: 1705536 - RNA, 14 nt, Salmonella enterica enterica serovar Typhi
gcugggcgaggcca

SEQ ID NO: 1705537 - RNA, 22 nt, Salmonella enterica enterica serovar Typhi
gcugggcuuuauccugaccgcu

SEQ ID NO: 1705538 - RNA, 17 nt, Salmonella enterica enterica serovar Typhi
gcugggucauuaugagu

SEQ ID NO: 1705539 - RNA, 23 nt, Salmonella enterica enterica serovar Typhi
gcugcggcguuccccaauguuca

SEQ ID NO: 1705540 - RNA, 18 nt, Salmonella enterica enterica serovar Typhi
gcugcggcaaacuggcga

SEQ ID NO: 1705541 - RNA, 21 nt, Salmonella enterica enterica serovar Typhi
gcugcuguuuuugaaaaugug

SEQ ID NO: 1705542 - RNA, 22 nt, Salmonella enterica enterica serovar Typhi
gcugcuguuaaccuugcgccuc

SEQ ID NO: 1705543 - RNA, 13 nt, Salmonella enterica enterica serovar Typhi
gcugcucuccuug

SEQ ID NO: 1705544 - RNA, 14 nt, Salmonella enterica enterica serovar Typhi
gcuggagccacauc

SEQ ID NO: 1705545 - RNA, 19 nt, Salmonella enterica enterica serovar Typhi
gcuggacauguuccgcccc

SEQ ID NO: 1705546 - RNA, 17 nt, Salmonella enterica enterica serovar Typhi
gcuggcauuacgcuggc

SEQ ID NO: 1705547 - RNA, 14 nt, Salmonella enterica enterica serovar Typhi
gcuggcagggggag

SEQ ID NO: 1705548 - RNA, 19 nt, Salmonella enterica enterica serovar Typhi
gcuggcgauaaugccguga

SEQ ID NO: 1705549 - RNA, 15 nt, Salmonella enterica enterica serovar Typhi
gcuggcgacggcggu

SEQ ID NO: 1705550 - RNA, 22 nt, Salmonella enterica enterica serovar Typhi
gcuggcgcacauuuacgccagc

SEQ ID NO: 1705551 - RNA, 14 nt, Salmonella enterica enterica serovar Typhi
gcuggccgcgugcu

SEQ ID NO: 1705552 - RNA, 16 nt, Salmonella enterica enterica serovar Typhi
gcuggccuucuccacu

SEQ ID NO: 1705553 - RNA, 17 nt, Salmonella enterica enterica serovar Typhi
gcuggcgaaccaccagc

SEQ ID NO: 1705554 - RNA, 19 nt, Salmonella enterica enterica serovar Typhi
gcuggcgcggggaacacua

SEQ ID NO: 1705555 - RNA, 19 nt, Salmonella enterica enterica serovar Typhi
gcuggcgcggggaacacuc

SEQ ID NO: 1705556 - RNA, 18 nt, Salmonella enterica enterica serovar Typhi
gcuggcgcugacgacacu

SEQ ID NO: 1705557 - RNA, 16 nt, Salmonella enterica enterica serovar Typhi
gcuggcgcggggaucg

SEQ ID NO: 1705558 - RNA, 17 nt, Salmonella enterica enterica serovar Typhi
gcuggcgcggggaucgg

SEQ ID NO: 1705559 - RNA, 14 nt, Salmonella enterica enterica serovar Typhi
gcuggcggccccuc

SEQ ID NO: 1705560 - RNA, 13 nt, Salmonella enterica enterica serovar Typhi
gcuggcgccgcaa

SEQ ID NO: 1705561 - RNA, 12 nt, Salmonella enterica enterica serovar Typhi
gcuggcgcgcua

SEQ ID NO: 1705562 - RNA, 12 nt, Salmonella enterica enterica serovar Typhi
gcgucccggcaa

SEQ ID NO: 1705563 - RNA, 15 nt, Salmonella enterica enterica serovar Typhi
gcguccccguucuga

SEQ ID NO: 1705564 - RNA, 17 nt, Salmonella enterica enterica serovar Typhi
gcgucccggcagugcau

SEQ ID NO: 1705565 - RNA, 11 nt, Salmonella enterica enterica serovar Typhi
gcguccgccgc

SEQ ID NO: 1705566 - RNA, 20 nt, Salmonella enterica enterica serovar Typhi
gcgucccucuccagggcaac

SEQ ID NO: 1705567 - RNA, 14 nt, Salmonella enterica enterica serovar Typhi
gcgucccucuccag

SEQ ID NO: 1705568 - RNA, 22 nt, Salmonella enterica enterica serovar Typhi
gcguccaguacuuucuuuugau

SEQ ID NO: 1705569 - RNA, 15 nt, Salmonella enterica enterica serovar Typhi
gcguccagaggaucu

SEQ ID NO: 1705570 - RNA, 23 nt, Salmonella enterica enterica serovar Typhi
gcguccacuuucucggcuuucca

SEQ ID NO: 1705571 - RNA, 18 nt, Salmonella enterica enterica serovar Typhi
gcguccaacuggcuuuca

SEQ ID NO: 1705572 - RNA, 16 nt, Salmonella enterica enterica serovar Typhi
gcgucgccauaaagcu

SEQ ID NO: 1705573 - RNA, 21 nt, Salmonella enterica enterica serovar Typhi
gcgucgccaaagcagcugcug

SEQ ID NO: 1705574 - RNA, 14 nt, Salmonella enterica enterica serovar Typhi
gcgucgccagcaac

SEQ ID NO: 1705575 - RNA, 15 nt, Salmonella enterica enterica serovar Typhi
gcguccuucuuccgc

SEQ ID NO: 1705576 - RNA, 16 nt, Salmonella enterica enterica serovar Typhi
gcgucgaaugacgcgc

SEQ ID NO: 1705577 - RNA, 16 nt, Salmonella enterica enterica serovar Typhi
gcguagguaagauauu

SEQ ID NO: 1705578 - RNA, 17 nt, Salmonella enterica enterica serovar Typhi
gcguagcucgcccagca

SEQ ID NO: 1705579 - RNA, 19 nt, Salmonella enterica enterica serovar Typhi
gcguacuuucacuaccacu

SEQ ID NO: 1705580 - RNA, 14 nt, Salmonella enterica enterica serovar Typhi
gcguagcccagcgc

SEQ ID NO: 1705581 - RNA, 15 nt, Salmonella enterica enterica serovar Typhi
gcgucaaagcacaug

SEQ ID NO: 1705582 - RNA, 15 nt, Salmonella enterica enterica serovar Typhi
gcguauagccaggca

SEQ ID NO: 1705583 - RNA, 16 nt, Salmonella enterica enterica serovar Typhi
gcguauaacgccgccc

SEQ ID NO: 1705584 - RNA, 17 nt, Salmonella enterica enterica serovar Typhi
gcgucaacucagcaaua

SEQ ID NO: 1705585 - RNA, 15 nt, Salmonella enterica enterica serovar Typhi
gcgucaacguccagu

SEQ ID NO: 1705586 - RNA, 17 nt, Salmonella enterica enterica serovar Typhi
gcgucacaaaaacaccc

SEQ ID NO: 1705587 - RNA, 13 nt, Salmonella enterica enterica serovar Typhi
gcgucaauauuaa

SEQ ID NO: 1705588 - RNA, 22 nt, Salmonella enterica enterica serovar Typhi
gcgucacccgccggcagcagcu

SEQ ID NO: 1705589 - RNA, 18 nt, Salmonella enterica enterica serovar Typhi
gcgucacccgccggcagc

SEQ ID NO: 1705590 - RNA, 21 nt, Salmonella enterica enterica serovar Typhi
gcgucacccgccggcagcagc

SEQ ID NO: 1705591 - RNA, 19 nt, Salmonella enterica enterica serovar Typhi
gcgucacgcgcaaagcugc

SEQ ID NO: 1705592 - RNA, 18 nt, Salmonella enterica enterica serovar Typhi
gcgucaccgugccaguua

SEQ ID NO: 1705593 - RNA, 18 nt, Salmonella enterica enterica serovar Typhi
gcgucacgcgcaaagcug

SEQ ID NO: 1705594 - RNA, 22 nt, Salmonella enterica enterica serovar Typhi
gcgucaucgacauuaacaaugc

SEQ ID NO: 1705595 - RNA, 15 nt, Salmonella enterica enterica serovar Typhi
gcgucauccaguguu

SEQ ID NO: 1705596 - RNA, 14 nt, Salmonella enterica enterica serovar Typhi
gcgucaucgcucca

SEQ ID NO: 1705597 - RNA, 19 nt, Salmonella enterica enterica serovar Typhi
gcgucaggcuguuguucuu

SEQ ID NO: 1705598 - RNA, 12 nt, Salmonella enterica enterica serovar Typhi
gcgucaggcgau

SEQ ID NO: 1705599 - RNA, 13 nt, Salmonella enterica enterica serovar Typhi
gcgucagccggca

SEQ ID NO: 1705600 - RNA, 17 nt, Salmonella enterica enterica serovar Typhi
gcgucagccagaacgaa

SEQ ID NO: 1705601 - RNA, 16 nt, Salmonella enterica enterica serovar Typhi
gcgucagcccaagcug

SEQ ID NO: 1705602 - RNA, 14 nt, Salmonella enterica enterica serovar Typhi
gcgucagcccuucu

SEQ ID NO: 1705603 - RNA, 15 nt, Salmonella enterica enterica serovar Typhi
gcgucagcgugcggu

SEQ ID NO: 1705604 - RNA, 20 nt, Salmonella enterica enterica serovar Typhi
gcgucagcgcuugccgcagc

SEQ ID NO: 1705605 - RNA, 15 nt, Salmonella enterica enterica serovar Typhi
gcguggcauuaacaa

SEQ ID NO: 1705606 - RNA, 21 nt, Salmonella enterica enterica serovar Typhi
gcguggcaucuuaucaggccu

SEQ ID NO: 1705607 - RNA, 18 nt, Salmonella enterica enterica serovar Typhi
gcgugcuucaacggugcu

SEQ ID NO: 1705608 - RNA, 17 nt, Salmonella enterica enterica serovar Typhi
gcgugcugacggagcug

SEQ ID NO: 1705609 - RNA, 18 nt, Salmonella enterica enterica serovar Typhi
gcgugccuucaaauauau

SEQ ID NO: 1705610 - RNA, 15 nt, Salmonella enterica enterica serovar Typhi
gcgugcggcugacgu

SEQ ID NO: 1705611 - RNA, 17 nt, Salmonella enterica enterica serovar Typhi
gcgugagcgcauccggc

SEQ ID NO: 1705612 - RNA, 17 nt, Salmonella enterica enterica serovar Typhi
gcgugagccacuaucca

SEQ ID NO: 1705613 - RNA, 12 nt, Salmonella enterica enterica serovar Typhi
gcgugccgagca

SEQ ID NO: 1705614 - RNA, 21 nt, Salmonella enterica enterica serovar Typhi
gcgugcagaucaagcgggggc

SEQ ID NO: 1705615 - RNA, 21 nt, Salmonella enterica enterica serovar Typhi
gcgugaugcgauccagcgggc

SEQ ID NO: 1705616 - RNA, 15 nt, Salmonella enterica enterica serovar Typhi
gcgucugcaccggua

SEQ ID NO: 1705617 - RNA, 18 nt, Salmonella enterica enterica serovar Typhi
gcgucugccccaaacgcu

SEQ ID NO: 1705618 - RNA, 21 nt, Salmonella enterica enterica serovar Typhi
gcgucucagauggaaaaaaag

SEQ ID NO: 1705619 - RNA, 14 nt, Salmonella enterica enterica serovar Typhi
gcgucucagcaggc

SEQ ID NO: 1705620 - RNA, 17 nt, Salmonella enterica enterica serovar Typhi
gcgucucaucaaaaagg

SEQ ID NO: 1705621 - RNA, 21 nt, Salmonella enterica enterica serovar Typhi
gcgucuuauccggccuaccug

SEQ ID NO: 1705622 - RNA, 22 nt, Salmonella enterica enterica serovar Typhi
gcgucuggcgacuaaccagcgc

SEQ ID NO: 1705623 - RNA, 17 nt, Salmonella enterica enterica serovar Typhi
gcgucggcaccauuccc

SEQ ID NO: 1705624 - RNA, 14 nt, Salmonella enterica enterica serovar Typhi
gcgucgcgcauggc

SEQ ID NO: 1705625 - RNA, 23 nt, Salmonella enterica enterica serovar Typhi
gcgucgggggcgacaaacagcgc

SEQ ID NO: 1705626 - RNA, 15 nt, Salmonella enterica enterica serovar Typhi
gcgucgugcugggcg

SEQ ID NO: 1705627 - RNA, 18 nt, Salmonella enterica enterica serovar Typhi
gcgggcagccuucaaguu

SEQ ID NO: 1705628 - RNA, 20 nt, Salmonella enterica enterica serovar Typhi
gcgggcaggucgucuucuug

SEQ ID NO: 1705629 - RNA, 17 nt, Salmonella enterica enterica serovar Typhi
gcgggcaaaagggccau

SEQ ID NO: 1705630 - RNA, 13 nt, Salmonella enterica enterica serovar Typhi
gcgggccgucagg

SEQ ID NO: 1705631 - RNA, 14 nt, Salmonella enterica enterica serovar Typhi
gcggcuuacccuga

SEQ ID NO: 1705632 - RNA, 15 nt, Salmonella enterica enterica serovar Typhi
gcggcuucagcgaca

SEQ ID NO: 1705633 - RNA, 19 nt, Salmonella enterica enterica serovar Typhi
gcggcgcgauaugucucuc

SEQ ID NO: 1705634 - RNA, 21 nt, Salmonella enterica enterica serovar Typhi
gcggcugguaagagagccuua

SEQ ID NO: 1705635 - RNA, 15 nt, Salmonella enterica enterica serovar Typhi
gcggguucccccacu

SEQ ID NO: 1705636 - RNA, 18 nt, Salmonella enterica enterica serovar Typhi
gcggguucccccacucuu

SEQ ID NO: 1705637 - RNA, 12 nt, Salmonella enterica enterica serovar Typhi
gcggucaggaau

SEQ ID NO: 1705638 - RNA, 21 nt, Salmonella enterica enterica serovar Typhi
gcgguccaauaaacgccaggu

SEQ ID NO: 1705639 - RNA, 16 nt, Salmonella enterica enterica serovar Typhi
gcggucaucgcccauc

SEQ ID NO: 1705640 - RNA, 23 nt, Salmonella enterica enterica serovar Typhi
gcggguaaacucacccaggcgau

SEQ ID NO: 1705641 - RNA, 18 nt, Salmonella enterica enterica serovar Typhi
gcgggcggaaagcauucg

SEQ ID NO: 1705642 - RNA, 15 nt, Salmonella enterica enterica serovar Typhi
gcggugaaacuguuu

SEQ ID NO: 1705643 - RNA, 16 nt, Salmonella enterica enterica serovar Typhi
gcggucgcugauaauc

SEQ ID NO: 1705644 - RNA, 19 nt, Salmonella enterica enterica serovar Typhi
gcggucgccugccgcaugu

SEQ ID NO: 1705645 - RNA, 14 nt, Salmonella enterica enterica serovar Typhi
gcggugaagcagaa

SEQ ID NO: 1705646 - RNA, 20 nt, Salmonella enterica enterica serovar Typhi
gcggugaaaggcuugcagga

SEQ ID NO: 1705647 - RNA, 22 nt, Salmonella enterica enterica serovar Typhi
gcggugcaugaauaucaaacca

SEQ ID NO: 1705648 - RNA, 14 nt, Salmonella enterica enterica serovar Typhi
gcgguucucccggc

SEQ ID NO: 1705649 - RNA, 14 nt, Salmonella enterica enterica serovar Typhi
gcgguucuuuugcu

SEQ ID NO: 1705650 - RNA, 20 nt, Salmonella enterica enterica serovar Typhi
gcgguugacgcugcuuuuuu

SEQ ID NO: 1705651 - RNA, 20 nt, Salmonella enterica enterica serovar Typhi
gcgguuuauccccgcuggcg

SEQ ID NO: 1705652 - RNA, 14 nt, Salmonella enterica enterica serovar Typhi
gcguaacgccacau

SEQ ID NO: 1705653 - RNA, 18 nt, Salmonella enterica enterica serovar Typhi
gcguaacgccacauauaa

SEQ ID NO: 1705654 - RNA, 14 nt, Salmonella enterica enterica serovar Typhi
gcguaaagauuguu

SEQ ID NO: 1705655 - RNA, 18 nt, Salmonella enterica enterica serovar Typhi
gcguaaucggcaggccaa

SEQ ID NO: 1705656 - RNA, 16 nt, Salmonella enterica enterica serovar Typhi
gcguaaugagcgucgc

SEQ ID NO: 1705657 - RNA, 13 nt, Salmonella enterica enterica serovar Typhi
gcguaauuauuac

SEQ ID NO: 1705658 - RNA, 21 nt, Salmonella enterica enterica serovar Typhi
gcguaaugguggcaaccugac

SEQ ID NO: 1705659 - RNA, 17 nt, Salmonella enterica enterica serovar Typhi
gcguaaugcgccaggca

SEQ ID NO: 1705660 - RNA, 17 nt, Salmonella enterica enterica serovar Typhi
gcguaauuuuuccaguu

SEQ ID NO: 1705661 - RNA, 19 nt, Salmonella enterica enterica serovar Typhi
gcguacauugccggauggc

SEQ ID NO: 1705662 - RNA, 23 nt, Salmonella enterica enterica serovar Typhi
gcguacauugccggauggcggcg

SEQ ID NO: 1705663 - RNA, 21 nt, Salmonella enterica enterica serovar Typhi
gcguaccgcuaucgccaaacu

SEQ ID NO: 1705664 - RNA, 22 nt, Salmonella enterica enterica serovar Typhi
gcguaccggccacaauugccag

SEQ ID NO: 1705665 - RNA, 21 nt, Salmonella enterica enterica serovar Typhi
gcguacugcccguggcggagg

SEQ ID NO: 1705666 - RNA, 14 nt, Salmonella enterica enterica serovar Typhi
gcggcgacaccagc

SEQ ID NO: 1705667 - RNA, 21 nt, Salmonella enterica enterica serovar Typhi
gcggcgaucagacgcugguug

SEQ ID NO: 1705668 - RNA, 20 nt, Salmonella enterica enterica serovar Typhi
gcggcgaguuguuucaacau

SEQ ID NO: 1705669 - RNA, 14 nt, Salmonella enterica enterica serovar Typhi
gcggccugcaaaga

SEQ ID NO: 1705670 - RNA, 17 nt, Salmonella enterica enterica serovar Typhi
gcggccugcgugcgccg

SEQ ID NO: 1705671 - RNA, 16 nt, Salmonella enterica enterica serovar Typhi
gcggccuuuauccagc

SEQ ID NO: 1705672 - RNA, 19 nt, Salmonella enterica enterica serovar Typhi
gcggcagcgccauccggca

SEQ ID NO: 1705673 - RNA, 19 nt, Salmonella enterica enterica serovar Typhi
gcggcaggugagggcgucg

SEQ ID NO: 1705674 - RNA, 20 nt, Salmonella enterica enterica serovar Typhi
gcggcaguucaggcucgcaa

SEQ ID NO: 1705675 - RNA, 18 nt, Salmonella enterica enterica serovar Typhi
gcggcauacuuucgcgcg

SEQ ID NO: 1705676 - RNA, 20 nt, Salmonella enterica enterica serovar Typhi
gcggcauacuuucgcgcggc

SEQ ID NO: 1705677 - RNA, 22 nt, Salmonella enterica enterica serovar Typhi
gcggcaguacgagcauccagau

SEQ ID NO: 1705678 - RNA, 20 nt, Salmonella enterica enterica serovar Typhi
gcggccaguuguucuuucac

SEQ ID NO: 1705679 - RNA, 13 nt, Salmonella enterica enterica serovar Typhi
gcggccagcgggc

SEQ ID NO: 1705680 - RNA, 13 nt, Salmonella enterica enterica serovar Typhi
gcggccauccugc

SEQ ID NO: 1705681 - RNA, 21 nt, Salmonella enterica enterica serovar Typhi
gcggcagauaucgcugaccaa

SEQ ID NO: 1705682 - RNA, 19 nt, Salmonella enterica enterica serovar Typhi
gcggcagaauuaacucauc

SEQ ID NO: 1705683 - RNA, 24 nt, Salmonella enterica enterica serovar Typhi
gcggcagaauuaacucaucacagc

SEQ ID NO: 1705684 - RNA, 20 nt, Salmonella enterica enterica serovar Typhi
gcggcacagauacgaggugg

SEQ ID NO: 1705685 - RNA, 19 nt, Salmonella enterica enterica serovar Typhi
gcggaugguggcguaaaua

SEQ ID NO: 1705686 - RNA, 21 nt, Salmonella enterica enterica serovar Typhi
gcggaugcgccauccaccagg

SEQ ID NO: 1705687 - RNA, 17 nt, Salmonella enterica enterica serovar Typhi
gcggauaugcagcagcc

SEQ ID NO: 1705688 - RNA, 23 nt, Salmonella enterica enterica serovar Typhi
gcggaucaaacuccgcgcuggca

SEQ ID NO: 1705689 - RNA, 18 nt, Salmonella enterica enterica serovar Typhi
gcggauacagcggcgcgc

SEQ ID NO: 1705690 - RNA, 21 nt, Salmonella enterica enterica serovar Typhi
gcggauaagauagcaggcgau

SEQ ID NO: 1705691 - RNA, 19 nt, Salmonella enterica enterica serovar Typhi
gcggauaagcccggcggag

SEQ ID NO: 1705692 - RNA, 20 nt, Salmonella enterica enterica serovar Typhi
gcggagauacccuuaugaua

SEQ ID NO: 1705693 - RNA, 23 nt, Salmonella enterica enterica serovar Typhi
gcggagagaucgacagcgcgcgc

SEQ ID NO: 1705694 - RNA, 16 nt, Salmonella enterica enterica serovar Typhi
gcggagccucuuccug

SEQ ID NO: 1705695 - RNA, 21 nt, Salmonella enterica enterica serovar Typhi
gcggauaaauagugacgccgc

SEQ ID NO: 1705696 - RNA, 18 nt, Salmonella enterica enterica serovar Typhi
gcggauaaccgacgccgg

SEQ ID NO: 1705697 - RNA, 19 nt, Salmonella enterica enterica serovar Typhi
gcggagguuucuuuuucua

SEQ ID NO: 1705698 - RNA, 17 nt, Salmonella enterica enterica serovar Typhi
gcggacauuaacgccgc

SEQ ID NO: 1705699 - RNA, 16 nt, Salmonella enterica enterica serovar Typhi
gcggacacccgcagcc

SEQ ID NO: 1705700 - RNA, 19 nt, Salmonella enterica enterica serovar Typhi
gcggagaagacgccgccgc

SEQ ID NO: 1705701 - RNA, 14 nt, Salmonella enterica enterica serovar Typhi
gcggacugggcuga

SEQ ID NO: 1705702 - RNA, 16 nt, Salmonella enterica enterica serovar Typhi
gcgcuuuagggcuucc

SEQ ID NO: 1705703 - RNA, 22 nt, Salmonella enterica enterica serovar Typhi
gcggaaugcugguuaacgccgc

SEQ ID NO: 1705704 - RNA, 19 nt, Salmonella enterica enterica serovar Typhi
gcggaauggcgggcgcagg

SEQ ID NO: 1705705 - RNA, 14 nt, Salmonella enterica enterica serovar Typhi
gcgcuuuugccgcg

SEQ ID NO: 1705706 - RNA, 16 nt, Salmonella enterica enterica serovar Typhi
gcgcuuuuccagcacg

SEQ ID NO: 1705707 - RNA, 19 nt, Salmonella enterica enterica serovar Typhi
gcggaauugguagacgcgc

SEQ ID NO: 1705708 - RNA, 16 nt, Salmonella enterica enterica serovar Typhi
gcggaauuucaggaag

SEQ ID NO: 1705709 - RNA, 13 nt, Salmonella enterica enterica serovar Typhi
gcgcuugcggccg

SEQ ID NO: 1705710 - RNA, 15 nt, Salmonella enterica enterica serovar Typhi
gcgcuugcauugcuc

SEQ ID NO: 1705711 - RNA, 12 nt, Salmonella enterica enterica serovar Typhi
gcgcuuccugca

SEQ ID NO: 1705712 - RNA, 19 nt, Salmonella enterica enterica serovar Typhi
gcgcuucgcuugcccggcc

SEQ ID NO: 1705713 - RNA, 17 nt, Salmonella enterica enterica serovar Typhi
gcgcugaggcgcuggcu

SEQ ID NO: 1705714 - RNA, 15 nt, Salmonella enterica enterica serovar Typhi
gcgcugagucauccu

SEQ ID NO: 1705715 - RNA, 17 nt, Salmonella enterica enterica serovar Typhi
gcgcugaguuucucccg

SEQ ID NO: 1705716 - RNA, 16 nt, Salmonella enterica enterica serovar Typhi
gcgcuccugucaggcg

SEQ ID NO: 1705717 - RNA, 17 nt, Salmonella enterica enterica serovar Typhi
gcgcggauauggcggcg

SEQ ID NO: 1705718 - RNA, 14 nt, Salmonella enterica enterica serovar Typhi
gcgcggaucgccau

SEQ ID NO: 1705719 - RNA, 14 nt, Salmonella enterica enterica serovar Typhi
gcgcggccccauca

SEQ ID NO: 1705720 - RNA, 19 nt, Salmonella enterica enterica serovar Typhi
gcgcggcccauucaacggg

SEQ ID NO: 1705721 - RNA, 23 nt, Salmonella enterica enterica serovar Typhi
gcgcgccgaaaauauacaccuga

SEQ ID NO: 1705722 - RNA, 15 nt, Salmonella enterica enterica serovar Typhi
gcgcgccguaaacaa

SEQ ID NO: 1705723 - RNA, 18 nt, Salmonella enterica enterica serovar Typhi
gcgcgcccgccaccagca

SEQ ID NO: 1705724 - RNA, 15 nt, Salmonella enterica enterica serovar Typhi
gcgcgcccgacgcgc

SEQ ID NO: 1705725 - RNA, 17 nt, Salmonella enterica enterica serovar Typhi
gcgcgccuuccagcaau

SEQ ID NO: 1705726 - RNA, 17 nt, Salmonella enterica enterica serovar Typhi
gcgcgcgaaaagaaacu

SEQ ID NO: 1705727 - RNA, 15 nt, Salmonella enterica enterica serovar Typhi
gcgcgacaauauuca

SEQ ID NO: 1705728 - RNA, 14 nt, Salmonella enterica enterica serovar Typhi
gcgcgagagucaag

SEQ ID NO: 1705729 - RNA, 17 nt, Salmonella enterica enterica serovar Typhi
gcgcgauauccaccuga

SEQ ID NO: 1705730 - RNA, 17 nt, Salmonella enterica enterica serovar Typhi
gcgcgauacgcgacggc

SEQ ID NO: 1705731 - RNA, 17 nt, Salmonella enterica enterica serovar Typhi
gcgcgcacacaauagca

SEQ ID NO: 1705732 - RNA, 22 nt, Salmonella enterica enterica serovar Typhi
gcgcgcacaacgugcaaaacag

SEQ ID NO: 1705733 - RNA, 20 nt, Salmonella enterica enterica serovar Typhi
gcgcgccaguaaucggcgcg

SEQ ID NO: 1705734 - RNA, 15 nt, Salmonella enterica enterica serovar Typhi
gcgcgccaguuuggu

SEQ ID NO: 1705735 - RNA, 19 nt, Salmonella enterica enterica serovar Typhi
gcgcgcagaccacgaauca

SEQ ID NO: 1705736 - RNA, 11 nt, Salmonella enterica enterica serovar Typhi
gcgaucgccag

SEQ ID NO: 1705737 - RNA, 17 nt, Salmonella enterica enterica serovar Typhi
gcgcgaagucgagcuca

SEQ ID NO: 1705738 - RNA, 19 nt, Salmonella enterica enterica serovar Typhi
gcgcgaaucgacaauccgc

SEQ ID NO: 1705739 - RNA, 21 nt, Salmonella enterica enterica serovar Typhi
gcgauccgcgagacgccuggg

SEQ ID NO: 1705740 - RNA, 22 nt, Salmonella enterica enterica serovar Typhi
gcgauccagccccagcgccagc

SEQ ID NO: 1705741 - RNA, 17 nt, Salmonella enterica enterica serovar Typhi
gcgauccaggucuuccg

SEQ ID NO: 1705742 - RNA, 21 nt, Salmonella enterica enterica serovar Typhi
gcgcguaaauccuccaucaug

SEQ ID NO: 1705743 - RNA, 15 nt, Salmonella enterica enterica serovar Typhi
gcgcguaaauaccuu

SEQ ID NO: 1705744 - RNA, 12 nt, Salmonella enterica enterica serovar Typhi
gcgcguccagac

SEQ ID NO: 1705745 - RNA, 16 nt, Salmonella enterica enterica serovar Typhi
gcgcguccacggcggg

SEQ ID NO: 1705746 - RNA, 17 nt, Salmonella enterica enterica serovar Typhi
gcgcguccucacacuga

SEQ ID NO: 1705747 - RNA, 16 nt, Salmonella enterica enterica serovar Typhi
gcgcguccuuauaaug

SEQ ID NO: 1705748 - RNA, 21 nt, Salmonella enterica enterica serovar Typhi
gcgcgguggcuuuuuccugcc

SEQ ID NO: 1705749 - RNA, 17 nt, Salmonella enterica enterica serovar Typhi
gcgcggcguacacuuca

SEQ ID NO: 1705750 - RNA, 15 nt, Salmonella enterica enterica serovar Typhi
gcgcggggaacacac

SEQ ID NO: 1705751 - RNA, 14 nt, Salmonella enterica enterica serovar Typhi
gcgcggggaacaca

SEQ ID NO: 1705752 - RNA, 13 nt, Salmonella enterica enterica serovar Typhi
gcgcguggcaaau

SEQ ID NO: 1705753 - RNA, 14 nt, Salmonella enterica enterica serovar Typhi
gcgcgugucgggaa

SEQ ID NO: 1705754 - RNA, 13 nt, Salmonella enterica enterica serovar Typhi
gcgcgugcggcgg

SEQ ID NO: 1705755 - RNA, 17 nt, Salmonella enterica enterica serovar Typhi
gcgcguccuuauaaugc

SEQ ID NO: 1705756 - RNA, 13 nt, Salmonella enterica enterica serovar Typhi
gcgcgucgccuga

SEQ ID NO: 1705757 - RNA, 14 nt, Salmonella enterica enterica serovar Typhi
gcgcuaagccagcc

SEQ ID NO: 1705758 - RNA, 22 nt, Salmonella enterica enterica serovar Typhi
gcgcuaagcguuacggaaaaaa

SEQ ID NO: 1705759 - RNA, 21 nt, Salmonella enterica enterica serovar Typhi
gcgcuaauguacgccuaaaaa

SEQ ID NO: 1705760 - RNA, 17 nt, Salmonella enterica enterica serovar Typhi
gcgcuaaaugcauagcc

SEQ ID NO: 1705761 - RNA, 17 nt, Salmonella enterica enterica serovar Typhi
gcgcguuccccaacagc

SEQ ID NO: 1705762 - RNA, 19 nt, Salmonella enterica enterica serovar Typhi
gcgcguuuagcgccagcag

SEQ ID NO: 1705763 - RNA, 22 nt, Salmonella enterica enterica serovar Typhi
gcgcguugccaucggcgggcgu

SEQ ID NO: 1705764 - RNA, 14 nt, Salmonella enterica enterica serovar Typhi
gcgcguucugcucc

SEQ ID NO: 1705765 - RNA, 14 nt, Salmonella enterica enterica serovar Typhi
gcgcucaaaugguc

SEQ ID NO: 1705766 - RNA, 11 nt, Salmonella enterica enterica serovar Typhi
gcgcucaggca

SEQ ID NO: 1705767 - RNA, 21 nt, Salmonella enterica enterica serovar Typhi
gcgcucauauacccugcggcg

SEQ ID NO: 1705768 - RNA, 22 nt, Salmonella enterica enterica serovar Typhi
gcgcuccaccaaccaggcaaac

SEQ ID NO: 1705769 - RNA, 12 nt, Salmonella enterica enterica serovar Typhi
gcgcuccaggau

SEQ ID NO: 1705770 - RNA, 22 nt, Salmonella enterica enterica serovar Typhi
gcgcuccaucauaucgcgcagc

SEQ ID NO: 1705771 - RNA, 18 nt, Salmonella enterica enterica serovar Typhi
gcgcuaugcgcuccagga

SEQ ID NO: 1705772 - RNA, 17 nt, Salmonella enterica enterica serovar Typhi
gcgcuaucgguaucaug

SEQ ID NO: 1705773 - RNA, 13 nt, Salmonella enterica enterica serovar Typhi
gcgcuaucuucaa

SEQ ID NO: 1705774 - RNA, 17 nt, Salmonella enterica enterica serovar Typhi
gcgcuauucccaggcaa

SEQ ID NO: 1705775 - RNA, 15 nt, Salmonella enterica enterica serovar Typhi
gcgcucaauagccag

SEQ ID NO: 1705776 - RNA, 18 nt, Salmonella enterica enterica serovar Typhi
gcgcuagugccgccaggc

SEQ ID NO: 1705777 - RNA, 21 nt, Salmonella enterica enterica serovar Typhi
gcaacuuacgcccuauccggc

SEQ ID NO: 1705778 - RNA, 19 nt, Salmonella enterica enterica serovar Typhi
gcaagaaucacgccgauga

SEQ ID NO: 1705779 - RNA, 16 nt, Salmonella enterica enterica serovar Typhi
gcaagaauuaaauaac

SEQ ID NO: 1705780 - RNA, 21 nt, Salmonella enterica enterica serovar Typhi
aaagcggauggccugcucaau

SEQ ID NO: 1705781 - RNA, 22 nt, Salmonella enterica enterica serovar Typhi
aaagcggauaagauagcaggcg

SEQ ID NO: 1705782 - RNA, 22 nt, Salmonella enterica enterica serovar Typhi
aaagcggcgaauauagcuaaug

SEQ ID NO: 1705783 - RNA, 23 nt, Salmonella enterica enterica serovar Typhi
aaagcgcgcugauacuuauuacg

SEQ ID NO: 1705784 - RNA, 14 nt, Salmonella enterica enterica serovar Typhi
aaagcggacacugu

SEQ ID NO: 1705785 - RNA, 15 nt, Salmonella enterica enterica serovar Typhi
gcaacuggcaauagc

SEQ ID NO: 1705786 - RNA, 17 nt, Salmonella enterica enterica serovar Typhi
gcaacugcugcgcgugc

SEQ ID NO: 1705787 - RNA, 14 nt, Salmonella enterica enterica serovar Typhi
gcaacuguuuuacc

SEQ ID NO: 1705788 - RNA, 21 nt, Salmonella enterica enterica serovar Typhi
gcaacuguuuuaccaaaucaa

SEQ ID NO: 1705789 - RNA, 17 nt, Salmonella enterica enterica serovar Typhi
gcaacucacgccauucc

SEQ ID NO: 1705790 - RNA, 18 nt, Salmonella enterica enterica serovar Typhi
gcaacguuuguaacagca

SEQ ID NO: 1705791 - RNA, 19 nt, Salmonella enterica enterica serovar Typhi
gcaacugccggcuuaccag

SEQ ID NO: 1705792 - RNA, 14 nt, Salmonella enterica enterica serovar Typhi
gcaacgcgcaucaa

SEQ ID NO: 1705793 - RNA, 18 nt, Salmonella enterica enterica serovar Typhi
gcaacggaaggaaauaac

SEQ ID NO: 1705794 - RNA, 15 nt, Salmonella enterica enterica serovar Typhi
gcaacgccggugccu

SEQ ID NO: 1705795 - RNA, 18 nt, Salmonella enterica enterica serovar Typhi
gcaacgccguacuccagc

SEQ ID NO: 1705796 - RNA, 19 nt, Salmonella enterica enterica serovar Typhi
gcaacgccuccagcgggcu

SEQ ID NO: 1705797 - RNA, 13 nt, Salmonella enterica enterica serovar Typhi
gcaacgccgccga

SEQ ID NO: 1705798 - RNA, 12 nt, Salmonella enterica enterica serovar Typhi
gcaacgccgccg

SEQ ID NO: 1705799 - RNA, 17 nt, Salmonella enterica enterica serovar Typhi
gcaacgccccgucacca

SEQ ID NO: 1705800 - RNA, 12 nt, Salmonella enterica enterica serovar Typhi
gcaacgucagua

SEQ ID NO: 1705801 - RNA, 14 nt, Salmonella enterica enterica serovar Typhi
gcaacgugaacugc

SEQ ID NO: 1705802 - RNA, 18 nt, Salmonella enterica enterica serovar Typhi
gcaacgugaacugcgccu

SEQ ID NO: 1705803 - RNA, 21 nt, Salmonella enterica enterica serovar Typhi
gcaacgagaacccacuuugcu

SEQ ID NO: 1705804 - RNA, 19 nt, Salmonella enterica enterica serovar Typhi
gcaacgaucccuaauaaaa

SEQ ID NO: 1705805 - RNA, 17 nt, Salmonella enterica enterica serovar Typhi
gcaacgacgucuuucuu

SEQ ID NO: 1705806 - RNA, 18 nt, Salmonella enterica enterica serovar Typhi
gcaaccgcucuccgcaau

SEQ ID NO: 1705807 - RNA, 19 nt, Salmonella enterica enterica serovar Typhi
gcaaccgguacucuuccag

SEQ ID NO: 1705808 - RNA, 17 nt, Salmonella enterica enterica serovar Typhi
gaucacaaaaucauugc

SEQ ID NO: 1705809 - RNA, 14 nt, Salmonella enterica enterica serovar Typhi
gcaauaccuguaaa

SEQ ID NO: 1705810 - RNA, 22 nt, Salmonella enterica enterica serovar Typhi
gcaauagaauaggaaauaauua

SEQ ID NO: 1705811 - RNA, 14 nt, Salmonella enterica enterica serovar Typhi
gcaauagaguaaug

SEQ ID NO: 1705812 - RNA, 15 nt, Salmonella enterica enterica serovar Typhi
gcaauagaguaauga

SEQ ID NO: 1705813 - RNA, 23 nt, Salmonella enterica enterica serovar Typhi
gcaauauucaugccagaagcaaa

SEQ ID NO: 1705814 - RNA, 20 nt, Salmonella enterica enterica serovar Typhi
gcaauauuacaaagcaguaa

SEQ ID NO: 1705815 - RNA, 19 nt, Salmonella enterica enterica serovar Typhi
gcaauaugucuuaaacagc

SEQ ID NO: 1705816 - RNA, 13 nt, Salmonella enterica enterica serovar Typhi
gcaauauccuccg

SEQ ID NO: 1705817 - RNA, 17 nt, Salmonella enterica enterica serovar Typhi
gcaauagaguaaugaca

SEQ ID NO: 1705818 - RNA, 17 nt, Salmonella enterica enterica serovar Typhi
gcaauagccaauaacgu

SEQ ID NO: 1705819 - RNA, 16 nt, Salmonella enterica enterica serovar Typhi
gcaaguauuggcugcc

SEQ ID NO: 1705820 - RNA, 14 nt, Salmonella enterica enterica serovar Typhi
gcaagucaccauca

SEQ ID NO: 1705821 - RNA, 14 nt, Salmonella enterica enterica serovar Typhi
gcaaguauacuuau

SEQ ID NO: 1705822 - RNA, 19 nt, Salmonella enterica enterica serovar Typhi
gcaaguucuuguuucaucg

SEQ ID NO: 1705823 - RNA, 18 nt, Salmonella enterica enterica serovar Typhi
gcaauaaagcagggcggc

SEQ ID NO: 1705824 - RNA, 22 nt, Salmonella enterica enterica serovar Typhi
gcaauaacaccggcggcgccau

SEQ ID NO: 1705825 - RNA, 14 nt, Salmonella enterica enterica serovar Typhi
gcaauaaaaggaau

SEQ ID NO: 1705826 - RNA, 17 nt, Salmonella enterica enterica serovar Typhi
gcaaggucugcgcccac

SEQ ID NO: 1705827 - RNA, 19 nt, Salmonella enterica enterica serovar Typhi
gcaaggaaaaccaguaacg

SEQ ID NO: 1705828 - RNA, 21 nt, Salmonella enterica enterica serovar Typhi
gcaaggagacgcccgucacca

SEQ ID NO: 1705829 - RNA, 20 nt, Salmonella enterica enterica serovar Typhi
gcaaggaacaguagaggggg

SEQ ID NO: 1705830 - RNA, 16 nt, Salmonella enterica enterica serovar Typhi
gcaagauuucaaaacc

SEQ ID NO: 1705831 - RNA, 16 nt, Salmonella enterica enterica serovar Typhi
gcaagaggugacucac

SEQ ID NO: 1705832 - RNA, 17 nt, Salmonella enterica enterica serovar Typhi
gcaagacgaaaaaugaa

SEQ ID NO: 1705833 - RNA, 14 nt, Salmonella enterica enterica serovar Typhi
gcaagagaaauaac

SEQ ID NO: 1705834 - RNA, 14 nt, Salmonella enterica enterica serovar Typhi
gcaagagauucagg

SEQ ID NO: 1705835 - RNA, 14 nt, Salmonella enterica enterica serovar Typhi
gcaagcgaagcgcc

SEQ ID NO: 1705836 - RNA, 22 nt, Salmonella enterica enterica serovar Typhi
gcaagcaucugauauaucuuca

SEQ ID NO: 1705837 - RNA, 21 nt, Salmonella enterica enterica serovar Typhi
gcaaucaauacagagauauua

SEQ ID NO: 1705838 - RNA, 18 nt, Salmonella enterica enterica serovar Typhi
gcaauauugccgcacggu

SEQ ID NO: 1705839 - RNA, 12 nt, Salmonella enterica enterica serovar Typhi
gcaaucacuuca

SEQ ID NO: 1705840 - RNA, 18 nt, Salmonella enterica enterica serovar Typhi
gcaaucauccugauuuua

SEQ ID NO: 1705841 - RNA, 14 nt, Salmonella enterica enterica serovar Typhi
gcaaucaugacaga

SEQ ID NO: 1705842 - RNA, 19 nt, Salmonella enterica enterica serovar Typhi
gcaaugagcggccagcggg

SEQ ID NO: 1705843 - RNA, 15 nt, Salmonella enterica enterica serovar Typhi
gcaaugccccgccgc

SEQ ID NO: 1705844 - RNA, 15 nt, Salmonella enterica enterica serovar Typhi
gcaaugccaccacac

SEQ ID NO: 1705845 - RNA, 12 nt, Salmonella enterica enterica serovar Typhi
gcaaugccacca

SEQ ID NO: 1705846 - RNA, 15 nt, Salmonella enterica enterica serovar Typhi
gcaaucggcuuugac

SEQ ID NO: 1705847 - RNA, 21 nt, Salmonella enterica enterica serovar Typhi
gcaaucgacguugaucgccau

SEQ ID NO: 1705848 - RNA, 20 nt, Salmonella enterica enterica serovar Typhi
gcaaucucuuuauugcuggu

SEQ ID NO: 1705849 - RNA, 12 nt, Salmonella enterica enterica serovar Typhi
gcaaucucuuua

SEQ ID NO: 1705850 - RNA, 21 nt, Salmonella enterica enterica serovar Typhi
gcaaugcgcuuuuuuugcccu

SEQ ID NO: 1705851 - RNA, 20 nt, Salmonella enterica enterica serovar Typhi
gcaaugcgcuuuuuuugccc

SEQ ID NO: 1705852 - RNA, 18 nt, Salmonella enterica enterica serovar Typhi
gcaaugggggcuugcgcc

SEQ ID NO: 1705853 - RNA, 12 nt, Salmonella enterica enterica serovar Typhi
gcaauuaauauu

SEQ ID NO: 1705854 - RNA, 21 nt, Salmonella enterica enterica serovar Typhi
gcaauuauauugcguaaaaac

SEQ ID NO: 1705855 - RNA, 20 nt, Salmonella enterica enterica serovar Typhi
gcaauguuccccugaugcgu

SEQ ID NO: 1705856 - RNA, 21 nt, Salmonella enterica enterica serovar Typhi
gcaaugugcgccagaauugcc

SEQ ID NO: 1705857 - RNA, 18 nt, Salmonella enterica enterica serovar Typhi
gcaauugguaauuaaagg

SEQ ID NO: 1705858 - RNA, 15 nt, Salmonella enterica enterica serovar Typhi
gcaauuccugacugc

SEQ ID NO: 1705859 - RNA, 17 nt, Salmonella enterica enterica serovar Typhi
gcaauuccgcuuucuuc

SEQ ID NO: 1705860 - RNA, 21 nt, Salmonella enterica enterica serovar Typhi
gcaauuccggcgaaaaaccga

SEQ ID NO: 1705861 - RNA, 23 nt, Salmonella enterica enterica serovar Typhi
gcaauuugguuagggaucaucuu

SEQ ID NO: 1705862 - RNA, 12 nt, Salmonella enterica enterica serovar Typhi
gcaauuucucgc

SEQ ID NO: 1705863 - RNA, 21 nt, Salmonella enterica enterica serovar Typhi
gcaauuucucgcucgcccauc

SEQ ID NO: 1705864 - RNA, 17 nt, Salmonella enterica enterica serovar Typhi
gcacaaaaaaaccgcuc

SEQ ID NO: 1705865 - RNA, 20 nt, Salmonella enterica enterica serovar Typhi
gcacaaaaaguaguuccagc

SEQ ID NO: 1705866 - RNA, 18 nt, Salmonella enterica enterica serovar Typhi
gcacagggugaaaucacg

SEQ ID NO: 1705867 - RNA, 15 nt, Salmonella enterica enterica serovar Typhi
gcacagguacaggcc

SEQ ID NO: 1705868 - RNA, 14 nt, Salmonella enterica enterica serovar Typhi
gcacauaacgugcc

SEQ ID NO: 1705869 - RNA, 16 nt, Salmonella enterica enterica serovar Typhi
gcacaguauuaccgcu

SEQ ID NO: 1705870 - RNA, 18 nt, Salmonella enterica enterica serovar Typhi
gcacaguacgcccggcgg

SEQ ID NO: 1705871 - RNA, 16 nt, Salmonella enterica enterica serovar Typhi
gcacagcgcagcaacg

SEQ ID NO: 1705872 - RNA, 19 nt, Salmonella enterica enterica serovar Typhi
gcacagccaguaagaacga

SEQ ID NO: 1705873 - RNA, 17 nt, Salmonella enterica enterica serovar Typhi
gcacauuggcgagcagg

SEQ ID NO: 1705874 - RNA, 20 nt, Salmonella enterica enterica serovar Typhi
gcacauuggcgagcaggaac

SEQ ID NO: 1705875 - RNA, 17 nt, Salmonella enterica enterica serovar Typhi
gcacauucgauaaccgc

SEQ ID NO: 1705876 - RNA, 17 nt, Salmonella enterica enterica serovar Typhi
gcacauuguugcaggga

SEQ ID NO: 1705877 - RNA, 18 nt, Salmonella enterica enterica serovar Typhi
gcacauucagguggcuga

SEQ ID NO: 1705878 - RNA, 19 nt, Salmonella enterica enterica serovar Typhi
gcacauguuucagcaccuc

SEQ ID NO: 1705879 - RNA, 14 nt, Salmonella enterica enterica serovar Typhi
gcacauucagagcg

SEQ ID NO: 1705880 - RNA, 13 nt, Salmonella enterica enterica serovar Typhi
gcacauuacaggc

SEQ ID NO: 1705881 - RNA, 17 nt, Salmonella enterica enterica serovar Typhi
gcacaugacggcugacg

SEQ ID NO: 1705882 - RNA, 21 nt, Salmonella enterica enterica serovar Typhi
gcacaucaugaugaucuucag

SEQ ID NO: 1705883 - RNA, 22 nt, Salmonella enterica enterica serovar Typhi
gcacaucaugaugaucuucagc

SEQ ID NO: 1705884 - RNA, 21 nt, Salmonella enterica enterica serovar Typhi
gcacauaggcaaacaccucag

SEQ ID NO: 1705885 - RNA, 20 nt, Salmonella enterica enterica serovar Typhi
gcacaauaccaauaagaacu

SEQ ID NO: 1705886 - RNA, 22 nt, Salmonella enterica enterica serovar Typhi
gcacaauaccgagaauguguuc

SEQ ID NO: 1705887 - RNA, 17 nt, Salmonella enterica enterica serovar Typhi
gcacaauaccaauaaga

SEQ ID NO: 1705888 - RNA, 15 nt, Salmonella enterica enterica serovar Typhi
gcacaaccuggcuug

SEQ ID NO: 1705889 - RNA, 21 nt, Salmonella enterica enterica serovar Typhi
gcacaacgcauuggcaauuaa

SEQ ID NO: 1705890 - RNA, 11 nt, Salmonella enterica enterica serovar Typhi
gcacaagccau

SEQ ID NO: 1705891 - RNA, 18 nt, Salmonella enterica enterica serovar Typhi
gcacaagaaacauguugu

SEQ ID NO: 1705892 - RNA, 18 nt, Salmonella enterica enterica serovar Typhi
gcacacucauuuugccgu

SEQ ID NO: 1705893 - RNA, 19 nt, Salmonella enterica enterica serovar Typhi
gcacacgcuggaagagaac

SEQ ID NO: 1705894 - RNA, 14 nt, Salmonella enterica enterica serovar Typhi
gcacacgucugagc

SEQ ID NO: 1705895 - RNA, 13 nt, Salmonella enterica enterica serovar Typhi
gcacaccauuuca

SEQ ID NO: 1705896 - RNA, 15 nt, Salmonella enterica enterica serovar Typhi
gcacaccauuucaca

SEQ ID NO: 1705897 - RNA, 18 nt, Salmonella enterica enterica serovar Typhi
gcacacgaaauccaaaca

SEQ ID NO: 1705898 - RNA, 16 nt, Salmonella enterica enterica serovar Typhi
gcaccgccagcgccgc

SEQ ID NO: 1705899 - RNA, 16 nt, Salmonella enterica enterica serovar Typhi
gcaccgcuaaaaaaca

SEQ ID NO: 1705900 - RNA, 13 nt, Salmonella enterica enterica serovar Typhi
gcaccgaauguuc

SEQ ID NO: 1705901 - RNA, 15 nt, Salmonella enterica enterica serovar Typhi
gcaccguaaacggcu

SEQ ID NO: 1705902 - RNA, 19 nt, Salmonella enterica enterica serovar Typhi
gcaccguaucggcagucac

SEQ ID NO: 1705903 - RNA, 15 nt, Salmonella enterica enterica serovar Typhi
gcaccggaacagaag

SEQ ID NO: 1705904 - RNA, 21 nt, Salmonella enterica enterica serovar Typhi
gcaccugauagugaucgccaa

SEQ ID NO: 1705905 - RNA, 12 nt, Salmonella enterica enterica serovar Typhi
gcaccuggaagu

SEQ ID NO: 1705906 - RNA, 14 nt, Salmonella enterica enterica serovar Typhi
gcaccuccagcgcc

SEQ ID NO: 1705907 - RNA, 19 nt, Salmonella enterica enterica serovar Typhi
gcaccacuuuguuuuuguc

SEQ ID NO: 1705908 - RNA, 13 nt, Salmonella enterica enterica serovar Typhi
gcaccagcaacac

SEQ ID NO: 1705909 - RNA, 16 nt, Salmonella enterica enterica serovar Typhi
gcaccagcaacacauc

SEQ ID NO: 1705910 - RNA, 17 nt, Salmonella enterica enterica serovar Typhi
gcaccagcaggugguac

SEQ ID NO: 1705911 - RNA, 14 nt, Salmonella enterica enterica serovar Typhi
gcaccagccaggcg

SEQ ID NO: 1705912 - RNA, 13 nt, Salmonella enterica enterica serovar Typhi
gcaccagccagga

SEQ ID NO: 1705913 - RNA, 20 nt, Salmonella enterica enterica serovar Typhi
gcaccagcucuacaucgccg

SEQ ID NO: 1705914 - RNA, 19 nt, Salmonella enterica enterica serovar Typhi
gcaccacgaccagacuggu

SEQ ID NO: 1705915 - RNA, 16 nt, Salmonella enterica enterica serovar Typhi
gcaccaguucacuccu

SEQ ID NO: 1705916 - RNA, 20 nt, Salmonella enterica enterica serovar Typhi
gcaccaguucacuccuaaga

SEQ ID NO: 1705917 - RNA, 22 nt, Salmonella enterica enterica serovar Typhi
gcacccaccaucacuuccaucc

SEQ ID NO: 1705918 - RNA, 17 nt, Salmonella enterica enterica serovar Typhi
gcaccauucccacgcau

SEQ ID NO: 1705919 - RNA, 17 nt, Salmonella enterica enterica serovar Typhi
gcaccauguggcgcggc

SEQ ID NO: 1705920 - RNA, 16 nt, Salmonella enterica enterica serovar Typhi
gcacccggagagaaac

SEQ ID NO: 1705921 - RNA, 14 nt, Salmonella enterica enterica serovar Typhi
gcacccaucuuuac

SEQ ID NO: 1705922 - RNA, 17 nt, Salmonella enterica enterica serovar Typhi
gcacccaucuuuaccaa

SEQ ID NO: 1705923 - RNA, 21 nt, Salmonella enterica enterica serovar Typhi
gcaccccucuucuuuaagaac

SEQ ID NO: 1705924 - RNA, 15 nt, Salmonella enterica enterica serovar Typhi
gcacgccgcccgccu

SEQ ID NO: 1705925 - RNA, 15 nt, Salmonella enterica enterica serovar Typhi
gcacgccggccccgc

SEQ ID NO: 1705926 - RNA, 14 nt, Salmonella enterica enterica serovar Typhi
gcacgccaggguaa

SEQ ID NO: 1705927 - RNA, 16 nt, Salmonella enterica enterica serovar Typhi
gcacgccacauugacc

SEQ ID NO: 1705928 - RNA, 18 nt, Salmonella enterica enterica serovar Typhi
gcacgauauccagcaccu

SEQ ID NO: 1705929 - RNA, 16 nt, Salmonella enterica enterica serovar Typhi
gcacgacguagcccau

SEQ ID NO: 1705930 - RNA, 17 nt, Salmonella enterica enterica serovar Typhi
gcaccuggguauuccac

SEQ ID NO: 1705931 - RNA, 21 nt, Salmonella enterica enterica serovar Typhi
gcaccuuaaccgucugcucag

SEQ ID NO: 1705932 - RNA, 20 nt, Salmonella enterica enterica serovar Typhi
gcaccuguuucugcuggccu

SEQ ID NO: 1705933 - RNA, 22 nt, Salmonella enterica enterica serovar Typhi
gcaccuucaacagcucgccaug

SEQ ID NO: 1705934 - RNA, 20 nt, Salmonella enterica enterica serovar Typhi
gcaccuucaacagcucgcca

SEQ ID NO: 1705935 - RNA, 13 nt, Salmonella enterica enterica serovar Typhi
gcacgaaauguag

SEQ ID NO: 1705936 - RNA, 12 nt, Salmonella enterica enterica serovar Typhi
gcacgaaaaaua

SEQ ID NO: 1705937 - RNA, 13 nt, Salmonella enterica enterica serovar Typhi
gcacgaaaaauaa

SEQ ID NO: 1705938 - RNA, 18 nt, Salmonella enterica enterica serovar Typhi
gcacgaacauaccggagc

SEQ ID NO: 1705939 - RNA, 22 nt, Salmonella enterica enterica serovar Typhi
gcacgaacauaccggagccugg

SEQ ID NO: 1705940 - RNA, 14 nt, Salmonella enterica enterica serovar Typhi
gcacggauacugcu

SEQ ID NO: 1705941 - RNA, 16 nt, Salmonella enterica enterica serovar Typhi
gcacggaugcaucaug

SEQ ID NO: 1705942 - RNA, 21 nt, Salmonella enterica enterica serovar Typhi
gcacgcgcagcaucucaucca

SEQ ID NO: 1705943 - RNA, 16 nt, Salmonella enterica enterica serovar Typhi
gcacgccugcauaaag

SEQ ID NO: 1705944 - RNA, 22 nt, Salmonella enterica enterica serovar Typhi
gcacgcuaaagcgcuggcggcg

SEQ ID NO: 1705945 - RNA, 21 nt, Salmonella enterica enterica serovar Typhi
gcacgcgggccaauccagcua

SEQ ID NO: 1705946 - RNA, 22 nt, Salmonella enterica enterica serovar Typhi
gcacgcgacgcgccagccagcg

SEQ ID NO: 1705947 - RNA, 17 nt, Salmonella enterica enterica serovar Typhi
gcacgcuuuuuugcugg

SEQ ID NO: 1705948 - RNA, 15 nt, Salmonella enterica enterica serovar Typhi
gcacgcuggcaucaa

SEQ ID NO: 1705949 - RNA, 12 nt, Salmonella enterica enterica serovar Typhi
gcacgcugcgca

SEQ ID NO: 1705950 - RNA, 20 nt, Salmonella enterica enterica serovar Typhi
gcacgcgucaucggcgcgcu

SEQ ID NO: 1705951 - RNA, 14 nt, Salmonella enterica enterica serovar Typhi
gcacugacuuacag

SEQ ID NO: 1705952 - RNA, 19 nt, Salmonella enterica enterica serovar Typhi
gcacugcaauuucugcugg

SEQ ID NO: 1705953 - RNA, 18 nt, Salmonella enterica enterica serovar Typhi
gcacuccccggcuugcgg

SEQ ID NO: 1705954 - RNA, 22 nt, Salmonella enterica enterica serovar Typhi
gcacucagaaaauuauuuuaaa

SEQ ID NO: 1705955 - RNA, 15 nt, Salmonella enterica enterica serovar Typhi
gcacucagaaaauua

SEQ ID NO: 1705956 - RNA, 14 nt, Salmonella enterica enterica serovar Typhi
gcacucaccucuuc

SEQ ID NO: 1705957 - RNA, 17 nt, Salmonella enterica enterica serovar Typhi
gcacucagaaaauuauu

SEQ ID NO: 1705958 - RNA, 20 nt, Salmonella enterica enterica serovar Typhi
gcacgucauuacgguauuua

SEQ ID NO: 1705959 - RNA, 15 nt, Salmonella enterica enterica serovar Typhi
gcacgucgcgcucgc

SEQ ID NO: 1705960 - RNA, 14 nt, Salmonella enterica enterica serovar Typhi
gcacuaccaccuca

SEQ ID NO: 1705961 - RNA, 18 nt, Salmonella enterica enterica serovar Typhi
gcacuacggcaaacacaa

SEQ ID NO: 1705962 - RNA, 24 nt, Salmonella enterica enterica serovar Typhi
gcacuacgguccaguugcccucuu

SEQ ID NO: 1705963 - RNA, 20 nt, Salmonella enterica enterica serovar Typhi
gcagaaaaagcccccaucac

SEQ ID NO: 1705964 - RNA, 17 nt, Salmonella enterica enterica serovar Typhi
gcacuuuuuccuccugc

SEQ ID NO: 1705965 - RNA, 12 nt, Salmonella enterica enterica serovar Typhi
gcagaaaaccgg

SEQ ID NO: 1705966 - RNA, 13 nt, Salmonella enterica enterica serovar Typhi
gcacuuuaaacca

SEQ ID NO: 1705967 - RNA, 12 nt, Salmonella enterica enterica serovar Typhi
gcacugcaccug

SEQ ID NO: 1705968 - RNA, 17 nt, Salmonella enterica enterica serovar Typhi
gcacugauagccgccag

SEQ ID NO: 1705969 - RNA, 21 nt, Salmonella enterica enterica serovar Typhi
gcacuggcuuacucgcccugc

SEQ ID NO: 1705970 - RNA, 21 nt, Salmonella enterica enterica serovar Typhi
gcacuuacucuacauucuguu

SEQ ID NO: 1705971 - RNA, 18 nt, Salmonella enterica enterica serovar Typhi
gcagauaaccgucggcgc

SEQ ID NO: 1705972 - RNA, 14 nt, Salmonella enterica enterica serovar Typhi
gcagauaucuucca

SEQ ID NO: 1705973 - RNA, 14 nt, Salmonella enterica enterica serovar Typhi
gcagaggucucagg

SEQ ID NO: 1705974 - RNA, 15 nt, Salmonella enterica enterica serovar Typhi
gcagauaaaccacgc

SEQ ID NO: 1705975 - RNA, 14 nt, Salmonella enterica enterica serovar Typhi
gcagauaacaggca

SEQ ID NO: 1705976 - RNA, 16 nt, Salmonella enterica enterica serovar Typhi
gcagagucgcagcggc

SEQ ID NO: 1705977 - RNA, 19 nt, Salmonella enterica enterica serovar Typhi
gcagagucgcagcggcggu

SEQ ID NO: 1705978 - RNA, 20 nt, Salmonella enterica enterica serovar Typhi
gcagagcgcgcucugccuuu

SEQ ID NO: 1705979 - RNA, 16 nt, Salmonella enterica enterica serovar Typhi
gcagagcggggaaacu

SEQ ID NO: 1705980 - RNA, 19 nt, Salmonella enterica enterica serovar Typhi
gcagaugcugcguuuuuuc

SEQ ID NO: 1705981 - RNA, 17 nt, Salmonella enterica enterica serovar Typhi
gcagaugcucaggcaac

SEQ ID NO: 1705982 - RNA, 18 nt, Salmonella enterica enterica serovar Typhi
gcagaucugucgccauga

SEQ ID NO: 1705983 - RNA, 20 nt, Salmonella enterica enterica serovar Typhi
gcagaugaacggcaagaccu

SEQ ID NO: 1705984 - RNA, 17 nt, Salmonella enterica enterica serovar Typhi
gcagaugguauaaauca

SEQ ID NO: 1705985 - RNA, 21 nt, Salmonella enterica enterica serovar Typhi
gcagaugguauaaaucacgcu

SEQ ID NO: 1705986 - RNA, 23 nt, Salmonella enterica enterica serovar Typhi
gcagauagcccgccagcaccagc

SEQ ID NO: 1705987 - RNA, 13 nt, Salmonella enterica enterica serovar Typhi
gcagauccgcgau

SEQ ID NO: 1705988 - RNA, 20 nt, Salmonella enterica enterica serovar Typhi
gcagauccgcgauaucaauc

SEQ ID NO: 1705989 - RNA, 22 nt, Salmonella enterica enterica serovar Typhi
gcagaucccagguaaccgcuaa

SEQ ID NO: 1705990 - RNA, 16 nt, Salmonella enterica enterica serovar Typhi
gcagauccaucgccug

SEQ ID NO: 1705991 - RNA, 18 nt, Salmonella enterica enterica serovar Typhi
gcagaucgcgggcaauca

SEQ ID NO: 1705992 - RNA, 19 nt, Salmonella enterica enterica serovar Typhi
gcagaucggccuguuuuuc

SEQ ID NO: 1705993 - RNA, 18 nt, Salmonella enterica enterica serovar Typhi
gcagaucguuuacgaccu

SEQ ID NO: 1705994 - RNA, 17 nt, Salmonella enterica enterica serovar Typhi
gcagaucugucgccaug

SEQ ID NO: 1705995 - RNA, 14 nt, Salmonella enterica enterica serovar Typhi
gcagaucgccugga

SEQ ID NO: 1705996 - RNA, 21 nt, Salmonella enterica enterica serovar Typhi
gcagacccacuuucagcuccg

SEQ ID NO: 1705997 - RNA, 21 nt, Salmonella enterica enterica serovar Typhi
gcagacaguggccaucuucca

SEQ ID NO: 1705998 - RNA, 22 nt, Salmonella enterica enterica serovar Typhi
gcagacaugaccgcacagcaga

SEQ ID NO: 1705999 - RNA, 14 nt, Salmonella enterica enterica serovar Typhi
gcagaccuauaugg

SEQ ID NO: 1706000 - RNA, 15 nt, Salmonella enterica enterica serovar Typhi
gcagacggagaugau

SEQ ID NO: 1706001 - RNA, 16 nt, Salmonella enterica enterica serovar Typhi
gcagacggagaugauc

SEQ ID NO: 1706002 - RNA, 14 nt, Salmonella enterica enterica serovar Typhi
gcagacgccugccg

SEQ ID NO: 1706003 - RNA, 18 nt, Salmonella enterica enterica serovar Typhi
gcagacuuuaaccauucc

SEQ ID NO: 1706004 - RNA, 15 nt, Salmonella enterica enterica serovar Typhi
gcagacuuucugaca

SEQ ID NO: 1706005 - RNA, 18 nt, Salmonella enterica enterica serovar Typhi
gcagacuuucugacaggu

SEQ ID NO: 1706006 - RNA, 21 nt, Salmonella enterica enterica serovar Typhi
gcagaauauuuuucucagcca

SEQ ID NO: 1706007 - RNA, 16 nt, Salmonella enterica enterica serovar Typhi
gcagaauauuuuucuc

SEQ ID NO: 1706008 - RNA, 20 nt, Salmonella enterica enterica serovar Typhi
gcagaauauuuuucucagcc

SEQ ID NO: 1706009 - RNA, 18 nt, Salmonella enterica enterica serovar Typhi
gcagacaauuuccgccgc

SEQ ID NO: 1706010 - RNA, 14 nt, Salmonella enterica enterica serovar Typhi
gcagacacugccac

SEQ ID NO: 1706011 - RNA, 20 nt, Salmonella enterica enterica serovar Typhi
gcagacaaaaaaccggaggc

SEQ ID NO: 1706012 - RNA, 23 nt, Salmonella enterica enterica serovar Typhi
gcagaauuaacucaucacagcca

SEQ ID NO: 1706013 - RNA, 18 nt, Salmonella enterica enterica serovar Typhi
gcagaauuaacucaucac

SEQ ID NO: 1706014 - RNA, 18 nt, Salmonella enterica enterica serovar Typhi
gcagaaauucggcagcgu

SEQ ID NO: 1706015 - RNA, 20 nt, Salmonella enterica enterica serovar Typhi
gcagaaauaaaauacuucca

SEQ ID NO: 1706016 - RNA, 13 nt, Salmonella enterica enterica serovar Typhi
gcagcaucgccau

SEQ ID NO: 1706017 - RNA, 15 nt, Salmonella enterica enterica serovar Typhi
gcagcaucccggcaa

SEQ ID NO: 1706018 - RNA, 19 nt, Salmonella enterica enterica serovar Typhi
gcagcaucccggcaaaaau

SEQ ID NO: 1706019 - RNA, 22 nt, Salmonella enterica enterica serovar Typhi
gcagcaguuccccgccgcggcg

SEQ ID NO: 1706020 - RNA, 18 nt, Salmonella enterica enterica serovar Typhi
gcagcaguuccccgccgc

SEQ ID NO: 1706021 - RNA, 15 nt, Salmonella enterica enterica serovar Typhi
gcagcaguucuucgc

SEQ ID NO: 1706022 - RNA, 22 nt, Salmonella enterica enterica serovar Typhi
gcagcagcgcuuucuucuucac

SEQ ID NO: 1706023 - RNA, 21 nt, Salmonella enterica enterica serovar Typhi
gcagcagggauauacaaauau

SEQ ID NO: 1706024 - RNA, 17 nt, Salmonella enterica enterica serovar Typhi
gcagccauagcgcgccg

SEQ ID NO: 1706025 - RNA, 16 nt, Salmonella enterica enterica serovar Typhi
gcagccagaacucauc

SEQ ID NO: 1706026 - RNA, 14 nt, Salmonella enterica enterica serovar Typhi
gcagccagcaauaa

SEQ ID NO: 1706027 - RNA, 19 nt, Salmonella enterica enterica serovar Typhi
gcagccaggcaaagcccca

SEQ ID NO: 1706028 - RNA, 17 nt, Salmonella enterica enterica serovar Typhi
gcagccaggcaaagccc

SEQ ID NO: 1706029 - RNA, 17 nt, Salmonella enterica enterica serovar Typhi
gcagccaacgccgccau

SEQ ID NO: 1706030 - RNA, 14 nt, Salmonella enterica enterica serovar Typhi
gcagccaacaacag

SEQ ID NO: 1706031 - RNA, 16 nt, Salmonella enterica enterica serovar Typhi
gcagccaacaacaggc

SEQ ID NO: 1706032 - RNA, 19 nt, Salmonella enterica enterica serovar Typhi
gcagccaacaacaggccgc

SEQ ID NO: 1706033 - RNA, 20 nt, Salmonella enterica enterica serovar Typhi
gcagccaacaacaggccgcc

SEQ ID NO: 1706034 - RNA, 20 nt, Salmonella enterica enterica serovar Typhi
gcagcacuucagaacggcua

SEQ ID NO: 1706035 - RNA, 18 nt, Salmonella enterica enterica serovar Typhi
gcagcagaaucaggcaca

SEQ ID NO: 1706036 - RNA, 15 nt, Salmonella enterica enterica serovar Typhi
gcagcaccgccgcga

SEQ ID NO: 1706037 - RNA, 21 nt, Salmonella enterica enterica serovar Typhi
gcagcaccucgguauguccug

SEQ ID NO: 1706038 - RNA, 18 nt, Salmonella enterica enterica serovar Typhi
gcagcaccgguuuuuccg

SEQ ID NO: 1706039 - RNA, 22 nt, Salmonella enterica enterica serovar Typhi
gcagcaauaguugucagaccuu

SEQ ID NO: 1706040 - RNA, 17 nt, Salmonella enterica enterica serovar Typhi
gcagcaaacgccauagc

SEQ ID NO: 1706041 - RNA, 20 nt, Salmonella enterica enterica serovar Typhi
gcagcaacugauucaaaagg

SEQ ID NO: 1706042 - RNA, 14 nt, Salmonella enterica enterica serovar Typhi
gcagcaagaacaga

SEQ ID NO: 1706043 - RNA, 14 nt, Salmonella enterica enterica serovar Typhi
gcagcaacccugcc

SEQ ID NO: 1706044 - RNA, 13 nt, Salmonella enterica enterica serovar Typhi
gcagauuuuuauc

SEQ ID NO: 1706045 - RNA, 18 nt, Salmonella enterica enterica serovar Typhi
gcagccccggcauccagu

SEQ ID NO: 1706046 - RNA, 21 nt, Salmonella enterica enterica serovar Typhi
gcagccccggcauccaguucc

SEQ ID NO: 1706047 - RNA, 18 nt, Salmonella enterica enterica serovar Typhi
gcagcccgcccacaggcu

SEQ ID NO: 1706048 - RNA, 15 nt, Salmonella enterica enterica serovar Typhi
gcagccgcacaugaa

SEQ ID NO: 1706049 - RNA, 17 nt, Salmonella enterica enterica serovar Typhi
gcagccgcucaggguaa

SEQ ID NO: 1706050 - RNA, 15 nt, Salmonella enterica enterica serovar Typhi
gcagccgggccagac

SEQ ID NO: 1706051 - RNA, 15 nt, Salmonella enterica enterica serovar Typhi
gcagcgauauuucuc

SEQ ID NO: 1706052 - RNA, 15 nt, Salmonella enterica enterica serovar Typhi
gcagcgauagacugu

SEQ ID NO: 1706053 - RNA, 18 nt, Salmonella enterica enterica serovar Typhi
gcagcgaaagcugccuuu

SEQ ID NO: 1706054 - RNA, 13 nt, Salmonella enterica enterica serovar Typhi
gcagccugccgca

SEQ ID NO: 1706055 - RNA, 16 nt, Salmonella enterica enterica serovar Typhi
gcagccgguauccagc

SEQ ID NO: 1706056 - RNA, 13 nt, Salmonella enterica enterica serovar Typhi
gcagcgcccagca

SEQ ID NO: 1706057 - RNA, 17 nt, Salmonella enterica enterica serovar Typhi
gcagcgccccgccgcgc

SEQ ID NO: 1706058 - RNA, 13 nt, Salmonella enterica enterica serovar Typhi
gcagcgccgccug

SEQ ID NO: 1706059 - RNA, 15 nt, Salmonella enterica enterica serovar Typhi
gcagcgccccgccgc

SEQ ID NO: 1706060 - RNA, 15 nt, Salmonella enterica enterica serovar Typhi
gcagcgccaucaggc

SEQ ID NO: 1706061 - RNA, 18 nt, Salmonella enterica enterica serovar Typhi
gcagcgccaucaggcccc

SEQ ID NO: 1706062 - RNA, 15 nt, Salmonella enterica enterica serovar Typhi
gcagcgccuucgcuu

SEQ ID NO: 1706063 - RNA, 17 nt, Salmonella enterica enterica serovar Typhi
gcagcgcgacauagagc

SEQ ID NO: 1706064 - RNA, 20 nt, Salmonella enterica enterica serovar Typhi
gcagcgcgcgacccagcgca

SEQ ID NO: 1706065 - RNA, 13 nt, Salmonella enterica enterica serovar Typhi
gcagcgcggccug

SEQ ID NO: 1706066 - RNA, 13 nt, Salmonella enterica enterica serovar Typhi
gcagcggcaguga

SEQ ID NO: 1706067 - RNA, 14 nt, Salmonella enterica enterica serovar Typhi
gcagcgcuuucacc

SEQ ID NO: 1706068 - RNA, 20 nt, Salmonella enterica enterica serovar Typhi
gcagcggcguaucuuccagc

SEQ ID NO: 1706069 - RNA, 21 nt, Salmonella enterica enterica serovar Typhi
gcagcggcguaucuuccagcg

SEQ ID NO: 1706070 - RNA, 11 nt, Salmonella enterica enterica serovar Typhi
gcagcggcggu

SEQ ID NO: 1706071 - RNA, 20 nt, Salmonella enterica enterica serovar Typhi
gcagcgugaaacgcccuucc

SEQ ID NO: 1706072 - RNA, 19 nt, Salmonella enterica enterica serovar Typhi
gcagcgugccuucaaauau

SEQ ID NO: 1706073 - RNA, 15 nt, Salmonella enterica enterica serovar Typhi
gcagcgucggcuuca

SEQ ID NO: 1706074 - RNA, 23 nt, Salmonella enterica enterica serovar Typhi
gcaggaucuccagaucgccacga

SEQ ID NO: 1706075 - RNA, 13 nt, Salmonella enterica enterica serovar Typhi
gcagcucugccug

SEQ ID NO: 1706076 - RNA, 23 nt, Salmonella enterica enterica serovar Typhi
gcagcuccuuuuaauaaagaaag

SEQ ID NO: 1706077 - RNA, 18 nt, Salmonella enterica enterica serovar Typhi
gcaggcauaaaaaagagg

SEQ ID NO: 1706078 - RNA, 13 nt, Salmonella enterica enterica serovar Typhi
gcaggcaaaucaa

SEQ ID NO: 1706079 - RNA, 22 nt, Salmonella enterica enterica serovar Typhi
gcaggcaaaucaacauuauuaa

SEQ ID NO: 1706080 - RNA, 16 nt, Salmonella enterica enterica serovar Typhi
gcaggcggcuucgcau

SEQ ID NO: 1706081 - RNA, 19 nt, Salmonella enterica enterica serovar Typhi
gcaggcgggugcgcagccc

SEQ ID NO: 1706082 - RNA, 17 nt, Salmonella enterica enterica serovar Typhi
gcaggcauuaaaaaaac

SEQ ID NO: 1706083 - RNA, 13 nt, Salmonella enterica enterica serovar Typhi
gcaggcauggcca

SEQ ID NO: 1706084 - RNA, 18 nt, Salmonella enterica enterica serovar Typhi
gcagggaucguuuuucuu

SEQ ID NO: 1706085 - RNA, 21 nt, Salmonella enterica enterica serovar Typhi
gcagggauauacaaauauccc

SEQ ID NO: 1706086 - RNA, 14 nt, Salmonella enterica enterica serovar Typhi
gcagggauccugua

SEQ ID NO: 1706087 - RNA, 16 nt, Salmonella enterica enterica serovar Typhi
gcaggcuuugcugcug

SEQ ID NO: 1706088 - RNA, 18 nt, Salmonella enterica enterica serovar Typhi
gcaggcuuugcugcugcg

SEQ ID NO: 1706089 - RNA, 22 nt, Salmonella enterica enterica serovar Typhi
gcaggcuuccacgcacgccggc

SEQ ID NO: 1706090 - RNA, 22 nt, Salmonella enterica enterica serovar Typhi
gcagguaguaaccccaguagcc

SEQ ID NO: 1706091 - RNA, 18 nt, Salmonella enterica enterica serovar Typhi
gcagguaguccaaauaag

SEQ ID NO: 1706092 - RNA, 18 nt, Salmonella enterica enterica serovar Typhi
gcaggguuugaccucauc

SEQ ID NO: 1706093 - RNA, 22 nt, Salmonella enterica enterica serovar Typhi
gcagguuacucuuccaccaucc

SEQ ID NO: 1706094 - RNA, 20 nt, Salmonella enterica enterica serovar Typhi
gcagguugccgaugacuccc

SEQ ID NO: 1706095 - RNA, 16 nt, Salmonella enterica enterica serovar Typhi
gcaggugguacaucaa

SEQ ID NO: 1706096 - RNA, 14 nt, Salmonella enterica enterica serovar Typhi
gcaugagcacgcgg

SEQ ID NO: 1706097 - RNA, 18 nt, Salmonella enterica enterica serovar Typhi
gcaugagcacgcggaaga

SEQ ID NO: 1706098 - RNA, 14 nt, Salmonella enterica enterica serovar Typhi
gcaugagccagccc

SEQ ID NO: 1706099 - RNA, 16 nt, Salmonella enterica enterica serovar Typhi
gcaugagccagcccuc

SEQ ID NO: 1706100 - RNA, 22 nt, Salmonella enterica enterica serovar Typhi
gcaugccccucgacaggaguau

SEQ ID NO: 1706101 - RNA, 22 nt, Salmonella enterica enterica serovar Typhi
gcaugcgccccguuuccgcgac

SEQ ID NO: 1706102 - RNA, 16 nt, Salmonella enterica enterica serovar Typhi
gcauggcguugcugca

SEQ ID NO: 1706103 - RNA, 14 nt, Salmonella enterica enterica serovar Typhi
gcauggggagaccc

SEQ ID NO: 1706104 - RNA, 18 nt, Salmonella enterica enterica serovar Typhi
gcauggucagcauaauau

SEQ ID NO: 1706105 - RNA, 20 nt, Salmonella enterica enterica serovar Typhi
gcaugaauaauuucuucuuu

SEQ ID NO: 1706106 - RNA, 14 nt, Salmonella enterica enterica serovar Typhi
gcaugaauuucucg

SEQ ID NO: 1706107 - RNA, 18 nt, Salmonella enterica enterica serovar Typhi
gcaugaauaaccucccgc

SEQ ID NO: 1706108 - RNA, 14 nt, Salmonella enterica enterica serovar Typhi
gcaugaccauccac

SEQ ID NO: 1706109 - RNA, 13 nt, Salmonella enterica enterica serovar Typhi
gcaucuuuugccg

SEQ ID NO: 1706110 - RNA, 14 nt, Salmonella enterica enterica serovar Typhi
gcauucagccagcu

SEQ ID NO: 1706111 - RNA, 14 nt, Salmonella enterica enterica serovar Typhi
gcauuaggcuuuuc

SEQ ID NO: 1706112 - RNA, 20 nt, Salmonella enterica enterica serovar Typhi
gcauuauacgccuauuuucu

SEQ ID NO: 1706113 - RNA, 18 nt, Salmonella enterica enterica serovar Typhi
gcauuaugggcgugcuga

SEQ ID NO: 1706114 - RNA, 19 nt, Salmonella enterica enterica serovar Typhi
gcauggguauaagcgugca

SEQ ID NO: 1706115 - RNA, 18 nt, Salmonella enterica enterica serovar Typhi
gcaugucguauccccagu

SEQ ID NO: 1706116 - RNA, 20 nt, Salmonella enterica enterica serovar Typhi
gcauuaaaucaucauaauca

SEQ ID NO: 1706117 - RNA, 15 nt, Salmonella enterica enterica serovar Typhi
gcauuaacaaaucau

SEQ ID NO: 1706118 - RNA, 13 nt, Salmonella enterica enterica serovar Typhi
gccaaaaccacag

SEQ ID NO: 1706119 - RNA, 18 nt, Salmonella enterica enterica serovar Typhi
gccaaaaccacagugacc

SEQ ID NO: 1706120 - RNA, 19 nt, Salmonella enterica enterica serovar Typhi
gccaaaacccaccagcagg

SEQ ID NO: 1706121 - RNA, 14 nt, Salmonella enterica enterica serovar Typhi
gcauuuuuucuuca

SEQ ID NO: 1706122 - RNA, 15 nt, Salmonella enterica enterica serovar Typhi
gcauuuuuucuucag

SEQ ID NO: 1706123 - RNA, 22 nt, Salmonella enterica enterica serovar Typhi
gcauugguggggcuaagugagc

SEQ ID NO: 1706124 - RNA, 17 nt, Salmonella enterica enterica serovar Typhi
gcauugggauggauaaa

SEQ ID NO: 1706125 - RNA, 18 nt, Salmonella enterica enterica serovar Typhi
gcauugggauggauaaau

SEQ ID NO: 1706126 - RNA, 18 nt, Salmonella enterica enterica serovar Typhi
gcauugugccggguagcg

SEQ ID NO: 1706127 - RNA, 19 nt, Salmonella enterica enterica serovar Typhi
gcauuggcguuaccggcag

SEQ ID NO: 1706128 - RNA, 23 nt, Salmonella enterica enterica serovar Typhi
gcauucuuugcuuuguaaagcgc

SEQ ID NO: 1706129 - RNA, 20 nt, Salmonella enterica enterica serovar Typhi
gcauucuuugcuuuguaaag

SEQ ID NO: 1706130 - RNA, 23 nt, Salmonella enterica enterica serovar Typhi
gcaucgcguuauugaccaucgcc

SEQ ID NO: 1706131 - RNA, 18 nt, Salmonella enterica enterica serovar Typhi
gcauccguagcuucagcu

SEQ ID NO: 1706132 - RNA, 15 nt, Salmonella enterica enterica serovar Typhi
gcaucgccgcccagu

SEQ ID NO: 1706133 - RNA, 17 nt, Salmonella enterica enterica serovar Typhi
gcauccggcccgugcca

SEQ ID NO: 1706134 - RNA, 15 nt, Salmonella enterica enterica serovar Typhi
gcaucagaaaaaccu

SEQ ID NO: 1706135 - RNA, 16 nt, Salmonella enterica enterica serovar Typhi
gcaucagaacaaacuu

SEQ ID NO: 1706136 - RNA, 17 nt, Salmonella enterica enterica serovar Typhi
gcaucagacuacuuuua

SEQ ID NO: 1706137 - RNA, 13 nt, Salmonella enterica enterica serovar Typhi
gcauccaugccag

SEQ ID NO: 1706138 - RNA, 16 nt, Salmonella enterica enterica serovar Typhi
gcauccggaaucgccg

SEQ ID NO: 1706139 - RNA, 15 nt, Salmonella enterica enterica serovar Typhi
gcauccggacgccag

SEQ ID NO: 1706140 - RNA, 16 nt, Salmonella enterica enterica serovar Typhi
gcauccggcaauucaa

SEQ ID NO: 1706141 - RNA, 14 nt, Salmonella enterica enterica serovar Typhi
gcauccggcaucaa

SEQ ID NO: 1706142 - RNA, 16 nt, Salmonella enterica enterica serovar Typhi
gcauccggccagcgac

SEQ ID NO: 1706143 - RNA, 21 nt, Salmonella enterica enterica serovar Typhi
gcaucccggugucaaagcgcc

SEQ ID NO: 1706144 - RNA, 23 nt, Salmonella enterica enterica serovar Typhi
gcaucccggugucaaagcgccag

SEQ ID NO: 1706145 - RNA, 11 nt, Salmonella enterica enterica serovar Typhi
gcaucccggca

SEQ ID NO: 1706146 - RNA, 14 nt, Salmonella enterica enterica serovar Typhi
gcauccccugcagg

SEQ ID NO: 1706147 - RNA, 23 nt, Salmonella enterica enterica serovar Typhi
gcauaccggccacgagcugucac

SEQ ID NO: 1706148 - RNA, 13 nt, Salmonella enterica enterica serovar Typhi
gcauaccuucaca

SEQ ID NO: 1706149 - RNA, 23 nt, Salmonella enterica enterica serovar Typhi
gcauaccaaguuuggcaaucaaa

SEQ ID NO: 1706150 - RNA, 18 nt, Salmonella enterica enterica serovar Typhi
gcauaccaaguuuggcaa

SEQ ID NO: 1706151 - RNA, 20 nt, Salmonella enterica enterica serovar Typhi
gcauacucuccuccauaccu

SEQ ID NO: 1706152 - RNA, 19 nt, Salmonella enterica enterica serovar Typhi
gcauacaggucuuuccgac

SEQ ID NO: 1706153 - RNA, 23 nt, Salmonella enterica enterica serovar Typhi
gcauacauucuguuuucgagccu

SEQ ID NO: 1706154 - RNA, 23 nt, Salmonella enterica enterica serovar Typhi
gcauacagcgauaaccgccgccg

SEQ ID NO: 1706155 - RNA, 19 nt, Salmonella enterica enterica serovar Typhi
gcaguagauucuaucuguu

SEQ ID NO: 1706156 - RNA, 12 nt, Salmonella enterica enterica serovar Typhi
gcaguagccaug

SEQ ID NO: 1706157 - RNA, 22 nt, Salmonella enterica enterica serovar Typhi
gcaguagcgcuuugacaucggg

SEQ ID NO: 1706158 - RNA, 14 nt, Salmonella enterica enterica serovar Typhi
gcauagaaaaagaa

SEQ ID NO: 1706159 - RNA, 14 nt, Salmonella enterica enterica serovar Typhi
gcauauccagcgcc

SEQ ID NO: 1706160 - RNA, 17 nt, Salmonella enterica enterica serovar Typhi
gcauauacucacugaau

SEQ ID NO: 1706161 - RNA, 18 nt, Salmonella enterica enterica serovar Typhi
gcauauaagagacgccaa

SEQ ID NO: 1706162 - RNA, 14 nt, Salmonella enterica enterica serovar Typhi
gcaucacaugcggg

SEQ ID NO: 1706163 - RNA, 18 nt, Salmonella enterica enterica serovar Typhi
gcaucaaugcccagcgca

SEQ ID NO: 1706164 - RNA, 14 nt, Salmonella enterica enterica serovar Typhi
gccaacaacaggcc

SEQ ID NO: 1706165 - RNA, 20 nt, Salmonella enterica enterica serovar Typhi
gccaacaacaggccgccgag

SEQ ID NO: 1706166 - RNA, 17 nt, Salmonella enterica enterica serovar Typhi
gccaaaccugccacagg

SEQ ID NO: 1706167 - RNA, 21 nt, Salmonella enterica enterica serovar Typhi
gccaacagccgcccacaaccg

SEQ ID NO: 1706168 - RNA, 13 nt, Salmonella enterica enterica serovar Typhi
gccaaccagaccg

SEQ ID NO: 1706169 - RNA, 21 nt, Salmonella enterica enterica serovar Typhi
gccaaccagcgcuuugcggcu

SEQ ID NO: 1706170 - RNA, 22 nt, Salmonella enterica enterica serovar Typhi
gccaacgaccggcgcagcgccc

SEQ ID NO: 1706171 - RNA, 21 nt, Salmonella enterica enterica serovar Typhi
gccaaccgugagcgcgccgca

SEQ ID NO: 1706172 - RNA, 19 nt, Salmonella enterica enterica serovar Typhi
gccaaccgugagcgcgccg

SEQ ID NO: 1706173 - RNA, 15 nt, Salmonella enterica enterica serovar Typhi
gccaacgccagcagc

SEQ ID NO: 1706174 - RNA, 18 nt, Salmonella enterica enterica serovar Typhi
gccaacgagaauaagacc

SEQ ID NO: 1706175 - RNA, 16 nt, Salmonella enterica enterica serovar Typhi
gccaacgauacagcac

SEQ ID NO: 1706176 - RNA, 17 nt, Salmonella enterica enterica serovar Typhi
gccaacguccgccguca

SEQ ID NO: 1706177 - RNA, 18 nt, Salmonella enterica enterica serovar Typhi
gccaagcagcgccacgcc

SEQ ID NO: 1706178 - RNA, 20 nt, Salmonella enterica enterica serovar Typhi
gccaagaccgccuaacagcg

SEQ ID NO: 1706179 - RNA, 21 nt, Salmonella enterica enterica serovar Typhi
gccaaucggcgucuugccgca

SEQ ID NO: 1706180 - RNA, 14 nt, Salmonella enterica enterica serovar Typhi
gccaaucgccgccg

SEQ ID NO: 1706181 - RNA, 12 nt, Salmonella enterica enterica serovar Typhi
gccaauccugca

SEQ ID NO: 1706182 - RNA, 18 nt, Salmonella enterica enterica serovar Typhi
gccaaugccggacgccac

SEQ ID NO: 1706183 - RNA, 15 nt, Salmonella enterica enterica serovar Typhi
gccaauuccgccaua

SEQ ID NO: 1706184 - RNA, 22 nt, Salmonella enterica enterica serovar Typhi
gccaauggcucaacuccgccgg

SEQ ID NO: 1706185 - RNA, 21 nt, Salmonella enterica enterica serovar Typhi
gccaauguacguaaaaccagc

SEQ ID NO: 1706186 - RNA, 21 nt, Salmonella enterica enterica serovar Typhi
gccacaaccgcccccaacuga

SEQ ID NO: 1706187 - RNA, 17 nt, Salmonella enterica enterica serovar Typhi
gccaaguaauaaagaga

SEQ ID NO: 1706188 - RNA, 21 nt, Salmonella enterica enterica serovar Typhi
gccaaguaauaaagagaacga

SEQ ID NO: 1706189 - RNA, 17 nt, Salmonella enterica enterica serovar Typhi
gccaauaacgccuggug

SEQ ID NO: 1706190 - RNA, 19 nt, Salmonella enterica enterica serovar Typhi
gccaauaauuaguuuuacc

SEQ ID NO: 1706191 - RNA, 18 nt, Salmonella enterica enterica serovar Typhi
gccaauaaccaccuguuc

SEQ ID NO: 1706192 - RNA, 20 nt, Salmonella enterica enterica serovar Typhi
gccaaucaccgccagcaacg

SEQ ID NO: 1706193 - RNA, 18 nt, Salmonella enterica enterica serovar Typhi
gccaauauugacguuaaa

SEQ ID NO: 1706194 - RNA, 17 nt, Salmonella enterica enterica serovar Typhi
gccaaucaacgccgcca

SEQ ID NO: 1706195 - RNA, 17 nt, Salmonella enterica enterica serovar Typhi
gccaagcgcggacagca

SEQ ID NO: 1706196 - RNA, 19 nt, Salmonella enterica enterica serovar Typhi
gccaagcggcaucucgcca

SEQ ID NO: 1706197 - RNA, 16 nt, Salmonella enterica enterica serovar Typhi
gccaagcgcggcagca

SEQ ID NO: 1706198 - RNA, 19 nt, Salmonella enterica enterica serovar Typhi
gccaagcgcggcagcagcu

SEQ ID NO: 1706199 - RNA, 21 nt, Salmonella enterica enterica serovar Typhi
gccacggcguguugaaauccu

SEQ ID NO: 1706200 - RNA, 15 nt, Salmonella enterica enterica serovar Typhi
gccacgguuggccca

SEQ ID NO: 1706201 - RNA, 20 nt, Salmonella enterica enterica serovar Typhi
gccacgagaaauccacauua

SEQ ID NO: 1706202 - RNA, 16 nt, Salmonella enterica enterica serovar Typhi
gccacgaucggcaaug

SEQ ID NO: 1706203 - RNA, 15 nt, Salmonella enterica enterica serovar Typhi
gccaccuuucugcuc

SEQ ID NO: 1706204 - RNA, 11 nt, Salmonella enterica enterica serovar Typhi
gccacuggccu

SEQ ID NO: 1706205 - RNA, 20 nt, Salmonella enterica enterica serovar Typhi
gccacugcccuggaagaacu

SEQ ID NO: 1706206 - RNA, 17 nt, Salmonella enterica enterica serovar Typhi
gccacugcugaaagccg

SEQ ID NO: 1706207 - RNA, 22 nt, Salmonella enterica enterica serovar Typhi
gccacugcugaaagccgcgacg

SEQ ID NO: 1706208 - RNA, 15 nt, Salmonella enterica enterica serovar Typhi
gccacugcuggccca

SEQ ID NO: 1706209 - RNA, 12 nt, Salmonella enterica enterica serovar Typhi
gccacucuccag

SEQ ID NO: 1706210 - RNA, 14 nt, Salmonella enterica enterica serovar Typhi
gccacguucuucca

SEQ ID NO: 1706211 - RNA, 19 nt, Salmonella enterica enterica serovar Typhi
gccacucacggcaaguaua

SEQ ID NO: 1706212 - RNA, 15 nt, Salmonella enterica enterica serovar Typhi
gccacuccuuacggu

SEQ ID NO: 1706213 - RNA, 22 nt, Salmonella enterica enterica serovar Typhi
gccacuauuucggcacugacuc

SEQ ID NO: 1706214 - RNA, 20 nt, Salmonella enterica enterica serovar Typhi
gccacagcgccagacacugg

SEQ ID NO: 1706215 - RNA, 18 nt, Salmonella enterica enterica serovar Typhi
gccacaggcggcaugggu

SEQ ID NO: 1706216 - RNA, 15 nt, Salmonella enterica enterica serovar Typhi
gccaccccaaaucuc

SEQ ID NO: 1706217 - RNA, 14 nt, Salmonella enterica enterica serovar Typhi
gccacccgacaagg

SEQ ID NO: 1706218 - RNA, 13 nt, Salmonella enterica enterica serovar Typhi
gccacccggcuuu

SEQ ID NO: 1706219 - RNA, 22 nt, Salmonella enterica enterica serovar Typhi
gccaccuuaaucgacuucaugc

SEQ ID NO: 1706220 - RNA, 20 nt, Salmonella enterica enterica serovar Typhi
gccaccuguuucgccaggcc

SEQ ID NO: 1706221 - RNA, 21 nt, Salmonella enterica enterica serovar Typhi
gccaccggguuaaagcccuga

SEQ ID NO: 1706222 - RNA, 21 nt, Salmonella enterica enterica serovar Typhi
gccaccgggcaacacacgcuu

SEQ ID NO: 1706223 - RNA, 17 nt, Salmonella enterica enterica serovar Typhi
gccaccgggcaacccgg

SEQ ID NO: 1706224 - RNA, 15 nt, Salmonella enterica enterica serovar Typhi
gccaccgggcauggc

SEQ ID NO: 1706225 - RNA, 17 nt, Salmonella enterica enterica serovar Typhi
gccaccggcacauccag

SEQ ID NO: 1706226 - RNA, 16 nt, Salmonella enterica enterica serovar Typhi
gccaccgccagccaug

SEQ ID NO: 1706227 - RNA, 15 nt, Salmonella enterica enterica serovar Typhi
gccaccgccagcagu

SEQ ID NO: 1706228 - RNA, 15 nt, Salmonella enterica enterica serovar Typhi
gccccugggcgaaaa

SEQ ID NO: 1706229 - RNA, 19 nt, Salmonella enterica enterica serovar Typhi
gccccuguggaaucagucg

SEQ ID NO: 1706230 - RNA, 21 nt, Salmonella enterica enterica serovar Typhi
gccccugagcaaucaguucuc

SEQ ID NO: 1706231 - RNA, 20 nt, Salmonella enterica enterica serovar Typhi
gccccugcgucaccgugcca

SEQ ID NO: 1706232 - RNA, 14 nt, Salmonella enterica enterica serovar Typhi
gccccugcuggcga

SEQ ID NO: 1706233 - RNA, 23 nt, Salmonella enterica enterica serovar Typhi
gccccugcuggcgaaccaccagc

SEQ ID NO: 1706234 - RNA, 11 nt, Salmonella enterica enterica serovar Typhi
gccccucccug

SEQ ID NO: 1706235 - RNA, 12 nt, Salmonella enterica enterica serovar Typhi
gccccucccuga

SEQ ID NO: 1706236 - RNA, 20 nt, Salmonella enterica enterica serovar Typhi
gccccucgcuaaugcccggc

SEQ ID NO: 1706237 - RNA, 19 nt, Salmonella enterica enterica serovar Typhi
gccccugaaauaacagacu

SEQ ID NO: 1706238 - RNA, 16 nt, Salmonella enterica enterica serovar Typhi
gccccuaaggcagcaa

SEQ ID NO: 1706239 - RNA, 20 nt, Salmonella enterica enterica serovar Typhi
gccccucaauuauguauuuc

SEQ ID NO: 1706240 - RNA, 15 nt, Salmonella enterica enterica serovar Typhi
gcccgauggcgcugc

SEQ ID NO: 1706241 - RNA, 20 nt, Salmonella enterica enterica serovar Typhi
gcccgauggcgcugcgcgca

SEQ ID NO: 1706242 - RNA, 18 nt, Salmonella enterica enterica serovar Typhi
gcccgaccacgcccagcu

SEQ ID NO: 1706243 - RNA, 16 nt, Salmonella enterica enterica serovar Typhi
gcccgcauucgcggca

SEQ ID NO: 1706244 - RNA, 15 nt, Salmonella enterica enterica serovar Typhi
gcccccaugccgccu

SEQ ID NO: 1706245 - RNA, 17 nt, Salmonella enterica enterica serovar Typhi
gccccgccacagccgca

SEQ ID NO: 1706246 - RNA, 22 nt, Salmonella enterica enterica serovar Typhi
gccccgcuucccgaaaggaagc

SEQ ID NO: 1706247 - RNA, 14 nt, Salmonella enterica enterica serovar Typhi
gccccagcgccagc

SEQ ID NO: 1706248 - RNA, 11 nt, Salmonella enterica enterica serovar Typhi
gccccagcgcc

SEQ ID NO: 1706249 - RNA, 12 nt, Salmonella enterica enterica serovar Typhi
gccccagcgcca

SEQ ID NO: 1706250 - RNA, 17 nt, Salmonella enterica enterica serovar Typhi
gccccagcgccagccgc

SEQ ID NO: 1706251 - RNA, 17 nt, Salmonella enterica enterica serovar Typhi
gccccagcccugugccg

SEQ ID NO: 1706252 - RNA, 16 nt, Salmonella enterica enterica serovar Typhi
gccccagcaccagagc

SEQ ID NO: 1706253 - RNA, 14 nt, Salmonella enterica enterica serovar Typhi
gccccagcacaauc

SEQ ID NO: 1706254 - RNA, 12 nt, Salmonella enterica enterica serovar Typhi
gccccagcacca

SEQ ID NO: 1706255 - RNA, 18 nt, Salmonella enterica enterica serovar Typhi
gccccagcaugagccagc

SEQ ID NO: 1706256 - RNA, 23 nt, Salmonella enterica enterica serovar Typhi
gccccagguuugaggcuugcagc

SEQ ID NO: 1706257 - RNA, 17 nt, Salmonella enterica enterica serovar Typhi
gcccccauacgcgcgcc

SEQ ID NO: 1706258 - RNA, 13 nt, Salmonella enterica enterica serovar Typhi
gcccaauagcgcu

SEQ ID NO: 1706259 - RNA, 18 nt, Salmonella enterica enterica serovar Typhi
gcccagaggugaaccauu

SEQ ID NO: 1706260 - RNA, 14 nt, Salmonella enterica enterica serovar Typhi
gcccagcagcagaa

SEQ ID NO: 1706261 - RNA, 19 nt, Salmonella enterica enterica serovar Typhi
gcccagcaacacagccagc

SEQ ID NO: 1706262 - RNA, 20 nt, Salmonella enterica enterica serovar Typhi
gcccagcacuaacagcagca

SEQ ID NO: 1706263 - RNA, 16 nt, Salmonella enterica enterica serovar Typhi
gcccagccugccugcc

SEQ ID NO: 1706264 - RNA, 13 nt, Salmonella enterica enterica serovar Typhi
gcccagcgccgga

SEQ ID NO: 1706265 - RNA, 15 nt, Salmonella enterica enterica serovar Typhi
gcccaucugacgugc

SEQ ID NO: 1706266 - RNA, 21 nt, Salmonella enterica enterica serovar Typhi
gcccaugauggugaacagaau

SEQ ID NO: 1706267 - RNA, 15 nt, Salmonella enterica enterica serovar Typhi
gcccaugccgcccag

SEQ ID NO: 1706268 - RNA, 20 nt, Salmonella enterica enterica serovar Typhi
gcccauggcaggcagcacaa

SEQ ID NO: 1706269 - RNA, 17 nt, Salmonella enterica enterica serovar Typhi
gcccauggcaggcagca

SEQ ID NO: 1706270 - RNA, 14 nt, Salmonella enterica enterica serovar Typhi
gcccaggcggcggg

SEQ ID NO: 1706271 - RNA, 15 nt, Salmonella enterica enterica serovar Typhi
gcccaguaccagcac

SEQ ID NO: 1706272 - RNA, 22 nt, Salmonella enterica enterica serovar Typhi
gcccaggcggguagucccagga

SEQ ID NO: 1706273 - RNA, 13 nt, Salmonella enterica enterica serovar Typhi
gcccagugcccga

SEQ ID NO: 1706274 - RNA, 13 nt, Salmonella enterica enterica serovar Typhi
gccccaauaccac

SEQ ID NO: 1706275 - RNA, 18 nt, Salmonella enterica enterica serovar Typhi
gccccacacggccaccau

SEQ ID NO: 1706276 - RNA, 16 nt, Salmonella enterica enterica serovar Typhi
gcccauuuuccuccca

SEQ ID NO: 1706277 - RNA, 14 nt, Salmonella enterica enterica serovar Typhi
gccccaccgccaga

SEQ ID NO: 1706278 - RNA, 12 nt, Salmonella enterica enterica serovar Typhi
gccccaccgcca

SEQ ID NO: 1706279 - RNA, 13 nt, Salmonella enterica enterica serovar Typhi
gccccacuggccc

SEQ ID NO: 1706280 - RNA, 17 nt, Salmonella enterica enterica serovar Typhi
gccccacuggcccccug

SEQ ID NO: 1706281 - RNA, 18 nt, Salmonella enterica enterica serovar Typhi
gccccagauacgcacggu

SEQ ID NO: 1706282 - RNA, 23 nt, Salmonella enterica enterica serovar Typhi
gccagucauuaauucccgcagcc

SEQ ID NO: 1706283 - RNA, 13 nt, Salmonella enterica enterica serovar Typhi
gccagucaucgcc

SEQ ID NO: 1706284 - RNA, 19 nt, Salmonella enterica enterica serovar Typhi
gccaguccugccaccagcg

SEQ ID NO: 1706285 - RNA, 16 nt, Salmonella enterica enterica serovar Typhi
gccaguccugccacca

SEQ ID NO: 1706286 - RNA, 17 nt, Salmonella enterica enterica serovar Typhi
gccagucgcagcaaacg

SEQ ID NO: 1706287 - RNA, 15 nt, Salmonella enterica enterica serovar Typhi
gccagucgccaggca

SEQ ID NO: 1706288 - RNA, 17 nt, Salmonella enterica enterica serovar Typhi
gccagucgccaggcaag

SEQ ID NO: 1706289 - RNA, 13 nt, Salmonella enterica enterica serovar Typhi
gccaguccagguu

SEQ ID NO: 1706290 - RNA, 18 nt, Salmonella enterica enterica serovar Typhi
gccaguacagcagcgacg

SEQ ID NO: 1706291 - RNA, 15 nt, Salmonella enterica enterica serovar Typhi
gccaguaaucggcgc

SEQ ID NO: 1706292 - RNA, 20 nt, Salmonella enterica enterica serovar Typhi
gccaguagauggcgcuaaaa

SEQ ID NO: 1706293 - RNA, 22 nt, Salmonella enterica enterica serovar Typhi
gccaguagcggaauaucuuccc

SEQ ID NO: 1706294 - RNA, 17 nt, Salmonella enterica enterica serovar Typhi
gccaguagcucgccgcu

SEQ ID NO: 1706295 - RNA, 18 nt, Salmonella enterica enterica serovar Typhi
gccaguaucgcgccgcca

SEQ ID NO: 1706296 - RNA, 20 nt, Salmonella enterica enterica serovar Typhi
gccaguuaaugccgacccac

SEQ ID NO: 1706297 - RNA, 19 nt, Salmonella enterica enterica serovar Typhi
gccaguucauucgccacca

SEQ ID NO: 1706298 - RNA, 17 nt, Salmonella enterica enterica serovar Typhi
gccaguuaucaggacau

SEQ ID NO: 1706299 - RNA, 14 nt, Salmonella enterica enterica serovar Typhi
gccaguucgccggc

SEQ ID NO: 1706300 - RNA, 15 nt, Salmonella enterica enterica serovar Typhi
gccaguuggccggau

SEQ ID NO: 1706301 - RNA, 18 nt, Salmonella enterica enterica serovar Typhi
gccaguugcgcaggguau

SEQ ID NO: 1706302 - RNA, 20 nt, Salmonella enterica enterica serovar Typhi
gccagugggcgucaaaaucc

SEQ ID NO: 1706303 - RNA, 22 nt, Salmonella enterica enterica serovar Typhi
gccagucuuugcaggaggcgcg

SEQ ID NO: 1706304 - RNA, 18 nt, Salmonella enterica enterica serovar Typhi
gccagucuuauuguccug

SEQ ID NO: 1706305 - RNA, 21 nt, Salmonella enterica enterica serovar Typhi
gccagugacgacgccagauaa

SEQ ID NO: 1706306 - RNA, 20 nt, Salmonella enterica enterica serovar Typhi
gccagggaaauggcgaacag

SEQ ID NO: 1706307 - RNA, 22 nt, Salmonella enterica enterica serovar Typhi
gccacuucacuggcggcaagcu

SEQ ID NO: 1706308 - RNA, 18 nt, Salmonella enterica enterica serovar Typhi
gccacuucacuggcggca

SEQ ID NO: 1706309 - RNA, 18 nt, Salmonella enterica enterica serovar Typhi
gccacuuccagcgcgccg

SEQ ID NO: 1706310 - RNA, 19 nt, Salmonella enterica enterica serovar Typhi
gccaggggaugauuuucag

SEQ ID NO: 1706311 - RNA, 18 nt, Salmonella enterica enterica serovar Typhi
gccagggcggaagcagau

SEQ ID NO: 1706312 - RNA, 21 nt, Salmonella enterica enterica serovar Typhi
gccagggcgggauccccugcu

SEQ ID NO: 1706313 - RNA, 20 nt, Salmonella enterica enterica serovar Typhi
gccagguugcgcccggcgca

SEQ ID NO: 1706314 - RNA, 22 nt, Salmonella enterica enterica serovar Typhi
gccagguugcgcccggcgcauc

SEQ ID NO: 1706315 - RNA, 19 nt, Salmonella enterica enterica serovar Typhi
gccaucccaugcaccaguc

SEQ ID NO: 1706316 - RNA, 19 nt, Salmonella enterica enterica serovar Typhi
gccaucccgcugaucgccg

SEQ ID NO: 1706317 - RNA, 22 nt, Salmonella enterica enterica serovar Typhi
gccauccgacgccuuuaccacc

SEQ ID NO: 1706318 - RNA, 11 nt, Salmonella enterica enterica serovar Typhi
gccauccggcc

SEQ ID NO: 1706319 - RNA, 22 nt, Salmonella enterica enterica serovar Typhi
gccauccggcaaacucagcggc

SEQ ID NO: 1706320 - RNA, 20 nt, Salmonella enterica enterica serovar Typhi
gccauccggcaaauccucca

SEQ ID NO: 1706321 - RNA, 14 nt, Salmonella enterica enterica serovar Typhi
gccaucgcggcgca

SEQ ID NO: 1706322 - RNA, 14 nt, Salmonella enterica enterica serovar Typhi
gccaucgccucgau

SEQ ID NO: 1706323 - RNA, 18 nt, Salmonella enterica enterica serovar Typhi
gccauaguagaagugaag

SEQ ID NO: 1706324 - RNA, 17 nt, Salmonella enterica enterica serovar Typhi
gccaucagcaaaauacc

SEQ ID NO: 1706325 - RNA, 14 nt, Salmonella enterica enterica serovar Typhi
gccaucagcaccuu

SEQ ID NO: 1706326 - RNA, 14 nt, Salmonella enterica enterica serovar Typhi
gccauacacgcggc

SEQ ID NO: 1706327 - RNA, 23 nt, Salmonella enterica enterica serovar Typhi
gccauaaucaguacugcgcccgc

SEQ ID NO: 1706328 - RNA, 14 nt, Salmonella enterica enterica serovar Typhi
gccauaauacuuaa

SEQ ID NO: 1706329 - RNA, 18 nt, Salmonella enterica enterica serovar Typhi
gccauaacaacuauuuuu

SEQ ID NO: 1706330 - RNA, 13 nt, Salmonella enterica enterica serovar Typhi
gccauagaaagau

SEQ ID NO: 1706331 - RNA, 13 nt, Salmonella enterica enterica serovar Typhi
gccauagcgggca

SEQ ID NO: 1706332 - RNA, 15 nt, Salmonella enterica enterica serovar Typhi
gccaguuuguaacca

SEQ ID NO: 1706333 - RNA, 18 nt, Salmonella enterica enterica serovar Typhi
gccauaaagcuguaccug

SEQ ID NO: 1706334 - RNA, 12 nt, Salmonella enterica enterica serovar Typhi
gccaguuucucu

SEQ ID NO: 1706335 - RNA, 20 nt, Salmonella enterica enterica serovar Typhi
gccaguuguccgcuggucag

SEQ ID NO: 1706336 - RNA, 12 nt, Salmonella enterica enterica serovar Typhi
gccaguuuacgc

SEQ ID NO: 1706337 - RNA, 13 nt, Salmonella enterica enterica serovar Typhi
gccauuccaagaa

SEQ ID NO: 1706338 - RNA, 18 nt, Salmonella enterica enterica serovar Typhi
gccauucccagccgagcg

SEQ ID NO: 1706339 - RNA, 14 nt, Salmonella enterica enterica serovar Typhi
gccaugucuucacu

SEQ ID NO: 1706340 - RNA, 18 nt, Salmonella enterica enterica serovar Typhi
gccauucgcuuccgccgg

SEQ ID NO: 1706341 - RNA, 19 nt, Salmonella enterica enterica serovar Typhi
gccauucgcccagucauca

SEQ ID NO: 1706342 - RNA, 22 nt, Salmonella enterica enterica serovar Typhi
gccaugaccauucacacuccag

SEQ ID NO: 1706343 - RNA, 20 nt, Salmonella enterica enterica serovar Typhi
gccaugagacgcguaaauca

SEQ ID NO: 1706344 - RNA, 16 nt, Salmonella enterica enterica serovar Typhi
gccaugaucgccgcca

SEQ ID NO: 1706345 - RNA, 18 nt, Salmonella enterica enterica serovar Typhi
gccaugaucgccgccauc

SEQ ID NO: 1706346 - RNA, 15 nt, Salmonella enterica enterica serovar Typhi
gccaucguccagcca

SEQ ID NO: 1706347 - RNA, 14 nt, Salmonella enterica enterica serovar Typhi
gccaucucauucgc

SEQ ID NO: 1706348 - RNA, 14 nt, Salmonella enterica enterica serovar Typhi
gccaucgucacgca

SEQ ID NO: 1706349 - RNA, 13 nt, Salmonella enterica enterica serovar Typhi
gccauggcccuuu

SEQ ID NO: 1706350 - RNA, 14 nt, Salmonella enterica enterica serovar Typhi
gccauggagaaaca

SEQ ID NO: 1706351 - RNA, 22 nt, Salmonella enterica enterica serovar Typhi
gccaugcugugugaccagcagu

SEQ ID NO: 1706352 - RNA, 23 nt, Salmonella enterica enterica serovar Typhi
gccaugcaccacgacggccggac

SEQ ID NO: 1706353 - RNA, 16 nt, Salmonella enterica enterica serovar Typhi
gcccguagcucagcug

SEQ ID NO: 1706354 - RNA, 12 nt, Salmonella enterica enterica serovar Typhi
gcccgucagggg

SEQ ID NO: 1706355 - RNA, 17 nt, Salmonella enterica enterica serovar Typhi
gcccguagcgacgccau

SEQ ID NO: 1706356 - RNA, 14 nt, Salmonella enterica enterica serovar Typhi
gcccguaaacaggc

SEQ ID NO: 1706357 - RNA, 13 nt, Salmonella enterica enterica serovar Typhi
gcccgguucaccg

SEQ ID NO: 1706358 - RNA, 15 nt, Salmonella enterica enterica serovar Typhi
gcccguaaacaggcu

SEQ ID NO: 1706359 - RNA, 19 nt, Salmonella enterica enterica serovar Typhi
gcccguaaacaggcugccc

SEQ ID NO: 1706360 - RNA, 23 nt, Salmonella enterica enterica serovar Typhi
gcccgguagcgcaaacuaccggg

SEQ ID NO: 1706361 - RNA, 14 nt, Salmonella enterica enterica serovar Typhi
gcccgguauuuuuu

SEQ ID NO: 1706362 - RNA, 14 nt, Salmonella enterica enterica serovar Typhi
gcccgguggcgcug

SEQ ID NO: 1706363 - RNA, 15 nt, Salmonella enterica enterica serovar Typhi
gcccgguggcgcugc

SEQ ID NO: 1706364 - RNA, 20 nt, Salmonella enterica enterica serovar Typhi
gcccgguucgaacgacagaa

SEQ ID NO: 1706365 - RNA, 13 nt, Salmonella enterica enterica serovar Typhi
gcccgccagcggg

SEQ ID NO: 1706366 - RNA, 12 nt, Salmonella enterica enterica serovar Typhi
gcccgccagcac

SEQ ID NO: 1706367 - RNA, 14 nt, Salmonella enterica enterica serovar Typhi
gcccgcccagcauu

SEQ ID NO: 1706368 - RNA, 16 nt, Salmonella enterica enterica serovar Typhi
gcccgguaagcgcagc

SEQ ID NO: 1706369 - RNA, 15 nt, Salmonella enterica enterica serovar Typhi
gcccucgcaaagcug

SEQ ID NO: 1706370 - RNA, 14 nt, Salmonella enterica enterica serovar Typhi
gcccgugacgccag

SEQ ID NO: 1706371 - RNA, 18 nt, Salmonella enterica enterica serovar Typhi
gcccguuuuuuccagcgc

SEQ ID NO: 1706372 - RNA, 19 nt, Salmonella enterica enterica serovar Typhi
gcccguuuuuuccagcgcc

SEQ ID NO: 1706373 - RNA, 18 nt, Salmonella enterica enterica serovar Typhi
gcccuaaaaauagcacca

SEQ ID NO: 1706374 - RNA, 17 nt, Salmonella enterica enterica serovar Typhi
gcccguucucgccgcgu

SEQ ID NO: 1706375 - RNA, 17 nt, Salmonella enterica enterica serovar Typhi
gcccuggcgggaaacag

SEQ ID NO: 1706376 - RNA, 19 nt, Salmonella enterica enterica serovar Typhi
gcccuggcucaauccaggu

SEQ ID NO: 1706377 - RNA, 15 nt, Salmonella enterica enterica serovar Typhi
gcccuucaucuucca

SEQ ID NO: 1706378 - RNA, 16 nt, Salmonella enterica enterica serovar Typhi
gcccuucaucuuccag

SEQ ID NO: 1706379 - RNA, 14 nt, Salmonella enterica enterica serovar Typhi
gcccuuccagcagc

SEQ ID NO: 1706380 - RNA, 22 nt, Salmonella enterica enterica serovar Typhi
gcccuucgucaggaggccugaa

SEQ ID NO: 1706381 - RNA, 11 nt, Salmonella enterica enterica serovar Typhi
gcccuuucuua

SEQ ID NO: 1706382 - RNA, 13 nt, Salmonella enterica enterica serovar Typhi
gcccuuucuucaa

SEQ ID NO: 1706383 - RNA, 12 nt, Salmonella enterica enterica serovar Typhi
gcccuuugcccu

SEQ ID NO: 1706384 - RNA, 18 nt, Salmonella enterica enterica serovar Typhi
gcccuuuuccagaaaacc

SEQ ID NO: 1706385 - RNA, 16 nt, Salmonella enterica enterica serovar Typhi
gcccugauggcgcgcc

SEQ ID NO: 1706386 - RNA, 22 nt, Salmonella enterica enterica serovar Typhi
gcccugacgccgcuguuuucac

SEQ ID NO: 1706387 - RNA, 17 nt, Salmonella enterica enterica serovar Typhi
gcccucuuuaucaaaca

SEQ ID NO: 1706388 - RNA, 23 nt, Salmonella enterica enterica serovar Typhi
gcccugaagggcggcuggauaaa

SEQ ID NO: 1706389 - RNA, 23 nt, Salmonella enterica enterica serovar Typhi
gcccucuaagcgcucaaauaaug

SEQ ID NO: 1706390 - RNA, 22 nt, Salmonella enterica enterica serovar Typhi
gccgacaugguuaaccaccagc

SEQ ID NO: 1706391 - RNA, 21 nt, Salmonella enterica enterica serovar Typhi
gccgacaucacgcaaaugcag

SEQ ID NO: 1706392 - RNA, 17 nt, Salmonella enterica enterica serovar Typhi
gccgacaucgcucccgg

SEQ ID NO: 1706393 - RNA, 16 nt, Salmonella enterica enterica serovar Typhi
gccgacgauuugcgcu

SEQ ID NO: 1706394 - RNA, 21 nt, Salmonella enterica enterica serovar Typhi
gccgacaggcagguugccgau

SEQ ID NO: 1706395 - RNA, 22 nt, Salmonella enterica enterica serovar Typhi
gccgacauaagugcaggcugag

SEQ ID NO: 1706396 - RNA, 19 nt, Salmonella enterica enterica serovar Typhi
gccgacauagcugaacaau

SEQ ID NO: 1706397 - RNA, 15 nt, Salmonella enterica enterica serovar Typhi
aaagcguuucaucau

SEQ ID NO: 1706398 - RNA, 19 nt, Salmonella enterica enterica serovar Typhi
aaagcgucaguaaaagccc

SEQ ID NO: 1706399 - RNA, 14 nt, Salmonella enterica enterica serovar Typhi
gccgaagugcgcgc

SEQ ID NO: 1706400 - RNA, 15 nt, Salmonella enterica enterica serovar Typhi
gccgaagcaggcgga

SEQ ID NO: 1706401 - RNA, 16 nt, Salmonella enterica enterica serovar Typhi
gccgaucaggccgcag

SEQ ID NO: 1706402 - RNA, 18 nt, Salmonella enterica enterica serovar Typhi
gccgauggcuaaagcgcu

SEQ ID NO: 1706403 - RNA, 13 nt, Salmonella enterica enterica serovar Typhi
gccgauggcgcuc

SEQ ID NO: 1706404 - RNA, 13 nt, Salmonella enterica enterica serovar Typhi
gccgauuucauuc

SEQ ID NO: 1706405 - RNA, 21 nt, Salmonella enterica enterica serovar Typhi
gccgaguagcugagcgucagg

SEQ ID NO: 1706406 - RNA, 19 nt, Salmonella enterica enterica serovar Typhi
gccgagggcauugaugguu

SEQ ID NO: 1706407 - RNA, 15 nt, Salmonella enterica enterica serovar Typhi
gccgacgccacccag

SEQ ID NO: 1706408 - RNA, 16 nt, Salmonella enterica enterica serovar Typhi
gccgacgccacccagc

SEQ ID NO: 1706409 - RNA, 20 nt, Salmonella enterica enterica serovar Typhi
gccgacgccacccagcgaac

SEQ ID NO: 1706410 - RNA, 16 nt, Salmonella enterica enterica serovar Typhi
gccgacgcucuuccuc

SEQ ID NO: 1706411 - RNA, 20 nt, Salmonella enterica enterica serovar Typhi
gccgccaguugcucaacauu

SEQ ID NO: 1706412 - RNA, 20 nt, Salmonella enterica enterica serovar Typhi
gccgccauccggcacaguau

SEQ ID NO: 1706413 - RNA, 13 nt, Salmonella enterica enterica serovar Typhi
gccgccauccggc

SEQ ID NO: 1706414 - RNA, 18 nt, Salmonella enterica enterica serovar Typhi
gccgccaucgucgccacc

SEQ ID NO: 1706415 - RNA, 12 nt, Salmonella enterica enterica serovar Typhi
gccgccauggcg

SEQ ID NO: 1706416 - RNA, 21 nt, Salmonella enterica enterica serovar Typhi
gccgccauucgcuuccgccgg

SEQ ID NO: 1706417 - RNA, 16 nt, Salmonella enterica enterica serovar Typhi
gccgccauuaauacca

SEQ ID NO: 1706418 - RNA, 23 nt, Salmonella enterica enterica serovar Typhi
gccgccauucgcuuccgccggga

SEQ ID NO: 1706419 - RNA, 14 nt, Salmonella enterica enterica serovar Typhi
gccgccauuaauac

SEQ ID NO: 1706420 - RNA, 23 nt, Salmonella enterica enterica serovar Typhi
gccgccaucuuuacccugagccu

SEQ ID NO: 1706421 - RNA, 17 nt, Salmonella enterica enterica serovar Typhi
gccgccaccacaaagcg

SEQ ID NO: 1706422 - RNA, 20 nt, Salmonella enterica enterica serovar Typhi
gccgccaaacugcgcgccgc

SEQ ID NO: 1706423 - RNA, 23 nt, Salmonella enterica enterica serovar Typhi
gccgccaaacugcgcgccgcccu

SEQ ID NO: 1706424 - RNA, 19 nt, Salmonella enterica enterica serovar Typhi
gccgccaaacugcgcgccg

SEQ ID NO: 1706425 - RNA, 16 nt, Salmonella enterica enterica serovar Typhi
gccgcaggacagcgac

SEQ ID NO: 1706426 - RNA, 18 nt, Salmonella enterica enterica serovar Typhi
gccgcaauuccugacugc

SEQ ID NO: 1706427 - RNA, 18 nt, Salmonella enterica enterica serovar Typhi
gccgcaaugaccacaaau

SEQ ID NO: 1706428 - RNA, 21 nt, Salmonella enterica enterica serovar Typhi
gccgcaaugaccacaaauucu

SEQ ID NO: 1706429 - RNA, 20 nt, Salmonella enterica enterica serovar Typhi
gccgcaaucacuucauacga

SEQ ID NO: 1706430 - RNA, 22 nt, Salmonella enterica enterica serovar Typhi
gccgcaggaaagugccugggga

SEQ ID NO: 1706431 - RNA, 18 nt, Salmonella enterica enterica serovar Typhi
gccgccgaggcuaagcca

SEQ ID NO: 1706432 - RNA, 20 nt, Salmonella enterica enterica serovar Typhi
aaagcuggauaucacgcgcg

SEQ ID NO: 1706433 - RNA, 16 nt, Salmonella enterica enterica serovar Typhi
gccgccgacaaccagc

SEQ ID NO: 1706434 - RNA, 18 nt, Salmonella enterica enterica serovar Typhi
gccgcccccaugccgccu

SEQ ID NO: 1706435 - RNA, 19 nt, Salmonella enterica enterica serovar Typhi
gccgcccaucgccacagcg

SEQ ID NO: 1706436 - RNA, 23 nt, Salmonella enterica enterica serovar Typhi
gccgcccauuaauaucagcccca

SEQ ID NO: 1706437 - RNA, 18 nt, Salmonella enterica enterica serovar Typhi
gccgcccaucgccacagc

SEQ ID NO: 1706438 - RNA, 11 nt, Salmonella enterica enterica serovar Typhi
gccgcccaggc

SEQ ID NO: 1706439 - RNA, 20 nt, Salmonella enterica enterica serovar Typhi
gccgccauuuuauccaggcc

SEQ ID NO: 1706440 - RNA, 23 nt, Salmonella enterica enterica serovar Typhi
gccgccauuuuauccaggccagc

SEQ ID NO: 1706441 - RNA, 14 nt, Salmonella enterica enterica serovar Typhi
gccgcgcgccgccu

SEQ ID NO: 1706442 - RNA, 15 nt, Salmonella enterica enterica serovar Typhi
gccgcgcgccgccuc

SEQ ID NO: 1706443 - RNA, 13 nt, Salmonella enterica enterica serovar Typhi
gccgcgcgccgcc

SEQ ID NO: 1706444 - RNA, 13 nt, Salmonella enterica enterica serovar Typhi
gccgcgcccagca

SEQ ID NO: 1706445 - RNA, 16 nt, Salmonella enterica enterica serovar Typhi
gccgcgccagacgcca

SEQ ID NO: 1706446 - RNA, 19 nt, Salmonella enterica enterica serovar Typhi
gccgcgagagucgccagga

SEQ ID NO: 1706447 - RNA, 20 nt, Salmonella enterica enterica serovar Typhi
gccgcgagaacuuccgccac

SEQ ID NO: 1706448 - RNA, 17 nt, Salmonella enterica enterica serovar Typhi
gccgccugaugcuggca

SEQ ID NO: 1706449 - RNA, 13 nt, Salmonella enterica enterica serovar Typhi
gcgacagcgcgcc

SEQ ID NO: 1706450 - RNA, 16 nt, Salmonella enterica enterica serovar Typhi
gcgacaucagccagcc

SEQ ID NO: 1706451 - RNA, 14 nt, Salmonella enterica enterica serovar Typhi
gcgacaucagccag

SEQ ID NO: 1706452 - RNA, 21 nt, Salmonella enterica enterica serovar Typhi
gcgacagucgcagagcccagc

SEQ ID NO: 1706453 - RNA, 17 nt, Salmonella enterica enterica serovar Typhi
gcgaauuugccccagau

SEQ ID NO: 1706454 - RNA, 19 nt, Salmonella enterica enterica serovar Typhi
gcgacaacaaguccaagua

SEQ ID NO: 1706455 - RNA, 19 nt, Salmonella enterica enterica serovar Typhi
gcgacaaugaaccagccca

SEQ ID NO: 1706456 - RNA, 23 nt, Salmonella enterica enterica serovar Typhi
gcgacacgcgcgcugcgccugga

SEQ ID NO: 1706457 - RNA, 23 nt, Salmonella enterica enterica serovar Typhi
gcgaaacaggucggcaugcaucu

SEQ ID NO: 1706458 - RNA, 18 nt, Salmonella enterica enterica serovar Typhi
gcgaaucacauccgccag

SEQ ID NO: 1706459 - RNA, 15 nt, Salmonella enterica enterica serovar Typhi
gcgaauccggcggcu

SEQ ID NO: 1706460 - RNA, 15 nt, Salmonella enterica enterica serovar Typhi
gcgaauacgggaucg

SEQ ID NO: 1706461 - RNA, 15 nt, Salmonella enterica enterica serovar Typhi
gcgaauauacgcacc

SEQ ID NO: 1706462 - RNA, 18 nt, Salmonella enterica enterica serovar Typhi
gcgaauugcgaguaaccu

SEQ ID NO: 1706463 - RNA, 15 nt, Salmonella enterica enterica serovar Typhi
gcgacaaacagcgcc

SEQ ID NO: 1706464 - RNA, 22 nt, Salmonella enterica enterica serovar Typhi
gcgaauuuuauuaagcaggccg

SEQ ID NO: 1706465 - RNA, 16 nt, Salmonella enterica enterica serovar Typhi
gcgaauuucaccaccg

SEQ ID NO: 1706466 - RNA, 21 nt, Salmonella enterica enterica serovar Typhi
gcgaauuucggcaaugacggu

SEQ ID NO: 1706467 - RNA, 16 nt, Salmonella enterica enterica serovar Typhi
gcgaauuuccugccag

SEQ ID NO: 1706468 - RNA, 20 nt, Salmonella enterica enterica serovar Typhi
gcgaaugcaaccggaacuca

SEQ ID NO: 1706469 - RNA, 13 nt, Salmonella enterica enterica serovar Typhi
gcgaauggcggca

SEQ ID NO: 1706470 - RNA, 14 nt, Salmonella enterica enterica serovar Typhi
gcgaaugcgcgcca

SEQ ID NO: 1706471 - RNA, 20 nt, Salmonella enterica enterica serovar Typhi
gcgaaucucgugaucgccaa

SEQ ID NO: 1706472 - RNA, 15 nt, Salmonella enterica enterica serovar Typhi
gcgaaucuaccagau

SEQ ID NO: 1706473 - RNA, 23 nt, Salmonella enterica enterica serovar Typhi
gcgaauccgugcguaaaauauac

SEQ ID NO: 1706474 - RNA, 20 nt, Salmonella enterica enterica serovar Typhi
gcgaccaguucaccggcggc

SEQ ID NO: 1706475 - RNA, 13 nt, Salmonella enterica enterica serovar Typhi
gcgaccagcgcgc

SEQ ID NO: 1706476 - RNA, 15 nt, Salmonella enterica enterica serovar Typhi
gcgaccagcgcgcca

SEQ ID NO: 1706477 - RNA, 14 nt, Salmonella enterica enterica serovar Typhi
gcgaccacccgcga

SEQ ID NO: 1706478 - RNA, 13 nt, Salmonella enterica enterica serovar Typhi
gcgaccuucuccc

SEQ ID NO: 1706479 - RNA, 18 nt, Salmonella enterica enterica serovar Typhi
gcgacgacacggcgcaga

SEQ ID NO: 1706480 - RNA, 18 nt, Salmonella enterica enterica serovar Typhi
gcgacgacgccagccagc

SEQ ID NO: 1706481 - RNA, 22 nt, Salmonella enterica enterica serovar Typhi
gcgacgacuucacccgcgggcg

SEQ ID NO: 1706482 - RNA, 19 nt, Salmonella enterica enterica serovar Typhi
gcgacgacuucacccgcgg

SEQ ID NO: 1706483 - RNA, 21 nt, Salmonella enterica enterica serovar Typhi
gcgaccgcaucaaugcccagc

SEQ ID NO: 1706484 - RNA, 16 nt, Salmonella enterica enterica serovar Typhi
gcgaccgccgcugguc

SEQ ID NO: 1706485 - RNA, 16 nt, Salmonella enterica enterica serovar Typhi
gcgacugaaaaucaaa

SEQ ID NO: 1706486 - RNA, 17 nt, Salmonella enterica enterica serovar Typhi
gcgacguuaucucgcca

SEQ ID NO: 1706487 - RNA, 18 nt, Salmonella enterica enterica serovar Typhi
gcgacguuaucucgccag

SEQ ID NO: 1706488 - RNA, 18 nt, Salmonella enterica enterica serovar Typhi
gcgacguccgccaacagc

SEQ ID NO: 1706489 - RNA, 14 nt, Salmonella enterica enterica serovar Typhi
gcgacuucauucag

SEQ ID NO: 1706490 - RNA, 16 nt, Salmonella enterica enterica serovar Typhi
gcgacuuggaaaguug

SEQ ID NO: 1706491 - RNA, 12 nt, Salmonella enterica enterica serovar Typhi
gcgacugccgca

SEQ ID NO: 1706492 - RNA, 14 nt, Salmonella enterica enterica serovar Typhi
gcgacugccgcaga

SEQ ID NO: 1706493 - RNA, 20 nt, Salmonella enterica enterica serovar Typhi
gcgagcacuuuuuccuccug

SEQ ID NO: 1706494 - RNA, 11 nt, Salmonella enterica enterica serovar Typhi
gcgagaaaaaa

SEQ ID NO: 1706495 - RNA, 20 nt, Salmonella enterica enterica serovar Typhi
gcgacuuuccgccaccagau

SEQ ID NO: 1706496 - RNA, 18 nt, Salmonella enterica enterica serovar Typhi
gcgacgauaaaucgguuc

SEQ ID NO: 1706497 - RNA, 20 nt, Salmonella enterica enterica serovar Typhi
gcgacgauaaaucgguucau

SEQ ID NO: 1706498 - RNA, 22 nt, Salmonella enterica enterica serovar Typhi
gcgacgauaggcauacacaucu

SEQ ID NO: 1706499 - RNA, 16 nt, Salmonella enterica enterica serovar Typhi
gcgacgcggcgaguua

SEQ ID NO: 1706500 - RNA, 15 nt, Salmonella enterica enterica serovar Typhi
gcgacggggcgcaga

SEQ ID NO: 1706501 - RNA, 20 nt, Salmonella enterica enterica serovar Typhi
gcgacgguccuggccaggcu

SEQ ID NO: 1706502 - RNA, 18 nt, Salmonella enterica enterica serovar Typhi
gcgacguauuacgcaggc

SEQ ID NO: 1706503 - RNA, 19 nt, Salmonella enterica enterica serovar Typhi
gcgagcgcauacgcugucc

SEQ ID NO: 1706504 - RNA, 17 nt, Salmonella enterica enterica serovar Typhi
gcgagucagacaccagc

SEQ ID NO: 1706505 - RNA, 20 nt, Salmonella enterica enterica serovar Typhi
gcgaguccgcuuuucguccc

SEQ ID NO: 1706506 - RNA, 15 nt, Salmonella enterica enterica serovar Typhi
gcgagguucccgccg

SEQ ID NO: 1706507 - RNA, 17 nt, Salmonella enterica enterica serovar Typhi
gcgagguucccgccgcc

SEQ ID NO: 1706508 - RNA, 21 nt, Salmonella enterica enterica serovar Typhi
gcgauagagaccgcuuuagcc

SEQ ID NO: 1706509 - RNA, 15 nt, Salmonella enterica enterica serovar Typhi
gcgaucagcgccacc

SEQ ID NO: 1706510 - RNA, 17 nt, Salmonella enterica enterica serovar Typhi
gcgauaaggauaucuug

SEQ ID NO: 1706511 - RNA, 20 nt, Salmonella enterica enterica serovar Typhi
gcgauaaugaagcauaaaaa

SEQ ID NO: 1706512 - RNA, 19 nt, Salmonella enterica enterica serovar Typhi
gcgauaaucaacucuccuu

SEQ ID NO: 1706513 - RNA, 22 nt, Salmonella enterica enterica serovar Typhi
gccucuuggaugauuuucuucu

SEQ ID NO: 1706514 - RNA, 21 nt, Salmonella enterica enterica serovar Typhi
gccucuuucagaucgccgccg

SEQ ID NO: 1706515 - RNA, 17 nt, Salmonella enterica enterica serovar Typhi
gccucuuuugcauuaca

SEQ ID NO: 1706516 - RNA, 22 nt, Salmonella enterica enterica serovar Typhi
gccucuuuugucguccccugga

SEQ ID NO: 1706517 - RNA, 22 nt, Salmonella enterica enterica serovar Typhi
gccugaaugcagaccucugcuu

SEQ ID NO: 1706518 - RNA, 12 nt, Salmonella enterica enterica serovar Typhi
gccugaaugcuc

SEQ ID NO: 1706519 - RNA, 14 nt, Salmonella enterica enterica serovar Typhi
gccugaaccggugg

SEQ ID NO: 1706520 - RNA, 17 nt, Salmonella enterica enterica serovar Typhi
gccugaagcgcaguguu

SEQ ID NO: 1706521 - RNA, 18 nt, Salmonella enterica enterica serovar Typhi
gccuacgcgcucacggca

SEQ ID NO: 1706522 - RNA, 24 nt, Salmonella enterica enterica serovar Typhi
gccuacggaaagcuguuguugcuc

SEQ ID NO: 1706523 - RNA, 19 nt, Salmonella enterica enterica serovar Typhi
gccuaccggaauacacaau

SEQ ID NO: 1706524 - RNA, 20 nt, Salmonella enterica enterica serovar Typhi
gccucuuggaugauuuucuu

SEQ ID NO: 1706525 - RNA, 22 nt, Salmonella enterica enterica serovar Typhi
gccucaacaaguccuucuuccc

SEQ ID NO: 1706526 - RNA, 21 nt, Salmonella enterica enterica serovar Typhi
gccugacgaaagucauccagu

SEQ ID NO: 1706527 - RNA, 18 nt, Salmonella enterica enterica serovar Typhi
gccugacgaauagcgcgc

SEQ ID NO: 1706528 - RNA, 18 nt, Salmonella enterica enterica serovar Typhi
gccugacggcgcugucac

SEQ ID NO: 1706529 - RNA, 20 nt, Salmonella enterica enterica serovar Typhi
gccugauaaauaugucggcc

SEQ ID NO: 1706530 - RNA, 16 nt, Salmonella enterica enterica serovar Typhi
gccugauaagcacagg

SEQ ID NO: 1706531 - RNA, 12 nt, Salmonella enterica enterica serovar Typhi
gccugagcgcga

SEQ ID NO: 1706532 - RNA, 17 nt, Salmonella enterica enterica serovar Typhi
gccugauuucccaguug

SEQ ID NO: 1706533 - RNA, 13 nt, Salmonella enterica enterica serovar Typhi
gccugauuucuga

SEQ ID NO: 1706534 - RNA, 20 nt, Salmonella enterica enterica serovar Typhi
gccugcaaaccucucccccg

SEQ ID NO: 1706535 - RNA, 13 nt, Salmonella enterica enterica serovar Typhi
gccugauggcgcu

SEQ ID NO: 1706536 - RNA, 17 nt, Salmonella enterica enterica serovar Typhi
gccugauggcgcugcgc

SEQ ID NO: 1706537 - RNA, 14 nt, Salmonella enterica enterica serovar Typhi
gccugauucauucc

SEQ ID NO: 1706538 - RNA, 17 nt, Salmonella enterica enterica serovar Typhi
gccugaugacgcugcgc

SEQ ID NO: 1706539 - RNA, 12 nt, Salmonella enterica enterica serovar Typhi
gccugaucuuuc

SEQ ID NO: 1706540 - RNA, 15 nt, Salmonella enterica enterica serovar Typhi
gccugaucuuucugg

SEQ ID NO: 1706541 - RNA, 18 nt, Salmonella enterica enterica serovar Typhi
gccugaucgcgcagacag

SEQ ID NO: 1706542 - RNA, 13 nt, Salmonella enterica enterica serovar Typhi
gccugaucgccac

SEQ ID NO: 1706543 - RNA, 22 nt, Salmonella enterica enterica serovar Typhi
gccugauaagcauagcgccauc

SEQ ID NO: 1706544 - RNA, 13 nt, Salmonella enterica enterica serovar Typhi
gccugcagaccca

SEQ ID NO: 1706545 - RNA, 12 nt, Salmonella enterica enterica serovar Typhi
gccugcagaccc

SEQ ID NO: 1706546 - RNA, 20 nt, Salmonella enterica enterica serovar Typhi
gccugcacggcgucauucac

SEQ ID NO: 1706547 - RNA, 22 nt, Salmonella enterica enterica serovar Typhi
gccugcauaaaggaguaacaga

SEQ ID NO: 1706548 - RNA, 14 nt, Salmonella enterica enterica serovar Typhi
gccugccaaccggc

SEQ ID NO: 1706549 - RNA, 20 nt, Salmonella enterica enterica serovar Typhi
gccugcaucaccucagaauu

SEQ ID NO: 1706550 - RNA, 21 nt, Salmonella enterica enterica serovar Typhi
gccugccagauccaacacauc

SEQ ID NO: 1706551 - RNA, 13 nt, Salmonella enterica enterica serovar Typhi
gccugccauagca

SEQ ID NO: 1706552 - RNA, 16 nt, Salmonella enterica enterica serovar Typhi
gccugcgaucuguguc

SEQ ID NO: 1706553 - RNA, 14 nt, Salmonella enterica enterica serovar Typhi
gccugcgccgcagg

SEQ ID NO: 1706554 - RNA, 12 nt, Salmonella enterica enterica serovar Typhi
gccugcccaucu

SEQ ID NO: 1706555 - RNA, 15 nt, Salmonella enterica enterica serovar Typhi
gccugcucaucaggu

SEQ ID NO: 1706556 - RNA, 19 nt, Salmonella enterica enterica serovar Typhi
gccugcucaauacuuuccg

SEQ ID NO: 1706557 - RNA, 15 nt, Salmonella enterica enterica serovar Typhi
gccugcgucgcccca

SEQ ID NO: 1706558 - RNA, 18 nt, Salmonella enterica enterica serovar Typhi
gccugcguugcuauggca

SEQ ID NO: 1706559 - RNA, 23 nt, Salmonella enterica enterica serovar Typhi
gccugcgccuauuguuccaaugu

SEQ ID NO: 1706560 - RNA, 16 nt, Salmonella enterica enterica serovar Typhi
gccuuccagaaauaaa

SEQ ID NO: 1706561 - RNA, 12 nt, Salmonella enterica enterica serovar Typhi
gccuuccagcaa

SEQ ID NO: 1706562 - RNA, 22 nt, Salmonella enterica enterica serovar Typhi
gccuuccuguggaaggcauuau

SEQ ID NO: 1706563 - RNA, 14 nt, Salmonella enterica enterica serovar Typhi
gccuuccuggucug

SEQ ID NO: 1706564 - RNA, 17 nt, Salmonella enterica enterica serovar Typhi
gccuuccuccaguaauu

SEQ ID NO: 1706565 - RNA, 14 nt, Salmonella enterica enterica serovar Typhi
gccuucuccccuuc

SEQ ID NO: 1706566 - RNA, 18 nt, Salmonella enterica enterica serovar Typhi
gccuucuucgcaaucucc

SEQ ID NO: 1706567 - RNA, 16 nt, Salmonella enterica enterica serovar Typhi
gccuugcggcgccagg

SEQ ID NO: 1706568 - RNA, 21 nt, Salmonella enterica enterica serovar Typhi
gccuuuacugaaucucagaua

SEQ ID NO: 1706569 - RNA, 15 nt, Salmonella enterica enterica serovar Typhi
gccuuuaccacccgu

SEQ ID NO: 1706570 - RNA, 20 nt, Salmonella enterica enterica serovar Typhi
gccuugugucacauuuucuu

SEQ ID NO: 1706571 - RNA, 15 nt, Salmonella enterica enterica serovar Typhi
gcgaaaaggccuggc

SEQ ID NO: 1706572 - RNA, 12 nt, Salmonella enterica enterica serovar Typhi
gcgaaaauaaac

SEQ ID NO: 1706573 - RNA, 12 nt, Salmonella enterica enterica serovar Typhi
gcgaaaaccagc

SEQ ID NO: 1706574 - RNA, 18 nt, Salmonella enterica enterica serovar Typhi
gccuuuuuucaccugcaa

SEQ ID NO: 1706575 - RNA, 18 nt, Salmonella enterica enterica serovar Typhi
gccuuuuuuaauccagga

SEQ ID NO: 1706576 - RNA, 22 nt, Salmonella enterica enterica serovar Typhi
gccuuuuuuauacuccagcaga

SEQ ID NO: 1706577 - RNA, 23 nt, Salmonella enterica enterica serovar Typhi
gccuuuuuuuuaccguuugucuu

SEQ ID NO: 1706578 - RNA, 15 nt, Salmonella enterica enterica serovar Typhi
gcgaaaacagcuggc

SEQ ID NO: 1706579 - RNA, 22 nt, Salmonella enterica enterica serovar Typhi
gccuuauaagaaccaucuacca

SEQ ID NO: 1706580 - RNA, 13 nt, Salmonella enterica enterica serovar Typhi
gccuuauccggcc

SEQ ID NO: 1706581 - RNA, 14 nt, Salmonella enterica enterica serovar Typhi
gccuuauccggccu

SEQ ID NO: 1706582 - RNA, 14 nt, Salmonella enterica enterica serovar Typhi
gccuucauuaauuu

SEQ ID NO: 1706583 - RNA, 13 nt, Salmonella enterica enterica serovar Typhi
gccuuccaggcgg

SEQ ID NO: 1706584 - RNA, 14 nt, Salmonella enterica enterica serovar Typhi
gccuguguaaugaa

SEQ ID NO: 1706585 - RNA, 18 nt, Salmonella enterica enterica serovar Typhi
gccuuacaggcgcaucag

SEQ ID NO: 1706586 - RNA, 12 nt, Salmonella enterica enterica serovar Typhi
gccuuacaggcg

SEQ ID NO: 1706587 - RNA, 15 nt, Salmonella enterica enterica serovar Typhi
gccuguuagggcgcg

SEQ ID NO: 1706588 - RNA, 14 nt, Salmonella enterica enterica serovar Typhi
gccuuacccggccu

SEQ ID NO: 1706589 - RNA, 19 nt, Salmonella enterica enterica serovar Typhi
gccuguaccgggcagacau

SEQ ID NO: 1706590 - RNA, 15 nt, Salmonella enterica enterica serovar Typhi
gccugucuccucagc

SEQ ID NO: 1706591 - RNA, 21 nt, Salmonella enterica enterica serovar Typhi
gccuguacuugcgccgccauc

SEQ ID NO: 1706592 - RNA, 21 nt, Salmonella enterica enterica serovar Typhi
gccugugacguuaacgcagca

SEQ ID NO: 1706593 - RNA, 15 nt, Salmonella enterica enterica serovar Typhi
gccugugcaaccagc

SEQ ID NO: 1706594 - RNA, 16 nt, Salmonella enterica enterica serovar Typhi
gccuguaaacguuccu

SEQ ID NO: 1706595 - RNA, 20 nt, Salmonella enterica enterica serovar Typhi
gccuguaaggucucagcgac

SEQ ID NO: 1706596 - RNA, 21 nt, Salmonella enterica enterica serovar Typhi
gccuggaaagggaaugcgccg

SEQ ID NO: 1706597 - RNA, 16 nt, Salmonella enterica enterica serovar Typhi
gccuggcaacaugacc

SEQ ID NO: 1706598 - RNA, 15 nt, Salmonella enterica enterica serovar Typhi
gccuggcauuuuacu

SEQ ID NO: 1706599 - RNA, 18 nt, Salmonella enterica enterica serovar Typhi
gccggcuuaccagcgggc

SEQ ID NO: 1706600 - RNA, 12 nt, Salmonella enterica enterica serovar Typhi
gccggcgcagcg

SEQ ID NO: 1706601 - RNA, 18 nt, Salmonella enterica enterica serovar Typhi
gccggcgaccaugccagc

SEQ ID NO: 1706602 - RNA, 23 nt, Salmonella enterica enterica serovar Typhi
gccggaagcgauugucggcgccg

SEQ ID NO: 1706603 - RNA, 16 nt, Salmonella enterica enterica serovar Typhi
gccggacgccacgcuc

SEQ ID NO: 1706604 - RNA, 14 nt, Salmonella enterica enterica serovar Typhi
gccggacaggcgac

SEQ ID NO: 1706605 - RNA, 20 nt, Salmonella enterica enterica serovar Typhi
gccggauagacaugaccgga

SEQ ID NO: 1706606 - RNA, 17 nt, Salmonella enterica enterica serovar Typhi
gccggauaagcguuagc

SEQ ID NO: 1706607 - RNA, 16 nt, Salmonella enterica enterica serovar Typhi
gccggauaaggccacg

SEQ ID NO: 1706608 - RNA, 17 nt, Salmonella enterica enterica serovar Typhi
gccggauaaggcgcagc

SEQ ID NO: 1706609 - RNA, 16 nt, Salmonella enterica enterica serovar Typhi
gccggauaagguguuu

SEQ ID NO: 1706610 - RNA, 17 nt, Salmonella enterica enterica serovar Typhi
gccggaucgggcuucca

SEQ ID NO: 1706611 - RNA, 21 nt, Salmonella enterica enterica serovar Typhi
gccggauauggcguccggcca

SEQ ID NO: 1706612 - RNA, 16 nt, Salmonella enterica enterica serovar Typhi
gccggagguuuuucug

SEQ ID NO: 1706613 - RNA, 15 nt, Salmonella enterica enterica serovar Typhi
gccggauaagacgcg

SEQ ID NO: 1706614 - RNA, 18 nt, Salmonella enterica enterica serovar Typhi
gccggagggcgaacuggc

SEQ ID NO: 1706615 - RNA, 21 nt, Salmonella enterica enterica serovar Typhi
gccggaggaggacucuccgag

SEQ ID NO: 1706616 - RNA, 18 nt, Salmonella enterica enterica serovar Typhi
gccggcaacacccgccga

SEQ ID NO: 1706617 - RNA, 13 nt, Salmonella enterica enterica serovar Typhi
gccggcaaagcca

SEQ ID NO: 1706618 - RNA, 17 nt, Salmonella enterica enterica serovar Typhi
gccggauggcggcugcg

SEQ ID NO: 1706619 - RNA, 17 nt, Salmonella enterica enterica serovar Typhi
gccggaugugagcgcau

SEQ ID NO: 1706620 - RNA, 22 nt, Salmonella enterica enterica serovar Typhi
gccggaugugagcgcauccggc

SEQ ID NO: 1706621 - RNA, 13 nt, Salmonella enterica enterica serovar Typhi
gccggauggcgcu

SEQ ID NO: 1706622 - RNA, 16 nt, Salmonella enterica enterica serovar Typhi
gccggauggcggcgca

SEQ ID NO: 1706623 - RNA, 15 nt, Salmonella enterica enterica serovar Typhi
gccggauggcggcug

SEQ ID NO: 1706624 - RNA, 22 nt, Salmonella enterica enterica serovar Typhi
gccggcagacgauagcggguga

SEQ ID NO: 1706625 - RNA, 14 nt, Salmonella enterica enterica serovar Typhi
gccggcagcagcuu

SEQ ID NO: 1706626 - RNA, 23 nt, Salmonella enterica enterica serovar Typhi
gccggcaucauucugcaggcggg

SEQ ID NO: 1706627 - RNA, 12 nt, Salmonella enterica enterica serovar Typhi
gccgugauucau

SEQ ID NO: 1706628 - RNA, 17 nt, Salmonella enterica enterica serovar Typhi
gccgucguucagccagc

SEQ ID NO: 1706629 - RNA, 18 nt, Salmonella enterica enterica serovar Typhi
gccgucucuuucauggaa

SEQ ID NO: 1706630 - RNA, 21 nt, Salmonella enterica enterica serovar Typhi
gccgucguugcugucgcgcaa

SEQ ID NO: 1706631 - RNA, 18 nt, Salmonella enterica enterica serovar Typhi
gccgugccugcuccgcca

SEQ ID NO: 1706632 - RNA, 15 nt, Salmonella enterica enterica serovar Typhi
gccgugccuggcgcu

SEQ ID NO: 1706633 - RNA, 12 nt, Salmonella enterica enterica serovar Typhi
gccguggcuggc

SEQ ID NO: 1706634 - RNA, 19 nt, Salmonella enterica enterica serovar Typhi
gccuaccagcgcuauccag

SEQ ID NO: 1706635 - RNA, 17 nt, Salmonella enterica enterica serovar Typhi
gccuaccaguuguuguc

SEQ ID NO: 1706636 - RNA, 15 nt, Salmonella enterica enterica serovar Typhi
gccuacccgcgugcg

SEQ ID NO: 1706637 - RNA, 13 nt, Salmonella enterica enterica serovar Typhi
gccuaccgccaua

SEQ ID NO: 1706638 - RNA, 16 nt, Salmonella enterica enterica serovar Typhi
gccuaagaccagcacc

SEQ ID NO: 1706639 - RNA, 18 nt, Salmonella enterica enterica serovar Typhi
gccuaagcccaccaucag

SEQ ID NO: 1706640 - RNA, 12 nt, Salmonella enterica enterica serovar Typhi
gccuaaagaaaa

SEQ ID NO: 1706641 - RNA, 13 nt, Salmonella enterica enterica serovar Typhi
gccuaaagaaaaa

SEQ ID NO: 1706642 - RNA, 22 nt, Salmonella enterica enterica serovar Typhi
gccguuuuuaauuugcuccaga

SEQ ID NO: 1706643 - RNA, 16 nt, Salmonella enterica enterica serovar Typhi
gccguacuccagccca

SEQ ID NO: 1706644 - RNA, 19 nt, Salmonella enterica enterica serovar Typhi
gccguagcgcgcuuccugc

SEQ ID NO: 1706645 - RNA, 16 nt, Salmonella enterica enterica serovar Typhi
gccgguguuaaccaga

SEQ ID NO: 1706646 - RNA, 21 nt, Salmonella enterica enterica serovar Typhi
gccgguucggccagucgcaga

SEQ ID NO: 1706647 - RNA, 18 nt, Salmonella enterica enterica serovar Typhi
gccguaaagggaagauca

SEQ ID NO: 1706648 - RNA, 20 nt, Salmonella enterica enterica serovar Typhi
gccguaacgaacgcggauca

SEQ ID NO: 1706649 - RNA, 22 nt, Salmonella enterica enterica serovar Typhi
gccgguuuuagcguauccggca

SEQ ID NO: 1706650 - RNA, 22 nt, Salmonella enterica enterica serovar Typhi
gccgucauggcaaacgaaccca

SEQ ID NO: 1706651 - RNA, 15 nt, Salmonella enterica enterica serovar Typhi
gccgucgacaaagcc

SEQ ID NO: 1706652 - RNA, 15 nt, Salmonella enterica enterica serovar Typhi
gccgucguacucacc

SEQ ID NO: 1706653 - RNA, 17 nt, Salmonella enterica enterica serovar Typhi
gccgucgucaccgccgc

SEQ ID NO: 1706654 - RNA, 19 nt, Salmonella enterica enterica serovar Typhi
gccgucgucaccgccgcgc

SEQ ID NO: 1706655 - RNA, 13 nt, Salmonella enterica enterica serovar Typhi
gccggugccgcaa

SEQ ID NO: 1706656 - RNA, 17 nt, Salmonella enterica enterica serovar Typhi
gccgguccguucucuca

SEQ ID NO: 1706657 - RNA, 16 nt, Salmonella enterica enterica serovar Typhi
gccggucgccagcaua

SEQ ID NO: 1706658 - RNA, 14 nt, Salmonella enterica enterica serovar Typhi
gccggguuuaaugc

SEQ ID NO: 1706659 - RNA, 16 nt, Salmonella enterica enterica serovar Typhi
gccggguggcgcugug

SEQ ID NO: 1706660 - RNA, 15 nt, Salmonella enterica enterica serovar Typhi
gccgguacgcagcag

SEQ ID NO: 1706661 - RNA, 17 nt, Salmonella enterica enterica serovar Typhi
gccgguacgcagcaggc

SEQ ID NO: 1706662 - RNA, 21 nt, Salmonella enterica enterica serovar Typhi
gccgguaaucgaucccgccgc

SEQ ID NO: 1706663 - RNA, 18 nt, Salmonella enterica enterica serovar Typhi
gccgguagcuucagcggc

SEQ ID NO: 1706664 - RNA, 14 nt, Salmonella enterica enterica serovar Typhi
gccgguagcgagaa

SEQ ID NO: 1706665 - RNA, 14 nt, Salmonella enterica enterica serovar Typhi
gccggggcgcuggc

SEQ ID NO: 1706666 - RNA, 16 nt, Salmonella enterica enterica serovar Typhi
gccggggcuggcggcg

SEQ ID NO: 1706667 - RNA, 17 nt, Salmonella enterica enterica serovar Typhi
gccgggccugagcgcgc

SEQ ID NO: 1706668 - RNA, 21 nt, Salmonella enterica enterica serovar Typhi
gccgggcagacaucgccgugc

SEQ ID NO: 1706669 - RNA, 20 nt, Salmonella enterica enterica serovar Typhi
gccgggcauugugccgggua

SEQ ID NO: 1706670 - RNA, 12 nt, Salmonella enterica enterica serovar Typhi
gccgggcauaug

SEQ ID NO: 1706671 - RNA, 18 nt, Salmonella enterica enterica serovar Typhi
gccgggcauaaacuaauc

SEQ ID NO: 1706672 - RNA, 23 nt, Salmonella enterica enterica serovar Typhi
gccgggcggcuguguccgccaug

SEQ ID NO: 1706673 - RNA, 20 nt, Salmonella enterica enterica serovar Typhi
gccgggcggcuguguccgcc

SEQ ID NO: 1706674 - RNA, 17 nt, Salmonella enterica enterica serovar Typhi
gguucgccucccucacc

SEQ ID NO: 1706675 - RNA, 13 nt, Salmonella enterica enterica serovar Typhi
gguucucccggca

SEQ ID NO: 1706676 - RNA, 19 nt, Salmonella enterica enterica serovar Typhi
gguucgcgaagugucuucc

SEQ ID NO: 1706677 - RNA, 15 nt, Salmonella enterica enterica serovar Typhi
gguucaucgccacau

SEQ ID NO: 1706678 - RNA, 23 nt, Salmonella enterica enterica serovar Typhi
gguucccgagcggccaaagggag

SEQ ID NO: 1706679 - RNA, 16 nt, Salmonella enterica enterica serovar Typhi
gguuacucacugccgc

SEQ ID NO: 1706680 - RNA, 17 nt, Salmonella enterica enterica serovar Typhi
gguuacuauuuuucacc

SEQ ID NO: 1706681 - RNA, 22 nt, Salmonella enterica enterica serovar Typhi
gguuauaaacccccuggccgga

SEQ ID NO: 1706682 - RNA, 14 nt, Salmonella enterica enterica serovar Typhi
gguuauaauaauaa

SEQ ID NO: 1706683 - RNA, 23 nt, Salmonella enterica enterica serovar Typhi
gguuaccaaacccuuuggcaaaa

SEQ ID NO: 1706684 - RNA, 17 nt, Salmonella enterica enterica serovar Typhi
gguuacaggugccuggg

SEQ ID NO: 1706685 - RNA, 16 nt, Salmonella enterica enterica serovar Typhi
gguuaaucagcacauu

SEQ ID NO: 1706686 - RNA, 20 nt, Salmonella enterica enterica serovar Typhi
gguuaaugaaaucgucgcca

SEQ ID NO: 1706687 - RNA, 13 nt, Salmonella enterica enterica serovar Typhi
gguuaaggaugua

SEQ ID NO: 1706688 - RNA, 22 nt, Salmonella enterica enterica serovar Typhi
gguuauucggucagauaaauaa

SEQ ID NO: 1706689 - RNA, 14 nt, Salmonella enterica enterica serovar Typhi
gguuauccagcagg

SEQ ID NO: 1706690 - RNA, 16 nt, Salmonella enterica enterica serovar Typhi
gguuauccagcaacca

SEQ ID NO: 1706691 - RNA, 22 nt, Salmonella enterica enterica serovar Typhi
gguucagcaacgugaacugcgc

SEQ ID NO: 1706692 - RNA, 19 nt, Salmonella enterica enterica serovar Typhi
gguucaauacccuuuucuu

SEQ ID NO: 1706693 - RNA, 18 nt, Salmonella enterica enterica serovar Typhi
gguguuuacgccgccauc

SEQ ID NO: 1706694 - RNA, 18 nt, Salmonella enterica enterica serovar Typhi
gguuaacgucagauuuuc

SEQ ID NO: 1706695 - RNA, 23 nt, Salmonella enterica enterica serovar Typhi
gguuaaauuaaauaacaaaugaa

SEQ ID NO: 1706696 - RNA, 23 nt, Salmonella enterica enterica serovar Typhi
gguuaaagcccugacagaaauag

SEQ ID NO: 1706697 - RNA, 18 nt, Salmonella enterica enterica serovar Typhi
gguuaaaaacagccagca

SEQ ID NO: 1706698 - RNA, 12 nt, Salmonella enterica enterica serovar Typhi
gguguccagaug

SEQ ID NO: 1706699 - RNA, 14 nt, Salmonella enterica enterica serovar Typhi
gguguaccccgccu

SEQ ID NO: 1706700 - RNA, 13 nt, Salmonella enterica enterica serovar Typhi
gguggugggcggc

SEQ ID NO: 1706701 - RNA, 22 nt, Salmonella enterica enterica serovar Typhi
gguggucaucgcggccagcaug

SEQ ID NO: 1706702 - RNA, 15 nt, Salmonella enterica enterica serovar Typhi
gguggucuggagccu

SEQ ID NO: 1706703 - RNA, 16 nt, Salmonella enterica enterica serovar Typhi
ggugggugaugacggg

SEQ ID NO: 1706704 - RNA, 23 nt, Salmonella enterica enterica serovar Typhi
gguugcggcggggauaaucagca

SEQ ID NO: 1706705 - RNA, 14 nt, Salmonella enterica enterica serovar Typhi
gguugcgcaaccuc

SEQ ID NO: 1706706 - RNA, 20 nt, Salmonella enterica enterica serovar Typhi
gguuggaauaauuuucgcaa

SEQ ID NO: 1706707 - RNA, 22 nt, Salmonella enterica enterica serovar Typhi
gguuuaccauuacgcuauaaag

SEQ ID NO: 1706708 - RNA, 22 nt, Salmonella enterica enterica serovar Typhi
gguugauaccggaggagugcgc

SEQ ID NO: 1706709 - RNA, 18 nt, Salmonella enterica enterica serovar Typhi
gguugacuuacaaaaaau

SEQ ID NO: 1706710 - RNA, 16 nt, Salmonella enterica enterica serovar Typhi
gguugacggcuacccc

SEQ ID NO: 1706711 - RNA, 22 nt, Salmonella enterica enterica serovar Typhi
gguugcccgguggcgcugcgcu

SEQ ID NO: 1706712 - RNA, 20 nt, Salmonella enterica enterica serovar Typhi
gguugaaggucugacaacua

SEQ ID NO: 1706713 - RNA, 12 nt, Salmonella enterica enterica serovar Typhi
gguugacgcugc

SEQ ID NO: 1706714 - RNA, 13 nt, Salmonella enterica enterica serovar Typhi
gguucugccagaa

SEQ ID NO: 1706715 - RNA, 14 nt, Salmonella enterica enterica serovar Typhi
gguucugccagaac

SEQ ID NO: 1706716 - RNA, 12 nt, Salmonella enterica enterica serovar Typhi
gguuuuuuaaug

SEQ ID NO: 1706717 - RNA, 15 nt, Salmonella enterica enterica serovar Typhi
gguuuuuauggaagg

SEQ ID NO: 1706718 - RNA, 22 nt, Salmonella enterica enterica serovar Typhi
gguuuuucgccgaccauccaga

SEQ ID NO: 1706719 - RNA, 13 nt, Salmonella enterica enterica serovar Typhi
guaaaaaaaccgu

SEQ ID NO: 1706720 - RNA, 22 nt, Salmonella enterica enterica serovar Typhi
guaaaaaaaccguaucacugua

SEQ ID NO: 1706721 - RNA, 21 nt, Salmonella enterica enterica serovar Typhi
gguuuuuuuguaucugcgcag

SEQ ID NO: 1706722 - RNA, 16 nt, Salmonella enterica enterica serovar Typhi
guaaaaacccuuucau

SEQ ID NO: 1706723 - RNA, 20 nt, Salmonella enterica enterica serovar Typhi
guaaaacacgccuccauaca

SEQ ID NO: 1706724 - RNA, 16 nt, Salmonella enterica enterica serovar Typhi
guaaaaccgacuauca

SEQ ID NO: 1706725 - RNA, 13 nt, Salmonella enterica enterica serovar Typhi
guaaaaccggcac

SEQ ID NO: 1706726 - RNA, 12 nt, Salmonella enterica enterica serovar Typhi
guaaaaagcuga

SEQ ID NO: 1706727 - RNA, 21 nt, Salmonella enterica enterica serovar Typhi
guaaaaauuuuugaucugcuu

SEQ ID NO: 1706728 - RNA, 17 nt, Salmonella enterica enterica serovar Typhi
gguuugccagcaccagc

SEQ ID NO: 1706729 - RNA, 17 nt, Salmonella enterica enterica serovar Typhi
gguuuggacuaccggua

SEQ ID NO: 1706730 - RNA, 15 nt, Salmonella enterica enterica serovar Typhi
gguuucuggcaacag

SEQ ID NO: 1706731 - RNA, 18 nt, Salmonella enterica enterica serovar Typhi
gguuuuaugcaucgcggu

SEQ ID NO: 1706732 - RNA, 20 nt, Salmonella enterica enterica serovar Typhi
gguuugugucguaguggcau

SEQ ID NO: 1706733 - RNA, 18 nt, Salmonella enterica enterica serovar Typhi
gguuucaccauuaagcaa

SEQ ID NO: 1706734 - RNA, 22 nt, Salmonella enterica enterica serovar Typhi
gguuucaauauagccguggcug

SEQ ID NO: 1706735 - RNA, 10 nt, Salmonella enterica enterica serovar Typhi
gguuuauccc

SEQ ID NO: 1706736 - RNA, 18 nt, Salmonella enterica enterica serovar Typhi
gguuucgccuaagcccac

SEQ ID NO: 1706737 - RNA, 19 nt, Salmonella enterica enterica serovar Typhi
gguuucccugccucaacau

SEQ ID NO: 1706738 - RNA, 18 nt, Salmonella enterica enterica serovar Typhi
gguuucgauagcaggcac

SEQ ID NO: 1706739 - RNA, 16 nt, Salmonella enterica enterica serovar Typhi
ggugaugcgcaacguu

SEQ ID NO: 1706740 - RNA, 18 nt, Salmonella enterica enterica serovar Typhi
ggugcaagcaccuuaucc

SEQ ID NO: 1706741 - RNA, 15 nt, Salmonella enterica enterica serovar Typhi
ggugcaaaacguuug

SEQ ID NO: 1706742 - RNA, 23 nt, Salmonella enterica enterica serovar Typhi
ggugaucuggccaauuuuucaca

SEQ ID NO: 1706743 - RNA, 22 nt, Salmonella enterica enterica serovar Typhi
ggugauauuuuagccaucccgg

SEQ ID NO: 1706744 - RNA, 17 nt, Salmonella enterica enterica serovar Typhi
ggugcccgcaaaaccuu

SEQ ID NO: 1706745 - RNA, 17 nt, Salmonella enterica enterica serovar Typhi
ggugccaaauguauacu

SEQ ID NO: 1706746 - RNA, 23 nt, Salmonella enterica enterica serovar Typhi
ggugcauuuuuaucaucugcaug

SEQ ID NO: 1706747 - RNA, 15 nt, Salmonella enterica enterica serovar Typhi
ggugcagaccucugc

SEQ ID NO: 1706748 - RNA, 16 nt, Salmonella enterica enterica serovar Typhi
ggugcagaccucugca

SEQ ID NO: 1706749 - RNA, 21 nt, Salmonella enterica enterica serovar Typhi
ggugagcucauccagcguuuc

SEQ ID NO: 1706750 - RNA, 19 nt, Salmonella enterica enterica serovar Typhi
ggugagcuccagcccgccg

SEQ ID NO: 1706751 - RNA, 22 nt, Salmonella enterica enterica serovar Typhi
ggugagcuccagcccgccgccc

SEQ ID NO: 1706752 - RNA, 12 nt, Salmonella enterica enterica serovar Typhi
ggugagcucuuu

SEQ ID NO: 1706753 - RNA, 22 nt, Salmonella enterica enterica serovar Typhi
ggugacaguccgggccgugaca

SEQ ID NO: 1706754 - RNA, 22 nt, Salmonella enterica enterica serovar Typhi
ggugaauaccagcggcaaacag

SEQ ID NO: 1706755 - RNA, 16 nt, Salmonella enterica enterica serovar Typhi
ggugaauaccaaagcc

SEQ ID NO: 1706756 - RNA, 13 nt, Salmonella enterica enterica serovar Typhi
ggcucaucaaaca

SEQ ID NO: 1706757 - RNA, 20 nt, Salmonella enterica enterica serovar Typhi
ggcucaucaaacagcggcac

SEQ ID NO: 1706758 - RNA, 22 nt, Salmonella enterica enterica serovar Typhi
ggcucaucaaacagcggcacuu

SEQ ID NO: 1706759 - RNA, 13 nt, Salmonella enterica enterica serovar Typhi
ggcucauauuauc

SEQ ID NO: 1706760 - RNA, 23 nt, Salmonella enterica enterica serovar Typhi
ggcuccgagacucaaagaaaaca

SEQ ID NO: 1706761 - RNA, 20 nt, Salmonella enterica enterica serovar Typhi
gguggcgcaguuuacgcagc

SEQ ID NO: 1706762 - RNA, 14 nt, Salmonella enterica enterica serovar Typhi
gguggccgggggcg

SEQ ID NO: 1706763 - RNA, 11 nt, Salmonella enterica enterica serovar Typhi
gguggccggag

SEQ ID NO: 1706764 - RNA, 17 nt, Salmonella enterica enterica serovar Typhi
ggugggguucccgagcg

SEQ ID NO: 1706765 - RNA, 19 nt, Salmonella enterica enterica serovar Typhi
gguggggcuaagugagcau

SEQ ID NO: 1706766 - RNA, 22 nt, Salmonella enterica enterica serovar Typhi
gguggggauaucuucgauaaga

SEQ ID NO: 1706767 - RNA, 14 nt, Salmonella enterica enterica serovar Typhi
ggugcgccccagca

SEQ ID NO: 1706768 - RNA, 16 nt, Salmonella enterica enterica serovar Typhi
ggugcgccccagcaug

SEQ ID NO: 1706769 - RNA, 14 nt, Salmonella enterica enterica serovar Typhi
ggugcucaauaaaa

SEQ ID NO: 1706770 - RNA, 14 nt, Salmonella enterica enterica serovar Typhi
ggugcgacgccaga

SEQ ID NO: 1706771 - RNA, 17 nt, Salmonella enterica enterica serovar Typhi
ggugccuguugcgggcc

SEQ ID NO: 1706772 - RNA, 21 nt, Salmonella enterica enterica serovar Typhi
ggugccuguugcgggccagca

SEQ ID NO: 1706773 - RNA, 12 nt, Salmonella enterica enterica serovar Typhi
guacggcauauu

SEQ ID NO: 1706774 - RNA, 14 nt, Salmonella enterica enterica serovar Typhi
guacggcauggcgu

SEQ ID NO: 1706775 - RNA, 14 nt, Salmonella enterica enterica serovar Typhi
guacggauauuggc

SEQ ID NO: 1706776 - RNA, 18 nt, Salmonella enterica enterica serovar Typhi
guacggguauuccagggc

SEQ ID NO: 1706777 - RNA, 15 nt, Salmonella enterica enterica serovar Typhi
guacgcuccagggcu

SEQ ID NO: 1706778 - RNA, 20 nt, Salmonella enterica enterica serovar Typhi
guacgcgcaaccgcaucacg

SEQ ID NO: 1706779 - RNA, 18 nt, Salmonella enterica enterica serovar Typhi
guacgccgccauccggca

SEQ ID NO: 1706780 - RNA, 22 nt, Salmonella enterica enterica serovar Typhi
guacgccuaaaugaacuuacac

SEQ ID NO: 1706781 - RNA, 12 nt, Salmonella enterica enterica serovar Typhi
guacgcccagcc

SEQ ID NO: 1706782 - RNA, 22 nt, Salmonella enterica enterica serovar Typhi
guacgccaaaucuguucugucc

SEQ ID NO: 1706783 - RNA, 14 nt, Salmonella enterica enterica serovar Typhi
guacgcaggaggga

SEQ ID NO: 1706784 - RNA, 16 nt, Salmonella enterica enterica serovar Typhi
guacgccaaguacgcc

SEQ ID NO: 1706785 - RNA, 21 nt, Salmonella enterica enterica serovar Typhi
guaccauugagcuuucuucca

SEQ ID NO: 1706786 - RNA, 18 nt, Salmonella enterica enterica serovar Typhi
guaccauugucaaaaaua

SEQ ID NO: 1706787 - RNA, 15 nt, Salmonella enterica enterica serovar Typhi
guacccgccgcuggc

SEQ ID NO: 1706788 - RNA, 23 nt, Salmonella enterica enterica serovar Typhi
guacccggcuuacaacauuguua

SEQ ID NO: 1706789 - RNA, 13 nt, Salmonella enterica enterica serovar Typhi
guaccgaaagcga

SEQ ID NO: 1706790 - RNA, 14 nt, Salmonella enterica enterica serovar Typhi
guacccucugcacc

SEQ ID NO: 1706791 - RNA, 18 nt, Salmonella enterica enterica serovar Typhi
guaccgaacagccaggcu

SEQ ID NO: 1706792 - RNA, 21 nt, Salmonella enterica enterica serovar Typhi
guaccgaagaacauaaacagc

SEQ ID NO: 1706793 - RNA, 20 nt, Salmonella enterica enterica serovar Typhi
guaccgacgccauuccccag

SEQ ID NO: 1706794 - RNA, 23 nt, Salmonella enterica enterica serovar Typhi
guaccgauuguuuggugcugaaa

SEQ ID NO: 1706795 - RNA, 21 nt, Salmonella enterica enterica serovar Typhi
guaccgggccuccuuuccugu

SEQ ID NO: 1706796 - RNA, 23 nt, Salmonella enterica enterica serovar Typhi
guaccggcaggacaaucauaaua

SEQ ID NO: 1706797 - RNA, 15 nt, Salmonella enterica enterica serovar Typhi
guaccgcguccugac

SEQ ID NO: 1706798 - RNA, 17 nt, Salmonella enterica enterica serovar Typhi
guaccgcuacgcaggcc

SEQ ID NO: 1706799 - RNA, 22 nt, Salmonella enterica enterica serovar Typhi
guaccgcuacgcaggccauuuc

SEQ ID NO: 1706800 - RNA, 15 nt, Salmonella enterica enterica serovar Typhi
guaccggauuuagcg

SEQ ID NO: 1706801 - RNA, 18 nt, Salmonella enterica enterica serovar Typhi
guaccucuugcuggguua

SEQ ID NO: 1706802 - RNA, 15 nt, Salmonella enterica enterica serovar Typhi
guaccagcagcgcca

SEQ ID NO: 1706803 - RNA, 15 nt, Salmonella enterica enterica serovar Typhi
guaccacgccgcaca

SEQ ID NO: 1706804 - RNA, 18 nt, Salmonella enterica enterica serovar Typhi
guaccacccgggaaaaau

SEQ ID NO: 1706805 - RNA, 22 nt, Salmonella enterica enterica serovar Typhi
guaccauaccggugcgccccag

SEQ ID NO: 1706806 - RNA, 12 nt, Salmonella enterica enterica serovar Typhi
guaccaaacagc

SEQ ID NO: 1706807 - RNA, 15 nt, Salmonella enterica enterica serovar Typhi
guaccaauacccagc

SEQ ID NO: 1706808 - RNA, 16 nt, Salmonella enterica enterica serovar Typhi
guaccaauacccagcg

SEQ ID NO: 1706809 - RNA, 20 nt, Salmonella enterica enterica serovar Typhi
guaccaccagaaucgccagc

SEQ ID NO: 1706810 - RNA, 20 nt, Salmonella enterica enterica serovar Typhi
guaccaccacgcccuucacg

SEQ ID NO: 1706811 - RNA, 12 nt, Salmonella enterica enterica serovar Typhi
guacagaugcug

SEQ ID NO: 1706812 - RNA, 22 nt, Salmonella enterica enterica serovar Typhi
guacacguauaaacgccgccgc

SEQ ID NO: 1706813 - RNA, 23 nt, Salmonella enterica enterica serovar Typhi
guacagcuuaaucaccagcgcau

SEQ ID NO: 1706814 - RNA, 11 nt, Salmonella enterica enterica serovar Typhi
guacauaucca

SEQ ID NO: 1706815 - RNA, 17 nt, Salmonella enterica enterica serovar Typhi
guacaugccauccggcg

SEQ ID NO: 1706816 - RNA, 19 nt, Salmonella enterica enterica serovar Typhi
guacaugaauaauaauaca

SEQ ID NO: 1706817 - RNA, 13 nt, Salmonella enterica enterica serovar Typhi
guacaucuuccau

SEQ ID NO: 1706818 - RNA, 13 nt, Salmonella enterica enterica serovar Typhi
guacaugaauaau

SEQ ID NO: 1706819 - RNA, 17 nt, Salmonella enterica enterica serovar Typhi
guacauaacagcagcag

SEQ ID NO: 1706820 - RNA, 20 nt, Salmonella enterica enterica serovar Typhi
guaaucaucaccguuuucca

SEQ ID NO: 1706821 - RNA, 22 nt, Salmonella enterica enterica serovar Typhi
guaaucacuaacugaccauaua

SEQ ID NO: 1706822 - RNA, 14 nt, Salmonella enterica enterica serovar Typhi
aaauagagaaaaua

SEQ ID NO: 1706823 - RNA, 16 nt, Salmonella enterica enterica serovar Typhi
aaauagagaaaauaac

SEQ ID NO: 1706824 - RNA, 21 nt, Salmonella enterica enterica serovar Typhi
aaauagacgagcgaaaaacug

SEQ ID NO: 1706825 - RNA, 22 nt, Salmonella enterica enterica serovar Typhi
aaauagaacagcuggugcggca

SEQ ID NO: 1706826 - RNA, 20 nt, Salmonella enterica enterica serovar Typhi
guaaucggccuguuggccuu

SEQ ID NO: 1706827 - RNA, 20 nt, Salmonella enterica enterica serovar Typhi
guaauggcgggaaaagguuu

SEQ ID NO: 1706828 - RNA, 12 nt, Salmonella enterica enterica serovar Typhi
guaauggucagc

SEQ ID NO: 1706829 - RNA, 15 nt, Salmonella enterica enterica serovar Typhi
guaauggcauaacgc

SEQ ID NO: 1706830 - RNA, 17 nt, Salmonella enterica enterica serovar Typhi
guaauggccuacacacu

SEQ ID NO: 1706831 - RNA, 22 nt, Salmonella enterica enterica serovar Typhi
guaaugcucgcccagaauuucc

SEQ ID NO: 1706832 - RNA, 15 nt, Salmonella enterica enterica serovar Typhi
guaaugcgccaggca

SEQ ID NO: 1706833 - RNA, 18 nt, Salmonella enterica enterica serovar Typhi
guaaugcgccaggcagca

SEQ ID NO: 1706834 - RNA, 19 nt, Salmonella enterica enterica serovar Typhi
guaaugcgccaggcagcac

SEQ ID NO: 1706835 - RNA, 15 nt, Salmonella enterica enterica serovar Typhi
guaaucugacagaua

SEQ ID NO: 1706836 - RNA, 16 nt, Salmonella enterica enterica serovar Typhi
guaaucuuuucauauu

SEQ ID NO: 1706837 - RNA, 19 nt, Salmonella enterica enterica serovar Typhi
guaaugagcacuuuccaca

SEQ ID NO: 1706838 - RNA, 19 nt, Salmonella enterica enterica serovar Typhi
guacaagagccgccgccau

SEQ ID NO: 1706839 - RNA, 18 nt, Salmonella enterica enterica serovar Typhi
guacaagagccgccgcca

SEQ ID NO: 1706840 - RNA, 15 nt, Salmonella enterica enterica serovar Typhi
guacaauggcaggca

SEQ ID NO: 1706841 - RNA, 19 nt, Salmonella enterica enterica serovar Typhi
guacaccugcaacuccugg

SEQ ID NO: 1706842 - RNA, 17 nt, Salmonella enterica enterica serovar Typhi
guacaccuuaucugugg

SEQ ID NO: 1706843 - RNA, 19 nt, Salmonella enterica enterica serovar Typhi
guacaccaguacaucuuca

SEQ ID NO: 1706844 - RNA, 17 nt, Salmonella enterica enterica serovar Typhi
guacacauaugggaaga

SEQ ID NO: 1706845 - RNA, 15 nt, Salmonella enterica enterica serovar Typhi
guacaaacaaauaaa

SEQ ID NO: 1706846 - RNA, 20 nt, Salmonella enterica enterica serovar Typhi
guacaaacaaauaaauccau

SEQ ID NO: 1706847 - RNA, 11 nt, Salmonella enterica enterica serovar Typhi
guaauuuucac

SEQ ID NO: 1706848 - RNA, 14 nt, Salmonella enterica enterica serovar Typhi
guaauuugcuuucu

SEQ ID NO: 1706849 - RNA, 17 nt, Salmonella enterica enterica serovar Typhi
guaauuuuucucccagc

SEQ ID NO: 1706850 - RNA, 16 nt, Salmonella enterica enterica serovar Typhi
guaauucucacagaau

SEQ ID NO: 1706851 - RNA, 14 nt, Salmonella enterica enterica serovar Typhi
guaauucucccaaa

SEQ ID NO: 1706852 - RNA, 23 nt, Salmonella enterica enterica serovar Typhi
guaauucaugcuguauaaacuca

SEQ ID NO: 1706853 - RNA, 21 nt, Salmonella enterica enterica serovar Typhi
guaauguuuucugccagcaga

SEQ ID NO: 1706854 - RNA, 19 nt, Salmonella enterica enterica serovar Typhi
guaauuaaggauugccgcc

SEQ ID NO: 1706855 - RNA, 18 nt, Salmonella enterica enterica serovar Typhi
guaauuucgcuggcggcc

SEQ ID NO: 1706856 - RNA, 13 nt, Salmonella enterica enterica serovar Typhi
guaauuuauaaag

SEQ ID NO: 1706857 - RNA, 18 nt, Salmonella enterica enterica serovar Typhi
guaauucucccaaauuuu

SEQ ID NO: 1706858 - RNA, 14 nt, Salmonella enterica enterica serovar Typhi
guaauugacauggc

SEQ ID NO: 1706859 - RNA, 23 nt, Salmonella enterica enterica serovar Typhi
guaaccgaacuggguaugcagug

SEQ ID NO: 1706860 - RNA, 18 nt, Salmonella enterica enterica serovar Typhi
guaaccgcaaaugccauc

SEQ ID NO: 1706861 - RNA, 23 nt, Salmonella enterica enterica serovar Typhi
guaaccccauacaguaguuuuca

SEQ ID NO: 1706862 - RNA, 14 nt, Salmonella enterica enterica serovar Typhi
guaaccgccacagc

SEQ ID NO: 1706863 - RNA, 14 nt, Salmonella enterica enterica serovar Typhi
guaacgcacuuuuc

SEQ ID NO: 1706864 - RNA, 17 nt, Salmonella enterica enterica serovar Typhi
guaacggacauaaagga

SEQ ID NO: 1706865 - RNA, 14 nt, Salmonella enterica enterica serovar Typhi
guaacgccuccacc

SEQ ID NO: 1706866 - RNA, 16 nt, Salmonella enterica enterica serovar Typhi
guaacgccuuugcccg

SEQ ID NO: 1706867 - RNA, 17 nt, Salmonella enterica enterica serovar Typhi
guaacguaaauacccag

SEQ ID NO: 1706868 - RNA, 18 nt, Salmonella enterica enterica serovar Typhi
guaacucaauaucgacag

SEQ ID NO: 1706869 - RNA, 18 nt, Salmonella enterica enterica serovar Typhi
guaacguuguccagcaga

SEQ ID NO: 1706870 - RNA, 19 nt, Salmonella enterica enterica serovar Typhi
guaagaucccagggcggcg

SEQ ID NO: 1706871 - RNA, 14 nt, Salmonella enterica enterica serovar Typhi
guaagcacaacgca

SEQ ID NO: 1706872 - RNA, 22 nt, Salmonella enterica enterica serovar Typhi
guaagcauagcgccuucaggca

SEQ ID NO: 1706873 - RNA, 20 nt, Salmonella enterica enterica serovar Typhi
guaagagagccuuacaggcg

SEQ ID NO: 1706874 - RNA, 17 nt, Salmonella enterica enterica serovar Typhi
guaagagcguuacccag

SEQ ID NO: 1706875 - RNA, 19 nt, Salmonella enterica enterica serovar Typhi
guaagagcguuacccagac

SEQ ID NO: 1706876 - RNA, 17 nt, Salmonella enterica enterica serovar Typhi
guaacuggcuccacggg

SEQ ID NO: 1706877 - RNA, 18 nt, Salmonella enterica enterica serovar Typhi
guaacugcgguaaauaau

SEQ ID NO: 1706878 - RNA, 21 nt, Salmonella enterica enterica serovar Typhi
guaacugcaccuuuuuuucca

SEQ ID NO: 1706879 - RNA, 23 nt, Salmonella enterica enterica serovar Typhi
guaacugcaccuuuuuuuccagc

SEQ ID NO: 1706880 - RNA, 18 nt, Salmonella enterica enterica serovar Typhi
guaagaaaaacagcgaga

SEQ ID NO: 1706881 - RNA, 22 nt, Salmonella enterica enterica serovar Typhi
guaaguuugcguacucagcaga

SEQ ID NO: 1706882 - RNA, 13 nt, Salmonella enterica enterica serovar Typhi
guaagguccaggg

SEQ ID NO: 1706883 - RNA, 19 nt, Salmonella enterica enterica serovar Typhi
guaagucgccgcagcucca

SEQ ID NO: 1706884 - RNA, 23 nt, Salmonella enterica enterica serovar Typhi
guaagcccauggcaggcagcaca

SEQ ID NO: 1706885 - RNA, 22 nt, Salmonella enterica enterica serovar Typhi
guaagcgcccguccaugaguag

SEQ ID NO: 1706886 - RNA, 18 nt, Salmonella enterica enterica serovar Typhi
guaauacggagcaaaaaa

SEQ ID NO: 1706887 - RNA, 15 nt, Salmonella enterica enterica serovar Typhi
guaauacaggguuug

SEQ ID NO: 1706888 - RNA, 13 nt, Salmonella enterica enterica serovar Typhi
guaauaauacuaa

SEQ ID NO: 1706889 - RNA, 14 nt, Salmonella enterica enterica serovar Typhi
guaaguuuugcucc

SEQ ID NO: 1706890 - RNA, 15 nt, Salmonella enterica enterica serovar Typhi
guaaguuuugcuccc

SEQ ID NO: 1706891 - RNA, 17 nt, Salmonella enterica enterica serovar Typhi
guaauaaccguggcggc

SEQ ID NO: 1706892 - RNA, 21 nt, Salmonella enterica enterica serovar Typhi
guaauaaggcggguugcugau

SEQ ID NO: 1706893 - RNA, 19 nt, Salmonella enterica enterica serovar Typhi
guaauagucugcucgucgg

SEQ ID NO: 1706894 - RNA, 11 nt, Salmonella enterica enterica serovar Typhi
guaauacuucc

SEQ ID NO: 1706895 - RNA, 19 nt, Salmonella enterica enterica serovar Typhi
guaauacggagcaaaaaau

SEQ ID NO: 1706896 - RNA, 22 nt, Salmonella enterica enterica serovar Typhi
guaauacgcgucugucgaaacu

SEQ ID NO: 1706897 - RNA, 18 nt, Salmonella enterica enterica serovar Typhi
guaauauaaucuaccauu

SEQ ID NO: 1706898 - RNA, 17 nt, Salmonella enterica enterica serovar Typhi
guaacauacaaaaagua

SEQ ID NO: 1706899 - RNA, 20 nt, Salmonella enterica enterica serovar Typhi
guaacauccuggguuugcug

SEQ ID NO: 1706900 - RNA, 22 nt, Salmonella enterica enterica serovar Typhi
guaaccaaagcaccauucuuca

SEQ ID NO: 1706901 - RNA, 13 nt, Salmonella enterica enterica serovar Typhi
guaaauuuauggu

SEQ ID NO: 1706902 - RNA, 21 nt, Salmonella enterica enterica serovar Typhi
guaaauucucuauacugcuga

SEQ ID NO: 1706903 - RNA, 18 nt, Salmonella enterica enterica serovar Typhi
guaacaacuguuuuucac

SEQ ID NO: 1706904 - RNA, 22 nt, Salmonella enterica enterica serovar Typhi
guaacaccuguaacgucacauu

SEQ ID NO: 1706905 - RNA, 13 nt, Salmonella enterica enterica serovar Typhi
guaacagcaggac

SEQ ID NO: 1706906 - RNA, 15 nt, Salmonella enterica enterica serovar Typhi
guaaauagaaaauaa

SEQ ID NO: 1706907 - RNA, 22 nt, Salmonella enterica enterica serovar Typhi
guaaauagaaaauaauucuuaa

SEQ ID NO: 1706908 - RNA, 13 nt, Salmonella enterica enterica serovar Typhi
guaaauagcccgg

SEQ ID NO: 1706909 - RNA, 21 nt, Salmonella enterica enterica serovar Typhi
guaaaucgcgagccuucaaca

SEQ ID NO: 1706910 - RNA, 19 nt, Salmonella enterica enterica serovar Typhi
guaaaucauuuguacaaaa

SEQ ID NO: 1706911 - RNA, 17 nt, Salmonella enterica enterica serovar Typhi
guaaaucagaauaccgc

SEQ ID NO: 1706912 - RNA, 18 nt, Salmonella enterica enterica serovar Typhi
guaaauauugauuaaucg

SEQ ID NO: 1706913 - RNA, 21 nt, Salmonella enterica enterica serovar Typhi
guaaauuccgcaggcaacaca

SEQ ID NO: 1706914 - RNA, 23 nt, Salmonella enterica enterica serovar Typhi
guaaagauuaauaauugagcgca

SEQ ID NO: 1706915 - RNA, 18 nt, Salmonella enterica enterica serovar Typhi
guaaagaccgggcgcggu

SEQ ID NO: 1706916 - RNA, 16 nt, Salmonella enterica enterica serovar Typhi
guaaacgugccacagu

SEQ ID NO: 1706917 - RNA, 22 nt, Salmonella enterica enterica serovar Typhi
guaaacgcaacaccaucccgcu

SEQ ID NO: 1706918 - RNA, 16 nt, Salmonella enterica enterica serovar Typhi
guaaacgccugcacca

SEQ ID NO: 1706919 - RNA, 16 nt, Salmonella enterica enterica serovar Typhi
guaaaccauuucuccu

SEQ ID NO: 1706920 - RNA, 13 nt, Salmonella enterica enterica serovar Typhi
guaaacagaugcu

SEQ ID NO: 1706921 - RNA, 21 nt, Salmonella enterica enterica serovar Typhi
guaaacaauggaacuaucaau

SEQ ID NO: 1706922 - RNA, 13 nt, Salmonella enterica enterica serovar Typhi
guaaacaccaccg

SEQ ID NO: 1706923 - RNA, 18 nt, Salmonella enterica enterica serovar Typhi
guaaacacgacgcugcca

SEQ ID NO: 1706924 - RNA, 12 nt, Salmonella enterica enterica serovar Typhi
guaaaacgcugg

SEQ ID NO: 1706925 - RNA, 17 nt, Salmonella enterica enterica serovar Typhi
guaaaauccggcaggca

SEQ ID NO: 1706926 - RNA, 16 nt, Salmonella enterica enterica serovar Typhi
guaaaauggacuuccg

SEQ ID NO: 1706927 - RNA, 15 nt, Salmonella enterica enterica serovar Typhi
guaaaaugcuggugc

SEQ ID NO: 1706928 - RNA, 14 nt, Salmonella enterica enterica serovar Typhi
guaaaauuagacaa

SEQ ID NO: 1706929 - RNA, 14 nt, Salmonella enterica enterica serovar Typhi
guacugcuggcgcg

SEQ ID NO: 1706930 - RNA, 16 nt, Salmonella enterica enterica serovar Typhi
guacucuuccagcugc

SEQ ID NO: 1706931 - RNA, 18 nt, Salmonella enterica enterica serovar Typhi
guacucaccaguccggca

SEQ ID NO: 1706932 - RNA, 18 nt, Salmonella enterica enterica serovar Typhi
guacguaaugugaaaaac

SEQ ID NO: 1706933 - RNA, 20 nt, Salmonella enterica enterica serovar Typhi
guacuccccuuuuuucuguu

SEQ ID NO: 1706934 - RNA, 15 nt, Salmonella enterica enterica serovar Typhi
guacgucgcauacuu

SEQ ID NO: 1706935 - RNA, 21 nt, Salmonella enterica enterica serovar Typhi
guacuuuucauccacagcgcc

SEQ ID NO: 1706936 - RNA, 16 nt, Salmonella enterica enterica serovar Typhi
guagaaaaagguaacu

SEQ ID NO: 1706937 - RNA, 24 nt, Salmonella enterica enterica serovar Typhi
guagaacguauuauuauuacgcau

SEQ ID NO: 1706938 - RNA, 14 nt, Salmonella enterica enterica serovar Typhi
guacuucagagcug

SEQ ID NO: 1706939 - RNA, 22 nt, Salmonella enterica enterica serovar Typhi
guacuucagcauacaggucuuu

SEQ ID NO: 1706940 - RNA, 13 nt, Salmonella enterica enterica serovar Typhi
guacuuucaaaua

SEQ ID NO: 1706941 - RNA, 22 nt, Salmonella enterica enterica serovar Typhi
guacuuucacuaccacuuucuu

SEQ ID NO: 1706942 - RNA, 15 nt, Salmonella enterica enterica serovar Typhi
guacuuuuaaaucau

SEQ ID NO: 1706943 - RNA, 21 nt, Salmonella enterica enterica serovar Typhi
guagacuggguaagcgcagcg

SEQ ID NO: 1706944 - RNA, 16 nt, Salmonella enterica enterica serovar Typhi
guagacucaggcgcau

SEQ ID NO: 1706945 - RNA, 19 nt, Salmonella enterica enterica serovar Typhi
guagagcaucgcggcauca

SEQ ID NO: 1706946 - RNA, 20 nt, Salmonella enterica enterica serovar Typhi
guagagauucugcaggccaa

SEQ ID NO: 1706947 - RNA, 16 nt, Salmonella enterica enterica serovar Typhi
guagagcgcggucagg

SEQ ID NO: 1706948 - RNA, 14 nt, Salmonella enterica enterica serovar Typhi
guagagaacagcau

SEQ ID NO: 1706949 - RNA, 13 nt, Salmonella enterica enterica serovar Typhi
guagaucauuuac

SEQ ID NO: 1706950 - RNA, 23 nt, Salmonella enterica enterica serovar Typhi
guagcaacccuggcgcuuuaaac

SEQ ID NO: 1706951 - RNA, 13 nt, Salmonella enterica enterica serovar Typhi
guagcagcgauga

SEQ ID NO: 1706952 - RNA, 15 nt, Salmonella enterica enterica serovar Typhi
guagcagcgaugaca

SEQ ID NO: 1706953 - RNA, 18 nt, Salmonella enterica enterica serovar Typhi
guagcagcgaugacagca

SEQ ID NO: 1706954 - RNA, 17 nt, Salmonella enterica enterica serovar Typhi
guagcaguggagaggcc

SEQ ID NO: 1706955 - RNA, 18 nt, Salmonella enterica enterica serovar Typhi
guagcaguguaucgaaga

SEQ ID NO: 1706956 - RNA, 12 nt, Salmonella enterica enterica serovar Typhi
guagccacagcg

SEQ ID NO: 1706957 - RNA, 23 nt, Salmonella enterica enterica serovar Typhi
guagccagccaaacaauaucccg

SEQ ID NO: 1706958 - RNA, 17 nt, Salmonella enterica enterica serovar Typhi
guagucucccuccugcu

SEQ ID NO: 1706959 - RNA, 19 nt, Salmonella enterica enterica serovar Typhi
guagucucccuccugcucc

SEQ ID NO: 1706960 - RNA, 15 nt, Salmonella enterica enterica serovar Typhi
guaguguaauaccac

SEQ ID NO: 1706961 - RNA, 13 nt, Salmonella enterica enterica serovar Typhi
guaguuagagaua

SEQ ID NO: 1706962 - RNA, 14 nt, Salmonella enterica enterica serovar Typhi
guaguccaaauaag

SEQ ID NO: 1706963 - RNA, 18 nt, Salmonella enterica enterica serovar Typhi
guagucaaauuccagcaa

SEQ ID NO: 1706964 - RNA, 13 nt, Salmonella enterica enterica serovar Typhi
guaguaaauagga

SEQ ID NO: 1706965 - RNA, 18 nt, Salmonella enterica enterica serovar Typhi
guagggcugccaucaggc

SEQ ID NO: 1706966 - RNA, 19 nt, Salmonella enterica enterica serovar Typhi
guaggcucuccgguugcug

SEQ ID NO: 1706967 - RNA, 20 nt, Salmonella enterica enterica serovar Typhi
guaggccugauagcacagcg

SEQ ID NO: 1706968 - RNA, 22 nt, Salmonella enterica enterica serovar Typhi
guaggccggauaagcggcagcg

SEQ ID NO: 1706969 - RNA, 20 nt, Salmonella enterica enterica serovar Typhi
guagcgagaagccgauggaa

SEQ ID NO: 1706970 - RNA, 17 nt, Salmonella enterica enterica serovar Typhi
guagccgcgcgccgccu

SEQ ID NO: 1706971 - RNA, 20 nt, Salmonella enterica enterica serovar Typhi
guagccgcagaaccauuucc

SEQ ID NO: 1706972 - RNA, 17 nt, Salmonella enterica enterica serovar Typhi
guagcgccaucaggcau

SEQ ID NO: 1706973 - RNA, 13 nt, Salmonella enterica enterica serovar Typhi
guagcgcgcgcua

SEQ ID NO: 1706974 - RNA, 16 nt, Salmonella enterica enterica serovar Typhi
guagcguacaggcgga

SEQ ID NO: 1706975 - RNA, 16 nt, Salmonella enterica enterica serovar Typhi
guagcgggggccggcu

SEQ ID NO: 1706976 - RNA, 14 nt, Salmonella enterica enterica serovar Typhi
guagcggcgccggg

SEQ ID NO: 1706977 - RNA, 16 nt, Salmonella enterica enterica serovar Typhi
guagcuuuuccgcugg

SEQ ID NO: 1706978 - RNA, 14 nt, Salmonella enterica enterica serovar Typhi
guagcuggcugccg

SEQ ID NO: 1706979 - RNA, 16 nt, Salmonella enterica enterica serovar Typhi
guagcugagcgucagg

SEQ ID NO: 1706980 - RNA, 18 nt, Salmonella enterica enterica serovar Typhi
guagcuggucgccagcgc

SEQ ID NO: 1706981 - RNA, 15 nt, Salmonella enterica enterica serovar Typhi
guagcuucagcugga

SEQ ID NO: 1706982 - RNA, 17 nt, Salmonella enterica enterica serovar Typhi
guagcuccagacaggac

SEQ ID NO: 1706983 - RNA, 20 nt, Salmonella enterica enterica serovar Typhi
guagcuauaaucacaggggu

SEQ ID NO: 1706984 - RNA, 20 nt, Salmonella enterica enterica serovar Typhi
guagcguuauccagucagag

SEQ ID NO: 1706985 - RNA, 21 nt, Salmonella enterica enterica serovar Typhi
guauaaauuuccgcagccaga

SEQ ID NO: 1706986 - RNA, 14 nt, Salmonella enterica enterica serovar Typhi
guauacacuuucca

SEQ ID NO: 1706987 - RNA, 15 nt, Salmonella enterica enterica serovar Typhi
guaguuauaaauuua

SEQ ID NO: 1706988 - RNA, 19 nt, Salmonella enterica enterica serovar Typhi
guauagaauacuuccugcu

SEQ ID NO: 1706989 - RNA, 13 nt, Salmonella enterica enterica serovar Typhi
guauaggaaaaug

SEQ ID NO: 1706990 - RNA, 21 nt, Salmonella enterica enterica serovar Typhi
guauagcggcguuuauauaaa

SEQ ID NO: 1706991 - RNA, 13 nt, Salmonella enterica enterica serovar Typhi
guauagccaggca

SEQ ID NO: 1706992 - RNA, 15 nt, Salmonella enterica enterica serovar Typhi
guauaugaauauacg

SEQ ID NO: 1706993 - RNA, 13 nt, Salmonella enterica enterica serovar Typhi
guaucuuccagcg

SEQ ID NO: 1706994 - RNA, 22 nt, Salmonella enterica enterica serovar Typhi
guaucuucgccguauucuuacc

SEQ ID NO: 1706995 - RNA, 22 nt, Salmonella enterica enterica serovar Typhi
guaucugucccagccuuccugg

SEQ ID NO: 1706996 - RNA, 22 nt, Salmonella enterica enterica serovar Typhi
guaucguuugcccaucauucaa

SEQ ID NO: 1706997 - RNA, 18 nt, Salmonella enterica enterica serovar Typhi
guaucguguuauuuucaa

SEQ ID NO: 1706998 - RNA, 19 nt, Salmonella enterica enterica serovar Typhi
guauccuaaugccacggcu

SEQ ID NO: 1706999 - RNA, 15 nt, Salmonella enterica enterica serovar Typhi
guauccguacuuucu

SEQ ID NO: 1707000 - RNA, 18 nt, Salmonella enterica enterica serovar Typhi
guauccccagucuuccug

SEQ ID NO: 1707001 - RNA, 17 nt, Salmonella enterica enterica serovar Typhi
guaucccgccagcggcg

SEQ ID NO: 1707002 - RNA, 15 nt, Salmonella enterica enterica serovar Typhi
guauccagcaacagu

SEQ ID NO: 1707003 - RNA, 21 nt, Salmonella enterica enterica serovar Typhi
guauccauucucaucagaccg

SEQ ID NO: 1707004 - RNA, 12 nt, Salmonella enterica enterica serovar Typhi
guaucccaaacg

SEQ ID NO: 1707005 - RNA, 16 nt, Salmonella enterica enterica serovar Typhi
guaucacuguaaaagg

SEQ ID NO: 1707006 - RNA, 15 nt, Salmonella enterica enterica serovar Typhi
guaucaucagauccu

SEQ ID NO: 1707007 - RNA, 21 nt, Salmonella enterica enterica serovar Typhi
guaucaucgcuuaacggccca

SEQ ID NO: 1707008 - RNA, 15 nt, Salmonella enterica enterica serovar Typhi
guaucaucgauuuua

SEQ ID NO: 1707009 - RNA, 16 nt, Salmonella enterica enterica serovar Typhi
guaugcggucaaaagc

SEQ ID NO: 1707010 - RNA, 15 nt, Salmonella enterica enterica serovar Typhi
guaugcagccaggcc

SEQ ID NO: 1707011 - RNA, 17 nt, Salmonella enterica enterica serovar Typhi
guaugcagccaggccau

SEQ ID NO: 1707012 - RNA, 15 nt, Salmonella enterica enterica serovar Typhi
guaugguggcggggu

SEQ ID NO: 1707013 - RNA, 22 nt, Salmonella enterica enterica serovar Typhi
guauguuaggguagaaaaaggu

SEQ ID NO: 1707014 - RNA, 12 nt, Salmonella enterica enterica serovar Typhi
guauuaaauaca

SEQ ID NO: 1707015 - RNA, 23 nt, Salmonella enterica enterica serovar Typhi
guauuacaugccguuaauaaugu

SEQ ID NO: 1707016 - RNA, 18 nt, Salmonella enterica enterica serovar Typhi
guauuacaagcaguuaau

SEQ ID NO: 1707017 - RNA, 20 nt, Salmonella enterica enterica serovar Typhi
guauuacaaguaauaaaaua

SEQ ID NO: 1707018 - RNA, 21 nt, Salmonella enterica enterica serovar Typhi
guauuacaaguaauaaaauaa

SEQ ID NO: 1707019 - RNA, 18 nt, Salmonella enterica enterica serovar Typhi
guauucgguggaaaccgc

SEQ ID NO: 1707020 - RNA, 14 nt, Salmonella enterica enterica serovar Typhi
guauucguuaccag

SEQ ID NO: 1707021 - RNA, 13 nt, Salmonella enterica enterica serovar Typhi
guauucuaacuga

SEQ ID NO: 1707022 - RNA, 21 nt, Salmonella enterica enterica serovar Typhi
guauucugcgccagccagcuc

SEQ ID NO: 1707023 - RNA, 14 nt, Salmonella enterica enterica serovar Typhi
guauugaagcgaua

SEQ ID NO: 1707024 - RNA, 20 nt, Salmonella enterica enterica serovar Typhi
guauuccagucgcuccacca

SEQ ID NO: 1707025 - RNA, 17 nt, Salmonella enterica enterica serovar Typhi
guauuccguuccuucuu

SEQ ID NO: 1707026 - RNA, 22 nt, Salmonella enterica enterica serovar Typhi
guauucauaugcucuccuggca

SEQ ID NO: 1707027 - RNA, 12 nt, Salmonella enterica enterica serovar Typhi
guauugauuuuu

SEQ ID NO: 1707028 - RNA, 13 nt, Salmonella enterica enterica serovar Typhi
guauuggcaagaa

SEQ ID NO: 1707029 - RNA, 12 nt, Salmonella enterica enterica serovar Typhi
guauugugcuua

SEQ ID NO: 1707030 - RNA, 16 nt, Salmonella enterica enterica serovar Typhi
guauuuuauuuuucaa

SEQ ID NO: 1707031 - RNA, 17 nt, Salmonella enterica enterica serovar Typhi
guauuucacuuuugccg

SEQ ID NO: 1707032 - RNA, 11 nt, Salmonella enterica enterica serovar Typhi
guauuuauucu

SEQ ID NO: 1707033 - RNA, 18 nt, Salmonella enterica enterica serovar Typhi
gucaaacuuuuauaaaua

SEQ ID NO: 1707034 - RNA, 16 nt, Salmonella enterica enterica serovar Typhi
gucaaacuuuuauaaa

SEQ ID NO: 1707035 - RNA, 23 nt, Salmonella enterica enterica serovar Typhi
gucaaagaaaacuuucauuucac

SEQ ID NO: 1707036 - RNA, 22 nt, Salmonella enterica enterica serovar Typhi
gucaaaugggaucuucaaugaa

SEQ ID NO: 1707037 - RNA, 18 nt, Salmonella enterica enterica serovar Typhi
gucaaauuaagaaaguag

SEQ ID NO: 1707038 - RNA, 19 nt, Salmonella enterica enterica serovar Typhi
gucaaacaguucagacacc

SEQ ID NO: 1707039 - RNA, 19 nt, Salmonella enterica enterica serovar Typhi
gucaaacaccugaaccagc

SEQ ID NO: 1707040 - RNA, 21 nt, Salmonella enterica enterica serovar Typhi
gucaaauucacccguuauuca

SEQ ID NO: 1707041 - RNA, 18 nt, Salmonella enterica enterica serovar Typhi
gucaacaaugcuuucacc

SEQ ID NO: 1707042 - RNA, 16 nt, Salmonella enterica enterica serovar Typhi
gucaaccaugaucacu

SEQ ID NO: 1707043 - RNA, 13 nt, Salmonella enterica enterica serovar Typhi
gucaaaaugauca

SEQ ID NO: 1707044 - RNA, 11 nt, Salmonella enterica enterica serovar Typhi
gucaaaaauaa

SEQ ID NO: 1707045 - RNA, 13 nt, Salmonella enterica enterica serovar Typhi
gucgaugauuuuc

SEQ ID NO: 1707046 - RNA, 15 nt, Salmonella enterica enterica serovar Typhi
gucgcagcggcugcg

SEQ ID NO: 1707047 - RNA, 17 nt, Salmonella enterica enterica serovar Typhi
gucgcauacuuccucac

SEQ ID NO: 1707048 - RNA, 16 nt, Salmonella enterica enterica serovar Typhi
gucgcauggcuaaaag

SEQ ID NO: 1707049 - RNA, 21 nt, Salmonella enterica enterica serovar Typhi
gucgagaaaccgcucgccgcc

SEQ ID NO: 1707050 - RNA, 14 nt, Salmonella enterica enterica serovar Typhi
gucgaacgguaaca

SEQ ID NO: 1707051 - RNA, 18 nt, Salmonella enterica enterica serovar Typhi
guccuucacaaacuucuc

SEQ ID NO: 1707052 - RNA, 22 nt, Salmonella enterica enterica serovar Typhi
guccucggcaacauaccgggua

SEQ ID NO: 1707053 - RNA, 19 nt, Salmonella enterica enterica serovar Typhi
guccucuuucccuuuuuaa

SEQ ID NO: 1707054 - RNA, 17 nt, Salmonella enterica enterica serovar Typhi
guccgccuaccagcaca

SEQ ID NO: 1707055 - RNA, 21 nt, Salmonella enterica enterica serovar Typhi
guccgccuaccagcacaugau

SEQ ID NO: 1707056 - RNA, 20 nt, Salmonella enterica enterica serovar Typhi
guccguuaccccuuuuucaa

SEQ ID NO: 1707057 - RNA, 14 nt, Salmonella enterica enterica serovar Typhi
guccgguguccauc

SEQ ID NO: 1707058 - RNA, 16 nt, Salmonella enterica enterica serovar Typhi
guccgguccgguggcg

SEQ ID NO: 1707059 - RNA, 20 nt, Salmonella enterica enterica serovar Typhi
guccgguugcaguacaggca

SEQ ID NO: 1707060 - RNA, 22 nt, Salmonella enterica enterica serovar Typhi
guccguauuauccacccccgca

SEQ ID NO: 1707061 - RNA, 21 nt, Salmonella enterica enterica serovar Typhi
gucgcuaaaacccaccaccuc

SEQ ID NO: 1707062 - RNA, 17 nt, Salmonella enterica enterica serovar Typhi
gucggccaggugccgag

SEQ ID NO: 1707063 - RNA, 22 nt, Salmonella enterica enterica serovar Typhi
gucgcgccaaaagaggcagcaa

SEQ ID NO: 1707064 - RNA, 20 nt, Salmonella enterica enterica serovar Typhi
gucgcgcauggcagggcgau

SEQ ID NO: 1707065 - RNA, 16 nt, Salmonella enterica enterica serovar Typhi
gucgcgcccuccucca

SEQ ID NO: 1707066 - RNA, 14 nt, Salmonella enterica enterica serovar Typhi
gucgcgcgccgcaa

SEQ ID NO: 1707067 - RNA, 16 nt, Salmonella enterica enterica serovar Typhi
gucgcgcgccgccugc

SEQ ID NO: 1707068 - RNA, 18 nt, Salmonella enterica enterica serovar Typhi
gucgccacgcgacgccag

SEQ ID NO: 1707069 - RNA, 12 nt, Salmonella enterica enterica serovar Typhi
gucgccaggcaa

SEQ ID NO: 1707070 - RNA, 23 nt, Salmonella enterica enterica serovar Typhi
gucgccaggcaagguuaacguca

SEQ ID NO: 1707071 - RNA, 19 nt, Salmonella enterica enterica serovar Typhi
gucgccaccaugcugguug

SEQ ID NO: 1707072 - RNA, 17 nt, Salmonella enterica enterica serovar Typhi
gucgccccaaucgccag

SEQ ID NO: 1707073 - RNA, 21 nt, Salmonella enterica enterica serovar Typhi
gucgccauauccaagccccuc

SEQ ID NO: 1707074 - RNA, 18 nt, Salmonella enterica enterica serovar Typhi
gucguauucuugcuaccg

SEQ ID NO: 1707075 - RNA, 23 nt, Salmonella enterica enterica serovar Typhi
gucggguucgcgcgccgcuuccg

SEQ ID NO: 1707076 - RNA, 12 nt, Salmonella enterica enterica serovar Typhi
gucggcgccauc

SEQ ID NO: 1707077 - RNA, 19 nt, Salmonella enterica enterica serovar Typhi
gucuacccgguguaaaaaa

SEQ ID NO: 1707078 - RNA, 19 nt, Salmonella enterica enterica serovar Typhi
gucguuuucacuuguucaa

SEQ ID NO: 1707079 - RNA, 19 nt, Salmonella enterica enterica serovar Typhi
gucgucgauuuucugcuca

SEQ ID NO: 1707080 - RNA, 20 nt, Salmonella enterica enterica serovar Typhi
gucacagguucgaaucccgu

SEQ ID NO: 1707081 - RNA, 17 nt, Salmonella enterica enterica serovar Typhi
gucacaauacuuccgcu

SEQ ID NO: 1707082 - RNA, 12 nt, Salmonella enterica enterica serovar Typhi
gucacaacagcc

SEQ ID NO: 1707083 - RNA, 21 nt, Salmonella enterica enterica serovar Typhi
gucacaaucguucucaggaag

SEQ ID NO: 1707084 - RNA, 18 nt, Salmonella enterica enterica serovar Typhi
gucacaaagcccaccgcg

SEQ ID NO: 1707085 - RNA, 22 nt, Salmonella enterica enterica serovar Typhi
gucaacgaggugaauaaauccu

SEQ ID NO: 1707086 - RNA, 16 nt, Salmonella enterica enterica serovar Typhi
gucaacgccaagcgcg

SEQ ID NO: 1707087 - RNA, 16 nt, Salmonella enterica enterica serovar Typhi
gucaauacaucacgca

SEQ ID NO: 1707088 - RNA, 20 nt, Salmonella enterica enterica serovar Typhi
gucaauaagugauccauacu

SEQ ID NO: 1707089 - RNA, 16 nt, Salmonella enterica enterica serovar Typhi
gucacgauccgcaaau

SEQ ID NO: 1707090 - RNA, 18 nt, Salmonella enterica enterica serovar Typhi
gucaccucuuucgccgcu

SEQ ID NO: 1707091 - RNA, 17 nt, Salmonella enterica enterica serovar Typhi
gucacuuacuuucuugc

SEQ ID NO: 1707092 - RNA, 11 nt, Salmonella enterica enterica serovar Typhi
gucacuucaac

SEQ ID NO: 1707093 - RNA, 16 nt, Salmonella enterica enterica serovar Typhi
gucacuucaaccuuua

SEQ ID NO: 1707094 - RNA, 23 nt, Salmonella enterica enterica serovar Typhi
gucacuucaaccuuuaucuguug

SEQ ID NO: 1707095 - RNA, 13 nt, Salmonella enterica enterica serovar Typhi
gucaccagcagca

SEQ ID NO: 1707096 - RNA, 12 nt, Salmonella enterica enterica serovar Typhi
gucacauccaga

SEQ ID NO: 1707097 - RNA, 20 nt, Salmonella enterica enterica serovar Typhi
gucacauggcgaaaaucacu

SEQ ID NO: 1707098 - RNA, 14 nt, Salmonella enterica enterica serovar Typhi
gucaccgggcgcug

SEQ ID NO: 1707099 - RNA, 15 nt, Salmonella enterica enterica serovar Typhi
gucaccguauugcca

SEQ ID NO: 1707100 - RNA, 14 nt, Salmonella enterica enterica serovar Typhi
gucaccgugccagu

SEQ ID NO: 1707101 - RNA, 14 nt, Salmonella enterica enterica serovar Typhi
gucaguggaaaaca

SEQ ID NO: 1707102 - RNA, 19 nt, Salmonella enterica enterica serovar Typhi
gucagugagcccuccucca

SEQ ID NO: 1707103 - RNA, 22 nt, Salmonella enterica enterica serovar Typhi
gucagucgccagaaggcaggcu

SEQ ID NO: 1707104 - RNA, 14 nt, Salmonella enterica enterica serovar Typhi
gucaguucgccacg

SEQ ID NO: 1707105 - RNA, 14 nt, Salmonella enterica enterica serovar Typhi
gucaguuccauaau

SEQ ID NO: 1707106 - RNA, 13 nt, Salmonella enterica enterica serovar Typhi
gucagcuuccugc

SEQ ID NO: 1707107 - RNA, 17 nt, Salmonella enterica enterica serovar Typhi
gucaggaggccugaaua

SEQ ID NO: 1707108 - RNA, 22 nt, Salmonella enterica enterica serovar Typhi
gucaggauaaaauccugcacgc

SEQ ID NO: 1707109 - RNA, 18 nt, Salmonella enterica enterica serovar Typhi
gucaguacgucgcauacu

SEQ ID NO: 1707110 - RNA, 18 nt, Salmonella enterica enterica serovar Typhi
gucaguaccagcgagaua

SEQ ID NO: 1707111 - RNA, 15 nt, Salmonella enterica enterica serovar Typhi
gucaguaauaugaau

SEQ ID NO: 1707112 - RNA, 22 nt, Salmonella enterica enterica serovar Typhi
gucaggaugggcuucuucacua

SEQ ID NO: 1707113 - RNA, 21 nt, Salmonella enterica enterica serovar Typhi
gucaggcaacaggauguccug

SEQ ID NO: 1707114 - RNA, 15 nt, Salmonella enterica enterica serovar Typhi
gucagcaauuaacaa

SEQ ID NO: 1707115 - RNA, 13 nt, Salmonella enterica enterica serovar Typhi
gucagcaagauua

SEQ ID NO: 1707116 - RNA, 19 nt, Salmonella enterica enterica serovar Typhi
gucagaucguaugcgccug

SEQ ID NO: 1707117 - RNA, 13 nt, Salmonella enterica enterica serovar Typhi
gucagauccuuuu

SEQ ID NO: 1707118 - RNA, 22 nt, Salmonella enterica enterica serovar Typhi
gucagauccuuuuucugcgcca

SEQ ID NO: 1707119 - RNA, 16 nt, Salmonella enterica enterica serovar Typhi
gucagcgcggcuucca

SEQ ID NO: 1707120 - RNA, 21 nt, Salmonella enterica enterica serovar Typhi
gucagcgcuugccgcagcgca

SEQ ID NO: 1707121 - RNA, 14 nt, Salmonella enterica enterica serovar Typhi
gucagcggcgcgcc

SEQ ID NO: 1707122 - RNA, 18 nt, Salmonella enterica enterica serovar Typhi
gucagcgucuauagauga

SEQ ID NO: 1707123 - RNA, 19 nt, Salmonella enterica enterica serovar Typhi
gucccugauguagcugggu

SEQ ID NO: 1707124 - RNA, 18 nt, Salmonella enterica enterica serovar Typhi
gucccuccgcuuccacuc

SEQ ID NO: 1707125 - RNA, 14 nt, Salmonella enterica enterica serovar Typhi
guccgacagcaaga

SEQ ID NO: 1707126 - RNA, 19 nt, Salmonella enterica enterica serovar Typhi
guccccagcguaccacgcc

SEQ ID NO: 1707127 - RNA, 15 nt, Salmonella enterica enterica serovar Typhi
guccagggaaaaaua

SEQ ID NO: 1707128 - RNA, 15 nt, Salmonella enterica enterica serovar Typhi
guccagaugcugggc

SEQ ID NO: 1707129 - RNA, 20 nt, Salmonella enterica enterica serovar Typhi
guccagcagacucauggaca

SEQ ID NO: 1707130 - RNA, 16 nt, Salmonella enterica enterica serovar Typhi
guccaguucguucugc

SEQ ID NO: 1707131 - RNA, 18 nt, Salmonella enterica enterica serovar Typhi
guccauuuauugcaggua

SEQ ID NO: 1707132 - RNA, 19 nt, Salmonella enterica enterica serovar Typhi
guccauuuuuuaucugaca

SEQ ID NO: 1707133 - RNA, 14 nt, Salmonella enterica enterica serovar Typhi
guccauuuuccuau

SEQ ID NO: 1707134 - RNA, 14 nt, Salmonella enterica enterica serovar Typhi
guccauuuuuuauc

SEQ ID NO: 1707135 - RNA, 22 nt, Salmonella enterica enterica serovar Typhi
gucaugcuucaccucagcaaaa

SEQ ID NO: 1707136 - RNA, 13 nt, Salmonella enterica enterica serovar Typhi
gucauggcaaacg

SEQ ID NO: 1707137 - RNA, 15 nt, Salmonella enterica enterica serovar Typhi
gucaugcuaaaacag

SEQ ID NO: 1707138 - RNA, 17 nt, Salmonella enterica enterica serovar Typhi
gucaugcuaaaacagau

SEQ ID NO: 1707139 - RNA, 19 nt, Salmonella enterica enterica serovar Typhi
gucauaucgaugguaauaa

SEQ ID NO: 1707140 - RNA, 23 nt, Salmonella enterica enterica serovar Typhi
gucauaacgcuuuguacagacaa

SEQ ID NO: 1707141 - RNA, 19 nt, Salmonella enterica enterica serovar Typhi
gucauagucggcgccaaag

SEQ ID NO: 1707142 - RNA, 22 nt, Salmonella enterica enterica serovar Typhi
gucauagcaaugauuagggaca

SEQ ID NO: 1707143 - RNA, 16 nt, Salmonella enterica enterica serovar Typhi
gucauacugugcguga

SEQ ID NO: 1707144 - RNA, 19 nt, Salmonella enterica enterica serovar Typhi
guccacgacaauauccucg

SEQ ID NO: 1707145 - RNA, 15 nt, Salmonella enterica enterica serovar Typhi
guccacgacaauauc

SEQ ID NO: 1707146 - RNA, 15 nt, Salmonella enterica enterica serovar Typhi
gucauuguaaaaccg

SEQ ID NO: 1707147 - RNA, 14 nt, Salmonella enterica enterica serovar Typhi
gucauuuauuuucg

SEQ ID NO: 1707148 - RNA, 13 nt, Salmonella enterica enterica serovar Typhi
gucauugagccgc

SEQ ID NO: 1707149 - RNA, 17 nt, Salmonella enterica enterica serovar Typhi
gucauugcgcgcaugca

SEQ ID NO: 1707150 - RNA, 14 nt, Salmonella enterica enterica serovar Typhi
gucauucaggucua

SEQ ID NO: 1707151 - RNA, 18 nt, Salmonella enterica enterica serovar Typhi
gucaugcuggcgaugagu

SEQ ID NO: 1707152 - RNA, 14 nt, Salmonella enterica enterica serovar Typhi
gucauugacagcaa

SEQ ID NO: 1707153 - RNA, 22 nt, Salmonella enterica enterica serovar Typhi
gucauuccugcguugaccagcg

SEQ ID NO: 1707154 - RNA, 13 nt, Salmonella enterica enterica serovar Typhi
guccacuuucugu

SEQ ID NO: 1707155 - RNA, 21 nt, Salmonella enterica enterica serovar Typhi
guccagauuacgcauggucaa

SEQ ID NO: 1707156 - RNA, 22 nt, Salmonella enterica enterica serovar Typhi
guccagauugagacaaauaacu

SEQ ID NO: 1707157 - RNA, 16 nt, Salmonella enterica enterica serovar Typhi
guccacgcgagcugcc

SEQ ID NO: 1707158 - RNA, 21 nt, Salmonella enterica enterica serovar Typhi
gugcgacaucgacaaaauagu

SEQ ID NO: 1707159 - RNA, 14 nt, Salmonella enterica enterica serovar Typhi
gugccugccgccuc

SEQ ID NO: 1707160 - RNA, 17 nt, Salmonella enterica enterica serovar Typhi
gugccugccuguggcug

SEQ ID NO: 1707161 - RNA, 19 nt, Salmonella enterica enterica serovar Typhi
gugccugacagcaaugagc

SEQ ID NO: 1707162 - RNA, 11 nt, Salmonella enterica enterica serovar Typhi
gugccugcugg

SEQ ID NO: 1707163 - RNA, 21 nt, Salmonella enterica enterica serovar Typhi
gugccguuaaucgauaagcca

SEQ ID NO: 1707164 - RNA, 12 nt, Salmonella enterica enterica serovar Typhi
gugccgguggga

SEQ ID NO: 1707165 - RNA, 19 nt, Salmonella enterica enterica serovar Typhi
gugccgguaaagggcggga

SEQ ID NO: 1707166 - RNA, 12 nt, Salmonella enterica enterica serovar Typhi
gugccgcuggug

SEQ ID NO: 1707167 - RNA, 17 nt, Salmonella enterica enterica serovar Typhi
gugccacuccgccagua

SEQ ID NO: 1707168 - RNA, 12 nt, Salmonella enterica enterica serovar Typhi
gugccagguuuu

SEQ ID NO: 1707169 - RNA, 20 nt, Salmonella enterica enterica serovar Typhi
gugccaguaacucaucgcca

SEQ ID NO: 1707170 - RNA, 12 nt, Salmonella enterica enterica serovar Typhi
gugccaguaauc

SEQ ID NO: 1707171 - RNA, 16 nt, Salmonella enterica enterica serovar Typhi
gugccaugaccauuca

SEQ ID NO: 1707172 - RNA, 12 nt, Salmonella enterica enterica serovar Typhi
gugcccaucggc

SEQ ID NO: 1707173 - RNA, 19 nt, Salmonella enterica enterica serovar Typhi
gugcccgcgaucgcuucca

SEQ ID NO: 1707174 - RNA, 14 nt, Salmonella enterica enterica serovar Typhi
gugcaucuggggga

SEQ ID NO: 1707175 - RNA, 13 nt, Salmonella enterica enterica serovar Typhi
gugcaucuccucg

SEQ ID NO: 1707176 - RNA, 14 nt, Salmonella enterica enterica serovar Typhi
gugcaucuccucgc

SEQ ID NO: 1707177 - RNA, 22 nt, Salmonella enterica enterica serovar Typhi
gugcaugggauacgccagcaga

SEQ ID NO: 1707178 - RNA, 20 nt, Salmonella enterica enterica serovar Typhi
gugcauuauuuuagugaaaa

SEQ ID NO: 1707179 - RNA, 20 nt, Salmonella enterica enterica serovar Typhi
gugcaucaggaaauccugga

SEQ ID NO: 1707180 - RNA, 22 nt, Salmonella enterica enterica serovar Typhi
gugcauaaagauuggcaucugc

SEQ ID NO: 1707181 - RNA, 13 nt, Salmonella enterica enterica serovar Typhi
gugcagugaacca

SEQ ID NO: 1707182 - RNA, 16 nt, Salmonella enterica enterica serovar Typhi
gugaugacuaaaucag

SEQ ID NO: 1707183 - RNA, 15 nt, Salmonella enterica enterica serovar Typhi
gugaugacuaaauca

SEQ ID NO: 1707184 - RNA, 18 nt, Salmonella enterica enterica serovar Typhi
gugaugagcucaaauaug

SEQ ID NO: 1707185 - RNA, 16 nt, Salmonella enterica enterica serovar Typhi
gugaugcggacgcuga

SEQ ID NO: 1707186 - RNA, 19 nt, Salmonella enterica enterica serovar Typhi
gugaugcgggacugcugcu

SEQ ID NO: 1707187 - RNA, 15 nt, Salmonella enterica enterica serovar Typhi
gugauuacaaaaugu

SEQ ID NO: 1707188 - RNA, 12 nt, Salmonella enterica enterica serovar Typhi
gugaugugcugg

SEQ ID NO: 1707189 - RNA, 12 nt, Salmonella enterica enterica serovar Typhi
gugauuacaaaa

SEQ ID NO: 1707190 - RNA, 15 nt, Salmonella enterica enterica serovar Typhi
gugauggguauuaga

SEQ ID NO: 1707191 - RNA, 15 nt, Salmonella enterica enterica serovar Typhi
gucuaugguacacau

SEQ ID NO: 1707192 - RNA, 14 nt, Salmonella enterica enterica serovar Typhi
gucuaugguacaca

SEQ ID NO: 1707193 - RNA, 16 nt, Salmonella enterica enterica serovar Typhi
gucuaucgcuccuccc

SEQ ID NO: 1707194 - RNA, 11 nt, Salmonella enterica enterica serovar Typhi
gucuauuuauu

SEQ ID NO: 1707195 - RNA, 21 nt, Salmonella enterica enterica serovar Typhi
gugauagcaggcacuguggug

SEQ ID NO: 1707196 - RNA, 14 nt, Salmonella enterica enterica serovar Typhi
gucucaaaaaauau

SEQ ID NO: 1707197 - RNA, 21 nt, Salmonella enterica enterica serovar Typhi
gucucacccguuuucuccuuc

SEQ ID NO: 1707198 - RNA, 19 nt, Salmonella enterica enterica serovar Typhi
gugcgggaggaauaaaaga

SEQ ID NO: 1707199 - RNA, 18 nt, Salmonella enterica enterica serovar Typhi
gugcggcgcacugccuga

SEQ ID NO: 1707200 - RNA, 15 nt, Salmonella enterica enterica serovar Typhi
gugcgguuuuccuga

SEQ ID NO: 1707201 - RNA, 16 nt, Salmonella enterica enterica serovar Typhi
gugcgcgggaggcggu

SEQ ID NO: 1707202 - RNA, 20 nt, Salmonella enterica enterica serovar Typhi
gugcgccguccugcaaggca

SEQ ID NO: 1707203 - RNA, 13 nt, Salmonella enterica enterica serovar Typhi
gugcgcgcgggcg

SEQ ID NO: 1707204 - RNA, 22 nt, Salmonella enterica enterica serovar Typhi
gugcgcggucauaucuggacgg

SEQ ID NO: 1707205 - RNA, 13 nt, Salmonella enterica enterica serovar Typhi
gugcgccccaggu

SEQ ID NO: 1707206 - RNA, 13 nt, Salmonella enterica enterica serovar Typhi
gugcgccugcugc

SEQ ID NO: 1707207 - RNA, 17 nt, Salmonella enterica enterica serovar Typhi
gugcgccguccugcaag

SEQ ID NO: 1707208 - RNA, 12 nt, Salmonella enterica enterica serovar Typhi
gugcgccccagc

SEQ ID NO: 1707209 - RNA, 19 nt, Salmonella enterica enterica serovar Typhi
gugcgauucagcgcaggca

SEQ ID NO: 1707210 - RNA, 13 nt, Salmonella enterica enterica serovar Typhi
gugcgagaaaaag

SEQ ID NO: 1707211 - RNA, 14 nt, Salmonella enterica enterica serovar Typhi
guggaaaacagcau

SEQ ID NO: 1707212 - RNA, 22 nt, Salmonella enterica enterica serovar Typhi
guggaaugccccagguuauaga

SEQ ID NO: 1707213 - RNA, 17 nt, Salmonella enterica enterica serovar Typhi
gugcuggauggcagaca

SEQ ID NO: 1707214 - RNA, 21 nt, Salmonella enterica enterica serovar Typhi
gugcucucccagcugagcuaa

SEQ ID NO: 1707215 - RNA, 18 nt, Salmonella enterica enterica serovar Typhi
gugcucauuugcggcguc

SEQ ID NO: 1707216 - RNA, 14 nt, Salmonella enterica enterica serovar Typhi
gugcuacgggcgcu

SEQ ID NO: 1707217 - RNA, 18 nt, Salmonella enterica enterica serovar Typhi
guguaucgcccugccagc

SEQ ID NO: 1707218 - RNA, 16 nt, Salmonella enterica enterica serovar Typhi
guguauauauugcauu

SEQ ID NO: 1707219 - RNA, 20 nt, Salmonella enterica enterica serovar Typhi
guguauauauugcauuuuau

SEQ ID NO: 1707220 - RNA, 15 nt, Salmonella enterica enterica serovar Typhi
guguauaccaaaaau

SEQ ID NO: 1707221 - RNA, 11 nt, Salmonella enterica enterica serovar Typhi
guguauuuuuu

SEQ ID NO: 1707222 - RNA, 11 nt, Salmonella enterica enterica serovar Typhi
gugucaaagcg

SEQ ID NO: 1707223 - RNA, 18 nt, Salmonella enterica enterica serovar Typhi
guguccguaagcggcgga

SEQ ID NO: 1707224 - RNA, 19 nt, Salmonella enterica enterica serovar Typhi
guguaauaaccguggcggc

SEQ ID NO: 1707225 - RNA, 21 nt, Salmonella enterica enterica serovar Typhi
guguaauaaccguggcggcag

SEQ ID NO: 1707226 - RNA, 14 nt, Salmonella enterica enterica serovar Typhi
guguaaaagccagc

SEQ ID NO: 1707227 - RNA, 23 nt, Salmonella enterica enterica serovar Typhi
guggugcaagcaccuuauccggc

SEQ ID NO: 1707228 - RNA, 14 nt, Salmonella enterica enterica serovar Typhi
guggucgcggcuca

SEQ ID NO: 1707229 - RNA, 19 nt, Salmonella enterica enterica serovar Typhi
guggucgucagccgugagc

SEQ ID NO: 1707230 - RNA, 17 nt, Salmonella enterica enterica serovar Typhi
gugggcgugucgccggg

SEQ ID NO: 1707231 - RNA, 17 nt, Salmonella enterica enterica serovar Typhi
gugguacaccaguacau

SEQ ID NO: 1707232 - RNA, 13 nt, Salmonella enterica enterica serovar Typhi
guggcgcuguucu

SEQ ID NO: 1707233 - RNA, 22 nt, Salmonella enterica enterica serovar Typhi
guggcgcuguucuugcugcugc

SEQ ID NO: 1707234 - RNA, 23 nt, Salmonella enterica enterica serovar Typhi
guggcgcuuuccggcgcuuccug

SEQ ID NO: 1707235 - RNA, 14 nt, Salmonella enterica enterica serovar Typhi
guggcggcaaaaaa

SEQ ID NO: 1707236 - RNA, 22 nt, Salmonella enterica enterica serovar Typhi
guggacaucgccauuccaagaa

SEQ ID NO: 1707237 - RNA, 19 nt, Salmonella enterica enterica serovar Typhi
guggccgauauugccuuca

SEQ ID NO: 1707238 - RNA, 19 nt, Salmonella enterica enterica serovar Typhi
guuauccagcaaccaggua

SEQ ID NO: 1707239 - RNA, 18 nt, Salmonella enterica enterica serovar Typhi
guuaucgaggcgcuggcg

SEQ ID NO: 1707240 - RNA, 15 nt, Salmonella enterica enterica serovar Typhi
guuauguccuuccag

SEQ ID NO: 1707241 - RNA, 15 nt, Salmonella enterica enterica serovar Typhi
guuauucagcaggag

SEQ ID NO: 1707242 - RNA, 15 nt, Salmonella enterica enterica serovar Typhi
guuauucauucaccc

SEQ ID NO: 1707243 - RNA, 14 nt, Salmonella enterica enterica serovar Typhi
guuauucgaugcgg

SEQ ID NO: 1707244 - RNA, 23 nt, Salmonella enterica enterica serovar Typhi
guuauucgcccaaaugcacugca

SEQ ID NO: 1707245 - RNA, 17 nt, Salmonella enterica enterica serovar Typhi
guuaguuucuauuaaau

SEQ ID NO: 1707246 - RNA, 13 nt, Salmonella enterica enterica serovar Typhi
guuagcucuuuca

SEQ ID NO: 1707247 - RNA, 16 nt, Salmonella enterica enterica serovar Typhi
guuagcgucaguaaac

SEQ ID NO: 1707248 - RNA, 15 nt, Salmonella enterica enterica serovar Typhi
guuagcaaaaaugcc

SEQ ID NO: 1707249 - RNA, 20 nt, Salmonella enterica enterica serovar Typhi
guuagauuagguacguacau

SEQ ID NO: 1707250 - RNA, 22 nt, Salmonella enterica enterica serovar Typhi
guuauaaggccugccguccuga

SEQ ID NO: 1707251 - RNA, 18 nt, Salmonella enterica enterica serovar Typhi
guuauaaauccccgccgc

SEQ ID NO: 1707252 - RNA, 22 nt, Salmonella enterica enterica serovar Typhi
guuauaaauuuauuuuuugcug

SEQ ID NO: 1707253 - RNA, 22 nt, Salmonella enterica enterica serovar Typhi
guuauaaccgaugcagccugga

SEQ ID NO: 1707254 - RNA, 23 nt, Salmonella enterica enterica serovar Typhi
guuacggcugaagcugccguccc

SEQ ID NO: 1707255 - RNA, 14 nt, Salmonella enterica enterica serovar Typhi
guuacggaaaaaau

SEQ ID NO: 1707256 - RNA, 16 nt, Salmonella enterica enterica serovar Typhi
guuacggaaaaaauac

SEQ ID NO: 1707257 - RNA, 13 nt, Salmonella enterica enterica serovar Typhi
guuacgcgccacg

SEQ ID NO: 1707258 - RNA, 16 nt, Salmonella enterica enterica serovar Typhi
guuacgcgcugcaaau

SEQ ID NO: 1707259 - RNA, 14 nt, Salmonella enterica enterica serovar Typhi
guuagauauuaaua

SEQ ID NO: 1707260 - RNA, 20 nt, Salmonella enterica enterica serovar Typhi
guuacgcacgccagauaaau

SEQ ID NO: 1707261 - RNA, 21 nt, Salmonella enterica enterica serovar Typhi
guuacgcacgccagauaaauc

SEQ ID NO: 1707262 - RNA, 20 nt, Salmonella enterica enterica serovar Typhi
guuaccaaugccaaaaaaac

SEQ ID NO: 1707263 - RNA, 19 nt, Salmonella enterica enterica serovar Typhi
guuacgcauuucaagcagg

SEQ ID NO: 1707264 - RNA, 17 nt, Salmonella enterica enterica serovar Typhi
guuacaggcuccaagua

SEQ ID NO: 1707265 - RNA, 14 nt, Salmonella enterica enterica serovar Typhi
guuaaucauuuucu

SEQ ID NO: 1707266 - RNA, 20 nt, Salmonella enterica enterica serovar Typhi
guuaauauacauucauuuua

SEQ ID NO: 1707267 - RNA, 14 nt, Salmonella enterica enterica serovar Typhi
guuaauaaugaaca

SEQ ID NO: 1707268 - RNA, 18 nt, Salmonella enterica enterica serovar Typhi
guuaauaccguggucucc

SEQ ID NO: 1707269 - RNA, 13 nt, Salmonella enterica enterica serovar Typhi
guguuugccagac

SEQ ID NO: 1707270 - RNA, 19 nt, Salmonella enterica enterica serovar Typhi
guuaaaccugguauuacaa

SEQ ID NO: 1707271 - RNA, 16 nt, Salmonella enterica enterica serovar Typhi
guuaaauauaucuguu

SEQ ID NO: 1707272 - RNA, 14 nt, Salmonella enterica enterica serovar Typhi
guguuucagcagcc

SEQ ID NO: 1707273 - RNA, 20 nt, Salmonella enterica enterica serovar Typhi
gugucgccggggcgcuggcg

SEQ ID NO: 1707274 - RNA, 15 nt, Salmonella enterica enterica serovar Typhi
guucgaucagcuggc

SEQ ID NO: 1707275 - RNA, 20 nt, Salmonella enterica enterica serovar Typhi
guucgauaaucccggcgcgc

SEQ ID NO: 1707276 - RNA, 15 nt, Salmonella enterica enterica serovar Typhi
guucggauaaacgcu

SEQ ID NO: 1707277 - RNA, 17 nt, Salmonella enterica enterica serovar Typhi
guucggauaaacgcugc

SEQ ID NO: 1707278 - RNA, 23 nt, Salmonella enterica enterica serovar Typhi
guucggaagacugcuccggcaag

SEQ ID NO: 1707279 - RNA, 18 nt, Salmonella enterica enterica serovar Typhi
guucggagaucagcggau

SEQ ID NO: 1707280 - RNA, 17 nt, Salmonella enterica enterica serovar Typhi
guucguacccgcaggcc

SEQ ID NO: 1707281 - RNA, 14 nt, Salmonella enterica enterica serovar Typhi
guuccgaaauaaau

SEQ ID NO: 1707282 - RNA, 14 nt, Salmonella enterica enterica serovar Typhi
guucccgaaaaucc

SEQ ID NO: 1707283 - RNA, 14 nt, Salmonella enterica enterica serovar Typhi
guucccuacgccca

SEQ ID NO: 1707284 - RNA, 16 nt, Salmonella enterica enterica serovar Typhi
guuccccgugcccggc

SEQ ID NO: 1707285 - RNA, 17 nt, Salmonella enterica enterica serovar Typhi
guucccgcgccagcguc

SEQ ID NO: 1707286 - RNA, 20 nt, Salmonella enterica enterica serovar Typhi
guucccgagcggccaaaggg

SEQ ID NO: 1707287 - RNA, 23 nt, Salmonella enterica enterica serovar Typhi
guucccagcgggaacaucacgga

SEQ ID NO: 1707288 - RNA, 22 nt, Salmonella enterica enterica serovar Typhi
guuccaggcgaaccauaauaaa

SEQ ID NO: 1707289 - RNA, 16 nt, Salmonella enterica enterica serovar Typhi
guuccaguaaggucca

SEQ ID NO: 1707290 - RNA, 14 nt, Salmonella enterica enterica serovar Typhi
guuccagcgccacg

SEQ ID NO: 1707291 - RNA, 21 nt, Salmonella enterica enterica serovar Typhi
guuccagccguaacuaugcca

SEQ ID NO: 1707292 - RNA, 17 nt, Salmonella enterica enterica serovar Typhi
guuccagccgccaggca

SEQ ID NO: 1707293 - RNA, 21 nt, Salmonella enterica enterica serovar Typhi
guuccagcagcgcaucauggu

SEQ ID NO: 1707294 - RNA, 17 nt, Salmonella enterica enterica serovar Typhi
guuccagaggcauuauu

SEQ ID NO: 1707295 - RNA, 20 nt, Salmonella enterica enterica serovar Typhi
guuccagauaauccagcguc

SEQ ID NO: 1707296 - RNA, 15 nt, Salmonella enterica enterica serovar Typhi
guuccagaaugguua

SEQ ID NO: 1707297 - RNA, 21 nt, Salmonella enterica enterica serovar Typhi
guucauuucaggcaaaggaau

SEQ ID NO: 1707298 - RNA, 21 nt, Salmonella enterica enterica serovar Typhi
guucauugaugaugaagcugc

SEQ ID NO: 1707299 - RNA, 15 nt, Salmonella enterica enterica serovar Typhi
guucauugcuuucuu

SEQ ID NO: 1707300 - RNA, 16 nt, Salmonella enterica enterica serovar Typhi
guucauugcuuucuug

SEQ ID NO: 1707301 - RNA, 16 nt, Salmonella enterica enterica serovar Typhi
guucauuaacaucugu

SEQ ID NO: 1707302 - RNA, 13 nt, Salmonella enterica enterica serovar Typhi
guucaguaggaca

SEQ ID NO: 1707303 - RNA, 11 nt, Salmonella enterica enterica serovar Typhi
guucagguuuu

SEQ ID NO: 1707304 - RNA, 22 nt, Salmonella enterica enterica serovar Typhi
guucaauaugccaggcauuuuc

SEQ ID NO: 1707305 - RNA, 23 nt, Salmonella enterica enterica serovar Typhi
guucaauagagcgcagcaaaacg

SEQ ID NO: 1707306 - RNA, 20 nt, Salmonella enterica enterica serovar Typhi
guucagaaauguauucuccc

SEQ ID NO: 1707307 - RNA, 19 nt, Salmonella enterica enterica serovar Typhi
guucagaaauguauucucc

SEQ ID NO: 1707308 - RNA, 20 nt, Salmonella enterica enterica serovar Typhi
guucaauucauagagcgcgu

SEQ ID NO: 1707309 - RNA, 21 nt, Salmonella enterica enterica serovar Typhi
guucacuaacgcggcaucaag

SEQ ID NO: 1707310 - RNA, 17 nt, Salmonella enterica enterica serovar Typhi
guucuguaggcugugca

SEQ ID NO: 1707311 - RNA, 19 nt, Salmonella enterica enterica serovar Typhi
guucugcgccauuuccagc

SEQ ID NO: 1707312 - RNA, 15 nt, Salmonella enterica enterica serovar Typhi
guucuggcugcgcuu

SEQ ID NO: 1707313 - RNA, 22 nt, Salmonella enterica enterica serovar Typhi
guucguucaacguaaagcuggc

SEQ ID NO: 1707314 - RNA, 20 nt, Salmonella enterica enterica serovar Typhi
guugaaaaaacgggcccgcg

SEQ ID NO: 1707315 - RNA, 14 nt, Salmonella enterica enterica serovar Typhi
guugaaagccccgg

SEQ ID NO: 1707316 - RNA, 14 nt, Salmonella enterica enterica serovar Typhi
guugaaauccucua

SEQ ID NO: 1707317 - RNA, 22 nt, Salmonella enterica enterica serovar Typhi
guucuuucaccauuaagacagg

SEQ ID NO: 1707318 - RNA, 18 nt, Salmonella enterica enterica serovar Typhi
guucuuugauuagcucau

SEQ ID NO: 1707319 - RNA, 15 nt, Salmonella enterica enterica serovar Typhi
guucuugccgccauc

SEQ ID NO: 1707320 - RNA, 18 nt, Salmonella enterica enterica serovar Typhi
guugaucugguucacaga

SEQ ID NO: 1707321 - RNA, 17 nt, Salmonella enterica enterica serovar Typhi
guugaucggccagcaag

SEQ ID NO: 1707322 - RNA, 17 nt, Salmonella enterica enterica serovar Typhi
guugaucguaaaaugaa

SEQ ID NO: 1707323 - RNA, 18 nt, Salmonella enterica enterica serovar Typhi
guugaugauuacugcuga

SEQ ID NO: 1707324 - RNA, 20 nt, Salmonella enterica enterica serovar Typhi
guugauucgcuaauaauucu

SEQ ID NO: 1707325 - RNA, 19 nt, Salmonella enterica enterica serovar Typhi
guugcaguuuuaccguaaa

SEQ ID NO: 1707326 - RNA, 22 nt, Salmonella enterica enterica serovar Typhi
guugaacauuucaucuaucugc

SEQ ID NO: 1707327 - RNA, 19 nt, Salmonella enterica enterica serovar Typhi
guugaccugaucggccagc

SEQ ID NO: 1707328 - RNA, 23 nt, Salmonella enterica enterica serovar Typhi
guugaccaguccgcacgccugca

SEQ ID NO: 1707329 - RNA, 15 nt, Salmonella enterica enterica serovar Typhi
guugacugccaggua

SEQ ID NO: 1707330 - RNA, 17 nt, Salmonella enterica enterica serovar Typhi
guugacuuacaaaaaau

SEQ ID NO: 1707331 - RNA, 14 nt, Salmonella enterica enterica serovar Typhi
guugacgcuucaag

SEQ ID NO: 1707332 - RNA, 20 nt, Salmonella enterica enterica serovar Typhi
guugacggcuaccccggcgc

SEQ ID NO: 1707333 - RNA, 18 nt, Salmonella enterica enterica serovar Typhi
guuguuuggguaacacaa

SEQ ID NO: 1707334 - RNA, 21 nt, Salmonella enterica enterica serovar Typhi
guuguuuuauuaccuccugca

SEQ ID NO: 1707335 - RNA, 20 nt, Salmonella enterica enterica serovar Typhi
guuuaaacucccggcuaaac

SEQ ID NO: 1707336 - RNA, 12 nt, Salmonella enterica enterica serovar Typhi
guuuaaaccacu

SEQ ID NO: 1707337 - RNA, 13 nt, Salmonella enterica enterica serovar Typhi
guuuaaagcgcuc

SEQ ID NO: 1707338 - RNA, 16 nt, Salmonella enterica enterica serovar Typhi
guuuaaaucgcuaagc

SEQ ID NO: 1707339 - RNA, 20 nt, Salmonella enterica enterica serovar Typhi
guuuaaaucgcuaagcagaa

SEQ ID NO: 1707340 - RNA, 12 nt, Salmonella enterica enterica serovar Typhi
guuguucugggu

SEQ ID NO: 1707341 - RNA, 21 nt, Salmonella enterica enterica serovar Typhi
guuguucuuuuuauggcgggg

SEQ ID NO: 1707342 - RNA, 22 nt, Salmonella enterica enterica serovar Typhi
guuuagacagacagcguaaaua

SEQ ID NO: 1707343 - RNA, 21 nt, Salmonella enterica enterica serovar Typhi
guuuaccggugcagaccucug

SEQ ID NO: 1707344 - RNA, 19 nt, Salmonella enterica enterica serovar Typhi
guuuacccagcgaaugcug

SEQ ID NO: 1707345 - RNA, 18 nt, Salmonella enterica enterica serovar Typhi
guuuacccaggaagagua

SEQ ID NO: 1707346 - RNA, 14 nt, Salmonella enterica enterica serovar Typhi
guuuaauuucugac

SEQ ID NO: 1707347 - RNA, 15 nt, Salmonella enterica enterica serovar Typhi
guuuauuauaaacac

SEQ ID NO: 1707348 - RNA, 17 nt, Salmonella enterica enterica serovar Typhi
guuuauuuaagcuuacu

SEQ ID NO: 1707349 - RNA, 17 nt, Salmonella enterica enterica serovar Typhi
guuuagcgccagcagca

SEQ ID NO: 1707350 - RNA, 13 nt, Salmonella enterica enterica serovar Typhi
guugccacaggcu

SEQ ID NO: 1707351 - RNA, 16 nt, Salmonella enterica enterica serovar Typhi
guugccagcggccagg

SEQ ID NO: 1707352 - RNA, 19 nt, Salmonella enterica enterica serovar Typhi
guugccaggguucaaccug

SEQ ID NO: 1707353 - RNA, 19 nt, Salmonella enterica enterica serovar Typhi
guuggcaacgucuugccau

SEQ ID NO: 1707354 - RNA, 20 nt, Salmonella enterica enterica serovar Typhi
guuggaugaaccauaucaaa

SEQ ID NO: 1707355 - RNA, 23 nt, Salmonella enterica enterica serovar Typhi
guugccgcccguuuuuuccagcg

SEQ ID NO: 1707356 - RNA, 23 nt, Salmonella enterica enterica serovar Typhi
guugggcagaaacguaccugaga

SEQ ID NO: 1707357 - RNA, 23 nt, Salmonella enterica enterica serovar Typhi
guugggauaaugucgacgcgcuc

SEQ ID NO: 1707358 - RNA, 21 nt, Salmonella enterica enterica serovar Typhi
guuggcauucgaauccuccug

SEQ ID NO: 1707359 - RNA, 18 nt, Salmonella enterica enterica serovar Typhi
guuggggauaaccagaaa

SEQ ID NO: 1707360 - RNA, 20 nt, Salmonella enterica enterica serovar Typhi
guugguaaauuuaugguucc

SEQ ID NO: 1707361 - RNA, 15 nt, Salmonella enterica enterica serovar Typhi
guuguagcacagccc

SEQ ID NO: 1707362 - RNA, 22 nt, Salmonella enterica enterica serovar Typhi
guuguacggaugggguaucgcc

SEQ ID NO: 1707363 - RNA, 15 nt, Salmonella enterica enterica serovar Typhi
guugucucaaaaaau

SEQ ID NO: 1707364 - RNA, 17 nt, Salmonella enterica enterica serovar Typhi
guugugcauuccaggug

SEQ ID NO: 1707365 - RNA, 22 nt, Salmonella enterica enterica serovar Typhi
uaaaaauaacgcgauaaucccc

SEQ ID NO: 1707366 - RNA, 12 nt, Salmonella enterica enterica serovar Typhi
uaaaaaaugaga

SEQ ID NO: 1707367 - RNA, 18 nt, Salmonella enterica enterica serovar Typhi
uaaaaacccuuucauucg

SEQ ID NO: 1707368 - RNA, 18 nt, Salmonella enterica enterica serovar Typhi
uaaaaacugcuaaaagaa

SEQ ID NO: 1707369 - RNA, 16 nt, Salmonella enterica enterica serovar Typhi
uaaaaacccaccagcg

SEQ ID NO: 1707370 - RNA, 17 nt, Salmonella enterica enterica serovar Typhi
uaaaaaccagaauuucc

SEQ ID NO: 1707371 - RNA, 12 nt, Salmonella enterica enterica serovar Typhi
uaaaaaccaggc

SEQ ID NO: 1707372 - RNA, 21 nt, Salmonella enterica enterica serovar Typhi
uaaaaaccaggcaaaaauagg

SEQ ID NO: 1707373 - RNA, 18 nt, Salmonella enterica enterica serovar Typhi
uaaaaaaaagccgaccug

SEQ ID NO: 1707374 - RNA, 21 nt, Salmonella enterica enterica serovar Typhi
uaaaaaaaccucuaccuacac

SEQ ID NO: 1707375 - RNA, 12 nt, Salmonella enterica enterica serovar Typhi
uaaaaaacauca

SEQ ID NO: 1707376 - RNA, 19 nt, Salmonella enterica enterica serovar Typhi
uaaaaaacaucauaauaau

SEQ ID NO: 1707377 - RNA, 15 nt, Salmonella enterica enterica serovar Typhi
uaaaaaagaggaaug

SEQ ID NO: 1707378 - RNA, 21 nt, Salmonella enterica enterica serovar Typhi
uaaaaaagccguauuuuauuu

SEQ ID NO: 1707379 - RNA, 13 nt, Salmonella enterica enterica serovar Typhi
uaaaaaagcugcg

SEQ ID NO: 1707380 - RNA, 11 nt, Salmonella enterica enterica serovar Typhi
uaaaaaaggca

SEQ ID NO: 1707381 - RNA, 22 nt, Salmonella enterica enterica serovar Typhi
uaaaaaaggccgcuuaauaaua

SEQ ID NO: 1707382 - RNA, 21 nt, Salmonella enterica enterica serovar Typhi
guuuuuuaaugagaaauuuua

SEQ ID NO: 1707383 - RNA, 13 nt, Salmonella enterica enterica serovar Typhi
guuuuuucaucuc

SEQ ID NO: 1707384 - RNA, 22 nt, Salmonella enterica enterica serovar Typhi
guuuuuuaaccguucuuccugg

SEQ ID NO: 1707385 - RNA, 17 nt, Salmonella enterica enterica serovar Typhi
guuuuuuguugauuuua

SEQ ID NO: 1707386 - RNA, 19 nt, Salmonella enterica enterica serovar Typhi
guuuuuccuuucugcgcca

SEQ ID NO: 1707387 - RNA, 18 nt, Salmonella enterica enterica serovar Typhi
guuuuuacacugaagccu

SEQ ID NO: 1707388 - RNA, 22 nt, Salmonella enterica enterica serovar Typhi
guuuuuggaaacuaugcaaaac

SEQ ID NO: 1707389 - RNA, 17 nt, Salmonella enterica enterica serovar Typhi
guuuuugucuccucaug

SEQ ID NO: 1707390 - RNA, 18 nt, Salmonella enterica enterica serovar Typhi
guuuuugcgccauugccg

SEQ ID NO: 1707391 - RNA, 14 nt, Salmonella enterica enterica serovar Typhi
guuuuucuuccugu

SEQ ID NO: 1707392 - RNA, 15 nt, Salmonella enterica enterica serovar Typhi
guuuuugaacauugc

SEQ ID NO: 1707393 - RNA, 17 nt, Salmonella enterica enterica serovar Typhi
guuuggccugcugcggu

SEQ ID NO: 1707394 - RNA, 14 nt, Salmonella enterica enterica serovar Typhi
guuuuaaaaauaac

SEQ ID NO: 1707395 - RNA, 14 nt, Salmonella enterica enterica serovar Typhi
guuuuaaucuuuua

SEQ ID NO: 1707396 - RNA, 19 nt, Salmonella enterica enterica serovar Typhi
guuuuaaucuuuuauaugu

SEQ ID NO: 1707397 - RNA, 21 nt, Salmonella enterica enterica serovar Typhi
aaaucagcccggacaucaucc

SEQ ID NO: 1707398 - RNA, 14 nt, Salmonella enterica enterica serovar Typhi
aaaucagcauuacc

SEQ ID NO: 1707399 - RNA, 16 nt, Salmonella enterica enterica serovar Typhi
aaaucagcauuacccc

SEQ ID NO: 1707400 - RNA, 14 nt, Salmonella enterica enterica serovar Typhi
guuucuuucaucag

SEQ ID NO: 1707401 - RNA, 17 nt, Salmonella enterica enterica serovar Typhi
guuucuuuucguuucuu

SEQ ID NO: 1707402 - RNA, 21 nt, Salmonella enterica enterica serovar Typhi
guuuauugccgcuucuuuauu

SEQ ID NO: 1707403 - RNA, 19 nt, Salmonella enterica enterica serovar Typhi
guuugccccauuguucuuu

SEQ ID NO: 1707404 - RNA, 16 nt, Salmonella enterica enterica serovar Typhi
aaaucauuacuuauau

SEQ ID NO: 1707405 - RNA, 22 nt, Salmonella enterica enterica serovar Typhi
aaauccagggaaaccauguuga

SEQ ID NO: 1707406 - RNA, 22 nt, Salmonella enterica enterica serovar Typhi
guuuuauccguuuccgcaauaa

SEQ ID NO: 1707407 - RNA, 13 nt, Salmonella enterica enterica serovar Typhi
guuuucauuagcc

SEQ ID NO: 1707408 - RNA, 17 nt, Salmonella enterica enterica serovar Typhi
guuuucauuagccgcca

SEQ ID NO: 1707409 - RNA, 23 nt, Salmonella enterica enterica serovar Typhi
aaaucaucgcgcugauauuuuua

SEQ ID NO: 1707410 - RNA, 15 nt, Salmonella enterica enterica serovar Typhi
aaaucaugccagaau

SEQ ID NO: 1707411 - RNA, 17 nt, Salmonella enterica enterica serovar Typhi
aaaucagugauggauuu

SEQ ID NO: 1707412 - RNA, 15 nt, Salmonella enterica enterica serovar Typhi
guuuucaucgguggc

SEQ ID NO: 1707413 - RNA, 18 nt, Salmonella enterica enterica serovar Typhi
guuuucgucccagcgcac

SEQ ID NO: 1707414 - RNA, 21 nt, Salmonella enterica enterica serovar Typhi
uaaaaauauggcgggccugug

SEQ ID NO: 1707415 - RNA, 20 nt, Salmonella enterica enterica serovar Typhi
uaaaaauauggggguaaaca

SEQ ID NO: 1707416 - RNA, 18 nt, Salmonella enterica enterica serovar Typhi
uaaaaaugaggugaaaca

SEQ ID NO: 1707417 - RNA, 20 nt, Salmonella enterica enterica serovar Typhi
uaaaaauucaaaaaagcagu

SEQ ID NO: 1707418 - RNA, 22 nt, Salmonella enterica enterica serovar Typhi
uaaaacaaaaaaacggccucaa

SEQ ID NO: 1707419 - RNA, 22 nt, Salmonella enterica enterica serovar Typhi
uaaaagagagcgccaaaaagaa

SEQ ID NO: 1707420 - RNA, 22 nt, Salmonella enterica enterica serovar Typhi
uaaaagcccuuaucgccccagc

SEQ ID NO: 1707421 - RNA, 17 nt, Salmonella enterica enterica serovar Typhi
uaaaagcccuuaucgcc

SEQ ID NO: 1707422 - RNA, 21 nt, Salmonella enterica enterica serovar Typhi
uaaaagcgauaaagacagguu

SEQ ID NO: 1707423 - RNA, 21 nt, Salmonella enterica enterica serovar Typhi
uaaaacuucccgcgcagugca

SEQ ID NO: 1707424 - RNA, 15 nt, Salmonella enterica enterica serovar Typhi
uaaaagaaaaccgua

SEQ ID NO: 1707425 - RNA, 22 nt, Salmonella enterica enterica serovar Typhi
uaaaacguuauuggcaggaugu

SEQ ID NO: 1707426 - RNA, 18 nt, Salmonella enterica enterica serovar Typhi
uaaaacgguaugaaacau

SEQ ID NO: 1707427 - RNA, 22 nt, Salmonella enterica enterica serovar Typhi
uaaaaccggucuggcucacuga

SEQ ID NO: 1707428 - RNA, 17 nt, Salmonella enterica enterica serovar Typhi
uaaaaccggcacaucca

SEQ ID NO: 1707429 - RNA, 14 nt, Salmonella enterica enterica serovar Typhi
uaaaacgcauacug

SEQ ID NO: 1707430 - RNA, 14 nt, Salmonella enterica enterica serovar Typhi
uaaaauaaacacua

SEQ ID NO: 1707431 - RNA, 13 nt, Salmonella enterica enterica serovar Typhi
uaaaaguuagccc

SEQ ID NO: 1707432 - RNA, 17 nt, Salmonella enterica enterica serovar Typhi
uaaaaguuagccccuua

SEQ ID NO: 1707433 - RNA, 20 nt, Salmonella enterica enterica serovar Typhi
uaaaauaaacacuaaaucau

SEQ ID NO: 1707434 - RNA, 12 nt, Salmonella enterica enterica serovar Typhi
uaaaauaagaau

SEQ ID NO: 1707435 - RNA, 15 nt, Salmonella enterica enterica serovar Typhi
uaaaauaacuauaau

SEQ ID NO: 1707436 - RNA, 10 nt, Salmonella enterica enterica serovar Typhi
uaaaaugacc

SEQ ID NO: 1707437 - RNA, 18 nt, Salmonella enterica enterica serovar Typhi
uaaaaugcccgucucauu

SEQ ID NO: 1707438 - RNA, 17 nt, Salmonella enterica enterica serovar Typhi
uaaaauggcuugugaau

SEQ ID NO: 1707439 - RNA, 12 nt, Salmonella enterica enterica serovar Typhi
uaaaaugucugu

SEQ ID NO: 1707440 - RNA, 23 nt, Salmonella enterica enterica serovar Typhi
uaaaaucuaagagccugucccac

SEQ ID NO: 1707441 - RNA, 23 nt, Salmonella enterica enterica serovar Typhi
uaaaaucggggucuuccagcaga

SEQ ID NO: 1707442 - RNA, 19 nt, Salmonella enterica enterica serovar Typhi
uaaaauccuuuuucaugca

SEQ ID NO: 1707443 - RNA, 12 nt, Salmonella enterica enterica serovar Typhi
uaaaauccugca

SEQ ID NO: 1707444 - RNA, 23 nt, Salmonella enterica enterica serovar Typhi
uaaaauauccaugcuuucaauaa

SEQ ID NO: 1707445 - RNA, 20 nt, Salmonella enterica enterica serovar Typhi
uaaaggggagcccaguagcc

SEQ ID NO: 1707446 - RNA, 14 nt, Salmonella enterica enterica serovar Typhi
uaaaggaugccacu

SEQ ID NO: 1707447 - RNA, 15 nt, Salmonella enterica enterica serovar Typhi
uaaagcgcaaaauag

SEQ ID NO: 1707448 - RNA, 21 nt, Salmonella enterica enterica serovar Typhi
uaaagcgcgggccugccuguu

SEQ ID NO: 1707449 - RNA, 22 nt, Salmonella enterica enterica serovar Typhi
uaaagcgcgggccugccuguuu

SEQ ID NO: 1707450 - RNA, 15 nt, Salmonella enterica enterica serovar Typhi
uaaagcgaauaacau

SEQ ID NO: 1707451 - RNA, 18 nt, Salmonella enterica enterica serovar Typhi
uaaagccuucaugcuucu

SEQ ID NO: 1707452 - RNA, 13 nt, Salmonella enterica enterica serovar Typhi
uaaagcagugcag

SEQ ID NO: 1707453 - RNA, 17 nt, Salmonella enterica enterica serovar Typhi
uaaagcacugguggaau

SEQ ID NO: 1707454 - RNA, 18 nt, Salmonella enterica enterica serovar Typhi
uaaagcagaccaccccac

SEQ ID NO: 1707455 - RNA, 16 nt, Salmonella enterica enterica serovar Typhi
uaaagcacaagaacuu

SEQ ID NO: 1707456 - RNA, 22 nt, Salmonella enterica enterica serovar Typhi
uaaagcacaagaacuuaaauua

SEQ ID NO: 1707457 - RNA, 22 nt, Salmonella enterica enterica serovar Typhi
uaaauacccaggccaucagaau

SEQ ID NO: 1707458 - RNA, 22 nt, Salmonella enterica enterica serovar Typhi
uaaauacaccaaacgaauuuaa

SEQ ID NO: 1707459 - RNA, 13 nt, Salmonella enterica enterica serovar Typhi
uaaauacacgagg

SEQ ID NO: 1707460 - RNA, 19 nt, Salmonella enterica enterica serovar Typhi
uaaauaguaaauagaaaau

SEQ ID NO: 1707461 - RNA, 19 nt, Salmonella enterica enterica serovar Typhi
uaaauaggcgccgccgaca

SEQ ID NO: 1707462 - RNA, 12 nt, Salmonella enterica enterica serovar Typhi
uaaauauucauc

SEQ ID NO: 1707463 - RNA, 16 nt, Salmonella enterica enterica serovar Typhi
uaaauauucaucaaaa

SEQ ID NO: 1707464 - RNA, 14 nt, Salmonella enterica enterica serovar Typhi
uaaauagccagcau

SEQ ID NO: 1707465 - RNA, 13 nt, Salmonella enterica enterica serovar Typhi
uaaauagcaggca

SEQ ID NO: 1707466 - RNA, 16 nt, Salmonella enterica enterica serovar Typhi
uaaauacuuuuuuagc

SEQ ID NO: 1707467 - RNA, 13 nt, Salmonella enterica enterica serovar Typhi
uaaauagaaaaua

SEQ ID NO: 1707468 - RNA, 15 nt, Salmonella enterica enterica serovar Typhi
uaaauaccuuauuca

SEQ ID NO: 1707469 - RNA, 20 nt, Salmonella enterica enterica serovar Typhi
uaaacacgauggcaaauaau

SEQ ID NO: 1707470 - RNA, 16 nt, Salmonella enterica enterica serovar Typhi
uaaacagguaaaacaa

SEQ ID NO: 1707471 - RNA, 17 nt, Salmonella enterica enterica serovar Typhi
uaaacaggcgcggcgcg

SEQ ID NO: 1707472 - RNA, 19 nt, Salmonella enterica enterica serovar Typhi
uaaacacagcaaacauccc

SEQ ID NO: 1707473 - RNA, 20 nt, Salmonella enterica enterica serovar Typhi
uaaacaauuugcccagcgcu

SEQ ID NO: 1707474 - RNA, 14 nt, Salmonella enterica enterica serovar Typhi
uaaacaaugcaggu

SEQ ID NO: 1707475 - RNA, 18 nt, Salmonella enterica enterica serovar Typhi
uaaaauuccaauauuuau

SEQ ID NO: 1707476 - RNA, 23 nt, Salmonella enterica enterica serovar Typhi
uaaaauuauuggcuuuguaaaua

SEQ ID NO: 1707477 - RNA, 17 nt, Salmonella enterica enterica serovar Typhi
uaaaauuauuuuuacuu

SEQ ID NO: 1707478 - RNA, 13 nt, Salmonella enterica enterica serovar Typhi
uaaaauuauaaac

SEQ ID NO: 1707479 - RNA, 16 nt, Salmonella enterica enterica serovar Typhi
uaaaauuauauucuaa

SEQ ID NO: 1707480 - RNA, 13 nt, Salmonella enterica enterica serovar Typhi
uaaaauugaauua

SEQ ID NO: 1707481 - RNA, 15 nt, Salmonella enterica enterica serovar Typhi
uaaacgcaacaccau

SEQ ID NO: 1707482 - RNA, 12 nt, Salmonella enterica enterica serovar Typhi
uaaacgggcugc

SEQ ID NO: 1707483 - RNA, 16 nt, Salmonella enterica enterica serovar Typhi
uaaacguaggccgggc

SEQ ID NO: 1707484 - RNA, 14 nt, Salmonella enterica enterica serovar Typhi
uaaacggucaggau

SEQ ID NO: 1707485 - RNA, 13 nt, Salmonella enterica enterica serovar Typhi
uaaaccaggccag

SEQ ID NO: 1707486 - RNA, 11 nt, Salmonella enterica enterica serovar Typhi
uaaagaaaaac

SEQ ID NO: 1707487 - RNA, 21 nt, Salmonella enterica enterica serovar Typhi
uaaagaacggccucccaaacu

SEQ ID NO: 1707488 - RNA, 15 nt, Salmonella enterica enterica serovar Typhi
uaaagaaauuuaaag

SEQ ID NO: 1707489 - RNA, 14 nt, Salmonella enterica enterica serovar Typhi
uaaacgucaugcug

SEQ ID NO: 1707490 - RNA, 16 nt, Salmonella enterica enterica serovar Typhi
uaaacgugcuggaugg

SEQ ID NO: 1707491 - RNA, 14 nt, Salmonella enterica enterica serovar Typhi
uaaacguuccugcc

SEQ ID NO: 1707492 - RNA, 17 nt, Salmonella enterica enterica serovar Typhi
uaaacguuccugccagc

SEQ ID NO: 1707493 - RNA, 19 nt, Salmonella enterica enterica serovar Typhi
uaaacuaaguaaggaggaa

SEQ ID NO: 1707494 - RNA, 17 nt, Salmonella enterica enterica serovar Typhi
uaacgacgcuccagaau

SEQ ID NO: 1707495 - RNA, 17 nt, Salmonella enterica enterica serovar Typhi
uaacgacaaaaauacca

SEQ ID NO: 1707496 - RNA, 15 nt, Salmonella enterica enterica serovar Typhi
uaaccuuucaccuua

SEQ ID NO: 1707497 - RNA, 17 nt, Salmonella enterica enterica serovar Typhi
uaaccucuauaguaaau

SEQ ID NO: 1707498 - RNA, 20 nt, Salmonella enterica enterica serovar Typhi
uaaccgcgcaaucaaaacau

SEQ ID NO: 1707499 - RNA, 12 nt, Salmonella enterica enterica serovar Typhi
uaaccgcuuuuu

SEQ ID NO: 1707500 - RNA, 19 nt, Salmonella enterica enterica serovar Typhi
uaaccuguaucugcugaca

SEQ ID NO: 1707501 - RNA, 13 nt, Salmonella enterica enterica serovar Typhi
uaaccucuuuuuc

SEQ ID NO: 1707502 - RNA, 19 nt, Salmonella enterica enterica serovar Typhi
uaaccuguuccucacugag

SEQ ID NO: 1707503 - RNA, 16 nt, Salmonella enterica enterica serovar Typhi
uaacccacaagaaaug

SEQ ID NO: 1707504 - RNA, 18 nt, Salmonella enterica enterica serovar Typhi
uaaccaacaggaggaucg

SEQ ID NO: 1707505 - RNA, 16 nt, Salmonella enterica enterica serovar Typhi
uaaccgccuccgacaa

SEQ ID NO: 1707506 - RNA, 15 nt, Salmonella enterica enterica serovar Typhi
uaaccgcaaaugcca

SEQ ID NO: 1707507 - RNA, 17 nt, Salmonella enterica enterica serovar Typhi
uaaccgcagcgcggccu

SEQ ID NO: 1707508 - RNA, 22 nt, Salmonella enterica enterica serovar Typhi
uaacauaaauaguauuaguuga

SEQ ID NO: 1707509 - RNA, 12 nt, Salmonella enterica enterica serovar Typhi
uaacauaaccgg

SEQ ID NO: 1707510 - RNA, 20 nt, Salmonella enterica enterica serovar Typhi
uaacauaagugauacaugcu

SEQ ID NO: 1707511 - RNA, 17 nt, Salmonella enterica enterica serovar Typhi
uaacauauagcagcagu

SEQ ID NO: 1707512 - RNA, 13 nt, Salmonella enterica enterica serovar Typhi
uaaccaaaccaga

SEQ ID NO: 1707513 - RNA, 18 nt, Salmonella enterica enterica serovar Typhi
uaacaggcaccagcguau

SEQ ID NO: 1707514 - RNA, 19 nt, Salmonella enterica enterica serovar Typhi
uaacagcuugaucaucagg

SEQ ID NO: 1707515 - RNA, 17 nt, Salmonella enterica enterica serovar Typhi
uaacagcuggcuugcca

SEQ ID NO: 1707516 - RNA, 18 nt, Salmonella enterica enterica serovar Typhi
uaacagcuugaucaucag

SEQ ID NO: 1707517 - RNA, 19 nt, Salmonella enterica enterica serovar Typhi
uaacagcgcuaucaggaag

SEQ ID NO: 1707518 - RNA, 19 nt, Salmonella enterica enterica serovar Typhi
uaacagcgcgaccagcgug

SEQ ID NO: 1707519 - RNA, 19 nt, Salmonella enterica enterica serovar Typhi
uaacagcgcgaccaggaaa

SEQ ID NO: 1707520 - RNA, 20 nt, Salmonella enterica enterica serovar Typhi
uaacaauccuaccguaacgu

SEQ ID NO: 1707521 - RNA, 20 nt, Salmonella enterica enterica serovar Typhi
uaacaauccccgucacagcg

SEQ ID NO: 1707522 - RNA, 13 nt, Salmonella enterica enterica serovar Typhi
uaacagccagcgg

SEQ ID NO: 1707523 - RNA, 13 nt, Salmonella enterica enterica serovar Typhi
uaaauuuacucag

SEQ ID NO: 1707524 - RNA, 14 nt, Salmonella enterica enterica serovar Typhi
uaaauuuacucagu

SEQ ID NO: 1707525 - RNA, 12 nt, Salmonella enterica enterica serovar Typhi
uaaauugguuau

SEQ ID NO: 1707526 - RNA, 18 nt, Salmonella enterica enterica serovar Typhi
uaaauuuccgcagccaga

SEQ ID NO: 1707527 - RNA, 21 nt, Salmonella enterica enterica serovar Typhi
uaaauuuccucuugucaggca

SEQ ID NO: 1707528 - RNA, 19 nt, Salmonella enterica enterica serovar Typhi
uaaauuuguuuaucauccu

SEQ ID NO: 1707529 - RNA, 18 nt, Salmonella enterica enterica serovar Typhi
uaacaaccagaauaaugg

SEQ ID NO: 1707530 - RNA, 21 nt, Salmonella enterica enterica serovar Typhi
uaacaaccgggaucuuuuuca

SEQ ID NO: 1707531 - RNA, 15 nt, Salmonella enterica enterica serovar Typhi
uaacaaaucauuucc

SEQ ID NO: 1707532 - RNA, 17 nt, Salmonella enterica enterica serovar Typhi
uaaaugccacuauagau

SEQ ID NO: 1707533 - RNA, 14 nt, Salmonella enterica enterica serovar Typhi
uaaaugaauuauuu

SEQ ID NO: 1707534 - RNA, 16 nt, Salmonella enterica enterica serovar Typhi
uaaaugucaggaucag

SEQ ID NO: 1707535 - RNA, 19 nt, Salmonella enterica enterica serovar Typhi
uaaaugucugaauauuaaa

SEQ ID NO: 1707536 - RNA, 22 nt, Salmonella enterica enterica serovar Typhi
uaaaugucugaauauuaaaguu

SEQ ID NO: 1707537 - RNA, 16 nt, Salmonella enterica enterica serovar Typhi
uaaaugcauagcccca

SEQ ID NO: 1707538 - RNA, 19 nt, Salmonella enterica enterica serovar Typhi
uaaaucaauagauuauucg

SEQ ID NO: 1707539 - RNA, 22 nt, Salmonella enterica enterica serovar Typhi
uaaaucuacccaauugaauuua

SEQ ID NO: 1707540 - RNA, 21 nt, Salmonella enterica enterica serovar Typhi
uaaaucugccgucaucgacuu

SEQ ID NO: 1707541 - RNA, 23 nt, Salmonella enterica enterica serovar Typhi
uaggccggcgaagauccgcucac

SEQ ID NO: 1707542 - RNA, 13 nt, Salmonella enterica enterica serovar Typhi
uaggccugauaag

SEQ ID NO: 1707543 - RNA, 18 nt, Salmonella enterica enterica serovar Typhi
uaggccugguaagcguag

SEQ ID NO: 1707544 - RNA, 12 nt, Salmonella enterica enterica serovar Typhi
uaggccggauaa

SEQ ID NO: 1707545 - RNA, 18 nt, Salmonella enterica enterica serovar Typhi
uaggccggauaagcaacg

SEQ ID NO: 1707546 - RNA, 20 nt, Salmonella enterica enterica serovar Typhi
uaggccggauaagcggcagc

SEQ ID NO: 1707547 - RNA, 15 nt, Salmonella enterica enterica serovar Typhi
uaggcaggaaaucca

SEQ ID NO: 1707548 - RNA, 15 nt, Salmonella enterica enterica serovar Typhi
uaggcacuuuccaga

SEQ ID NO: 1707549 - RNA, 13 nt, Salmonella enterica enterica serovar Typhi
uaggccaaacuua

SEQ ID NO: 1707550 - RNA, 13 nt, Salmonella enterica enterica serovar Typhi
uaggcgguuucau

SEQ ID NO: 1707551 - RNA, 18 nt, Salmonella enterica enterica serovar Typhi
uaggcuauaaaaaucauc

SEQ ID NO: 1707552 - RNA, 14 nt, Salmonella enterica enterica serovar Typhi
uagggacaucggag

SEQ ID NO: 1707553 - RNA, 16 nt, Salmonella enterica enterica serovar Typhi
uagggccgggcagugc

SEQ ID NO: 1707554 - RNA, 13 nt, Salmonella enterica enterica serovar Typhi
uaguagcuaauga

SEQ ID NO: 1707555 - RNA, 15 nt, Salmonella enterica enterica serovar Typhi
uaguauccauaauuu

SEQ ID NO: 1707556 - RNA, 22 nt, Salmonella enterica enterica serovar Typhi
uaguaucgcucuauauccugcc

SEQ ID NO: 1707557 - RNA, 18 nt, Salmonella enterica enterica serovar Typhi
uaguaaagaaauuuugca

SEQ ID NO: 1707558 - RNA, 21 nt, Salmonella enterica enterica serovar Typhi
uaguaaaccgguugcuccguu

SEQ ID NO: 1707559 - RNA, 23 nt, Salmonella enterica enterica serovar Typhi
uaguacguuccagcguuuccgga

SEQ ID NO: 1707560 - RNA, 16 nt, Salmonella enterica enterica serovar Typhi
uaguaaauagaaaaua

SEQ ID NO: 1707561 - RNA, 11 nt, Salmonella enterica enterica serovar Typhi
uaguaaauagg

SEQ ID NO: 1707562 - RNA, 14 nt, Salmonella enterica enterica serovar Typhi
uagguauccagcag

SEQ ID NO: 1707563 - RNA, 18 nt, Salmonella enterica enterica serovar Typhi
uagggugcagugaaccau

SEQ ID NO: 1707564 - RNA, 21 nt, Salmonella enterica enterica serovar Typhi
uagguaagauauuuuguuuua

SEQ ID NO: 1707565 - RNA, 12 nt, Salmonella enterica enterica serovar Typhi
uaguuguuuuau

SEQ ID NO: 1707566 - RNA, 23 nt, Salmonella enterica enterica serovar Typhi
uaguucagcgcagagugaccagc

SEQ ID NO: 1707567 - RNA, 18 nt, Salmonella enterica enterica serovar Typhi
uaguucaaguuuagaaaa

SEQ ID NO: 1707568 - RNA, 20 nt, Salmonella enterica enterica serovar Typhi
uaguucaaguuuagaaaaaa

SEQ ID NO: 1707569 - RNA, 21 nt, Salmonella enterica enterica serovar Typhi
uaguucaaguuuagaaaaaau

SEQ ID NO: 1707570 - RNA, 15 nt, Salmonella enterica enterica serovar Typhi
uagugugcugauugu

SEQ ID NO: 1707571 - RNA, 17 nt, Salmonella enterica enterica serovar Typhi
uaguguucgcggcuggu

SEQ ID NO: 1707572 - RNA, 13 nt, Salmonella enterica enterica serovar Typhi
uagucaaauugaa

SEQ ID NO: 1707573 - RNA, 17 nt, Salmonella enterica enterica serovar Typhi
uagucauugacagcaag

SEQ ID NO: 1707574 - RNA, 16 nt, Salmonella enterica enterica serovar Typhi
uagucauugacagcaa

SEQ ID NO: 1707575 - RNA, 15 nt, Salmonella enterica enterica serovar Typhi
uaguccauuacgcag

SEQ ID NO: 1707576 - RNA, 21 nt, Salmonella enterica enterica serovar Typhi
uagucccuccgcuuccacucu

SEQ ID NO: 1707577 - RNA, 21 nt, Salmonella enterica enterica serovar Typhi
uaguccucagcgaauaucucu

SEQ ID NO: 1707578 - RNA, 19 nt, Salmonella enterica enterica serovar Typhi
uagugcaggcgcggucugg

SEQ ID NO: 1707579 - RNA, 22 nt, Salmonella enterica enterica serovar Typhi
uagugcaggaaggcgugcagcg

SEQ ID NO: 1707580 - RNA, 15 nt, Salmonella enterica enterica serovar Typhi
uagugcgauaugugg

SEQ ID NO: 1707581 - RNA, 14 nt, Salmonella enterica enterica serovar Typhi
uauaaacucagcaa

SEQ ID NO: 1707582 - RNA, 21 nt, Salmonella enterica enterica serovar Typhi
uauaacgacagccuauuaauc

SEQ ID NO: 1707583 - RNA, 19 nt, Salmonella enterica enterica serovar Typhi
uauaacgaugauuauuguu

SEQ ID NO: 1707584 - RNA, 22 nt, Salmonella enterica enterica serovar Typhi
uauaaaaaccgacgaaagauaa

SEQ ID NO: 1707585 - RNA, 18 nt, Salmonella enterica enterica serovar Typhi
uauaaaaaacauauaauu

SEQ ID NO: 1707586 - RNA, 21 nt, Salmonella enterica enterica serovar Typhi
uaguuuccgguaaauccacaa

SEQ ID NO: 1707587 - RNA, 23 nt, Salmonella enterica enterica serovar Typhi
uaguuuccgccgcgguauucaua

SEQ ID NO: 1707588 - RNA, 16 nt, Salmonella enterica enterica serovar Typhi
uaguuucuauuaaauc

SEQ ID NO: 1707589 - RNA, 18 nt, Salmonella enterica enterica serovar Typhi
uaguuucuauuaaaucag

SEQ ID NO: 1707590 - RNA, 15 nt, Salmonella enterica enterica serovar Typhi
uauccaccgccagac

SEQ ID NO: 1707591 - RNA, 22 nt, Salmonella enterica enterica serovar Typhi
uauccacugucgggcaaaaugc

SEQ ID NO: 1707592 - RNA, 14 nt, Salmonella enterica enterica serovar Typhi
uauccaguugcgcc

SEQ ID NO: 1707593 - RNA, 19 nt, Salmonella enterica enterica serovar Typhi
uauccaguuucugacguaa

SEQ ID NO: 1707594 - RNA, 16 nt, Salmonella enterica enterica serovar Typhi
uauccauaauuuuccc

SEQ ID NO: 1707595 - RNA, 15 nt, Salmonella enterica enterica serovar Typhi
uauccauacaagcgu

SEQ ID NO: 1707596 - RNA, 17 nt, Salmonella enterica enterica serovar Typhi
uaucauuaugggcagca

SEQ ID NO: 1707597 - RNA, 15 nt, Salmonella enterica enterica serovar Typhi
uaucagguaacauau

SEQ ID NO: 1707598 - RNA, 23 nt, Salmonella enterica enterica serovar Typhi
uaucaggguuauuuccgcuggcc

SEQ ID NO: 1707599 - RNA, 21 nt, Salmonella enterica enterica serovar Typhi
uaucacugguuauaugaauaa

SEQ ID NO: 1707600 - RNA, 14 nt, Salmonella enterica enterica serovar Typhi
uaucauaaaaggcu

SEQ ID NO: 1707601 - RNA, 18 nt, Salmonella enterica enterica serovar Typhi
uaucaugcugaugacuaa

SEQ ID NO: 1707602 - RNA, 17 nt, Salmonella enterica enterica serovar Typhi
uaucaaucaccucuucc

SEQ ID NO: 1707603 - RNA, 17 nt, Salmonella enterica enterica serovar Typhi
uaucaauaguuaauuaa

SEQ ID NO: 1707604 - RNA, 20 nt, Salmonella enterica enterica serovar Typhi
uaucaaaccagcuuuucauu

SEQ ID NO: 1707605 - RNA, 17 nt, Salmonella enterica enterica serovar Typhi
uaucaaacugaaaauca

SEQ ID NO: 1707606 - RNA, 20 nt, Salmonella enterica enterica serovar Typhi
uaucaauaaugcgcugcaca

SEQ ID NO: 1707607 - RNA, 14 nt, Salmonella enterica enterica serovar Typhi
uaucaaauacgcua

SEQ ID NO: 1707608 - RNA, 18 nt, Salmonella enterica enterica serovar Typhi
uaucaaaucuucauuuca

SEQ ID NO: 1707609 - RNA, 15 nt, Salmonella enterica enterica serovar Typhi
uauauugcauuuuau

SEQ ID NO: 1707610 - RNA, 11 nt, Salmonella enterica enterica serovar Typhi
uauauuuuuaa

SEQ ID NO: 1707611 - RNA, 13 nt, Salmonella enterica enterica serovar Typhi
uaucaaaaagacu

SEQ ID NO: 1707612 - RNA, 23 nt, Salmonella enterica enterica serovar Typhi
uauauucugggcuuacuuuccaa

SEQ ID NO: 1707613 - RNA, 22 nt, Salmonella enterica enterica serovar Typhi
uauauucuucuuagaauagaau

SEQ ID NO: 1707614 - RNA, 16 nt, Salmonella enterica enterica serovar Typhi
uauauuccccuuaugg

SEQ ID NO: 1707615 - RNA, 15 nt, Salmonella enterica enterica serovar Typhi
uauauucuucuuaga

SEQ ID NO: 1707616 - RNA, 18 nt, Salmonella enterica enterica serovar Typhi
uauaucaugggaaaucac

SEQ ID NO: 1707617 - RNA, 13 nt, Salmonella enterica enterica serovar Typhi
uauauucagaauu

SEQ ID NO: 1707618 - RNA, 13 nt, Salmonella enterica enterica serovar Typhi
uauaucaggcaaa

SEQ ID NO: 1707619 - RNA, 19 nt, Salmonella enterica enterica serovar Typhi
uauaguccacuuucuguaa

SEQ ID NO: 1707620 - RNA, 23 nt, Salmonella enterica enterica serovar Typhi
uauauacuucaccauaaaucauu

SEQ ID NO: 1707621 - RNA, 21 nt, Salmonella enterica enterica serovar Typhi
uauagacgccggucaugccau

SEQ ID NO: 1707622 - RNA, 19 nt, Salmonella enterica enterica serovar Typhi
uauagagcgccauauugcu

SEQ ID NO: 1707623 - RNA, 15 nt, Salmonella enterica enterica serovar Typhi
uauagcaacccacuu

SEQ ID NO: 1707624 - RNA, 15 nt, Salmonella enterica enterica serovar Typhi
uauagccauuuuuug

SEQ ID NO: 1707625 - RNA, 13 nt, Salmonella enterica enterica serovar Typhi
uauagccaggcag

SEQ ID NO: 1707626 - RNA, 15 nt, Salmonella enterica enterica serovar Typhi
uauagccaggcagau

SEQ ID NO: 1707627 - RNA, 22 nt, Salmonella enterica enterica serovar Typhi
uauagcucagcgcggcagccgg

SEQ ID NO: 1707628 - RNA, 19 nt, Salmonella enterica enterica serovar Typhi
uauacggcggcaaugccgc

SEQ ID NO: 1707629 - RNA, 15 nt, Salmonella enterica enterica serovar Typhi
uauacguugauuggc

SEQ ID NO: 1707630 - RNA, 12 nt, Salmonella enterica enterica serovar Typhi
uauacucaaaaa

SEQ ID NO: 1707631 - RNA, 11 nt, Salmonella enterica enterica serovar Typhi
uauacugucuu

SEQ ID NO: 1707632 - RNA, 15 nt, Salmonella enterica enterica serovar Typhi
uauacucaaaaaauc

SEQ ID NO: 1707633 - RNA, 15 nt, Salmonella enterica enterica serovar Typhi
uauacuuauugaucc

SEQ ID NO: 1707634 - RNA, 13 nt, Salmonella enterica enterica serovar Typhi
uauacuucaucag

SEQ ID NO: 1707635 - RNA, 12 nt, Salmonella enterica enterica serovar Typhi
uauacauuucac

SEQ ID NO: 1707636 - RNA, 18 nt, Salmonella enterica enterica serovar Typhi
uauacauauuguuuucua

SEQ ID NO: 1707637 - RNA, 22 nt, Salmonella enterica enterica serovar Typhi
uauacauacauaccacgcagcg

SEQ ID NO: 1707638 - RNA, 23 nt, Salmonella enterica enterica serovar Typhi
uauaacuaaacucaucuuuauuc

SEQ ID NO: 1707639 - RNA, 19 nt, Salmonella enterica enterica serovar Typhi
uauaacucuuaauuauaaa

SEQ ID NO: 1707640 - RNA, 15 nt, Salmonella enterica enterica serovar Typhi
uauaacuuucaauau

SEQ ID NO: 1707641 - RNA, 14 nt, Salmonella enterica enterica serovar Typhi
uagcgggggccggc

SEQ ID NO: 1707642 - RNA, 23 nt, Salmonella enterica enterica serovar Typhi
uagcgggcaaugccaccagcgcc

SEQ ID NO: 1707643 - RNA, 22 nt, Salmonella enterica enterica serovar Typhi
uagcguacuuucaaauagcugg

SEQ ID NO: 1707644 - RNA, 18 nt, Salmonella enterica enterica serovar Typhi
uagcgucaacgcuuuuau

SEQ ID NO: 1707645 - RNA, 13 nt, Salmonella enterica enterica serovar Typhi
uagcggaacugcg

SEQ ID NO: 1707646 - RNA, 12 nt, Salmonella enterica enterica serovar Typhi
uagcgcgcugcu

SEQ ID NO: 1707647 - RNA, 16 nt, Salmonella enterica enterica serovar Typhi
uagcgccuaugcuguc

SEQ ID NO: 1707648 - RNA, 22 nt, Salmonella enterica enterica serovar Typhi
uagcgccuccccuaaucgagga

SEQ ID NO: 1707649 - RNA, 22 nt, Salmonella enterica enterica serovar Typhi
uagcgagaagccgauggaagua

SEQ ID NO: 1707650 - RNA, 20 nt, Salmonella enterica enterica serovar Typhi
uagcgcaggggggaaaugag

SEQ ID NO: 1707651 - RNA, 17 nt, Salmonella enterica enterica serovar Typhi
uagcgcccuggucagca

SEQ ID NO: 1707652 - RNA, 14 nt, Salmonella enterica enterica serovar Typhi
uagcgccagcagca

SEQ ID NO: 1707653 - RNA, 16 nt, Salmonella enterica enterica serovar Typhi
uagcgccagcagcaua

SEQ ID NO: 1707654 - RNA, 14 nt, Salmonella enterica enterica serovar Typhi
uagcgccagacaga

SEQ ID NO: 1707655 - RNA, 23 nt, Salmonella enterica enterica serovar Typhi
uagccuuuauugaugacauuaau

SEQ ID NO: 1707656 - RNA, 24 nt, Salmonella enterica enterica serovar Typhi
uagccuugacgcaauagaguaaug

SEQ ID NO: 1707657 - RNA, 18 nt, Salmonella enterica enterica serovar Typhi
uagccuucccggggaaca

SEQ ID NO: 1707658 - RNA, 15 nt, Salmonella enterica enterica serovar Typhi
uagccuuuuucuuuc

SEQ ID NO: 1707659 - RNA, 20 nt, Salmonella enterica enterica serovar Typhi
uagccuuuuucuuucagacc

SEQ ID NO: 1707660 - RNA, 22 nt, Salmonella enterica enterica serovar Typhi
uagcccgccagcaccagcagcg

SEQ ID NO: 1707661 - RNA, 21 nt, Salmonella enterica enterica serovar Typhi
uagccccagaccgauauuuug

SEQ ID NO: 1707662 - RNA, 20 nt, Salmonella enterica enterica serovar Typhi
uagcccucgguggauaaauu

SEQ ID NO: 1707663 - RNA, 19 nt, Salmonella enterica enterica serovar Typhi
uagcccugagcccacagcg

SEQ ID NO: 1707664 - RNA, 14 nt, Salmonella enterica enterica serovar Typhi
uagcccggcaggcu

SEQ ID NO: 1707665 - RNA, 16 nt, Salmonella enterica enterica serovar Typhi
uagcccggcaggcugg

SEQ ID NO: 1707666 - RNA, 23 nt, Salmonella enterica enterica serovar Typhi
uagcccgcuuuaccgaaaucggu

SEQ ID NO: 1707667 - RNA, 21 nt, Salmonella enterica enterica serovar Typhi
uagcccauauaacguuuucag

SEQ ID NO: 1707668 - RNA, 20 nt, Salmonella enterica enterica serovar Typhi
uagccagccugaacgggugg

SEQ ID NO: 1707669 - RNA, 20 nt, Salmonella enterica enterica serovar Typhi
uagccagcgauccugcggca

SEQ ID NO: 1707670 - RNA, 12 nt, Salmonella enterica enterica serovar Typhi
uagccagcauca

SEQ ID NO: 1707671 - RNA, 20 nt, Salmonella enterica enterica serovar Typhi
uagccaguaccgaaaucauc

SEQ ID NO: 1707672 - RNA, 15 nt, Salmonella enterica enterica serovar Typhi
uagccauucauuaaa

SEQ ID NO: 1707673 - RNA, 18 nt, Salmonella enterica enterica serovar Typhi
uagccauucauuaaaauu

SEQ ID NO: 1707674 - RNA, 20 nt, Salmonella enterica enterica serovar Typhi
uagccggugccgcaaucggu

SEQ ID NO: 1707675 - RNA, 18 nt, Salmonella enterica enterica serovar Typhi
uagccgguaacuuucccg

SEQ ID NO: 1707676 - RNA, 14 nt, Salmonella enterica enterica serovar Typhi
uagccggauaaaau

SEQ ID NO: 1707677 - RNA, 14 nt, Salmonella enterica enterica serovar Typhi
uagccguucuccag

SEQ ID NO: 1707678 - RNA, 18 nt, Salmonella enterica enterica serovar Typhi
uagccguucaugcacucg

SEQ ID NO: 1707679 - RNA, 16 nt, Salmonella enterica enterica serovar Typhi
uagccgcugcccugac

SEQ ID NO: 1707680 - RNA, 16 nt, Salmonella enterica enterica serovar Typhi
uagccgccccccguca

SEQ ID NO: 1707681 - RNA, 22 nt, Salmonella enterica enterica serovar Typhi
uagccgccagcuaauuuuacuu

SEQ ID NO: 1707682 - RNA, 18 nt, Salmonella enterica enterica serovar Typhi
uagcgucucaucaaaaag

SEQ ID NO: 1707683 - RNA, 18 nt, Salmonella enterica enterica serovar Typhi
uagcguucauucccgcca

SEQ ID NO: 1707684 - RNA, 13 nt, Salmonella enterica enterica serovar Typhi
uagcguuuuccag

SEQ ID NO: 1707685 - RNA, 13 nt, Salmonella enterica enterica serovar Typhi
uagcguugauaug

SEQ ID NO: 1707686 - RNA, 13 nt, Salmonella enterica enterica serovar Typhi
uagcguucugguu

SEQ ID NO: 1707687 - RNA, 16 nt, Salmonella enterica enterica serovar Typhi
uagcguucuuuccagu

SEQ ID NO: 1707688 - RNA, 12 nt, Salmonella enterica enterica serovar Typhi
uagcuaaugcaa

SEQ ID NO: 1707689 - RNA, 15 nt, Salmonella enterica enterica serovar Typhi
uagcuaaauaaaaau

SEQ ID NO: 1707690 - RNA, 17 nt, Salmonella enterica enterica serovar Typhi
uagcuccagacaggacg

SEQ ID NO: 1707691 - RNA, 22 nt, Salmonella enterica enterica serovar Typhi
uagcuacguagcgcauugcgcc

SEQ ID NO: 1707692 - RNA, 20 nt, Salmonella enterica enterica serovar Typhi
uagcuccgaauaauccuucc

SEQ ID NO: 1707693 - RNA, 20 nt, Salmonella enterica enterica serovar Typhi
uagcugcgcaagaaacauca

SEQ ID NO: 1707694 - RNA, 15 nt, Salmonella enterica enterica serovar Typhi
uagcuuaaaaaaucc

SEQ ID NO: 1707695 - RNA, 16 nt, Salmonella enterica enterica serovar Typhi
uagcugcggcucgcca

SEQ ID NO: 1707696 - RNA, 17 nt, Salmonella enterica enterica serovar Typhi
uagcugcguuuccagcc

SEQ ID NO: 1707697 - RNA, 20 nt, Salmonella enterica enterica serovar Typhi
uagcuuaucgccaaagauau

SEQ ID NO: 1707698 - RNA, 19 nt, Salmonella enterica enterica serovar Typhi
uagcuuaaaaaauccugca

SEQ ID NO: 1707699 - RNA, 21 nt, Salmonella enterica enterica serovar Typhi
uagcuuacuuuuagaauuauc

SEQ ID NO: 1707700 - RNA, 16 nt, Salmonella enterica enterica serovar Typhi
uagcuuacuuucagau

SEQ ID NO: 1707701 - RNA, 13 nt, Salmonella enterica enterica serovar Typhi
uagcuuuuuuaug

SEQ ID NO: 1707702 - RNA, 17 nt, Salmonella enterica enterica serovar Typhi
uagcuuuuccgcuggaa

SEQ ID NO: 1707703 - RNA, 14 nt, Salmonella enterica enterica serovar Typhi
uagcuucugucugc

SEQ ID NO: 1707704 - RNA, 18 nt, Salmonella enterica enterica serovar Typhi
uaggaagacgagaagcga

SEQ ID NO: 1707705 - RNA, 19 nt, Salmonella enterica enterica serovar Typhi
uaggaguaaauaauuuugu

SEQ ID NO: 1707706 - RNA, 17 nt, Salmonella enterica enterica serovar Typhi
uagccaauaacgucugg

SEQ ID NO: 1707707 - RNA, 15 nt, Salmonella enterica enterica serovar Typhi
uagccaacacauaag

SEQ ID NO: 1707708 - RNA, 20 nt, Salmonella enterica enterica serovar Typhi
uagccaacacauaagccacu

SEQ ID NO: 1707709 - RNA, 20 nt, Salmonella enterica enterica serovar Typhi
uagccaaagcgguaauuaau

SEQ ID NO: 1707710 - RNA, 20 nt, Salmonella enterica enterica serovar Typhi
uagccaaacucugaaaaaau

SEQ ID NO: 1707711 - RNA, 19 nt, Salmonella enterica enterica serovar Typhi
uagccaaagauuagcccca

SEQ ID NO: 1707712 - RNA, 23 nt, Salmonella enterica enterica serovar Typhi
uagcauuaagcugauauuuuacu

SEQ ID NO: 1707713 - RNA, 20 nt, Salmonella enterica enterica serovar Typhi
uagcauuaagcugauauuuu

SEQ ID NO: 1707714 - RNA, 14 nt, Salmonella enterica enterica serovar Typhi
uagcauccagaccc

SEQ ID NO: 1707715 - RNA, 19 nt, Salmonella enterica enterica serovar Typhi
uagcagcauaaacaucagc

SEQ ID NO: 1707716 - RNA, 14 nt, Salmonella enterica enterica serovar Typhi
uagcagacagccga

SEQ ID NO: 1707717 - RNA, 15 nt, Salmonella enterica enterica serovar Typhi
uagcacuuuaaacac

SEQ ID NO: 1707718 - RNA, 23 nt, Salmonella enterica enterica serovar Typhi
uagcaggauauuuugcucauauu

SEQ ID NO: 1707719 - RNA, 14 nt, Salmonella enterica enterica serovar Typhi
uagcaguggagagg

SEQ ID NO: 1707720 - RNA, 13 nt, Salmonella enterica enterica serovar Typhi
uagcaguuuucac

SEQ ID NO: 1707721 - RNA, 21 nt, Salmonella enterica enterica serovar Typhi
uagcauaaaugcgaugaacau

SEQ ID NO: 1707722 - RNA, 17 nt, Salmonella enterica enterica serovar Typhi
uagcauaacguuuccuu

SEQ ID NO: 1707723 - RNA, 18 nt, Salmonella enterica enterica serovar Typhi
uagcaaagcguacaugaa

SEQ ID NO: 1707724 - RNA, 20 nt, Salmonella enterica enterica serovar Typhi
uagcaacacagacuuugcac

SEQ ID NO: 1707725 - RNA, 13 nt, Salmonella enterica enterica serovar Typhi
uagcaaaaaugcc

SEQ ID NO: 1707726 - RNA, 18 nt, Salmonella enterica enterica serovar Typhi
uagcaauuaauaaacaau

SEQ ID NO: 1707727 - RNA, 20 nt, Salmonella enterica enterica serovar Typhi
uagcaaccucggcuugcuuc

SEQ ID NO: 1707728 - RNA, 14 nt, Salmonella enterica enterica serovar Typhi
uagcaccaggccaa

SEQ ID NO: 1707729 - RNA, 23 nt, Salmonella enterica enterica serovar Typhi
uagcaccucgcaauauucaugcc

SEQ ID NO: 1707730 - RNA, 14 nt, Salmonella enterica enterica serovar Typhi
uagcacaaagaauu

SEQ ID NO: 1707731 - RNA, 19 nt, Salmonella enterica enterica serovar Typhi
uagcaauugccauaaaaac

SEQ ID NO: 1707732 - RNA, 13 nt, Salmonella enterica enterica serovar Typhi
uagcaauuauauu

SEQ ID NO: 1707733 - RNA, 17 nt, Salmonella enterica enterica serovar Typhi
uagauauagcuuuucaa

SEQ ID NO: 1707734 - RNA, 22 nt, Salmonella enterica enterica serovar Typhi
uagauauaacccaguucaaauc

SEQ ID NO: 1707735 - RNA, 14 nt, Salmonella enterica enterica serovar Typhi
uagauauuccccac

SEQ ID NO: 1707736 - RNA, 13 nt, Salmonella enterica enterica serovar Typhi
uagauauuaauau

SEQ ID NO: 1707737 - RNA, 20 nt, Salmonella enterica enterica serovar Typhi
uagaugaaacucgcuguggc

SEQ ID NO: 1707738 - RNA, 19 nt, Salmonella enterica enterica serovar Typhi
uagauucuaacauaaugaa

SEQ ID NO: 1707739 - RNA, 20 nt, Salmonella enterica enterica serovar Typhi
uagauguuaaaguuuuucau

SEQ ID NO: 1707740 - RNA, 18 nt, Salmonella enterica enterica serovar Typhi
uagagcguggucauuagg

SEQ ID NO: 1707741 - RNA, 16 nt, Salmonella enterica enterica serovar Typhi
uagagugcuucugcaa

SEQ ID NO: 1707742 - RNA, 17 nt, Salmonella enterica enterica serovar Typhi
uagagugcuucugcaaa

SEQ ID NO: 1707743 - RNA, 23 nt, Salmonella enterica enterica serovar Typhi
uagauaccuacuuuauuuuucgc

SEQ ID NO: 1707744 - RNA, 16 nt, Salmonella enterica enterica serovar Typhi
uagauaccuacuuuau

SEQ ID NO: 1707745 - RNA, 18 nt, Salmonella enterica enterica serovar Typhi
uagauaaguccuaacacc

SEQ ID NO: 1707746 - RNA, 16 nt, Salmonella enterica enterica serovar Typhi
uagauaacuauaugcc

SEQ ID NO: 1707747 - RNA, 15 nt, Salmonella enterica enterica serovar Typhi
uagauaacaccgcau

SEQ ID NO: 1707748 - RNA, 18 nt, Salmonella enterica enterica serovar Typhi
uaccacgccgcacacagc

SEQ ID NO: 1707749 - RNA, 18 nt, Salmonella enterica enterica serovar Typhi
uaccaauuccaccaccuc

SEQ ID NO: 1707750 - RNA, 15 nt, Salmonella enterica enterica serovar Typhi
uaccaaugccaaaaa

SEQ ID NO: 1707751 - RNA, 15 nt, Salmonella enterica enterica serovar Typhi
uaccgcuaaaauacc

SEQ ID NO: 1707752 - RNA, 16 nt, Salmonella enterica enterica serovar Typhi
uaccacuucggcagaa

SEQ ID NO: 1707753 - RNA, 23 nt, Salmonella enterica enterica serovar Typhi
uaccgccgagcauuuccgcagcc

SEQ ID NO: 1707754 - RNA, 16 nt, Salmonella enterica enterica serovar Typhi
uaccgccagcggcguu

SEQ ID NO: 1707755 - RNA, 18 nt, Salmonella enterica enterica serovar Typhi
uaccggcgcucagccaga

SEQ ID NO: 1707756 - RNA, 15 nt, Salmonella enterica enterica serovar Typhi
uaccgggccuacgga

SEQ ID NO: 1707757 - RNA, 16 nt, Salmonella enterica enterica serovar Typhi
uaccgggcuaaaccac

SEQ ID NO: 1707758 - RNA, 23 nt, Salmonella enterica enterica serovar Typhi
uaccguuugucuucugccagcaa

SEQ ID NO: 1707759 - RNA, 21 nt, Salmonella enterica enterica serovar Typhi
uaccucaaaaaccaguugcca

SEQ ID NO: 1707760 - RNA, 18 nt, Salmonella enterica enterica serovar Typhi
uaccuacgcgauaaaaaa

SEQ ID NO: 1707761 - RNA, 19 nt, Salmonella enterica enterica serovar Typhi
uaccugucguacgccuaaa

SEQ ID NO: 1707762 - RNA, 17 nt, Salmonella enterica enterica serovar Typhi
uaccuguaucaaaccaa

SEQ ID NO: 1707763 - RNA, 22 nt, Salmonella enterica enterica serovar Typhi
uaccuuacggacugcggccugc

SEQ ID NO: 1707764 - RNA, 13 nt, Salmonella enterica enterica serovar Typhi
uaccuguauuaug

SEQ ID NO: 1707765 - RNA, 14 nt, Salmonella enterica enterica serovar Typhi
uaccugauaaaauu

SEQ ID NO: 1707766 - RNA, 22 nt, Salmonella enterica enterica serovar Typhi
uaccugauccagcucuucuucg

SEQ ID NO: 1707767 - RNA, 12 nt, Salmonella enterica enterica serovar Typhi
uaccugaugagc

SEQ ID NO: 1707768 - RNA, 17 nt, Salmonella enterica enterica serovar Typhi
uaccugaugagcaggcc

SEQ ID NO: 1707769 - RNA, 21 nt, Salmonella enterica enterica serovar Typhi
uaccugcaaaaacgccagacc

SEQ ID NO: 1707770 - RNA, 17 nt, Salmonella enterica enterica serovar Typhi
uaccugccugucacgca

SEQ ID NO: 1707771 - RNA, 16 nt, Salmonella enterica enterica serovar Typhi
uaccucuuauccggcu

SEQ ID NO: 1707772 - RNA, 17 nt, Salmonella enterica enterica serovar Typhi
uaccucgcgcuuauccg

SEQ ID NO: 1707773 - RNA, 14 nt, Salmonella enterica enterica serovar Typhi
uaccuccuggcguu

SEQ ID NO: 1707774 - RNA, 16 nt, Salmonella enterica enterica serovar Typhi
uaccuucuauuuuucc

SEQ ID NO: 1707775 - RNA, 14 nt, Salmonella enterica enterica serovar Typhi
uaccuuguucuucc

SEQ ID NO: 1707776 - RNA, 19 nt, Salmonella enterica enterica serovar Typhi
uaccuuuaaacuguuucca

SEQ ID NO: 1707777 - RNA, 16 nt, Salmonella enterica enterica serovar Typhi
uaccuuguucuuccau

SEQ ID NO: 1707778 - RNA, 16 nt, Salmonella enterica enterica serovar Typhi
uaccuuauucagccca

SEQ ID NO: 1707779 - RNA, 21 nt, Salmonella enterica enterica serovar Typhi
uaccuucgcguuuaucaccaa

SEQ ID NO: 1707780 - RNA, 22 nt, Salmonella enterica enterica serovar Typhi
uaccuuuuccucgucauaucug

SEQ ID NO: 1707781 - RNA, 13 nt, Salmonella enterica enterica serovar Typhi
uaccuuuacgcag

SEQ ID NO: 1707782 - RNA, 22 nt, Salmonella enterica enterica serovar Typhi
uacucagggcaaaaaugaucac

SEQ ID NO: 1707783 - RNA, 13 nt, Salmonella enterica enterica serovar Typhi
uacuccagcagac

SEQ ID NO: 1707784 - RNA, 21 nt, Salmonella enterica enterica serovar Typhi
uacuccagcccaucagucccc

SEQ ID NO: 1707785 - RNA, 21 nt, Salmonella enterica enterica serovar Typhi
uacuccauucccagcucuuuc

SEQ ID NO: 1707786 - RNA, 12 nt, Salmonella enterica enterica serovar Typhi
uacuccagccca

SEQ ID NO: 1707787 - RNA, 14 nt, Salmonella enterica enterica serovar Typhi
uacuccacaguuca

SEQ ID NO: 1707788 - RNA, 14 nt, Salmonella enterica enterica serovar Typhi
uacucaacaucauu

SEQ ID NO: 1707789 - RNA, 13 nt, Salmonella enterica enterica serovar Typhi
uacuauuuuucac

SEQ ID NO: 1707790 - RNA, 16 nt, Salmonella enterica enterica serovar Typhi
uacucacauucauaaa

SEQ ID NO: 1707791 - RNA, 19 nt, Salmonella enterica enterica serovar Typhi
uacucacgacuuucaccag

SEQ ID NO: 1707792 - RNA, 13 nt, Salmonella enterica enterica serovar Typhi
uacucacugccgc

SEQ ID NO: 1707793 - RNA, 24 nt, Salmonella enterica enterica serovar Typhi
uacucaccaguccggcagaaagca

SEQ ID NO: 1707794 - RNA, 20 nt, Salmonella enterica enterica serovar Typhi
uacucacgacuuucaccaga

SEQ ID NO: 1707795 - RNA, 13 nt, Salmonella enterica enterica serovar Typhi
uacguuuuuauua

SEQ ID NO: 1707796 - RNA, 12 nt, Salmonella enterica enterica serovar Typhi
uacguuuauucu

SEQ ID NO: 1707797 - RNA, 18 nt, Salmonella enterica enterica serovar Typhi
uacguugauuaucaccca

SEQ ID NO: 1707798 - RNA, 20 nt, Salmonella enterica enterica serovar Typhi
uacguucaccccgucauauu

SEQ ID NO: 1707799 - RNA, 15 nt, Salmonella enterica enterica serovar Typhi
uacggaaaaaauacu

SEQ ID NO: 1707800 - RNA, 15 nt, Salmonella enterica enterica serovar Typhi
uacgcuggugcagcc

SEQ ID NO: 1707801 - RNA, 18 nt, Salmonella enterica enterica serovar Typhi
uacgcuguagcuggcugc

SEQ ID NO: 1707802 - RNA, 18 nt, Salmonella enterica enterica serovar Typhi
uacgauucagguuuugcu

SEQ ID NO: 1707803 - RNA, 23 nt, Salmonella enterica enterica serovar Typhi
uacgauucagguuuugcugauca

SEQ ID NO: 1707804 - RNA, 16 nt, Salmonella enterica enterica serovar Typhi
uacgaugcagcaccag

SEQ ID NO: 1707805 - RNA, 16 nt, Salmonella enterica enterica serovar Typhi
uacgcuauuuaaaaac

SEQ ID NO: 1707806 - RNA, 16 nt, Salmonella enterica enterica serovar Typhi
uacgaucgccaccgca

SEQ ID NO: 1707807 - RNA, 13 nt, Salmonella enterica enterica serovar Typhi
uacgauaucaucg

SEQ ID NO: 1707808 - RNA, 18 nt, Salmonella enterica enterica serovar Typhi
uacgauagcaauuaauaa

SEQ ID NO: 1707809 - RNA, 12 nt, Salmonella enterica enterica serovar Typhi
uacggaaaaaug

SEQ ID NO: 1707810 - RNA, 20 nt, Salmonella enterica enterica serovar Typhi
uacggaaagcuguuguugcu

SEQ ID NO: 1707811 - RNA, 20 nt, Salmonella enterica enterica serovar Typhi
uacggacugcggccugcaaa

SEQ ID NO: 1707812 - RNA, 21 nt, Salmonella enterica enterica serovar Typhi
uacggaguuggaaccaaacac

SEQ ID NO: 1707813 - RNA, 20 nt, Salmonella enterica enterica serovar Typhi
uacggauggcccugccgggg

SEQ ID NO: 1707814 - RNA, 23 nt, Salmonella enterica enterica serovar Typhi
uacggcaaacacaaucacgccca

SEQ ID NO: 1707815 - RNA, 11 nt, Salmonella enterica enterica serovar Typhi
uacggcaggcc

SEQ ID NO: 1707816 - RNA, 16 nt, Salmonella enterica enterica serovar Typhi
uacgugcucucaccau

SEQ ID NO: 1707817 - RNA, 15 nt, Salmonella enterica enterica serovar Typhi
uagaauagcgccgug

SEQ ID NO: 1707818 - RNA, 16 nt, Salmonella enterica enterica serovar Typhi
uagaauaggaaauaau

SEQ ID NO: 1707819 - RNA, 21 nt, Salmonella enterica enterica serovar Typhi
uagaauagaaucaauuucucu

SEQ ID NO: 1707820 - RNA, 16 nt, Salmonella enterica enterica serovar Typhi
uagaauacuuccugcu

SEQ ID NO: 1707821 - RNA, 17 nt, Salmonella enterica enterica serovar Typhi
uagaauuaucugaaagu

SEQ ID NO: 1707822 - RNA, 23 nt, Salmonella enterica enterica serovar Typhi
uagaaucaauuucucuuuuauua

SEQ ID NO: 1707823 - RNA, 14 nt, Salmonella enterica enterica serovar Typhi
uagaaccacuuauu

SEQ ID NO: 1707824 - RNA, 14 nt, Salmonella enterica enterica serovar Typhi
uagaacagcaugaa

SEQ ID NO: 1707825 - RNA, 16 nt, Salmonella enterica enterica serovar Typhi
uagaagccacaaucug

SEQ ID NO: 1707826 - RNA, 20 nt, Salmonella enterica enterica serovar Typhi
uagaagcucaugugcagcau

SEQ ID NO: 1707827 - RNA, 19 nt, Salmonella enterica enterica serovar Typhi
uagaagcucaugugcagca

SEQ ID NO: 1707828 - RNA, 22 nt, Salmonella enterica enterica serovar Typhi
uagacaguuuuuucguuccaga

SEQ ID NO: 1707829 - RNA, 15 nt, Salmonella enterica enterica serovar Typhi
uagaccugaaaucag

SEQ ID NO: 1707830 - RNA, 17 nt, Salmonella enterica enterica serovar Typhi
uagaccugaaaucagcc

SEQ ID NO: 1707831 - RNA, 18 nt, Salmonella enterica enterica serovar Typhi
uagaccugaaaucagccu

SEQ ID NO: 1707832 - RNA, 11 nt, Salmonella enterica enterica serovar Typhi
uagacaaacag

SEQ ID NO: 1707833 - RNA, 18 nt, Salmonella enterica enterica serovar Typhi
uagacaacaucccagaaa

SEQ ID NO: 1707834 - RNA, 15 nt, Salmonella enterica enterica serovar Typhi
uagacggccugcaaa

SEQ ID NO: 1707835 - RNA, 22 nt, Salmonella enterica enterica serovar Typhi
uagacgacaucuuuuccugaag

SEQ ID NO: 1707836 - RNA, 23 nt, Salmonella enterica enterica serovar Typhi
uagacgucgcguacaauugcuuc

SEQ ID NO: 1707837 - RNA, 18 nt, Salmonella enterica enterica serovar Typhi
uagacgcgcuagcuucag

SEQ ID NO: 1707838 - RNA, 16 nt, Salmonella enterica enterica serovar Typhi
uagagaccgcuuuagc

SEQ ID NO: 1707839 - RNA, 14 nt, Salmonella enterica enterica serovar Typhi
uagagaaaauaaca

SEQ ID NO: 1707840 - RNA, 12 nt, Salmonella enterica enterica serovar Typhi
uagagaaaucaa

SEQ ID NO: 1707841 - RNA, 22 nt, Salmonella enterica enterica serovar Typhi
uagaaagucuuuuguuuuucuc

SEQ ID NO: 1707842 - RNA, 23 nt, Salmonella enterica enterica serovar Typhi
uagaaagucuuuuguuuuucucu

SEQ ID NO: 1707843 - RNA, 17 nt, Salmonella enterica enterica serovar Typhi
uagaaagauuucaucag

SEQ ID NO: 1707844 - RNA, 23 nt, Salmonella enterica enterica serovar Typhi
uagaaacucuuuaaagcgcugcg

SEQ ID NO: 1707845 - RNA, 14 nt, Salmonella enterica enterica serovar Typhi
uagaaaauauauug

SEQ ID NO: 1707846 - RNA, 16 nt, Salmonella enterica enterica serovar Typhi
uagaaaaggucgucag

SEQ ID NO: 1707847 - RNA, 16 nt, Salmonella enterica enterica serovar Typhi
uagaaaaaauuaaaaa

SEQ ID NO: 1707848 - RNA, 18 nt, Salmonella enterica enterica serovar Typhi
uagaaaaaauuaaaaaua

SEQ ID NO: 1707849 - RNA, 17 nt, Salmonella enterica enterica serovar Typhi
uagaaaaagguaacuau

SEQ ID NO: 1707850 - RNA, 23 nt, Salmonella enterica enterica serovar Typhi
uacuuuuuuaaauguuuuuucau

SEQ ID NO: 1707851 - RNA, 13 nt, Salmonella enterica enterica serovar Typhi
uacuuuuuuaaau

SEQ ID NO: 1707852 - RNA, 18 nt, Salmonella enterica enterica serovar Typhi
uacuuuuuuaaauguuuu

SEQ ID NO: 1707853 - RNA, 14 nt, Salmonella enterica enterica serovar Typhi
uacuuuguacugua

SEQ ID NO: 1707854 - RNA, 19 nt, Salmonella enterica enterica serovar Typhi
uacuuugcgcccagauaau

SEQ ID NO: 1707855 - RNA, 17 nt, Salmonella enterica enterica serovar Typhi
uacuucgcuuuguuuuc

SEQ ID NO: 1707856 - RNA, 14 nt, Salmonella enterica enterica serovar Typhi
uacuuuaaaacaua

SEQ ID NO: 1707857 - RNA, 16 nt, Salmonella enterica enterica serovar Typhi
uacuuucccccagauu

SEQ ID NO: 1707858 - RNA, 18 nt, Salmonella enterica enterica serovar Typhi
uacuuucuugccacuggc

SEQ ID NO: 1707859 - RNA, 22 nt, Salmonella enterica enterica serovar Typhi
uacuggcuaucuuuaugucagu

SEQ ID NO: 1707860 - RNA, 21 nt, Salmonella enterica enterica serovar Typhi
uacuggugcccgcaaaaccuu

SEQ ID NO: 1707861 - RNA, 20 nt, Salmonella enterica enterica serovar Typhi
uacucgacgcacuccagaug

SEQ ID NO: 1707862 - RNA, 21 nt, Salmonella enterica enterica serovar Typhi
uacugucaucccgauauacca

SEQ ID NO: 1707863 - RNA, 18 nt, Salmonella enterica enterica serovar Typhi
uaauugcuuuuuuccaca

SEQ ID NO: 1707864 - RNA, 19 nt, Salmonella enterica enterica serovar Typhi
uaauuguggaaauaagagu

SEQ ID NO: 1707865 - RNA, 15 nt, Salmonella enterica enterica serovar Typhi
uaauuguguaaucuu

SEQ ID NO: 1707866 - RNA, 19 nt, Salmonella enterica enterica serovar Typhi
uaauucuuaacccacaaga

SEQ ID NO: 1707867 - RNA, 21 nt, Salmonella enterica enterica serovar Typhi
uaauugcuuugcaauguucaa

SEQ ID NO: 1707868 - RNA, 23 nt, Salmonella enterica enterica serovar Typhi
uaauuuccagugccaguuaagca

SEQ ID NO: 1707869 - RNA, 15 nt, Salmonella enterica enterica serovar Typhi
uaauuuauagccauu

SEQ ID NO: 1707870 - RNA, 17 nt, Salmonella enterica enterica serovar Typhi
uaauuuauauugugccu

SEQ ID NO: 1707871 - RNA, 21 nt, Salmonella enterica enterica serovar Typhi
uaauuauaaagcauaaauaca

SEQ ID NO: 1707872 - RNA, 16 nt, Salmonella enterica enterica serovar Typhi
uaauucauaacaccaa

SEQ ID NO: 1707873 - RNA, 14 nt, Salmonella enterica enterica serovar Typhi
uaauucagcucaac

SEQ ID NO: 1707874 - RNA, 16 nt, Salmonella enterica enterica serovar Typhi
uaauucuaaaaguaag

SEQ ID NO: 1707875 - RNA, 18 nt, Salmonella enterica enterica serovar Typhi
uaauucucacagaaucau

SEQ ID NO: 1707876 - RNA, 20 nt, Salmonella enterica enterica serovar Typhi
uaauucucacagaaucauca

SEQ ID NO: 1707877 - RNA, 22 nt, Salmonella enterica enterica serovar Typhi
uaauucauggccaucaacuucu

SEQ ID NO: 1707878 - RNA, 17 nt, Salmonella enterica enterica serovar Typhi
uaauggcgcgaaaacag

SEQ ID NO: 1707879 - RNA, 18 nt, Salmonella enterica enterica serovar Typhi
uaauggcgcgaaaacagc

SEQ ID NO: 1707880 - RNA, 22 nt, Salmonella enterica enterica serovar Typhi
uaauggcgaagcccgccuccac

SEQ ID NO: 1707881 - RNA, 12 nt, Salmonella enterica enterica serovar Typhi
uaauggcccagu

SEQ ID NO: 1707882 - RNA, 17 nt, Salmonella enterica enterica serovar Typhi
uaauguaaaaaaauaaa

SEQ ID NO: 1707883 - RNA, 20 nt, Salmonella enterica enterica serovar Typhi
uaaugguugugccaguaauc

SEQ ID NO: 1707884 - RNA, 16 nt, Salmonella enterica enterica serovar Typhi
uaaugguggcaaccug

SEQ ID NO: 1707885 - RNA, 20 nt, Salmonella enterica enterica serovar Typhi
uaauggugguugcaucaucg

SEQ ID NO: 1707886 - RNA, 16 nt, Salmonella enterica enterica serovar Typhi
uaauuagcauccagca

SEQ ID NO: 1707887 - RNA, 16 nt, Salmonella enterica enterica serovar Typhi
uaaugacuaauuauua

SEQ ID NO: 1707888 - RNA, 17 nt, Salmonella enterica enterica serovar Typhi
uaaugacgauaaauaag

SEQ ID NO: 1707889 - RNA, 15 nt, Salmonella enterica enterica serovar Typhi
uaaugcauggcagau

SEQ ID NO: 1707890 - RNA, 15 nt, Salmonella enterica enterica serovar Typhi
uaaugcccaccgugg

SEQ ID NO: 1707891 - RNA, 15 nt, Salmonella enterica enterica serovar Typhi
uaaugcauuggccag

SEQ ID NO: 1707892 - RNA, 11 nt, Salmonella enterica enterica serovar Typhi
uaaugcuuuug

SEQ ID NO: 1707893 - RNA, 21 nt, Salmonella enterica enterica serovar Typhi
uaauggauucucgcgccgggg

SEQ ID NO: 1707894 - RNA, 15 nt, Salmonella enterica enterica serovar Typhi
uaauggcaauaauac

SEQ ID NO: 1707895 - RNA, 18 nt, Salmonella enterica enterica serovar Typhi
uaauggcagaauaaaaca

SEQ ID NO: 1707896 - RNA, 16 nt, Salmonella enterica enterica serovar Typhi
uaaugcuuuccagcca

SEQ ID NO: 1707897 - RNA, 15 nt, Salmonella enterica enterica serovar Typhi
uaaugcuuuaaaugc

SEQ ID NO: 1707898 - RNA, 19 nt, Salmonella enterica enterica serovar Typhi
uaaugccgacccaccugac

SEQ ID NO: 1707899 - RNA, 20 nt, Salmonella enterica enterica serovar Typhi
uaaugccgccguacaaaccc

SEQ ID NO: 1707900 - RNA, 19 nt, Salmonella enterica enterica serovar Typhi
uaaugaagacguugaauau

SEQ ID NO: 1707901 - RNA, 15 nt, Salmonella enterica enterica serovar Typhi
uaaugaauuuaauau

SEQ ID NO: 1707902 - RNA, 15 nt, Salmonella enterica enterica serovar Typhi
uaaugacauccagag

SEQ ID NO: 1707903 - RNA, 19 nt, Salmonella enterica enterica serovar Typhi
uaaucugucgcuaaagcac

SEQ ID NO: 1707904 - RNA, 17 nt, Salmonella enterica enterica serovar Typhi
uaaucucaaacuuggcc

SEQ ID NO: 1707905 - RNA, 14 nt, Salmonella enterica enterica serovar Typhi
uaaucuaaaauuau

SEQ ID NO: 1707906 - RNA, 15 nt, Salmonella enterica enterica serovar Typhi
uaaucuaaaauuauu

SEQ ID NO: 1707907 - RNA, 16 nt, Salmonella enterica enterica serovar Typhi
uaaucuaaaauuauuu

SEQ ID NO: 1707908 - RNA, 15 nt, Salmonella enterica enterica serovar Typhi
uaauccuuauuuaau

SEQ ID NO: 1707909 - RNA, 21 nt, Salmonella enterica enterica serovar Typhi
uaaucgccugcauauuagcaa

SEQ ID NO: 1707910 - RNA, 18 nt, Salmonella enterica enterica serovar Typhi
uaaucgcgagaaaauaga

SEQ ID NO: 1707911 - RNA, 20 nt, Salmonella enterica enterica serovar Typhi
uaaucgcgauuuuuuuccgc

SEQ ID NO: 1707912 - RNA, 15 nt, Salmonella enterica enterica serovar Typhi
uaaucgcuucaauca

SEQ ID NO: 1707913 - RNA, 18 nt, Salmonella enterica enterica serovar Typhi
uaauccgcugcaacuccc

SEQ ID NO: 1707914 - RNA, 20 nt, Salmonella enterica enterica serovar Typhi
uaauccggcaacugccgggg

SEQ ID NO: 1707915 - RNA, 16 nt, Salmonella enterica enterica serovar Typhi
uaacgaugaugaaaaa

SEQ ID NO: 1707916 - RNA, 18 nt, Salmonella enterica enterica serovar Typhi
uaacgaugauuauuguua

SEQ ID NO: 1707917 - RNA, 19 nt, Salmonella enterica enterica serovar Typhi
uaacgaggccaccaucacu

SEQ ID NO: 1707918 - RNA, 17 nt, Salmonella enterica enterica serovar Typhi
uaccaauacccagcgcc

SEQ ID NO: 1707919 - RNA, 18 nt, Salmonella enterica enterica serovar Typhi
uaccaauacccagcgcca

SEQ ID NO: 1707920 - RNA, 14 nt, Salmonella enterica enterica serovar Typhi
uacauuuuuuucuu

SEQ ID NO: 1707921 - RNA, 14 nt, Salmonella enterica enterica serovar Typhi
uaccaaacagcaga

SEQ ID NO: 1707922 - RNA, 15 nt, Salmonella enterica enterica serovar Typhi
uacauuuuccaugcc

SEQ ID NO: 1707923 - RNA, 19 nt, Salmonella enterica enterica serovar Typhi
uacauuuuuacaguuacca

SEQ ID NO: 1707924 - RNA, 20 nt, Salmonella enterica enterica serovar Typhi
uacauugggucguaauauuc

SEQ ID NO: 1707925 - RNA, 15 nt, Salmonella enterica enterica serovar Typhi
uacaugcuacaggca

SEQ ID NO: 1707926 - RNA, 12 nt, Salmonella enterica enterica serovar Typhi
uacaugaauaau

SEQ ID NO: 1707927 - RNA, 14 nt, Salmonella enterica enterica serovar Typhi
uacaugaauaauaa

SEQ ID NO: 1707928 - RNA, 12 nt, Salmonella enterica enterica serovar Typhi
uacauauuguuu

SEQ ID NO: 1707929 - RNA, 18 nt, Salmonella enterica enterica serovar Typhi
uacaucuuccauuuuggu

SEQ ID NO: 1707930 - RNA, 22 nt, Salmonella enterica enterica serovar Typhi
uacauaggcaauauccuccggc

SEQ ID NO: 1707931 - RNA, 20 nt, Salmonella enterica enterica serovar Typhi
uacagcccgccagcaccagg

SEQ ID NO: 1707932 - RNA, 21 nt, Salmonella enterica enterica serovar Typhi
uacagccaaaucagcaggaca

SEQ ID NO: 1707933 - RNA, 14 nt, Salmonella enterica enterica serovar Typhi
uacagccaaaaaua

SEQ ID NO: 1707934 - RNA, 13 nt, Salmonella enterica enterica serovar Typhi
uacagcgccauga

SEQ ID NO: 1707935 - RNA, 16 nt, Salmonella enterica enterica serovar Typhi
uacagccgcgaugcua

SEQ ID NO: 1707936 - RNA, 18 nt, Salmonella enterica enterica serovar Typhi
uacagccugcgugaaucc

SEQ ID NO: 1707937 - RNA, 13 nt, Salmonella enterica enterica serovar Typhi
uacagaugcugua

SEQ ID NO: 1707938 - RNA, 13 nt, Salmonella enterica enterica serovar Typhi
uacagcacgccgg

SEQ ID NO: 1707939 - RNA, 15 nt, Salmonella enterica enterica serovar Typhi
uacagcacuucccgc

SEQ ID NO: 1707940 - RNA, 19 nt, Salmonella enterica enterica serovar Typhi
uacagcgucgacagccccc

SEQ ID NO: 1707941 - RNA, 22 nt, Salmonella enterica enterica serovar Typhi
uacaggacaagcagugcuggca

SEQ ID NO: 1707942 - RNA, 14 nt, Salmonella enterica enterica serovar Typhi
uacaggacagaugu

SEQ ID NO: 1707943 - RNA, 18 nt, Salmonella enterica enterica serovar Typhi
uacaggaauuccaguccu

SEQ ID NO: 1707944 - RNA, 19 nt, Salmonella enterica enterica serovar Typhi
uacagcuuaaucaccagcg

SEQ ID NO: 1707945 - RNA, 16 nt, Salmonella enterica enterica serovar Typhi
uacaggcggaaaucaa

SEQ ID NO: 1707946 - RNA, 17 nt, Salmonella enterica enterica serovar Typhi
uacaggccgauauauug

SEQ ID NO: 1707947 - RNA, 18 nt, Salmonella enterica enterica serovar Typhi
uacaggggauuguuaacg

SEQ ID NO: 1707948 - RNA, 13 nt, Salmonella enterica enterica serovar Typhi
uacaguuaccaca

SEQ ID NO: 1707949 - RNA, 18 nt, Salmonella enterica enterica serovar Typhi
uacaguuaccacacaugc

SEQ ID NO: 1707950 - RNA, 20 nt, Salmonella enterica enterica serovar Typhi
uacacauaugggaagacauu

SEQ ID NO: 1707951 - RNA, 16 nt, Salmonella enterica enterica serovar Typhi
uacacaucaggaaugc

SEQ ID NO: 1707952 - RNA, 17 nt, Salmonella enterica enterica serovar Typhi
uacaccaacuaccaaca

SEQ ID NO: 1707953 - RNA, 12 nt, Salmonella enterica enterica serovar Typhi
uacacagcacaa

SEQ ID NO: 1707954 - RNA, 21 nt, Salmonella enterica enterica serovar Typhi
uacaauuauugcguugcuuua

SEQ ID NO: 1707955 - RNA, 14 nt, Salmonella enterica enterica serovar Typhi
uacaauggcaggca

SEQ ID NO: 1707956 - RNA, 21 nt, Salmonella enterica enterica serovar Typhi
uacaauccaggacgucuugca

SEQ ID NO: 1707957 - RNA, 13 nt, Salmonella enterica enterica serovar Typhi
uaauuuucaccuc

SEQ ID NO: 1707958 - RNA, 17 nt, Salmonella enterica enterica serovar Typhi
uaauuuucaccuccggg

SEQ ID NO: 1707959 - RNA, 16 nt, Salmonella enterica enterica serovar Typhi
uaauuuuacuuucauu

SEQ ID NO: 1707960 - RNA, 18 nt, Salmonella enterica enterica serovar Typhi
uaauuuuacuuucauucc

SEQ ID NO: 1707961 - RNA, 11 nt, Salmonella enterica enterica serovar Typhi
uaauuuuagaa

SEQ ID NO: 1707962 - RNA, 17 nt, Salmonella enterica enterica serovar Typhi
uaauuuuagaaauagaa

SEQ ID NO: 1707963 - RNA, 22 nt, Salmonella enterica enterica serovar Typhi
uacaaccguggcguuuucauua

SEQ ID NO: 1707964 - RNA, 21 nt, Salmonella enterica enterica serovar Typhi
uacaaccguggcguuuucauu

SEQ ID NO: 1707965 - RNA, 22 nt, Salmonella enterica enterica serovar Typhi
uacaacgacuacguucaucagg

SEQ ID NO: 1707966 - RNA, 21 nt, Salmonella enterica enterica serovar Typhi
uacaacguucggucauggaua

SEQ ID NO: 1707967 - RNA, 17 nt, Salmonella enterica enterica serovar Typhi
uacacuucagccagacg

SEQ ID NO: 1707968 - RNA, 17 nt, Salmonella enterica enterica serovar Typhi
uacagaaaaccggcaaa

SEQ ID NO: 1707969 - RNA, 12 nt, Salmonella enterica enterica serovar Typhi
uacagacaucau

SEQ ID NO: 1707970 - RNA, 17 nt, Salmonella enterica enterica serovar Typhi
uacacgccuuccuccag

SEQ ID NO: 1707971 - RNA, 23 nt, Salmonella enterica enterica serovar Typhi
uacacgcaucgggucgcgcgccg

SEQ ID NO: 1707972 - RNA, 20 nt, Salmonella enterica enterica serovar Typhi
uacacgauaaaccucacgca

SEQ ID NO: 1707973 - RNA, 12 nt, Salmonella enterica enterica serovar Typhi
uacaccuuugcc

SEQ ID NO: 1707974 - RNA, 20 nt, Salmonella enterica enterica serovar Typhi
uacacguauaaacgccgccg

SEQ ID NO: 1707975 - RNA, 16 nt, Salmonella enterica enterica serovar Typhi
uacacucaaccaucaa

SEQ ID NO: 1707976 - RNA, 15 nt, Salmonella enterica enterica serovar Typhi
uacacucugcgcgcg

SEQ ID NO: 1707977 - RNA, 18 nt, Salmonella enterica enterica serovar Typhi
uacaccccuucuggagaa

SEQ ID NO: 1707978 - RNA, 22 nt, Salmonella enterica enterica serovar Typhi
uacaccgccuagcgucccggca

SEQ ID NO: 1707979 - RNA, 14 nt, Salmonella enterica enterica serovar Typhi
uacaccgccauaua

SEQ ID NO: 1707980 - RNA, 20 nt, Salmonella enterica enterica serovar Typhi
uacaccugacggcagccacg

SEQ ID NO: 1707981 - RNA, 14 nt, Salmonella enterica enterica serovar Typhi
uauuucugaaaaac

SEQ ID NO: 1707982 - RNA, 21 nt, Salmonella enterica enterica serovar Typhi
uauuucuaucagguaacauau

SEQ ID NO: 1707983 - RNA, 18 nt, Salmonella enterica enterica serovar Typhi
uauuucgacuuucuucgg

SEQ ID NO: 1707984 - RNA, 22 nt, Salmonella enterica enterica serovar Typhi
uauuucgacaagaagauuucuu

SEQ ID NO: 1707985 - RNA, 13 nt, Salmonella enterica enterica serovar Typhi
uauuugaauuuua

SEQ ID NO: 1707986 - RNA, 13 nt, Salmonella enterica enterica serovar Typhi
uauuugcauuuuc

SEQ ID NO: 1707987 - RNA, 13 nt, Salmonella enterica enterica serovar Typhi
uauuugcccuguu

SEQ ID NO: 1707988 - RNA, 14 nt, Salmonella enterica enterica serovar Typhi
uauuuggagagcau

SEQ ID NO: 1707989 - RNA, 15 nt, Salmonella enterica enterica serovar Typhi
uauuuguguauuuuu

SEQ ID NO: 1707990 - RNA, 22 nt, Salmonella enterica enterica serovar Typhi
uauuuguuuaccgcgauagaaa

SEQ ID NO: 1707991 - RNA, 15 nt, Salmonella enterica enterica serovar Typhi
uauuuuaaauuccca

SEQ ID NO: 1707992 - RNA, 16 nt, Salmonella enterica enterica serovar Typhi
uauuuuauucgccauu

SEQ ID NO: 1707993 - RNA, 12 nt, Salmonella enterica enterica serovar Typhi
uauuuuauuuuu

SEQ ID NO: 1707994 - RNA, 18 nt, Salmonella enterica enterica serovar Typhi
uauuuuccguuagccaau

SEQ ID NO: 1707995 - RNA, 22 nt, Salmonella enterica enterica serovar Typhi
uauuuuccugaaaaaauucccg

SEQ ID NO: 1707996 - RNA, 20 nt, Salmonella enterica enterica serovar Typhi
uauuuucuccggcaguccau

SEQ ID NO: 1707997 - RNA, 18 nt, Salmonella enterica enterica serovar Typhi
ucaaagaaaacuuucauu

SEQ ID NO: 1707998 - RNA, 13 nt, Salmonella enterica enterica serovar Typhi
ucaaagaaaacau

SEQ ID NO: 1707999 - RNA, 18 nt, Salmonella enterica enterica serovar Typhi
ucaaagaaaacaucagcc

SEQ ID NO: 1708000 - RNA, 20 nt, Salmonella enterica enterica serovar Typhi
ucaaacuuuuaaauugaaga

SEQ ID NO: 1708001 - RNA, 20 nt, Salmonella enterica enterica serovar Typhi
ucaaacuuuuauaaauauag

SEQ ID NO: 1708002 - RNA, 14 nt, Salmonella enterica enterica serovar Typhi
ucaaacgcgccgcu

SEQ ID NO: 1708003 - RNA, 14 nt, Salmonella enterica enterica serovar Typhi
ucaaacccuuccgc

SEQ ID NO: 1708004 - RNA, 15 nt, Salmonella enterica enterica serovar Typhi
ucaaacccuuccgca

SEQ ID NO: 1708005 - RNA, 19 nt, Salmonella enterica enterica serovar Typhi
ucaaaguuauuuaccacgg

SEQ ID NO: 1708006 - RNA, 22 nt, Salmonella enterica enterica serovar Typhi
ucaaauaagacauggaguucca

SEQ ID NO: 1708007 - RNA, 23 nt, Salmonella enterica enterica serovar Typhi
ucaaauaagacauggaguuccag

SEQ ID NO: 1708008 - RNA, 22 nt, Salmonella enterica enterica serovar Typhi
ucaaauacgcgauaaaaaccca

SEQ ID NO: 1708009 - RNA, 22 nt, Salmonella enterica enterica serovar Typhi
ucaaaggcgcugaacgcauaca

SEQ ID NO: 1708010 - RNA, 16 nt, Salmonella enterica enterica serovar Typhi
uauuuuucucagccag

SEQ ID NO: 1708011 - RNA, 12 nt, Salmonella enterica enterica serovar Typhi
uauuuuucagcu

SEQ ID NO: 1708012 - RNA, 14 nt, Salmonella enterica enterica serovar Typhi
ucaaaaaaaaccag

SEQ ID NO: 1708013 - RNA, 13 nt, Salmonella enterica enterica serovar Typhi
ucaaaaaaaauag

SEQ ID NO: 1708014 - RNA, 21 nt, Salmonella enterica enterica serovar Typhi
ucaaaaaaaauagccauugcu

SEQ ID NO: 1708015 - RNA, 22 nt, Salmonella enterica enterica serovar Typhi
ucaaaaaagcgacgcugucaau

SEQ ID NO: 1708016 - RNA, 13 nt, Salmonella enterica enterica serovar Typhi
ucaaaaaagagaa

SEQ ID NO: 1708017 - RNA, 14 nt, Salmonella enterica enterica serovar Typhi
ucaaaaaagagaag

SEQ ID NO: 1708018 - RNA, 18 nt, Salmonella enterica enterica serovar Typhi
ucaaaaccgaccccgcuc

SEQ ID NO: 1708019 - RNA, 21 nt, Salmonella enterica enterica serovar Typhi
ucaaaaccgggcagggaauac

SEQ ID NO: 1708020 - RNA, 16 nt, Salmonella enterica enterica serovar Typhi
ucaaaaggugagaaaa

SEQ ID NO: 1708021 - RNA, 23 nt, Salmonella enterica enterica serovar Typhi
ucaaaacccagcccaauacgcca

SEQ ID NO: 1708022 - RNA, 23 nt, Salmonella enterica enterica serovar Typhi
ucaaaaccagcgcggauaaaaaa

SEQ ID NO: 1708023 - RNA, 19 nt, Salmonella enterica enterica serovar Typhi
ucaaaaaauaucucucccu

SEQ ID NO: 1708024 - RNA, 16 nt, Salmonella enterica enterica serovar Typhi
ucaaaaaaucagcaau

SEQ ID NO: 1708025 - RNA, 21 nt, Salmonella enterica enterica serovar Typhi
ucaaaaaaucgaccaacgcac

SEQ ID NO: 1708026 - RNA, 12 nt, Salmonella enterica enterica serovar Typhi
uauuuauuuaaa

SEQ ID NO: 1708027 - RNA, 12 nt, Salmonella enterica enterica serovar Typhi
uauuuauuuaau

SEQ ID NO: 1708028 - RNA, 14 nt, Salmonella enterica enterica serovar Typhi
uauuucauaaugug

SEQ ID NO: 1708029 - RNA, 18 nt, Salmonella enterica enterica serovar Typhi
uauuucauuaaucuauuu

SEQ ID NO: 1708030 - RNA, 14 nt, Salmonella enterica enterica serovar Typhi
uauuucaagcaaua

SEQ ID NO: 1708031 - RNA, 22 nt, Salmonella enterica enterica serovar Typhi
uauuuaaauaucgguucaauac

SEQ ID NO: 1708032 - RNA, 21 nt, Salmonella enterica enterica serovar Typhi
uauuuacugaauaaauaguau

SEQ ID NO: 1708033 - RNA, 15 nt, Salmonella enterica enterica serovar Typhi
uauuuaccuuuuccu

SEQ ID NO: 1708034 - RNA, 20 nt, Salmonella enterica enterica serovar Typhi
uauuuagccguucaugcacu

SEQ ID NO: 1708035 - RNA, 17 nt, Salmonella enterica enterica serovar Typhi
uauugccugaagaacau

SEQ ID NO: 1708036 - RNA, 16 nt, Salmonella enterica enterica serovar Typhi
uauugccuaaauaacu

SEQ ID NO: 1708037 - RNA, 23 nt, Salmonella enterica enterica serovar Typhi
uauugcucuuccggcauaaaaag

SEQ ID NO: 1708038 - RNA, 17 nt, Salmonella enterica enterica serovar Typhi
uauugcggaucagcaaa

SEQ ID NO: 1708039 - RNA, 23 nt, Salmonella enterica enterica serovar Typhi
uauugucgaauuccgccugcugu

SEQ ID NO: 1708040 - RNA, 22 nt, Salmonella enterica enterica serovar Typhi
uauugucgccaccgcuauucuu

SEQ ID NO: 1708041 - RNA, 17 nt, Salmonella enterica enterica serovar Typhi
uauugucgcccugcaau

SEQ ID NO: 1708042 - RNA, 14 nt, Salmonella enterica enterica serovar Typhi
uauuuaaaauucca

SEQ ID NO: 1708043 - RNA, 20 nt, Salmonella enterica enterica serovar Typhi
uauuuaaaauuccaauauuu

SEQ ID NO: 1708044 - RNA, 19 nt, Salmonella enterica enterica serovar Typhi
uauugucgcccugcaauuc

SEQ ID NO: 1708045 - RNA, 15 nt, Salmonella enterica enterica serovar Typhi
uauugcccuuuuguu

SEQ ID NO: 1708046 - RNA, 22 nt, Salmonella enterica enterica serovar Typhi
uauugccacagcgguauaucug

SEQ ID NO: 1708047 - RNA, 23 nt, Salmonella enterica enterica serovar Typhi
uauucugcacgcacgacagugcu

SEQ ID NO: 1708048 - RNA, 15 nt, Salmonella enterica enterica serovar Typhi
uauugaccaucucuu

SEQ ID NO: 1708049 - RNA, 22 nt, Salmonella enterica enterica serovar Typhi
uauugacacuaacgcucuucuc

SEQ ID NO: 1708050 - RNA, 17 nt, Salmonella enterica enterica serovar Typhi
uauugaccgcuuuuucc

SEQ ID NO: 1708051 - RNA, 17 nt, Salmonella enterica enterica serovar Typhi
uauugacgaaaagauaa

SEQ ID NO: 1708052 - RNA, 17 nt, Salmonella enterica enterica serovar Typhi
uauugacgcuuucuucc

SEQ ID NO: 1708053 - RNA, 22 nt, Salmonella enterica enterica serovar Typhi
uauuaccugguauuauugucuu

SEQ ID NO: 1708054 - RNA, 18 nt, Salmonella enterica enterica serovar Typhi
uauccgccugcugacaaa

SEQ ID NO: 1708055 - RNA, 20 nt, Salmonella enterica enterica serovar Typhi
uauccgcgaguguaaagauu

SEQ ID NO: 1708056 - RNA, 15 nt, Salmonella enterica enterica serovar Typhi
uauuaccuccugcau

SEQ ID NO: 1708057 - RNA, 16 nt, Salmonella enterica enterica serovar Typhi
uauccgccgcaaauuc

SEQ ID NO: 1708058 - RNA, 21 nt, Salmonella enterica enterica serovar Typhi
uauccgccaucgacagcgcca

SEQ ID NO: 1708059 - RNA, 14 nt, Salmonella enterica enterica serovar Typhi
uauccgcauucuaa

SEQ ID NO: 1708060 - RNA, 15 nt, Salmonella enterica enterica serovar Typhi
uauccgcaacugaaa

SEQ ID NO: 1708061 - RNA, 23 nt, Salmonella enterica enterica serovar Typhi
uauccaucagccaggguuuaauc

SEQ ID NO: 1708062 - RNA, 18 nt, Salmonella enterica enterica serovar Typhi
uauuaggcacuaccaccu

SEQ ID NO: 1708063 - RNA, 14 nt, Salmonella enterica enterica serovar Typhi
uauuacuuuccagc

SEQ ID NO: 1708064 - RNA, 21 nt, Salmonella enterica enterica serovar Typhi
uauuagcgguacucuuuuucc

SEQ ID NO: 1708065 - RNA, 16 nt, Salmonella enterica enterica serovar Typhi
uauuagcguuuuuacc

SEQ ID NO: 1708066 - RNA, 14 nt, Salmonella enterica enterica serovar Typhi
uauuaucaaaucuu

SEQ ID NO: 1708067 - RNA, 15 nt, Salmonella enterica enterica serovar Typhi
uauuaucggcgucau

SEQ ID NO: 1708068 - RNA, 19 nt, Salmonella enterica enterica serovar Typhi
uauuauuagaggucagaau

SEQ ID NO: 1708069 - RNA, 13 nt, Salmonella enterica enterica serovar Typhi
uauuauuauauag

SEQ ID NO: 1708070 - RNA, 15 nt, Salmonella enterica enterica serovar Typhi
uauucgcuaucagaa

SEQ ID NO: 1708071 - RNA, 19 nt, Salmonella enterica enterica serovar Typhi
uauucgcgaugcucaacca

SEQ ID NO: 1708072 - RNA, 17 nt, Salmonella enterica enterica serovar Typhi
uauucgcgcccucauuc

SEQ ID NO: 1708073 - RNA, 14 nt, Salmonella enterica enterica serovar Typhi
uauucggauuggcc

SEQ ID NO: 1708074 - RNA, 20 nt, Salmonella enterica enterica serovar Typhi
uauucucaaccagccgauca

SEQ ID NO: 1708075 - RNA, 22 nt, Salmonella enterica enterica serovar Typhi
uauuccuguauaauuauuuguu

SEQ ID NO: 1708076 - RNA, 16 nt, Salmonella enterica enterica serovar Typhi
uauuccucuuccucga

SEQ ID NO: 1708077 - RNA, 21 nt, Salmonella enterica enterica serovar Typhi
uauucgcaucgguaauuucaa

SEQ ID NO: 1708078 - RNA, 15 nt, Salmonella enterica enterica serovar Typhi
uauuccaaaauaaua

SEQ ID NO: 1708079 - RNA, 16 nt, Salmonella enterica enterica serovar Typhi
uauucauuuccagcac

SEQ ID NO: 1708080 - RNA, 17 nt, Salmonella enterica enterica serovar Typhi
uauuccagaaaggaugc

SEQ ID NO: 1708081 - RNA, 19 nt, Salmonella enterica enterica serovar Typhi
uauuccagggcauuuuuuc

SEQ ID NO: 1708082 - RNA, 20 nt, Salmonella enterica enterica serovar Typhi
uauuccagucgcuccaccac

SEQ ID NO: 1708083 - RNA, 19 nt, Salmonella enterica enterica serovar Typhi
uauucaugccagaagcaaa

SEQ ID NO: 1708084 - RNA, 17 nt, Salmonella enterica enterica serovar Typhi
uauucaucaucuugucc

SEQ ID NO: 1708085 - RNA, 22 nt, Salmonella enterica enterica serovar Typhi
uauucauuauuuuuaaauaacu

SEQ ID NO: 1708086 - RNA, 19 nt, Salmonella enterica enterica serovar Typhi
uauucauucacccaauaaa

SEQ ID NO: 1708087 - RNA, 23 nt, Salmonella enterica enterica serovar Typhi
uauucauuacagguguuaaucau

SEQ ID NO: 1708088 - RNA, 23 nt, Salmonella enterica enterica serovar Typhi
uauucaccucccugcaacagcac

SEQ ID NO: 1708089 - RNA, 13 nt, Salmonella enterica enterica serovar Typhi
uauuauugucuua

SEQ ID NO: 1708090 - RNA, 17 nt, Salmonella enterica enterica serovar Typhi
uauucagcacaucagcc

SEQ ID NO: 1708091 - RNA, 18 nt, Salmonella enterica enterica serovar Typhi
uauucagcaguucauucg

SEQ ID NO: 1708092 - RNA, 18 nt, Salmonella enterica enterica serovar Typhi
uauucacgcgaauuccuu

SEQ ID NO: 1708093 - RNA, 18 nt, Salmonella enterica enterica serovar Typhi
uauucagaauaugccagg

SEQ ID NO: 1708094 - RNA, 21 nt, Salmonella enterica enterica serovar Typhi
ucaagaaucaauauaucaggc

SEQ ID NO: 1708095 - RNA, 14 nt, Salmonella enterica enterica serovar Typhi
ucaagauaaaaaga

SEQ ID NO: 1708096 - RNA, 16 nt, Salmonella enterica enterica serovar Typhi
ucaagaaugaccagcc

SEQ ID NO: 1708097 - RNA, 15 nt, Salmonella enterica enterica serovar Typhi
ucaagagaugcagac

SEQ ID NO: 1708098 - RNA, 23 nt, Salmonella enterica enterica serovar Typhi
ucaacugggcgagggaggcaauc

SEQ ID NO: 1708099 - RNA, 17 nt, Salmonella enterica enterica serovar Typhi
ucaacucuuucaggcga

SEQ ID NO: 1708100 - RNA, 20 nt, Salmonella enterica enterica serovar Typhi
ucaacugcucuaccaacuga

SEQ ID NO: 1708101 - RNA, 21 nt, Salmonella enterica enterica serovar Typhi
ucaacugcucuaccaacugag

SEQ ID NO: 1708102 - RNA, 19 nt, Salmonella enterica enterica serovar Typhi
ucaacguuccuucaggaga

SEQ ID NO: 1708103 - RNA, 15 nt, Salmonella enterica enterica serovar Typhi
ucaacgugcaucucc

SEQ ID NO: 1708104 - RNA, 15 nt, Salmonella enterica enterica serovar Typhi
ucaacggucaaaaua

SEQ ID NO: 1708105 - RNA, 13 nt, Salmonella enterica enterica serovar Typhi
ucaacguaaauag

SEQ ID NO: 1708106 - RNA, 19 nt, Salmonella enterica enterica serovar Typhi
ucaacgguucgacggagau

SEQ ID NO: 1708107 - RNA, 17 nt, Salmonella enterica enterica serovar Typhi
ucaagaugauagccauu

SEQ ID NO: 1708108 - RNA, 16 nt, Salmonella enterica enterica serovar Typhi
ucaagcaguuccagca

SEQ ID NO: 1708109 - RNA, 22 nt, Salmonella enterica enterica serovar Typhi
ucaagcccauguucaugaacca

SEQ ID NO: 1708110 - RNA, 14 nt, Salmonella enterica enterica serovar Typhi
ucaagcccagcuca

SEQ ID NO: 1708111 - RNA, 18 nt, Salmonella enterica enterica serovar Typhi
ucaagccguuuuggcagc

SEQ ID NO: 1708112 - RNA, 12 nt, Salmonella enterica enterica serovar Typhi
ucaagcgauacg

SEQ ID NO: 1708113 - RNA, 16 nt, Salmonella enterica enterica serovar Typhi
ucaagcggcaccacau

SEQ ID NO: 1708114 - RNA, 15 nt, Salmonella enterica enterica serovar Typhi
ucaaggcgcaaaacc

SEQ ID NO: 1708115 - RNA, 16 nt, Salmonella enterica enterica serovar Typhi
ucaaggcauccagcag

SEQ ID NO: 1708116 - RNA, 14 nt, Salmonella enterica enterica serovar Typhi
ucaagcuugccgcu

SEQ ID NO: 1708117 - RNA, 16 nt, Salmonella enterica enterica serovar Typhi
ucaagcuggugcuuua

SEQ ID NO: 1708118 - RNA, 22 nt, Salmonella enterica enterica serovar Typhi
ucaagcugauugauuuuguaau

SEQ ID NO: 1708119 - RNA, 21 nt, Salmonella enterica enterica serovar Typhi
ucaagcuggacgguaaccauu

SEQ ID NO: 1708120 - RNA, 19 nt, Salmonella enterica enterica serovar Typhi
ucaagguagcgugucuacc

SEQ ID NO: 1708121 - RNA, 13 nt, Salmonella enterica enterica serovar Typhi
ucaaucaacucuu

SEQ ID NO: 1708122 - RNA, 19 nt, Salmonella enterica enterica serovar Typhi
ucaaucaacuccauaauuu

SEQ ID NO: 1708123 - RNA, 22 nt, Salmonella enterica enterica serovar Typhi
ucaauauuggcuucuuuaacua

SEQ ID NO: 1708124 - RNA, 23 nt, Salmonella enterica enterica serovar Typhi
ucaauauuggcuucuuuaacuaa

SEQ ID NO: 1708125 - RNA, 22 nt, Salmonella enterica enterica serovar Typhi
ucaauauuccuggcgccaccca

SEQ ID NO: 1708126 - RNA, 22 nt, Salmonella enterica enterica serovar Typhi
ucaaguuauguuauccccacuu

SEQ ID NO: 1708127 - RNA, 23 nt, Salmonella enterica enterica serovar Typhi
ucaaugccgucggcaauuaacau

SEQ ID NO: 1708128 - RNA, 15 nt, Salmonella enterica enterica serovar Typhi
ucaaugccuggcaga

SEQ ID NO: 1708129 - RNA, 17 nt, Salmonella enterica enterica serovar Typhi
ucaauggccuugccagc

SEQ ID NO: 1708130 - RNA, 16 nt, Salmonella enterica enterica serovar Typhi
ucaaucgccugcugua

SEQ ID NO: 1708131 - RNA, 18 nt, Salmonella enterica enterica serovar Typhi
ucaaucgucguuccgcca

SEQ ID NO: 1708132 - RNA, 16 nt, Salmonella enterica enterica serovar Typhi
ucacaacgucaucccg

SEQ ID NO: 1708133 - RNA, 18 nt, Salmonella enterica enterica serovar Typhi
ucacaaccuccacgccca

SEQ ID NO: 1708134 - RNA, 16 nt, Salmonella enterica enterica serovar Typhi
ucaauuuuacagccuc

SEQ ID NO: 1708135 - RNA, 13 nt, Salmonella enterica enterica serovar Typhi
ucaauuauguauu

SEQ ID NO: 1708136 - RNA, 11 nt, Salmonella enterica enterica serovar Typhi
ucaauuuccag

SEQ ID NO: 1708137 - RNA, 17 nt, Salmonella enterica enterica serovar Typhi
ucacaauaucgagauga

SEQ ID NO: 1708138 - RNA, 16 nt, Salmonella enterica enterica serovar Typhi
ucacaaugaccucuuu

SEQ ID NO: 1708139 - RNA, 17 nt, Salmonella enterica enterica serovar Typhi
ucacaaucguucucagg

SEQ ID NO: 1708140 - RNA, 17 nt, Salmonella enterica enterica serovar Typhi
ucacaaucgcgccugcc

SEQ ID NO: 1708141 - RNA, 20 nt, Salmonella enterica enterica serovar Typhi
ucacaagcuguuucuccguu

SEQ ID NO: 1708142 - RNA, 13 nt, Salmonella enterica enterica serovar Typhi
ucacaaggaauga

SEQ ID NO: 1708143 - RNA, 19 nt, Salmonella enterica enterica serovar Typhi
ucacaccaacgcuggcccg

SEQ ID NO: 1708144 - RNA, 20 nt, Salmonella enterica enterica serovar Typhi
ucacacugcgccgccagcga

SEQ ID NO: 1708145 - RNA, 16 nt, Salmonella enterica enterica serovar Typhi
ucacauuggcaaaccc

SEQ ID NO: 1708146 - RNA, 14 nt, Salmonella enterica enterica serovar Typhi
ucaccauucccagc

SEQ ID NO: 1708147 - RNA, 15 nt, Salmonella enterica enterica serovar Typhi
ucaccauucccagcg

SEQ ID NO: 1708148 - RNA, 13 nt, Salmonella enterica enterica serovar Typhi
ucaccauuaauac

SEQ ID NO: 1708149 - RNA, 19 nt, Salmonella enterica enterica serovar Typhi
ucaccagcgcauugacgau

SEQ ID NO: 1708150 - RNA, 15 nt, Salmonella enterica enterica serovar Typhi
ucaccauuaacauca

SEQ ID NO: 1708151 - RNA, 14 nt, Salmonella enterica enterica serovar Typhi
ucacccacaucagc

SEQ ID NO: 1708152 - RNA, 22 nt, Salmonella enterica enterica serovar Typhi
ucacccagaauacggccuucuu

SEQ ID NO: 1708153 - RNA, 16 nt, Salmonella enterica enterica serovar Typhi
ucacccagacugugau

SEQ ID NO: 1708154 - RNA, 18 nt, Salmonella enterica enterica serovar Typhi
ucacccaacauuuuuagc

SEQ ID NO: 1708155 - RNA, 16 nt, Salmonella enterica enterica serovar Typhi
ucacccaauaaauaau

SEQ ID NO: 1708156 - RNA, 17 nt, Salmonella enterica enterica serovar Typhi
ucaccacuucaaacggu

SEQ ID NO: 1708157 - RNA, 22 nt, Salmonella enterica enterica serovar Typhi
ucaccacgggguuggcccuccc

SEQ ID NO: 1708158 - RNA, 22 nt, Salmonella enterica enterica serovar Typhi
ucacccagaugcgaaucuucau

SEQ ID NO: 1708159 - RNA, 23 nt, Salmonella enterica enterica serovar Typhi
ucacccagagauuaauuacgcac

SEQ ID NO: 1708160 - RNA, 15 nt, Salmonella enterica enterica serovar Typhi
ucacccauuuuaucc

SEQ ID NO: 1708161 - RNA, 14 nt, Salmonella enterica enterica serovar Typhi
ucaccgccaguccc

SEQ ID NO: 1708162 - RNA, 14 nt, Salmonella enterica enterica serovar Typhi
ucaccgcaugacaa

SEQ ID NO: 1708163 - RNA, 17 nt, Salmonella enterica enterica serovar Typhi
ucaccguggcaucauca

SEQ ID NO: 1708164 - RNA, 21 nt, Salmonella enterica enterica serovar Typhi
ucaccguugugcuccagcgug

SEQ ID NO: 1708165 - RNA, 22 nt, Salmonella enterica enterica serovar Typhi
ucaccggcuguauacacuuucc

SEQ ID NO: 1708166 - RNA, 15 nt, Salmonella enterica enterica serovar Typhi
ucaccggcgugcgcu

SEQ ID NO: 1708167 - RNA, 18 nt, Salmonella enterica enterica serovar Typhi
ucaccguaauauaaucua

SEQ ID NO: 1708168 - RNA, 20 nt, Salmonella enterica enterica serovar Typhi
ucaccgccgcccguccgcua

SEQ ID NO: 1708169 - RNA, 21 nt, Salmonella enterica enterica serovar Typhi
ucaccgcccaaugcccccauc

SEQ ID NO: 1708170 - RNA, 17 nt, Salmonella enterica enterica serovar Typhi
ucaccgcugacugaacu

SEQ ID NO: 1708171 - RNA, 21 nt, Salmonella enterica enterica serovar Typhi
ucaccgcggcaaccagcccau

SEQ ID NO: 1708172 - RNA, 19 nt, Salmonella enterica enterica serovar Typhi
ucacgauccgcaaauuacu

SEQ ID NO: 1708173 - RNA, 18 nt, Salmonella enterica enterica serovar Typhi
ucacgauacuguugcagu

SEQ ID NO: 1708174 - RNA, 13 nt, Salmonella enterica enterica serovar Typhi
ucacgauagcgcc

SEQ ID NO: 1708175 - RNA, 22 nt, Salmonella enterica enterica serovar Typhi
ucaccuugcccuggaauuuuuc

SEQ ID NO: 1708176 - RNA, 15 nt, Salmonella enterica enterica serovar Typhi
ucaccuuucauuuua

SEQ ID NO: 1708177 - RNA, 12 nt, Salmonella enterica enterica serovar Typhi
ucaccuuucugc

SEQ ID NO: 1708178 - RNA, 16 nt, Salmonella enterica enterica serovar Typhi
ucaccuccgcuuuuau

SEQ ID NO: 1708179 - RNA, 19 nt, Salmonella enterica enterica serovar Typhi
ucaccucuaccggggcgcu

SEQ ID NO: 1708180 - RNA, 16 nt, Salmonella enterica enterica serovar Typhi
ucaccucuuccccggu

SEQ ID NO: 1708181 - RNA, 21 nt, Salmonella enterica enterica serovar Typhi
ucaccucuucgcuguuaaccu

SEQ ID NO: 1708182 - RNA, 21 nt, Salmonella enterica enterica serovar Typhi
ucaccguuuaaaaacaucauu

SEQ ID NO: 1708183 - RNA, 17 nt, Salmonella enterica enterica serovar Typhi
ucaccuucugcgcagga

SEQ ID NO: 1708184 - RNA, 18 nt, Salmonella enterica enterica serovar Typhi
ucaccuucugcgcaggag

SEQ ID NO: 1708185 - RNA, 21 nt, Salmonella enterica enterica serovar Typhi
ucaccuucggugaaaucacga

SEQ ID NO: 1708186 - RNA, 21 nt, Salmonella enterica enterica serovar Typhi
ucacgcuauguuugcugagaa

SEQ ID NO: 1708187 - RNA, 19 nt, Salmonella enterica enterica serovar Typhi
ucacuacccggaggcaaua

SEQ ID NO: 1708188 - RNA, 14 nt, Salmonella enterica enterica serovar Typhi
ucacuaccgccauc

SEQ ID NO: 1708189 - RNA, 12 nt, Salmonella enterica enterica serovar Typhi
ucacuaauuuga

SEQ ID NO: 1708190 - RNA, 18 nt, Salmonella enterica enterica serovar Typhi
ucacuaauccccauuuuu

SEQ ID NO: 1708191 - RNA, 14 nt, Salmonella enterica enterica serovar Typhi
ucacuaaaccagcu

SEQ ID NO: 1708192 - RNA, 13 nt, Salmonella enterica enterica serovar Typhi
ucacuauuugugc

SEQ ID NO: 1708193 - RNA, 21 nt, Salmonella enterica enterica serovar Typhi
ucauaaugacgauaaauaaga

SEQ ID NO: 1708194 - RNA, 16 nt, Salmonella enterica enterica serovar Typhi
ucauaaucgcgauacu

SEQ ID NO: 1708195 - RNA, 22 nt, Salmonella enterica enterica serovar Typhi
ucauaauauuauccuuuaauua

SEQ ID NO: 1708196 - RNA, 15 nt, Salmonella enterica enterica serovar Typhi
ucauaauucagcuca

SEQ ID NO: 1708197 - RNA, 12 nt, Salmonella enterica enterica serovar Typhi
ucauaauguucg

SEQ ID NO: 1708198 - RNA, 15 nt, Salmonella enterica enterica serovar Typhi
ucauaauuaaaaagg

SEQ ID NO: 1708199 - RNA, 14 nt, Salmonella enterica enterica serovar Typhi
ucauacgcuuucug

SEQ ID NO: 1708200 - RNA, 22 nt, Salmonella enterica enterica serovar Typhi
ucauacgcuuucugaauuuccu

SEQ ID NO: 1708201 - RNA, 14 nt, Salmonella enterica enterica serovar Typhi
ucauacuauuuccu

SEQ ID NO: 1708202 - RNA, 20 nt, Salmonella enterica enterica serovar Typhi
ucauaggacugaucccacuu

SEQ ID NO: 1708203 - RNA, 22 nt, Salmonella enterica enterica serovar Typhi
ucauagugccggugacaugaaa

SEQ ID NO: 1708204 - RNA, 15 nt, Salmonella enterica enterica serovar Typhi
ucauauaagaaauag

SEQ ID NO: 1708205 - RNA, 13 nt, Salmonella enterica enterica serovar Typhi
ucauauaagaaau

SEQ ID NO: 1708206 - RNA, 16 nt, Salmonella enterica enterica serovar Typhi
ucaucaccagcagcag

SEQ ID NO: 1708207 - RNA, 20 nt, Salmonella enterica enterica serovar Typhi
ucaucacaucgcgcagcagg

SEQ ID NO: 1708208 - RNA, 21 nt, Salmonella enterica enterica serovar Typhi
ucaucaauggauuuauggcac

SEQ ID NO: 1708209 - RNA, 14 nt, Salmonella enterica enterica serovar Typhi
ucaucaaauuucaa

SEQ ID NO: 1708210 - RNA, 15 nt, Salmonella enterica enterica serovar Typhi
ucaucaaacgauacc

SEQ ID NO: 1708211 - RNA, 15 nt, Salmonella enterica enterica serovar Typhi
ucauaugugccgaug

SEQ ID NO: 1708212 - RNA, 21 nt, Salmonella enterica enterica serovar Typhi
ucauauggaagcuguuaauuu

SEQ ID NO: 1708213 - RNA, 15 nt, Salmonella enterica enterica serovar Typhi
ucauauugcgccgca

SEQ ID NO: 1708214 - RNA, 13 nt, Salmonella enterica enterica serovar Typhi
ucauauuccagcc

SEQ ID NO: 1708215 - RNA, 19 nt, Salmonella enterica enterica serovar Typhi
ucauauuacauagaaaaua

SEQ ID NO: 1708216 - RNA, 20 nt, Salmonella enterica enterica serovar Typhi
ucauauuacauagaaaauau

SEQ ID NO: 1708217 - RNA, 13 nt, Salmonella enterica enterica serovar Typhi
ucaucaaaaaggc

SEQ ID NO: 1708218 - RNA, 22 nt, Salmonella enterica enterica serovar Typhi
ucauauuugcuggcuugcucag

SEQ ID NO: 1708219 - RNA, 14 nt, Salmonella enterica enterica serovar Typhi
ucaucgcgccuccc

SEQ ID NO: 1708220 - RNA, 16 nt, Salmonella enterica enterica serovar Typhi
ucaucgcaaauucugu

SEQ ID NO: 1708221 - RNA, 17 nt, Salmonella enterica enterica serovar Typhi
ucaucgcaaauucugua

SEQ ID NO: 1708222 - RNA, 13 nt, Salmonella enterica enterica serovar Typhi
ucaucgccagccc

SEQ ID NO: 1708223 - RNA, 16 nt, Salmonella enterica enterica serovar Typhi
ucaucgccacaugcgg

SEQ ID NO: 1708224 - RNA, 22 nt, Salmonella enterica enterica serovar Typhi
ucaucgacauuaacaaugccuu

SEQ ID NO: 1708225 - RNA, 20 nt, Salmonella enterica enterica serovar Typhi
ucauccagucagcaauuaac

SEQ ID NO: 1708226 - RNA, 17 nt, Salmonella enterica enterica serovar Typhi
ucaucccacgucgccuu

SEQ ID NO: 1708227 - RNA, 23 nt, Salmonella enterica enterica serovar Typhi
ucaucccgguuucccgcgugaac

SEQ ID NO: 1708228 - RNA, 21 nt, Salmonella enterica enterica serovar Typhi
ucaucccgcccagcaacacag

SEQ ID NO: 1708229 - RNA, 17 nt, Salmonella enterica enterica serovar Typhi
ucaucccgcugugaucc

SEQ ID NO: 1708230 - RNA, 16 nt, Salmonella enterica enterica serovar Typhi
ucaucgaacgccgccu

SEQ ID NO: 1708231 - RNA, 12 nt, Salmonella enterica enterica serovar Typhi
ucauccuucccc

SEQ ID NO: 1708232 - RNA, 17 nt, Salmonella enterica enterica serovar Typhi
ucauccugauuuuacug

SEQ ID NO: 1708233 - RNA, 19 nt, Salmonella enterica enterica serovar Typhi
ucauccggguuaaaccagc

SEQ ID NO: 1708234 - RNA, 12 nt, Salmonella enterica enterica serovar Typhi
ucauccgcuucg

SEQ ID NO: 1708235 - RNA, 19 nt, Salmonella enterica enterica serovar Typhi
ucauccagcguuucaugaa

SEQ ID NO: 1708236 - RNA, 13 nt, Salmonella enterica enterica serovar Typhi
ucauccagcagca

SEQ ID NO: 1708237 - RNA, 16 nt, Salmonella enterica enterica serovar Typhi
ucauccagcagcagca

SEQ ID NO: 1708238 - RNA, 24 nt, Salmonella enterica enterica serovar Typhi
ucauccagcgaaccuuccaucgca

SEQ ID NO: 1708239 - RNA, 15 nt, Salmonella enterica enterica serovar Typhi
ucauccaccuuaucc

SEQ ID NO: 1708240 - RNA, 16 nt, Salmonella enterica enterica serovar Typhi
ucauccagcaaaauaa

SEQ ID NO: 1708241 - RNA, 21 nt, Salmonella enterica enterica serovar Typhi
ucauccagcaauaacaccggc

SEQ ID NO: 1708242 - RNA, 14 nt, Salmonella enterica enterica serovar Typhi
ucauccagaaaaug

SEQ ID NO: 1708243 - RNA, 16 nt, Salmonella enterica enterica serovar Typhi
ucaucaucggcacagc

SEQ ID NO: 1708244 - RNA, 21 nt, Salmonella enterica enterica serovar Typhi
ucaucaucucugucgaccauc

SEQ ID NO: 1708245 - RNA, 22 nt, Salmonella enterica enterica serovar Typhi
ucaucaugcugcugauccuguu

SEQ ID NO: 1708246 - RNA, 22 nt, Salmonella enterica enterica serovar Typhi
ucaucauugaggcgcgaaaaau

SEQ ID NO: 1708247 - RNA, 17 nt, Salmonella enterica enterica serovar Typhi
ucaucauuaccuuuucc

SEQ ID NO: 1708248 - RNA, 19 nt, Salmonella enterica enterica serovar Typhi
ucaucauggacagauuucc

SEQ ID NO: 1708249 - RNA, 15 nt, Salmonella enterica enterica serovar Typhi
ucaucagcacaaaau

SEQ ID NO: 1708250 - RNA, 19 nt, Salmonella enterica enterica serovar Typhi
ucaucagcacaaaauccca

SEQ ID NO: 1708251 - RNA, 22 nt, Salmonella enterica enterica serovar Typhi
ucaucagccguuacuuccccca

SEQ ID NO: 1708252 - RNA, 15 nt, Salmonella enterica enterica serovar Typhi
ucaucagaagaagac

SEQ ID NO: 1708253 - RNA, 17 nt, Salmonella enterica enterica serovar Typhi
ucaucagaccgagaccc

SEQ ID NO: 1708254 - RNA, 20 nt, Salmonella enterica enterica serovar Typhi
ucaucagaccgagacccagc

SEQ ID NO: 1708255 - RNA, 21 nt, Salmonella enterica enterica serovar Typhi
ucaucagaccgugaauaagau

SEQ ID NO: 1708256 - RNA, 14 nt, Salmonella enterica enterica serovar Typhi
ucaucauaauucag

SEQ ID NO: 1708257 - RNA, 15 nt, Salmonella enterica enterica serovar Typhi
ucaucaggccugggc

SEQ ID NO: 1708258 - RNA, 16 nt, Salmonella enterica enterica serovar Typhi
ucaucaguaacacccg

SEQ ID NO: 1708259 - RNA, 15 nt, Salmonella enterica enterica serovar Typhi
ucaucaggccugcaa

SEQ ID NO: 1708260 - RNA, 19 nt, Salmonella enterica enterica serovar Typhi
ucaucaggcaauaaacauc

SEQ ID NO: 1708261 - RNA, 14 nt, Salmonella enterica enterica serovar Typhi
ucaucaggcgugcc

SEQ ID NO: 1708262 - RNA, 16 nt, Salmonella enterica enterica serovar Typhi
ucauaauaaacugcau

SEQ ID NO: 1708263 - RNA, 19 nt, Salmonella enterica enterica serovar Typhi
ucauaacaccaauacguga

SEQ ID NO: 1708264 - RNA, 21 nt, Salmonella enterica enterica serovar Typhi
ucauaaccgcagucuccggua

SEQ ID NO: 1708265 - RNA, 22 nt, Salmonella enterica enterica serovar Typhi
ucauaaaacccguuaaauacca

SEQ ID NO: 1708266 - RNA, 22 nt, Salmonella enterica enterica serovar Typhi
ucaguuaacgcguaaucuucca

SEQ ID NO: 1708267 - RNA, 21 nt, Salmonella enterica enterica serovar Typhi
ucaguccuuccgcuuuaagcg

SEQ ID NO: 1708268 - RNA, 23 nt, Salmonella enterica enterica serovar Typhi
ucaguccccagcguaccacgccg

SEQ ID NO: 1708269 - RNA, 22 nt, Salmonella enterica enterica serovar Typhi
ucagucccgggcuaaucgcaaa

SEQ ID NO: 1708270 - RNA, 16 nt, Salmonella enterica enterica serovar Typhi
ucaguucggagaucag

SEQ ID NO: 1708271 - RNA, 18 nt, Salmonella enterica enterica serovar Typhi
ucaguuuuggcaaucaca

SEQ ID NO: 1708272 - RNA, 14 nt, Salmonella enterica enterica serovar Typhi
ucaguucagaaacg

SEQ ID NO: 1708273 - RNA, 12 nt, Salmonella enterica enterica serovar Typhi
ucaguucagaaa

SEQ ID NO: 1708274 - RNA, 23 nt, Salmonella enterica enterica serovar Typhi
ucaggcaaaaaucgucaucagau

SEQ ID NO: 1708275 - RNA, 17 nt, Salmonella enterica enterica serovar Typhi
ucaggcaaaaaaaaacc

SEQ ID NO: 1708276 - RNA, 14 nt, Salmonella enterica enterica serovar Typhi
ucagggcaaggcgg

SEQ ID NO: 1708277 - RNA, 12 nt, Salmonella enterica enterica serovar Typhi
ucagggaaaaau

SEQ ID NO: 1708278 - RNA, 23 nt, Salmonella enterica enterica serovar Typhi
ucaggcaaucuuuaacgcuggca

SEQ ID NO: 1708279 - RNA, 17 nt, Salmonella enterica enterica serovar Typhi
ucaggcaauaaacauca

SEQ ID NO: 1708280 - RNA, 20 nt, Salmonella enterica enterica serovar Typhi
ucaggcaauaaacaucagcc

SEQ ID NO: 1708281 - RNA, 23 nt, Salmonella enterica enterica serovar Typhi
ucaggcaauaaacaucagccauu

SEQ ID NO: 1708282 - RNA, 22 nt, Salmonella enterica enterica serovar Typhi
ucagggcgcggcgcaacuuuuu

SEQ ID NO: 1708283 - RNA, 20 nt, Salmonella enterica enterica serovar Typhi
ucagggucuuauuucuccug

SEQ ID NO: 1708284 - RNA, 17 nt, Salmonella enterica enterica serovar Typhi
ucaggggcgaacccauc

SEQ ID NO: 1708285 - RNA, 18 nt, Salmonella enterica enterica serovar Typhi
ucagggguccccacggga

SEQ ID NO: 1708286 - RNA, 18 nt, Salmonella enterica enterica serovar Typhi
ucaguaaaggaugccacu

SEQ ID NO: 1708287 - RNA, 16 nt, Salmonella enterica enterica serovar Typhi
ucaguaauaauauaaa

SEQ ID NO: 1708288 - RNA, 11 nt, Salmonella enterica enterica serovar Typhi
ucagguuuuuu

SEQ ID NO: 1708289 - RNA, 21 nt, Salmonella enterica enterica serovar Typhi
ucagguuuuuugugaguucau

SEQ ID NO: 1708290 - RNA, 16 nt, Salmonella enterica enterica serovar Typhi
ucaguaaaagcccgcc

SEQ ID NO: 1708291 - RNA, 21 nt, Salmonella enterica enterica serovar Typhi
ucaggguuuucuaccgcagcc

SEQ ID NO: 1708292 - RNA, 23 nt, Salmonella enterica enterica serovar Typhi
ucaggugauugcccuccagccau

SEQ ID NO: 1708293 - RNA, 18 nt, Salmonella enterica enterica serovar Typhi
ucagcuauuagcguuuuu

SEQ ID NO: 1708294 - RNA, 12 nt, Salmonella enterica enterica serovar Typhi
ucagcuggcuuu

SEQ ID NO: 1708295 - RNA, 12 nt, Salmonella enterica enterica serovar Typhi
ucagcgcgcgcu

SEQ ID NO: 1708296 - RNA, 19 nt, Salmonella enterica enterica serovar Typhi
ucagcgcggcagccggaac

SEQ ID NO: 1708297 - RNA, 12 nt, Salmonella enterica enterica serovar Typhi
ucagcgcgcucc

SEQ ID NO: 1708298 - RNA, 17 nt, Salmonella enterica enterica serovar Typhi
ucagcgcgcuccagacc

SEQ ID NO: 1708299 - RNA, 19 nt, Salmonella enterica enterica serovar Typhi
ucagcuucugucagccuug

SEQ ID NO: 1708300 - RNA, 18 nt, Salmonella enterica enterica serovar Typhi
ucaggaagcccugaaacu

SEQ ID NO: 1708301 - RNA, 17 nt, Salmonella enterica enterica serovar Typhi
ucaggaaugccacgauc

SEQ ID NO: 1708302 - RNA, 21 nt, Salmonella enterica enterica serovar Typhi
ucaggaaauucucagaaacaa

SEQ ID NO: 1708303 - RNA, 23 nt, Salmonella enterica enterica serovar Typhi
ucaggaacgcggcgccgaagcag

SEQ ID NO: 1708304 - RNA, 17 nt, Salmonella enterica enterica serovar Typhi
ucacuguuaucgccauu

SEQ ID NO: 1708305 - RNA, 21 nt, Salmonella enterica enterica serovar Typhi
ucacugaacccaaacagauaa

SEQ ID NO: 1708306 - RNA, 16 nt, Salmonella enterica enterica serovar Typhi
ucagccagcagcucaa

SEQ ID NO: 1708307 - RNA, 15 nt, Salmonella enterica enterica serovar Typhi
ucagccagcgaucag

SEQ ID NO: 1708308 - RNA, 16 nt, Salmonella enterica enterica serovar Typhi
ucagccacuucuucca

SEQ ID NO: 1708309 - RNA, 18 nt, Salmonella enterica enterica serovar Typhi
ucagccgcgcauagcugg

SEQ ID NO: 1708310 - RNA, 15 nt, Salmonella enterica enterica serovar Typhi
ucagccgccggugac

SEQ ID NO: 1708311 - RNA, 21 nt, Salmonella enterica enterica serovar Typhi
ucagccgauaagaacuccaaa

SEQ ID NO: 1708312 - RNA, 22 nt, Salmonella enterica enterica serovar Typhi
ucagccugaaagauuauuuuau

SEQ ID NO: 1708313 - RNA, 13 nt, Salmonella enterica enterica serovar Typhi
ucagccugcuaca

SEQ ID NO: 1708314 - RNA, 21 nt, Salmonella enterica enterica serovar Typhi
ucagccugugcaaccagcucu

SEQ ID NO: 1708315 - RNA, 16 nt, Salmonella enterica enterica serovar Typhi
ucagccuuaaucaacu

SEQ ID NO: 1708316 - RNA, 16 nt, Salmonella enterica enterica serovar Typhi
ucagccuuuucauaug

SEQ ID NO: 1708317 - RNA, 22 nt, Salmonella enterica enterica serovar Typhi
ucauuuaccagugcuaaaauua

SEQ ID NO: 1708318 - RNA, 15 nt, Salmonella enterica enterica serovar Typhi
ucauuucgaucuguu

SEQ ID NO: 1708319 - RNA, 17 nt, Salmonella enterica enterica serovar Typhi
ucauuggggggaaauua

SEQ ID NO: 1708320 - RNA, 16 nt, Salmonella enterica enterica serovar Typhi
ucauugcguucaggcg

SEQ ID NO: 1708321 - RNA, 20 nt, Salmonella enterica enterica serovar Typhi
ucauuggaagagacacgcug

SEQ ID NO: 1708322 - RNA, 19 nt, Salmonella enterica enterica serovar Typhi
ucauugcgcuaaaauccac

SEQ ID NO: 1708323 - RNA, 20 nt, Salmonella enterica enterica serovar Typhi
ucauucugcuuaccagaccg

SEQ ID NO: 1708324 - RNA, 12 nt, Salmonella enterica enterica serovar Typhi
uccaaaauaaua

SEQ ID NO: 1708325 - RNA, 15 nt, Salmonella enterica enterica serovar Typhi
uccaaaaauaaacac

SEQ ID NO: 1708326 - RNA, 21 nt, Salmonella enterica enterica serovar Typhi
ucauggcuuuuacccuucaug

SEQ ID NO: 1708327 - RNA, 13 nt, Salmonella enterica enterica serovar Typhi
ucauguccccagg

SEQ ID NO: 1708328 - RNA, 13 nt, Salmonella enterica enterica serovar Typhi
ucaugguugaaaa

SEQ ID NO: 1708329 - RNA, 18 nt, Salmonella enterica enterica serovar Typhi
ucauuaacguaggccgga

SEQ ID NO: 1708330 - RNA, 21 nt, Salmonella enterica enterica serovar Typhi
ucauuaauuauacugucgcuc

SEQ ID NO: 1708331 - RNA, 13 nt, Salmonella enterica enterica serovar Typhi
ucauuaauauaau

SEQ ID NO: 1708332 - RNA, 20 nt, Salmonella enterica enterica serovar Typhi
ucauuaagcccauaaagcac

SEQ ID NO: 1708333 - RNA, 13 nt, Salmonella enterica enterica serovar Typhi
ucauuaccuuuuc

SEQ ID NO: 1708334 - RNA, 22 nt, Salmonella enterica enterica serovar Typhi
ucauuaauuuucacgcucugac

SEQ ID NO: 1708335 - RNA, 12 nt, Salmonella enterica enterica serovar Typhi
ucauuacaggcg

SEQ ID NO: 1708336 - RNA, 14 nt, Salmonella enterica enterica serovar Typhi
ucauuaccaguuga

SEQ ID NO: 1708337 - RNA, 17 nt, Salmonella enterica enterica serovar Typhi
ucauuacccaauaauga

SEQ ID NO: 1708338 - RNA, 19 nt, Salmonella enterica enterica serovar Typhi
ucauuacgaaguuuaauuc

SEQ ID NO: 1708339 - RNA, 16 nt, Salmonella enterica enterica serovar Typhi
ucauuaccaacguaaa

SEQ ID NO: 1708340 - RNA, 20 nt, Salmonella enterica enterica serovar Typhi
ucauucgggucaaugccguc

SEQ ID NO: 1708341 - RNA, 18 nt, Salmonella enterica enterica serovar Typhi
ucauucgcgaauagugca

SEQ ID NO: 1708342 - RNA, 21 nt, Salmonella enterica enterica serovar Typhi
ucauucgggaugcauaaaaaa

SEQ ID NO: 1708343 - RNA, 18 nt, Salmonella enterica enterica serovar Typhi
ucauuauuuuuaaauaac

SEQ ID NO: 1708344 - RNA, 22 nt, Salmonella enterica enterica serovar Typhi
ucaugcuggcgaugaguaaaau

SEQ ID NO: 1708345 - RNA, 16 nt, Salmonella enterica enterica serovar Typhi
ucaugcuggucagcaa

SEQ ID NO: 1708346 - RNA, 15 nt, Salmonella enterica enterica serovar Typhi
ucaugcugcaccgca

SEQ ID NO: 1708347 - RNA, 16 nt, Salmonella enterica enterica serovar Typhi
ucaugcggucuucacu

SEQ ID NO: 1708348 - RNA, 20 nt, Salmonella enterica enterica serovar Typhi
ucauggacagauuuccacga

SEQ ID NO: 1708349 - RNA, 23 nt, Salmonella enterica enterica serovar Typhi
ucaugcugcgguuauaauaauaa

SEQ ID NO: 1708350 - RNA, 18 nt, Salmonella enterica enterica serovar Typhi
ucauggcauagccaaaga

SEQ ID NO: 1708351 - RNA, 22 nt, Salmonella enterica enterica serovar Typhi
ucaugccuucuuugccuuuuuc

SEQ ID NO: 1708352 - RNA, 13 nt, Salmonella enterica enterica serovar Typhi
ucaugcgccgcga

SEQ ID NO: 1708353 - RNA, 21 nt, Salmonella enterica enterica serovar Typhi
ucaugcauuaaugggcgaaaa

SEQ ID NO: 1708354 - RNA, 16 nt, Salmonella enterica enterica serovar Typhi
ucaugcagccggcgau

SEQ ID NO: 1708355 - RNA, 18 nt, Salmonella enterica enterica serovar Typhi
ucaugcauuaaugggcga

SEQ ID NO: 1708356 - RNA, 21 nt, Salmonella enterica enterica serovar Typhi
ucaugcaacuucaccucaguc

SEQ ID NO: 1708357 - RNA, 15 nt, Salmonella enterica enterica serovar Typhi
ucaugcaagacaucu

SEQ ID NO: 1708358 - RNA, 21 nt, Salmonella enterica enterica serovar Typhi
ucaugauuucuugagcggcau

SEQ ID NO: 1708359 - RNA, 14 nt, Salmonella enterica enterica serovar Typhi
ucaugaucuuuccu

SEQ ID NO: 1708360 - RNA, 19 nt, Salmonella enterica enterica serovar Typhi
ucaugaguaaaugaacguu

SEQ ID NO: 1708361 - RNA, 22 nt, Salmonella enterica enterica serovar Typhi
ucaugagucgcgcgcgccaguc

SEQ ID NO: 1708362 - RNA, 22 nt, Salmonella enterica enterica serovar Typhi
ucaugaugaucuucagcccguu

SEQ ID NO: 1708363 - RNA, 23 nt, Salmonella enterica enterica serovar Typhi
ucaugaucuuuccuuuuucaggc

SEQ ID NO: 1708364 - RNA, 16 nt, Salmonella enterica enterica serovar Typhi
ucaugaaguuaccaga

SEQ ID NO: 1708365 - RNA, 20 nt, Salmonella enterica enterica serovar Typhi
ucaugacauagcauaauaau

SEQ ID NO: 1708366 - RNA, 14 nt, Salmonella enterica enterica serovar Typhi
ucaugacgcgauau

SEQ ID NO: 1708367 - RNA, 19 nt, Salmonella enterica enterica serovar Typhi
ucaugacaucgcccugggu

SEQ ID NO: 1708368 - RNA, 17 nt, Salmonella enterica enterica serovar Typhi
ucaugaccgaaaucuuc

SEQ ID NO: 1708369 - RNA, 13 nt, Salmonella enterica enterica serovar Typhi
ucaucuacacgca

SEQ ID NO: 1708370 - RNA, 14 nt, Salmonella enterica enterica serovar Typhi
ucaucuaucugcuu

SEQ ID NO: 1708371 - RNA, 16 nt, Salmonella enterica enterica serovar Typhi
ucaucucaagccccau

SEQ ID NO: 1708372 - RNA, 15 nt, Salmonella enterica enterica serovar Typhi
ucaucucccaggccg

SEQ ID NO: 1708373 - RNA, 17 nt, Salmonella enterica enterica serovar Typhi
ucaucgguuacuccuua

SEQ ID NO: 1708374 - RNA, 20 nt, Salmonella enterica enterica serovar Typhi
ucaucggucaguuugcccca

SEQ ID NO: 1708375 - RNA, 16 nt, Salmonella enterica enterica serovar Typhi
ucaucgguguucacaa

SEQ ID NO: 1708376 - RNA, 18 nt, Salmonella enterica enterica serovar Typhi
ucaucgguguucacaauu

SEQ ID NO: 1708377 - RNA, 20 nt, Salmonella enterica enterica serovar Typhi
ucaucgucauuaaugccuaa

SEQ ID NO: 1708378 - RNA, 18 nt, Salmonella enterica enterica serovar Typhi
ucaucgugaaauuauucc

SEQ ID NO: 1708379 - RNA, 11 nt, Salmonella enterica enterica serovar Typhi
ucaucugcuuc

SEQ ID NO: 1708380 - RNA, 22 nt, Salmonella enterica enterica serovar Typhi
ucaucuucccgcagauauccgc

SEQ ID NO: 1708381 - RNA, 18 nt, Salmonella enterica enterica serovar Typhi
ucaucuucaccuuuccag

SEQ ID NO: 1708382 - RNA, 17 nt, Salmonella enterica enterica serovar Typhi
ucaucuucacuucacaa

SEQ ID NO: 1708383 - RNA, 17 nt, Salmonella enterica enterica serovar Typhi
ucaucuucaccuuucca

SEQ ID NO: 1708384 - RNA, 17 nt, Salmonella enterica enterica serovar Typhi
ucaucuguggcaauuuu

SEQ ID NO: 1708385 - RNA, 11 nt, Salmonella enterica enterica serovar Typhi
ucaucuucuuu

SEQ ID NO: 1708386 - RNA, 20 nt, Salmonella enterica enterica serovar Typhi
ucaucuucggcgggaucucc

SEQ ID NO: 1708387 - RNA, 17 nt, Salmonella enterica enterica serovar Typhi
ucaucuuguccucauca

SEQ ID NO: 1708388 - RNA, 14 nt, Salmonella enterica enterica serovar Typhi
ucaucuuuuaaaau

SEQ ID NO: 1708389 - RNA, 15 nt, Salmonella enterica enterica serovar Typhi
uccacugguuguccg

SEQ ID NO: 1708390 - RNA, 15 nt, Salmonella enterica enterica serovar Typhi
uccagacccacagcc

SEQ ID NO: 1708391 - RNA, 18 nt, Salmonella enterica enterica serovar Typhi
uccagacccagacaaccg

SEQ ID NO: 1708392 - RNA, 16 nt, Salmonella enterica enterica serovar Typhi
uccagacaauccgcgg

SEQ ID NO: 1708393 - RNA, 16 nt, Salmonella enterica enterica serovar Typhi
uccagacagccgacgg

SEQ ID NO: 1708394 - RNA, 22 nt, Salmonella enterica enterica serovar Typhi
uccagaccaaacaugcggcuuu

SEQ ID NO: 1708395 - RNA, 14 nt, Salmonella enterica enterica serovar Typhi
uccagaccaccagc

SEQ ID NO: 1708396 - RNA, 15 nt, Salmonella enterica enterica serovar Typhi
uccagaguacauucu

SEQ ID NO: 1708397 - RNA, 15 nt, Salmonella enterica enterica serovar Typhi
uccagaggcguugcc

SEQ ID NO: 1708398 - RNA, 17 nt, Salmonella enterica enterica serovar Typhi
uccagaggcauuauugc

SEQ ID NO: 1708399 - RNA, 16 nt, Salmonella enterica enterica serovar Typhi
uccagaugaagcgcau

SEQ ID NO: 1708400 - RNA, 18 nt, Salmonella enterica enterica serovar Typhi
uccagauagggccaggcg

SEQ ID NO: 1708401 - RNA, 17 nt, Salmonella enterica enterica serovar Typhi
uccagaucgcauaaaau

SEQ ID NO: 1708402 - RNA, 21 nt, Salmonella enterica enterica serovar Typhi
uccagaugcgccagauucaug

SEQ ID NO: 1708403 - RNA, 20 nt, Salmonella enterica enterica serovar Typhi
uccagaugcggcgccaacgc

SEQ ID NO: 1708404 - RNA, 22 nt, Salmonella enterica enterica serovar Typhi
uccagauuacuaugaggauuau

SEQ ID NO: 1708405 - RNA, 21 nt, Salmonella enterica enterica serovar Typhi
uccagauugagacaaauaacu

SEQ ID NO: 1708406 - RNA, 12 nt, Salmonella enterica enterica serovar Typhi
uccaccagaacc

SEQ ID NO: 1708407 - RNA, 13 nt, Salmonella enterica enterica serovar Typhi
uccaccagcccau

SEQ ID NO: 1708408 - RNA, 22 nt, Salmonella enterica enterica serovar Typhi
uccaccagauuucgcagcagca

SEQ ID NO: 1708409 - RNA, 12 nt, Salmonella enterica enterica serovar Typhi
uccaccgccaga

SEQ ID NO: 1708410 - RNA, 21 nt, Salmonella enterica enterica serovar Typhi
uccacauccagcgccagcgcc

SEQ ID NO: 1708411 - RNA, 14 nt, Salmonella enterica enterica serovar Typhi
uccacauuccagac

SEQ ID NO: 1708412 - RNA, 16 nt, Salmonella enterica enterica serovar Typhi
uccaccaaccaggcaa

SEQ ID NO: 1708413 - RNA, 21 nt, Salmonella enterica enterica serovar Typhi
uccacauugguuuugccauuc

SEQ ID NO: 1708414 - RNA, 16 nt, Salmonella enterica enterica serovar Typhi
uccacaaccggcuggc

SEQ ID NO: 1708415 - RNA, 22 nt, Salmonella enterica enterica serovar Typhi
uccacaaaaggauacagcgccg

SEQ ID NO: 1708416 - RNA, 22 nt, Salmonella enterica enterica serovar Typhi
uccaaauggcguacuaaauagg

SEQ ID NO: 1708417 - RNA, 19 nt, Salmonella enterica enterica serovar Typhi
uccagggaaaccauguuga

SEQ ID NO: 1708418 - RNA, 24 nt, Salmonella enterica enterica serovar Typhi
uccaggcucgauaaucaucacgcu

SEQ ID NO: 1708419 - RNA, 16 nt, Salmonella enterica enterica serovar Typhi
uccagguaacauacaa

SEQ ID NO: 1708420 - RNA, 16 nt, Salmonella enterica enterica serovar Typhi
uccaggguaauuaacg

SEQ ID NO: 1708421 - RNA, 20 nt, Salmonella enterica enterica serovar Typhi
uccagcucuuugguccauaa

SEQ ID NO: 1708422 - RNA, 19 nt, Salmonella enterica enterica serovar Typhi
uccagcugcgacagcgaac

SEQ ID NO: 1708423 - RNA, 14 nt, Salmonella enterica enterica serovar Typhi
uccagcucuucuuc

SEQ ID NO: 1708424 - RNA, 23 nt, Salmonella enterica enterica serovar Typhi
uccagcugguauaggccaggcua

SEQ ID NO: 1708425 - RNA, 12 nt, Salmonella enterica enterica serovar Typhi
uccagcuggcug

SEQ ID NO: 1708426 - RNA, 14 nt, Salmonella enterica enterica serovar Typhi
uccaguaauuucag

SEQ ID NO: 1708427 - RNA, 16 nt, Salmonella enterica enterica serovar Typhi
uccaguacuuucuuuu

SEQ ID NO: 1708428 - RNA, 19 nt, Salmonella enterica enterica serovar Typhi
uccaguacuuucuuuugau

SEQ ID NO: 1708429 - RNA, 12 nt, Salmonella enterica enterica serovar Typhi
uccauaaaauga

SEQ ID NO: 1708430 - RNA, 14 nt, Salmonella enterica enterica serovar Typhi
uccauaaauaacau

SEQ ID NO: 1708431 - RNA, 16 nt, Salmonella enterica enterica serovar Typhi
uccauaaauaacauuu

SEQ ID NO: 1708432 - RNA, 18 nt, Salmonella enterica enterica serovar Typhi
uccagccguaccacccgg

SEQ ID NO: 1708433 - RNA, 22 nt, Salmonella enterica enterica serovar Typhi
uccagccgcccuucuccgguaa

SEQ ID NO: 1708434 - RNA, 15 nt, Salmonella enterica enterica serovar Typhi
uccagcccgccgccc

SEQ ID NO: 1708435 - RNA, 23 nt, Salmonella enterica enterica serovar Typhi
uccagccccagcgccagcugcgu

SEQ ID NO: 1708436 - RNA, 14 nt, Salmonella enterica enterica serovar Typhi
uccagcuccaucca

SEQ ID NO: 1708437 - RNA, 18 nt, Salmonella enterica enterica serovar Typhi
uccagcucaguuuccagc

SEQ ID NO: 1708438 - RNA, 14 nt, Salmonella enterica enterica serovar Typhi
uccagcgcaaaggg

SEQ ID NO: 1708439 - RNA, 14 nt, Salmonella enterica enterica serovar Typhi
uccagcgauaaacg

SEQ ID NO: 1708440 - RNA, 13 nt, Salmonella enterica enterica serovar Typhi
uccagcagcgcau

SEQ ID NO: 1708441 - RNA, 16 nt, Salmonella enterica enterica serovar Typhi
uccagcagccagccgu

SEQ ID NO: 1708442 - RNA, 14 nt, Salmonella enterica enterica serovar Typhi
uccagcacggccuu

SEQ ID NO: 1708443 - RNA, 14 nt, Salmonella enterica enterica serovar Typhi
uccagcagauuagc

SEQ ID NO: 1708444 - RNA, 22 nt, Salmonella enterica enterica serovar Typhi
uccagcaccgcgaccaguucac

SEQ ID NO: 1708445 - RNA, 13 nt, Salmonella enterica enterica serovar Typhi
uccagcacgccca

SEQ ID NO: 1708446 - RNA, 13 nt, Salmonella enterica enterica serovar Typhi
uccagcacgaccu

SEQ ID NO: 1708447 - RNA, 21 nt, Salmonella enterica enterica serovar Typhi
uccagcaacagugggcuauga

SEQ ID NO: 1708448 - RNA, 17 nt, Salmonella enterica enterica serovar Typhi
uccagcaauaacaccgg

SEQ ID NO: 1708449 - RNA, 16 nt, Salmonella enterica enterica serovar Typhi
uccagcacauccucaa

SEQ ID NO: 1708450 - RNA, 16 nt, Salmonella enterica enterica serovar Typhi
uccagcaaugauuuua

SEQ ID NO: 1708451 - RNA, 19 nt, Salmonella enterica enterica serovar Typhi
ugauuuguuuuuuauauuu

SEQ ID NO: 1708452 - RNA, 22 nt, Salmonella enterica enterica serovar Typhi
ugauuuguuuuuuauauuuuua

SEQ ID NO: 1708453 - RNA, 16 nt, Salmonella enterica enterica serovar Typhi
ugcacgguugaagcga

SEQ ID NO: 1708454 - RNA, 17 nt, Salmonella enterica enterica serovar Typhi
ugcacguaccugcucca

SEQ ID NO: 1708455 - RNA, 20 nt, Salmonella enterica enterica serovar Typhi
ugcacgccaggguaauacug

SEQ ID NO: 1708456 - RNA, 16 nt, Salmonella enterica enterica serovar Typhi
ugcacgcgauuugcag

SEQ ID NO: 1708457 - RNA, 20 nt, Salmonella enterica enterica serovar Typhi
ugcacgccugcuucacguau

SEQ ID NO: 1708458 - RNA, 18 nt, Salmonella enterica enterica serovar Typhi
ugcaggcaggucuccagc

SEQ ID NO: 1708459 - RNA, 18 nt, Salmonella enterica enterica serovar Typhi
ugcaggccaagcagcgcc

SEQ ID NO: 1708460 - RNA, 18 nt, Salmonella enterica enterica serovar Typhi
ugcaggcauaaaaaagag

SEQ ID NO: 1708461 - RNA, 17 nt, Salmonella enterica enterica serovar Typhi
ugcaggauucgaaccug

SEQ ID NO: 1708462 - RNA, 23 nt, Salmonella enterica enterica serovar Typhi
ugcagcggaugcucuuuacggac

SEQ ID NO: 1708463 - RNA, 15 nt, Salmonella enterica enterica serovar Typhi
ugcagcgccagagau

SEQ ID NO: 1708464 - RNA, 16 nt, Salmonella enterica enterica serovar Typhi
ugcagcgccgccugua

SEQ ID NO: 1708465 - RNA, 18 nt, Salmonella enterica enterica serovar Typhi
ugcagcgcggcggcaacu

SEQ ID NO: 1708466 - RNA, 18 nt, Salmonella enterica enterica serovar Typhi
ugcagcggaauucccaca

SEQ ID NO: 1708467 - RNA, 13 nt, Salmonella enterica enterica serovar Typhi
ugcaggaaggucu

SEQ ID NO: 1708468 - RNA, 15 nt, Salmonella enterica enterica serovar Typhi
ugcagcgaccuggga

SEQ ID NO: 1708469 - RNA, 16 nt, Salmonella enterica enterica serovar Typhi
ugcagaccucugcaaa

SEQ ID NO: 1708470 - RNA, 16 nt, Salmonella enterica enterica serovar Typhi
ugcagaccucugcuuu

SEQ ID NO: 1708471 - RNA, 21 nt, Salmonella enterica enterica serovar Typhi
ugcagacgcucguauccgagc

SEQ ID NO: 1708472 - RNA, 12 nt, Salmonella enterica enterica serovar Typhi
ugcagcagccag

SEQ ID NO: 1708473 - RNA, 17 nt, Salmonella enterica enterica serovar Typhi
ugcaucgcggucagcgg

SEQ ID NO: 1708474 - RNA, 14 nt, Salmonella enterica enterica serovar Typhi
ugcaugaauaucaa

SEQ ID NO: 1708475 - RNA, 18 nt, Salmonella enterica enterica serovar Typhi
ugcaugcgcuggacuggg

SEQ ID NO: 1708476 - RNA, 23 nt, Salmonella enterica enterica serovar Typhi
ugcaugguagucguuauaauccu

SEQ ID NO: 1708477 - RNA, 14 nt, Salmonella enterica enterica serovar Typhi
ugcaugguagucgu

SEQ ID NO: 1708478 - RNA, 15 nt, Salmonella enterica enterica serovar Typhi
ugcaugggcagcuug

SEQ ID NO: 1708479 - RNA, 17 nt, Salmonella enterica enterica serovar Typhi
ugcauguaguaagccau

SEQ ID NO: 1708480 - RNA, 16 nt, Salmonella enterica enterica serovar Typhi
ugcauauaacuuucaa

SEQ ID NO: 1708481 - RNA, 22 nt, Salmonella enterica enterica serovar Typhi
ugcauaucgccuugcugcggca

SEQ ID NO: 1708482 - RNA, 15 nt, Salmonella enterica enterica serovar Typhi
ugcauauuauucaug

SEQ ID NO: 1708483 - RNA, 13 nt, Salmonella enterica enterica serovar Typhi
ugcauauuguauu

SEQ ID NO: 1708484 - RNA, 14 nt, Salmonella enterica enterica serovar Typhi
ugcaucaaacuucg

SEQ ID NO: 1708485 - RNA, 22 nt, Salmonella enterica enterica serovar Typhi
ugcagggacuuauuaaaaauag

SEQ ID NO: 1708486 - RNA, 17 nt, Salmonella enterica enterica serovar Typhi
ugcaggcgggaagcuuc

SEQ ID NO: 1708487 - RNA, 22 nt, Salmonella enterica enterica serovar Typhi
ugcaggcugagcguagaccgcc

SEQ ID NO: 1708488 - RNA, 17 nt, Salmonella enterica enterica serovar Typhi
ugccaagcaacacggcg

SEQ ID NO: 1708489 - RNA, 14 nt, Salmonella enterica enterica serovar Typhi
ugccaaccaccgcg

SEQ ID NO: 1708490 - RNA, 16 nt, Salmonella enterica enterica serovar Typhi
ugccacaauaucaucg

SEQ ID NO: 1708491 - RNA, 16 nt, Salmonella enterica enterica serovar Typhi
ugccaaguaauaaaga

SEQ ID NO: 1708492 - RNA, 21 nt, Salmonella enterica enterica serovar Typhi
ugccaaaagguuagguuaaau

SEQ ID NO: 1708493 - RNA, 23 nt, Salmonella enterica enterica serovar Typhi
ugccaaaagguuagguuaaauag

SEQ ID NO: 1708494 - RNA, 16 nt, Salmonella enterica enterica serovar Typhi
ugccaaacugcuggaa

SEQ ID NO: 1708495 - RNA, 21 nt, Salmonella enterica enterica serovar Typhi
ugccaaacaucgcucgcgcca

SEQ ID NO: 1708496 - RNA, 13 nt, Salmonella enterica enterica serovar Typhi
ugccagcaccagc

SEQ ID NO: 1708497 - RNA, 16 nt, Salmonella enterica enterica serovar Typhi
ugccagcaccagcagu

SEQ ID NO: 1708498 - RNA, 16 nt, Salmonella enterica enterica serovar Typhi
ugccacuguucagaaa

SEQ ID NO: 1708499 - RNA, 12 nt, Salmonella enterica enterica serovar Typhi
ugccacuguucg

SEQ ID NO: 1708500 - RNA, 12 nt, Salmonella enterica enterica serovar Typhi
ugccacuggccu

SEQ ID NO: 1708501 - RNA, 13 nt, Salmonella enterica enterica serovar Typhi
ugccacuggccuc

SEQ ID NO: 1708502 - RNA, 16 nt, Salmonella enterica enterica serovar Typhi
ugccacuauagaugau

SEQ ID NO: 1708503 - RNA, 22 nt, Salmonella enterica enterica serovar Typhi
ugccacgucacgcaacaggccg

SEQ ID NO: 1708504 - RNA, 17 nt, Salmonella enterica enterica serovar Typhi
ugccacaggccaacaua

SEQ ID NO: 1708505 - RNA, 18 nt, Salmonella enterica enterica serovar Typhi
ugccacagccucagcacg

SEQ ID NO: 1708506 - RNA, 22 nt, Salmonella enterica enterica serovar Typhi
ugccacacccugagcgccgcca

SEQ ID NO: 1708507 - RNA, 14 nt, Salmonella enterica enterica serovar Typhi
ugccacacccugag

SEQ ID NO: 1708508 - RNA, 15 nt, Salmonella enterica enterica serovar Typhi
ugcccaaccugcgca

SEQ ID NO: 1708509 - RNA, 11 nt, Salmonella enterica enterica serovar Typhi
ugccaugcugg

SEQ ID NO: 1708510 - RNA, 15 nt, Salmonella enterica enterica serovar Typhi
ugccauguuaauacc

SEQ ID NO: 1708511 - RNA, 20 nt, Salmonella enterica enterica serovar Typhi
ugccaucgcuuaacccugcc

SEQ ID NO: 1708512 - RNA, 17 nt, Salmonella enterica enterica serovar Typhi
ugccaucgcuucuacag

SEQ ID NO: 1708513 - RNA, 14 nt, Salmonella enterica enterica serovar Typhi
ugccaucggccagc

SEQ ID NO: 1708514 - RNA, 18 nt, Salmonella enterica enterica serovar Typhi
ugccaucgaccgauuggg

SEQ ID NO: 1708515 - RNA, 23 nt, Salmonella enterica enterica serovar Typhi
ugccaucgaccgauugggcucag

SEQ ID NO: 1708516 - RNA, 16 nt, Salmonella enterica enterica serovar Typhi
ugccaucaucaguaac

SEQ ID NO: 1708517 - RNA, 19 nt, Salmonella enterica enterica serovar Typhi
ugccaucaucaguaacacc

SEQ ID NO: 1708518 - RNA, 13 nt, Salmonella enterica enterica serovar Typhi
ugccaucauccag

SEQ ID NO: 1708519 - RNA, 22 nt, Salmonella enterica enterica serovar Typhi
ugccaucauuaauuuacugaua

SEQ ID NO: 1708520 - RNA, 21 nt, Salmonella enterica enterica serovar Typhi
ugccauauuuuuccagcgccu

SEQ ID NO: 1708521 - RNA, 14 nt, Salmonella enterica enterica serovar Typhi
ugccaucagcaccu

SEQ ID NO: 1708522 - RNA, 17 nt, Salmonella enterica enterica serovar Typhi
ugccauacuguuuauca

SEQ ID NO: 1708523 - RNA, 18 nt, Salmonella enterica enterica serovar Typhi
ugccauauuguucaguuu

SEQ ID NO: 1708524 - RNA, 20 nt, Salmonella enterica enterica serovar Typhi
ugccauauuguucaguuuca

SEQ ID NO: 1708525 - RNA, 21 nt, Salmonella enterica enterica serovar Typhi
ugccauauuguucaguuucaa

SEQ ID NO: 1708526 - RNA, 22 nt, Salmonella enterica enterica serovar Typhi
ugccauaaucgauauaauuuua

SEQ ID NO: 1708527 - RNA, 19 nt, Salmonella enterica enterica serovar Typhi
ugccaguuucucaaagcug

SEQ ID NO: 1708528 - RNA, 17 nt, Salmonella enterica enterica serovar Typhi
ugccauaaaaacaauaa

SEQ ID NO: 1708529 - RNA, 18 nt, Salmonella enterica enterica serovar Typhi
ugccauaaaaacaauaaa

SEQ ID NO: 1708530 - RNA, 13 nt, Salmonella enterica enterica serovar Typhi
ugccagugaaaaa

SEQ ID NO: 1708531 - RNA, 15 nt, Salmonella enterica enterica serovar Typhi
ugccaguacagcagc

SEQ ID NO: 1708532 - RNA, 17 nt, Salmonella enterica enterica serovar Typhi
ugccaguaccgccgccg

SEQ ID NO: 1708533 - RNA, 15 nt, Salmonella enterica enterica serovar Typhi
ugccaguagcugcuc

SEQ ID NO: 1708534 - RNA, 14 nt, Salmonella enterica enterica serovar Typhi
ugccaggguucaac

SEQ ID NO: 1708535 - RNA, 14 nt, Salmonella enterica enterica serovar Typhi
ugccagguuauuuc

SEQ ID NO: 1708536 - RNA, 19 nt, Salmonella enterica enterica serovar Typhi
ugccagggcggaagcagau

SEQ ID NO: 1708537 - RNA, 19 nt, Salmonella enterica enterica serovar Typhi
ugccagcucguuauuuccg

SEQ ID NO: 1708538 - RNA, 17 nt, Salmonella enterica enterica serovar Typhi
ugccagcucguuauuuc

SEQ ID NO: 1708539 - RNA, 19 nt, Salmonella enterica enterica serovar Typhi
ugccagcgucgcugauugc

SEQ ID NO: 1708540 - RNA, 23 nt, Salmonella enterica enterica serovar Typhi
ugccagcgucgcugauugccgcc

SEQ ID NO: 1708541 - RNA, 16 nt, Salmonella enterica enterica serovar Typhi
ugccaggcuuccugcg

SEQ ID NO: 1708542 - RNA, 11 nt, Salmonella enterica enterica serovar Typhi
ugccaggcauu

SEQ ID NO: 1708543 - RNA, 16 nt, Salmonella enterica enterica serovar Typhi
ugccagccauagccca

SEQ ID NO: 1708544 - RNA, 14 nt, Salmonella enterica enterica serovar Typhi
ugccagcgccgccg

SEQ ID NO: 1708545 - RNA, 14 nt, Salmonella enterica enterica serovar Typhi
ugccagcgccguca

SEQ ID NO: 1708546 - RNA, 18 nt, Salmonella enterica enterica serovar Typhi
ugccagcggccagggcgu

SEQ ID NO: 1708547 - RNA, 14 nt, Salmonella enterica enterica serovar Typhi
ugccagcgcugaga

SEQ ID NO: 1708548 - RNA, 19 nt, Salmonella enterica enterica serovar Typhi
ugccagcguaagucugaua

SEQ ID NO: 1708549 - RNA, 18 nt, Salmonella enterica enterica serovar Typhi
ugcccgcgaucgcuucca

SEQ ID NO: 1708550 - RNA, 19 nt, Salmonella enterica enterica serovar Typhi
ugcccgguggcgcugcgcu

SEQ ID NO: 1708551 - RNA, 17 nt, Salmonella enterica enterica serovar Typhi
ugcccgucggacucauc

SEQ ID NO: 1708552 - RNA, 18 nt, Salmonella enterica enterica serovar Typhi
ugcccgauagugcaagcu

SEQ ID NO: 1708553 - RNA, 17 nt, Salmonella enterica enterica serovar Typhi
ugcccgagugacugaca

SEQ ID NO: 1708554 - RNA, 14 nt, Salmonella enterica enterica serovar Typhi
ugccccugaccgaa

SEQ ID NO: 1708555 - RNA, 12 nt, Salmonella enterica enterica serovar Typhi
ugccccucuucc

SEQ ID NO: 1708556 - RNA, 19 nt, Salmonella enterica enterica serovar Typhi
ugcccgaaagcaauacugu

SEQ ID NO: 1708557 - RNA, 20 nt, Salmonella enterica enterica serovar Typhi
ugcccgaaagcaauacugua

SEQ ID NO: 1708558 - RNA, 21 nt, Salmonella enterica enterica serovar Typhi
ugccccuuccgccacggcuuu

SEQ ID NO: 1708559 - RNA, 21 nt, Salmonella enterica enterica serovar Typhi
ugcccgaugagcuugcacuau

SEQ ID NO: 1708560 - RNA, 20 nt, Salmonella enterica enterica serovar Typhi
ugcccgcaaucucuggccag

SEQ ID NO: 1708561 - RNA, 22 nt, Salmonella enterica enterica serovar Typhi
ugcccaucuaaccgggccugau

SEQ ID NO: 1708562 - RNA, 17 nt, Salmonella enterica enterica serovar Typhi
ugcccaucgcgccauga

SEQ ID NO: 1708563 - RNA, 13 nt, Salmonella enterica enterica serovar Typhi
ugcccauuccgcc

SEQ ID NO: 1708564 - RNA, 15 nt, Salmonella enterica enterica serovar Typhi
ugcccauuuccugca

SEQ ID NO: 1708565 - RNA, 19 nt, Salmonella enterica enterica serovar Typhi
ugcccauuuccugcauuaa

SEQ ID NO: 1708566 - RNA, 21 nt, Salmonella enterica enterica serovar Typhi
ugccccacgauacgccccugc

SEQ ID NO: 1708567 - RNA, 23 nt, Salmonella enterica enterica serovar Typhi
ugcccccaucacuuuacccacau

SEQ ID NO: 1708568 - RNA, 15 nt, Salmonella enterica enterica serovar Typhi
ugcccccgagccaga

SEQ ID NO: 1708569 - RNA, 19 nt, Salmonella enterica enterica serovar Typhi
ugcccccgaucacggcgaa

SEQ ID NO: 1708570 - RNA, 18 nt, Salmonella enterica enterica serovar Typhi
ugcccagcaucccgcugg

SEQ ID NO: 1708571 - RNA, 20 nt, Salmonella enterica enterica serovar Typhi
ugcccaccugaaaaagggua

SEQ ID NO: 1708572 - RNA, 16 nt, Salmonella enterica enterica serovar Typhi
ugcccagcucagcuuu

SEQ ID NO: 1708573 - RNA, 19 nt, Salmonella enterica enterica serovar Typhi
ugcccagcgccuucuucac

SEQ ID NO: 1708574 - RNA, 23 nt, Salmonella enterica enterica serovar Typhi
ugccgccgucaucugcgccgaca

SEQ ID NO: 1708575 - RNA, 16 nt, Salmonella enterica enterica serovar Typhi
ugccgccgucgcggcu

SEQ ID NO: 1708576 - RNA, 19 nt, Salmonella enterica enterica serovar Typhi
ugccgccggaccaucuucc

SEQ ID NO: 1708577 - RNA, 23 nt, Salmonella enterica enterica serovar Typhi
ugccgcgaccacgcauaccagcc

SEQ ID NO: 1708578 - RNA, 14 nt, Salmonella enterica enterica serovar Typhi
ugccggaagcgauu

SEQ ID NO: 1708579 - RNA, 16 nt, Salmonella enterica enterica serovar Typhi
ugccggaacucagcua

SEQ ID NO: 1708580 - RNA, 17 nt, Salmonella enterica enterica serovar Typhi
ugccgcuuccaguccag

SEQ ID NO: 1708581 - RNA, 17 nt, Salmonella enterica enterica serovar Typhi
ugccgcuggcguauucg

SEQ ID NO: 1708582 - RNA, 16 nt, Salmonella enterica enterica serovar Typhi
ugccgcuuauccggcc

SEQ ID NO: 1708583 - RNA, 15 nt, Salmonella enterica enterica serovar Typhi
ugccgcugcugccuu

SEQ ID NO: 1708584 - RNA, 16 nt, Salmonella enterica enterica serovar Typhi
ugccgcugcuggcguu

SEQ ID NO: 1708585 - RNA, 16 nt, Salmonella enterica enterica serovar Typhi
ugccgcguuacucggc

SEQ ID NO: 1708586 - RNA, 22 nt, Salmonella enterica enterica serovar Typhi
ugccgugcgccgacaucgccac

SEQ ID NO: 1708587 - RNA, 15 nt, Salmonella enterica enterica serovar Typhi
ugccguuaauaaugu

SEQ ID NO: 1708588 - RNA, 17 nt, Salmonella enterica enterica serovar Typhi
ugccguuaacugcugcu

SEQ ID NO: 1708589 - RNA, 14 nt, Salmonella enterica enterica serovar Typhi
ugccguuggcgcga

SEQ ID NO: 1708590 - RNA, 18 nt, Salmonella enterica enterica serovar Typhi
ugccguuguugucaauau

SEQ ID NO: 1708591 - RNA, 21 nt, Salmonella enterica enterica serovar Typhi
ugccguuugcgccagcccggc

SEQ ID NO: 1708592 - RNA, 17 nt, Salmonella enterica enterica serovar Typhi
ugccguuuuccagccgu

SEQ ID NO: 1708593 - RNA, 18 nt, Salmonella enterica enterica serovar Typhi
ugccguuuuucucaucaa

SEQ ID NO: 1708594 - RNA, 15 nt, Salmonella enterica enterica serovar Typhi
ugccuaaagaaaaac

SEQ ID NO: 1708595 - RNA, 17 nt, Salmonella enterica enterica serovar Typhi
ugccuauucaccagacu

SEQ ID NO: 1708596 - RNA, 18 nt, Salmonella enterica enterica serovar Typhi
ugccuaagauggcgccuu

SEQ ID NO: 1708597 - RNA, 20 nt, Salmonella enterica enterica serovar Typhi
ugccuaagauggcgccuugc

SEQ ID NO: 1708598 - RNA, 17 nt, Salmonella enterica enterica serovar Typhi
ugccuaaaccuucgcuu

SEQ ID NO: 1708599 - RNA, 18 nt, Salmonella enterica enterica serovar Typhi
ugccguccggcaucacaa

SEQ ID NO: 1708600 - RNA, 12 nt, Salmonella enterica enterica serovar Typhi
ugccgugccggg

SEQ ID NO: 1708601 - RNA, 18 nt, Salmonella enterica enterica serovar Typhi
ugccguaggcgacgccaa

SEQ ID NO: 1708602 - RNA, 14 nt, Salmonella enterica enterica serovar Typhi
ugccguaggcaacg

SEQ ID NO: 1708603 - RNA, 20 nt, Salmonella enterica enterica serovar Typhi
ugccgucaacacgcagaccc

SEQ ID NO: 1708604 - RNA, 15 nt, Salmonella enterica enterica serovar Typhi
ugccgggccuggcau

SEQ ID NO: 1708605 - RNA, 18 nt, Salmonella enterica enterica serovar Typhi
ugccgucaauuuuaagaa

SEQ ID NO: 1708606 - RNA, 13 nt, Salmonella enterica enterica serovar Typhi
ugccgggcaaaaa

SEQ ID NO: 1708607 - RNA, 15 nt, Salmonella enterica enterica serovar Typhi
ugccgggcaaaaaac

SEQ ID NO: 1708608 - RNA, 17 nt, Salmonella enterica enterica serovar Typhi
ugccggcuuuccgcacc

SEQ ID NO: 1708609 - RNA, 19 nt, Salmonella enterica enterica serovar Typhi
ugccggauggcgcuaaugc

SEQ ID NO: 1708610 - RNA, 15 nt, Salmonella enterica enterica serovar Typhi
ugccgccagcaguug

SEQ ID NO: 1708611 - RNA, 18 nt, Salmonella enterica enterica serovar Typhi
ugccgccacgccgcucca

SEQ ID NO: 1708612 - RNA, 21 nt, Salmonella enterica enterica serovar Typhi
ugccgccaguuguucaacaua

SEQ ID NO: 1708613 - RNA, 15 nt, Salmonella enterica enterica serovar Typhi
ugccgcccaggccug

SEQ ID NO: 1708614 - RNA, 20 nt, Salmonella enterica enterica serovar Typhi
ugccgcccagggaaagauca

SEQ ID NO: 1708615 - RNA, 21 nt, Salmonella enterica enterica serovar Typhi
ugccgcccugaaagccgaccc

SEQ ID NO: 1708616 - RNA, 19 nt, Salmonella enterica enterica serovar Typhi
ugccgcccaucgccacagc

SEQ ID NO: 1708617 - RNA, 16 nt, Salmonella enterica enterica serovar Typhi
ugccgcccauccagag

SEQ ID NO: 1708618 - RNA, 16 nt, Salmonella enterica enterica serovar Typhi
ugccgaugacucccag

SEQ ID NO: 1708619 - RNA, 18 nt, Salmonella enterica enterica serovar Typhi
ugccgaucaccagcgcau

SEQ ID NO: 1708620 - RNA, 21 nt, Salmonella enterica enterica serovar Typhi
ugccgaucaccagcgcaucuc

SEQ ID NO: 1708621 - RNA, 21 nt, Salmonella enterica enterica serovar Typhi
ugccgauggcgcuccugaauc

SEQ ID NO: 1708622 - RNA, 18 nt, Salmonella enterica enterica serovar Typhi
ugccgauggcuaaagcgc

SEQ ID NO: 1708623 - RNA, 21 nt, Salmonella enterica enterica serovar Typhi
ugccgauggcuaaagcgcugg

SEQ ID NO: 1708624 - RNA, 23 nt, Salmonella enterica enterica serovar Typhi
ugccgauuuaccucucaccagua

SEQ ID NO: 1708625 - RNA, 19 nt, Salmonella enterica enterica serovar Typhi
ugccgcagccacauuguau

SEQ ID NO: 1708626 - RNA, 21 nt, Salmonella enterica enterica serovar Typhi
ugccgcagccgcucaggguaa

SEQ ID NO: 1708627 - RNA, 14 nt, Salmonella enterica enterica serovar Typhi
ugccgcacucccca

SEQ ID NO: 1708628 - RNA, 17 nt, Salmonella enterica enterica serovar Typhi
ugcccugacucgcaccg

SEQ ID NO: 1708629 - RNA, 19 nt, Salmonella enterica enterica serovar Typhi
ugcccugcuggcgcaugau

SEQ ID NO: 1708630 - RNA, 13 nt, Salmonella enterica enterica serovar Typhi
ugcccguuccagg

SEQ ID NO: 1708631 - RNA, 16 nt, Salmonella enterica enterica serovar Typhi
ugcccguugucacagg

SEQ ID NO: 1708632 - RNA, 20 nt, Salmonella enterica enterica serovar Typhi
ugcccguugucacaggcuug

SEQ ID NO: 1708633 - RNA, 22 nt, Salmonella enterica enterica serovar Typhi
ugcccuucgacaaucagcacca

SEQ ID NO: 1708634 - RNA, 13 nt, Salmonella enterica enterica serovar Typhi
ugcccuuucuuau

SEQ ID NO: 1708635 - RNA, 14 nt, Salmonella enterica enterica serovar Typhi
ugcccuuucuuaug

SEQ ID NO: 1708636 - RNA, 16 nt, Salmonella enterica enterica serovar Typhi
ugcccuuccagcagcc

SEQ ID NO: 1708637 - RNA, 17 nt, Salmonella enterica enterica serovar Typhi
ugcccuuccagcagcca

SEQ ID NO: 1708638 - RNA, 16 nt, Salmonella enterica enterica serovar Typhi
ugcccuuaucuggaug

SEQ ID NO: 1708639 - RNA, 22 nt, Salmonella enterica enterica serovar Typhi
ugcccugcuugucgaucaucag

SEQ ID NO: 1708640 - RNA, 23 nt, Salmonella enterica enterica serovar Typhi
ugcccugcuugucgaucaucaga

SEQ ID NO: 1708641 - RNA, 13 nt, Salmonella enterica enterica serovar Typhi
ugcccuggaagaa

SEQ ID NO: 1708642 - RNA, 13 nt, Salmonella enterica enterica serovar Typhi
ugccgacggcgcu

SEQ ID NO: 1708643 - RNA, 15 nt, Salmonella enterica enterica serovar Typhi
ugccgaccuggcuug

SEQ ID NO: 1708644 - RNA, 18 nt, Salmonella enterica enterica serovar Typhi
ugccgaccgccagcagag

SEQ ID NO: 1708645 - RNA, 17 nt, Salmonella enterica enterica serovar Typhi
ugccgauaauaaacgcg

SEQ ID NO: 1708646 - RNA, 19 nt, Salmonella enterica enterica serovar Typhi
ugccgauacguccccaucc

SEQ ID NO: 1708647 - RNA, 18 nt, Salmonella enterica enterica serovar Typhi
ugccgauagucuccgcca

SEQ ID NO: 1708648 - RNA, 13 nt, Salmonella enterica enterica serovar Typhi
ugccgacaggcag

SEQ ID NO: 1708649 - RNA, 20 nt, Salmonella enterica enterica serovar Typhi
ugccgacaaagagcucccca

SEQ ID NO: 1708650 - RNA, 14 nt, Salmonella enterica enterica serovar Typhi
ugcccuuuuccaga

SEQ ID NO: 1708651 - RNA, 23 nt, Salmonella enterica enterica serovar Typhi
ugcccuuuuugcauucgcuccuc

SEQ ID NO: 1708652 - RNA, 21 nt, Salmonella enterica enterica serovar Typhi
ugcgcaagcacugaaugcuga

SEQ ID NO: 1708653 - RNA, 12 nt, Salmonella enterica enterica serovar Typhi
ugcgcacucaga

SEQ ID NO: 1708654 - RNA, 16 nt, Salmonella enterica enterica serovar Typhi
ugcgcacucagaaaau

SEQ ID NO: 1708655 - RNA, 22 nt, Salmonella enterica enterica serovar Typhi
ugcgcaacguuucuuucaucag

SEQ ID NO: 1708656 - RNA, 18 nt, Salmonella enterica enterica serovar Typhi
ugcgcagcguuuccagac

SEQ ID NO: 1708657 - RNA, 15 nt, Salmonella enterica enterica serovar Typhi
ugcgcaaccuccgcg

SEQ ID NO: 1708658 - RNA, 12 nt, Salmonella enterica enterica serovar Typhi
ugcgcaaaugcc

SEQ ID NO: 1708659 - RNA, 12 nt, Salmonella enterica enterica serovar Typhi
ugcgcaaacgua

SEQ ID NO: 1708660 - RNA, 12 nt, Salmonella enterica enterica serovar Typhi
ugcgagaaaaag

SEQ ID NO: 1708661 - RNA, 18 nt, Salmonella enterica enterica serovar Typhi
ugcgagcaguucagcagc

SEQ ID NO: 1708662 - RNA, 14 nt, Salmonella enterica enterica serovar Typhi
ugccugcuccgcca

SEQ ID NO: 1708663 - RNA, 15 nt, Salmonella enterica enterica serovar Typhi
ugccugcuucagaca

SEQ ID NO: 1708664 - RNA, 17 nt, Salmonella enterica enterica serovar Typhi
ugccucccguuucagug

SEQ ID NO: 1708665 - RNA, 12 nt, Salmonella enterica enterica serovar Typhi
ugccuggccucc

SEQ ID NO: 1708666 - RNA, 22 nt, Salmonella enterica enterica serovar Typhi
ugccuggcaacaugaccagcgc

SEQ ID NO: 1708667 - RNA, 16 nt, Salmonella enterica enterica serovar Typhi
ugccuggguuccaggc

SEQ ID NO: 1708668 - RNA, 18 nt, Salmonella enterica enterica serovar Typhi
ugcgaccgcgccacggcc

SEQ ID NO: 1708669 - RNA, 21 nt, Salmonella enterica enterica serovar Typhi
ugcgaccacggguagagcuuu

SEQ ID NO: 1708670 - RNA, 15 nt, Salmonella enterica enterica serovar Typhi
ugcgaccacuccggc

SEQ ID NO: 1708671 - RNA, 21 nt, Salmonella enterica enterica serovar Typhi
ugcgacaucagccagccgcca

SEQ ID NO: 1708672 - RNA, 21 nt, Salmonella enterica enterica serovar Typhi
ugcgcauccgcggcgcuuugc

SEQ ID NO: 1708673 - RNA, 14 nt, Salmonella enterica enterica serovar Typhi
ugcgcccacaauga

SEQ ID NO: 1708674 - RNA, 14 nt, Salmonella enterica enterica serovar Typhi
aaauggauacuggu

SEQ ID NO: 1708675 - RNA, 18 nt, Salmonella enterica enterica serovar Typhi
ugcgcccaugacaugaaa

SEQ ID NO: 1708676 - RNA, 15 nt, Salmonella enterica enterica serovar Typhi
ugcgcccaucaucau

SEQ ID NO: 1708677 - RNA, 21 nt, Salmonella enterica enterica serovar Typhi
ugcgccccagcaugagccagc

SEQ ID NO: 1708678 - RNA, 21 nt, Salmonella enterica enterica serovar Typhi
aaauggcaaguaaaauagccc

SEQ ID NO: 1708679 - RNA, 12 nt, Salmonella enterica enterica serovar Typhi
aaauggcgcugu

SEQ ID NO: 1708680 - RNA, 15 nt, Salmonella enterica enterica serovar Typhi
ugcgccgucaggcuu

SEQ ID NO: 1708681 - RNA, 15 nt, Salmonella enterica enterica serovar Typhi
ugcgccgugccuggc

SEQ ID NO: 1708682 - RNA, 18 nt, Salmonella enterica enterica serovar Typhi
ugcgccgugccuggcgcu

SEQ ID NO: 1708683 - RNA, 19 nt, Salmonella enterica enterica serovar Typhi
aaauggucccugauauaca

SEQ ID NO: 1708684 - RNA, 16 nt, Salmonella enterica enterica serovar Typhi
aaauggucggucacgc

SEQ ID NO: 1708685 - RNA, 16 nt, Salmonella enterica enterica serovar Typhi
aaauggguaucgccuu

SEQ ID NO: 1708686 - RNA, 17 nt, Salmonella enterica enterica serovar Typhi
aaaugggcuggaaauau

SEQ ID NO: 1708687 - RNA, 22 nt, Salmonella enterica enterica serovar Typhi
ugcgcgacgacgccagccagcc

SEQ ID NO: 1708688 - RNA, 19 nt, Salmonella enterica enterica serovar Typhi
ugcgcgacgacgccagcca

SEQ ID NO: 1708689 - RNA, 14 nt, Salmonella enterica enterica serovar Typhi
ugcgcgauguucau

SEQ ID NO: 1708690 - RNA, 21 nt, Salmonella enterica enterica serovar Typhi
ugcgccuguuagggcgcggcu

SEQ ID NO: 1708691 - RNA, 23 nt, Salmonella enterica enterica serovar Typhi
ugcgccuuaucaagccuacaccu

SEQ ID NO: 1708692 - RNA, 18 nt, Salmonella enterica enterica serovar Typhi
ugcgccuuauccggcgug

SEQ ID NO: 1708693 - RNA, 13 nt, Salmonella enterica enterica serovar Typhi
ugcguauuuccac

SEQ ID NO: 1708694 - RNA, 19 nt, Salmonella enterica enterica serovar Typhi
ugcguagacgaugcaggcc

SEQ ID NO: 1708695 - RNA, 21 nt, Salmonella enterica enterica serovar Typhi
ugcguaauacggagcaaaaaa

SEQ ID NO: 1708696 - RNA, 17 nt, Salmonella enterica enterica serovar Typhi
ugcguaaucagcuuuuc

SEQ ID NO: 1708697 - RNA, 21 nt, Salmonella enterica enterica serovar Typhi
ugcguaaucuuuucauauuau

SEQ ID NO: 1708698 - RNA, 19 nt, Salmonella enterica enterica serovar Typhi
ugcguaaugagcgucgcca

SEQ ID NO: 1708699 - RNA, 17 nt, Salmonella enterica enterica serovar Typhi
ugcgguagcuccagaca

SEQ ID NO: 1708700 - RNA, 15 nt, Salmonella enterica enterica serovar Typhi
ugcgguaaauaaugc

SEQ ID NO: 1708701 - RNA, 15 nt, Salmonella enterica enterica serovar Typhi
ugcgggccagcagcc

SEQ ID NO: 1708702 - RNA, 19 nt, Salmonella enterica enterica serovar Typhi
ugcgggccagcagccaggc

SEQ ID NO: 1708703 - RNA, 18 nt, Salmonella enterica enterica serovar Typhi
ugcgggcaugggaaauaa

SEQ ID NO: 1708704 - RNA, 20 nt, Salmonella enterica enterica serovar Typhi
ugcggccuugccgccagcgc

SEQ ID NO: 1708705 - RNA, 22 nt, Salmonella enterica enterica serovar Typhi
ugcgggccguaaaguucccagc

SEQ ID NO: 1708706 - RNA, 16 nt, Salmonella enterica enterica serovar Typhi
ugcgggcgaucggcug

SEQ ID NO: 1708707 - RNA, 18 nt, Salmonella enterica enterica serovar Typhi
ugcggcaaaaauccuucu

SEQ ID NO: 1708708 - RNA, 15 nt, Salmonella enterica enterica serovar Typhi
ugcgcugcgcgcgau

SEQ ID NO: 1708709 - RNA, 19 nt, Salmonella enterica enterica serovar Typhi
ugcgcuggaacugaucgug

SEQ ID NO: 1708710 - RNA, 15 nt, Salmonella enterica enterica serovar Typhi
ugcgcuggaacugau

SEQ ID NO: 1708711 - RNA, 13 nt, Salmonella enterica enterica serovar Typhi
ugcggacauuaac

SEQ ID NO: 1708712 - RNA, 19 nt, Salmonella enterica enterica serovar Typhi
ugcggagaagacgccgccg

SEQ ID NO: 1708713 - RNA, 14 nt, Salmonella enterica enterica serovar Typhi
ugcgcugcaaaaag

SEQ ID NO: 1708714 - RNA, 22 nt, Salmonella enterica enterica serovar Typhi
ugcgcugaauagcgcugcggcu

SEQ ID NO: 1708715 - RNA, 14 nt, Salmonella enterica enterica serovar Typhi
ugcgcuccggcgcu

SEQ ID NO: 1708716 - RNA, 17 nt, Salmonella enterica enterica serovar Typhi
ugcgcucuaucaccgcc

SEQ ID NO: 1708717 - RNA, 22 nt, Salmonella enterica enterica serovar Typhi
ugcgcucacgcuuauccggccu

SEQ ID NO: 1708718 - RNA, 15 nt, Salmonella enterica enterica serovar Typhi
ugcgcuauuacucuu

SEQ ID NO: 1708719 - RNA, 16 nt, Salmonella enterica enterica serovar Typhi
ugcgcucagggucaga

SEQ ID NO: 1708720 - RNA, 18 nt, Salmonella enterica enterica serovar Typhi
ugcgcguuuagcgccagc

SEQ ID NO: 1708721 - RNA, 23 nt, Salmonella enterica enterica serovar Typhi
ugcgcuaagcguuacggaaaaaa

SEQ ID NO: 1708722 - RNA, 17 nt, Salmonella enterica enterica serovar Typhi
ugcgcgcgaugcugcuc

SEQ ID NO: 1708723 - RNA, 16 nt, Salmonella enterica enterica serovar Typhi
ugcgcgcaucgggccg

SEQ ID NO: 1708724 - RNA, 19 nt, Salmonella enterica enterica serovar Typhi
ugcgcgcgaugcugcucca

SEQ ID NO: 1708725 - RNA, 20 nt, Salmonella enterica enterica serovar Typhi
ugcgcgggcguauagccagg

SEQ ID NO: 1708726 - RNA, 20 nt, Salmonella enterica enterica serovar Typhi
ugcgcguagcccacagguag

SEQ ID NO: 1708727 - RNA, 14 nt, Salmonella enterica enterica serovar Typhi
ugcgcguaaauuuc

SEQ ID NO: 1708728 - RNA, 16 nt, Salmonella enterica enterica serovar Typhi
ugagcgagaauuuuau

SEQ ID NO: 1708729 - RNA, 16 nt, Salmonella enterica enterica serovar Typhi
ugagcgaaacuccagc

SEQ ID NO: 1708730 - RNA, 19 nt, Salmonella enterica enterica serovar Typhi
ugagcgaauccccgggaac

SEQ ID NO: 1708731 - RNA, 19 nt, Salmonella enterica enterica serovar Typhi
ugagccgaaauccaccagc

SEQ ID NO: 1708732 - RNA, 17 nt, Salmonella enterica enterica serovar Typhi
ugagcccacagcggaug

SEQ ID NO: 1708733 - RNA, 19 nt, Salmonella enterica enterica serovar Typhi
ugagccacgguaguuucaa

SEQ ID NO: 1708734 - RNA, 20 nt, Salmonella enterica enterica serovar Typhi
ugagcaucaaacuuuuaaau

SEQ ID NO: 1708735 - RNA, 21 nt, Salmonella enterica enterica serovar Typhi
ugagaugcaggccaagcagcg

SEQ ID NO: 1708736 - RNA, 18 nt, Salmonella enterica enterica serovar Typhi
ugagcacgcggaagaaau

SEQ ID NO: 1708737 - RNA, 20 nt, Salmonella enterica enterica serovar Typhi
ugagcagaucagcacgcgcc

SEQ ID NO: 1708738 - RNA, 16 nt, Salmonella enterica enterica serovar Typhi
ugacuuugcucuccuu

SEQ ID NO: 1708739 - RNA, 12 nt, Salmonella enterica enterica serovar Typhi
ugacuuuuacgc

SEQ ID NO: 1708740 - RNA, 12 nt, Salmonella enterica enterica serovar Typhi
ugagaaaaggaa

SEQ ID NO: 1708741 - RNA, 15 nt, Salmonella enterica enterica serovar Typhi
ugagaaaaggaagaa

SEQ ID NO: 1708742 - RNA, 20 nt, Salmonella enterica enterica serovar Typhi
ugagaaaaggaagaauaaau

SEQ ID NO: 1708743 - RNA, 14 nt, Salmonella enterica enterica serovar Typhi
ugagaaaagcagag

SEQ ID NO: 1708744 - RNA, 18 nt, Salmonella enterica enterica serovar Typhi
ugagaaaagcgaaaauaa

SEQ ID NO: 1708745 - RNA, 21 nt, Salmonella enterica enterica serovar Typhi
ugacuuuuuucaaccucacug

SEQ ID NO: 1708746 - RNA, 14 nt, Salmonella enterica enterica serovar Typhi
ugagaauggcggga

SEQ ID NO: 1708747 - RNA, 23 nt, Salmonella enterica enterica serovar Typhi
ugagaaaauuacgcccaucagcc

SEQ ID NO: 1708748 - RNA, 14 nt, Salmonella enterica enterica serovar Typhi
ugagaagggcagau

SEQ ID NO: 1708749 - RNA, 21 nt, Salmonella enterica enterica serovar Typhi
ugacugccguauaauccagcu

SEQ ID NO: 1708750 - RNA, 19 nt, Salmonella enterica enterica serovar Typhi
ugacugguuuguugcgucu

SEQ ID NO: 1708751 - RNA, 19 nt, Salmonella enterica enterica serovar Typhi
ugacuguaauaauacuaac

SEQ ID NO: 1708752 - RNA, 21 nt, Salmonella enterica enterica serovar Typhi
ugacuuuaccgguuucaaucc

SEQ ID NO: 1708753 - RNA, 15 nt, Salmonella enterica enterica serovar Typhi
ugagcuugagccagc

SEQ ID NO: 1708754 - RNA, 20 nt, Salmonella enterica enterica serovar Typhi
ugagcgagucagacaccagc

SEQ ID NO: 1708755 - RNA, 18 nt, Salmonella enterica enterica serovar Typhi
ugagcgcagugaccagca

SEQ ID NO: 1708756 - RNA, 23 nt, Salmonella enterica enterica serovar Typhi
ugagcgcgaggcauaccgcccag

SEQ ID NO: 1708757 - RNA, 16 nt, Salmonella enterica enterica serovar Typhi
ugaggccgcucgccau

SEQ ID NO: 1708758 - RNA, 20 nt, Salmonella enterica enterica serovar Typhi
ugagguugagauccugaucc

SEQ ID NO: 1708759 - RNA, 21 nt, Salmonella enterica enterica serovar Typhi
ugaguauaaaacucgccgcga

SEQ ID NO: 1708760 - RNA, 19 nt, Salmonella enterica enterica serovar Typhi
ugaguaaagagaucaauuu

SEQ ID NO: 1708761 - RNA, 13 nt, Salmonella enterica enterica serovar Typhi
ugaguaacguuaa

SEQ ID NO: 1708762 - RNA, 22 nt, Salmonella enterica enterica serovar Typhi
ugaguaacguuaauacaucaug

SEQ ID NO: 1708763 - RNA, 18 nt, Salmonella enterica enterica serovar Typhi
ugauaauuguuaauuauu

SEQ ID NO: 1708764 - RNA, 19 nt, Salmonella enterica enterica serovar Typhi
ugauaaccuauuuugcaaa

SEQ ID NO: 1708765 - RNA, 15 nt, Salmonella enterica enterica serovar Typhi
ugauaaccgccgcca

SEQ ID NO: 1708766 - RNA, 17 nt, Salmonella enterica enterica serovar Typhi
ugauaaugucaacuuaa

SEQ ID NO: 1708767 - RNA, 23 nt, Salmonella enterica enterica serovar Typhi
ugauaaucaauggccuugccagc

SEQ ID NO: 1708768 - RNA, 23 nt, Salmonella enterica enterica serovar Typhi
ugagucagaaacggccuggcccg

SEQ ID NO: 1708769 - RNA, 16 nt, Salmonella enterica enterica serovar Typhi
ugaguccccgggagca

SEQ ID NO: 1708770 - RNA, 19 nt, Salmonella enterica enterica serovar Typhi
ugaguccauaccguuucaa

SEQ ID NO: 1708771 - RNA, 15 nt, Salmonella enterica enterica serovar Typhi
ugagucauccuuccc

SEQ ID NO: 1708772 - RNA, 16 nt, Salmonella enterica enterica serovar Typhi
ugagucauccuucccc

SEQ ID NO: 1708773 - RNA, 18 nt, Salmonella enterica enterica serovar Typhi
ugaguuugucauccagac

SEQ ID NO: 1708774 - RNA, 22 nt, Salmonella enterica enterica serovar Typhi
ugaguuuuaacgaaggauuuau

SEQ ID NO: 1708775 - RNA, 20 nt, Salmonella enterica enterica serovar Typhi
ugauaaagcuuucaucuuua

SEQ ID NO: 1708776 - RNA, 18 nt, Salmonella enterica enterica serovar Typhi
ugauaaaucgucggcagg

SEQ ID NO: 1708777 - RNA, 22 nt, Salmonella enterica enterica serovar Typhi
ugauccaccaccaguacauggc

SEQ ID NO: 1708778 - RNA, 21 nt, Salmonella enterica enterica serovar Typhi
ugaucacuuuugggccgcgua

SEQ ID NO: 1708779 - RNA, 12 nt, Salmonella enterica enterica serovar Typhi
ugaucccaccag

SEQ ID NO: 1708780 - RNA, 13 nt, Salmonella enterica enterica serovar Typhi
ugaucgugcccac

SEQ ID NO: 1708781 - RNA, 18 nt, Salmonella enterica enterica serovar Typhi
ugaucgugauaggccaga

SEQ ID NO: 1708782 - RNA, 23 nt, Salmonella enterica enterica serovar Typhi
ugaucgugccaugaccauucaca

SEQ ID NO: 1708783 - RNA, 14 nt, Salmonella enterica enterica serovar Typhi
ugaucaauuugccu

SEQ ID NO: 1708784 - RNA, 18 nt, Salmonella enterica enterica serovar Typhi
ugaucaaucaacucuuua

SEQ ID NO: 1708785 - RNA, 17 nt, Salmonella enterica enterica serovar Typhi
ugaucaccgcccuggcg

SEQ ID NO: 1708786 - RNA, 17 nt, Salmonella enterica enterica serovar Typhi
ugauauuuuuacugauu

SEQ ID NO: 1708787 - RNA, 23 nt, Salmonella enterica enterica serovar Typhi
ugauauuacuaauaaaauucacu

SEQ ID NO: 1708788 - RNA, 21 nt, Salmonella enterica enterica serovar Typhi
ugauauuagaaagcugcacca

SEQ ID NO: 1708789 - RNA, 17 nt, Salmonella enterica enterica serovar Typhi
ugauaccacaucaauag

SEQ ID NO: 1708790 - RNA, 20 nt, Salmonella enterica enterica serovar Typhi
ugauauuucuuagcacccac

SEQ ID NO: 1708791 - RNA, 23 nt, Salmonella enterica enterica serovar Typhi
ugaugcguuguaccguuuuccag

SEQ ID NO: 1708792 - RNA, 15 nt, Salmonella enterica enterica serovar Typhi
ugaugcugcgcaucc

SEQ ID NO: 1708793 - RNA, 20 nt, Salmonella enterica enterica serovar Typhi
ugauggcagaccguggccgu

SEQ ID NO: 1708794 - RNA, 15 nt, Salmonella enterica enterica serovar Typhi
ugauggccacaucgu

SEQ ID NO: 1708795 - RNA, 17 nt, Salmonella enterica enterica serovar Typhi
ugauggccuuugugauc

SEQ ID NO: 1708796 - RNA, 10 nt, Salmonella enterica enterica serovar Typhi
ugauggcuuu

SEQ ID NO: 1708797 - RNA, 16 nt, Salmonella enterica enterica serovar Typhi
ugauggcgcuacgcca

SEQ ID NO: 1708798 - RNA, 19 nt, Salmonella enterica enterica serovar Typhi
ugauggcguagcgccauca

SEQ ID NO: 1708799 - RNA, 20 nt, Salmonella enterica enterica serovar Typhi
ugaugcaucagaacaaacuu

SEQ ID NO: 1708800 - RNA, 22 nt, Salmonella enterica enterica serovar Typhi
ugauugcgacaggcugccgaca

SEQ ID NO: 1708801 - RNA, 15 nt, Salmonella enterica enterica serovar Typhi
ugauugcgacaggcu

SEQ ID NO: 1708802 - RNA, 18 nt, Salmonella enterica enterica serovar Typhi
ugauuucgccccacuggc

SEQ ID NO: 1708803 - RNA, 11 nt, Salmonella enterica enterica serovar Typhi
ugauuuauuca

SEQ ID NO: 1708804 - RNA, 23 nt, Salmonella enterica enterica serovar Typhi
ugauucaucacguucaggcagua

SEQ ID NO: 1708805 - RNA, 19 nt, Salmonella enterica enterica serovar Typhi
ugauucauucccauacugc

SEQ ID NO: 1708806 - RNA, 21 nt, Salmonella enterica enterica serovar Typhi
ugauucguuuaaguaagguaa

SEQ ID NO: 1708807 - RNA, 15 nt, Salmonella enterica enterica serovar Typhi
ugauuauuacaauaa

SEQ ID NO: 1708808 - RNA, 19 nt, Salmonella enterica enterica serovar Typhi
ugauuaucacccacaggag

SEQ ID NO: 1708809 - RNA, 14 nt, Salmonella enterica enterica serovar Typhi
ugauuacggaacaa

SEQ ID NO: 1708810 - RNA, 20 nt, Salmonella enterica enterica serovar Typhi
ugauuacggaacaaaacgga

SEQ ID NO: 1708811 - RNA, 21 nt, Salmonella enterica enterica serovar Typhi
ugauuacggaacaaaacggaa

SEQ ID NO: 1708812 - RNA, 15 nt, Salmonella enterica enterica serovar Typhi
ugauuacaaagggca

SEQ ID NO: 1708813 - RNA, 18 nt, Salmonella enterica enterica serovar Typhi
ugauuaaugauuugcuuu

SEQ ID NO: 1708814 - RNA, 12 nt, Salmonella enterica enterica serovar Typhi
ugauuacaaaau

SEQ ID NO: 1708815 - RNA, 15 nt, Salmonella enterica enterica serovar Typhi
ugauuacaaaaugug

SEQ ID NO: 1708816 - RNA, 17 nt, Salmonella enterica enterica serovar Typhi
ugauuaaaagucaacug

SEQ ID NO: 1708817 - RNA, 19 nt, Salmonella enterica enterica serovar Typhi
ugauuaaguuuuuuuaaaa

SEQ ID NO: 1708818 - RNA, 17 nt, Salmonella enterica enterica serovar Typhi
ugaugugucuauuuauu

SEQ ID NO: 1708819 - RNA, 17 nt, Salmonella enterica enterica serovar Typhi
ugauguguuucagcagc

SEQ ID NO: 1708820 - RNA, 21 nt, Salmonella enterica enterica serovar Typhi
ugaugguuucggcaugccacu

SEQ ID NO: 1708821 - RNA, 15 nt, Salmonella enterica enterica serovar Typhi
ugaugguuauuuuca

SEQ ID NO: 1708822 - RNA, 15 nt, Salmonella enterica enterica serovar Typhi
ugauguacaggugaa

SEQ ID NO: 1708823 - RNA, 21 nt, Salmonella enterica enterica serovar Typhi
ugauguagcuugaaagcgcaa

SEQ ID NO: 1708824 - RNA, 17 nt, Salmonella enterica enterica serovar Typhi
ugaauugcgguuuaucc

SEQ ID NO: 1708825 - RNA, 15 nt, Salmonella enterica enterica serovar Typhi
ugaauuuaaauacuu

SEQ ID NO: 1708826 - RNA, 22 nt, Salmonella enterica enterica serovar Typhi
ugaauuuaauggucuuaaaugc

SEQ ID NO: 1708827 - RNA, 20 nt, Salmonella enterica enterica serovar Typhi
ugaauuuaucccgugguggg

SEQ ID NO: 1708828 - RNA, 14 nt, Salmonella enterica enterica serovar Typhi
ugaauucaacgucc

SEQ ID NO: 1708829 - RNA, 15 nt, Salmonella enterica enterica serovar Typhi
ugaauucaccgcaug

SEQ ID NO: 1708830 - RNA, 22 nt, Salmonella enterica enterica serovar Typhi
ugaauuacagcucauaaacgcg

SEQ ID NO: 1708831 - RNA, 17 nt, Salmonella enterica enterica serovar Typhi
ugaauuauaauaaaggg

SEQ ID NO: 1708832 - RNA, 11 nt, Salmonella enterica enterica serovar Typhi
ugaauguuuug

SEQ ID NO: 1708833 - RNA, 22 nt, Salmonella enterica enterica serovar Typhi
ugaaugccccagcgcugcugua

SEQ ID NO: 1708834 - RNA, 19 nt, Salmonella enterica enterica serovar Typhi
ugaaugccccagcgcugcu

SEQ ID NO: 1708835 - RNA, 13 nt, Salmonella enterica enterica serovar Typhi
ugaaugcaaagaa

SEQ ID NO: 1708836 - RNA, 17 nt, Salmonella enterica enterica serovar Typhi
ugaaucucuucccagcg

SEQ ID NO: 1708837 - RNA, 13 nt, Salmonella enterica enterica serovar Typhi
ugaaucagcaucu

SEQ ID NO: 1708838 - RNA, 21 nt, Salmonella enterica enterica serovar Typhi
ugaaucagauacggcuccagc

SEQ ID NO: 1708839 - RNA, 24 nt, Salmonella enterica enterica serovar Typhi
ugaaucaucagaaucguccagauu

SEQ ID NO: 1708840 - RNA, 22 nt, Salmonella enterica enterica serovar Typhi
ugaaucaucgguaaaugcuuau

SEQ ID NO: 1708841 - RNA, 15 nt, Salmonella enterica enterica serovar Typhi
ugaaucaagcuuugc

SEQ ID NO: 1708842 - RNA, 13 nt, Salmonella enterica enterica serovar Typhi
ugaauauuuugcu

SEQ ID NO: 1708843 - RNA, 21 nt, Salmonella enterica enterica serovar Typhi
ugaaucccgccaucguccagc

SEQ ID NO: 1708844 - RNA, 17 nt, Salmonella enterica enterica serovar Typhi
ugacaacuauugcugcc

SEQ ID NO: 1708845 - RNA, 20 nt, Salmonella enterica enterica serovar Typhi
ugacaauauugccauaaaua

SEQ ID NO: 1708846 - RNA, 14 nt, Salmonella enterica enterica serovar Typhi
ugacaaucacucuc

SEQ ID NO: 1708847 - RNA, 23 nt, Salmonella enterica enterica serovar Typhi
ugacaaacucacguuccccagca

SEQ ID NO: 1708848 - RNA, 23 nt, Salmonella enterica enterica serovar Typhi
ugacaacacucacaaaacuauuu

SEQ ID NO: 1708849 - RNA, 17 nt, Salmonella enterica enterica serovar Typhi
ugacaacacucacaaaa

SEQ ID NO: 1708850 - RNA, 22 nt, Salmonella enterica enterica serovar Typhi
ugacaaauuguuuaaaaacagg

SEQ ID NO: 1708851 - RNA, 19 nt, Salmonella enterica enterica serovar Typhi
ugacagcaucgauuccgcc

SEQ ID NO: 1708852 - RNA, 21 nt, Salmonella enterica enterica serovar Typhi
ugacagagcucgucaaaaauc

SEQ ID NO: 1708853 - RNA, 21 nt, Salmonella enterica enterica serovar Typhi
ugacagcaaguugcgccacug

SEQ ID NO: 1708854 - RNA, 18 nt, Salmonella enterica enterica serovar Typhi
ugacagcacauagccuaa

SEQ ID NO: 1708855 - RNA, 14 nt, Salmonella enterica enterica serovar Typhi
ugacacccucugcg

SEQ ID NO: 1708856 - RNA, 14 nt, Salmonella enterica enterica serovar Typhi
ugacacucauccag

SEQ ID NO: 1708857 - RNA, 15 nt, Salmonella enterica enterica serovar Typhi
ugacacggucagcgg

SEQ ID NO: 1708858 - RNA, 17 nt, Salmonella enterica enterica serovar Typhi
ugaccaugccacaacag

SEQ ID NO: 1708859 - RNA, 21 nt, Salmonella enterica enterica serovar Typhi
ugaccgccgcgcgucagcacg

SEQ ID NO: 1708860 - RNA, 19 nt, Salmonella enterica enterica serovar Typhi
ugaccgcuucgccuucgcc

SEQ ID NO: 1708861 - RNA, 12 nt, Salmonella enterica enterica serovar Typhi
ugaccucgccua

SEQ ID NO: 1708862 - RNA, 11 nt, Salmonella enterica enterica serovar Typhi
ugaccugaaua

SEQ ID NO: 1708863 - RNA, 15 nt, Salmonella enterica enterica serovar Typhi
ugaccugcccauccu

SEQ ID NO: 1708864 - RNA, 21 nt, Salmonella enterica enterica serovar Typhi
ugaccagcugacgacgccagc

SEQ ID NO: 1708865 - RNA, 12 nt, Salmonella enterica enterica serovar Typhi
ugaccagcgccc

SEQ ID NO: 1708866 - RNA, 18 nt, Salmonella enterica enterica serovar Typhi
ugaccagcgcccacacca

SEQ ID NO: 1708867 - RNA, 17 nt, Salmonella enterica enterica serovar Typhi
ugaccagggcaaauuau

SEQ ID NO: 1708868 - RNA, 19 nt, Salmonella enterica enterica serovar Typhi
ugaccaggucgccagcggg

SEQ ID NO: 1708869 - RNA, 17 nt, Salmonella enterica enterica serovar Typhi
ugaccauauaugaaauc

SEQ ID NO: 1708870 - RNA, 22 nt, Salmonella enterica enterica serovar Typhi
ugaccaguuguuccgcgcugau

SEQ ID NO: 1708871 - RNA, 15 nt, Salmonella enterica enterica serovar Typhi
ugaccaucaaauaau

SEQ ID NO: 1708872 - RNA, 17 nt, Salmonella enterica enterica serovar Typhi
ugaccaucaaauaauac

SEQ ID NO: 1708873 - RNA, 12 nt, Salmonella enterica enterica serovar Typhi
ugaccagcaguu

SEQ ID NO: 1708874 - RNA, 15 nt, Salmonella enterica enterica serovar Typhi
ugaccagcaguuccg

SEQ ID NO: 1708875 - RNA, 22 nt, Salmonella enterica enterica serovar Typhi
ugacaucaagcccacacaucac

SEQ ID NO: 1708876 - RNA, 18 nt, Salmonella enterica enterica serovar Typhi
ugacauagcauaauaaug

SEQ ID NO: 1708877 - RNA, 18 nt, Salmonella enterica enterica serovar Typhi
ugaaacgaaaacugggca

SEQ ID NO: 1708878 - RNA, 19 nt, Salmonella enterica enterica serovar Typhi
ugaaacccgccaccgccag

SEQ ID NO: 1708879 - RNA, 20 nt, Salmonella enterica enterica serovar Typhi
ugaaaccccaaaucagcaaa

SEQ ID NO: 1708880 - RNA, 22 nt, Salmonella enterica enterica serovar Typhi
ucuucggcgggaucuccagaag

SEQ ID NO: 1708881 - RNA, 15 nt, Salmonella enterica enterica serovar Typhi
ucuucggcuucaccg

SEQ ID NO: 1708882 - RNA, 15 nt, Salmonella enterica enterica serovar Typhi
ugaaagaaaucaccg

SEQ ID NO: 1708883 - RNA, 12 nt, Salmonella enterica enterica serovar Typhi
ugaaaggguggg

SEQ ID NO: 1708884 - RNA, 18 nt, Salmonella enterica enterica serovar Typhi
ugaaauauuugaucacau

SEQ ID NO: 1708885 - RNA, 15 nt, Salmonella enterica enterica serovar Typhi
ugaaauuaaucaggc

SEQ ID NO: 1708886 - RNA, 18 nt, Salmonella enterica enterica serovar Typhi
ugaaauuaaucaggcauc

SEQ ID NO: 1708887 - RNA, 19 nt, Salmonella enterica enterica serovar Typhi
ugaaauuacgccauaaaaa

SEQ ID NO: 1708888 - RNA, 22 nt, Salmonella enterica enterica serovar Typhi
ugaaauuauuccuuaucacauu

SEQ ID NO: 1708889 - RNA, 21 nt, Salmonella enterica enterica serovar Typhi
ugaaauugaucacaaaaucau

SEQ ID NO: 1708890 - RNA, 16 nt, Salmonella enterica enterica serovar Typhi
ugaaauuucuuuucca

SEQ ID NO: 1708891 - RNA, 14 nt, Salmonella enterica enterica serovar Typhi
ugaacacccugccc

SEQ ID NO: 1708892 - RNA, 13 nt, Salmonella enterica enterica serovar Typhi
ugaacauuuuuuc

SEQ ID NO: 1708893 - RNA, 15 nt, Salmonella enterica enterica serovar Typhi
ugaacauugccccuc

SEQ ID NO: 1708894 - RNA, 21 nt, Salmonella enterica enterica serovar Typhi
ugaaccagcggcaccagcacg

SEQ ID NO: 1708895 - RNA, 20 nt, Salmonella enterica enterica serovar Typhi
ugaaccagcaucccacgaau

SEQ ID NO: 1708896 - RNA, 15 nt, Salmonella enterica enterica serovar Typhi
ugaacauuuuuucag

SEQ ID NO: 1708897 - RNA, 21 nt, Salmonella enterica enterica serovar Typhi
ugaacaaaggcagccaacaaa

SEQ ID NO: 1708898 - RNA, 15 nt, Salmonella enterica enterica serovar Typhi
ugaauaccaaagccc

SEQ ID NO: 1708899 - RNA, 12 nt, Salmonella enterica enterica serovar Typhi
ugaauaccagcg

SEQ ID NO: 1708900 - RNA, 19 nt, Salmonella enterica enterica serovar Typhi
ugaauaccagcggcaaaca

SEQ ID NO: 1708901 - RNA, 16 nt, Salmonella enterica enterica serovar Typhi
ugaauaauuucuucuu

SEQ ID NO: 1708902 - RNA, 18 nt, Salmonella enterica enterica serovar Typhi
ugaauaauuucuucuuua

SEQ ID NO: 1708903 - RNA, 21 nt, Salmonella enterica enterica serovar Typhi
ugaauaaucgucgugguuuaa

SEQ ID NO: 1708904 - RNA, 14 nt, Salmonella enterica enterica serovar Typhi
ugaauaaugaccag

SEQ ID NO: 1708905 - RNA, 14 nt, Salmonella enterica enterica serovar Typhi
ugaauaaugaccuc

SEQ ID NO: 1708906 - RNA, 22 nt, Salmonella enterica enterica serovar Typhi
ugaagugugcaaacgauaaaag

SEQ ID NO: 1708907 - RNA, 12 nt, Salmonella enterica enterica serovar Typhi
ugaauagccagc

SEQ ID NO: 1708908 - RNA, 14 nt, Salmonella enterica enterica serovar Typhi
ugaauagcgcugcg

SEQ ID NO: 1708909 - RNA, 18 nt, Salmonella enterica enterica serovar Typhi
ugaauauggccagucccc

SEQ ID NO: 1708910 - RNA, 17 nt, Salmonella enterica enterica serovar Typhi
ugaagaguuugaucaug

SEQ ID NO: 1708911 - RNA, 18 nt, Salmonella enterica enterica serovar Typhi
ugaagauaaacagcagcg

SEQ ID NO: 1708912 - RNA, 15 nt, Salmonella enterica enterica serovar Typhi
ugaagauguagacca

SEQ ID NO: 1708913 - RNA, 17 nt, Salmonella enterica enterica serovar Typhi
ugaagccuggugcccaa

SEQ ID NO: 1708914 - RNA, 14 nt, Salmonella enterica enterica serovar Typhi
ugaagcgcaguguu

SEQ ID NO: 1708915 - RNA, 15 nt, Salmonella enterica enterica serovar Typhi
ugaagcgcaguguua

SEQ ID NO: 1708916 - RNA, 19 nt, Salmonella enterica enterica serovar Typhi
ugaaggcgcuaugcuuacc

SEQ ID NO: 1708917 - RNA, 17 nt, Salmonella enterica enterica serovar Typhi
ugaaggcguaugaauga

SEQ ID NO: 1708918 - RNA, 16 nt, Salmonella enterica enterica serovar Typhi
ugaaggcgccgcgcag

SEQ ID NO: 1708919 - RNA, 19 nt, Salmonella enterica enterica serovar Typhi
ugaacuuuuugcaggagcu

SEQ ID NO: 1708920 - RNA, 19 nt, Salmonella enterica enterica serovar Typhi
ugaagaaaauacugauuaa

SEQ ID NO: 1708921 - RNA, 16 nt, Salmonella enterica enterica serovar Typhi
ucgccuuucaccagcg

SEQ ID NO: 1708922 - RNA, 20 nt, Salmonella enterica enterica serovar Typhi
ucgccuguaccgggcagaca

SEQ ID NO: 1708923 - RNA, 22 nt, Salmonella enterica enterica serovar Typhi
ucgccuggauaauggcuaugcc

SEQ ID NO: 1708924 - RNA, 17 nt, Salmonella enterica enterica serovar Typhi
ucgccuucauccgcaua

SEQ ID NO: 1708925 - RNA, 13 nt, Salmonella enterica enterica serovar Typhi
ucgccuucauccg

SEQ ID NO: 1708926 - RNA, 15 nt, Salmonella enterica enterica serovar Typhi
ucgccuguuucugcg

SEQ ID NO: 1708927 - RNA, 22 nt, Salmonella enterica enterica serovar Typhi
ucgccuuaacucuuaaaucaug

SEQ ID NO: 1708928 - RNA, 16 nt, Salmonella enterica enterica serovar Typhi
ucgccuuacccggccu

SEQ ID NO: 1708929 - RNA, 16 nt, Salmonella enterica enterica serovar Typhi
ucgcgacugauaccca

SEQ ID NO: 1708930 - RNA, 22 nt, Salmonella enterica enterica serovar Typhi
ucgcgagcacuuuuuccuccug

SEQ ID NO: 1708931 - RNA, 12 nt, Salmonella enterica enterica serovar Typhi
ucgcgaugaugu

SEQ ID NO: 1708932 - RNA, 17 nt, Salmonella enterica enterica serovar Typhi
ucgcgaucacagacaga

SEQ ID NO: 1708933 - RNA, 22 nt, Salmonella enterica enterica serovar Typhi
ucgcgaauagugcaggaaggcg

SEQ ID NO: 1708934 - RNA, 21 nt, Salmonella enterica enterica serovar Typhi
ucgcgacggaccggcagcguc

SEQ ID NO: 1708935 - RNA, 17 nt, Salmonella enterica enterica serovar Typhi
ucgcgaaucgcuucacg

SEQ ID NO: 1708936 - RNA, 13 nt, Salmonella enterica enterica serovar Typhi
ucgcgaauuucaa

SEQ ID NO: 1708937 - RNA, 14 nt, Salmonella enterica enterica serovar Typhi
ucgcgcaggcggaa

SEQ ID NO: 1708938 - RNA, 18 nt, Salmonella enterica enterica serovar Typhi
ucgcgccaaaagaggcag

SEQ ID NO: 1708939 - RNA, 19 nt, Salmonella enterica enterica serovar Typhi
ucgcgccaaaagaggcagc

SEQ ID NO: 1708940 - RNA, 20 nt, Salmonella enterica enterica serovar Typhi
ucgcgccaaaagaggcagca

SEQ ID NO: 1708941 - RNA, 17 nt, Salmonella enterica enterica serovar Typhi
ucgcgcauggcagggcg

SEQ ID NO: 1708942 - RNA, 15 nt, Salmonella enterica enterica serovar Typhi
ucgcgauuuuuuucc

SEQ ID NO: 1708943 - RNA, 14 nt, Salmonella enterica enterica serovar Typhi
ucgcgauccagccc

SEQ ID NO: 1708944 - RNA, 13 nt, Salmonella enterica enterica serovar Typhi
ucgcgauuuagcg

SEQ ID NO: 1708945 - RNA, 15 nt, Salmonella enterica enterica serovar Typhi
ucgcgcaccauaaua

SEQ ID NO: 1708946 - RNA, 22 nt, Salmonella enterica enterica serovar Typhi
ucgcgcacgcgccgaaugcguu

SEQ ID NO: 1708947 - RNA, 22 nt, Salmonella enterica enterica serovar Typhi
ucgcgcagacaguggccaucuu

SEQ ID NO: 1708948 - RNA, 19 nt, Salmonella enterica enterica serovar Typhi
ucgccgcuuucugagccgc

SEQ ID NO: 1708949 - RNA, 23 nt, Salmonella enterica enterica serovar Typhi
ucgccgcugauucguuuuuacac

SEQ ID NO: 1708950 - RNA, 22 nt, Salmonella enterica enterica serovar Typhi
ucgccgcguuuaagucccuggc

SEQ ID NO: 1708951 - RNA, 16 nt, Salmonella enterica enterica serovar Typhi
ucgccgcggcgcuggc

SEQ ID NO: 1708952 - RNA, 19 nt, Salmonella enterica enterica serovar Typhi
ucgccgcggcgcuggccuu

SEQ ID NO: 1708953 - RNA, 21 nt, Salmonella enterica enterica serovar Typhi
ucgccgcgacgcgcgagcgca

SEQ ID NO: 1708954 - RNA, 12 nt, Salmonella enterica enterica serovar Typhi
ucgccgcgcgca

SEQ ID NO: 1708955 - RNA, 23 nt, Salmonella enterica enterica serovar Typhi
ucgccggagaauccuuccaguag

SEQ ID NO: 1708956 - RNA, 15 nt, Salmonella enterica enterica serovar Typhi
ucgccgggcggcgca

SEQ ID NO: 1708957 - RNA, 15 nt, Salmonella enterica enterica serovar Typhi
ucgccucccugccua

SEQ ID NO: 1708958 - RNA, 18 nt, Salmonella enterica enterica serovar Typhi
ucgccucccugccuaaag

SEQ ID NO: 1708959 - RNA, 16 nt, Salmonella enterica enterica serovar Typhi
ucgccuauuuucucuu

SEQ ID NO: 1708960 - RNA, 15 nt, Salmonella enterica enterica serovar Typhi
ucgccugccagcgcu

SEQ ID NO: 1708961 - RNA, 20 nt, Salmonella enterica enterica serovar Typhi
ucgccugccagcgcucugca

SEQ ID NO: 1708962 - RNA, 23 nt, Salmonella enterica enterica serovar Typhi
ucgccugcgcucauauacccugc

SEQ ID NO: 1708963 - RNA, 19 nt, Salmonella enterica enterica serovar Typhi
ucgccgucguucagccagc

SEQ ID NO: 1708964 - RNA, 18 nt, Salmonella enterica enterica serovar Typhi
ucgccgucguucagccag

SEQ ID NO: 1708965 - RNA, 19 nt, Salmonella enterica enterica serovar Typhi
ucgccgacaugcuccugca

SEQ ID NO: 1708966 - RNA, 14 nt, Salmonella enterica enterica serovar Typhi
ucgcccuuuucgca

SEQ ID NO: 1708967 - RNA, 15 nt, Salmonella enterica enterica serovar Typhi
ucgcccuuuucgcaa

SEQ ID NO: 1708968 - RNA, 18 nt, Salmonella enterica enterica serovar Typhi
ucgcccugcgccagacgc

SEQ ID NO: 1708969 - RNA, 22 nt, Salmonella enterica enterica serovar Typhi
ucgccgccgccagauuauccag

SEQ ID NO: 1708970 - RNA, 15 nt, Salmonella enterica enterica serovar Typhi
ucgccgccaggaacg

SEQ ID NO: 1708971 - RNA, 15 nt, Salmonella enterica enterica serovar Typhi
ucgccaugucaaaug

SEQ ID NO: 1708972 - RNA, 18 nt, Salmonella enterica enterica serovar Typhi
ucgccauuccaagaauga

SEQ ID NO: 1708973 - RNA, 15 nt, Salmonella enterica enterica serovar Typhi
ucgcccacgcccaga

SEQ ID NO: 1708974 - RNA, 22 nt, Salmonella enterica enterica serovar Typhi
ucgcccacgcccagagcgcggc

SEQ ID NO: 1708975 - RNA, 19 nt, Salmonella enterica enterica serovar Typhi
ucgcccagcacuaacagca

SEQ ID NO: 1708976 - RNA, 20 nt, Salmonella enterica enterica serovar Typhi
ucgcccgcguuguccccuca

SEQ ID NO: 1708977 - RNA, 14 nt, Salmonella enterica enterica serovar Typhi
ucgcccguuuuacc

SEQ ID NO: 1708978 - RNA, 21 nt, Salmonella enterica enterica serovar Typhi
ucgccccguaaaccaauacgc

SEQ ID NO: 1708979 - RNA, 20 nt, Salmonella enterica enterica serovar Typhi
ucgcccgccgcaaaaaauac

SEQ ID NO: 1708980 - RNA, 21 nt, Salmonella enterica enterica serovar Typhi
uccauaccggacuccaggcaa

SEQ ID NO: 1708981 - RNA, 18 nt, Salmonella enterica enterica serovar Typhi
ucgccaaagcagcugcug

SEQ ID NO: 1708982 - RNA, 17 nt, Salmonella enterica enterica serovar Typhi
ucgccaaagcagugaau

SEQ ID NO: 1708983 - RNA, 15 nt, Salmonella enterica enterica serovar Typhi
ucgccaaagcgcugc

SEQ ID NO: 1708984 - RNA, 20 nt, Salmonella enterica enterica serovar Typhi
ucgccaaagucauugcugcc

SEQ ID NO: 1708985 - RNA, 21 nt, Salmonella enterica enterica serovar Typhi
ucgccaaauuuagugcucagc

SEQ ID NO: 1708986 - RNA, 22 nt, Salmonella enterica enterica serovar Typhi
ucgccaacaccgauccgaagaa

SEQ ID NO: 1708987 - RNA, 22 nt, Salmonella enterica enterica serovar Typhi
ucgccacguauuucgcagcggu

SEQ ID NO: 1708988 - RNA, 18 nt, Salmonella enterica enterica serovar Typhi
ucgccagaccgaaaagcc

SEQ ID NO: 1708989 - RNA, 17 nt, Salmonella enterica enterica serovar Typhi
ucgccagacccagcgcu

SEQ ID NO: 1708990 - RNA, 17 nt, Salmonella enterica enterica serovar Typhi
ucgccagaaggcaggcu

SEQ ID NO: 1708991 - RNA, 16 nt, Salmonella enterica enterica serovar Typhi
ucgccaauuaaauauc

SEQ ID NO: 1708992 - RNA, 16 nt, Salmonella enterica enterica serovar Typhi
ucgccaccacauucag

SEQ ID NO: 1708993 - RNA, 15 nt, Salmonella enterica enterica serovar Typhi
ucgccaccaccagcg

SEQ ID NO: 1708994 - RNA, 23 nt, Salmonella enterica enterica serovar Typhi
ucgccacccggcuuuuuuauugc

SEQ ID NO: 1708995 - RNA, 17 nt, Salmonella enterica enterica serovar Typhi
ucgccaccaugcugguu

SEQ ID NO: 1708996 - RNA, 13 nt, Salmonella enterica enterica serovar Typhi
ucgccaccgcauu

SEQ ID NO: 1708997 - RNA, 18 nt, Salmonella enterica enterica serovar Typhi
ucgccaccgcauuuucag

SEQ ID NO: 1708998 - RNA, 21 nt, Salmonella enterica enterica serovar Typhi
ucgccaccgcauuuucagcuu

SEQ ID NO: 1708999 - RNA, 18 nt, Salmonella enterica enterica serovar Typhi
ucgccauauguuccaccg

SEQ ID NO: 1709000 - RNA, 13 nt, Salmonella enterica enterica serovar Typhi
ucgccaucaccag

SEQ ID NO: 1709001 - RNA, 12 nt, Salmonella enterica enterica serovar Typhi
ucgccauaucuu

SEQ ID NO: 1709002 - RNA, 20 nt, Salmonella enterica enterica serovar Typhi
ucgccauccggcaaauccuc

SEQ ID NO: 1709003 - RNA, 16 nt, Salmonella enterica enterica serovar Typhi
ucgccauacaucgcgu

SEQ ID NO: 1709004 - RNA, 15 nt, Salmonella enterica enterica serovar Typhi
ucgccaguaagggga

SEQ ID NO: 1709005 - RNA, 15 nt, Salmonella enterica enterica serovar Typhi
ucgccagcguuagca

SEQ ID NO: 1709006 - RNA, 15 nt, Salmonella enterica enterica serovar Typhi
ucgccagcagcgcga

SEQ ID NO: 1709007 - RNA, 11 nt, Salmonella enterica enterica serovar Typhi
ucgccagcaac

SEQ ID NO: 1709008 - RNA, 16 nt, Salmonella enterica enterica serovar Typhi
ucgccagccccagccc

SEQ ID NO: 1709009 - RNA, 19 nt, Salmonella enterica enterica serovar Typhi
ucgccagccugaacaucuu

SEQ ID NO: 1709010 - RNA, 19 nt, Salmonella enterica enterica serovar Typhi
ucgccagccauucaccacu

SEQ ID NO: 1709011 - RNA, 14 nt, Salmonella enterica enterica serovar Typhi
ucgccagccccagc

SEQ ID NO: 1709012 - RNA, 18 nt, Salmonella enterica enterica serovar Typhi
ucgcugaauuucucguga

SEQ ID NO: 1709013 - RNA, 17 nt, Salmonella enterica enterica serovar Typhi
ucgcugacauugcuacg

SEQ ID NO: 1709014 - RNA, 22 nt, Salmonella enterica enterica serovar Typhi
ucgcucuaucgccuggagcuga

SEQ ID NO: 1709015 - RNA, 21 nt, Salmonella enterica enterica serovar Typhi
ucgcugacgccgaccaccgcc

SEQ ID NO: 1709016 - RNA, 22 nt, Salmonella enterica enterica serovar Typhi
ucgcugacgccgaccaccgccc

SEQ ID NO: 1709017 - RNA, 18 nt, Salmonella enterica enterica serovar Typhi
ucgcuggcguagauauuc

SEQ ID NO: 1709018 - RNA, 18 nt, Salmonella enterica enterica serovar Typhi
ucgcuguauuucccucuc

SEQ ID NO: 1709019 - RNA, 15 nt, Salmonella enterica enterica serovar Typhi
ucgcugcugcuuuuu

SEQ ID NO: 1709020 - RNA, 16 nt, Salmonella enterica enterica serovar Typhi
ucgcucgcgccacgca

SEQ ID NO: 1709021 - RNA, 21 nt, Salmonella enterica enterica serovar Typhi
ucgcucgacauagguucugcg

SEQ ID NO: 1709022 - RNA, 16 nt, Salmonella enterica enterica serovar Typhi
ucgcucaucucaagcc

SEQ ID NO: 1709023 - RNA, 18 nt, Salmonella enterica enterica serovar Typhi
ucgcucaggacagguucc

SEQ ID NO: 1709024 - RNA, 18 nt, Salmonella enterica enterica serovar Typhi
ucgcguuuuucgaaaauu

SEQ ID NO: 1709025 - RNA, 16 nt, Salmonella enterica enterica serovar Typhi
ucgcuauauacccccu

SEQ ID NO: 1709026 - RNA, 13 nt, Salmonella enterica enterica serovar Typhi
ucgcuauccagca

SEQ ID NO: 1709027 - RNA, 22 nt, Salmonella enterica enterica serovar Typhi
ucgcuauccgcauauguuuagu

SEQ ID NO: 1709028 - RNA, 17 nt, Salmonella enterica enterica serovar Typhi
ucgcguucuggaaguga

SEQ ID NO: 1709029 - RNA, 18 nt, Salmonella enterica enterica serovar Typhi
ucgcguuauagccgccaa

SEQ ID NO: 1709030 - RNA, 17 nt, Salmonella enterica enterica serovar Typhi
ucgcggugaucccaggc

SEQ ID NO: 1709031 - RNA, 21 nt, Salmonella enterica enterica serovar Typhi
ucgcguacagcgccaugaaga

SEQ ID NO: 1709032 - RNA, 17 nt, Salmonella enterica enterica serovar Typhi
ucgcggcugguacggcg

SEQ ID NO: 1709033 - RNA, 19 nt, Salmonella enterica enterica serovar Typhi
ucgcgguaacggccuggcu

SEQ ID NO: 1709034 - RNA, 16 nt, Salmonella enterica enterica serovar Typhi
ucgcgguacuucugac

SEQ ID NO: 1709035 - RNA, 14 nt, Salmonella enterica enterica serovar Typhi
ucgcgguaaaaagc

SEQ ID NO: 1709036 - RNA, 15 nt, Salmonella enterica enterica serovar Typhi
ucgcgguaaaaagcu

SEQ ID NO: 1709037 - RNA, 19 nt, Salmonella enterica enterica serovar Typhi
ucgcggauaugcagcagcc

SEQ ID NO: 1709038 - RNA, 17 nt, Salmonella enterica enterica serovar Typhi
ucgcggaauuucaggaa

SEQ ID NO: 1709039 - RNA, 14 nt, Salmonella enterica enterica serovar Typhi
ucgcgcuauaucag

SEQ ID NO: 1709040 - RNA, 22 nt, Salmonella enterica enterica serovar Typhi
ucgcgcggcgguucauccugcg

SEQ ID NO: 1709041 - RNA, 19 nt, Salmonella enterica enterica serovar Typhi
ucgcgccgugcccagcauc

SEQ ID NO: 1709042 - RNA, 15 nt, Salmonella enterica enterica serovar Typhi
ucgcgccuccccugc

SEQ ID NO: 1709043 - RNA, 16 nt, Salmonella enterica enterica serovar Typhi
ucgcgccuccccugcc

SEQ ID NO: 1709044 - RNA, 23 nt, Salmonella enterica enterica serovar Typhi
ucgcuuuuacucuuccugcugcg

SEQ ID NO: 1709045 - RNA, 15 nt, Salmonella enterica enterica serovar Typhi
ucgcuuuuacucuuc

SEQ ID NO: 1709046 - RNA, 19 nt, Salmonella enterica enterica serovar Typhi
ucgcuuuuauguuacccag

SEQ ID NO: 1709047 - RNA, 19 nt, Salmonella enterica enterica serovar Typhi
ucgcuugcccagcauauua

SEQ ID NO: 1709048 - RNA, 12 nt, Salmonella enterica enterica serovar Typhi
ucgcuuguuuca

SEQ ID NO: 1709049 - RNA, 23 nt, Salmonella enterica enterica serovar Typhi
ucgcuuaaauggcgaaagugaac

SEQ ID NO: 1709050 - RNA, 13 nt, Salmonella enterica enterica serovar Typhi
ucgcuguggccag

SEQ ID NO: 1709051 - RNA, 20 nt, Salmonella enterica enterica serovar Typhi
ucgcugucggucagauucag

SEQ ID NO: 1709052 - RNA, 20 nt, Salmonella enterica enterica serovar Typhi
ucggaauaauguaaaaaaau

SEQ ID NO: 1709053 - RNA, 21 nt, Salmonella enterica enterica serovar Typhi
ucggaauauugguaccgagga

SEQ ID NO: 1709054 - RNA, 21 nt, Salmonella enterica enterica serovar Typhi
ucggacacgacguggacgcug

SEQ ID NO: 1709055 - RNA, 18 nt, Salmonella enterica enterica serovar Typhi
ucggaacgcgacucccag

SEQ ID NO: 1709056 - RNA, 19 nt, Salmonella enterica enterica serovar Typhi
ucggaagacuggcgcagca

SEQ ID NO: 1709057 - RNA, 21 nt, Salmonella enterica enterica serovar Typhi
ucggaagacugcuccggcaag

SEQ ID NO: 1709058 - RNA, 18 nt, Salmonella enterica enterica serovar Typhi
ucggaagacuggcgcagc

SEQ ID NO: 1709059 - RNA, 19 nt, Salmonella enterica enterica serovar Typhi
ucggaaacuauccuggccu

SEQ ID NO: 1709060 - RNA, 20 nt, Salmonella enterica enterica serovar Typhi
ucggagguuuucucauccag

SEQ ID NO: 1709061 - RNA, 22 nt, Salmonella enterica enterica serovar Typhi
ucggcaugauggcgaacagccc

SEQ ID NO: 1709062 - RNA, 18 nt, Salmonella enterica enterica serovar Typhi
ucggccaaccgccacaau

SEQ ID NO: 1709063 - RNA, 15 nt, Salmonella enterica enterica serovar Typhi
ucggccaaccgccac

SEQ ID NO: 1709064 - RNA, 12 nt, Salmonella enterica enterica serovar Typhi
ucggccaccauu

SEQ ID NO: 1709065 - RNA, 17 nt, Salmonella enterica enterica serovar Typhi
ucggcaugcaucucuuc

SEQ ID NO: 1709066 - RNA, 16 nt, Salmonella enterica enterica serovar Typhi
ucggcaugccacuggg

SEQ ID NO: 1709067 - RNA, 18 nt, Salmonella enterica enterica serovar Typhi
ucggcaucuguagcggcg

SEQ ID NO: 1709068 - RNA, 23 nt, Salmonella enterica enterica serovar Typhi
ucggcauacaccgccagcgucug

SEQ ID NO: 1709069 - RNA, 20 nt, Salmonella enterica enterica serovar Typhi
ucggcauagcgggagauuga

SEQ ID NO: 1709070 - RNA, 13 nt, Salmonella enterica enterica serovar Typhi
ucggcauaucgcc

SEQ ID NO: 1709071 - RNA, 21 nt, Salmonella enterica enterica serovar Typhi
ucggcacugacucuuccgggc

SEQ ID NO: 1709072 - RNA, 19 nt, Salmonella enterica enterica serovar Typhi
ucggcaccauucccacgca

SEQ ID NO: 1709073 - RNA, 16 nt, Salmonella enterica enterica serovar Typhi
ucggcagucacuuuca

SEQ ID NO: 1709074 - RNA, 17 nt, Salmonella enterica enterica serovar Typhi
ucggcagcuuccagcaa

SEQ ID NO: 1709075 - RNA, 13 nt, Salmonella enterica enterica serovar Typhi
ucggcagcgccag

SEQ ID NO: 1709076 - RNA, 17 nt, Salmonella enterica enterica serovar Typhi
ucggcaauauugccgca

SEQ ID NO: 1709077 - RNA, 16 nt, Salmonella enterica enterica serovar Typhi
ucggcaaauucuuuuc

SEQ ID NO: 1709078 - RNA, 19 nt, Salmonella enterica enterica serovar Typhi
ucggcaagaauuucaauca

SEQ ID NO: 1709079 - RNA, 14 nt, Salmonella enterica enterica serovar Typhi
ucggcaaagucuuu

SEQ ID NO: 1709080 - RNA, 19 nt, Salmonella enterica enterica serovar Typhi
ucggcaaagcacugcugcu

SEQ ID NO: 1709081 - RNA, 17 nt, Salmonella enterica enterica serovar Typhi
ucggcaaacagcuucau

SEQ ID NO: 1709082 - RNA, 14 nt, Salmonella enterica enterica serovar Typhi
ucggauguacugua

SEQ ID NO: 1709083 - RNA, 19 nt, Salmonella enterica enterica serovar Typhi
ucggauaaggcguuuacgc

SEQ ID NO: 1709084 - RNA, 23 nt, Salmonella enterica enterica serovar Typhi
ucgggcaggcuuccacgcacgcc

SEQ ID NO: 1709085 - RNA, 13 nt, Salmonella enterica enterica serovar Typhi
ucgggccaaucgg

SEQ ID NO: 1709086 - RNA, 17 nt, Salmonella enterica enterica serovar Typhi
ucgggucgaauuccagu

SEQ ID NO: 1709087 - RNA, 19 nt, Salmonella enterica enterica serovar Typhi
ucgggugauaaaauaaaca

SEQ ID NO: 1709088 - RNA, 22 nt, Salmonella enterica enterica serovar Typhi
ucggguaaggcguagccgccac

SEQ ID NO: 1709089 - RNA, 17 nt, Salmonella enterica enterica serovar Typhi
ucggguaaagguuugcu

SEQ ID NO: 1709090 - RNA, 14 nt, Salmonella enterica enterica serovar Typhi
ucgguaaagaaacc

SEQ ID NO: 1709091 - RNA, 21 nt, Salmonella enterica enterica serovar Typhi
ucggguucacuuuaccaggca

SEQ ID NO: 1709092 - RNA, 17 nt, Salmonella enterica enterica serovar Typhi
ucggguucggcggugcc

SEQ ID NO: 1709093 - RNA, 13 nt, Salmonella enterica enterica serovar Typhi
ucggguuuuccug

SEQ ID NO: 1709094 - RNA, 15 nt, Salmonella enterica enterica serovar Typhi
ucgguacuccccuuu

SEQ ID NO: 1709095 - RNA, 22 nt, Salmonella enterica enterica serovar Typhi
ucgguagcuguaccagaucgcc

SEQ ID NO: 1709096 - RNA, 18 nt, Salmonella enterica enterica serovar Typhi
ucgguagaaugaauguag

SEQ ID NO: 1709097 - RNA, 16 nt, Salmonella enterica enterica serovar Typhi
ucgguuuguaagugcc

SEQ ID NO: 1709098 - RNA, 20 nt, Salmonella enterica enterica serovar Typhi
ucguaaacacgacgccgccg

SEQ ID NO: 1709099 - RNA, 19 nt, Salmonella enterica enterica serovar Typhi
ucguaaagcgcauccagcu

SEQ ID NO: 1709100 - RNA, 17 nt, Salmonella enterica enterica serovar Typhi
ucggucgagcuuuugcu

SEQ ID NO: 1709101 - RNA, 19 nt, Salmonella enterica enterica serovar Typhi
ucggugaagaaaaagaagc

SEQ ID NO: 1709102 - RNA, 14 nt, Salmonella enterica enterica serovar Typhi
ucggucaggcugcg

SEQ ID NO: 1709103 - RNA, 16 nt, Salmonella enterica enterica serovar Typhi
ucggucaacauuccgu

SEQ ID NO: 1709104 - RNA, 19 nt, Salmonella enterica enterica serovar Typhi
ucggugacggaaaccagca

SEQ ID NO: 1709105 - RNA, 14 nt, Salmonella enterica enterica serovar Typhi
ucggugauccagca

SEQ ID NO: 1709106 - RNA, 17 nt, Salmonella enterica enterica serovar Typhi
ucggcgccagccacaag

SEQ ID NO: 1709107 - RNA, 18 nt, Salmonella enterica enterica serovar Typhi
ucggcgauugucaucauu

SEQ ID NO: 1709108 - RNA, 17 nt, Salmonella enterica enterica serovar Typhi
ucggcgaggggcaggcg

SEQ ID NO: 1709109 - RNA, 17 nt, Salmonella enterica enterica serovar Typhi
ucggccagcaagcggcg

SEQ ID NO: 1709110 - RNA, 17 nt, Salmonella enterica enterica serovar Typhi
ucggcuaguaauaccag

SEQ ID NO: 1709111 - RNA, 22 nt, Salmonella enterica enterica serovar Typhi
ucggcuggcauuuuuauuuaac

SEQ ID NO: 1709112 - RNA, 18 nt, Salmonella enterica enterica serovar Typhi
ucgggauauaugcaaaac

SEQ ID NO: 1709113 - RNA, 21 nt, Salmonella enterica enterica serovar Typhi
ucgggaaucaucgaggccacc

SEQ ID NO: 1709114 - RNA, 14 nt, Salmonella enterica enterica serovar Typhi
ucggcuuucaccuu

SEQ ID NO: 1709115 - RNA, 23 nt, Salmonella enterica enterica serovar Typhi
ucggcuuuuuuuuaugccucuua

SEQ ID NO: 1709116 - RNA, 14 nt, Salmonella enterica enterica serovar Typhi
ucggcuuuuuucaa

SEQ ID NO: 1709117 - RNA, 23 nt, Salmonella enterica enterica serovar Typhi
ucggcuuuguaucagcauuuaca

SEQ ID NO: 1709118 - RNA, 18 nt, Salmonella enterica enterica serovar Typhi
ucggcuuuuguucccgca

SEQ ID NO: 1709119 - RNA, 20 nt, Salmonella enterica enterica serovar Typhi
ucggcgggcaggucgucuuc

SEQ ID NO: 1709120 - RNA, 18 nt, Salmonella enterica enterica serovar Typhi
ucggcguaacccagugca

SEQ ID NO: 1709121 - RNA, 19 nt, Salmonella enterica enterica serovar Typhi
ucggcguaacccagugcaa

SEQ ID NO: 1709122 - RNA, 19 nt, Salmonella enterica enterica serovar Typhi
ucggcgucgugcugggcgc

SEQ ID NO: 1709123 - RNA, 13 nt, Salmonella enterica enterica serovar Typhi
ucggcgucuggag

SEQ ID NO: 1709124 - RNA, 20 nt, Salmonella enterica enterica serovar Typhi
ucggcgucaacguuuuucag

SEQ ID NO: 1709125 - RNA, 17 nt, Salmonella enterica enterica serovar Typhi
ucggcgugaauaaaaua

SEQ ID NO: 1709126 - RNA, 14 nt, Salmonella enterica enterica serovar Typhi
ucggcgccggcguc

SEQ ID NO: 1709127 - RNA, 13 nt, Salmonella enterica enterica serovar Typhi
ucggcgcgcuggc

SEQ ID NO: 1709128 - RNA, 15 nt, Salmonella enterica enterica serovar Typhi
ucguccaguaaaauc

SEQ ID NO: 1709129 - RNA, 21 nt, Salmonella enterica enterica serovar Typhi
ucgucagacggacaucagagg

SEQ ID NO: 1709130 - RNA, 21 nt, Salmonella enterica enterica serovar Typhi
ucgucaggccgccgcaaaagc

SEQ ID NO: 1709131 - RNA, 21 nt, Salmonella enterica enterica serovar Typhi
ucgucagaugcguuuucugca

SEQ ID NO: 1709132 - RNA, 19 nt, Salmonella enterica enterica serovar Typhi
ucgucauuaacgggaaacu

SEQ ID NO: 1709133 - RNA, 15 nt, Salmonella enterica enterica serovar Typhi
ucgucauuaaugccu

SEQ ID NO: 1709134 - RNA, 23 nt, Salmonella enterica enterica serovar Typhi
ucgucauagugagcgacuucaaa

SEQ ID NO: 1709135 - RNA, 12 nt, Salmonella enterica enterica serovar Typhi
ucguccugcaau

SEQ ID NO: 1709136 - RNA, 23 nt, Salmonella enterica enterica serovar Typhi
ucgucgccaccaugcugguuggg

SEQ ID NO: 1709137 - RNA, 16 nt, Salmonella enterica enterica serovar Typhi
ucgucgccuuccagcg

SEQ ID NO: 1709138 - RNA, 14 nt, Salmonella enterica enterica serovar Typhi
ucguacguuuuucc

SEQ ID NO: 1709139 - RNA, 11 nt, Salmonella enterica enterica serovar Typhi
ucguaccuuca

SEQ ID NO: 1709140 - RNA, 16 nt, Salmonella enterica enterica serovar Typhi
ucguacauguccagau

SEQ ID NO: 1709141 - RNA, 14 nt, Salmonella enterica enterica serovar Typhi
ucguagaacaccac

SEQ ID NO: 1709142 - RNA, 15 nt, Salmonella enterica enterica serovar Typhi
ucguagacucaggcg

SEQ ID NO: 1709143 - RNA, 18 nt, Salmonella enterica enterica serovar Typhi
ucguagccaccaucuuuu

SEQ ID NO: 1709144 - RNA, 16 nt, Salmonella enterica enterica serovar Typhi
ucguaaucuaaaauua

SEQ ID NO: 1709145 - RNA, 22 nt, Salmonella enterica enterica serovar Typhi
ucguaacgcauauccagcagau

SEQ ID NO: 1709146 - RNA, 12 nt, Salmonella enterica enterica serovar Typhi
ucgucaccagca

SEQ ID NO: 1709147 - RNA, 19 nt, Salmonella enterica enterica serovar Typhi
ucgucaccugauagcgggu

SEQ ID NO: 1709148 - RNA, 22 nt, Salmonella enterica enterica serovar Typhi
ucgucacaauaugguuauccag

SEQ ID NO: 1709149 - RNA, 13 nt, Salmonella enterica enterica serovar Typhi
ucgucacagaccc

SEQ ID NO: 1709150 - RNA, 15 nt, Salmonella enterica enterica serovar Typhi
ucguauuuauuuucu

SEQ ID NO: 1709151 - RNA, 18 nt, Salmonella enterica enterica serovar Typhi
ucguaguggaucagcaga

SEQ ID NO: 1709152 - RNA, 20 nt, Salmonella enterica enterica serovar Typhi
ucgucugguaucugucaugc

SEQ ID NO: 1709153 - RNA, 14 nt, Salmonella enterica enterica serovar Typhi
ucgucuuauuucgu

SEQ ID NO: 1709154 - RNA, 16 nt, Salmonella enterica enterica serovar Typhi
ucgucugacgcuugca

SEQ ID NO: 1709155 - RNA, 21 nt, Salmonella enterica enterica serovar Typhi
ucgucuauuuccgcuucgcuu

SEQ ID NO: 1709156 - RNA, 17 nt, Salmonella enterica enterica serovar Typhi
ucgugacccgccagcau

SEQ ID NO: 1709157 - RNA, 12 nt, Salmonella enterica enterica serovar Typhi
ucgugacccgcc

SEQ ID NO: 1709158 - RNA, 12 nt, Salmonella enterica enterica serovar Typhi
ucgugauaaacg

SEQ ID NO: 1709159 - RNA, 23 nt, Salmonella enterica enterica serovar Typhi
ucgucuuguguggagguuucuuc

SEQ ID NO: 1709160 - RNA, 14 nt, Salmonella enterica enterica serovar Typhi
ucgugcgccccagg

SEQ ID NO: 1709161 - RNA, 18 nt, Salmonella enterica enterica serovar Typhi
ucgugcaaccgccugcac

SEQ ID NO: 1709162 - RNA, 20 nt, Salmonella enterica enterica serovar Typhi
ucgugcaggauucgaaccug

SEQ ID NO: 1709163 - RNA, 15 nt, Salmonella enterica enterica serovar Typhi
ucgugcagcgccgcc

SEQ ID NO: 1709164 - RNA, 19 nt, Salmonella enterica enterica serovar Typhi
ucguguuauuuucaaaaac

SEQ ID NO: 1709165 - RNA, 16 nt, Salmonella enterica enterica serovar Typhi
ucguggcgcuguucuu

SEQ ID NO: 1709166 - RNA, 19 nt, Salmonella enterica enterica serovar Typhi
ucguggcgcuguucuugcu

SEQ ID NO: 1709167 - RNA, 16 nt, Salmonella enterica enterica serovar Typhi
ucguuacccuccugca

SEQ ID NO: 1709168 - RNA, 19 nt, Salmonella enterica enterica serovar Typhi
ucguuaaugcuguccugca

SEQ ID NO: 1709169 - RNA, 14 nt, Salmonella enterica enterica serovar Typhi
ucguuaccgcuuca

SEQ ID NO: 1709170 - RNA, 23 nt, Salmonella enterica enterica serovar Typhi
ucguuagugauacgcggcugaug

SEQ ID NO: 1709171 - RNA, 20 nt, Salmonella enterica enterica serovar Typhi
ucguuagcaaauugcugaug

SEQ ID NO: 1709172 - RNA, 16 nt, Salmonella enterica enterica serovar Typhi
ucguuagcaaauugcu

SEQ ID NO: 1709173 - RNA, 22 nt, Salmonella enterica enterica serovar Typhi
ucguuaaucucaaacuuggcca

SEQ ID NO: 1709174 - RNA, 16 nt, Salmonella enterica enterica serovar Typhi
ucguuaaccagcggcg

SEQ ID NO: 1709175 - RNA, 19 nt, Salmonella enterica enterica serovar Typhi
ucguuauuuuccugaaaaa

SEQ ID NO: 1709176 - RNA, 13 nt, Salmonella enterica enterica serovar Typhi
ucguuauuuccga

SEQ ID NO: 1709177 - RNA, 15 nt, Salmonella enterica enterica serovar Typhi
ucguuccgccaggcg

SEQ ID NO: 1709178 - RNA, 17 nt, Salmonella enterica enterica serovar Typhi
ucguucccguuuauguu

SEQ ID NO: 1709179 - RNA, 16 nt, Salmonella enterica enterica serovar Typhi
ucguucccgccugcug

SEQ ID NO: 1709180 - RNA, 19 nt, Salmonella enterica enterica serovar Typhi
ucguucggucaggauacua

SEQ ID NO: 1709181 - RNA, 14 nt, Salmonella enterica enterica serovar Typhi
ucguugccauuggu

SEQ ID NO: 1709182 - RNA, 12 nt, Salmonella enterica enterica serovar Typhi
ucguugcgccug

SEQ ID NO: 1709183 - RNA, 21 nt, Salmonella enterica enterica serovar Typhi
ucguuggcauggucagcauaa

SEQ ID NO: 1709184 - RNA, 21 nt, Salmonella enterica enterica serovar Typhi
ucguuggcgccaaaaccgcuc

SEQ ID NO: 1709185 - RNA, 20 nt, Salmonella enterica enterica serovar Typhi
ucguuuacaccuauuccucc

SEQ ID NO: 1709186 - RNA, 15 nt, Salmonella enterica enterica serovar Typhi
ucguuugcaguuccg

SEQ ID NO: 1709187 - RNA, 13 nt, Salmonella enterica enterica serovar Typhi
ucguuucuacaau

SEQ ID NO: 1709188 - RNA, 22 nt, Salmonella enterica enterica serovar Typhi
ucuccagggcaacggccagcgc

SEQ ID NO: 1709189 - RNA, 18 nt, Salmonella enterica enterica serovar Typhi
ucucauuguguacaucca

SEQ ID NO: 1709190 - RNA, 17 nt, Salmonella enterica enterica serovar Typhi
ucucauuauuaaauuaa

SEQ ID NO: 1709191 - RNA, 19 nt, Salmonella enterica enterica serovar Typhi
ucucauuuucuuuacgcua

SEQ ID NO: 1709192 - RNA, 14 nt, Salmonella enterica enterica serovar Typhi
ucuccaguuugcgu

SEQ ID NO: 1709193 - RNA, 20 nt, Salmonella enterica enterica serovar Typhi
ucuccaucgggcucggcgcu

SEQ ID NO: 1709194 - RNA, 15 nt, Salmonella enterica enterica serovar Typhi
ucucccaaaugaaaa

SEQ ID NO: 1709195 - RNA, 14 nt, Salmonella enterica enterica serovar Typhi
ucucccaucaauaa

SEQ ID NO: 1709196 - RNA, 17 nt, Salmonella enterica enterica serovar Typhi
ucucccaaaugaaaaau

SEQ ID NO: 1709197 - RNA, 20 nt, Salmonella enterica enterica serovar Typhi
ucucccagccgggcaggaaa

SEQ ID NO: 1709198 - RNA, 16 nt, Salmonella enterica enterica serovar Typhi
ucucccugccagugaa

SEQ ID NO: 1709199 - RNA, 13 nt, Salmonella enterica enterica serovar Typhi
ucucccuggcagu

SEQ ID NO: 1709200 - RNA, 18 nt, Salmonella enterica enterica serovar Typhi
ucucccgaucuucugaug

SEQ ID NO: 1709201 - RNA, 13 nt, Salmonella enterica enterica serovar Typhi
ucucccgggccgc

SEQ ID NO: 1709202 - RNA, 22 nt, Salmonella enterica enterica serovar Typhi
ucucccuacugcuuagcucauc

SEQ ID NO: 1709203 - RNA, 21 nt, Salmonella enterica enterica serovar Typhi
ucucgcuauauacccccugca

SEQ ID NO: 1709204 - RNA, 17 nt, Salmonella enterica enterica serovar Typhi
ucucgccaaaccacacc

SEQ ID NO: 1709205 - RNA, 15 nt, Salmonella enterica enterica serovar Typhi
ucuccuuucggccac

SEQ ID NO: 1709206 - RNA, 19 nt, Salmonella enterica enterica serovar Typhi
ucuccgggaaaaacguguc

SEQ ID NO: 1709207 - RNA, 15 nt, Salmonella enterica enterica serovar Typhi
ucuccguuguugcac

SEQ ID NO: 1709208 - RNA, 22 nt, Salmonella enterica enterica serovar Typhi
ucuccucacgcccugaagggcg

SEQ ID NO: 1709209 - RNA, 17 nt, Salmonella enterica enterica serovar Typhi
ucuccucgccagcuacc

SEQ ID NO: 1709210 - RNA, 15 nt, Salmonella enterica enterica serovar Typhi
ucuccugcgccagcc

SEQ ID NO: 1709211 - RNA, 20 nt, Salmonella enterica enterica serovar Typhi
ucuccugaagccagugcccg

SEQ ID NO: 1709212 - RNA, 21 nt, Salmonella enterica enterica serovar Typhi
ucuccugcgauagcugcugac

SEQ ID NO: 1709213 - RNA, 18 nt, Salmonella enterica enterica serovar Typhi
ucuccuugagugguuuau

SEQ ID NO: 1709214 - RNA, 19 nt, Salmonella enterica enterica serovar Typhi
ucuccuggcgcagcgcggg

SEQ ID NO: 1709215 - RNA, 21 nt, Salmonella enterica enterica serovar Typhi
ucuccuguaaugaggcaaauc

SEQ ID NO: 1709216 - RNA, 21 nt, Salmonella enterica enterica serovar Typhi
ucucggccuggcccggcaguu

SEQ ID NO: 1709217 - RNA, 21 nt, Salmonella enterica enterica serovar Typhi
ucucguuuuugucuccucaug

SEQ ID NO: 1709218 - RNA, 20 nt, Salmonella enterica enterica serovar Typhi
ucucucucguucccgccugc

SEQ ID NO: 1709219 - RNA, 14 nt, Salmonella enterica enterica serovar Typhi
ucucucccuggcag

SEQ ID NO: 1709220 - RNA, 15 nt, Salmonella enterica enterica serovar Typhi
ucucugagaucaaac

SEQ ID NO: 1709221 - RNA, 21 nt, Salmonella enterica enterica serovar Typhi
ucucuucguguaacgcauaca

SEQ ID NO: 1709222 - RNA, 17 nt, Salmonella enterica enterica serovar Typhi
aaauggagcgagcuggu

SEQ ID NO: 1709223 - RNA, 22 nt, Salmonella enterica enterica serovar Typhi
aaauggaaaauaauaaucguuu

SEQ ID NO: 1709224 - RNA, 14 nt, Salmonella enterica enterica serovar Typhi
ucucuucuuuuaca

SEQ ID NO: 1709225 - RNA, 17 nt, Salmonella enterica enterica serovar Typhi
ucucuugcauaauaucc

SEQ ID NO: 1709226 - RNA, 16 nt, Salmonella enterica enterica serovar Typhi
ucugacauauacaaac

SEQ ID NO: 1709227 - RNA, 17 nt, Salmonella enterica enterica serovar Typhi
ucugacaggucggcguu

SEQ ID NO: 1709228 - RNA, 22 nt, Salmonella enterica enterica serovar Typhi
ucugaaaguaagcuauuccugu

SEQ ID NO: 1709229 - RNA, 23 nt, Salmonella enterica enterica serovar Typhi
ucugaaaguaagcuauuccugua

SEQ ID NO: 1709230 - RNA, 14 nt, Salmonella enterica enterica serovar Typhi
ucucuuucaccagc

SEQ ID NO: 1709231 - RNA, 19 nt, Salmonella enterica enterica serovar Typhi
ucugaaaaggggauaacaa

SEQ ID NO: 1709232 - RNA, 13 nt, Salmonella enterica enterica serovar Typhi
ucucuuuauugaa

SEQ ID NO: 1709233 - RNA, 14 nt, Salmonella enterica enterica serovar Typhi
ucucuuuagcgcua

SEQ ID NO: 1709234 - RNA, 13 nt, Salmonella enterica enterica serovar Typhi
ucugaaacgcuuc

SEQ ID NO: 1709235 - RNA, 22 nt, Salmonella enterica enterica serovar Typhi
ucugcaaugguaaaacgcuggc

SEQ ID NO: 1709236 - RNA, 16 nt, Salmonella enterica enterica serovar Typhi
ucugcaccacgguguc

SEQ ID NO: 1709237 - RNA, 24 nt, Salmonella enterica enterica serovar Typhi
ucugauaacgcaggcgauagcccc

SEQ ID NO: 1709238 - RNA, 15 nt, Salmonella enterica enterica serovar Typhi
ucugaguauguuagg

SEQ ID NO: 1709239 - RNA, 16 nt, Salmonella enterica enterica serovar Typhi
ucugcaagagaaauaa

SEQ ID NO: 1709240 - RNA, 19 nt, Salmonella enterica enterica serovar Typhi
ucugauacugcuccggcgc

SEQ ID NO: 1709241 - RNA, 16 nt, Salmonella enterica enterica serovar Typhi
ucuuaucgugcgcgua

SEQ ID NO: 1709242 - RNA, 14 nt, Salmonella enterica enterica serovar Typhi
ucuucaacgugcau

SEQ ID NO: 1709243 - RNA, 24 nt, Salmonella enterica enterica serovar Typhi
ucuuagguucguagcgcaaauauc

SEQ ID NO: 1709244 - RNA, 15 nt, Salmonella enterica enterica serovar Typhi
ucuuaguaucccuuu

SEQ ID NO: 1709245 - RNA, 21 nt, Salmonella enterica enterica serovar Typhi
ucuuauaaaggucaaacaccu

SEQ ID NO: 1709246 - RNA, 16 nt, Salmonella enterica enterica serovar Typhi
ucuuacggauaaaaac

SEQ ID NO: 1709247 - RNA, 22 nt, Salmonella enterica enterica serovar Typhi
ucuuacguugcauuuaucaauc

SEQ ID NO: 1709248 - RNA, 14 nt, Salmonella enterica enterica serovar Typhi
ucuuaccucuccug

SEQ ID NO: 1709249 - RNA, 14 nt, Salmonella enterica enterica serovar Typhi
ucuuaguaacauaa

SEQ ID NO: 1709250 - RNA, 12 nt, Salmonella enterica enterica serovar Typhi
ucuuacauaaga

SEQ ID NO: 1709251 - RNA, 17 nt, Salmonella enterica enterica serovar Typhi
ucuuacacuuagcacaa

SEQ ID NO: 1709252 - RNA, 23 nt, Salmonella enterica enterica serovar Typhi
ucuuaccgcuaaaauacccgacc

SEQ ID NO: 1709253 - RNA, 21 nt, Salmonella enterica enterica serovar Typhi
ucuguuucaguucggagauca

SEQ ID NO: 1709254 - RNA, 22 nt, Salmonella enterica enterica serovar Typhi
ucuguuucaguucggagaucag

SEQ ID NO: 1709255 - RNA, 18 nt, Salmonella enterica enterica serovar Typhi
ucuguucuacuacagaaa

SEQ ID NO: 1709256 - RNA, 21 nt, Salmonella enterica enterica serovar Typhi
ucuguucuacuacagaaagcc

SEQ ID NO: 1709257 - RNA, 23 nt, Salmonella enterica enterica serovar Typhi
ucuguucuacuacagaaagccau

SEQ ID NO: 1709258 - RNA, 22 nt, Salmonella enterica enterica serovar Typhi
ucugugucguccaggccugaua

SEQ ID NO: 1709259 - RNA, 11 nt, Salmonella enterica enterica serovar Typhi
ucuguuauuuc

SEQ ID NO: 1709260 - RNA, 23 nt, Salmonella enterica enterica serovar Typhi
ucuguuaucaggcguagagaggc

SEQ ID NO: 1709261 - RNA, 12 nt, Salmonella enterica enterica serovar Typhi
ucuguuaucugg

SEQ ID NO: 1709262 - RNA, 17 nt, Salmonella enterica enterica serovar Typhi
ucuuccagcggcagacc

SEQ ID NO: 1709263 - RNA, 16 nt, Salmonella enterica enterica serovar Typhi
ucuuccaugccuucau

SEQ ID NO: 1709264 - RNA, 18 nt, Salmonella enterica enterica serovar Typhi
ucuuccauugcuuuuuug

SEQ ID NO: 1709265 - RNA, 16 nt, Salmonella enterica enterica serovar Typhi
ucuuccgggucaguuu

SEQ ID NO: 1709266 - RNA, 21 nt, Salmonella enterica enterica serovar Typhi
ucuuccggugugaccagcgcg

SEQ ID NO: 1709267 - RNA, 12 nt, Salmonella enterica enterica serovar Typhi
ucuucccauauu

SEQ ID NO: 1709268 - RNA, 15 nt, Salmonella enterica enterica serovar Typhi
ucuuccucugugccg

SEQ ID NO: 1709269 - RNA, 11 nt, Salmonella enterica enterica serovar Typhi
ucuuccucaca

SEQ ID NO: 1709270 - RNA, 16 nt, Salmonella enterica enterica serovar Typhi
ucuucggcaaaauauu

SEQ ID NO: 1709271 - RNA, 15 nt, Salmonella enterica enterica serovar Typhi
ucuucaccuugcugc

SEQ ID NO: 1709272 - RNA, 19 nt, Salmonella enterica enterica serovar Typhi
ucuucaccuuuccagucaa

SEQ ID NO: 1709273 - RNA, 20 nt, Salmonella enterica enterica serovar Typhi
ucuuccaaccgugucugcug

SEQ ID NO: 1709274 - RNA, 23 nt, Salmonella enterica enterica serovar Typhi
ucuuccaccacggcaaaaauaug

SEQ ID NO: 1709275 - RNA, 18 nt, Salmonella enterica enterica serovar Typhi
ucuuccacgccgucgaug

SEQ ID NO: 1709276 - RNA, 17 nt, Salmonella enterica enterica serovar Typhi
ucuuccacuucagcagc

SEQ ID NO: 1709277 - RNA, 18 nt, Salmonella enterica enterica serovar Typhi
ucuguacgcugaauaacc

SEQ ID NO: 1709278 - RNA, 16 nt, Salmonella enterica enterica serovar Typhi
ucuguacggcauauuc

SEQ ID NO: 1709279 - RNA, 21 nt, Salmonella enterica enterica serovar Typhi
ucuguacagcgucgacagccc

SEQ ID NO: 1709280 - RNA, 15 nt, Salmonella enterica enterica serovar Typhi
ucuguaauuauaaau

SEQ ID NO: 1709281 - RNA, 13 nt, Salmonella enterica enterica serovar Typhi
ucuguaggccgga

SEQ ID NO: 1709282 - RNA, 14 nt, Salmonella enterica enterica serovar Typhi
ucugguuauccacc

SEQ ID NO: 1709283 - RNA, 22 nt, Salmonella enterica enterica serovar Typhi
ucugguuguuucgguuuccguu

SEQ ID NO: 1709284 - RNA, 19 nt, Salmonella enterica enterica serovar Typhi
ucuguccgcuuuuuuauug

SEQ ID NO: 1709285 - RNA, 19 nt, Salmonella enterica enterica serovar Typhi
ucuguccgaugagaaguag

SEQ ID NO: 1709286 - RNA, 13 nt, Salmonella enterica enterica serovar Typhi
ucuguauuuaaua

SEQ ID NO: 1709287 - RNA, 17 nt, Salmonella enterica enterica serovar Typhi
ucuguaugacaacauaa

SEQ ID NO: 1709288 - RNA, 16 nt, Salmonella enterica enterica serovar Typhi
ucugugaaaguuucag

SEQ ID NO: 1709289 - RNA, 19 nt, Salmonella enterica enterica serovar Typhi
ucugugaaaguuucaggau

SEQ ID NO: 1709290 - RNA, 18 nt, Salmonella enterica enterica serovar Typhi
ucugucucaauaaaaugu

SEQ ID NO: 1709291 - RNA, 14 nt, Salmonella enterica enterica serovar Typhi
ucugucugacgacc

SEQ ID NO: 1709292 - RNA, 13 nt, Salmonella enterica enterica serovar Typhi
ucugugaugaugc

SEQ ID NO: 1709293 - RNA, 15 nt, Salmonella enterica enterica serovar Typhi
ucuguguugaauaaa

SEQ ID NO: 1709294 - RNA, 23 nt, Salmonella enterica enterica serovar Typhi
ucugcuuuuugauacagcagcac

SEQ ID NO: 1709295 - RNA, 20 nt, Salmonella enterica enterica serovar Typhi
ucugcuuaugaucgcccagc

SEQ ID NO: 1709296 - RNA, 16 nt, Salmonella enterica enterica serovar Typhi
ucugccagcaacggcg

SEQ ID NO: 1709297 - RNA, 17 nt, Salmonella enterica enterica serovar Typhi
ucugcauguaguaagcc

SEQ ID NO: 1709298 - RNA, 17 nt, Salmonella enterica enterica serovar Typhi
ucugcaguauuaccgaa

SEQ ID NO: 1709299 - RNA, 13 nt, Salmonella enterica enterica serovar Typhi
ucuggcucccgca

SEQ ID NO: 1709300 - RNA, 17 nt, Salmonella enterica enterica serovar Typhi
ucuggauuacaaaaaua

SEQ ID NO: 1709301 - RNA, 22 nt, Salmonella enterica enterica serovar Typhi
ucuggaugcguucaaagaucuc

SEQ ID NO: 1709302 - RNA, 13 nt, Salmonella enterica enterica serovar Typhi
ucuggcaauaagg

SEQ ID NO: 1709303 - RNA, 22 nt, Salmonella enterica enterica serovar Typhi
ucuggucauggcuuagcgccag

SEQ ID NO: 1709304 - RNA, 21 nt, Salmonella enterica enterica serovar Typhi
ucuggugcuguuuagccgucu

SEQ ID NO: 1709305 - RNA, 23 nt, Salmonella enterica enterica serovar Typhi
ucuaaaauuauuuuuacuuaaaa

SEQ ID NO: 1709306 - RNA, 11 nt, Salmonella enterica enterica serovar Typhi
ucuaaaaagga

SEQ ID NO: 1709307 - RNA, 12 nt, Salmonella enterica enterica serovar Typhi
ucuaaaaaggaa

SEQ ID NO: 1709308 - RNA, 17 nt, Salmonella enterica enterica serovar Typhi
ucguuugcaguuccgca

SEQ ID NO: 1709309 - RNA, 17 nt, Salmonella enterica enterica serovar Typhi
ucguuuuugucuccuca

SEQ ID NO: 1709310 - RNA, 17 nt, Salmonella enterica enterica serovar Typhi
ucguuuuuguuuaaaaa

SEQ ID NO: 1709311 - RNA, 15 nt, Salmonella enterica enterica serovar Typhi
ucuaacauaaugaau

SEQ ID NO: 1709312 - RNA, 20 nt, Salmonella enterica enterica serovar Typhi
ucuaaaugggcaggagauga

SEQ ID NO: 1709313 - RNA, 23 nt, Salmonella enterica enterica serovar Typhi
ucuaaagagacagaaucaggcca

SEQ ID NO: 1709314 - RNA, 22 nt, Salmonella enterica enterica serovar Typhi
aaaugaaaugcccauaaagaaa

SEQ ID NO: 1709315 - RNA, 14 nt, Salmonella enterica enterica serovar Typhi
aaaugaaaaagaua

SEQ ID NO: 1709316 - RNA, 17 nt, Salmonella enterica enterica serovar Typhi
aaaucuuuuucgcugua

SEQ ID NO: 1709317 - RNA, 21 nt, Salmonella enterica enterica serovar Typhi
aaaugaaaaacgguauuucca

SEQ ID NO: 1709318 - RNA, 23 nt, Salmonella enterica enterica serovar Typhi
aaaucuucuacuucaauuuucca

SEQ ID NO: 1709319 - RNA, 21 nt, Salmonella enterica enterica serovar Typhi
aaaucuucggcaaaauauuca

SEQ ID NO: 1709320 - RNA, 23 nt, Salmonella enterica enterica serovar Typhi
ucuaacgcaacggaaggaaauaa

SEQ ID NO: 1709321 - RNA, 13 nt, Salmonella enterica enterica serovar Typhi
aaaugaauaccaa

SEQ ID NO: 1709322 - RNA, 18 nt, Salmonella enterica enterica serovar Typhi
aaaugacgcccugcgcca

SEQ ID NO: 1709323 - RNA, 16 nt, Salmonella enterica enterica serovar Typhi
aaaugacgccggguaa

SEQ ID NO: 1709324 - RNA, 18 nt, Salmonella enterica enterica serovar Typhi
ucuaccuggaaccaggcg

SEQ ID NO: 1709325 - RNA, 19 nt, Salmonella enterica enterica serovar Typhi
ucuaccgcuucgcgcgcca

SEQ ID NO: 1709326 - RNA, 15 nt, Salmonella enterica enterica serovar Typhi
ucuacgcgccagcag

SEQ ID NO: 1709327 - RNA, 19 nt, Salmonella enterica enterica serovar Typhi
ucuacgcugccauccucau

SEQ ID NO: 1709328 - RNA, 16 nt, Salmonella enterica enterica serovar Typhi
ucuacuaacuggcaau

SEQ ID NO: 1709329 - RNA, 14 nt, Salmonella enterica enterica serovar Typhi
ucuacggaucccuu

SEQ ID NO: 1709330 - RNA, 14 nt, Salmonella enterica enterica serovar Typhi
ucuacgguaucugc

SEQ ID NO: 1709331 - RNA, 16 nt, Salmonella enterica enterica serovar Typhi
ucuacggccacaaaac

SEQ ID NO: 1709332 - RNA, 15 nt, Salmonella enterica enterica serovar Typhi
ucuacuuuccugaag

SEQ ID NO: 1709333 - RNA, 20 nt, Salmonella enterica enterica serovar Typhi
ucuacuuuccugaagguaga

SEQ ID NO: 1709334 - RNA, 22 nt, Salmonella enterica enterica serovar Typhi
ucuacuuuucggguguccacuc

SEQ ID NO: 1709335 - RNA, 15 nt, Salmonella enterica enterica serovar Typhi
ucuacuguuauugac

SEQ ID NO: 1709336 - RNA, 16 nt, Salmonella enterica enterica serovar Typhi
ucuacugguuaaggau

SEQ ID NO: 1709337 - RNA, 21 nt, Salmonella enterica enterica serovar Typhi
aaaugagaaaaggaagaauaa

SEQ ID NO: 1709338 - RNA, 12 nt, Salmonella enterica enterica serovar Typhi
aaaugagaacac

SEQ ID NO: 1709339 - RNA, 23 nt, Salmonella enterica enterica serovar Typhi
ucuaauucccaguaaccuauuuu

SEQ ID NO: 1709340 - RNA, 15 nt, Salmonella enterica enterica serovar Typhi
ucuacaucaagagaa

SEQ ID NO: 1709341 - RNA, 19 nt, Salmonella enterica enterica serovar Typhi
ucucaaggucugucaggac

SEQ ID NO: 1709342 - RNA, 19 nt, Salmonella enterica enterica serovar Typhi
ucucaauaucguugccgcc

SEQ ID NO: 1709343 - RNA, 17 nt, Salmonella enterica enterica serovar Typhi
ucucaaacacuucuaaa

SEQ ID NO: 1709344 - RNA, 16 nt, Salmonella enterica enterica serovar Typhi
ucucaaaggccugcau

SEQ ID NO: 1709345 - RNA, 14 nt, Salmonella enterica enterica serovar Typhi
ucucaaaaaauauc

SEQ ID NO: 1709346 - RNA, 13 nt, Salmonella enterica enterica serovar Typhi
ucuauugauuggc

SEQ ID NO: 1709347 - RNA, 23 nt, Salmonella enterica enterica serovar Typhi
ucuauugauuggcaagaauuauu

SEQ ID NO: 1709348 - RNA, 11 nt, Salmonella enterica enterica serovar Typhi
ucuauuauuga

SEQ ID NO: 1709349 - RNA, 16 nt, Salmonella enterica enterica serovar Typhi
ucuauuaaaucagaua

SEQ ID NO: 1709350 - RNA, 16 nt, Salmonella enterica enterica serovar Typhi
ucucaccgaccugccu

SEQ ID NO: 1709351 - RNA, 11 nt, Salmonella enterica enterica serovar Typhi
aaaugcgcaug

SEQ ID NO: 1709352 - RNA, 16 nt, Salmonella enterica enterica serovar Typhi
aaaugcgcaaagcaua

SEQ ID NO: 1709353 - RNA, 17 nt, Salmonella enterica enterica serovar Typhi
aaaugcgcaaagcauaa

SEQ ID NO: 1709354 - RNA, 13 nt, Salmonella enterica enterica serovar Typhi
ucucaccguggca

SEQ ID NO: 1709355 - RNA, 22 nt, Salmonella enterica enterica serovar Typhi
ucucaccgccuaggccagugcc

SEQ ID NO: 1709356 - RNA, 14 nt, Salmonella enterica enterica serovar Typhi
aaaugccugugcca

SEQ ID NO: 1709357 - RNA, 15 nt, Salmonella enterica enterica serovar Typhi
aaaugcgaaaaaaag

SEQ ID NO: 1709358 - RNA, 18 nt, Salmonella enterica enterica serovar Typhi
aaaugcgacaucucaggc

SEQ ID NO: 1709359 - RNA, 17 nt, Salmonella enterica enterica serovar Typhi
ucucacagaaucaucag

SEQ ID NO: 1709360 - RNA, 21 nt, Salmonella enterica enterica serovar Typhi
ucucagauggaaaaaaagaau

SEQ ID NO: 1709361 - RNA, 16 nt, Salmonella enterica enterica serovar Typhi
ucucagcgucggugaa

SEQ ID NO: 1709362 - RNA, 16 nt, Salmonella enterica enterica serovar Typhi
ucucauccgccaaaac

SEQ ID NO: 1709363 - RNA, 16 nt, Salmonella enterica enterica serovar Typhi
ucucaucugaugauua

SEQ ID NO: 1709364 - RNA, 22 nt, Salmonella enterica enterica serovar Typhi
ucucaucugcaaaauauauaau

SEQ ID NO: 1709365 - RNA, 15 nt, Salmonella enterica enterica serovar Typhi
ucucaucgacgauaa

SEQ ID NO: 1709366 - RNA, 13 nt, Salmonella enterica enterica serovar Typhi
ucucaucagacug

SEQ ID NO: 1709367 - RNA, 19 nt, Salmonella enterica enterica serovar Typhi
ucucauccagcuugccguc

SEQ ID NO: 1709368 - RNA, 16 nt, Salmonella enterica enterica serovar Typhi
ucucagguucgaaucc

SEQ ID NO: 1709369 - RNA, 22 nt, Salmonella enterica enterica serovar Typhi
ucucauaaaacauuccugacau

SEQ ID NO: 1709370 - RNA, 22 nt, Salmonella enterica enterica serovar Typhi
ucucauaaaccgccgcuuugau

SEQ ID NO: 1709371 - RNA, 13 nt, Salmonella enterica enterica serovar Typhi
ucuagucgccggu

SEQ ID NO: 1709372 - RNA, 15 nt, Salmonella enterica enterica serovar Typhi
aaaugaucacuuccg

SEQ ID NO: 1709373 - RNA, 13 nt, Salmonella enterica enterica serovar Typhi
aaaugaucacuuc

SEQ ID NO: 1709374 - RNA, 12 nt, Salmonella enterica enterica serovar Typhi
aaaugaucguuu

SEQ ID NO: 1709375 - RNA, 19 nt, Salmonella enterica enterica serovar Typhi
aaaugaugacucauuaaaa

SEQ ID NO: 1709376 - RNA, 21 nt, Salmonella enterica enterica serovar Typhi
ucuauccacuggguaaggcgc

SEQ ID NO: 1709377 - RNA, 19 nt, Salmonella enterica enterica serovar Typhi
ucuaucuguuuuaauuccu

SEQ ID NO: 1709378 - RNA, 13 nt, Salmonella enterica enterica serovar Typhi
ucuaucuuuucaa

SEQ ID NO: 1709379 - RNA, 17 nt, Salmonella enterica enterica serovar Typhi
ucuaugaaugccggaug

SEQ ID NO: 1709380 - RNA, 19 nt, Salmonella enterica enterica serovar Typhi
aaaugcauugauaggcugc

SEQ ID NO: 1709381 - RNA, 14 nt, Salmonella enterica enterica serovar Typhi
ucuauagauuucgc

SEQ ID NO: 1709382 - RNA, 15 nt, Salmonella enterica enterica serovar Typhi
ucuauacggcgcgca

SEQ ID NO: 1709383 - RNA, 13 nt, Salmonella enterica enterica serovar Typhi
ucuauauccugcc

SEQ ID NO: 1709384 - RNA, 16 nt, Salmonella enterica enterica serovar Typhi
uuaacacauauaagua

SEQ ID NO: 1709385 - RNA, 20 nt, Salmonella enterica enterica serovar Typhi
uuaacaauccccgucacagc

SEQ ID NO: 1709386 - RNA, 15 nt, Salmonella enterica enterica serovar Typhi
uuaaauuuuuaauaa

SEQ ID NO: 1709387 - RNA, 12 nt, Salmonella enterica enterica serovar Typhi
uuaacaaaucau

SEQ ID NO: 1709388 - RNA, 17 nt, Salmonella enterica enterica serovar Typhi
uuaaauuguuauaccgc

SEQ ID NO: 1709389 - RNA, 17 nt, Salmonella enterica enterica serovar Typhi
uuaaauugguuauauua

SEQ ID NO: 1709390 - RNA, 20 nt, Salmonella enterica enterica serovar Typhi
uuaaaugccuguuuauauuc

SEQ ID NO: 1709391 - RNA, 23 nt, Salmonella enterica enterica serovar Typhi
uuaaauaaauaguaaauagaaaa

SEQ ID NO: 1709392 - RNA, 11 nt, Salmonella enterica enterica serovar Typhi
uuaaagccacg

SEQ ID NO: 1709393 - RNA, 17 nt, Salmonella enterica enterica serovar Typhi
uuaaagcccugacagaa

SEQ ID NO: 1709394 - RNA, 13 nt, Salmonella enterica enterica serovar Typhi
uuaaagccuucau

SEQ ID NO: 1709395 - RNA, 17 nt, Salmonella enterica enterica serovar Typhi
uuaaauaugaaagagaa

SEQ ID NO: 1709396 - RNA, 16 nt, Salmonella enterica enterica serovar Typhi
uuaaaucaucauaauc

SEQ ID NO: 1709397 - RNA, 16 nt, Salmonella enterica enterica serovar Typhi
uuaaaucagauaacaa

SEQ ID NO: 1709398 - RNA, 15 nt, Salmonella enterica enterica serovar Typhi
uuaauaaacaaugca

SEQ ID NO: 1709399 - RNA, 15 nt, Salmonella enterica enterica serovar Typhi
uuaaggcaucaauac

SEQ ID NO: 1709400 - RNA, 17 nt, Salmonella enterica enterica serovar Typhi
uuaaggcggcaaagaua

SEQ ID NO: 1709401 - RNA, 17 nt, Salmonella enterica enterica serovar Typhi
uuaauauauucaucuuu

SEQ ID NO: 1709402 - RNA, 21 nt, Salmonella enterica enterica serovar Typhi
uuaauauaugaaccaagauaa

SEQ ID NO: 1709403 - RNA, 18 nt, Salmonella enterica enterica serovar Typhi
uuaauacaucagaaaaca

SEQ ID NO: 1709404 - RNA, 21 nt, Salmonella enterica enterica serovar Typhi
uuaauaccagcgccaaucacu

SEQ ID NO: 1709405 - RNA, 14 nt, Salmonella enterica enterica serovar Typhi
uuaauacccauagu

SEQ ID NO: 1709406 - RNA, 15 nt, Salmonella enterica enterica serovar Typhi
uuaaucaggcauuca

SEQ ID NO: 1709407 - RNA, 17 nt, Salmonella enterica enterica serovar Typhi
uuaauaucaauauaauu

SEQ ID NO: 1709408 - RNA, 18 nt, Salmonella enterica enterica serovar Typhi
uuaacauuuaagaaacaa

SEQ ID NO: 1709409 - RNA, 17 nt, Salmonella enterica enterica serovar Typhi
uuaacaucaucaggccu

SEQ ID NO: 1709410 - RNA, 16 nt, Salmonella enterica enterica serovar Typhi
uuaacaucagaaaaaa

SEQ ID NO: 1709411 - RNA, 16 nt, Salmonella enterica enterica serovar Typhi
uuaacaucaccuuuca

SEQ ID NO: 1709412 - RNA, 20 nt, Salmonella enterica enterica serovar Typhi
uuaacagcgcgaccaggaaa

SEQ ID NO: 1709413 - RNA, 20 nt, Salmonella enterica enterica serovar Typhi
uuaacagcgccaucaggaaa

SEQ ID NO: 1709414 - RNA, 16 nt, Salmonella enterica enterica serovar Typhi
uuaacagauaauuaau

SEQ ID NO: 1709415 - RNA, 16 nt, Salmonella enterica enterica serovar Typhi
uuaacgauuuccccug

SEQ ID NO: 1709416 - RNA, 16 nt, Salmonella enterica enterica serovar Typhi
uuaacgaagguaaacg

SEQ ID NO: 1709417 - RNA, 16 nt, Salmonella enterica enterica serovar Typhi
uuaacgauaauguugg

SEQ ID NO: 1709418 - RNA, 18 nt, Salmonella enterica enterica serovar Typhi
uuaacgccgccaucagua

SEQ ID NO: 1709419 - RNA, 17 nt, Salmonella enterica enterica serovar Typhi
uuaacgccggcaaauag

SEQ ID NO: 1709420 - RNA, 22 nt, Salmonella enterica enterica serovar Typhi
uuaacgcgaaauaaucagguga

SEQ ID NO: 1709421 - RNA, 22 nt, Salmonella enterica enterica serovar Typhi
uuaacgcgaauccgccauagcc

SEQ ID NO: 1709422 - RNA, 22 nt, Salmonella enterica enterica serovar Typhi
uuaacucuuuuucagcaaauac

SEQ ID NO: 1709423 - RNA, 17 nt, Salmonella enterica enterica serovar Typhi
uuaacgcggccguaaua

SEQ ID NO: 1709424 - RNA, 12 nt, Salmonella enterica enterica serovar Typhi
uuaagaaaguag

SEQ ID NO: 1709425 - RNA, 16 nt, Salmonella enterica enterica serovar Typhi
uuaagauuuaaaacaa

SEQ ID NO: 1709426 - RNA, 23 nt, Salmonella enterica enterica serovar Typhi
uuaagcaacugauuaaucugccg

SEQ ID NO: 1709427 - RNA, 19 nt, Salmonella enterica enterica serovar Typhi
uuaagcaacguuuccgcua

SEQ ID NO: 1709428 - RNA, 22 nt, Salmonella enterica enterica serovar Typhi
uuaacuggcgacgacuucaccc

SEQ ID NO: 1709429 - RNA, 19 nt, Salmonella enterica enterica serovar Typhi
uuacgcugguuugugugca

SEQ ID NO: 1709430 - RNA, 21 nt, Salmonella enterica enterica serovar Typhi
uuacgcucgucaaacaguuca

SEQ ID NO: 1709431 - RNA, 23 nt, Salmonella enterica enterica serovar Typhi
uuacgcuuaauggcgucaaucaa

SEQ ID NO: 1709432 - RNA, 20 nt, Salmonella enterica enterica serovar Typhi
uuacgcuuacccggccuaca

SEQ ID NO: 1709433 - RNA, 22 nt, Salmonella enterica enterica serovar Typhi
uuacggaaaaaauacugauaaa

SEQ ID NO: 1709434 - RNA, 16 nt, Salmonella enterica enterica serovar Typhi
uuacggaaaaaugucg

SEQ ID NO: 1709435 - RNA, 14 nt, Salmonella enterica enterica serovar Typhi
uuacggacugcggc

SEQ ID NO: 1709436 - RNA, 22 nt, Salmonella enterica enterica serovar Typhi
uuacggacugcggccugcaaag

SEQ ID NO: 1709437 - RNA, 15 nt, Salmonella enterica enterica serovar Typhi
uuacgggaacagaau

SEQ ID NO: 1709438 - RNA, 12 nt, Salmonella enterica enterica serovar Typhi
uuacgccgccau

SEQ ID NO: 1709439 - RNA, 19 nt, Salmonella enterica enterica serovar Typhi
uuacgcguuacgcccugug

SEQ ID NO: 1709440 - RNA, 18 nt, Salmonella enterica enterica serovar Typhi
uuacgcagcaagaacaga

SEQ ID NO: 1709441 - RNA, 22 nt, Salmonella enterica enterica serovar Typhi
uuacgcagcaagaacagagcaa

SEQ ID NO: 1709442 - RNA, 17 nt, Salmonella enterica enterica serovar Typhi
uuacgcacgccagauaa

SEQ ID NO: 1709443 - RNA, 13 nt, Salmonella enterica enterica serovar Typhi
uuacgcacuuuua

SEQ ID NO: 1709444 - RNA, 16 nt, Salmonella enterica enterica serovar Typhi
uuacuguuuuaucagg

SEQ ID NO: 1709445 - RNA, 12 nt, Salmonella enterica enterica serovar Typhi
uuacuucaggcu

SEQ ID NO: 1709446 - RNA, 15 nt, Salmonella enterica enterica serovar Typhi
uuacugacaauaagu

SEQ ID NO: 1709447 - RNA, 19 nt, Salmonella enterica enterica serovar Typhi
uuacugucgcccgcaacca

SEQ ID NO: 1709448 - RNA, 11 nt, Salmonella enterica enterica serovar Typhi
uuacucuucca

SEQ ID NO: 1709449 - RNA, 14 nt, Salmonella enterica enterica serovar Typhi
uuacucuuccacca

SEQ ID NO: 1709450 - RNA, 13 nt, Salmonella enterica enterica serovar Typhi
uuacuaucuucaa

SEQ ID NO: 1709451 - RNA, 15 nt, Salmonella enterica enterica serovar Typhi
uuacucucauguuca

SEQ ID NO: 1709452 - RNA, 20 nt, Salmonella enterica enterica serovar Typhi
uuagaaaaaauuaaaaauac

SEQ ID NO: 1709453 - RNA, 13 nt, Salmonella enterica enterica serovar Typhi
uuacuuuuuuaaa

SEQ ID NO: 1709454 - RNA, 17 nt, Salmonella enterica enterica serovar Typhi
uuacuuuuuuaaauguu

SEQ ID NO: 1709455 - RNA, 13 nt, Salmonella enterica enterica serovar Typhi
uuagaaaaagaaa

SEQ ID NO: 1709456 - RNA, 16 nt, Salmonella enterica enterica serovar Typhi
uuagaaaauacugcua

SEQ ID NO: 1709457 - RNA, 12 nt, Salmonella enterica enterica serovar Typhi
uuagaaaaagaa

SEQ ID NO: 1709458 - RNA, 13 nt, Salmonella enterica enterica serovar Typhi
uuagcgaaacagu

SEQ ID NO: 1709459 - RNA, 23 nt, Salmonella enterica enterica serovar Typhi
uuagcgcuaauuccuguccauug

SEQ ID NO: 1709460 - RNA, 19 nt, Salmonella enterica enterica serovar Typhi
uuagcgcauuuuuaucagg

SEQ ID NO: 1709461 - RNA, 14 nt, Salmonella enterica enterica serovar Typhi
uuagcaaaaaugcc

SEQ ID NO: 1709462 - RNA, 16 nt, Salmonella enterica enterica serovar Typhi
uuaccuuguucuucca

SEQ ID NO: 1709463 - RNA, 17 nt, Salmonella enterica enterica serovar Typhi
uuaccuuguucuuccau

SEQ ID NO: 1709464 - RNA, 22 nt, Salmonella enterica enterica serovar Typhi
uuaccugcgcaaucaugacaga

SEQ ID NO: 1709465 - RNA, 20 nt, Salmonella enterica enterica serovar Typhi
uuaccguaucccaccauaaa

SEQ ID NO: 1709466 - RNA, 19 nt, Salmonella enterica enterica serovar Typhi
uuaccuacgcgauaaaaaa

SEQ ID NO: 1709467 - RNA, 22 nt, Salmonella enterica enterica serovar Typhi
uuacgaccgcagaaacagauag

SEQ ID NO: 1709468 - RNA, 21 nt, Salmonella enterica enterica serovar Typhi
uuacgacgauaaggccaauau

SEQ ID NO: 1709469 - RNA, 20 nt, Salmonella enterica enterica serovar Typhi
uuacgagugcguucuuccac

SEQ ID NO: 1709470 - RNA, 21 nt, Salmonella enterica enterica serovar Typhi
uuacgauacguuuaaaaugaa

SEQ ID NO: 1709471 - RNA, 15 nt, Salmonella enterica enterica serovar Typhi
uuaccggcuggaagc

SEQ ID NO: 1709472 - RNA, 14 nt, Salmonella enterica enterica serovar Typhi
uuaccgggcaucug

SEQ ID NO: 1709473 - RNA, 22 nt, Salmonella enterica enterica serovar Typhi
uuaccauuccucacgaaguuua

SEQ ID NO: 1709474 - RNA, 14 nt, Salmonella enterica enterica serovar Typhi
uuaccagaaccacu

SEQ ID NO: 1709475 - RNA, 19 nt, Salmonella enterica enterica serovar Typhi
uuaccacuuugcgcuccug

SEQ ID NO: 1709476 - RNA, 13 nt, Salmonella enterica enterica serovar Typhi
uuacaucagauaa

SEQ ID NO: 1709477 - RNA, 19 nt, Salmonella enterica enterica serovar Typhi
uuaauuguaccgauuguuu

SEQ ID NO: 1709478 - RNA, 21 nt, Salmonella enterica enterica serovar Typhi
uuaaucucuucaucuguggca

SEQ ID NO: 1709479 - RNA, 13 nt, Salmonella enterica enterica serovar Typhi
uuaaucuuaucca

SEQ ID NO: 1709480 - RNA, 19 nt, Salmonella enterica enterica serovar Typhi
uuacacacccggccuauca

SEQ ID NO: 1709481 - RNA, 19 nt, Salmonella enterica enterica serovar Typhi
uuacacugauaccccagcg

SEQ ID NO: 1709482 - RNA, 15 nt, Salmonella enterica enterica serovar Typhi
uuacacguuccaugg

SEQ ID NO: 1709483 - RNA, 17 nt, Salmonella enterica enterica serovar Typhi
uuacaccccacuauuca

SEQ ID NO: 1709484 - RNA, 17 nt, Salmonella enterica enterica serovar Typhi
uguuugagaaaaacauc

SEQ ID NO: 1709485 - RNA, 12 nt, Salmonella enterica enterica serovar Typhi
uguuugaugagg

SEQ ID NO: 1709486 - RNA, 21 nt, Salmonella enterica enterica serovar Typhi
uguuugcccaccguaauaguu

SEQ ID NO: 1709487 - RNA, 22 nt, Salmonella enterica enterica serovar Typhi
uguuugcccaccguaauaguuu

SEQ ID NO: 1709488 - RNA, 16 nt, Salmonella enterica enterica serovar Typhi
uguuugcccagcucau

SEQ ID NO: 1709489 - RNA, 15 nt, Salmonella enterica enterica serovar Typhi
uguuugcugauaaga

SEQ ID NO: 1709490 - RNA, 17 nt, Salmonella enterica enterica serovar Typhi
uguuucucuuccgccag

SEQ ID NO: 1709491 - RNA, 15 nt, Salmonella enterica enterica serovar Typhi
uguuucugcuggccu

SEQ ID NO: 1709492 - RNA, 17 nt, Salmonella enterica enterica serovar Typhi
uguuucggauaauucug

SEQ ID NO: 1709493 - RNA, 19 nt, Salmonella enterica enterica serovar Typhi
uguuucgacaguuucuucu

SEQ ID NO: 1709494 - RNA, 21 nt, Salmonella enterica enterica serovar Typhi
uguuucgaccgccugcaucac

SEQ ID NO: 1709495 - RNA, 12 nt, Salmonella enterica enterica serovar Typhi
uguuucagcagc

SEQ ID NO: 1709496 - RNA, 18 nt, Salmonella enterica enterica serovar Typhi
uguuucagcaccucuuug

SEQ ID NO: 1709497 - RNA, 15 nt, Salmonella enterica enterica serovar Typhi
uguuucauggagauc

SEQ ID NO: 1709498 - RNA, 18 nt, Salmonella enterica enterica serovar Typhi
uguuucaucgucagcucc

SEQ ID NO: 1709499 - RNA, 16 nt, Salmonella enterica enterica serovar Typhi
uguuucaucucaucaa

SEQ ID NO: 1709500 - RNA, 20 nt, Salmonella enterica enterica serovar Typhi
uguuuauucuucgucagaug

SEQ ID NO: 1709501 - RNA, 16 nt, Salmonella enterica enterica serovar Typhi
uguuuaugacccugcg

SEQ ID NO: 1709502 - RNA, 19 nt, Salmonella enterica enterica serovar Typhi
uguuuauccccgcuggcgc

SEQ ID NO: 1709503 - RNA, 20 nt, Salmonella enterica enterica serovar Typhi
uguuuucccagaauccgcgc

SEQ ID NO: 1709504 - RNA, 17 nt, Salmonella enterica enterica serovar Typhi
uguuuucgagccuugcc

SEQ ID NO: 1709505 - RNA, 21 nt, Salmonella enterica enterica serovar Typhi
uguuuucgagccuugccgcaa

SEQ ID NO: 1709506 - RNA, 11 nt, Salmonella enterica enterica serovar Typhi
uguuuuuucau

SEQ ID NO: 1709507 - RNA, 23 nt, Salmonella enterica enterica serovar Typhi
uguuuuuucaucuccgauaaaua

SEQ ID NO: 1709508 - RNA, 12 nt, Salmonella enterica enterica serovar Typhi
uguuuuugcuuu

SEQ ID NO: 1709509 - RNA, 15 nt, Salmonella enterica enterica serovar Typhi
uguuuuugaaaaugu

SEQ ID NO: 1709510 - RNA, 16 nt, Salmonella enterica enterica serovar Typhi
uguuuuugaaaaugug

SEQ ID NO: 1709511 - RNA, 15 nt, Salmonella enterica enterica serovar Typhi
uguuuuuauacaucc

SEQ ID NO: 1709512 - RNA, 19 nt, Salmonella enterica enterica serovar Typhi
uguuuucauauguuugaua

SEQ ID NO: 1709513 - RNA, 19 nt, Salmonella enterica enterica serovar Typhi
uguuuuaccaaaucaauag

SEQ ID NO: 1709514 - RNA, 13 nt, Salmonella enterica enterica serovar Typhi
uguuuggugcuga

SEQ ID NO: 1709515 - RNA, 13 nt, Salmonella enterica enterica serovar Typhi
uuaaacugccuuc

SEQ ID NO: 1709516 - RNA, 22 nt, Salmonella enterica enterica serovar Typhi
uuaaacuggccccgcauuuuac

SEQ ID NO: 1709517 - RNA, 19 nt, Salmonella enterica enterica serovar Typhi
uuaaacgccggauuccaga

SEQ ID NO: 1709518 - RNA, 17 nt, Salmonella enterica enterica serovar Typhi
uuaaacgccugaucauc

SEQ ID NO: 1709519 - RNA, 12 nt, Salmonella enterica enterica serovar Typhi
uuaaacacaucc

SEQ ID NO: 1709520 - RNA, 11 nt, Salmonella enterica enterica serovar Typhi
uuaaacaacau

SEQ ID NO: 1709521 - RNA, 11 nt, Salmonella enterica enterica serovar Typhi
uuaaaaugacc

SEQ ID NO: 1709522 - RNA, 21 nt, Salmonella enterica enterica serovar Typhi
uuaaaaugcggggacuggaug

SEQ ID NO: 1709523 - RNA, 14 nt, Salmonella enterica enterica serovar Typhi
uuaaacaguauuua

SEQ ID NO: 1709524 - RNA, 13 nt, Salmonella enterica enterica serovar Typhi
uuaaaccacaccu

SEQ ID NO: 1709525 - RNA, 17 nt, Salmonella enterica enterica serovar Typhi
uuaaaagggaguauuua

SEQ ID NO: 1709526 - RNA, 22 nt, Salmonella enterica enterica serovar Typhi
uuaaaaucggggucuuccagca

SEQ ID NO: 1709527 - RNA, 22 nt, Salmonella enterica enterica serovar Typhi
uuaaaaauauccuguaacucau

SEQ ID NO: 1709528 - RNA, 17 nt, Salmonella enterica enterica serovar Typhi
uuaaaaagcugcauaau

SEQ ID NO: 1709529 - RNA, 14 nt, Salmonella enterica enterica serovar Typhi
uuaaaaagcugcau

SEQ ID NO: 1709530 - RNA, 12 nt, Salmonella enterica enterica serovar Typhi
uuaaaaacauca

SEQ ID NO: 1709531 - RNA, 13 nt, Salmonella enterica enterica serovar Typhi
uuaaaaacagcca

SEQ ID NO: 1709532 - RNA, 18 nt, Salmonella enterica enterica serovar Typhi
uuaaaaaaggcagaagaa

SEQ ID NO: 1709533 - RNA, 16 nt, Salmonella enterica enterica serovar Typhi
uguuuuuuguaggccg

SEQ ID NO: 1709534 - RNA, 22 nt, Salmonella enterica enterica serovar Typhi
uguuuuuuguugauuuuaugau

SEQ ID NO: 1709535 - RNA, 18 nt, Salmonella enterica enterica serovar Typhi
uguuauauauuuuucagc

SEQ ID NO: 1709536 - RNA, 15 nt, Salmonella enterica enterica serovar Typhi
uguuaguguccuuac

SEQ ID NO: 1709537 - RNA, 14 nt, Salmonella enterica enterica serovar Typhi
uguucauaaagugc

SEQ ID NO: 1709538 - RNA, 18 nt, Salmonella enterica enterica serovar Typhi
uguucauaaagugccagg

SEQ ID NO: 1709539 - RNA, 14 nt, Salmonella enterica enterica serovar Typhi
uguucagccagcaa

SEQ ID NO: 1709540 - RNA, 18 nt, Salmonella enterica enterica serovar Typhi
uguucagauggccaauga

SEQ ID NO: 1709541 - RNA, 20 nt, Salmonella enterica enterica serovar Typhi
uguucagaaaucggcagcac

SEQ ID NO: 1709542 - RNA, 20 nt, Salmonella enterica enterica serovar Typhi
uguucacguaccaggcagcg

SEQ ID NO: 1709543 - RNA, 13 nt, Salmonella enterica enterica serovar Typhi
uguucaauauucc

SEQ ID NO: 1709544 - RNA, 16 nt, Salmonella enterica enterica serovar Typhi
uguucaauauuccugg

SEQ ID NO: 1709545 - RNA, 14 nt, Salmonella enterica enterica serovar Typhi
uguucaagcaauaa

SEQ ID NO: 1709546 - RNA, 18 nt, Salmonella enterica enterica serovar Typhi
uguuauuuucaaaaacaa

SEQ ID NO: 1709547 - RNA, 15 nt, Salmonella enterica enterica serovar Typhi
uguucauccauauau

SEQ ID NO: 1709548 - RNA, 22 nt, Salmonella enterica enterica serovar Typhi
uguucauccauauaucugaaua

SEQ ID NO: 1709549 - RNA, 22 nt, Salmonella enterica enterica serovar Typhi
uguucaguaggacaaaaaugga

SEQ ID NO: 1709550 - RNA, 21 nt, Salmonella enterica enterica serovar Typhi
uguucaucaaagaaaaccacg

SEQ ID NO: 1709551 - RNA, 16 nt, Salmonella enterica enterica serovar Typhi
uguuccagggcuucca

SEQ ID NO: 1709552 - RNA, 18 nt, Salmonella enterica enterica serovar Typhi
uguuccggaugcgggccg

SEQ ID NO: 1709553 - RNA, 22 nt, Salmonella enterica enterica serovar Typhi
uguuccggcgaggacuguacaa

SEQ ID NO: 1709554 - RNA, 14 nt, Salmonella enterica enterica serovar Typhi
uguuccugagcaga

SEQ ID NO: 1709555 - RNA, 14 nt, Salmonella enterica enterica serovar Typhi
uguuccugcaauau

SEQ ID NO: 1709556 - RNA, 16 nt, Salmonella enterica enterica serovar Typhi
uguuccugcgggaaca

SEQ ID NO: 1709557 - RNA, 13 nt, Salmonella enterica enterica serovar Typhi
uguucucccugcu

SEQ ID NO: 1709558 - RNA, 13 nt, Salmonella enterica enterica serovar Typhi
uguucuaaacguu

SEQ ID NO: 1709559 - RNA, 23 nt, Salmonella enterica enterica serovar Typhi
uguucuaaaaaguucauguaagu

SEQ ID NO: 1709560 - RNA, 17 nt, Salmonella enterica enterica serovar Typhi
uguucuacuacagaaag

SEQ ID NO: 1709561 - RNA, 20 nt, Salmonella enterica enterica serovar Typhi
uguucgcuuauuccuccgcc

SEQ ID NO: 1709562 - RNA, 15 nt, Salmonella enterica enterica serovar Typhi
uguucgcuucuucua

SEQ ID NO: 1709563 - RNA, 13 nt, Salmonella enterica enterica serovar Typhi
uguucuuccauug

SEQ ID NO: 1709564 - RNA, 14 nt, Salmonella enterica enterica serovar Typhi
uguucuuuucuuuc

SEQ ID NO: 1709565 - RNA, 16 nt, Salmonella enterica enterica serovar Typhi
uguugacgacuuuugc

SEQ ID NO: 1709566 - RNA, 12 nt, Salmonella enterica enterica serovar Typhi
uguugacugcgc

SEQ ID NO: 1709567 - RNA, 14 nt, Salmonella enterica enterica serovar Typhi
uguugacugcgcuc

SEQ ID NO: 1709568 - RNA, 14 nt, Salmonella enterica enterica serovar Typhi
uguugagacgguga

SEQ ID NO: 1709569 - RNA, 14 nt, Salmonella enterica enterica serovar Typhi
uguugaccaacaau

SEQ ID NO: 1709570 - RNA, 13 nt, Salmonella enterica enterica serovar Typhi
uguugaccagguc

SEQ ID NO: 1709571 - RNA, 16 nt, Salmonella enterica enterica serovar Typhi
uguugcuccagcauca

SEQ ID NO: 1709572 - RNA, 16 nt, Salmonella enterica enterica serovar Typhi
uguugcucaaaaaaga

SEQ ID NO: 1709573 - RNA, 14 nt, Salmonella enterica enterica serovar Typhi
uguugcuaaaucca

SEQ ID NO: 1709574 - RNA, 20 nt, Salmonella enterica enterica serovar Typhi
uguugcgccauggcuucucc

SEQ ID NO: 1709575 - RNA, 15 nt, Salmonella enterica enterica serovar Typhi
uguugcgggccagca

SEQ ID NO: 1709576 - RNA, 21 nt, Salmonella enterica enterica serovar Typhi
uguugcggaugaccgcaaacc

SEQ ID NO: 1709577 - RNA, 13 nt, Salmonella enterica enterica serovar Typhi
uguugccaugauc

SEQ ID NO: 1709578 - RNA, 23 nt, Salmonella enterica enterica serovar Typhi
uguugauauggugcgcuuuuggc

SEQ ID NO: 1709579 - RNA, 22 nt, Salmonella enterica enterica serovar Typhi
uguugaguucccuucuccucaa

SEQ ID NO: 1709580 - RNA, 13 nt, Salmonella enterica enterica serovar Typhi
uguugauacagaa

SEQ ID NO: 1709581 - RNA, 18 nt, Salmonella enterica enterica serovar Typhi
uguugucgagguuauaaa

SEQ ID NO: 1709582 - RNA, 14 nt, Salmonella enterica enterica serovar Typhi
uguuguacagcaau

SEQ ID NO: 1709583 - RNA, 22 nt, Salmonella enterica enterica serovar Typhi
uguuguacagcaauaaaaggaa

SEQ ID NO: 1709584 - RNA, 17 nt, Salmonella enterica enterica serovar Typhi
uguuguaaagaaauuua

SEQ ID NO: 1709585 - RNA, 13 nt, Salmonella enterica enterica serovar Typhi
uguugguuuaaac

SEQ ID NO: 1709586 - RNA, 20 nt, Salmonella enterica enterica serovar Typhi
uguuguucuuuucuuucagc

SEQ ID NO: 1709587 - RNA, 16 nt, Salmonella enterica enterica serovar Typhi
uguuuaauacgcuguc

SEQ ID NO: 1709588 - RNA, 23 nt, Salmonella enterica enterica serovar Typhi
uguuuagccuuauagagguguua

SEQ ID NO: 1709589 - RNA, 23 nt, Salmonella enterica enterica serovar Typhi
uguuuaguacgcaaggaaauauu

SEQ ID NO: 1709590 - RNA, 19 nt, Salmonella enterica enterica serovar Typhi
uguuuaccaagcaccgcca

SEQ ID NO: 1709591 - RNA, 14 nt, Salmonella enterica enterica serovar Typhi
uguuuaccuuuacg

SEQ ID NO: 1709592 - RNA, 18 nt, Salmonella enterica enterica serovar Typhi
uguuuaauggcagaauaa

SEQ ID NO: 1709593 - RNA, 21 nt, Salmonella enterica enterica serovar Typhi
uguagagauucugcaggccaa

SEQ ID NO: 1709594 - RNA, 16 nt, Salmonella enterica enterica serovar Typhi
uguacuuuugcuucca

SEQ ID NO: 1709595 - RNA, 18 nt, Salmonella enterica enterica serovar Typhi
uguacuuuugcuuccagu

SEQ ID NO: 1709596 - RNA, 17 nt, Salmonella enterica enterica serovar Typhi
uguaccauugucaaaaa

SEQ ID NO: 1709597 - RNA, 15 nt, Salmonella enterica enterica serovar Typhi
uguaacccgccgcca

SEQ ID NO: 1709598 - RNA, 13 nt, Salmonella enterica enterica serovar Typhi
uguaaccaacaaa

SEQ ID NO: 1709599 - RNA, 19 nt, Salmonella enterica enterica serovar Typhi
uguaaugaaagaaaucacc

SEQ ID NO: 1709600 - RNA, 21 nt, Salmonella enterica enterica serovar Typhi
ugguuuaucgccgauugaggg

SEQ ID NO: 1709601 - RNA, 20 nt, Salmonella enterica enterica serovar Typhi
ugguuucaugcaucauugaa

SEQ ID NO: 1709602 - RNA, 17 nt, Salmonella enterica enterica serovar Typhi
ugguuucccugccucaa

SEQ ID NO: 1709603 - RNA, 13 nt, Salmonella enterica enterica serovar Typhi
ugguuucccugcc

SEQ ID NO: 1709604 - RNA, 16 nt, Salmonella enterica enterica serovar Typhi
ugguuucccugccuca

SEQ ID NO: 1709605 - RNA, 23 nt, Salmonella enterica enterica serovar Typhi
uggucuuaaugcugcgguugagc

SEQ ID NO: 1709606 - RNA, 19 nt, Salmonella enterica enterica serovar Typhi
uggucggcguaacccagug

SEQ ID NO: 1709607 - RNA, 18 nt, Salmonella enterica enterica serovar Typhi
uggugaaaaaucauuauc

SEQ ID NO: 1709608 - RNA, 22 nt, Salmonella enterica enterica serovar Typhi
uggugaaacguucggugaagaa

SEQ ID NO: 1709609 - RNA, 24 nt, Salmonella enterica enterica serovar Typhi
uggugaaaaucgugguuagacauc

SEQ ID NO: 1709610 - RNA, 20 nt, Salmonella enterica enterica serovar Typhi
uggugacguuuuuuggcaga

SEQ ID NO: 1709611 - RNA, 18 nt, Salmonella enterica enterica serovar Typhi
ugguuuaaacucugcaaa

SEQ ID NO: 1709612 - RNA, 20 nt, Salmonella enterica enterica serovar Typhi
uguaacaaugccucgauggc

SEQ ID NO: 1709613 - RNA, 20 nt, Salmonella enterica enterica serovar Typhi
uguaacagcaggacccgaga

SEQ ID NO: 1709614 - RNA, 13 nt, Salmonella enterica enterica serovar Typhi
uguaaaaaugccu

SEQ ID NO: 1709615 - RNA, 21 nt, Salmonella enterica enterica serovar Typhi
uguaaaacgguaugaaacaua

SEQ ID NO: 1709616 - RNA, 18 nt, Salmonella enterica enterica serovar Typhi
uguagcggcaacagcacc

SEQ ID NO: 1709617 - RNA, 21 nt, Salmonella enterica enterica serovar Typhi
uguaggccugauagcacagcg

SEQ ID NO: 1709618 - RNA, 23 nt, Salmonella enterica enterica serovar Typhi
uguagcugucccagugucaacug

SEQ ID NO: 1709619 - RNA, 18 nt, Salmonella enterica enterica serovar Typhi
uguagcucauaacucgcu

SEQ ID NO: 1709620 - RNA, 17 nt, Salmonella enterica enterica serovar Typhi
uguaggguacagcgcga

SEQ ID NO: 1709621 - RNA, 12 nt, Salmonella enterica enterica serovar Typhi
uguaguuaucgc

SEQ ID NO: 1709622 - RNA, 12 nt, Salmonella enterica enterica serovar Typhi
uguagugguugu

SEQ ID NO: 1709623 - RNA, 12 nt, Salmonella enterica enterica serovar Typhi
uguaguuuuuug

SEQ ID NO: 1709624 - RNA, 15 nt, Salmonella enterica enterica serovar Typhi
uguauaaacucagca

SEQ ID NO: 1709625 - RNA, 21 nt, Salmonella enterica enterica serovar Typhi
uguauaauccaacauuaucaa

SEQ ID NO: 1709626 - RNA, 12 nt, Salmonella enterica enterica serovar Typhi
uguauaauuauu

SEQ ID NO: 1709627 - RNA, 17 nt, Salmonella enterica enterica serovar Typhi
uguauaccaaaaauaau

SEQ ID NO: 1709628 - RNA, 14 nt, Salmonella enterica enterica serovar Typhi
ugucacgcaggggg

SEQ ID NO: 1709629 - RNA, 17 nt, Salmonella enterica enterica serovar Typhi
ugucaacgugugccagg

SEQ ID NO: 1709630 - RNA, 19 nt, Salmonella enterica enterica serovar Typhi
ugucaacaacuucaaaaua

SEQ ID NO: 1709631 - RNA, 15 nt, Salmonella enterica enterica serovar Typhi
ugucaaauucaagcc

SEQ ID NO: 1709632 - RNA, 22 nt, Salmonella enterica enterica serovar Typhi
uguauuaaaggaucgauuaagg

SEQ ID NO: 1709633 - RNA, 15 nt, Salmonella enterica enterica serovar Typhi
ugucagacaugauaa

SEQ ID NO: 1709634 - RNA, 18 nt, Salmonella enterica enterica serovar Typhi
ugucagauccuucauuca

SEQ ID NO: 1709635 - RNA, 16 nt, Salmonella enterica enterica serovar Typhi
ugucaguggacgauaa

SEQ ID NO: 1709636 - RNA, 12 nt, Salmonella enterica enterica serovar Typhi
ugucauccugcu

SEQ ID NO: 1709637 - RNA, 23 nt, Salmonella enterica enterica serovar Typhi
ugucauagucggcgccaaaguua

SEQ ID NO: 1709638 - RNA, 17 nt, Salmonella enterica enterica serovar Typhi
ugucaucgucagcaacg

SEQ ID NO: 1709639 - RNA, 16 nt, Salmonella enterica enterica serovar Typhi
ugucaugcuaaaacag

SEQ ID NO: 1709640 - RNA, 13 nt, Salmonella enterica enterica serovar Typhi
ugucguauuuauu

SEQ ID NO: 1709641 - RNA, 16 nt, Salmonella enterica enterica serovar Typhi
ugucuauaggccugau

SEQ ID NO: 1709642 - RNA, 14 nt, Salmonella enterica enterica serovar Typhi
ugucuauuuauuga

SEQ ID NO: 1709643 - RNA, 21 nt, Salmonella enterica enterica serovar Typhi
ugucuauuuauugaagaugua

SEQ ID NO: 1709644 - RNA, 19 nt, Salmonella enterica enterica serovar Typhi
ugucgggccuacagaugaa

SEQ ID NO: 1709645 - RNA, 22 nt, Salmonella enterica enterica serovar Typhi
ugucgggccaaucggagugaau

SEQ ID NO: 1709646 - RNA, 17 nt, Salmonella enterica enterica serovar Typhi
ugucgcgagcuuccagu

SEQ ID NO: 1709647 - RNA, 17 nt, Salmonella enterica enterica serovar Typhi
ugucgcggcggcaaaag

SEQ ID NO: 1709648 - RNA, 19 nt, Salmonella enterica enterica serovar Typhi
ugucgggcaaaaugcgucg

SEQ ID NO: 1709649 - RNA, 18 nt, Salmonella enterica enterica serovar Typhi
ugucgcuggauagcacca

SEQ ID NO: 1709650 - RNA, 19 nt, Salmonella enterica enterica serovar Typhi
ugucauucgccucaaaacc

SEQ ID NO: 1709651 - RNA, 16 nt, Salmonella enterica enterica serovar Typhi
uguccagcagugucug

SEQ ID NO: 1709652 - RNA, 14 nt, Salmonella enterica enterica serovar Typhi
uguccagcggccau

SEQ ID NO: 1709653 - RNA, 20 nt, Salmonella enterica enterica serovar Typhi
uguccaggucaucaccucca

SEQ ID NO: 1709654 - RNA, 22 nt, Salmonella enterica enterica serovar Typhi
uguccaggucaucaccuccagc

SEQ ID NO: 1709655 - RNA, 20 nt, Salmonella enterica enterica serovar Typhi
uguccaguuuuugcauuaua

SEQ ID NO: 1709656 - RNA, 21 nt, Salmonella enterica enterica serovar Typhi
ugucgccauaucuucgcgcgu

SEQ ID NO: 1709657 - RNA, 13 nt, Salmonella enterica enterica serovar Typhi
uguccauaaaaug

SEQ ID NO: 1709658 - RNA, 14 nt, Salmonella enterica enterica serovar Typhi
ugucgccguggaac

SEQ ID NO: 1709659 - RNA, 15 nt, Salmonella enterica enterica serovar Typhi
ugucgccggaaaaaa

SEQ ID NO: 1709660 - RNA, 11 nt, Salmonella enterica enterica serovar Typhi
ugugauaaaug

SEQ ID NO: 1709661 - RNA, 18 nt, Salmonella enterica enterica serovar Typhi
ugugcauaucuggcgagg

SEQ ID NO: 1709662 - RNA, 15 nt, Salmonella enterica enterica serovar Typhi
ugugccgucauccag

SEQ ID NO: 1709663 - RNA, 15 nt, Salmonella enterica enterica serovar Typhi
ugucuuaaagaaaaa

SEQ ID NO: 1709664 - RNA, 13 nt, Salmonella enterica enterica serovar Typhi
ugucuuaaauaug

SEQ ID NO: 1709665 - RNA, 14 nt, Salmonella enterica enterica serovar Typhi
ugugaccccggccu

SEQ ID NO: 1709666 - RNA, 17 nt, Salmonella enterica enterica serovar Typhi
ugugacaaucacucucu

SEQ ID NO: 1709667 - RNA, 23 nt, Salmonella enterica enterica serovar Typhi
ugugagaaaagcgaaaauaaacg

SEQ ID NO: 1709668 - RNA, 12 nt, Salmonella enterica enterica serovar Typhi
ugugagccauaa

SEQ ID NO: 1709669 - RNA, 20 nt, Salmonella enterica enterica serovar Typhi
ugugagauaaaaaagcugcg

SEQ ID NO: 1709670 - RNA, 12 nt, Salmonella enterica enterica serovar Typhi
uguuacccagcc

SEQ ID NO: 1709671 - RNA, 12 nt, Salmonella enterica enterica serovar Typhi
uguuaccaaugc

SEQ ID NO: 1709672 - RNA, 18 nt, Salmonella enterica enterica serovar Typhi
uguuacgcugguuugugu

SEQ ID NO: 1709673 - RNA, 17 nt, Salmonella enterica enterica serovar Typhi
uguuacucaauaaaagu

SEQ ID NO: 1709674 - RNA, 22 nt, Salmonella enterica enterica serovar Typhi
uguuagacauuccauuggccag

SEQ ID NO: 1709675 - RNA, 16 nt, Salmonella enterica enterica serovar Typhi
uguuaaugguaccaau

SEQ ID NO: 1709676 - RNA, 20 nt, Salmonella enterica enterica serovar Typhi
uguuaaucauuuucuuugca

SEQ ID NO: 1709677 - RNA, 21 nt, Salmonella enterica enterica serovar Typhi
uguuaauuugcaucaggccaa

SEQ ID NO: 1709678 - RNA, 14 nt, Salmonella enterica enterica serovar Typhi
uguuaauugucagc

SEQ ID NO: 1709679 - RNA, 18 nt, Salmonella enterica enterica serovar Typhi
uguguggagguuucuuca

SEQ ID NO: 1709680 - RNA, 20 nt, Salmonella enterica enterica serovar Typhi
ugugugagcgcccgccgcga

SEQ ID NO: 1709681 - RNA, 20 nt, Salmonella enterica enterica serovar Typhi
ugugcgucgcguucgcauau

SEQ ID NO: 1709682 - RNA, 14 nt, Salmonella enterica enterica serovar Typhi
ugugcgugaugggc

SEQ ID NO: 1709683 - RNA, 16 nt, Salmonella enterica enterica serovar Typhi
ugugcugauugucagc

SEQ ID NO: 1709684 - RNA, 12 nt, Salmonella enterica enterica serovar Typhi
ugugcugguuga

SEQ ID NO: 1709685 - RNA, 15 nt, Salmonella enterica enterica serovar Typhi
ugugcuuccagcucc

SEQ ID NO: 1709686 - RNA, 18 nt, Salmonella enterica enterica serovar Typhi
uguggcuguguucauccc

SEQ ID NO: 1709687 - RNA, 14 nt, Salmonella enterica enterica serovar Typhi
uguggccaggcacg

SEQ ID NO: 1709688 - RNA, 21 nt, Salmonella enterica enterica serovar Typhi
uguguacauccagaaggcaaa

SEQ ID NO: 1709689 - RNA, 13 nt, Salmonella enterica enterica serovar Typhi
uguguacaaccau

SEQ ID NO: 1709690 - RNA, 13 nt, Salmonella enterica enterica serovar Typhi
ugugguuuaaaac

SEQ ID NO: 1709691 - RNA, 14 nt, Salmonella enterica enterica serovar Typhi
uguguauauauugc

SEQ ID NO: 1709692 - RNA, 21 nt, Salmonella enterica enterica serovar Typhi
uguguauauauugcauuuuau

SEQ ID NO: 1709693 - RNA, 14 nt, Salmonella enterica enterica serovar Typhi
ugugucaaaaaguu

SEQ ID NO: 1709694 - RNA, 18 nt, Salmonella enterica enterica serovar Typhi
ugugguugugguaaucaa

SEQ ID NO: 1709695 - RNA, 13 nt, Salmonella enterica enterica serovar Typhi
uguggugcggcuu

SEQ ID NO: 1709696 - RNA, 22 nt, Salmonella enterica enterica serovar Typhi
uguggggggaacggcagacagc

SEQ ID NO: 1709697 - RNA, 15 nt, Salmonella enterica enterica serovar Typhi
uggggcaagcucagc

SEQ ID NO: 1709698 - RNA, 19 nt, Salmonella enterica enterica serovar Typhi
uggggcaagcucagcggca

SEQ ID NO: 1709699 - RNA, 17 nt, Salmonella enterica enterica serovar Typhi
ugggcgcacagcgccau

SEQ ID NO: 1709700 - RNA, 14 nt, Salmonella enterica enterica serovar Typhi
ugggcggcaccagc

SEQ ID NO: 1709701 - RNA, 17 nt, Salmonella enterica enterica serovar Typhi
uggcuuaccuucggccu

SEQ ID NO: 1709702 - RNA, 17 nt, Salmonella enterica enterica serovar Typhi
uggcuuaccguaugcaa

SEQ ID NO: 1709703 - RNA, 20 nt, Salmonella enterica enterica serovar Typhi
uggcguuaccggcaggcugg

SEQ ID NO: 1709704 - RNA, 19 nt, Salmonella enterica enterica serovar Typhi
uggcguuccacccaguuca

SEQ ID NO: 1709705 - RNA, 18 nt, Salmonella enterica enterica serovar Typhi
uggcuuccguccccagcc

SEQ ID NO: 1709706 - RNA, 22 nt, Salmonella enterica enterica serovar Typhi
uggcuucuuuaacuaauggcaa

SEQ ID NO: 1709707 - RNA, 14 nt, Salmonella enterica enterica serovar Typhi
ugggcaaucaucag

SEQ ID NO: 1709708 - RNA, 20 nt, Salmonella enterica enterica serovar Typhi
ugggaucgacucauccagca

SEQ ID NO: 1709709 - RNA, 14 nt, Salmonella enterica enterica serovar Typhi
ugggauauuacaga

SEQ ID NO: 1709710 - RNA, 22 nt, Salmonella enterica enterica serovar Typhi
ugggauaggcucuuauucaauc

SEQ ID NO: 1709711 - RNA, 18 nt, Salmonella enterica enterica serovar Typhi
uggcuuuuaagguuaauu

SEQ ID NO: 1709712 - RNA, 15 nt, Salmonella enterica enterica serovar Typhi
uggucacaaaggcca

SEQ ID NO: 1709713 - RNA, 15 nt, Salmonella enterica enterica serovar Typhi
uggucaccaugacgc

SEQ ID NO: 1709714 - RNA, 12 nt, Salmonella enterica enterica serovar Typhi
uggucaucgcgg

SEQ ID NO: 1709715 - RNA, 20 nt, Salmonella enterica enterica serovar Typhi
uggucagcucacgcgccagc

SEQ ID NO: 1709716 - RNA, 15 nt, Salmonella enterica enterica serovar Typhi
uggucaggcuaaaug

SEQ ID NO: 1709717 - RNA, 12 nt, Salmonella enterica enterica serovar Typhi
uggucagcgcgc

SEQ ID NO: 1709718 - RNA, 14 nt, Salmonella enterica enterica serovar Typhi
uggucaucgaaggc

SEQ ID NO: 1709719 - RNA, 14 nt, Salmonella enterica enterica serovar Typhi
uggucgaaaauauc

SEQ ID NO: 1709720 - RNA, 19 nt, Salmonella enterica enterica serovar Typhi
uggucgcuaacccaggccg

SEQ ID NO: 1709721 - RNA, 23 nt, Salmonella enterica enterica serovar Typhi
uggucggcgaccagcagcgcggc

SEQ ID NO: 1709722 - RNA, 19 nt, Salmonella enterica enterica serovar Typhi
ugguaagagcgacucaggu

SEQ ID NO: 1709723 - RNA, 19 nt, Salmonella enterica enterica serovar Typhi
ugguaagcgccaagcggca

SEQ ID NO: 1709724 - RNA, 13 nt, Salmonella enterica enterica serovar Typhi
ugguaaaauccuu

SEQ ID NO: 1709725 - RNA, 18 nt, Salmonella enterica enterica serovar Typhi
ugguaccaaacagcagaa

SEQ ID NO: 1709726 - RNA, 22 nt, Salmonella enterica enterica serovar Typhi
uggguuugugucguaguggcau

SEQ ID NO: 1709727 - RNA, 23 nt, Salmonella enterica enterica serovar Typhi
ugguaaaauuauugugagaaaag

SEQ ID NO: 1709728 - RNA, 15 nt, Salmonella enterica enterica serovar Typhi
ugguaaaacgcuggc

SEQ ID NO: 1709729 - RNA, 20 nt, Salmonella enterica enterica serovar Typhi
uggguuauggguguuuucac

SEQ ID NO: 1709730 - RNA, 22 nt, Salmonella enterica enterica serovar Typhi
ugguaucaaaaagcgcagaccc

SEQ ID NO: 1709731 - RNA, 15 nt, Salmonella enterica enterica serovar Typhi
ugguauucauuacag

SEQ ID NO: 1709732 - RNA, 22 nt, Salmonella enterica enterica serovar Typhi
ugguaccgccaucggcgccggg

SEQ ID NO: 1709733 - RNA, 22 nt, Salmonella enterica enterica serovar Typhi
ugguagcgcugaugcaggcaau

SEQ ID NO: 1709734 - RNA, 15 nt, Salmonella enterica enterica serovar Typhi
ugguagcccucgcaa

SEQ ID NO: 1709735 - RNA, 15 nt, Salmonella enterica enterica serovar Typhi
ugguagacccggcau

SEQ ID NO: 1709736 - RNA, 16 nt, Salmonella enterica enterica serovar Typhi
ugguagacgcaccaga

SEQ ID NO: 1709737 - RNA, 17 nt, Salmonella enterica enterica serovar Typhi
uggcgguauaacugccu

SEQ ID NO: 1709738 - RNA, 21 nt, Salmonella enterica enterica serovar Typhi
uggcgcuggccgaauagcuga

SEQ ID NO: 1709739 - RNA, 13 nt, Salmonella enterica enterica serovar Typhi
uggcgcuuuucca

SEQ ID NO: 1709740 - RNA, 18 nt, Salmonella enterica enterica serovar Typhi
uggcggagaucuccagau

SEQ ID NO: 1709741 - RNA, 19 nt, Salmonella enterica enterica serovar Typhi
uggcggaauaucgcggaaa

SEQ ID NO: 1709742 - RNA, 16 nt, Salmonella enterica enterica serovar Typhi
uggcgcuccugaaucg

SEQ ID NO: 1709743 - RNA, 18 nt, Salmonella enterica enterica serovar Typhi
uggcgccuuuuggcagca

SEQ ID NO: 1709744 - RNA, 18 nt, Salmonella enterica enterica serovar Typhi
uggcgcuaaaauccacuc

SEQ ID NO: 1709745 - RNA, 17 nt, Salmonella enterica enterica serovar Typhi
uggcgauauccgugccg

SEQ ID NO: 1709746 - RNA, 15 nt, Salmonella enterica enterica serovar Typhi
uggccgcgugcucgc

SEQ ID NO: 1709747 - RNA, 18 nt, Salmonella enterica enterica serovar Typhi
uggccgggauauccugcu

SEQ ID NO: 1709748 - RNA, 21 nt, Salmonella enterica enterica serovar Typhi
uggcgaauaaaauucagcgca

SEQ ID NO: 1709749 - RNA, 13 nt, Salmonella enterica enterica serovar Typhi
uggcgaauacugu

SEQ ID NO: 1709750 - RNA, 20 nt, Salmonella enterica enterica serovar Typhi
uggcgaauacuguuccaggc

SEQ ID NO: 1709751 - RNA, 16 nt, Salmonella enterica enterica serovar Typhi
uggccucccaguuccc

SEQ ID NO: 1709752 - RNA, 23 nt, Salmonella enterica enterica serovar Typhi
uggcagccucguccugcaauuug

SEQ ID NO: 1709753 - RNA, 12 nt, Salmonella enterica enterica serovar Typhi
uggcaggccucu

SEQ ID NO: 1709754 - RNA, 17 nt, Salmonella enterica enterica serovar Typhi
uggccacaucguuaccc

SEQ ID NO: 1709755 - RNA, 13 nt, Salmonella enterica enterica serovar Typhi
uggccacaucguu

SEQ ID NO: 1709756 - RNA, 13 nt, Salmonella enterica enterica serovar Typhi
uggccaaauaacc

SEQ ID NO: 1709757 - RNA, 21 nt, Salmonella enterica enterica serovar Typhi
uggccaaucagcggguauugc

SEQ ID NO: 1709758 - RNA, 15 nt, Salmonella enterica enterica serovar Typhi
uggccaagaugcuga

SEQ ID NO: 1709759 - RNA, 14 nt, Salmonella enterica enterica serovar Typhi
uggccaaucagcgg

SEQ ID NO: 1709760 - RNA, 12 nt, Salmonella enterica enterica serovar Typhi
uggccaccagcu

SEQ ID NO: 1709761 - RNA, 19 nt, Salmonella enterica enterica serovar Typhi
uggccaggaauaaagguca

SEQ ID NO: 1709762 - RNA, 17 nt, Salmonella enterica enterica serovar Typhi
uggccauauuuuuucag

SEQ ID NO: 1709763 - RNA, 19 nt, Salmonella enterica enterica serovar Typhi
uggccaucuuccagcauca

SEQ ID NO: 1709764 - RNA, 14 nt, Salmonella enterica enterica serovar Typhi
uggccaucuuccag

SEQ ID NO: 1709765 - RNA, 22 nt, Salmonella enterica enterica serovar Typhi
uggccgauaugaauaauuucgg

SEQ ID NO: 1709766 - RNA, 20 nt, Salmonella enterica enterica serovar Typhi
uggccaugccuaaaccgaca

SEQ ID NO: 1709767 - RNA, 22 nt, Salmonella enterica enterica serovar Typhi
uggccgaugucaauuacgcacc

SEQ ID NO: 1709768 - RNA, 20 nt, Salmonella enterica enterica serovar Typhi
uggccgcaaauuccaacaua

SEQ ID NO: 1709769 - RNA, 15 nt, Salmonella enterica enterica serovar Typhi
uggcaaaccccugcu

SEQ ID NO: 1709770 - RNA, 14 nt, Salmonella enterica enterica serovar Typhi
uggcaaaauccaac

SEQ ID NO: 1709771 - RNA, 19 nt, Salmonella enterica enterica serovar Typhi
uggauuucacgaucaucgc

SEQ ID NO: 1709772 - RNA, 12 nt, Salmonella enterica enterica serovar Typhi
ugcguucuucca

SEQ ID NO: 1709773 - RNA, 21 nt, Salmonella enterica enterica serovar Typhi
ugcguucuuccacuucagcag

SEQ ID NO: 1709774 - RNA, 15 nt, Salmonella enterica enterica serovar Typhi
ugcguugcuauggca

SEQ ID NO: 1709775 - RNA, 23 nt, Salmonella enterica enterica serovar Typhi
ugcguuaaacgcugugaccagua

SEQ ID NO: 1709776 - RNA, 23 nt, Salmonella enterica enterica serovar Typhi
ugcguuaacggcuucguuucaga

SEQ ID NO: 1709777 - RNA, 20 nt, Salmonella enterica enterica serovar Typhi
ugcguucacagcaccauguu

SEQ ID NO: 1709778 - RNA, 16 nt, Salmonella enterica enterica serovar Typhi
uggcacagggcaauaa

SEQ ID NO: 1709779 - RNA, 16 nt, Salmonella enterica enterica serovar Typhi
uggcacgauaaccaga

SEQ ID NO: 1709780 - RNA, 20 nt, Salmonella enterica enterica serovar Typhi
uggcaaucaaauccagcuca

SEQ ID NO: 1709781 - RNA, 13 nt, Salmonella enterica enterica serovar Typhi
uggcaacauuaau

SEQ ID NO: 1709782 - RNA, 22 nt, Salmonella enterica enterica serovar Typhi
uggcaacauuaaucuuauccag

SEQ ID NO: 1709783 - RNA, 22 nt, Salmonella enterica enterica serovar Typhi
uggcaacauagcaucguuaccg

SEQ ID NO: 1709784 - RNA, 13 nt, Salmonella enterica enterica serovar Typhi
uggcaacagccau

SEQ ID NO: 1709785 - RNA, 23 nt, Salmonella enterica enterica serovar Typhi
uggcaaucauaccgucagauucu

SEQ ID NO: 1709786 - RNA, 23 nt, Salmonella enterica enterica serovar Typhi
uucaaagccgccauccggccugu

SEQ ID NO: 1709787 - RNA, 21 nt, Salmonella enterica enterica serovar Typhi
uuauuuuccugaaaaaauucc

SEQ ID NO: 1709788 - RNA, 13 nt, Salmonella enterica enterica serovar Typhi
uuauuuucauacu

SEQ ID NO: 1709789 - RNA, 15 nt, Salmonella enterica enterica serovar Typhi
uuauuuucacgccau

SEQ ID NO: 1709790 - RNA, 14 nt, Salmonella enterica enterica serovar Typhi
uucaacggcaucaa

SEQ ID NO: 1709791 - RNA, 19 nt, Salmonella enterica enterica serovar Typhi
uucaacagcucgccaugca

SEQ ID NO: 1709792 - RNA, 15 nt, Salmonella enterica enterica serovar Typhi
uuaggcguaauuauu

SEQ ID NO: 1709793 - RNA, 11 nt, Salmonella enterica enterica serovar Typhi
uuaggcguggu

SEQ ID NO: 1709794 - RNA, 13 nt, Salmonella enterica enterica serovar Typhi
uuagggcgcggcu

SEQ ID NO: 1709795 - RNA, 17 nt, Salmonella enterica enterica serovar Typhi
uuauucccauuccugca

SEQ ID NO: 1709796 - RNA, 21 nt, Salmonella enterica enterica serovar Typhi
uuauuccuuuuuaggcuauaa

SEQ ID NO: 1709797 - RNA, 15 nt, Salmonella enterica enterica serovar Typhi
uuauucaucuccucu

SEQ ID NO: 1709798 - RNA, 10 nt, Salmonella enterica enterica serovar Typhi
uuauuucuau

SEQ ID NO: 1709799 - RNA, 21 nt, Salmonella enterica enterica serovar Typhi
uuauuucaggaauacauuaac

SEQ ID NO: 1709800 - RNA, 20 nt, Salmonella enterica enterica serovar Typhi
uuauuggugaaaaaucauua

SEQ ID NO: 1709801 - RNA, 20 nt, Salmonella enterica enterica serovar Typhi
uuauucggucagauaaauaa

SEQ ID NO: 1709802 - RNA, 19 nt, Salmonella enterica enterica serovar Typhi
uuauucggaaugaugugcu

SEQ ID NO: 1709803 - RNA, 23 nt, Salmonella enterica enterica serovar Typhi
uuauucgccuuucacgcguucaa

SEQ ID NO: 1709804 - RNA, 23 nt, Salmonella enterica enterica serovar Typhi
uucaaggcucaauacgcauaaug

SEQ ID NO: 1709805 - RNA, 18 nt, Salmonella enterica enterica serovar Typhi
uucaacuuccaccaccuc

SEQ ID NO: 1709806 - RNA, 18 nt, Salmonella enterica enterica serovar Typhi
uucaaugcauacugccgg

SEQ ID NO: 1709807 - RNA, 14 nt, Salmonella enterica enterica serovar Typhi
uucaaugcacgcca

SEQ ID NO: 1709808 - RNA, 15 nt, Salmonella enterica enterica serovar Typhi
uucaaugaacaauaa

SEQ ID NO: 1709809 - RNA, 14 nt, Salmonella enterica enterica serovar Typhi
uucacacaauuuuc

SEQ ID NO: 1709810 - RNA, 14 nt, Salmonella enterica enterica serovar Typhi
uucacaaccugaaa

SEQ ID NO: 1709811 - RNA, 21 nt, Salmonella enterica enterica serovar Typhi
uucaauuugugagauaaaaaa

SEQ ID NO: 1709812 - RNA, 13 nt, Salmonella enterica enterica serovar Typhi
uucacaaacuucu

SEQ ID NO: 1709813 - RNA, 18 nt, Salmonella enterica enterica serovar Typhi
uucagauggccaaugaug

SEQ ID NO: 1709814 - RNA, 16 nt, Salmonella enterica enterica serovar Typhi
uucagauaauucuaaa

SEQ ID NO: 1709815 - RNA, 20 nt, Salmonella enterica enterica serovar Typhi
uucagagcgucuuuuauccc

SEQ ID NO: 1709816 - RNA, 24 nt, Salmonella enterica enterica serovar Typhi
uucacugucaugguuauuuugucc

SEQ ID NO: 1709817 - RNA, 16 nt, Salmonella enterica enterica serovar Typhi
uucacuuuaaagccca

SEQ ID NO: 1709818 - RNA, 21 nt, Salmonella enterica enterica serovar Typhi
uucagaaaguuacuuuccaua

SEQ ID NO: 1709819 - RNA, 18 nt, Salmonella enterica enterica serovar Typhi
uucacuccuaagagaaaa

SEQ ID NO: 1709820 - RNA, 19 nt, Salmonella enterica enterica serovar Typhi
uucacgcucacgcagauau

SEQ ID NO: 1709821 - RNA, 20 nt, Salmonella enterica enterica serovar Typhi
uucacgcucacgcagauauu

SEQ ID NO: 1709822 - RNA, 21 nt, Salmonella enterica enterica serovar Typhi
uucacgcucgaguucuucacg

SEQ ID NO: 1709823 - RNA, 16 nt, Salmonella enterica enterica serovar Typhi
uucaccaaauccucac

SEQ ID NO: 1709824 - RNA, 19 nt, Salmonella enterica enterica serovar Typhi
uucacgcauugccacagcc

SEQ ID NO: 1709825 - RNA, 22 nt, Salmonella enterica enterica serovar Typhi
uucaccauuaauacccauagua

SEQ ID NO: 1709826 - RNA, 18 nt, Salmonella enterica enterica serovar Typhi
uucacgccauugccagga

SEQ ID NO: 1709827 - RNA, 16 nt, Salmonella enterica enterica serovar Typhi
uucaucaggccugcaa

SEQ ID NO: 1709828 - RNA, 13 nt, Salmonella enterica enterica serovar Typhi
uucaucaggcuga

SEQ ID NO: 1709829 - RNA, 18 nt, Salmonella enterica enterica serovar Typhi
uucaucaggcaauaaaca

SEQ ID NO: 1709830 - RNA, 21 nt, Salmonella enterica enterica serovar Typhi
uucaucaggcaauaaacauca

SEQ ID NO: 1709831 - RNA, 14 nt, Salmonella enterica enterica serovar Typhi
uucaucaguaacug

SEQ ID NO: 1709832 - RNA, 20 nt, Salmonella enterica enterica serovar Typhi
uucaucgccacaugcggcag

SEQ ID NO: 1709833 - RNA, 16 nt, Salmonella enterica enterica serovar Typhi
uucaucgccgauuccu

SEQ ID NO: 1709834 - RNA, 22 nt, Salmonella enterica enterica serovar Typhi
uucauccauauaucugaauaga

SEQ ID NO: 1709835 - RNA, 14 nt, Salmonella enterica enterica serovar Typhi
uucaucaaaaugca

SEQ ID NO: 1709836 - RNA, 16 nt, Salmonella enterica enterica serovar Typhi
uucaucaaagaaauac

SEQ ID NO: 1709837 - RNA, 20 nt, Salmonella enterica enterica serovar Typhi
uucauaugcgccaacugcau

SEQ ID NO: 1709838 - RNA, 23 nt, Salmonella enterica enterica serovar Typhi
uucauauuauuauauagacuccg

SEQ ID NO: 1709839 - RNA, 14 nt, Salmonella enterica enterica serovar Typhi
uucauagaaccacu

SEQ ID NO: 1709840 - RNA, 21 nt, Salmonella enterica enterica serovar Typhi
uucauauagucauaauacuca

SEQ ID NO: 1709841 - RNA, 16 nt, Salmonella enterica enterica serovar Typhi
uucagccuuuucauau

SEQ ID NO: 1709842 - RNA, 17 nt, Salmonella enterica enterica serovar Typhi
uucagcggcagcucugc

SEQ ID NO: 1709843 - RNA, 15 nt, Salmonella enterica enterica serovar Typhi
uucagcgccugaaug

SEQ ID NO: 1709844 - RNA, 18 nt, Salmonella enterica enterica serovar Typhi
uucagcgccagauaguca

SEQ ID NO: 1709845 - RNA, 23 nt, Salmonella enterica enterica serovar Typhi
uucagcguaccgaagaacauaaa

SEQ ID NO: 1709846 - RNA, 16 nt, Salmonella enterica enterica serovar Typhi
uucagcguugcagcca

SEQ ID NO: 1709847 - RNA, 15 nt, Salmonella enterica enterica serovar Typhi
uucagguauugguau

SEQ ID NO: 1709848 - RNA, 21 nt, Salmonella enterica enterica serovar Typhi
uucaggucauacggcaugcca

SEQ ID NO: 1709849 - RNA, 16 nt, Salmonella enterica enterica serovar Typhi
uucaguaggacaaaaa

SEQ ID NO: 1709850 - RNA, 23 nt, Salmonella enterica enterica serovar Typhi
uucagugccugauagcgcugugc

SEQ ID NO: 1709851 - RNA, 15 nt, Salmonella enterica enterica serovar Typhi
uucauaagucaucca

SEQ ID NO: 1709852 - RNA, 22 nt, Salmonella enterica enterica serovar Typhi
uucauaacgaccuuuacugaca

SEQ ID NO: 1709853 - RNA, 21 nt, Salmonella enterica enterica serovar Typhi
uucauaauaagcgcucaggca

SEQ ID NO: 1709854 - RNA, 17 nt, Salmonella enterica enterica serovar Typhi
uucauaaagugccaggg

SEQ ID NO: 1709855 - RNA, 21 nt, Salmonella enterica enterica serovar Typhi
uucauaaagugccagggcgga

SEQ ID NO: 1709856 - RNA, 16 nt, Salmonella enterica enterica serovar Typhi
uucauaacaccaauac

SEQ ID NO: 1709857 - RNA, 16 nt, Salmonella enterica enterica serovar Typhi
uucaguucggagauca

SEQ ID NO: 1709858 - RNA, 21 nt, Salmonella enterica enterica serovar Typhi
uucaguugcccauuuuccucc

SEQ ID NO: 1709859 - RNA, 20 nt, Salmonella enterica enterica serovar Typhi
uucaguuaaauaaacaaaaa

SEQ ID NO: 1709860 - RNA, 13 nt, Salmonella enterica enterica serovar Typhi
uucauaaaagauc

SEQ ID NO: 1709861 - RNA, 15 nt, Salmonella enterica enterica serovar Typhi
uucaucggcucgacu

SEQ ID NO: 1709862 - RNA, 15 nt, Salmonella enterica enterica serovar Typhi
uucaucgguaauauu

SEQ ID NO: 1709863 - RNA, 20 nt, Salmonella enterica enterica serovar Typhi
uucaucuguggcaauuuuca

SEQ ID NO: 1709864 - RNA, 12 nt, Salmonella enterica enterica serovar Typhi
uucaucuucuuu

SEQ ID NO: 1709865 - RNA, 14 nt, Salmonella enterica enterica serovar Typhi
uucaucuucaguaa

SEQ ID NO: 1709866 - RNA, 22 nt, Salmonella enterica enterica serovar Typhi
uucaucuucaccuuuccaguca

SEQ ID NO: 1709867 - RNA, 15 nt, Salmonella enterica enterica serovar Typhi
uucaucuuccgggac

SEQ ID NO: 1709868 - RNA, 16 nt, Salmonella enterica enterica serovar Typhi
uucaugaucuuuccuu

SEQ ID NO: 1709869 - RNA, 18 nt, Salmonella enterica enterica serovar Typhi
uucaugaucuuuccuuuu

SEQ ID NO: 1709870 - RNA, 21 nt, Salmonella enterica enterica serovar Typhi
uucaugguacucaacaucauu

SEQ ID NO: 1709871 - RNA, 22 nt, Salmonella enterica enterica serovar Typhi
uucauguuucgacaguuucuuc

SEQ ID NO: 1709872 - RNA, 13 nt, Salmonella enterica enterica serovar Typhi
uucaugcaauaau

SEQ ID NO: 1709873 - RNA, 21 nt, Salmonella enterica enterica serovar Typhi
uucaugcaauuccgcuuucuu

SEQ ID NO: 1709874 - RNA, 16 nt, Salmonella enterica enterica serovar Typhi
uucaugcacaaaaccc

SEQ ID NO: 1709875 - RNA, 22 nt, Salmonella enterica enterica serovar Typhi
uucaugcacaaaacccgcagcc

SEQ ID NO: 1709876 - RNA, 14 nt, Salmonella enterica enterica serovar Typhi
uucaugcagccaua

SEQ ID NO: 1709877 - RNA, 17 nt, Salmonella enterica enterica serovar Typhi
uucaugcagcccgcacu

SEQ ID NO: 1709878 - RNA, 19 nt, Salmonella enterica enterica serovar Typhi
uucaugccauacuccugcc

SEQ ID NO: 1709879 - RNA, 20 nt, Salmonella enterica enterica serovar Typhi
uucauggcgcgacauggcga

SEQ ID NO: 1709880 - RNA, 19 nt, Salmonella enterica enterica serovar Typhi
uucaugguaaaauccuuuu

SEQ ID NO: 1709881 - RNA, 21 nt, Salmonella enterica enterica serovar Typhi
uucauggucaucgcaaauucu

SEQ ID NO: 1709882 - RNA, 13 nt, Salmonella enterica enterica serovar Typhi
uucaugcgcggcg

SEQ ID NO: 1709883 - RNA, 16 nt, Salmonella enterica enterica serovar Typhi
uucaugcuguauaaac

SEQ ID NO: 1709884 - RNA, 15 nt, Salmonella enterica enterica serovar Typhi
uucaugcuucucaaa

SEQ ID NO: 1709885 - RNA, 22 nt, Salmonella enterica enterica serovar Typhi
uucauuuguuccucgaaacgcu

SEQ ID NO: 1709886 - RNA, 18 nt, Salmonella enterica enterica serovar Typhi
uucauuuuauagucccuc

SEQ ID NO: 1709887 - RNA, 16 nt, Salmonella enterica enterica serovar Typhi
uucauucgccaccagg

SEQ ID NO: 1709888 - RNA, 20 nt, Salmonella enterica enterica serovar Typhi
uucauucgucaaauucaccc

SEQ ID NO: 1709889 - RNA, 18 nt, Salmonella enterica enterica serovar Typhi
uucauuauuuuuaaauaa

SEQ ID NO: 1709890 - RNA, 20 nt, Salmonella enterica enterica serovar Typhi
uucauucacccaauaaauaa

SEQ ID NO: 1709891 - RNA, 21 nt, Salmonella enterica enterica serovar Typhi
uucauucacccaauaaauaau

SEQ ID NO: 1709892 - RNA, 15 nt, Salmonella enterica enterica serovar Typhi
uucauuacgccuguc

SEQ ID NO: 1709893 - RNA, 17 nt, Salmonella enterica enterica serovar Typhi
uucauuucgaucuguuu

SEQ ID NO: 1709894 - RNA, 16 nt, Salmonella enterica enterica serovar Typhi
uucauuucacuuguuc

SEQ ID NO: 1709895 - RNA, 15 nt, Salmonella enterica enterica serovar Typhi
uucauuucaggcaaa

SEQ ID NO: 1709896 - RNA, 17 nt, Salmonella enterica enterica serovar Typhi
uuccugaguuuaugagg

SEQ ID NO: 1709897 - RNA, 14 nt, Salmonella enterica enterica serovar Typhi
uuccggugugacca

SEQ ID NO: 1709898 - RNA, 14 nt, Salmonella enterica enterica serovar Typhi
uuccguccaccugg

SEQ ID NO: 1709899 - RNA, 23 nt, Salmonella enterica enterica serovar Typhi
uucgaccgacgcguuuuccagca

SEQ ID NO: 1709900 - RNA, 15 nt, Salmonella enterica enterica serovar Typhi
uucgacaguuucuuc

SEQ ID NO: 1709901 - RNA, 14 nt, Salmonella enterica enterica serovar Typhi
uucgaauccuccug

SEQ ID NO: 1709902 - RNA, 23 nt, Salmonella enterica enterica serovar Typhi
uuccuuauuaaagccccuuccuc

SEQ ID NO: 1709903 - RNA, 18 nt, Salmonella enterica enterica serovar Typhi
uucgaacgccgacaucac

SEQ ID NO: 1709904 - RNA, 15 nt, Salmonella enterica enterica serovar Typhi
uuccgccaccacgcc

SEQ ID NO: 1709905 - RNA, 16 nt, Salmonella enterica enterica serovar Typhi
uuccgccaccacgccc

SEQ ID NO: 1709906 - RNA, 19 nt, Salmonella enterica enterica serovar Typhi
uuccgccaccagauaguca

SEQ ID NO: 1709907 - RNA, 23 nt, Salmonella enterica enterica serovar Typhi
uuccgccaccagauagucaucac

SEQ ID NO: 1709908 - RNA, 15 nt, Salmonella enterica enterica serovar Typhi
uucccuuaucugcaa

SEQ ID NO: 1709909 - RNA, 11 nt, Salmonella enterica enterica serovar Typhi
uucccuggccg

SEQ ID NO: 1709910 - RNA, 17 nt, Salmonella enterica enterica serovar Typhi
uuccgggcgcaccaguu

SEQ ID NO: 1709911 - RNA, 21 nt, Salmonella enterica enterica serovar Typhi
uuccgggcgcaccaguucccc

SEQ ID NO: 1709912 - RNA, 16 nt, Salmonella enterica enterica serovar Typhi
uuccggcgaaaaaccg

SEQ ID NO: 1709913 - RNA, 18 nt, Salmonella enterica enterica serovar Typhi
uuccggcggucagccagc

SEQ ID NO: 1709914 - RNA, 19 nt, Salmonella enterica enterica serovar Typhi
uuccgccgcgguauucaua

SEQ ID NO: 1709915 - RNA, 14 nt, Salmonella enterica enterica serovar Typhi
uuccgcgcaaauac

SEQ ID NO: 1709916 - RNA, 21 nt, Salmonella enterica enterica serovar Typhi
uuccgccagcgccagcagcag

SEQ ID NO: 1709917 - RNA, 13 nt, Salmonella enterica enterica serovar Typhi
uuccgccccgccu

SEQ ID NO: 1709918 - RNA, 14 nt, Salmonella enterica enterica serovar Typhi
uuccgccagauaca

SEQ ID NO: 1709919 - RNA, 21 nt, Salmonella enterica enterica serovar Typhi
uucccggcuaaccuguaucug

SEQ ID NO: 1709920 - RNA, 17 nt, Salmonella enterica enterica serovar Typhi
uucccgcugguugccuu

SEQ ID NO: 1709921 - RNA, 19 nt, Salmonella enterica enterica serovar Typhi
uucccggcaugccauaauc

SEQ ID NO: 1709922 - RNA, 16 nt, Salmonella enterica enterica serovar Typhi
uucccggaaaaguauu

SEQ ID NO: 1709923 - RNA, 18 nt, Salmonella enterica enterica serovar Typhi
uucccggcaauuaccgcc

SEQ ID NO: 1709924 - RNA, 17 nt, Salmonella enterica enterica serovar Typhi
uucccuacucucgcaug

SEQ ID NO: 1709925 - RNA, 15 nt, Salmonella enterica enterica serovar Typhi
uucccucauauuugu

SEQ ID NO: 1709926 - RNA, 22 nt, Salmonella enterica enterica serovar Typhi
uuccaauauuuauuuaauguuu

SEQ ID NO: 1709927 - RNA, 17 nt, Salmonella enterica enterica serovar Typhi
uucccccauccgcgccg

SEQ ID NO: 1709928 - RNA, 11 nt, Salmonella enterica enterica serovar Typhi
uuccccuccgc

SEQ ID NO: 1709929 - RNA, 16 nt, Salmonella enterica enterica serovar Typhi
uuccccugaugcguau

SEQ ID NO: 1709930 - RNA, 12 nt, Salmonella enterica enterica serovar Typhi
uuccccguggcc

SEQ ID NO: 1709931 - RNA, 19 nt, Salmonella enterica enterica serovar Typhi
uuccccgccgcacacgccg

SEQ ID NO: 1709932 - RNA, 20 nt, Salmonella enterica enterica serovar Typhi
uuccccgaucagaaaaccuu

SEQ ID NO: 1709933 - RNA, 14 nt, Salmonella enterica enterica serovar Typhi
uucgcgaugcagca

SEQ ID NO: 1709934 - RNA, 17 nt, Salmonella enterica enterica serovar Typhi
uucgcgaugcucaacca

SEQ ID NO: 1709935 - RNA, 16 nt, Salmonella enterica enterica serovar Typhi
uucgcggaauuucagg

SEQ ID NO: 1709936 - RNA, 22 nt, Salmonella enterica enterica serovar Typhi
uucgcgcuaaaugacaaauaga

SEQ ID NO: 1709937 - RNA, 13 nt, Salmonella enterica enterica serovar Typhi
uucgcccauaucc

SEQ ID NO: 1709938 - RNA, 17 nt, Salmonella enterica enterica serovar Typhi
uucgccccacuggcccc

SEQ ID NO: 1709939 - RNA, 13 nt, Salmonella enterica enterica serovar Typhi
uucgcccacgccc

SEQ ID NO: 1709940 - RNA, 21 nt, Salmonella enterica enterica serovar Typhi
uucgcaaccuaaccaaacaga

SEQ ID NO: 1709941 - RNA, 20 nt, Salmonella enterica enterica serovar Typhi
uucgauuguugacugccagc

SEQ ID NO: 1709942 - RNA, 15 nt, Salmonella enterica enterica serovar Typhi
uucgacgauaaaaaa

SEQ ID NO: 1709943 - RNA, 16 nt, Salmonella enterica enterica serovar Typhi
uucgacgauaaaaaaa

SEQ ID NO: 1709944 - RNA, 13 nt, Salmonella enterica enterica serovar Typhi
uucgacuguuguu

SEQ ID NO: 1709945 - RNA, 23 nt, Salmonella enterica enterica serovar Typhi
uucgaguguaucuccugaaaccc

SEQ ID NO: 1709946 - RNA, 14 nt, Salmonella enterica enterica serovar Typhi
uucgauaaacucaa

SEQ ID NO: 1709947 - RNA, 23 nt, Salmonella enterica enterica serovar Typhi
uucgauaaacucaaucaggcuau

SEQ ID NO: 1709948 - RNA, 14 nt, Salmonella enterica enterica serovar Typhi
uucgaugaaaaaga

SEQ ID NO: 1709949 - RNA, 23 nt, Salmonella enterica enterica serovar Typhi
uucgaugaugagaugcaggccaa

SEQ ID NO: 1709950 - RNA, 21 nt, Salmonella enterica enterica serovar Typhi
uucgauagcguuuuccagcuc

SEQ ID NO: 1709951 - RNA, 17 nt, Salmonella enterica enterica serovar Typhi
uucgauaaccaccagcg

SEQ ID NO: 1709952 - RNA, 20 nt, Salmonella enterica enterica serovar Typhi
uucgggcgcaugucagugac

SEQ ID NO: 1709953 - RNA, 18 nt, Salmonella enterica enterica serovar Typhi
uucguccggcugccacuc

SEQ ID NO: 1709954 - RNA, 14 nt, Salmonella enterica enterica serovar Typhi
uucggguuuuccug

SEQ ID NO: 1709955 - RNA, 13 nt, Salmonella enterica enterica serovar Typhi
uucgucuucaucu

SEQ ID NO: 1709956 - RNA, 18 nt, Salmonella enterica enterica serovar Typhi
uucgucuuuauucaucau

SEQ ID NO: 1709957 - RNA, 13 nt, Salmonella enterica enterica serovar Typhi
uucggcuucaauu

SEQ ID NO: 1709958 - RNA, 21 nt, Salmonella enterica enterica serovar Typhi
uucggcuccagguugcucagg

SEQ ID NO: 1709959 - RNA, 17 nt, Salmonella enterica enterica serovar Typhi
uucggcuucaccgauuu

SEQ ID NO: 1709960 - RNA, 15 nt, Salmonella enterica enterica serovar Typhi
uucggcgaaagaagc

SEQ ID NO: 1709961 - RNA, 15 nt, Salmonella enterica enterica serovar Typhi
uucggauucaauauu

SEQ ID NO: 1709962 - RNA, 14 nt, Salmonella enterica enterica serovar Typhi
uucggcagaaaaag

SEQ ID NO: 1709963 - RNA, 13 nt, Salmonella enterica enterica serovar Typhi
uucgcuaaaucag

SEQ ID NO: 1709964 - RNA, 18 nt, Salmonella enterica enterica serovar Typhi
uucuguaauuugaaauug

SEQ ID NO: 1709965 - RNA, 15 nt, Salmonella enterica enterica serovar Typhi
uucugucgccaccac

SEQ ID NO: 1709966 - RNA, 20 nt, Salmonella enterica enterica serovar Typhi
uucuguuuucgagccuugcc

SEQ ID NO: 1709967 - RNA, 13 nt, Salmonella enterica enterica serovar Typhi
uucuguucagugg

SEQ ID NO: 1709968 - RNA, 17 nt, Salmonella enterica enterica serovar Typhi
uucuguaauacgcugua

SEQ ID NO: 1709969 - RNA, 17 nt, Salmonella enterica enterica serovar Typhi
uucuguaggcugugcaa

SEQ ID NO: 1709970 - RNA, 15 nt, Salmonella enterica enterica serovar Typhi
uucugguaaaccuca

SEQ ID NO: 1709971 - RNA, 14 nt, Salmonella enterica enterica serovar Typhi
uucuggcucggccu

SEQ ID NO: 1709972 - RNA, 23 nt, Salmonella enterica enterica serovar Typhi
uucuuacgauaccccauccacuu

SEQ ID NO: 1709973 - RNA, 20 nt, Salmonella enterica enterica serovar Typhi
uucuuacuaauaaauauuca

SEQ ID NO: 1709974 - RNA, 15 nt, Salmonella enterica enterica serovar Typhi
uucuuacuaauaaau

SEQ ID NO: 1709975 - RNA, 22 nt, Salmonella enterica enterica serovar Typhi
uucuuagcgccagcagaaaacc

SEQ ID NO: 1709976 - RNA, 13 nt, Salmonella enterica enterica serovar Typhi
uucuucucuucuu

SEQ ID NO: 1709977 - RNA, 12 nt, Salmonella enterica enterica serovar Typhi
uucuucuucacg

SEQ ID NO: 1709978 - RNA, 17 nt, Salmonella enterica enterica serovar Typhi
uucuuccgucagcgaau

SEQ ID NO: 1709979 - RNA, 12 nt, Salmonella enterica enterica serovar Typhi
uucuuccgugcc

SEQ ID NO: 1709980 - RNA, 14 nt, Salmonella enterica enterica serovar Typhi
uucuuccauuccca

SEQ ID NO: 1709981 - RNA, 15 nt, Salmonella enterica enterica serovar Typhi
uucuuccagcggcag

SEQ ID NO: 1709982 - RNA, 19 nt, Salmonella enterica enterica serovar Typhi
uucuucgccgucauaaaac

SEQ ID NO: 1709983 - RNA, 12 nt, Salmonella enterica enterica serovar Typhi
uucuuauuuauu

SEQ ID NO: 1709984 - RNA, 16 nt, Salmonella enterica enterica serovar Typhi
uucuuauuacaagaaa

SEQ ID NO: 1709985 - RNA, 23 nt, Salmonella enterica enterica serovar Typhi
uucuucaucaaagaaauacccuu

SEQ ID NO: 1709986 - RNA, 13 nt, Salmonella enterica enterica serovar Typhi
uucuuccagaacg

SEQ ID NO: 1709987 - RNA, 13 nt, Salmonella enterica enterica serovar Typhi
uucuucaucuuca

SEQ ID NO: 1709988 - RNA, 18 nt, Salmonella enterica enterica serovar Typhi
uucucccgccagaugcag

SEQ ID NO: 1709989 - RNA, 22 nt, Salmonella enterica enterica serovar Typhi
uucuccccuucaucaguaacug

SEQ ID NO: 1709990 - RNA, 22 nt, Salmonella enterica enterica serovar Typhi
uucuccugcgccagccggauac

SEQ ID NO: 1709991 - RNA, 19 nt, Salmonella enterica enterica serovar Typhi
uucuccugcgcuugcggcc

SEQ ID NO: 1709992 - RNA, 13 nt, Salmonella enterica enterica serovar Typhi
uucugaauaaauu

SEQ ID NO: 1709993 - RNA, 20 nt, Salmonella enterica enterica serovar Typhi
uucugacagaauauaggaga

SEQ ID NO: 1709994 - RNA, 14 nt, Salmonella enterica enterica serovar Typhi
uucugcucaaugau

SEQ ID NO: 1709995 - RNA, 19 nt, Salmonella enterica enterica serovar Typhi
uucugcgguaaucugccag

SEQ ID NO: 1709996 - RNA, 17 nt, Salmonella enterica enterica serovar Typhi
uucugauaacgcaggcg

SEQ ID NO: 1709997 - RNA, 15 nt, Salmonella enterica enterica serovar Typhi
uucugcuuccagaau

SEQ ID NO: 1709998 - RNA, 9 nt, Salmonella enterica enterica serovar Typhi
uucuggaag

SEQ ID NO: 1709999 - RNA, 20 nt, Salmonella enterica enterica serovar Typhi
uucuggccccugagcaauca

SEQ ID NO: 1710000 - RNA, 22 nt, Salmonella enterica enterica serovar Typhi
uucuggcgaugugcccgaguga

SEQ ID NO: 1710001 - RNA, 15 nt, Salmonella enterica enterica serovar Typhi
uucucaaaggcuuug

SEQ ID NO: 1710002 - RNA, 14 nt, Salmonella enterica enterica serovar Typhi
uucucaaugaacag

SEQ ID NO: 1710003 - RNA, 20 nt, Salmonella enterica enterica serovar Typhi
uucuaucguuauauauacuu

SEQ ID NO: 1710004 - RNA, 11 nt, Salmonella enterica enterica serovar Typhi
uucguuuuccg

SEQ ID NO: 1710005 - RNA, 19 nt, Salmonella enterica enterica serovar Typhi
uucuacucuucacccuucu

SEQ ID NO: 1710006 - RNA, 14 nt, Salmonella enterica enterica serovar Typhi
uucuacuacagaaa

SEQ ID NO: 1710007 - RNA, 14 nt, Salmonella enterica enterica serovar Typhi
uugugaguaauaau

SEQ ID NO: 1710008 - RNA, 15 nt, Salmonella enterica enterica serovar Typhi
uugugaguucauaaa

SEQ ID NO: 1710009 - RNA, 23 nt, Salmonella enterica enterica serovar Typhi
uugugccgacaucgcucccggca

SEQ ID NO: 1710010 - RNA, 15 nt, Salmonella enterica enterica serovar Typhi
uugugcagaaucauu

SEQ ID NO: 1710011 - RNA, 12 nt, Salmonella enterica enterica serovar Typhi
uugugcuuuagc

SEQ ID NO: 1710012 - RNA, 22 nt, Salmonella enterica enterica serovar Typhi
uugugcuuauggguuuccucca

SEQ ID NO: 1710013 - RNA, 14 nt, Salmonella enterica enterica serovar Typhi
uugucuucuuagua

SEQ ID NO: 1710014 - RNA, 15 nt, Salmonella enterica enterica serovar Typhi
uugucuuuuccagua

SEQ ID NO: 1710015 - RNA, 16 nt, Salmonella enterica enterica serovar Typhi
uugugagaaaagcaga

SEQ ID NO: 1710016 - RNA, 13 nt, Salmonella enterica enterica serovar Typhi
uugucuuaaauau

SEQ ID NO: 1710017 - RNA, 22 nt, Salmonella enterica enterica serovar Typhi
uugucugaugacucucggccua

SEQ ID NO: 1710018 - RNA, 14 nt, Salmonella enterica enterica serovar Typhi
uugucugaccgggc

SEQ ID NO: 1710019 - RNA, 14 nt, Salmonella enterica enterica serovar Typhi
uugucuaacuuacc

SEQ ID NO: 1710020 - RNA, 13 nt, Salmonella enterica enterica serovar Typhi
uuguucauaucga

SEQ ID NO: 1710021 - RNA, 15 nt, Salmonella enterica enterica serovar Typhi
uuguggcgaccagca

SEQ ID NO: 1710022 - RNA, 17 nt, Salmonella enterica enterica serovar Typhi
uugugucaaaaaguugu

SEQ ID NO: 1710023 - RNA, 13 nt, Salmonella enterica enterica serovar Typhi
uuguguaaucuuu

SEQ ID NO: 1710024 - RNA, 14 nt, Salmonella enterica enterica serovar Typhi
uuguucuaaacguu

SEQ ID NO: 1710025 - RNA, 16 nt, Salmonella enterica enterica serovar Typhi
uuguucgucuuuugaa

SEQ ID NO: 1710026 - RNA, 18 nt, Salmonella enterica enterica serovar Typhi
uuguuuguggcaaaguac

SEQ ID NO: 1710027 - RNA, 15 nt, Salmonella enterica enterica serovar Typhi
uugguuuugccauuc

SEQ ID NO: 1710028 - RNA, 19 nt, Salmonella enterica enterica serovar Typhi
uuguaaaaccgacuaucag

SEQ ID NO: 1710029 - RNA, 18 nt, Salmonella enterica enterica serovar Typhi
uugguuuaaacucugcaa

SEQ ID NO: 1710030 - RNA, 16 nt, Salmonella enterica enterica serovar Typhi
uuguaaagaaauuuaa

SEQ ID NO: 1710031 - RNA, 12 nt, Salmonella enterica enterica serovar Typhi
uuguaacagcag

SEQ ID NO: 1710032 - RNA, 18 nt, Salmonella enterica enterica serovar Typhi
uuguagcugcgccagcgu

SEQ ID NO: 1710033 - RNA, 21 nt, Salmonella enterica enterica serovar Typhi
uuguagcugcgccagcgugcu

SEQ ID NO: 1710034 - RNA, 17 nt, Salmonella enterica enterica serovar Typhi
uuguaggcuuccagaag

SEQ ID NO: 1710035 - RNA, 16 nt, Salmonella enterica enterica serovar Typhi
uuguaggccugauagc

SEQ ID NO: 1710036 - RNA, 13 nt, Salmonella enterica enterica serovar Typhi
uuguacaggauau

SEQ ID NO: 1710037 - RNA, 17 nt, Salmonella enterica enterica serovar Typhi
uuguacagcaauaaaag

SEQ ID NO: 1710038 - RNA, 17 nt, Salmonella enterica enterica serovar Typhi
uuguacagcuugccguc

SEQ ID NO: 1710039 - RNA, 23 nt, Salmonella enterica enterica serovar Typhi
uugucagcugaacagucccacca

SEQ ID NO: 1710040 - RNA, 16 nt, Salmonella enterica enterica serovar Typhi
uugucaggcagaaaua

SEQ ID NO: 1710041 - RNA, 15 nt, Salmonella enterica enterica serovar Typhi
uugucagcauaaagc

SEQ ID NO: 1710042 - RNA, 13 nt, Salmonella enterica enterica serovar Typhi
uugucaaaaauag

SEQ ID NO: 1710043 - RNA, 15 nt, Salmonella enterica enterica serovar Typhi
uugucaaaaauagca

SEQ ID NO: 1710044 - RNA, 18 nt, Salmonella enterica enterica serovar Typhi
uuguccggaucucgccag

SEQ ID NO: 1710045 - RNA, 17 nt, Salmonella enterica enterica serovar Typhi
uugucgaucaucagacc

SEQ ID NO: 1710046 - RNA, 17 nt, Salmonella enterica enterica serovar Typhi
uugucauccugcucauc

SEQ ID NO: 1710047 - RNA, 17 nt, Salmonella enterica enterica serovar Typhi
uugucaucagucucaaa

SEQ ID NO: 1710048 - RNA, 15 nt, Salmonella enterica enterica serovar Typhi
uugucaucagucuca

SEQ ID NO: 1710049 - RNA, 17 nt, Salmonella enterica enterica serovar Typhi
uuguccagcggccauga

SEQ ID NO: 1710050 - RNA, 16 nt, Salmonella enterica enterica serovar Typhi
uuuaagcauccaggaa

SEQ ID NO: 1710051 - RNA, 23 nt, Salmonella enterica enterica serovar Typhi
uuuaaaacuucccgcgcagugca

SEQ ID NO: 1710052 - RNA, 18 nt, Salmonella enterica enterica serovar Typhi
uuuaagccgauugaauaa

SEQ ID NO: 1710053 - RNA, 17 nt, Salmonella enterica enterica serovar Typhi
uuuaagcgccuccacaa

SEQ ID NO: 1710054 - RNA, 19 nt, Salmonella enterica enterica serovar Typhi
uuuaaggcggcaaagauaa

SEQ ID NO: 1710055 - RNA, 23 nt, Salmonella enterica enterica serovar Typhi
uuuaaggaauaacgcgcuuuuuu

SEQ ID NO: 1710056 - RNA, 16 nt, Salmonella enterica enterica serovar Typhi
uuuaaggcggcaaaga

SEQ ID NO: 1710057 - RNA, 12 nt, Salmonella enterica enterica serovar Typhi
uuuaaucaccug

SEQ ID NO: 1710058 - RNA, 20 nt, Salmonella enterica enterica serovar Typhi
uuuaaugcccgguauuuuuu

SEQ ID NO: 1710059 - RNA, 18 nt, Salmonella enterica enterica serovar Typhi
uuuaaugcuuuccagcca

SEQ ID NO: 1710060 - RNA, 20 nt, Salmonella enterica enterica serovar Typhi
uuuaauauaugaaccaagau

SEQ ID NO: 1710061 - RNA, 21 nt, Salmonella enterica enterica serovar Typhi
uuuaauacgcugucgaugaua

SEQ ID NO: 1710062 - RNA, 16 nt, Salmonella enterica enterica serovar Typhi
uuuacgguuggccauu

SEQ ID NO: 1710063 - RNA, 13 nt, Salmonella enterica enterica serovar Typhi
uuuagaauuaucu

SEQ ID NO: 1710064 - RNA, 17 nt, Salmonella enterica enterica serovar Typhi
uuuagaauuaucugaaa

SEQ ID NO: 1710065 - RNA, 16 nt, Salmonella enterica enterica serovar Typhi
uuuagaaccaauagua

SEQ ID NO: 1710066 - RNA, 12 nt, Salmonella enterica enterica serovar Typhi
uuuacuuucauu

SEQ ID NO: 1710067 - RNA, 16 nt, Salmonella enterica enterica serovar Typhi
uuuaccucacggugac

SEQ ID NO: 1710068 - RNA, 17 nt, Salmonella enterica enterica serovar Typhi
uuuaccuguuuaucuga

SEQ ID NO: 1710069 - RNA, 18 nt, Salmonella enterica enterica serovar Typhi
uuuauuaccugguauuau

SEQ ID NO: 1710070 - RNA, 22 nt, Salmonella enterica enterica serovar Typhi
uuuauuacgcgcucucauaagc

SEQ ID NO: 1710071 - RNA, 22 nt, Salmonella enterica enterica serovar Typhi
uuuauugaagugcgaaauuuaa

SEQ ID NO: 1710072 - RNA, 18 nt, Salmonella enterica enterica serovar Typhi
uuuauugaugacauuaau

SEQ ID NO: 1710073 - RNA, 17 nt, Salmonella enterica enterica serovar Typhi
uuuaucgaucuccaucu

SEQ ID NO: 1710074 - RNA, 24 nt, Salmonella enterica enterica serovar Typhi
uuuaucuauucagguuauuugccu

SEQ ID NO: 1710075 - RNA, 13 nt, Salmonella enterica enterica serovar Typhi
uuuaucuauuucu

SEQ ID NO: 1710076 - RNA, 22 nt, Salmonella enterica enterica serovar Typhi
uuuaucuucucuaucagcgccu

SEQ ID NO: 1710077 - RNA, 22 nt, Salmonella enterica enterica serovar Typhi
uuuaucuuuaaauuucagggcu

SEQ ID NO: 1710078 - RNA, 15 nt, Salmonella enterica enterica serovar Typhi
uuuaugcguuauaga

SEQ ID NO: 1710079 - RNA, 19 nt, Salmonella enterica enterica serovar Typhi
uuuaugccggcuaauaguu

SEQ ID NO: 1710080 - RNA, 15 nt, Salmonella enterica enterica serovar Typhi
uuuauggcacaucag

SEQ ID NO: 1710081 - RNA, 11 nt, Salmonella enterica enterica serovar Typhi
uuuauccagua

SEQ ID NO: 1710082 - RNA, 23 nt, Salmonella enterica enterica serovar Typhi
uuuauccggauggaacgcaucca

SEQ ID NO: 1710083 - RNA, 20 nt, Salmonella enterica enterica serovar Typhi
uuuauccggcacgguaaacc

SEQ ID NO: 1710084 - RNA, 18 nt, Salmonella enterica enterica serovar Typhi
uuuauccggcgccauagu

SEQ ID NO: 1710085 - RNA, 12 nt, Salmonella enterica enterica serovar Typhi
uuuaucaggccu

SEQ ID NO: 1710086 - RNA, 15 nt, Salmonella enterica enterica serovar Typhi
uuuauauuuuuaagg

SEQ ID NO: 1710087 - RNA, 19 nt, Salmonella enterica enterica serovar Typhi
uuuagcauaacguuuccuu

SEQ ID NO: 1710088 - RNA, 13 nt, Salmonella enterica enterica serovar Typhi
uuuagcaccagac

SEQ ID NO: 1710089 - RNA, 14 nt, Salmonella enterica enterica serovar Typhi
uuuagccagcagcg

SEQ ID NO: 1710090 - RNA, 23 nt, Salmonella enterica enterica serovar Typhi
uuuauaacauaaauaguauuagu

SEQ ID NO: 1710091 - RNA, 19 nt, Salmonella enterica enterica serovar Typhi
uuuauaacuaaacucaucu

SEQ ID NO: 1710092 - RNA, 13 nt, Salmonella enterica enterica serovar Typhi
uugagccauucca

SEQ ID NO: 1710093 - RNA, 23 nt, Salmonella enterica enterica serovar Typhi
uugagcgagucagacaccagccc

SEQ ID NO: 1710094 - RNA, 18 nt, Salmonella enterica enterica serovar Typhi
uugagcgcaaaacgcugc

SEQ ID NO: 1710095 - RNA, 14 nt, Salmonella enterica enterica serovar Typhi
uugauaagagaaaa

SEQ ID NO: 1710096 - RNA, 18 nt, Salmonella enterica enterica serovar Typhi
uugauaccuuuaaccucu

SEQ ID NO: 1710097 - RNA, 21 nt, Salmonella enterica enterica serovar Typhi
uugauaauguuggauuauaca

SEQ ID NO: 1710098 - RNA, 18 nt, Salmonella enterica enterica serovar Typhi
uugauaccuauuuaauaa

SEQ ID NO: 1710099 - RNA, 14 nt, Salmonella enterica enterica serovar Typhi
uugauacauuuuuu

SEQ ID NO: 1710100 - RNA, 17 nt, Salmonella enterica enterica serovar Typhi
uugauaccaucaauguu

SEQ ID NO: 1710101 - RNA, 18 nt, Salmonella enterica enterica serovar Typhi
uugauagggugaaugcgu

SEQ ID NO: 1710102 - RNA, 12 nt, Salmonella enterica enterica serovar Typhi
uugaucugcuug

SEQ ID NO: 1710103 - RNA, 18 nt, Salmonella enterica enterica serovar Typhi
uugaucgcgcagcaaauc

SEQ ID NO: 1710104 - RNA, 22 nt, Salmonella enterica enterica serovar Typhi
uugaucgcgcagcaaaucagcu

SEQ ID NO: 1710105 - RNA, 17 nt, Salmonella enterica enterica serovar Typhi
uugaucguaaaaugaaa

SEQ ID NO: 1710106 - RNA, 19 nt, Salmonella enterica enterica serovar Typhi
uugaucggguuuuccugaa

SEQ ID NO: 1710107 - RNA, 15 nt, Salmonella enterica enterica serovar Typhi
uugauuuguuuuuua

SEQ ID NO: 1710108 - RNA, 17 nt, Salmonella enterica enterica serovar Typhi
uugauuucauugcugca

SEQ ID NO: 1710109 - RNA, 21 nt, Salmonella enterica enterica serovar Typhi
uugaugucauccgguucaccc

SEQ ID NO: 1710110 - RNA, 22 nt, Salmonella enterica enterica serovar Typhi
uugcagcagcgagauggcuuuu

SEQ ID NO: 1710111 - RNA, 16 nt, Salmonella enterica enterica serovar Typhi
uugcagacgugcaaua

SEQ ID NO: 1710112 - RNA, 17 nt, Salmonella enterica enterica serovar Typhi
uugcacuuuugccaggc

SEQ ID NO: 1710113 - RNA, 12 nt, Salmonella enterica enterica serovar Typhi
uugauuuuauga

SEQ ID NO: 1710114 - RNA, 16 nt, Salmonella enterica enterica serovar Typhi
uugcagcgugaaaagc

SEQ ID NO: 1710115 - RNA, 15 nt, Salmonella enterica enterica serovar Typhi
uugcagcuccuuuua

SEQ ID NO: 1710116 - RNA, 13 nt, Salmonella enterica enterica serovar Typhi
uugcaggaggcgc

SEQ ID NO: 1710117 - RNA, 17 nt, Salmonella enterica enterica serovar Typhi
uugcaggaagggcagca

SEQ ID NO: 1710118 - RNA, 19 nt, Salmonella enterica enterica serovar Typhi
uugcaggaaaaacuguccc

SEQ ID NO: 1710119 - RNA, 15 nt, Salmonella enterica enterica serovar Typhi
uugcaguacaggcau

SEQ ID NO: 1710120 - RNA, 21 nt, Salmonella enterica enterica serovar Typhi
uugcagguaacgacuacuucc

SEQ ID NO: 1710121 - RNA, 20 nt, Salmonella enterica enterica serovar Typhi
uugccacuacgcagcuccag

SEQ ID NO: 1710122 - RNA, 16 nt, Salmonella enterica enterica serovar Typhi
uugccacgccauacgu

SEQ ID NO: 1710123 - RNA, 13 nt, Salmonella enterica enterica serovar Typhi
uugccacuggccu

SEQ ID NO: 1710124 - RNA, 23 nt, Salmonella enterica enterica serovar Typhi
uugccacuggcuuuccugaucaa

SEQ ID NO: 1710125 - RNA, 14 nt, Salmonella enterica enterica serovar Typhi
uugcaugaccaucc

SEQ ID NO: 1710126 - RNA, 18 nt, Salmonella enterica enterica serovar Typhi
uugcauggcaauuaaauu

SEQ ID NO: 1710127 - RNA, 17 nt, Salmonella enterica enterica serovar Typhi
uugcauccguagcuuca

SEQ ID NO: 1710128 - RNA, 23 nt, Salmonella enterica enterica serovar Typhi
uugcauauaaggcccauacccca

SEQ ID NO: 1710129 - RNA, 13 nt, Salmonella enterica enterica serovar Typhi
uugcauaaagaac

SEQ ID NO: 1710130 - RNA, 13 nt, Salmonella enterica enterica serovar Typhi
uugcauaaauaau

SEQ ID NO: 1710131 - RNA, 13 nt, Salmonella enterica enterica serovar Typhi
uugcauacauaaa

SEQ ID NO: 1710132 - RNA, 14 nt, Salmonella enterica enterica serovar Typhi
uugcgcucugccag

SEQ ID NO: 1710133 - RNA, 19 nt, Salmonella enterica enterica serovar Typhi
uugcggaucgaucucgaua

SEQ ID NO: 1710134 - RNA, 15 nt, Salmonella enterica enterica serovar Typhi
uugcggcacacagcc

SEQ ID NO: 1710135 - RNA, 23 nt, Salmonella enterica enterica serovar Typhi
uugcgcucaccuuuuuauuuacu

SEQ ID NO: 1710136 - RNA, 20 nt, Salmonella enterica enterica serovar Typhi
uugcgcguucggguuuuccu

SEQ ID NO: 1710137 - RNA, 21 nt, Salmonella enterica enterica serovar Typhi
uugcggcggggauaaucagca

SEQ ID NO: 1710138 - RNA, 13 nt, Salmonella enterica enterica serovar Typhi
uugcgagaaaaaa

SEQ ID NO: 1710139 - RNA, 15 nt, Salmonella enterica enterica serovar Typhi
uugcgauaauacacg

SEQ ID NO: 1710140 - RNA, 16 nt, Salmonella enterica enterica serovar Typhi
uugcgcaaccuccgcg

SEQ ID NO: 1710141 - RNA, 19 nt, Salmonella enterica enterica serovar Typhi
uugcgacuguucaucaaag

SEQ ID NO: 1710142 - RNA, 21 nt, Salmonella enterica enterica serovar Typhi
uugcgacaagcucauuuccca

SEQ ID NO: 1710143 - RNA, 15 nt, Salmonella enterica enterica serovar Typhi
uugccuuucagaucg

SEQ ID NO: 1710144 - RNA, 15 nt, Salmonella enterica enterica serovar Typhi
uugccguuaacugcu

SEQ ID NO: 1710145 - RNA, 23 nt, Salmonella enterica enterica serovar Typhi
uugccgucgccggaaugcgaaua

SEQ ID NO: 1710146 - RNA, 22 nt, Salmonella enterica enterica serovar Typhi
uugccaucggauauauuuuacc

SEQ ID NO: 1710147 - RNA, 19 nt, Salmonella enterica enterica serovar Typhi
uugccauacgcccacgcgg

SEQ ID NO: 1710148 - RNA, 12 nt, Salmonella enterica enterica serovar Typhi
uugccauacgcc

SEQ ID NO: 1710149 - RNA, 17 nt, Salmonella enterica enterica serovar Typhi
uugccagcggccagggc

SEQ ID NO: 1710150 - RNA, 15 nt, Salmonella enterica enterica serovar Typhi
uugccagugaaaaaa

SEQ ID NO: 1710151 - RNA, 18 nt, Salmonella enterica enterica serovar Typhi
uuggaaccaaacaccaga

SEQ ID NO: 1710152 - RNA, 22 nt, Salmonella enterica enterica serovar Typhi
uuggaaaaccccaucccggcaa

SEQ ID NO: 1710153 - RNA, 18 nt, Salmonella enterica enterica serovar Typhi
uuggaaacuaugcaaaac

SEQ ID NO: 1710154 - RNA, 22 nt, Salmonella enterica enterica serovar Typhi
uuggcagcccggcguugaaauc

SEQ ID NO: 1710155 - RNA, 22 nt, Salmonella enterica enterica serovar Typhi
uuggcagccccugaaauaacag

SEQ ID NO: 1710156 - RNA, 14 nt, Salmonella enterica enterica serovar Typhi
uuggcaucugcaau

SEQ ID NO: 1710157 - RNA, 15 nt, Salmonella enterica enterica serovar Typhi
uuggcaaucaaaucc

SEQ ID NO: 1710158 - RNA, 14 nt, Salmonella enterica enterica serovar Typhi
uuggcaaucacaag

SEQ ID NO: 1710159 - RNA, 17 nt, Salmonella enterica enterica serovar Typhi
uuggcaaucagcggcaa

SEQ ID NO: 1710160 - RNA, 19 nt, Salmonella enterica enterica serovar Typhi
uuggaugaaccauaucaaa

SEQ ID NO: 1710161 - RNA, 17 nt, Salmonella enterica enterica serovar Typhi
uuggcaacgucuugcca

SEQ ID NO: 1710162 - RNA, 12 nt, Salmonella enterica enterica serovar Typhi
uuggcaaauccg

SEQ ID NO: 1710163 - RNA, 22 nt, Salmonella enterica enterica serovar Typhi
uugcuucuguccuuucugcugc

SEQ ID NO: 1710164 - RNA, 14 nt, Salmonella enterica enterica serovar Typhi
uugcuuucuugaau

SEQ ID NO: 1710165 - RNA, 16 nt, Salmonella enterica enterica serovar Typhi
uugcuuauccggccua

SEQ ID NO: 1710166 - RNA, 16 nt, Salmonella enterica enterica serovar Typhi
uugcuuaccuuguucu

SEQ ID NO: 1710167 - RNA, 22 nt, Salmonella enterica enterica serovar Typhi
uugcguaucguaagccaccgcc

SEQ ID NO: 1710168 - RNA, 15 nt, Salmonella enterica enterica serovar Typhi
uugcguaaugauuaa

SEQ ID NO: 1710169 - RNA, 15 nt, Salmonella enterica enterica serovar Typhi
uugcguaagcagcug

SEQ ID NO: 1710170 - RNA, 20 nt, Salmonella enterica enterica serovar Typhi
uugcuaccccggaaauaacg

SEQ ID NO: 1710171 - RNA, 17 nt, Salmonella enterica enterica serovar Typhi
uugcuaggaacagugac

SEQ ID NO: 1710172 - RNA, 21 nt, Salmonella enterica enterica serovar Typhi
uugcugcugcggaucgucucu

SEQ ID NO: 1710173 - RNA, 14 nt, Salmonella enterica enterica serovar Typhi
uugcugcuauguaa

SEQ ID NO: 1710174 - RNA, 17 nt, Salmonella enterica enterica serovar Typhi
uugcuggcuugcucagg

SEQ ID NO: 1710175 - RNA, 14 nt, Salmonella enterica enterica serovar Typhi
uugcuggauucucu

SEQ ID NO: 1710176 - RNA, 21 nt, Salmonella enterica enterica serovar Typhi
uugcuggagcaggugcggcug

SEQ ID NO: 1710177 - RNA, 13 nt, Salmonella enterica enterica serovar Typhi
uuggcguauuaug

SEQ ID NO: 1710178 - RNA, 17 nt, Salmonella enterica enterica serovar Typhi
uuggcuuuguaaauauu

SEQ ID NO: 1710179 - RNA, 18 nt, Salmonella enterica enterica serovar Typhi
uugggaauuagcgaauca

SEQ ID NO: 1710180 - RNA, 18 nt, Salmonella enterica enterica serovar Typhi
uugggcagugcucgccaa

SEQ ID NO: 1710181 - RNA, 23 nt, Salmonella enterica enterica serovar Typhi
uuggcgagcaggaaccacaucgc

SEQ ID NO: 1710182 - RNA, 22 nt, Salmonella enterica enterica serovar Typhi
uuggcgaggaacaucagccagc

SEQ ID NO: 1710183 - RNA, 18 nt, Salmonella enterica enterica serovar Typhi
uuggcgacgaacacggcg

SEQ ID NO: 1710184 - RNA, 14 nt, Salmonella enterica enterica serovar Typhi
uuggcgaucacaau

SEQ ID NO: 1710185 - RNA, 14 nt, Salmonella enterica enterica serovar Typhi
uuggcgcgucauca

SEQ ID NO: 1710186 - RNA, 14 nt, Salmonella enterica enterica serovar Typhi
uuggcgcuggguac

SEQ ID NO: 1710187 - RNA, 14 nt, Salmonella enterica enterica serovar Typhi
uuggcaucugucau

SEQ ID NO: 1710188 - RNA, 15 nt, Salmonella enterica enterica serovar Typhi
uuggccagcauggcg

SEQ ID NO: 1710189 - RNA, 11 nt, Salmonella enterica enterica serovar Typhi
uuggccagcgu

SEQ ID NO: 1710190 - RNA, 22 nt, Salmonella enterica enterica serovar Typhi
uuggccagcguggaugaacuca

SEQ ID NO: 1710191 - RNA, 23 nt, Salmonella enterica enterica serovar Typhi
uugggcgcgaaacugcugccgca

SEQ ID NO: 1710192 - RNA, 18 nt, Salmonella enterica enterica serovar Typhi
uugguaaguuuuucucuu

SEQ ID NO: 1710193 - RNA, 19 nt, Salmonella enterica enterica serovar Typhi
uugguuagggaucaucuuc

SEQ ID NO: 1710194 - RNA, 22 nt, Salmonella enterica enterica serovar Typhi
uugguguaacagcaacaucuau

SEQ ID NO: 1710195 - RNA, 21 nt, Salmonella enterica enterica serovar Typhi
uuggugauuaacagcgccauc

SEQ ID NO: 1710196 - RNA, 15 nt, Salmonella enterica enterica serovar Typhi
aauaauugagcgcaa

SEQ ID NO: 1710197 - RNA, 15 nt, Salmonella enterica enterica serovar Typhi
aauaauuaacccaca

SEQ ID NO: 1710198 - RNA, 16 nt, Salmonella enterica enterica serovar Typhi
aauaauguaaaaaaau

SEQ ID NO: 1710199 - RNA, 18 nt, Salmonella enterica enterica serovar Typhi
aauaauguaaaaaaauaa

SEQ ID NO: 1710200 - RNA, 14 nt, Salmonella enterica enterica serovar Typhi
aauaauguaaaaaa

SEQ ID NO: 1710201 - RNA, 18 nt, Salmonella enterica enterica serovar Typhi
aauaaucgccgccgguaa

SEQ ID NO: 1710202 - RNA, 17 nt, Salmonella enterica enterica serovar Typhi
aauaaucgaaauaaagu

SEQ ID NO: 1710203 - RNA, 17 nt, Salmonella enterica enterica serovar Typhi
aauaaucccuucuuuua

SEQ ID NO: 1710204 - RNA, 19 nt, Salmonella enterica enterica serovar Typhi
aauaauggagaugaaaaua

SEQ ID NO: 1710205 - RNA, 19 nt, Salmonella enterica enterica serovar Typhi
aauaaugaagacguugaau

SEQ ID NO: 1710206 - RNA, 15 nt, Salmonella enterica enterica serovar Typhi
aauaaugaccagcgc

SEQ ID NO: 1710207 - RNA, 12 nt, Salmonella enterica enterica serovar Typhi
aauaaugacuaa

SEQ ID NO: 1710208 - RNA, 20 nt, Salmonella enterica enterica serovar Typhi
aauaauaaaacgacucauca

SEQ ID NO: 1710209 - RNA, 23 nt, Salmonella enterica enterica serovar Typhi
aauaagcuccgggacauccggau

SEQ ID NO: 1710210 - RNA, 20 nt, Salmonella enterica enterica serovar Typhi
aauaagggcauguuucaugu

SEQ ID NO: 1710211 - RNA, 13 nt, Salmonella enterica enterica serovar Typhi
aauaaggcuggca

SEQ ID NO: 1710212 - RNA, 19 nt, Salmonella enterica enterica serovar Typhi
aauaagcgcccaugaagau

SEQ ID NO: 1710213 - RNA, 15 nt, Salmonella enterica enterica serovar Typhi
aauaagcgcucaggc

SEQ ID NO: 1710214 - RNA, 11 nt, Salmonella enterica enterica serovar Typhi
aauaaucacug

SEQ ID NO: 1710215 - RNA, 20 nt, Salmonella enterica enterica serovar Typhi
aauaauauguuccacaauca

SEQ ID NO: 1710216 - RNA, 13 nt, Salmonella enterica enterica serovar Typhi
aauaauauuauug

SEQ ID NO: 1710217 - RNA, 23 nt, Salmonella enterica enterica serovar Typhi
aaguugcucggcaauuucuuugu

SEQ ID NO: 1710218 - RNA, 19 nt, Salmonella enterica enterica serovar Typhi
aauaaauaaaaccagcagc

SEQ ID NO: 1710219 - RNA, 20 nt, Salmonella enterica enterica serovar Typhi
aauaaagugcugaacaauaa

SEQ ID NO: 1710220 - RNA, 14 nt, Salmonella enterica enterica serovar Typhi
aauaaauauucauc

SEQ ID NO: 1710221 - RNA, 15 nt, Salmonella enterica enterica serovar Typhi
aauaaaucaaugaaa

SEQ ID NO: 1710222 - RNA, 22 nt, Salmonella enterica enterica serovar Typhi
aauaaauaguaaauagaaaaua

SEQ ID NO: 1710223 - RNA, 23 nt, Salmonella enterica enterica serovar Typhi
aauaaauugaauucgcuaauaaa

SEQ ID NO: 1710224 - RNA, 17 nt, Salmonella enterica enterica serovar Typhi
aauaaaugauauuuaaa

SEQ ID NO: 1710225 - RNA, 13 nt, Salmonella enterica enterica serovar Typhi
aauaacaaaugaa

SEQ ID NO: 1710226 - RNA, 21 nt, Salmonella enterica enterica serovar Typhi
aauaacuauaauugcuuuuuu

SEQ ID NO: 1710227 - RNA, 17 nt, Salmonella enterica enterica serovar Typhi
aauaacugacagacuca

SEQ ID NO: 1710228 - RNA, 20 nt, Salmonella enterica enterica serovar Typhi
aauaacgguaacggacauaa

SEQ ID NO: 1710229 - RNA, 21 nt, Salmonella enterica enterica serovar Typhi
aauaacguguaauuucauaau

SEQ ID NO: 1710230 - RNA, 16 nt, Salmonella enterica enterica serovar Typhi
aauaacuauaauugcu

SEQ ID NO: 1710231 - RNA, 16 nt, Salmonella enterica enterica serovar Typhi
aauaacgugucaggau

SEQ ID NO: 1710232 - RNA, 14 nt, Salmonella enterica enterica serovar Typhi
aauaagaaacugcu

SEQ ID NO: 1710233 - RNA, 21 nt, Salmonella enterica enterica serovar Typhi
aauaacuuuuaauuuuuaugu

SEQ ID NO: 1710234 - RNA, 23 nt, Salmonella enterica enterica serovar Typhi
aauaacuuuuaauuuuuauguca

SEQ ID NO: 1710235 - RNA, 18 nt, Salmonella enterica enterica serovar Typhi
aauaagaagguuaauaua

SEQ ID NO: 1710236 - RNA, 21 nt, Salmonella enterica enterica serovar Typhi
aauaagaagguuaauauacau

SEQ ID NO: 1710237 - RNA, 16 nt, Salmonella enterica enterica serovar Typhi
aauaagaacuuuauca

SEQ ID NO: 1710238 - RNA, 20 nt, Salmonella enterica enterica serovar Typhi
aauaagacauggaguuccag

SEQ ID NO: 1710239 - RNA, 19 nt, Salmonella enterica enterica serovar Typhi
aauaacgcgagaagaagaa

SEQ ID NO: 1710240 - RNA, 21 nt, Salmonella enterica enterica serovar Typhi
aauaacgaucuggucgccaag

SEQ ID NO: 1710241 - RNA, 15 nt, Salmonella enterica enterica serovar Typhi
aauaacgaugaugaa

SEQ ID NO: 1710242 - RNA, 19 nt, Salmonella enterica enterica serovar Typhi
aauaacgaugaugaaaaag

SEQ ID NO: 1710243 - RNA, 19 nt, Salmonella enterica enterica serovar Typhi
aauaaccucaacgucgcuc

SEQ ID NO: 1710244 - RNA, 20 nt, Salmonella enterica enterica serovar Typhi
aauaaccggcagaccggaaa

SEQ ID NO: 1710245 - RNA, 12 nt, Salmonella enterica enterica serovar Typhi
aauaacaucuuc

SEQ ID NO: 1710246 - RNA, 22 nt, Salmonella enterica enterica serovar Typhi
aauaacaucguaaaucaaauga

SEQ ID NO: 1710247 - RNA, 15 nt, Salmonella enterica enterica serovar Typhi
aauagccagccccag

SEQ ID NO: 1710248 - RNA, 12 nt, Salmonella enterica enterica serovar Typhi
aauagccagaca

SEQ ID NO: 1710249 - RNA, 15 nt, Salmonella enterica enterica serovar Typhi
aauagcagcguuuug

SEQ ID NO: 1710250 - RNA, 20 nt, Salmonella enterica enterica serovar Typhi
aauagaugcgucgcauccuu

SEQ ID NO: 1710251 - RNA, 15 nt, Salmonella enterica enterica serovar Typhi
aauacuguaagccuc

SEQ ID NO: 1710252 - RNA, 12 nt, Salmonella enterica enterica serovar Typhi
aauacugauaaa

SEQ ID NO: 1710253 - RNA, 15 nt, Salmonella enterica enterica serovar Typhi
aauacuuuccagcug

SEQ ID NO: 1710254 - RNA, 20 nt, Salmonella enterica enterica serovar Typhi
aauagagugcgauuugacau

SEQ ID NO: 1710255 - RNA, 15 nt, Salmonella enterica enterica serovar Typhi
aauagaacccaaagc

SEQ ID NO: 1710256 - RNA, 12 nt, Salmonella enterica enterica serovar Typhi
aauagaaaauaa

SEQ ID NO: 1710257 - RNA, 14 nt, Salmonella enterica enterica serovar Typhi
aauaccgugcagga

SEQ ID NO: 1710258 - RNA, 20 nt, Salmonella enterica enterica serovar Typhi
aauaccgguuauccauauga

SEQ ID NO: 1710259 - RNA, 17 nt, Salmonella enterica enterica serovar Typhi
aauaccguaagaccaga

SEQ ID NO: 1710260 - RNA, 19 nt, Salmonella enterica enterica serovar Typhi
aauaccuaacucuuccgca

SEQ ID NO: 1710261 - RNA, 20 nt, Salmonella enterica enterica serovar Typhi
aauaccuuauucagcccacg

SEQ ID NO: 1710262 - RNA, 18 nt, Salmonella enterica enterica serovar Typhi
aauacgcaagccgaacuc

SEQ ID NO: 1710263 - RNA, 22 nt, Salmonella enterica enterica serovar Typhi
aauaccuccuggcguuaucauc

SEQ ID NO: 1710264 - RNA, 14 nt, Salmonella enterica enterica serovar Typhi
aauacgcugaacuu

SEQ ID NO: 1710265 - RNA, 18 nt, Salmonella enterica enterica serovar Typhi
aauacgcgucuguagcgc

SEQ ID NO: 1710266 - RNA, 23 nt, Salmonella enterica enterica serovar Typhi
aauacgcggcacguuuuccaggu

SEQ ID NO: 1710267 - RNA, 20 nt, Salmonella enterica enterica serovar Typhi
aauacgccagccgucaugau

SEQ ID NO: 1710268 - RNA, 17 nt, Salmonella enterica enterica serovar Typhi
aauacggagcaaaaaau

SEQ ID NO: 1710269 - RNA, 17 nt, Salmonella enterica enterica serovar Typhi
aauacgcuguagcuggc

SEQ ID NO: 1710270 - RNA, 21 nt, Salmonella enterica enterica serovar Typhi
aauaccacuucggcagaaaaa

SEQ ID NO: 1710271 - RNA, 20 nt, Salmonella enterica enterica serovar Typhi
aauaccaccugccaaagcug

SEQ ID NO: 1710272 - RNA, 15 nt, Salmonella enterica enterica serovar Typhi
aauaccacaucagac

SEQ ID NO: 1710273 - RNA, 16 nt, Salmonella enterica enterica serovar Typhi
aauaccgaaauccgcu

SEQ ID NO: 1710274 - RNA, 22 nt, Salmonella enterica enterica serovar Typhi
aauaccaaagugguuccaggcg

SEQ ID NO: 1710275 - RNA, 17 nt, Salmonella enterica enterica serovar Typhi
aauaccaaauauuucuu

SEQ ID NO: 1710276 - RNA, 13 nt, Salmonella enterica enterica serovar Typhi
aauaccacaaauu

SEQ ID NO: 1710277 - RNA, 20 nt, Salmonella enterica enterica serovar Typhi
aauaccacaaauuuugauaa

SEQ ID NO: 1710278 - RNA, 22 nt, Salmonella enterica enterica serovar Typhi
aauaucaucgucauuaaugccu

SEQ ID NO: 1710279 - RNA, 14 nt, Salmonella enterica enterica serovar Typhi
aauaucaugaauaa

SEQ ID NO: 1710280 - RNA, 20 nt, Salmonella enterica enterica serovar Typhi
aauaucauucgcgucauacu

SEQ ID NO: 1710281 - RNA, 22 nt, Salmonella enterica enterica serovar Typhi
aauaucauucgcgucauacuua

SEQ ID NO: 1710282 - RNA, 20 nt, Salmonella enterica enterica serovar Typhi
aauaucauugaggucuuugc

SEQ ID NO: 1710283 - RNA, 23 nt, Salmonella enterica enterica serovar Typhi
aauauccccaucccagaccauuc

SEQ ID NO: 1710284 - RNA, 11 nt, Salmonella enterica enterica serovar Typhi
aauauccauuu

SEQ ID NO: 1710285 - RNA, 18 nt, Salmonella enterica enterica serovar Typhi
aauauaguuagaaaauac

SEQ ID NO: 1710286 - RNA, 13 nt, Salmonella enterica enterica serovar Typhi
aauaugccaggca

SEQ ID NO: 1710287 - RNA, 17 nt, Salmonella enterica enterica serovar Typhi
aauaugcgucagauaaa

SEQ ID NO: 1710288 - RNA, 15 nt, Salmonella enterica enterica serovar Typhi
aauaugccugcacua

SEQ ID NO: 1710289 - RNA, 15 nt, Salmonella enterica enterica serovar Typhi
aauaugccagauauu

SEQ ID NO: 1710290 - RNA, 23 nt, Salmonella enterica enterica serovar Typhi
aauaucccgcaagaaacaggcug

SEQ ID NO: 1710291 - RNA, 20 nt, Salmonella enterica enterica serovar Typhi
aauauccgguacaccaacua

SEQ ID NO: 1710292 - RNA, 22 nt, Salmonella enterica enterica serovar Typhi
aauaucucuauugcuuauuaga

SEQ ID NO: 1710293 - RNA, 22 nt, Salmonella enterica enterica serovar Typhi
aauaucucccguuuguauaaau

SEQ ID NO: 1710294 - RNA, 12 nt, Salmonella enterica enterica serovar Typhi
aauaucucuccc

SEQ ID NO: 1710295 - RNA, 22 nt, Salmonella enterica enterica serovar Typhi
aauaggccggagaaaagaccag

SEQ ID NO: 1710296 - RNA, 17 nt, Salmonella enterica enterica serovar Typhi
aauaggcgaggaaaaca

SEQ ID NO: 1710297 - RNA, 21 nt, Salmonella enterica enterica serovar Typhi
aauaggcgaggaaaacauucg

SEQ ID NO: 1710298 - RNA, 14 nt, Salmonella enterica enterica serovar Typhi
aauagugcaggaag

SEQ ID NO: 1710299 - RNA, 21 nt, Salmonella enterica enterica serovar Typhi
aauagugggguguaaagucgg

SEQ ID NO: 1710300 - RNA, 22 nt, Salmonella enterica enterica serovar Typhi
aauagcgcuacauccgccagcc

SEQ ID NO: 1710301 - RNA, 14 nt, Salmonella enterica enterica serovar Typhi
aauagcgccagaca

SEQ ID NO: 1710302 - RNA, 13 nt, Salmonella enterica enterica serovar Typhi
aauagcggcacag

SEQ ID NO: 1710303 - RNA, 11 nt, Salmonella enterica enterica serovar Typhi
aauagcgcugc

SEQ ID NO: 1710304 - RNA, 20 nt, Salmonella enterica enterica serovar Typhi
aauagcgcuggcgccgcaaa

SEQ ID NO: 1710305 - RNA, 19 nt, Salmonella enterica enterica serovar Typhi
aauagccagccccagaaaa

SEQ ID NO: 1710306 - RNA, 14 nt, Salmonella enterica enterica serovar Typhi
aauauaaucuacca

SEQ ID NO: 1710307 - RNA, 14 nt, Salmonella enterica enterica serovar Typhi
aauauaauuauuau

SEQ ID NO: 1710308 - RNA, 18 nt, Salmonella enterica enterica serovar Typhi
aauaguguggaugucaua

SEQ ID NO: 1710309 - RNA, 14 nt, Salmonella enterica enterica serovar Typhi
aauauacgccaccu

SEQ ID NO: 1710310 - RNA, 12 nt, Salmonella enterica enterica serovar Typhi
aauauacauuca

SEQ ID NO: 1710311 - RNA, 21 nt, Salmonella enterica enterica serovar Typhi
aauauacauucauuuuaucga

SEQ ID NO: 1710312 - RNA, 16 nt, Salmonella enterica enterica serovar Typhi
aauauacuuaucggcg

SEQ ID NO: 1710313 - RNA, 19 nt, Salmonella enterica enterica serovar Typhi
aagccugauacuuuuacuc

SEQ ID NO: 1710314 - RNA, 14 nt, Salmonella enterica enterica serovar Typhi
aagccuggucaccu

SEQ ID NO: 1710315 - RNA, 22 nt, Salmonella enterica enterica serovar Typhi
aagccucuuccgccugauaaaa

SEQ ID NO: 1710316 - RNA, 16 nt, Salmonella enterica enterica serovar Typhi
aagccuacaccuuacu

SEQ ID NO: 1710317 - RNA, 22 nt, Salmonella enterica enterica serovar Typhi
aagccggcggaaaaaagcagca

SEQ ID NO: 1710318 - RNA, 22 nt, Salmonella enterica enterica serovar Typhi
aagccggcaggcagcgccagcg

SEQ ID NO: 1710319 - RNA, 20 nt, Salmonella enterica enterica serovar Typhi
aagccgcccugcggacaggc

SEQ ID NO: 1710320 - RNA, 12 nt, Salmonella enterica enterica serovar Typhi
aagcgaaaauaa

SEQ ID NO: 1710321 - RNA, 14 nt, Salmonella enterica enterica serovar Typhi
aagcgaaaauaaac

SEQ ID NO: 1710322 - RNA, 23 nt, Salmonella enterica enterica serovar Typhi
aagccuuucuguucuuugauuag

SEQ ID NO: 1710323 - RNA, 13 nt, Salmonella enterica enterica serovar Typhi
aagcgaccuucuc

SEQ ID NO: 1710324 - RNA, 20 nt, Salmonella enterica enterica serovar Typhi
aagcgaauaauuaacccaca

SEQ ID NO: 1710325 - RNA, 17 nt, Salmonella enterica enterica serovar Typhi
aagcgagguaaaaagcg

SEQ ID NO: 1710326 - RNA, 18 nt, Salmonella enterica enterica serovar Typhi
aagcgauuuauccaccgc

SEQ ID NO: 1710327 - RNA, 23 nt, Salmonella enterica enterica serovar Typhi
aagcgauguauuuauccacgccg

SEQ ID NO: 1710328 - RNA, 22 nt, Salmonella enterica enterica serovar Typhi
aagccagccaaauagcgccaga

SEQ ID NO: 1710329 - RNA, 17 nt, Salmonella enterica enterica serovar Typhi
aagccaggccgccagca

SEQ ID NO: 1710330 - RNA, 15 nt, Salmonella enterica enterica serovar Typhi
aagaagucugugaga

SEQ ID NO: 1710331 - RNA, 20 nt, Salmonella enterica enterica serovar Typhi
aagaagucugugagaaaagc

SEQ ID NO: 1710332 - RNA, 21 nt, Salmonella enterica enterica serovar Typhi
aagaagucugugagaaaagcg

SEQ ID NO: 1710333 - RNA, 13 nt, Salmonella enterica enterica serovar Typhi
aagccagguuuuc

SEQ ID NO: 1710334 - RNA, 20 nt, Salmonella enterica enterica serovar Typhi
aagccagguugcgcccggcg

SEQ ID NO: 1710335 - RNA, 18 nt, Salmonella enterica enterica serovar Typhi
aagcccaacuacacucuu

SEQ ID NO: 1710336 - RNA, 18 nt, Salmonella enterica enterica serovar Typhi
aagccgaaaccacagcgg

SEQ ID NO: 1710337 - RNA, 22 nt, Salmonella enterica enterica serovar Typhi
aagccgacccgcaucagaccuc

SEQ ID NO: 1710338 - RNA, 18 nt, Salmonella enterica enterica serovar Typhi
aagccgccaacgccagca

SEQ ID NO: 1710339 - RNA, 16 nt, Salmonella enterica enterica serovar Typhi
aagcccggccacagcg

SEQ ID NO: 1710340 - RNA, 12 nt, Salmonella enterica enterica serovar Typhi
aagcccauggca

SEQ ID NO: 1710341 - RNA, 15 nt, Salmonella enterica enterica serovar Typhi
aagccccccgcacag

SEQ ID NO: 1710342 - RNA, 18 nt, Salmonella enterica enterica serovar Typhi
aagccccccgcacagcac

SEQ ID NO: 1710343 - RNA, 16 nt, Salmonella enterica enterica serovar Typhi
aagcgccuguucaaca

SEQ ID NO: 1710344 - RNA, 23 nt, Salmonella enterica enterica serovar Typhi
aagcgccggaugaggacauaaac

SEQ ID NO: 1710345 - RNA, 12 nt, Salmonella enterica enterica serovar Typhi
aagcgccgcgau

SEQ ID NO: 1710346 - RNA, 15 nt, Salmonella enterica enterica serovar Typhi
aagcgcccguagcuc

SEQ ID NO: 1710347 - RNA, 23 nt, Salmonella enterica enterica serovar Typhi
aagcgccagauaugaucgaaaau

SEQ ID NO: 1710348 - RNA, 13 nt, Salmonella enterica enterica serovar Typhi
aagcgcaguguua

SEQ ID NO: 1710349 - RNA, 22 nt, Salmonella enterica enterica serovar Typhi
aagcgcauccagcucuuucaau

SEQ ID NO: 1710350 - RNA, 13 nt, Salmonella enterica enterica serovar Typhi
aagcucagcggca

SEQ ID NO: 1710351 - RNA, 21 nt, Salmonella enterica enterica serovar Typhi
aagcucauuucccaauaguuu

SEQ ID NO: 1710352 - RNA, 12 nt, Salmonella enterica enterica serovar Typhi
aagcguuccagu

SEQ ID NO: 1710353 - RNA, 12 nt, Salmonella enterica enterica serovar Typhi
aagcguaagcgu

SEQ ID NO: 1710354 - RNA, 15 nt, Salmonella enterica enterica serovar Typhi
aagcguaacagcgcu

SEQ ID NO: 1710355 - RNA, 23 nt, Salmonella enterica enterica serovar Typhi
aagcguaacagcgcuaucaggaa

SEQ ID NO: 1710356 - RNA, 21 nt, Salmonella enterica enterica serovar Typhi
aagcguuacggaaaaaauacu

SEQ ID NO: 1710357 - RNA, 20 nt, Salmonella enterica enterica serovar Typhi
aagcguugccguaggcaacg

SEQ ID NO: 1710358 - RNA, 15 nt, Salmonella enterica enterica serovar Typhi
aagcguuucucuugu

SEQ ID NO: 1710359 - RNA, 14 nt, Salmonella enterica enterica serovar Typhi
aagcguuuccagag

SEQ ID NO: 1710360 - RNA, 13 nt, Salmonella enterica enterica serovar Typhi
aagcuuguagaaa

SEQ ID NO: 1710361 - RNA, 11 nt, Salmonella enterica enterica serovar Typhi
aaggaaauuca

SEQ ID NO: 1710362 - RNA, 22 nt, Salmonella enterica enterica serovar Typhi
aaggaaacuuauuucaacuuau

SEQ ID NO: 1710363 - RNA, 21 nt, Salmonella enterica enterica serovar Typhi
aagcuggauaccgcgccagcg

SEQ ID NO: 1710364 - RNA, 13 nt, Salmonella enterica enterica serovar Typhi
aagcugauauuuu

SEQ ID NO: 1710365 - RNA, 16 nt, Salmonella enterica enterica serovar Typhi
aagcugauauuuuacu

SEQ ID NO: 1710366 - RNA, 23 nt, Salmonella enterica enterica serovar Typhi
aagcucauuucccaauaguuuau

SEQ ID NO: 1710367 - RNA, 15 nt, Salmonella enterica enterica serovar Typhi
aagcugaccagggca

SEQ ID NO: 1710368 - RNA, 21 nt, Salmonella enterica enterica serovar Typhi
aagcugaccagggcaaauuau

SEQ ID NO: 1710369 - RNA, 20 nt, Salmonella enterica enterica serovar Typhi
aagcugggcgucaacgugaa

SEQ ID NO: 1710370 - RNA, 22 nt, Salmonella enterica enterica serovar Typhi
aagcugguggcgaguccugccg

SEQ ID NO: 1710371 - RNA, 23 nt, Salmonella enterica enterica serovar Typhi
aagcugguuaaugaccugccgcg

SEQ ID NO: 1710372 - RNA, 17 nt, Salmonella enterica enterica serovar Typhi
aagcuucgucaggcggc

SEQ ID NO: 1710373 - RNA, 23 nt, Salmonella enterica enterica serovar Typhi
aagugauacaugcuacaggcaag

SEQ ID NO: 1710374 - RNA, 22 nt, Salmonella enterica enterica serovar Typhi
aagugaguaaacgcucaagcaa

SEQ ID NO: 1710375 - RNA, 15 nt, Salmonella enterica enterica serovar Typhi
aagucugugagaaaa

SEQ ID NO: 1710376 - RNA, 18 nt, Salmonella enterica enterica serovar Typhi
aagucugagcgcaaacau

SEQ ID NO: 1710377 - RNA, 18 nt, Salmonella enterica enterica serovar Typhi
aagugguuaacagcgcag

SEQ ID NO: 1710378 - RNA, 18 nt, Salmonella enterica enterica serovar Typhi
aaguuaucccugcugagu

SEQ ID NO: 1710379 - RNA, 12 nt, Salmonella enterica enterica serovar Typhi
aagucaaacuga

SEQ ID NO: 1710380 - RNA, 16 nt, Salmonella enterica enterica serovar Typhi
aagucauaccuguucc

SEQ ID NO: 1710381 - RNA, 14 nt, Salmonella enterica enterica serovar Typhi
aagucaucugccag

SEQ ID NO: 1710382 - RNA, 18 nt, Salmonella enterica enterica serovar Typhi
aagucaucugccaguuau

SEQ ID NO: 1710383 - RNA, 20 nt, Salmonella enterica enterica serovar Typhi
aagucaucuguucaacuuuu

SEQ ID NO: 1710384 - RNA, 20 nt, Salmonella enterica enterica serovar Typhi
aagucgaaauuuucuucuuc

SEQ ID NO: 1710385 - RNA, 15 nt, Salmonella enterica enterica serovar Typhi
aaguccuucuucccc

SEQ ID NO: 1710386 - RNA, 17 nt, Salmonella enterica enterica serovar Typhi
aaguccuucuucccccu

SEQ ID NO: 1710387 - RNA, 23 nt, Salmonella enterica enterica serovar Typhi
aaguccuucuccuucgccaaaau

SEQ ID NO: 1710388 - RNA, 17 nt, Salmonella enterica enterica serovar Typhi
aagucgggaaagggcgg

SEQ ID NO: 1710389 - RNA, 20 nt, Salmonella enterica enterica serovar Typhi
aagucgcaauauaaauauca

SEQ ID NO: 1710390 - RNA, 13 nt, Salmonella enterica enterica serovar Typhi
aagucgcgcauaa

SEQ ID NO: 1710391 - RNA, 22 nt, Salmonella enterica enterica serovar Typhi
aaguagcugaaaaucaaaucgg

SEQ ID NO: 1710392 - RNA, 15 nt, Salmonella enterica enterica serovar Typhi
aaguagcugaaaauc

SEQ ID NO: 1710393 - RNA, 15 nt, Salmonella enterica enterica serovar Typhi
aaguagcagagaaaa

SEQ ID NO: 1710394 - RNA, 14 nt, Salmonella enterica enterica serovar Typhi
aaguagaucaccag

SEQ ID NO: 1710395 - RNA, 17 nt, Salmonella enterica enterica serovar Typhi
aaguaucagcgcgcuuu

SEQ ID NO: 1710396 - RNA, 16 nt, Salmonella enterica enterica serovar Typhi
aaguauaaucauaccg

SEQ ID NO: 1710397 - RNA, 22 nt, Salmonella enterica enterica serovar Typhi
aaguaccagcgcgaacauuaca

SEQ ID NO: 1710398 - RNA, 22 nt, Salmonella enterica enterica serovar Typhi
aaguaccgugaagaaacggaaa

SEQ ID NO: 1710399 - RNA, 21 nt, Salmonella enterica enterica serovar Typhi
aaguaauucuucgaaugucuc

SEQ ID NO: 1710400 - RNA, 15 nt, Salmonella enterica enterica serovar Typhi
aagguauugauuuuu

SEQ ID NO: 1710401 - RNA, 17 nt, Salmonella enterica enterica serovar Typhi
aagguauugauuuuuaa

SEQ ID NO: 1710402 - RNA, 16 nt, Salmonella enterica enterica serovar Typhi
aagggugcccgccugg

SEQ ID NO: 1710403 - RNA, 18 nt, Salmonella enterica enterica serovar Typhi
aaggucgacauuuaauga

SEQ ID NO: 1710404 - RNA, 15 nt, Salmonella enterica enterica serovar Typhi
aaguaaaaugcccug

SEQ ID NO: 1710405 - RNA, 15 nt, Salmonella enterica enterica serovar Typhi
aaggcguucacaccg

SEQ ID NO: 1710406 - RNA, 23 nt, Salmonella enterica enterica serovar Typhi
aaggcuaccgcugggaugaccug

SEQ ID NO: 1710407 - RNA, 19 nt, Salmonella enterica enterica serovar Typhi
aaggcuaccgggcaaacau

SEQ ID NO: 1710408 - RNA, 16 nt, Salmonella enterica enterica serovar Typhi
aaggaugacuaaucaa

SEQ ID NO: 1710409 - RNA, 19 nt, Salmonella enterica enterica serovar Typhi
aaggaugaacucuaugcaa

SEQ ID NO: 1710410 - RNA, 23 nt, Salmonella enterica enterica serovar Typhi
aaggaugaacucuaugcaaaaga

SEQ ID NO: 1710411 - RNA, 12 nt, Salmonella enterica enterica serovar Typhi
aagggcgcugcc

SEQ ID NO: 1710412 - RNA, 18 nt, Salmonella enterica enterica serovar Typhi
aaggggauaacaaccagg

SEQ ID NO: 1710413 - RNA, 14 nt, Salmonella enterica enterica serovar Typhi
aagggcaccugggc

SEQ ID NO: 1710414 - RNA, 15 nt, Salmonella enterica enterica serovar Typhi
aagggcaauaucaug

SEQ ID NO: 1710415 - RNA, 21 nt, Salmonella enterica enterica serovar Typhi
aagggaucgauaauugcucac

SEQ ID NO: 1710416 - RNA, 18 nt, Salmonella enterica enterica serovar Typhi
aagggaggugcucuccca

SEQ ID NO: 1710417 - RNA, 20 nt, Salmonella enterica enterica serovar Typhi
aagggaggugcucucccagc

SEQ ID NO: 1710418 - RNA, 16 nt, Salmonella enterica enterica serovar Typhi
aauuggaguuaucauu

SEQ ID NO: 1710419 - RNA, 17 nt, Salmonella enterica enterica serovar Typhi
aauugcgguucugcaua

SEQ ID NO: 1710420 - RNA, 20 nt, Salmonella enterica enterica serovar Typhi
aauugcgguuuauccccgcu

SEQ ID NO: 1710421 - RNA, 20 nt, Salmonella enterica enterica serovar Typhi
aauugcgguagaugaaaauu

SEQ ID NO: 1710422 - RNA, 17 nt, Salmonella enterica enterica serovar Typhi
aauugcgccaggcccag

SEQ ID NO: 1710423 - RNA, 11 nt, Salmonella enterica enterica serovar Typhi
aauugcgcauc

SEQ ID NO: 1710424 - RNA, 16 nt, Salmonella enterica enterica serovar Typhi
aauugccgucgccgga

SEQ ID NO: 1710425 - RNA, 13 nt, Salmonella enterica enterica serovar Typhi
aauugccgcccgu

SEQ ID NO: 1710426 - RNA, 20 nt, Salmonella enterica enterica serovar Typhi
aauugcagggugcagcaaau

SEQ ID NO: 1710427 - RNA, 18 nt, Salmonella enterica enterica serovar Typhi
aauugcagggugcagcaa

SEQ ID NO: 1710428 - RNA, 13 nt, Salmonella enterica enterica serovar Typhi
aauugauucugug

SEQ ID NO: 1710429 - RNA, 15 nt, Salmonella enterica enterica serovar Typhi
aauugauucugugau

SEQ ID NO: 1710430 - RNA, 20 nt, Salmonella enterica enterica serovar Typhi
aauucuugcccgcugagugg

SEQ ID NO: 1710431 - RNA, 21 nt, Salmonella enterica enterica serovar Typhi
aauucuguaccaggacgcacc

SEQ ID NO: 1710432 - RNA, 20 nt, Salmonella enterica enterica serovar Typhi
aauucuuaacccacaagaaa

SEQ ID NO: 1710433 - RNA, 14 nt, Salmonella enterica enterica serovar Typhi
aauugaauuauaau

SEQ ID NO: 1710434 - RNA, 15 nt, Salmonella enterica enterica serovar Typhi
aauugaauuauaaua

SEQ ID NO: 1710435 - RNA, 17 nt, Salmonella enterica enterica serovar Typhi
aauugaauuauaauaaa

SEQ ID NO: 1710436 - RNA, 23 nt, Salmonella enterica enterica serovar Typhi
aauugaccguccccagccagaga

SEQ ID NO: 1710437 - RNA, 18 nt, Salmonella enterica enterica serovar Typhi
aauugaagaguuugauca

SEQ ID NO: 1710438 - RNA, 22 nt, Salmonella enterica enterica serovar Typhi
aauugaggccguuauugucaug

SEQ ID NO: 1710439 - RNA, 18 nt, Salmonella enterica enterica serovar Typhi
aauugauaauaaccgucu

SEQ ID NO: 1710440 - RNA, 23 nt, Salmonella enterica enterica serovar Typhi
aauugacuggauuuuugacuaaa

SEQ ID NO: 1710441 - RNA, 21 nt, Salmonella enterica enterica serovar Typhi
aauuucaaucgccaguuuuug

SEQ ID NO: 1710442 - RNA, 16 nt, Salmonella enterica enterica serovar Typhi
aauuucacgcagcacg

SEQ ID NO: 1710443 - RNA, 12 nt, Salmonella enterica enterica serovar Typhi
aauuuaugauuu

SEQ ID NO: 1710444 - RNA, 20 nt, Salmonella enterica enterica serovar Typhi
aauuuaugguuccugaaaua

SEQ ID NO: 1710445 - RNA, 18 nt, Salmonella enterica enterica serovar Typhi
aauuuaaccguuuuaccu

SEQ ID NO: 1710446 - RNA, 19 nt, Salmonella enterica enterica serovar Typhi
aauuuaauauaugaaccaa

SEQ ID NO: 1710447 - RNA, 14 nt, Salmonella enterica enterica serovar Typhi
aauuuaucaacaaa

SEQ ID NO: 1710448 - RNA, 22 nt, Salmonella enterica enterica serovar Typhi
aauuuaucaacaaauuccggca

SEQ ID NO: 1710449 - RNA, 13 nt, Salmonella enterica enterica serovar Typhi
aauuuaaacaugu

SEQ ID NO: 1710450 - RNA, 12 nt, Salmonella enterica enterica serovar Typhi
aauuuaaacgga

SEQ ID NO: 1710451 - RNA, 20 nt, Salmonella enterica enterica serovar Typhi
aauuguugcgccauggcuuc

SEQ ID NO: 1710452 - RNA, 18 nt, Salmonella enterica enterica serovar Typhi
aauuguaggcaggaauuc

SEQ ID NO: 1710453 - RNA, 15 nt, Salmonella enterica enterica serovar Typhi
aauucaccaaauccu

SEQ ID NO: 1710454 - RNA, 12 nt, Salmonella enterica enterica serovar Typhi
aauucaaucacu

SEQ ID NO: 1710455 - RNA, 18 nt, Salmonella enterica enterica serovar Typhi
aauuauuuuuucaugacu

SEQ ID NO: 1710456 - RNA, 16 nt, Salmonella enterica enterica serovar Typhi
aauuauuaucaauuuc

SEQ ID NO: 1710457 - RNA, 20 nt, Salmonella enterica enterica serovar Typhi
aauuauuuuuacuuaaaauu

SEQ ID NO: 1710458 - RNA, 23 nt, Salmonella enterica enterica serovar Typhi
aauuaucuguugauaaaacacuc

SEQ ID NO: 1710459 - RNA, 17 nt, Salmonella enterica enterica serovar Typhi
aauuaugaauaaccauc

SEQ ID NO: 1710460 - RNA, 16 nt, Salmonella enterica enterica serovar Typhi
aauuaugaccaauguu

SEQ ID NO: 1710461 - RNA, 17 nt, Salmonella enterica enterica serovar Typhi
aauuaugaccaauguua

SEQ ID NO: 1710462 - RNA, 15 nt, Salmonella enterica enterica serovar Typhi
aauuauuaaaucaau

SEQ ID NO: 1710463 - RNA, 12 nt, Salmonella enterica enterica serovar Typhi
aauguagcccca

SEQ ID NO: 1710464 - RNA, 14 nt, Salmonella enterica enterica serovar Typhi
aauuaacaaauaaa

SEQ ID NO: 1710465 - RNA, 15 nt, Salmonella enterica enterica serovar Typhi
aauguacaucacauu

SEQ ID NO: 1710466 - RNA, 22 nt, Salmonella enterica enterica serovar Typhi
aauuacguuggggauaaccaga

SEQ ID NO: 1710467 - RNA, 18 nt, Salmonella enterica enterica serovar Typhi
aauuacuaucuucaaagc

SEQ ID NO: 1710468 - RNA, 22 nt, Salmonella enterica enterica serovar Typhi
aauuacuccguuuuaaucuuuu

SEQ ID NO: 1710469 - RNA, 16 nt, Salmonella enterica enterica serovar Typhi
aauuacgccauaaaaa

SEQ ID NO: 1710470 - RNA, 18 nt, Salmonella enterica enterica serovar Typhi
aauuccuucaauuuuacu

SEQ ID NO: 1710471 - RNA, 21 nt, Salmonella enterica enterica serovar Typhi
aauucgaaauaaagaaaguag

SEQ ID NO: 1710472 - RNA, 16 nt, Salmonella enterica enterica serovar Typhi
aauuccugacugcgcg

SEQ ID NO: 1710473 - RNA, 14 nt, Salmonella enterica enterica serovar Typhi
aauucgugugauuu

SEQ ID NO: 1710474 - RNA, 22 nt, Salmonella enterica enterica serovar Typhi
aauucgucaauaccuaaguuca

SEQ ID NO: 1710475 - RNA, 22 nt, Salmonella enterica enterica serovar Typhi
aauucguacguuuuuccauuca

SEQ ID NO: 1710476 - RNA, 21 nt, Salmonella enterica enterica serovar Typhi
aauucugacgcagcuucugau

SEQ ID NO: 1710477 - RNA, 19 nt, Salmonella enterica enterica serovar Typhi
aauucugcgcgucaucgcu

SEQ ID NO: 1710478 - RNA, 16 nt, Salmonella enterica enterica serovar Typhi
aauucuaugccaggcg

SEQ ID NO: 1710479 - RNA, 15 nt, Salmonella enterica enterica serovar Typhi
aauucuaugccaggc

SEQ ID NO: 1710480 - RNA, 16 nt, Salmonella enterica enterica serovar Typhi
aauuccggagccugug

SEQ ID NO: 1710481 - RNA, 17 nt, Salmonella enterica enterica serovar Typhi
aauuccggcgaaaaacc

SEQ ID NO: 1710482 - RNA, 16 nt, Salmonella enterica enterica serovar Typhi
aauuccgcaucauuca

SEQ ID NO: 1710483 - RNA, 17 nt, Salmonella enterica enterica serovar Typhi
aauuccgcaucauucau

SEQ ID NO: 1710484 - RNA, 20 nt, Salmonella enterica enterica serovar Typhi
aauucccgcagccagcaaua

SEQ ID NO: 1710485 - RNA, 14 nt, Salmonella enterica enterica serovar Typhi
aauuccaggaugac

SEQ ID NO: 1710486 - RNA, 19 nt, Salmonella enterica enterica serovar Typhi
aauucagcgucgagcaccu

SEQ ID NO: 1710487 - RNA, 15 nt, Salmonella enterica enterica serovar Typhi
aauucauaacaccaa

SEQ ID NO: 1710488 - RNA, 12 nt, Salmonella enterica enterica serovar Typhi
aauucagacuca

SEQ ID NO: 1710489 - RNA, 21 nt, Salmonella enterica enterica serovar Typhi
aauucagaaaguuacuuucca

SEQ ID NO: 1710490 - RNA, 17 nt, Salmonella enterica enterica serovar Typhi
aauucaccaaauccuca

SEQ ID NO: 1710491 - RNA, 18 nt, Salmonella enterica enterica serovar Typhi
aauucacguuccauuuca

SEQ ID NO: 1710492 - RNA, 18 nt, Salmonella enterica enterica serovar Typhi
aauucacccguuauucau

SEQ ID NO: 1710493 - RNA, 19 nt, Salmonella enterica enterica serovar Typhi
aauucacccguuauucauu

SEQ ID NO: 1710494 - RNA, 18 nt, Salmonella enterica enterica serovar Typhi
aauucaccgcaugacaau

SEQ ID NO: 1710495 - RNA, 18 nt, Salmonella enterica enterica serovar Typhi
aaugcggcguguggcugu

SEQ ID NO: 1710496 - RNA, 19 nt, Salmonella enterica enterica serovar Typhi
aaugcgcuuuuuuugcccu

SEQ ID NO: 1710497 - RNA, 22 nt, Salmonella enterica enterica serovar Typhi
aaugcgcgcggcuaccggacug

SEQ ID NO: 1710498 - RNA, 15 nt, Salmonella enterica enterica serovar Typhi
aaugcgcuagcuggc

SEQ ID NO: 1710499 - RNA, 16 nt, Salmonella enterica enterica serovar Typhi
aaugcgucggcaccau

SEQ ID NO: 1710500 - RNA, 16 nt, Salmonella enterica enterica serovar Typhi
aaugcggccauccugc

SEQ ID NO: 1710501 - RNA, 20 nt, Salmonella enterica enterica serovar Typhi
aaugcgucggcaccauuccc

SEQ ID NO: 1710502 - RNA, 14 nt, Salmonella enterica enterica serovar Typhi
aauggaacugccug

SEQ ID NO: 1710503 - RNA, 11 nt, Salmonella enterica enterica serovar Typhi
aauggagauga

SEQ ID NO: 1710504 - RNA, 19 nt, Salmonella enterica enterica serovar Typhi
aauggaccagccaggcgau

SEQ ID NO: 1710505 - RNA, 10 nt, Salmonella enterica enterica serovar Typhi
aaugcuuucc

SEQ ID NO: 1710506 - RNA, 13 nt, Salmonella enterica enterica serovar Typhi
aaugcuuuaaaug

SEQ ID NO: 1710507 - RNA, 20 nt, Salmonella enterica enterica serovar Typhi
aauggccagaugaaacugca

SEQ ID NO: 1710508 - RNA, 14 nt, Salmonella enterica enterica serovar Typhi
aauggcgcgaaaac

SEQ ID NO: 1710509 - RNA, 19 nt, Salmonella enterica enterica serovar Typhi
aauggcgcgaaaacagcug

SEQ ID NO: 1710510 - RNA, 21 nt, Salmonella enterica enterica serovar Typhi
aauggcgacgacgcuguuuau

SEQ ID NO: 1710511 - RNA, 15 nt, Salmonella enterica enterica serovar Typhi
aaugguuucccaggu

SEQ ID NO: 1710512 - RNA, 12 nt, Salmonella enterica enterica serovar Typhi
aaugguuuugcc

SEQ ID NO: 1710513 - RNA, 13 nt, Salmonella enterica enterica serovar Typhi
aauguaaaacuga

SEQ ID NO: 1710514 - RNA, 19 nt, Salmonella enterica enterica serovar Typhi
aauggcgcguuuuaucaug

SEQ ID NO: 1710515 - RNA, 16 nt, Salmonella enterica enterica serovar Typhi
aauggcgcucuuuucc

SEQ ID NO: 1710516 - RNA, 20 nt, Salmonella enterica enterica serovar Typhi
aaugccgauagucuccgcca

SEQ ID NO: 1710517 - RNA, 18 nt, Salmonella enterica enterica serovar Typhi
aaugccgacccaccugac

SEQ ID NO: 1710518 - RNA, 12 nt, Salmonella enterica enterica serovar Typhi
aaugcccggcgc

SEQ ID NO: 1710519 - RNA, 17 nt, Salmonella enterica enterica serovar Typhi
aaugcccgguauuuuuu

SEQ ID NO: 1710520 - RNA, 21 nt, Salmonella enterica enterica serovar Typhi
aaugcccgucucauuucugga

SEQ ID NO: 1710521 - RNA, 16 nt, Salmonella enterica enterica serovar Typhi
aaugcccguugacgaa

SEQ ID NO: 1710522 - RNA, 18 nt, Salmonella enterica enterica serovar Typhi
aaugcccucaacgcccug

SEQ ID NO: 1710523 - RNA, 14 nt, Salmonella enterica enterica serovar Typhi
aaugccaaaaaaac

SEQ ID NO: 1710524 - RNA, 18 nt, Salmonella enterica enterica serovar Typhi
aaugccacgauccccguc

SEQ ID NO: 1710525 - RNA, 17 nt, Salmonella enterica enterica serovar Typhi
aaugccacuauagauga

SEQ ID NO: 1710526 - RNA, 23 nt, Salmonella enterica enterica serovar Typhi
aaugccagaaaucgcucaugcgc

SEQ ID NO: 1710527 - RNA, 21 nt, Salmonella enterica enterica serovar Typhi
aaugcauggcagauaaaccac

SEQ ID NO: 1710528 - RNA, 19 nt, Salmonella enterica enterica serovar Typhi
aaugcauagccccagcgca

SEQ ID NO: 1710529 - RNA, 19 nt, Salmonella enterica enterica serovar Typhi
aaugcagggguguccagau

SEQ ID NO: 1710530 - RNA, 16 nt, Salmonella enterica enterica serovar Typhi
aaugcaggcguuuuau

SEQ ID NO: 1710531 - RNA, 14 nt, Salmonella enterica enterica serovar Typhi
aaugcgaaaaaaag

SEQ ID NO: 1710532 - RNA, 14 nt, Salmonella enterica enterica serovar Typhi
aaugccuuccugug

SEQ ID NO: 1710533 - RNA, 21 nt, Salmonella enterica enterica serovar Typhi
aaugcgcaaaauucacaccaa

SEQ ID NO: 1710534 - RNA, 19 nt, Salmonella enterica enterica serovar Typhi
aaugcgcaaucccggagag

SEQ ID NO: 1710535 - RNA, 17 nt, Salmonella enterica enterica serovar Typhi
aaugcgcgaauaucuuu

SEQ ID NO: 1710536 - RNA, 15 nt, Salmonella enterica enterica serovar Typhi
aaugcgccccggcgg

SEQ ID NO: 1710537 - RNA, 14 nt, Salmonella enterica enterica serovar Typhi
aaugccugaccaac

SEQ ID NO: 1710538 - RNA, 22 nt, Salmonella enterica enterica serovar Typhi
aaugccgggcaaaaaacggaac

SEQ ID NO: 1710539 - RNA, 15 nt, Salmonella enterica enterica serovar Typhi
aaugccgggcaaaaa

SEQ ID NO: 1710540 - RNA, 17 nt, Salmonella enterica enterica serovar Typhi
aaugaauugaacuaaaa

SEQ ID NO: 1710541 - RNA, 15 nt, Salmonella enterica enterica serovar Typhi
aaugaccucaagaau

SEQ ID NO: 1710542 - RNA, 15 nt, Salmonella enterica enterica serovar Typhi
aaugaauguaggccg

SEQ ID NO: 1710543 - RNA, 18 nt, Salmonella enterica enterica serovar Typhi
aaugaauuauuuuuucau

SEQ ID NO: 1710544 - RNA, 22 nt, Salmonella enterica enterica serovar Typhi
aaugaauuauuuuuucaugacu

SEQ ID NO: 1710545 - RNA, 13 nt, Salmonella enterica enterica serovar Typhi
aaugaaucccccc

SEQ ID NO: 1710546 - RNA, 15 nt, Salmonella enterica enterica serovar Typhi
aaugagcaucuaccc

SEQ ID NO: 1710547 - RNA, 13 nt, Salmonella enterica enterica serovar Typhi
aaugagaugcacg

SEQ ID NO: 1710548 - RNA, 17 nt, Salmonella enterica enterica serovar Typhi
aaugagagacggagaaa

SEQ ID NO: 1710549 - RNA, 13 nt, Salmonella enterica enterica serovar Typhi
aaugacgcccugc

SEQ ID NO: 1710550 - RNA, 15 nt, Salmonella enterica enterica serovar Typhi
aaugacggaccaaca

SEQ ID NO: 1710551 - RNA, 20 nt, Salmonella enterica enterica serovar Typhi
aaugacggaccaacaaccca

SEQ ID NO: 1710552 - RNA, 22 nt, Salmonella enterica enterica serovar Typhi
aaugacggacgcagaccaaagu

SEQ ID NO: 1710553 - RNA, 21 nt, Salmonella enterica enterica serovar Typhi
aaugaucguaugcagccaggc

SEQ ID NO: 1710554 - RNA, 19 nt, Salmonella enterica enterica serovar Typhi
aaugaucguaugcagccag

SEQ ID NO: 1710555 - RNA, 15 nt, Salmonella enterica enterica serovar Typhi
aaugauccacggcgu

SEQ ID NO: 1710556 - RNA, 21 nt, Salmonella enterica enterica serovar Typhi
aaugaugacucauuaaaaaaa

SEQ ID NO: 1710557 - RNA, 22 nt, Salmonella enterica enterica serovar Typhi
aaugaugacucauuaaaaaaac

SEQ ID NO: 1710558 - RNA, 17 nt, Salmonella enterica enterica serovar Typhi
aaugaugccccagaaca

SEQ ID NO: 1710559 - RNA, 24 nt, Salmonella enterica enterica serovar Typhi
aaugagcggaacgcguuccacgau

SEQ ID NO: 1710560 - RNA, 21 nt, Salmonella enterica enterica serovar Typhi
aaugaggacggcccgcugucu

SEQ ID NO: 1710561 - RNA, 22 nt, Salmonella enterica enterica serovar Typhi
aaugauggcgagaguuugugau

SEQ ID NO: 1710562 - RNA, 19 nt, Salmonella enterica enterica serovar Typhi
aaugauggggucacagguu

SEQ ID NO: 1710563 - RNA, 12 nt, Salmonella enterica enterica serovar Typhi
aaugaugggguc

SEQ ID NO: 1710564 - RNA, 13 nt, Salmonella enterica enterica serovar Typhi
aaugauuugcuuu

SEQ ID NO: 1710565 - RNA, 14 nt, Salmonella enterica enterica serovar Typhi
aaugaaaaaaaaau

SEQ ID NO: 1710566 - RNA, 12 nt, Salmonella enterica enterica serovar Typhi
aaucuuuuauau

SEQ ID NO: 1710567 - RNA, 22 nt, Salmonella enterica enterica serovar Typhi
aaucuuuuauauguugaauauu

SEQ ID NO: 1710568 - RNA, 15 nt, Salmonella enterica enterica serovar Typhi
aaucuuaccuguucc

SEQ ID NO: 1710569 - RNA, 23 nt, Salmonella enterica enterica serovar Typhi
aaugaacaugacgccgaaauaaa

SEQ ID NO: 1710570 - RNA, 12 nt, Salmonella enterica enterica serovar Typhi
aaugaaaucguc

SEQ ID NO: 1710571 - RNA, 17 nt, Salmonella enterica enterica serovar Typhi
aaucuguucguugcugu

SEQ ID NO: 1710572 - RNA, 18 nt, Salmonella enterica enterica serovar Typhi
aaucuggucguaagaauu

SEQ ID NO: 1710573 - RNA, 13 nt, Salmonella enterica enterica serovar Typhi
aaucccuucuuuu

SEQ ID NO: 1710574 - RNA, 14 nt, Salmonella enterica enterica serovar Typhi
aaucccuucuuuua

SEQ ID NO: 1710575 - RNA, 19 nt, Salmonella enterica enterica serovar Typhi
aaucccuggcgaauaaaau

SEQ ID NO: 1710576 - RNA, 21 nt, Salmonella enterica enterica serovar Typhi
aauccgagacgguaagaauaa

SEQ ID NO: 1710577 - RNA, 20 nt, Salmonella enterica enterica serovar Typhi
aaucccuucuuuuacugccc

SEQ ID NO: 1710578 - RNA, 17 nt, Salmonella enterica enterica serovar Typhi
aaucccacgccgcugau

SEQ ID NO: 1710579 - RNA, 17 nt, Salmonella enterica enterica serovar Typhi
aaucccccugccacaac

SEQ ID NO: 1710580 - RNA, 23 nt, Salmonella enterica enterica serovar Typhi
aaucccgaaucacuuacuaaggu

SEQ ID NO: 1710581 - RNA, 22 nt, Salmonella enterica enterica serovar Typhi
aaucccggcgauuaauaaaauc

SEQ ID NO: 1710582 - RNA, 14 nt, Salmonella enterica enterica serovar Typhi
aauccgcgcccugg

SEQ ID NO: 1710583 - RNA, 22 nt, Salmonella enterica enterica serovar Typhi
aauccggcgccagguaaguuca

SEQ ID NO: 1710584 - RNA, 21 nt, Salmonella enterica enterica serovar Typhi
aauccggcugccugccggauu

SEQ ID NO: 1710585 - RNA, 18 nt, Salmonella enterica enterica serovar Typhi
aauccgugcguaaaauau

SEQ ID NO: 1710586 - RNA, 16 nt, Salmonella enterica enterica serovar Typhi
aauccguuaagcccug

SEQ ID NO: 1710587 - RNA, 15 nt, Salmonella enterica enterica serovar Typhi
aauccugcacccgcc

SEQ ID NO: 1710588 - RNA, 12 nt, Salmonella enterica enterica serovar Typhi
aauccugcaccc

SEQ ID NO: 1710589 - RNA, 19 nt, Salmonella enterica enterica serovar Typhi
aauccucuaccggaaaaca

SEQ ID NO: 1710590 - RNA, 21 nt, Salmonella enterica enterica serovar Typhi
aaucgcucacccgauaaaauc

SEQ ID NO: 1710591 - RNA, 14 nt, Salmonella enterica enterica serovar Typhi
aaucgcuaaacaua

SEQ ID NO: 1710592 - RNA, 20 nt, Salmonella enterica enterica serovar Typhi
aaucgccugcuguacuuuug

SEQ ID NO: 1710593 - RNA, 18 nt, Salmonella enterica enterica serovar Typhi
aaucgcgagccuucaaca

SEQ ID NO: 1710594 - RNA, 16 nt, Salmonella enterica enterica serovar Typhi
aaucgccgggcggcgc

SEQ ID NO: 1710595 - RNA, 15 nt, Salmonella enterica enterica serovar Typhi
aaucgccgccgccag

SEQ ID NO: 1710596 - RNA, 21 nt, Salmonella enterica enterica serovar Typhi
aaucgccgucagugagcccuc

SEQ ID NO: 1710597 - RNA, 14 nt, Salmonella enterica enterica serovar Typhi
aaucgccucaacca

SEQ ID NO: 1710598 - RNA, 16 nt, Salmonella enterica enterica serovar Typhi
aaucgccucaaccaac

SEQ ID NO: 1710599 - RNA, 17 nt, Salmonella enterica enterica serovar Typhi
aauccugucgucaccag

SEQ ID NO: 1710600 - RNA, 13 nt, Salmonella enterica enterica serovar Typhi
aauccuuccuuuc

SEQ ID NO: 1710601 - RNA, 16 nt, Salmonella enterica enterica serovar Typhi
aauccuucuuccauuc

SEQ ID NO: 1710602 - RNA, 18 nt, Salmonella enterica enterica serovar Typhi
aauccuuguccauguaaa

SEQ ID NO: 1710603 - RNA, 23 nt, Salmonella enterica enterica serovar Typhi
aauccuuguccauguaaacucca

SEQ ID NO: 1710604 - RNA, 18 nt, Salmonella enterica enterica serovar Typhi
aaucgcuaaacauauacc

SEQ ID NO: 1710605 - RNA, 19 nt, Salmonella enterica enterica serovar Typhi
aaucgggcgcuaaacccaa

SEQ ID NO: 1710606 - RNA, 23 nt, Salmonella enterica enterica serovar Typhi
aaucgguaacaucaaguacagcu

SEQ ID NO: 1710607 - RNA, 20 nt, Salmonella enterica enterica serovar Typhi
aaucguagcgugcgcaauau

SEQ ID NO: 1710608 - RNA, 20 nt, Salmonella enterica enterica serovar Typhi
aaucgucgccaacaccgauc

SEQ ID NO: 1710609 - RNA, 22 nt, Salmonella enterica enterica serovar Typhi
aaucguaugcgccugucuuaaa

SEQ ID NO: 1710610 - RNA, 19 nt, Salmonella enterica enterica serovar Typhi
aaucuaccauugauaccaa

SEQ ID NO: 1710611 - RNA, 13 nt, Salmonella enterica enterica serovar Typhi
aauccaucccccu

SEQ ID NO: 1710612 - RNA, 13 nt, Salmonella enterica enterica serovar Typhi
aauccagguggau

SEQ ID NO: 1710613 - RNA, 23 nt, Salmonella enterica enterica serovar Typhi
aauccaguaaugccauaauuuau

SEQ ID NO: 1710614 - RNA, 12 nt, Salmonella enterica enterica serovar Typhi
aauccaucucag

SEQ ID NO: 1710615 - RNA, 20 nt, Salmonella enterica enterica serovar Typhi
aauccagaggguaauuucuu

SEQ ID NO: 1710616 - RNA, 21 nt, Salmonella enterica enterica serovar Typhi
aauccacuggucgucugaaag

SEQ ID NO: 1710617 - RNA, 21 nt, Salmonella enterica enterica serovar Typhi
aauccacggguuacaacugcg

SEQ ID NO: 1710618 - RNA, 12 nt, Salmonella enterica enterica serovar Typhi
aauccaccagcg

SEQ ID NO: 1710619 - RNA, 15 nt, Salmonella enterica enterica serovar Typhi
aaucauuuguacaaa

SEQ ID NO: 1710620 - RNA, 14 nt, Salmonella enterica enterica serovar Typhi
aauccaaauccgca

SEQ ID NO: 1710621 - RNA, 13 nt, Salmonella enterica enterica serovar Typhi
aaucaggaaaaag

SEQ ID NO: 1710622 - RNA, 17 nt, Salmonella enterica enterica serovar Typhi
aauauguuccacaauca

SEQ ID NO: 1710623 - RNA, 23 nt, Salmonella enterica enterica serovar Typhi
aaucaggcacaacccaaaggcca

SEQ ID NO: 1710624 - RNA, 17 nt, Salmonella enterica enterica serovar Typhi
aaucaggcauccugccc

SEQ ID NO: 1710625 - RNA, 17 nt, Salmonella enterica enterica serovar Typhi
aaucaggugaauaccaa

SEQ ID NO: 1710626 - RNA, 22 nt, Salmonella enterica enterica serovar Typhi
aaucaugaacguuaucggcaua

SEQ ID NO: 1710627 - RNA, 13 nt, Salmonella enterica enterica serovar Typhi
aaucaugucaaau

SEQ ID NO: 1710628 - RNA, 14 nt, Salmonella enterica enterica serovar Typhi
aaucauuaauacac

SEQ ID NO: 1710629 - RNA, 13 nt, Salmonella enterica enterica serovar Typhi
aaucauuaucacu

SEQ ID NO: 1710630 - RNA, 18 nt, Salmonella enterica enterica serovar Typhi
aaucauucgggaugcaua

SEQ ID NO: 1710631 - RNA, 19 nt, Salmonella enterica enterica serovar Typhi
aaucauucgggaugcauaa

SEQ ID NO: 1710632 - RNA, 20 nt, Salmonella enterica enterica serovar Typhi
aaucauucgggaugcauaaa

SEQ ID NO: 1710633 - RNA, 22 nt, Salmonella enterica enterica serovar Typhi
aaucauucuacaaguucaguag

SEQ ID NO: 1710634 - RNA, 18 nt, Salmonella enterica enterica serovar Typhi
aaccuuccgccaggcggg

SEQ ID NO: 1710635 - RNA, 15 nt, Salmonella enterica enterica serovar Typhi
aaccuucgcuuuuaa

SEQ ID NO: 1710636 - RNA, 19 nt, Salmonella enterica enterica serovar Typhi
aaccuucgcuuuuaaaacu

SEQ ID NO: 1710637 - RNA, 15 nt, Salmonella enterica enterica serovar Typhi
aaccuucauaaauac

SEQ ID NO: 1710638 - RNA, 17 nt, Salmonella enterica enterica serovar Typhi
aaccuucaagaaucaau

SEQ ID NO: 1710639 - RNA, 20 nt, Salmonella enterica enterica serovar Typhi
aaccuucaagaaucaauaua

SEQ ID NO: 1710640 - RNA, 12 nt, Salmonella enterica enterica serovar Typhi
aaccuugcgccu

SEQ ID NO: 1710641 - RNA, 14 nt, Salmonella enterica enterica serovar Typhi
aaccuuugcugacg

SEQ ID NO: 1710642 - RNA, 12 nt, Salmonella enterica enterica serovar Typhi
aacgaaacucag

SEQ ID NO: 1710643 - RNA, 20 nt, Salmonella enterica enterica serovar Typhi
aacgaauuuaaauagcaauu

SEQ ID NO: 1710644 - RNA, 15 nt, Salmonella enterica enterica serovar Typhi
aacgacaaaucugcc

SEQ ID NO: 1710645 - RNA, 20 nt, Salmonella enterica enterica serovar Typhi
aacgacaaaucugccgggag

SEQ ID NO: 1710646 - RNA, 14 nt, Salmonella enterica enterica serovar Typhi
aacgaccagaauca

SEQ ID NO: 1710647 - RNA, 15 nt, Salmonella enterica enterica serovar Typhi
aacgacccaucaaua

SEQ ID NO: 1710648 - RNA, 22 nt, Salmonella enterica enterica serovar Typhi
aaccuccugcaaucguucuugc

SEQ ID NO: 1710649 - RNA, 20 nt, Salmonella enterica enterica serovar Typhi
aaccucaucccggcuuaaau

SEQ ID NO: 1710650 - RNA, 13 nt, Salmonella enterica enterica serovar Typhi
aaccucccgccgg

SEQ ID NO: 1710651 - RNA, 20 nt, Salmonella enterica enterica serovar Typhi
aaccucggcuugcuucaucu

SEQ ID NO: 1710652 - RNA, 15 nt, Salmonella enterica enterica serovar Typhi
aaccugagaauauua

SEQ ID NO: 1710653 - RNA, 13 nt, Salmonella enterica enterica serovar Typhi
aaccugagcgcga

SEQ ID NO: 1710654 - RNA, 21 nt, Salmonella enterica enterica serovar Typhi
aaccugcgccgcgauaaagaa

SEQ ID NO: 1710655 - RNA, 21 nt, Salmonella enterica enterica serovar Typhi
aaccugcguuacggucgauuu

SEQ ID NO: 1710656 - RNA, 19 nt, Salmonella enterica enterica serovar Typhi
aaccucaccguccgccagg

SEQ ID NO: 1710657 - RNA, 22 nt, Salmonella enterica enterica serovar Typhi
aaccuauugaaaauaaaugaua

SEQ ID NO: 1710658 - RNA, 22 nt, Salmonella enterica enterica serovar Typhi
aaccguuuuaccuucugccgcg

SEQ ID NO: 1710659 - RNA, 14 nt, Salmonella enterica enterica serovar Typhi
aaccguuaugaauc

SEQ ID NO: 1710660 - RNA, 21 nt, Salmonella enterica enterica serovar Typhi
aaccguucaucuaucgccagc

SEQ ID NO: 1710661 - RNA, 16 nt, Salmonella enterica enterica serovar Typhi
aaccguuggggaaaau

SEQ ID NO: 1710662 - RNA, 15 nt, Salmonella enterica enterica serovar Typhi
aaccgugcuucacgg

SEQ ID NO: 1710663 - RNA, 14 nt, Salmonella enterica enterica serovar Typhi
aaccguccacaucc

SEQ ID NO: 1710664 - RNA, 14 nt, Salmonella enterica enterica serovar Typhi
aaccgucaucagcc

SEQ ID NO: 1710665 - RNA, 21 nt, Salmonella enterica enterica serovar Typhi
aacgcaggcgauagccccagu

SEQ ID NO: 1710666 - RNA, 15 nt, Salmonella enterica enterica serovar Typhi
aacgcauaaaaacgu

SEQ ID NO: 1710667 - RNA, 18 nt, Salmonella enterica enterica serovar Typhi
aacgcaucaaauaccuuu

SEQ ID NO: 1710668 - RNA, 18 nt, Salmonella enterica enterica serovar Typhi
aacgcacccgcgcaggcg

SEQ ID NO: 1710669 - RNA, 18 nt, Salmonella enterica enterica serovar Typhi
aacgauucguaaauugac

SEQ ID NO: 1710670 - RNA, 18 nt, Salmonella enterica enterica serovar Typhi
aacgaugauuauuguuaa

SEQ ID NO: 1710671 - RNA, 17 nt, Salmonella enterica enterica serovar Typhi
aacgaugaugaaaaaga

SEQ ID NO: 1710672 - RNA, 19 nt, Salmonella enterica enterica serovar Typhi
aacgaugaugaaaaagaau

SEQ ID NO: 1710673 - RNA, 20 nt, Salmonella enterica enterica serovar Typhi
aacgaugaugaaaaagaaug

SEQ ID NO: 1710674 - RNA, 21 nt, Salmonella enterica enterica serovar Typhi
aacgacuacguucaucaggca

SEQ ID NO: 1710675 - RNA, 20 nt, Salmonella enterica enterica serovar Typhi
aacgauaauaucgucaccag

SEQ ID NO: 1710676 - RNA, 14 nt, Salmonella enterica enterica serovar Typhi
aacgccugauccgg

SEQ ID NO: 1710677 - RNA, 18 nt, Salmonella enterica enterica serovar Typhi
aacgccugaugcugcgca

SEQ ID NO: 1710678 - RNA, 13 nt, Salmonella enterica enterica serovar Typhi
aacgccuccaccg

SEQ ID NO: 1710679 - RNA, 15 nt, Salmonella enterica enterica serovar Typhi
aacgcgaaauaauca

SEQ ID NO: 1710680 - RNA, 13 nt, Salmonella enterica enterica serovar Typhi
aacgcgaaaauac

SEQ ID NO: 1710681 - RNA, 19 nt, Salmonella enterica enterica serovar Typhi
aacgcgagaagaagaauua

SEQ ID NO: 1710682 - RNA, 18 nt, Salmonella enterica enterica serovar Typhi
aacgcgcaucaacgccag

SEQ ID NO: 1710683 - RNA, 17 nt, Salmonella enterica enterica serovar Typhi
aacgccggauuccagaa

SEQ ID NO: 1710684 - RNA, 15 nt, Salmonella enterica enterica serovar Typhi
aacgccgggccugcc

SEQ ID NO: 1710685 - RNA, 20 nt, Salmonella enterica enterica serovar Typhi
aacgccgcuuuaccgccuuc

SEQ ID NO: 1710686 - RNA, 22 nt, Salmonella enterica enterica serovar Typhi
aacgccgucacaaagcccaccg

SEQ ID NO: 1710687 - RNA, 18 nt, Salmonella enterica enterica serovar Typhi
aacgccguuaccagcauc

SEQ ID NO: 1710688 - RNA, 23 nt, Salmonella enterica enterica serovar Typhi
aacgccgcgcaaagcaauaccac

SEQ ID NO: 1710689 - RNA, 16 nt, Salmonella enterica enterica serovar Typhi
aacgccgcgcguaaau

SEQ ID NO: 1710690 - RNA, 17 nt, Salmonella enterica enterica serovar Typhi
aacgccgccgcaaggcg

SEQ ID NO: 1710691 - RNA, 17 nt, Salmonella enterica enterica serovar Typhi
aacgccgaagccagcgc

SEQ ID NO: 1710692 - RNA, 22 nt, Salmonella enterica enterica serovar Typhi
aacgcaucgcugcgcuuacaca

SEQ ID NO: 1710693 - RNA, 16 nt, Salmonella enterica enterica serovar Typhi
aacgcauccagcguca

SEQ ID NO: 1710694 - RNA, 22 nt, Salmonella enterica enterica serovar Typhi
aacgcaucaaauaccuuuucau

SEQ ID NO: 1710695 - RNA, 13 nt, Salmonella enterica enterica serovar Typhi
aacgcaucacaug

SEQ ID NO: 1710696 - RNA, 23 nt, Salmonella enterica enterica serovar Typhi
aacgccaaaguuuuuaaacaaca

SEQ ID NO: 1710697 - RNA, 15 nt, Salmonella enterica enterica serovar Typhi
aacgccaacgcccgg

SEQ ID NO: 1710698 - RNA, 16 nt, Salmonella enterica enterica serovar Typhi
aacgccaagcgcggca

SEQ ID NO: 1710699 - RNA, 21 nt, Salmonella enterica enterica serovar Typhi
aacgcccggcgcgacaccuuc

SEQ ID NO: 1710700 - RNA, 15 nt, Salmonella enterica enterica serovar Typhi
aacgccgaagccagc

SEQ ID NO: 1710701 - RNA, 17 nt, Salmonella enterica enterica serovar Typhi
aacgccaucagcaaaau

SEQ ID NO: 1710702 - RNA, 13 nt, Salmonella enterica enterica serovar Typhi
aacgccaucagcc

SEQ ID NO: 1710703 - RNA, 22 nt, Salmonella enterica enterica serovar Typhi
aacggaccggcaaucgccugca

SEQ ID NO: 1710704 - RNA, 13 nt, Salmonella enterica enterica serovar Typhi
aacggcagccagc

SEQ ID NO: 1710705 - RNA, 15 nt, Salmonella enterica enterica serovar Typhi
aacggcaccagcaac

SEQ ID NO: 1710706 - RNA, 17 nt, Salmonella enterica enterica serovar Typhi
aacgcuuuguacagaca

SEQ ID NO: 1710707 - RNA, 15 nt, Salmonella enterica enterica serovar Typhi
aacgcuuaaucccuu

SEQ ID NO: 1710708 - RNA, 15 nt, Salmonella enterica enterica serovar Typhi
aacgcuaggcaaccu

SEQ ID NO: 1710709 - RNA, 21 nt, Salmonella enterica enterica serovar Typhi
aacgcuaucaccgccgcccgu

SEQ ID NO: 1710710 - RNA, 13 nt, Salmonella enterica enterica serovar Typhi
aacgcuccagcag

SEQ ID NO: 1710711 - RNA, 22 nt, Salmonella enterica enterica serovar Typhi
aacgcuggccgcaaauccacug

SEQ ID NO: 1710712 - RNA, 13 nt, Salmonella enterica enterica serovar Typhi
aacgcugcaaagu

SEQ ID NO: 1710713 - RNA, 16 nt, Salmonella enterica enterica serovar Typhi
aacgcugagucagaaa

SEQ ID NO: 1710714 - RNA, 22 nt, Salmonella enterica enterica serovar Typhi
aacgcucuuaccgcuaaaauac

SEQ ID NO: 1710715 - RNA, 19 nt, Salmonella enterica enterica serovar Typhi
aacgcucucuuuucuuacu

SEQ ID NO: 1710716 - RNA, 20 nt, Salmonella enterica enterica serovar Typhi
aacgcggcuuuaaguuuuuc

SEQ ID NO: 1710717 - RNA, 22 nt, Salmonella enterica enterica serovar Typhi
aacgcgucuucaucagccagca

SEQ ID NO: 1710718 - RNA, 16 nt, Salmonella enterica enterica serovar Typhi
aacgcgucuucaucag

SEQ ID NO: 1710719 - RNA, 19 nt, Salmonella enterica enterica serovar Typhi
aacgcgucuucaucagcca

SEQ ID NO: 1710720 - RNA, 16 nt, Salmonella enterica enterica serovar Typhi
aacgcgccauccggca

SEQ ID NO: 1710721 - RNA, 18 nt, Salmonella enterica enterica serovar Typhi
aacgcgcccaacggaugc

SEQ ID NO: 1710722 - RNA, 13 nt, Salmonella enterica enterica serovar Typhi
aacgcgccacgcg

SEQ ID NO: 1710723 - RNA, 17 nt, Salmonella enterica enterica serovar Typhi
aacgcgcucgccagcgc

SEQ ID NO: 1710724 - RNA, 15 nt, Salmonella enterica enterica serovar Typhi
aacgcgcucgccagc

SEQ ID NO: 1710725 - RNA, 23 nt, Salmonella enterica enterica serovar Typhi
aacgggcggugugauuaauccaa

SEQ ID NO: 1710726 - RNA, 12 nt, Salmonella enterica enterica serovar Typhi
aacggcucugca

SEQ ID NO: 1710727 - RNA, 17 nt, Salmonella enterica enterica serovar Typhi
aacggcuuuccagcagc

SEQ ID NO: 1710728 - RNA, 19 nt, Salmonella enterica enterica serovar Typhi
aacggcgcguccagccagc

SEQ ID NO: 1710729 - RNA, 23 nt, Salmonella enterica enterica serovar Typhi
aacggcggaaccauuuuccccag

SEQ ID NO: 1710730 - RNA, 19 nt, Salmonella enterica enterica serovar Typhi
aacggcgugaaucccccug

SEQ ID NO: 1710731 - RNA, 15 nt, Salmonella enterica enterica serovar Typhi
aacggccagcaaaau

SEQ ID NO: 1710732 - RNA, 13 nt, Salmonella enterica enterica serovar Typhi
aacggcccggcgu

SEQ ID NO: 1710733 - RNA, 19 nt, Salmonella enterica enterica serovar Typhi
aacguagcccauugucauc

SEQ ID NO: 1710734 - RNA, 16 nt, Salmonella enterica enterica serovar Typhi
aacguaaauacccagg

SEQ ID NO: 1710735 - RNA, 21 nt, Salmonella enterica enterica serovar Typhi
aacguaaauagagaaaucaac

SEQ ID NO: 1710736 - RNA, 19 nt, Salmonella enterica enterica serovar Typhi
aacggguuugauugccauc

SEQ ID NO: 1710737 - RNA, 18 nt, Salmonella enterica enterica serovar Typhi
aacguugacguuucaguc

SEQ ID NO: 1710738 - RNA, 12 nt, Salmonella enterica enterica serovar Typhi
aacguggcggca

SEQ ID NO: 1710739 - RNA, 22 nt, Salmonella enterica enterica serovar Typhi
aacguguuacguuuaaaccaug

SEQ ID NO: 1710740 - RNA, 12 nt, Salmonella enterica enterica serovar Typhi
aacguucaaaau

SEQ ID NO: 1710741 - RNA, 12 nt, Salmonella enterica enterica serovar Typhi
aacguguuaucg

SEQ ID NO: 1710742 - RNA, 16 nt, Salmonella enterica enterica serovar Typhi
aacgucguaaaaccug

SEQ ID NO: 1710743 - RNA, 19 nt, Salmonella enterica enterica serovar Typhi
aacgucguaaaaccugcgu

SEQ ID NO: 1710744 - RNA, 17 nt, Salmonella enterica enterica serovar Typhi
aacgucgcguacaccuu

SEQ ID NO: 1710745 - RNA, 11 nt, Salmonella enterica enterica serovar Typhi
aacgucaguac

SEQ ID NO: 1710746 - RNA, 21 nt, Salmonella enterica enterica serovar Typhi
aacgucaguggaaaacagcau

SEQ ID NO: 1710747 - RNA, 20 nt, Salmonella enterica enterica serovar Typhi
aacgucagcgccacccauuu

SEQ ID NO: 1710748 - RNA, 12 nt, Salmonella enterica enterica serovar Typhi
aacguauuauua

SEQ ID NO: 1710749 - RNA, 18 nt, Salmonella enterica enterica serovar Typhi
aacguuuugugucaaaaa

SEQ ID NO: 1710750 - RNA, 16 nt, Salmonella enterica enterica serovar Typhi
aacuaaaaauucaaaa

SEQ ID NO: 1710751 - RNA, 22 nt, Salmonella enterica enterica serovar Typhi
aacguuuuuccuugauuucauu

SEQ ID NO: 1710752 - RNA, 17 nt, Salmonella enterica enterica serovar Typhi
aacucacguuccccagc

SEQ ID NO: 1710753 - RNA, 19 nt, Salmonella enterica enterica serovar Typhi
aacucacguuccccagcac

SEQ ID NO: 1710754 - RNA, 12 nt, Salmonella enterica enterica serovar Typhi
aacucaggaaau

SEQ ID NO: 1710755 - RNA, 20 nt, Salmonella enterica enterica serovar Typhi
aacucaucgcuuagcggcuc

SEQ ID NO: 1710756 - RNA, 15 nt, Salmonella enterica enterica serovar Typhi
aacucaucaugauau

SEQ ID NO: 1710757 - RNA, 17 nt, Salmonella enterica enterica serovar Typhi
aacucaucaugauauaa

SEQ ID NO: 1710758 - RNA, 18 nt, Salmonella enterica enterica serovar Typhi
aacucaucggaacaguaa

SEQ ID NO: 1710759 - RNA, 17 nt, Salmonella enterica enterica serovar Typhi
aacuaugccagaauaca

SEQ ID NO: 1710760 - RNA, 22 nt, Salmonella enterica enterica serovar Typhi
aacuauguacgccaagcugcaa

SEQ ID NO: 1710761 - RNA, 14 nt, Salmonella enterica enterica serovar Typhi
aacuauuaauucuu

SEQ ID NO: 1710762 - RNA, 19 nt, Salmonella enterica enterica serovar Typhi
aacucugcgacgccaggcg

SEQ ID NO: 1710763 - RNA, 20 nt, Salmonella enterica enterica serovar Typhi
aacucuuccccgaucagaaa

SEQ ID NO: 1710764 - RNA, 20 nt, Salmonella enterica enterica serovar Typhi
aacucucguucggucaggau

SEQ ID NO: 1710765 - RNA, 17 nt, Salmonella enterica enterica serovar Typhi
aacuccagugcagaaag

SEQ ID NO: 1710766 - RNA, 21 nt, Salmonella enterica enterica serovar Typhi
aacuccggacguacccaggcg

SEQ ID NO: 1710767 - RNA, 17 nt, Salmonella enterica enterica serovar Typhi
aacucccgcauauauug

SEQ ID NO: 1710768 - RNA, 15 nt, Salmonella enterica enterica serovar Typhi
aacuccucuuccgac

SEQ ID NO: 1710769 - RNA, 16 nt, Salmonella enterica enterica serovar Typhi
aacuccugggcaaaau

SEQ ID NO: 1710770 - RNA, 18 nt, Salmonella enterica enterica serovar Typhi
aacucgcuguggccaggc

SEQ ID NO: 1710771 - RNA, 21 nt, Salmonella enterica enterica serovar Typhi
aacucggcgggguuuuuuuau

SEQ ID NO: 1710772 - RNA, 16 nt, Salmonella enterica enterica serovar Typhi
aacugcgccaaaucgg

SEQ ID NO: 1710773 - RNA, 19 nt, Salmonella enterica enterica serovar Typhi
aacugcgcgcccgccuccg

SEQ ID NO: 1710774 - RNA, 14 nt, Salmonella enterica enterica serovar Typhi
aacugcggccagac

SEQ ID NO: 1710775 - RNA, 11 nt, Salmonella enterica enterica serovar Typhi
aacugcggcua

SEQ ID NO: 1710776 - RNA, 18 nt, Salmonella enterica enterica serovar Typhi
aacugcgguaaauaaugc

SEQ ID NO: 1710777 - RNA, 18 nt, Salmonella enterica enterica serovar Typhi
aacugcugcgcgugcugu

SEQ ID NO: 1710778 - RNA, 22 nt, Salmonella enterica enterica serovar Typhi
aacugcggaauuuuauccugug

SEQ ID NO: 1710779 - RNA, 10 nt, Salmonella enterica enterica serovar Typhi
aacugcacca

SEQ ID NO: 1710780 - RNA, 22 nt, Salmonella enterica enterica serovar Typhi
aacugauuuguaggccugauaa

SEQ ID NO: 1710781 - RNA, 20 nt, Salmonella enterica enterica serovar Typhi
aacugauggcgcuaagccag

SEQ ID NO: 1710782 - RNA, 23 nt, Salmonella enterica enterica serovar Typhi
aacugauggcgcuaagccagcca

SEQ ID NO: 1710783 - RNA, 22 nt, Salmonella enterica enterica serovar Typhi
aacugauccugcguuaacgacc

SEQ ID NO: 1710784 - RNA, 20 nt, Salmonella enterica enterica serovar Typhi
aacugauauuacuaauaaaa

SEQ ID NO: 1710785 - RNA, 21 nt, Salmonella enterica enterica serovar Typhi
aacugauaacgauaagugaag

SEQ ID NO: 1710786 - RNA, 17 nt, Salmonella enterica enterica serovar Typhi
aacugagacucagcagc

SEQ ID NO: 1710787 - RNA, 16 nt, Salmonella enterica enterica serovar Typhi
aacugaaaccaggcac

SEQ ID NO: 1710788 - RNA, 14 nt, Salmonella enterica enterica serovar Typhi
aacugacgaccggg

SEQ ID NO: 1710789 - RNA, 18 nt, Salmonella enterica enterica serovar Typhi
aacugaccauauaugaaa

SEQ ID NO: 1710790 - RNA, 22 nt, Salmonella enterica enterica serovar Typhi
aacugaauuucauccccggcgc

SEQ ID NO: 1710791 - RNA, 15 nt, Salmonella enterica enterica serovar Typhi
aacuguucagccagc

SEQ ID NO: 1710792 - RNA, 13 nt, Salmonella enterica enterica serovar Typhi
aacuguuaucaua

SEQ ID NO: 1710793 - RNA, 17 nt, Salmonella enterica enterica serovar Typhi
aacuguuaggccggaca

SEQ ID NO: 1710794 - RNA, 14 nt, Salmonella enterica enterica serovar Typhi
aacuguuuuucacu

SEQ ID NO: 1710795 - RNA, 18 nt, Salmonella enterica enterica serovar Typhi
aacuuaaauuaaugauua

SEQ ID NO: 1710796 - RNA, 18 nt, Salmonella enterica enterica serovar Typhi
aacuguuaucauagacug

SEQ ID NO: 1710797 - RNA, 19 nt, Salmonella enterica enterica serovar Typhi
aacuguagcaggauauuuu

SEQ ID NO: 1710798 - RNA, 13 nt, Salmonella enterica enterica serovar Typhi
aacugucagauca

SEQ ID NO: 1710799 - RNA, 15 nt, Salmonella enterica enterica serovar Typhi
aacuguauccguaau

SEQ ID NO: 1710800 - RNA, 14 nt, Salmonella enterica enterica serovar Typhi
aacugucgccgcua

SEQ ID NO: 1710801 - RNA, 14 nt, Salmonella enterica enterica serovar Typhi
aacugucugaauca

SEQ ID NO: 1710802 - RNA, 16 nt, Salmonella enterica enterica serovar Typhi
aacuggcgccggaguc

SEQ ID NO: 1710803 - RNA, 16 nt, Salmonella enterica enterica serovar Typhi
aacuggguaugcagug

SEQ ID NO: 1710804 - RNA, 19 nt, Salmonella enterica enterica serovar Typhi
aacugggugccgugaauau

SEQ ID NO: 1710805 - RNA, 19 nt, Salmonella enterica enterica serovar Typhi
aacuggcgcaucuggucau

SEQ ID NO: 1710806 - RNA, 19 nt, Salmonella enterica enterica serovar Typhi
aacuggcaagcgcuaagca

SEQ ID NO: 1710807 - RNA, 22 nt, Salmonella enterica enterica serovar Typhi
aacuggcacgccguuugccaua

SEQ ID NO: 1710808 - RNA, 12 nt, Salmonella enterica enterica serovar Typhi
aacuggaaaaag

SEQ ID NO: 1710809 - RNA, 14 nt, Salmonella enterica enterica serovar Typhi
aacugcuguagcac

SEQ ID NO: 1710810 - RNA, 19 nt, Salmonella enterica enterica serovar Typhi
aacuucuccgccaucaguu

SEQ ID NO: 1710811 - RNA, 18 nt, Salmonella enterica enterica serovar Typhi
aacuucgcgguuagaaag

SEQ ID NO: 1710812 - RNA, 16 nt, Salmonella enterica enterica serovar Typhi
aacuuccaccaccucc

SEQ ID NO: 1710813 - RNA, 22 nt, Salmonella enterica enterica serovar Typhi
aacuuccaccaccuccugcugg

SEQ ID NO: 1710814 - RNA, 13 nt, Salmonella enterica enterica serovar Typhi
aacuuccuuugcc

SEQ ID NO: 1710815 - RNA, 20 nt, Salmonella enterica enterica serovar Typhi
aacuucaugguacagaucca

SEQ ID NO: 1710816 - RNA, 18 nt, Salmonella enterica enterica serovar Typhi
aacuuacaagugucguga

SEQ ID NO: 1710817 - RNA, 20 nt, Salmonella enterica enterica serovar Typhi
aacuuacacuuaccugauua

SEQ ID NO: 1710818 - RNA, 18 nt, Salmonella enterica enterica serovar Typhi
aacuucaauucagaaagu

SEQ ID NO: 1710819 - RNA, 17 nt, Salmonella enterica enterica serovar Typhi
aacuuauuuuauuuuua

SEQ ID NO: 1710820 - RNA, 12 nt, Salmonella enterica enterica serovar Typhi
aacuuucagaau

SEQ ID NO: 1710821 - RNA, 12 nt, Salmonella enterica enterica serovar Typhi
aacuuucauuuc

SEQ ID NO: 1710822 - RNA, 15 nt, Salmonella enterica enterica serovar Typhi
aacuuucagaauaau

SEQ ID NO: 1710823 - RNA, 16 nt, Salmonella enterica enterica serovar Typhi
aacuuucauuucacuu

SEQ ID NO: 1710824 - RNA, 18 nt, Salmonella enterica enterica serovar Typhi
aacuuuuggugcccaucg

SEQ ID NO: 1710825 - RNA, 20 nt, Salmonella enterica enterica serovar Typhi
aacuuugcgccauuucaaua

SEQ ID NO: 1710826 - RNA, 16 nt, Salmonella enterica enterica serovar Typhi
aacuuuuaauuuuuau

SEQ ID NO: 1710827 - RNA, 20 nt, Salmonella enterica enterica serovar Typhi
aacuugacuuugcucuccuu

SEQ ID NO: 1710828 - RNA, 19 nt, Salmonella enterica enterica serovar Typhi
aacuugaaguuuucgggca

SEQ ID NO: 1710829 - RNA, 23 nt, Salmonella enterica enterica serovar Typhi
aacuugccguuuuucucaucaag

SEQ ID NO: 1710830 - RNA, 13 nt, Salmonella enterica enterica serovar Typhi
aacuuguaaaaau

SEQ ID NO: 1710831 - RNA, 16 nt, Salmonella enterica enterica serovar Typhi
aacuuuaacacuaacu

SEQ ID NO: 1710832 - RNA, 17 nt, Salmonella enterica enterica serovar Typhi
aagaaauugggcuucca

SEQ ID NO: 1710833 - RNA, 20 nt, Salmonella enterica enterica serovar Typhi
aagaacgccgcaaacgccga

SEQ ID NO: 1710834 - RNA, 16 nt, Salmonella enterica enterica serovar Typhi
aagaacguucaugcgu

SEQ ID NO: 1710835 - RNA, 16 nt, Salmonella enterica enterica serovar Typhi
aagaacgguuggaaua

SEQ ID NO: 1710836 - RNA, 16 nt, Salmonella enterica enterica serovar Typhi
aagaagaaaccgcaga

SEQ ID NO: 1710837 - RNA, 19 nt, Salmonella enterica enterica serovar Typhi
aagaacuuccccaucagga

SEQ ID NO: 1710838 - RNA, 22 nt, Salmonella enterica enterica serovar Typhi
aagaacugcaaauaccacauca

SEQ ID NO: 1710839 - RNA, 19 nt, Salmonella enterica enterica serovar Typhi
aagaacuggaugacgaaua

SEQ ID NO: 1710840 - RNA, 12 nt, Salmonella enterica enterica serovar Typhi
aagaagaauuau

SEQ ID NO: 1710841 - RNA, 13 nt, Salmonella enterica enterica serovar Typhi
aagaaaaagaagc

SEQ ID NO: 1710842 - RNA, 17 nt, Salmonella enterica enterica serovar Typhi
aagaaaaaacuggugca

SEQ ID NO: 1710843 - RNA, 20 nt, Salmonella enterica enterica serovar Typhi
aagaaaacuuucauuucacu

SEQ ID NO: 1710844 - RNA, 18 nt, Salmonella enterica enterica serovar Typhi
aagaaaccgcagaaaaag

SEQ ID NO: 1710845 - RNA, 19 nt, Salmonella enterica enterica serovar Typhi
aagaaagacgcugaaaagc

SEQ ID NO: 1710846 - RNA, 15 nt, Salmonella enterica enterica serovar Typhi
aagaaauguccauaa

SEQ ID NO: 1710847 - RNA, 19 nt, Salmonella enterica enterica serovar Typhi
aaauuggugauauaaacgg

SEQ ID NO: 1710848 - RNA, 18 nt, Salmonella enterica enterica serovar Typhi
aaauugguuauauuacug

SEQ ID NO: 1710849 - RNA, 24 nt, Salmonella enterica enterica serovar Typhi
aaauugccacgaacgauauaaaaa

SEQ ID NO: 1710850 - RNA, 21 nt, Salmonella enterica enterica serovar Typhi
aaauugccgcgcccugcggaa

SEQ ID NO: 1710851 - RNA, 22 nt, Salmonella enterica enterica serovar Typhi
uuucaaaaccgaccccgcucag

SEQ ID NO: 1710852 - RNA, 16 nt, Salmonella enterica enterica serovar Typhi
aaauuuaauauaugaa

SEQ ID NO: 1710853 - RNA, 14 nt, Salmonella enterica enterica serovar Typhi
aaauuuaauauaug

SEQ ID NO: 1710854 - RNA, 18 nt, Salmonella enterica enterica serovar Typhi
aaauuguuuaaaaacagg

SEQ ID NO: 1710855 - RNA, 12 nt, Salmonella enterica enterica serovar Typhi
aaauuuccucuu

SEQ ID NO: 1710856 - RNA, 14 nt, Salmonella enterica enterica serovar Typhi
aaauuucugaugug

SEQ ID NO: 1710857 - RNA, 14 nt, Salmonella enterica enterica serovar Typhi
aaauuucuuuucca

SEQ ID NO: 1710858 - RNA, 20 nt, Salmonella enterica enterica serovar Typhi
aaauuucaucguagucguag

SEQ ID NO: 1710859 - RNA, 23 nt, Salmonella enterica enterica serovar Typhi
aaauuucacgucacguucauccu

SEQ ID NO: 1710860 - RNA, 20 nt, Salmonella enterica enterica serovar Typhi
aaauuuucaaccacggauaa

SEQ ID NO: 1710861 - RNA, 16 nt, Salmonella enterica enterica serovar Typhi
aaauuugcagcgcugu

SEQ ID NO: 1710862 - RNA, 22 nt, Salmonella enterica enterica serovar Typhi
aacaacauugaggcuacccaga

SEQ ID NO: 1710863 - RNA, 14 nt, Salmonella enterica enterica serovar Typhi
aacaacuguuuuuc

SEQ ID NO: 1710864 - RNA, 20 nt, Salmonella enterica enterica serovar Typhi
aacaacuguuuuucacuaau

SEQ ID NO: 1710865 - RNA, 23 nt, Salmonella enterica enterica serovar Typhi
aacaagccgccaacgccagcagc

SEQ ID NO: 1710866 - RNA, 15 nt, Salmonella enterica enterica serovar Typhi
aacaagcaaaccuau

SEQ ID NO: 1710867 - RNA, 22 nt, Salmonella enterica enterica serovar Typhi
aacaaaaagauauuauaaaaua

SEQ ID NO: 1710868 - RNA, 14 nt, Salmonella enterica enterica serovar Typhi
aacaaacacagcca

SEQ ID NO: 1710869 - RNA, 15 nt, Salmonella enterica enterica serovar Typhi
aacaaaaccagcauc

SEQ ID NO: 1710870 - RNA, 14 nt, Salmonella enterica enterica serovar Typhi
aacaaagggcaccu

SEQ ID NO: 1710871 - RNA, 20 nt, Salmonella enterica enterica serovar Typhi
aacaaagggcaccugggcaa

SEQ ID NO: 1710872 - RNA, 14 nt, Salmonella enterica enterica serovar Typhi
aacaaauaaaucca

SEQ ID NO: 1710873 - RNA, 16 nt, Salmonella enterica enterica serovar Typhi
aacaaaucgacagcca

SEQ ID NO: 1710874 - RNA, 20 nt, Salmonella enterica enterica serovar Typhi
aacaauuacgccuacuggga

SEQ ID NO: 1710875 - RNA, 19 nt, Salmonella enterica enterica serovar Typhi
aacacacgcuuagcuugcc

SEQ ID NO: 1710876 - RNA, 18 nt, Salmonella enterica enterica serovar Typhi
aacacacaguugccuucg

SEQ ID NO: 1710877 - RNA, 19 nt, Salmonella enterica enterica serovar Typhi
aacaauccccgucacagcg

SEQ ID NO: 1710878 - RNA, 23 nt, Salmonella enterica enterica serovar Typhi
aacaauaucgauagcauuuuuac

SEQ ID NO: 1710879 - RNA, 12 nt, Salmonella enterica enterica serovar Typhi
aacaauauuaaa

SEQ ID NO: 1710880 - RNA, 20 nt, Salmonella enterica enterica serovar Typhi
aacaccuuuggggaaaggua

SEQ ID NO: 1710881 - RNA, 22 nt, Salmonella enterica enterica serovar Typhi
aacaccuguaacgucacauucc

SEQ ID NO: 1710882 - RNA, 15 nt, Salmonella enterica enterica serovar Typhi
aacaccggggcauuu

SEQ ID NO: 1710883 - RNA, 22 nt, Salmonella enterica enterica serovar Typhi
aacacauaacgcccgacaaucg

SEQ ID NO: 1710884 - RNA, 16 nt, Salmonella enterica enterica serovar Typhi
aacacauaagcaacuu

SEQ ID NO: 1710885 - RNA, 21 nt, Salmonella enterica enterica serovar Typhi
aacaccagccgcaucuuauau

SEQ ID NO: 1710886 - RNA, 17 nt, Salmonella enterica enterica serovar Typhi
aacagacaauaccaggg

SEQ ID NO: 1710887 - RNA, 17 nt, Salmonella enterica enterica serovar Typhi
aacagaauuaccugggu

SEQ ID NO: 1710888 - RNA, 22 nt, Salmonella enterica enterica serovar Typhi
aacagacaauuagcgacgcaua

SEQ ID NO: 1710889 - RNA, 17 nt, Salmonella enterica enterica serovar Typhi
aacagaauuaacgcaga

SEQ ID NO: 1710890 - RNA, 19 nt, Salmonella enterica enterica serovar Typhi
aacagaaucgcgcugaggg

SEQ ID NO: 1710891 - RNA, 23 nt, Salmonella enterica enterica serovar Typhi
aacagaaaccauaaacaaaacaa

SEQ ID NO: 1710892 - RNA, 17 nt, Salmonella enterica enterica serovar Typhi
aacagaaaaaaugcacc

SEQ ID NO: 1710893 - RNA, 13 nt, Salmonella enterica enterica serovar Typhi
aacagauaaaugu

SEQ ID NO: 1710894 - RNA, 13 nt, Salmonella enterica enterica serovar Typhi
aacagauacugga

SEQ ID NO: 1710895 - RNA, 13 nt, Salmonella enterica enterica serovar Typhi
aacagaguaaccc

SEQ ID NO: 1710896 - RNA, 13 nt, Salmonella enterica enterica serovar Typhi
aacagacuccguc

SEQ ID NO: 1710897 - RNA, 17 nt, Salmonella enterica enterica serovar Typhi
aacagacgccuuucaga

SEQ ID NO: 1710898 - RNA, 18 nt, Salmonella enterica enterica serovar Typhi
aacagagagggaaaaaaa

SEQ ID NO: 1710899 - RNA, 12 nt, Salmonella enterica enterica serovar Typhi
aacagagcaauu

SEQ ID NO: 1710900 - RNA, 19 nt, Salmonella enterica enterica serovar Typhi
aacagagagggaaaaaaau

SEQ ID NO: 1710901 - RNA, 16 nt, Salmonella enterica enterica serovar Typhi
aacacgacgcugccac

SEQ ID NO: 1710902 - RNA, 15 nt, Salmonella enterica enterica serovar Typhi
aacacgauaaaacgc

SEQ ID NO: 1710903 - RNA, 21 nt, Salmonella enterica enterica serovar Typhi
aacacgccgccuaucgccagc

SEQ ID NO: 1710904 - RNA, 15 nt, Salmonella enterica enterica serovar Typhi
aacacgucgauuuuc

SEQ ID NO: 1710905 - RNA, 14 nt, Salmonella enterica enterica serovar Typhi
aacacucuccacca

SEQ ID NO: 1710906 - RNA, 16 nt, Salmonella enterica enterica serovar Typhi
aacacuaaaucauaau

SEQ ID NO: 1710907 - RNA, 18 nt, Salmonella enterica enterica serovar Typhi
aacacuauauguccuuua

SEQ ID NO: 1710908 - RNA, 13 nt, Salmonella enterica enterica serovar Typhi
aacagccagaagc

SEQ ID NO: 1710909 - RNA, 18 nt, Salmonella enterica enterica serovar Typhi
aacagcauaauaaagcag

SEQ ID NO: 1710910 - RNA, 12 nt, Salmonella enterica enterica serovar Typhi
aacagccaggcu

SEQ ID NO: 1710911 - RNA, 16 nt, Salmonella enterica enterica serovar Typhi
aacagcaaugcccaaa

SEQ ID NO: 1710912 - RNA, 14 nt, Salmonella enterica enterica serovar Typhi
aacagcaauguuuc

SEQ ID NO: 1710913 - RNA, 20 nt, Salmonella enterica enterica serovar Typhi
aacagcaaaucgggaaaaug

SEQ ID NO: 1710914 - RNA, 12 nt, Salmonella enterica enterica serovar Typhi
aacagcagcagc

SEQ ID NO: 1710915 - RNA, 13 nt, Salmonella enterica enterica serovar Typhi
aacagcaggaccc

SEQ ID NO: 1710916 - RNA, 12 nt, Salmonella enterica enterica serovar Typhi
aacagcaggacc

SEQ ID NO: 1710917 - RNA, 20 nt, Salmonella enterica enterica serovar Typhi
aacagcgaucacgccgucca

SEQ ID NO: 1710918 - RNA, 17 nt, Salmonella enterica enterica serovar Typhi
aacagcgccaucaggaa

SEQ ID NO: 1710919 - RNA, 17 nt, Salmonella enterica enterica serovar Typhi
aacagcgccggcagcag

SEQ ID NO: 1710920 - RNA, 12 nt, Salmonella enterica enterica serovar Typhi
aacagcgcucca

SEQ ID NO: 1710921 - RNA, 21 nt, Salmonella enterica enterica serovar Typhi
aacagcgggguaaagccuuua

SEQ ID NO: 1710922 - RNA, 22 nt, Salmonella enterica enterica serovar Typhi
aacagcuuaccccuguccuuuc

SEQ ID NO: 1710923 - RNA, 21 nt, Salmonella enterica enterica serovar Typhi
aacagcguaccuuuaucuuga

SEQ ID NO: 1710924 - RNA, 20 nt, Salmonella enterica enterica serovar Typhi
aacagcgucauccaguguua

SEQ ID NO: 1710925 - RNA, 16 nt, Salmonella enterica enterica serovar Typhi
aacaggcuuuucaggc

SEQ ID NO: 1710926 - RNA, 19 nt, Salmonella enterica enterica serovar Typhi
aacaggcuuuucaggcugu

SEQ ID NO: 1710927 - RNA, 22 nt, Salmonella enterica enterica serovar Typhi
aacaggcugucugccaugccuu

SEQ ID NO: 1710928 - RNA, 21 nt, Salmonella enterica enterica serovar Typhi
aacaggccugcggaaaaaguc

SEQ ID NO: 1710929 - RNA, 19 nt, Salmonella enterica enterica serovar Typhi
aacaggcgcaggcauuaaa

SEQ ID NO: 1710930 - RNA, 23 nt, Salmonella enterica enterica serovar Typhi
aacaggcgcaggcauuaaaaaaa

SEQ ID NO: 1710931 - RNA, 14 nt, Salmonella enterica enterica serovar Typhi
aacaguacuggucg

SEQ ID NO: 1710932 - RNA, 15 nt, Salmonella enterica enterica serovar Typhi
aacaguaccugauaa

SEQ ID NO: 1710933 - RNA, 19 nt, Salmonella enterica enterica serovar Typhi
aacaguaccugauaaaauu

SEQ ID NO: 1710934 - RNA, 20 nt, Salmonella enterica enterica serovar Typhi
aacagggcggccuccuggcu

SEQ ID NO: 1710935 - RNA, 18 nt, Salmonella enterica enterica serovar Typhi
aacaggguuucucgggag

SEQ ID NO: 1710936 - RNA, 16 nt, Salmonella enterica enterica serovar Typhi
aacaguuuuuccuuuc

SEQ ID NO: 1710937 - RNA, 14 nt, Salmonella enterica enterica serovar Typhi
aacauaaccggaau

SEQ ID NO: 1710938 - RNA, 22 nt, Salmonella enterica enterica serovar Typhi
aacaguucauuucaggcaaagg

SEQ ID NO: 1710939 - RNA, 22 nt, Salmonella enterica enterica serovar Typhi
aacagugggcuaugaagagaaa

SEQ ID NO: 1710940 - RNA, 21 nt, Salmonella enterica enterica serovar Typhi
aacaguguaaacgccagauaa

SEQ ID NO: 1710941 - RNA, 17 nt, Salmonella enterica enterica serovar Typhi
aacaguguaaacgccag

SEQ ID NO: 1710942 - RNA, 19 nt, Salmonella enterica enterica serovar Typhi
aacagugggcuaugaagag

SEQ ID NO: 1710943 - RNA, 23 nt, Salmonella enterica enterica serovar Typhi
aacagugauuacaaaaugugcaa

SEQ ID NO: 1710944 - RNA, 22 nt, Salmonella enterica enterica serovar Typhi
aacagucgcgccgugcccagca

SEQ ID NO: 1710945 - RNA, 23 nt, Salmonella enterica enterica serovar Typhi
aacagucccaccagcgcggcaca

SEQ ID NO: 1710946 - RNA, 16 nt, Salmonella enterica enterica serovar Typhi
aacagugacaaacuca

SEQ ID NO: 1710947 - RNA, 24 nt, Salmonella enterica enterica serovar Typhi
aacaucauggcuuaaaacgauuug

SEQ ID NO: 1710948 - RNA, 18 nt, Salmonella enterica enterica serovar Typhi
aacaucauuauuccccuc

SEQ ID NO: 1710949 - RNA, 16 nt, Salmonella enterica enterica serovar Typhi
aacaucccagaaaaug

SEQ ID NO: 1710950 - RNA, 22 nt, Salmonella enterica enterica serovar Typhi
aacaucagaaaaaagccaagca

SEQ ID NO: 1710951 - RNA, 23 nt, Salmonella enterica enterica serovar Typhi
aacaucagcccuaucgcugcgcu

SEQ ID NO: 1710952 - RNA, 14 nt, Salmonella enterica enterica serovar Typhi
aacaucagcgcuac

SEQ ID NO: 1710953 - RNA, 20 nt, Salmonella enterica enterica serovar Typhi
aacaucagcgcuaccagcgc

SEQ ID NO: 1710954 - RNA, 19 nt, Salmonella enterica enterica serovar Typhi
aacaucaucaggccugacu

SEQ ID NO: 1710955 - RNA, 13 nt, Salmonella enterica enterica serovar Typhi
aacaucaucguuu

SEQ ID NO: 1710956 - RNA, 13 nt, Salmonella enterica enterica serovar Typhi
aacauauuuuuau

SEQ ID NO: 1710957 - RNA, 12 nt, Salmonella enterica enterica serovar Typhi
aacauauuuuua

SEQ ID NO: 1710958 - RNA, 15 nt, Salmonella enterica enterica serovar Typhi
aacauauuuuucaca

SEQ ID NO: 1710959 - RNA, 23 nt, Salmonella enterica enterica serovar Typhi
aacauauuuuucacacauaagca

SEQ ID NO: 1710960 - RNA, 23 nt, Salmonella enterica enterica serovar Typhi
aacauacgggcaugaagaaaaua

SEQ ID NO: 1710961 - RNA, 18 nt, Salmonella enterica enterica serovar Typhi
aacauagcuuacuuuuag

SEQ ID NO: 1710962 - RNA, 20 nt, Salmonella enterica enterica serovar Typhi
aacauauagcaguuuucacu

SEQ ID NO: 1710963 - RNA, 12 nt, Salmonella enterica enterica serovar Typhi
aacauauauauc

SEQ ID NO: 1710964 - RNA, 18 nt, Salmonella enterica enterica serovar Typhi
aacauagcggcaaggaaa

SEQ ID NO: 1710965 - RNA, 17 nt, Salmonella enterica enterica serovar Typhi
aacauucaaaccuucaa

SEQ ID NO: 1710966 - RNA, 21 nt, Salmonella enterica enterica serovar Typhi
aacauuggaaaacuccagcag

SEQ ID NO: 1710967 - RNA, 15 nt, Salmonella enterica enterica serovar Typhi
aacauuuaagauuua

SEQ ID NO: 1710968 - RNA, 16 nt, Salmonella enterica enterica serovar Typhi
aaccaacgcauaaaaa

SEQ ID NO: 1710969 - RNA, 12 nt, Salmonella enterica enterica serovar Typhi
aaccaaugcagc

SEQ ID NO: 1710970 - RNA, 14 nt, Salmonella enterica enterica serovar Typhi
aaccaaaaaauaug

SEQ ID NO: 1710971 - RNA, 17 nt, Salmonella enterica enterica serovar Typhi
aaccaaagguauugccu

SEQ ID NO: 1710972 - RNA, 14 nt, Salmonella enterica enterica serovar Typhi
aaccaaaugcccag

SEQ ID NO: 1710973 - RNA, 20 nt, Salmonella enterica enterica serovar Typhi
aacauggguuugacccauuu

SEQ ID NO: 1710974 - RNA, 17 nt, Salmonella enterica enterica serovar Typhi
aacauggauucgcugga

SEQ ID NO: 1710975 - RNA, 19 nt, Salmonella enterica enterica serovar Typhi
aacauguccuacacucaau

SEQ ID NO: 1710976 - RNA, 17 nt, Salmonella enterica enterica serovar Typhi
aacauuaucaaaaguga

SEQ ID NO: 1710977 - RNA, 13 nt, Salmonella enterica enterica serovar Typhi
aacauuacugacc

SEQ ID NO: 1710978 - RNA, 20 nt, Salmonella enterica enterica serovar Typhi
aacauuaaucgccauugcaa

SEQ ID NO: 1710979 - RNA, 17 nt, Salmonella enterica enterica serovar Typhi
aacaucgcaaaauuccg

SEQ ID NO: 1710980 - RNA, 15 nt, Salmonella enterica enterica serovar Typhi
aacaucguaaaucaa

SEQ ID NO: 1710981 - RNA, 18 nt, Salmonella enterica enterica serovar Typhi
aacauccucuccugaagc

SEQ ID NO: 1710982 - RNA, 17 nt, Salmonella enterica enterica serovar Typhi
aacaucuuuuaccugug

SEQ ID NO: 1710983 - RNA, 17 nt, Salmonella enterica enterica serovar Typhi
aacccgccucaaacgcc

SEQ ID NO: 1710984 - RNA, 15 nt, Salmonella enterica enterica serovar Typhi
aacccgccuucaguc

SEQ ID NO: 1710985 - RNA, 12 nt, Salmonella enterica enterica serovar Typhi
aacccggcauuu

SEQ ID NO: 1710986 - RNA, 14 nt, Salmonella enterica enterica serovar Typhi
aacccggcauuucu

SEQ ID NO: 1710987 - RNA, 19 nt, Salmonella enterica enterica serovar Typhi
aaccccacccacugauaaa

SEQ ID NO: 1710988 - RNA, 15 nt, Salmonella enterica enterica serovar Typhi
aaccccaaacaccaa

SEQ ID NO: 1710989 - RNA, 15 nt, Salmonella enterica enterica serovar Typhi
aaccccaaaucagca

SEQ ID NO: 1710990 - RNA, 16 nt, Salmonella enterica enterica serovar Typhi
aaccccagcugcggca

SEQ ID NO: 1710991 - RNA, 13 nt, Salmonella enterica enterica serovar Typhi
aaccccugcucgc

SEQ ID NO: 1710992 - RNA, 16 nt, Salmonella enterica enterica serovar Typhi
aaccccgauaaaccag

SEQ ID NO: 1710993 - RNA, 14 nt, Salmonella enterica enterica serovar Typhi
aacccgauacccug

SEQ ID NO: 1710994 - RNA, 23 nt, Salmonella enterica enterica serovar Typhi
aacccgaucgccauccugcaccg

SEQ ID NO: 1710995 - RNA, 18 nt, Salmonella enterica enterica serovar Typhi
aaccccguggugacacaa

SEQ ID NO: 1710996 - RNA, 15 nt, Salmonella enterica enterica serovar Typhi
aacccucaucgguca

SEQ ID NO: 1710997 - RNA, 21 nt, Salmonella enterica enterica serovar Typhi
aacccuauugccacaauauca

SEQ ID NO: 1710998 - RNA, 21 nt, Salmonella enterica enterica serovar Typhi
aacccuucauaggugaacaug

SEQ ID NO: 1710999 - RNA, 23 nt, Salmonella enterica enterica serovar Typhi
aacccuuucauucgucaaauuca

SEQ ID NO: 1711000 - RNA, 19 nt, Salmonella enterica enterica serovar Typhi
aaccgagguucaccagcgc

SEQ ID NO: 1711001 - RNA, 15 nt, Salmonella enterica enterica serovar Typhi
aaccgauaaucacca

SEQ ID NO: 1711002 - RNA, 18 nt, Salmonella enterica enterica serovar Typhi
aaccgacgaaagauaaaa

SEQ ID NO: 1711003 - RNA, 16 nt, Salmonella enterica enterica serovar Typhi
aaccgacccaaaaaug

SEQ ID NO: 1711004 - RNA, 18 nt, Salmonella enterica enterica serovar Typhi
aaccgacuaucagaaaaa

SEQ ID NO: 1711005 - RNA, 16 nt, Salmonella enterica enterica serovar Typhi
aaccgaauaacgccag

SEQ ID NO: 1711006 - RNA, 18 nt, Salmonella enterica enterica serovar Typhi
aaccgcggucggcaggcg

SEQ ID NO: 1711007 - RNA, 23 nt, Salmonella enterica enterica serovar Typhi
aaccgcuaaugaggaaaaagccg

SEQ ID NO: 1711008 - RNA, 19 nt, Salmonella enterica enterica serovar Typhi
aaccgcccaucaacaccag

SEQ ID NO: 1711009 - RNA, 15 nt, Salmonella enterica enterica serovar Typhi
aaccgcccccaacug

SEQ ID NO: 1711010 - RNA, 14 nt, Salmonella enterica enterica serovar Typhi
aaccgcaaaugcca

SEQ ID NO: 1711011 - RNA, 13 nt, Salmonella enterica enterica serovar Typhi
aaccgcagaaaaa

SEQ ID NO: 1711012 - RNA, 16 nt, Salmonella enterica enterica serovar Typhi
aaccggcaaccaaagu

SEQ ID NO: 1711013 - RNA, 18 nt, Salmonella enterica enterica serovar Typhi
aaccggcaacucgccggu

SEQ ID NO: 1711014 - RNA, 23 nt, Salmonella enterica enterica serovar Typhi
aaccggcaacucgccgguuuuuu

SEQ ID NO: 1711015 - RNA, 15 nt, Salmonella enterica enterica serovar Typhi
aaccggcaugaagac

SEQ ID NO: 1711016 - RNA, 19 nt, Salmonella enterica enterica serovar Typhi
aaccgcuucgaaguuuuga

SEQ ID NO: 1711017 - RNA, 19 nt, Salmonella enterica enterica serovar Typhi
aaccggucagguagcagac

SEQ ID NO: 1711018 - RNA, 20 nt, Salmonella enterica enterica serovar Typhi
aaccggucagguagcagacc

SEQ ID NO: 1711019 - RNA, 22 nt, Salmonella enterica enterica serovar Typhi
aaccguaucacuguaaaaggga

SEQ ID NO: 1711020 - RNA, 14 nt, Salmonella enterica enterica serovar Typhi
aaccguagcguugc

SEQ ID NO: 1711021 - RNA, 22 nt, Salmonella enterica enterica serovar Typhi
aaccgguuugucauucgccuca

SEQ ID NO: 1711022 - RNA, 22 nt, Salmonella enterica enterica serovar Typhi
aaccgguggucaucgcggccag

SEQ ID NO: 1711023 - RNA, 20 nt, Salmonella enterica enterica serovar Typhi
aaccguaaacgccugcacca

SEQ ID NO: 1711024 - RNA, 10 nt, Salmonella enterica enterica serovar Typhi
aaccagggag

SEQ ID NO: 1711025 - RNA, 23 nt, Salmonella enterica enterica serovar Typhi
aaccaggauucaacgcgugaucc

SEQ ID NO: 1711026 - RNA, 11 nt, Salmonella enterica enterica serovar Typhi
aaccaggcaaa

SEQ ID NO: 1711027 - RNA, 16 nt, Salmonella enterica enterica serovar Typhi
aaccaggcaaaaauag

SEQ ID NO: 1711028 - RNA, 18 nt, Salmonella enterica enterica serovar Typhi
aaccaggcaaaccagcac

SEQ ID NO: 1711029 - RNA, 15 nt, Salmonella enterica enterica serovar Typhi
aaccagcuuuucauu

SEQ ID NO: 1711030 - RNA, 22 nt, Salmonella enterica enterica serovar Typhi
aaccagcgccgccagauaaagc

SEQ ID NO: 1711031 - RNA, 17 nt, Salmonella enterica enterica serovar Typhi
aaccagcgcggccagaa

SEQ ID NO: 1711032 - RNA, 17 nt, Salmonella enterica enterica serovar Typhi
aaccagcaaugagacaa

SEQ ID NO: 1711033 - RNA, 23 nt, Salmonella enterica enterica serovar Typhi
aaccagaguccggcgccugaaua

SEQ ID NO: 1711034 - RNA, 21 nt, Salmonella enterica enterica serovar Typhi
aaccagacccguugcgucacg

SEQ ID NO: 1711035 - RNA, 14 nt, Salmonella enterica enterica serovar Typhi
aaccaccaaaaagc

SEQ ID NO: 1711036 - RNA, 20 nt, Salmonella enterica enterica serovar Typhi
aaccacaaguuuauccggca

SEQ ID NO: 1711037 - RNA, 21 nt, Salmonella enterica enterica serovar Typhi
aaccaccggcgcgccagcgca

SEQ ID NO: 1711038 - RNA, 13 nt, Salmonella enterica enterica serovar Typhi
aaccacgaaaauu

SEQ ID NO: 1711039 - RNA, 13 nt, Salmonella enterica enterica serovar Typhi
aaccacuucugac

SEQ ID NO: 1711040 - RNA, 22 nt, Salmonella enterica enterica serovar Typhi
aaccagaaaaccgacagcaaua

SEQ ID NO: 1711041 - RNA, 16 nt, Salmonella enterica enterica serovar Typhi
aaccaguaacggcagu

SEQ ID NO: 1711042 - RNA, 18 nt, Salmonella enterica enterica serovar Typhi
aaccagugaauacugcgc

SEQ ID NO: 1711043 - RNA, 17 nt, Salmonella enterica enterica serovar Typhi
aaccauaaacaaaacaa

SEQ ID NO: 1711044 - RNA, 14 nt, Salmonella enterica enterica serovar Typhi
aaccauaauaaaua

SEQ ID NO: 1711045 - RNA, 15 nt, Salmonella enterica enterica serovar Typhi
aaccaucaaaaaaaa

SEQ ID NO: 1711046 - RNA, 18 nt, Salmonella enterica enterica serovar Typhi
aaccaugcgagaucggca

SEQ ID NO: 1711047 - RNA, 15 nt, Salmonella enterica enterica serovar Typhi
aaccauucaaauuca

SEQ ID NO: 1711048 - RNA, 20 nt, Salmonella enterica enterica serovar Typhi
aaccauucccgauaaugacc

SEQ ID NO: 1711049 - RNA, 15 nt, Salmonella enterica enterica serovar Typhi
aaccauuuccucugc

SEQ ID NO: 1711050 - RNA, 17 nt, Salmonella enterica enterica serovar Typhi
aacccauuggcgaggaa

SEQ ID NO: 1711051 - RNA, 19 nt, Salmonella enterica enterica serovar Typhi
aacccauauucgucuucau

SEQ ID NO: 1711052 - RNA, 18 nt, Salmonella enterica enterica serovar Typhi
aacccagauaucagucug

SEQ ID NO: 1711053 - RNA, 16 nt, Salmonella enterica enterica serovar Typhi
aacccacaagaaaugc

SEQ ID NO: 1711054 - RNA, 14 nt, Salmonella enterica enterica serovar Typhi
aacccaccagcgcc

SEQ ID NO: 1711055 - RNA, 20 nt, Salmonella enterica enterica serovar Typhi
accgcgcggcguucugcgcc

SEQ ID NO: 1711056 - RNA, 18 nt, Salmonella enterica enterica serovar Typhi
accgcggcaaccagccca

SEQ ID NO: 1711057 - RNA, 15 nt, Salmonella enterica enterica serovar Typhi
accgcuccgcgcauc

SEQ ID NO: 1711058 - RNA, 15 nt, Salmonella enterica enterica serovar Typhi
accgcucgccgccuc

SEQ ID NO: 1711059 - RNA, 17 nt, Salmonella enterica enterica serovar Typhi
accgcugcggaacacca

SEQ ID NO: 1711060 - RNA, 16 nt, Salmonella enterica enterica serovar Typhi
accgcgaacauuggaa

SEQ ID NO: 1711061 - RNA, 17 nt, Salmonella enterica enterica serovar Typhi
accgccuguuuaaugau

SEQ ID NO: 1711062 - RNA, 18 nt, Salmonella enterica enterica serovar Typhi
accgccuucagcgcgccc

SEQ ID NO: 1711063 - RNA, 14 nt, Salmonella enterica enterica serovar Typhi
accgccuuccugcu

SEQ ID NO: 1711064 - RNA, 17 nt, Salmonella enterica enterica serovar Typhi
accgccuuccugcugcg

SEQ ID NO: 1711065 - RNA, 18 nt, Salmonella enterica enterica serovar Typhi
accgcccaucaacaccag

SEQ ID NO: 1711066 - RNA, 18 nt, Salmonella enterica enterica serovar Typhi
accgcccaucgccugauu

SEQ ID NO: 1711067 - RNA, 19 nt, Salmonella enterica enterica serovar Typhi
accgcccauggaugcgccg

SEQ ID NO: 1711068 - RNA, 17 nt, Salmonella enterica enterica serovar Typhi
accgccaugcggcgcca

SEQ ID NO: 1711069 - RNA, 16 nt, Salmonella enterica enterica serovar Typhi
accgccguuagcgccu

SEQ ID NO: 1711070 - RNA, 22 nt, Salmonella enterica enterica serovar Typhi
accgccuaacagcgccgcgccg

SEQ ID NO: 1711071 - RNA, 18 nt, Salmonella enterica enterica serovar Typhi
accccuguucaaaauagc

SEQ ID NO: 1711072 - RNA, 14 nt, Salmonella enterica enterica serovar Typhi
accccuuaguuuuc

SEQ ID NO: 1711073 - RNA, 17 nt, Salmonella enterica enterica serovar Typhi
accccuucgcccucgcc

SEQ ID NO: 1711074 - RNA, 15 nt, Salmonella enterica enterica serovar Typhi
accgccagucccagc

SEQ ID NO: 1711075 - RNA, 16 nt, Salmonella enterica enterica serovar Typhi
accgccauccggcauu

SEQ ID NO: 1711076 - RNA, 18 nt, Salmonella enterica enterica serovar Typhi
accgccaucaaacgcagc

SEQ ID NO: 1711077 - RNA, 15 nt, Salmonella enterica enterica serovar Typhi
accgccauauauuua

SEQ ID NO: 1711078 - RNA, 17 nt, Salmonella enterica enterica serovar Typhi
accgccaaccgcccguc

SEQ ID NO: 1711079 - RNA, 15 nt, Salmonella enterica enterica serovar Typhi
accgccaaccgcccg

SEQ ID NO: 1711080 - RNA, 21 nt, Salmonella enterica enterica serovar Typhi
accgccaauaaaaacugcuaa

SEQ ID NO: 1711081 - RNA, 16 nt, Salmonella enterica enterica serovar Typhi
accgcacaucacugcc

SEQ ID NO: 1711082 - RNA, 15 nt, Salmonella enterica enterica serovar Typhi
accgcaugacaauau

SEQ ID NO: 1711083 - RNA, 13 nt, Salmonella enterica enterica serovar Typhi
accgcuuaacucc

SEQ ID NO: 1711084 - RNA, 16 nt, Salmonella enterica enterica serovar Typhi
accgcuucgcauugcg

SEQ ID NO: 1711085 - RNA, 22 nt, Salmonella enterica enterica serovar Typhi
accggcaaauaccgucauaauc

SEQ ID NO: 1711086 - RNA, 20 nt, Salmonella enterica enterica serovar Typhi
accggcaggugauggcggcu

SEQ ID NO: 1711087 - RNA, 21 nt, Salmonella enterica enterica serovar Typhi
accggcauacacgccgggcac

SEQ ID NO: 1711088 - RNA, 20 nt, Salmonella enterica enterica serovar Typhi
accggcagcgucagcccaag

SEQ ID NO: 1711089 - RNA, 13 nt, Salmonella enterica enterica serovar Typhi
accggcagcguca

SEQ ID NO: 1711090 - RNA, 15 nt, Salmonella enterica enterica serovar Typhi
accggcacucaccuc

SEQ ID NO: 1711091 - RNA, 18 nt, Salmonella enterica enterica serovar Typhi
accggcacucaccucuuc

SEQ ID NO: 1711092 - RNA, 22 nt, Salmonella enterica enterica serovar Typhi
accggcauuucaccgucaauaa

SEQ ID NO: 1711093 - RNA, 20 nt, Salmonella enterica enterica serovar Typhi
accggcguccccguucugac

SEQ ID NO: 1711094 - RNA, 16 nt, Salmonella enterica enterica serovar Typhi
accggcguaauugcgc

SEQ ID NO: 1711095 - RNA, 20 nt, Salmonella enterica enterica serovar Typhi
accggcgcgccuuccagcaa

SEQ ID NO: 1711096 - RNA, 14 nt, Salmonella enterica enterica serovar Typhi
accggcccccggcc

SEQ ID NO: 1711097 - RNA, 18 nt, Salmonella enterica enterica serovar Typhi
accggccauugccgcgcc

SEQ ID NO: 1711098 - RNA, 14 nt, Salmonella enterica enterica serovar Typhi
accgggcaggauac

SEQ ID NO: 1711099 - RNA, 18 nt, Salmonella enterica enterica serovar Typhi
accgggcaggauacggcg

SEQ ID NO: 1711100 - RNA, 23 nt, Salmonella enterica enterica serovar Typhi
accgggccugaugcgcguuuagc

SEQ ID NO: 1711101 - RNA, 18 nt, Salmonella enterica enterica serovar Typhi
accgggucgauaaacagc

SEQ ID NO: 1711102 - RNA, 17 nt, Salmonella enterica enterica serovar Typhi
accgggucgcagaacau

SEQ ID NO: 1711103 - RNA, 19 nt, Salmonella enterica enterica serovar Typhi
accgguaacugucagauca

SEQ ID NO: 1711104 - RNA, 18 nt, Salmonella enterica enterica serovar Typhi
accggguuaaagcccuga

SEQ ID NO: 1711105 - RNA, 12 nt, Salmonella enterica enterica serovar Typhi
accgggcuaaac

SEQ ID NO: 1711106 - RNA, 15 nt, Salmonella enterica enterica serovar Typhi
accgggcugcagccc

SEQ ID NO: 1711107 - RNA, 14 nt, Salmonella enterica enterica serovar Typhi
accggugcgcccca

SEQ ID NO: 1711108 - RNA, 20 nt, Salmonella enterica enterica serovar Typhi
accggugcggagcaggcaau

SEQ ID NO: 1711109 - RNA, 17 nt, Salmonella enterica enterica serovar Typhi
accguaaacgccugcac

SEQ ID NO: 1711110 - RNA, 18 nt, Salmonella enterica enterica serovar Typhi
accguaaacgccugcacc

SEQ ID NO: 1711111 - RNA, 19 nt, Salmonella enterica enterica serovar Typhi
accguaaacgccugcacca

SEQ ID NO: 1711112 - RNA, 23 nt, Salmonella enterica enterica serovar Typhi
accguaagcuuucugaauuucac

SEQ ID NO: 1711113 - RNA, 22 nt, Salmonella enterica enterica serovar Typhi
accgugaauaaugaccagcgcc

SEQ ID NO: 1711114 - RNA, 14 nt, Salmonella enterica enterica serovar Typhi
accgugacugacca

SEQ ID NO: 1711115 - RNA, 18 nt, Salmonella enterica enterica serovar Typhi
accgucuggcgaggcgcc

SEQ ID NO: 1711116 - RNA, 18 nt, Salmonella enterica enterica serovar Typhi
accgucguuacccuccug

SEQ ID NO: 1711117 - RNA, 18 nt, Salmonella enterica enterica serovar Typhi
accgucgcgcccuccucc

SEQ ID NO: 1711118 - RNA, 14 nt, Salmonella enterica enterica serovar Typhi
accgucggcacgca

SEQ ID NO: 1711119 - RNA, 16 nt, Salmonella enterica enterica serovar Typhi
accguggucuccgccu

SEQ ID NO: 1711120 - RNA, 19 nt, Salmonella enterica enterica serovar Typhi
accguggcggcagugggcu

SEQ ID NO: 1711121 - RNA, 12 nt, Salmonella enterica enterica serovar Typhi
accgugauuuuu

SEQ ID NO: 1711122 - RNA, 14 nt, Salmonella enterica enterica serovar Typhi
accgugauuuuuac

SEQ ID NO: 1711123 - RNA, 14 nt, Salmonella enterica enterica serovar Typhi
accguauccgccac

SEQ ID NO: 1711124 - RNA, 19 nt, Salmonella enterica enterica serovar Typhi
accguauccuuccagcccg

SEQ ID NO: 1711125 - RNA, 18 nt, Salmonella enterica enterica serovar Typhi
accguauuaucaaaucuu

SEQ ID NO: 1711126 - RNA, 15 nt, Salmonella enterica enterica serovar Typhi
accgucaaaacgcgc

SEQ ID NO: 1711127 - RNA, 21 nt, Salmonella enterica enterica serovar Typhi
accgucacugaaccugccuuu

SEQ ID NO: 1711128 - RNA, 21 nt, Salmonella enterica enterica serovar Typhi
accgucauuuccggcgcgguc

SEQ ID NO: 1711129 - RNA, 15 nt, Salmonella enterica enterica serovar Typhi
accguccccagccag

SEQ ID NO: 1711130 - RNA, 22 nt, Salmonella enterica enterica serovar Typhi
accgucagccccguacaagguc

SEQ ID NO: 1711131 - RNA, 14 nt, Salmonella enterica enterica serovar Typhi
accgucagcagcac

SEQ ID NO: 1711132 - RNA, 14 nt, Salmonella enterica enterica serovar Typhi
accgucagauucug

SEQ ID NO: 1711133 - RNA, 14 nt, Salmonella enterica enterica serovar Typhi
accuacuguggugu

SEQ ID NO: 1711134 - RNA, 15 nt, Salmonella enterica enterica serovar Typhi
accuacagaaaauca

SEQ ID NO: 1711135 - RNA, 15 nt, Salmonella enterica enterica serovar Typhi
accuaauagccagcc

SEQ ID NO: 1711136 - RNA, 16 nt, Salmonella enterica enterica serovar Typhi
accuaauagccagccc

SEQ ID NO: 1711137 - RNA, 17 nt, Salmonella enterica enterica serovar Typhi
accguuggaauaaauca

SEQ ID NO: 1711138 - RNA, 15 nt, Salmonella enterica enterica serovar Typhi
accguucucaauccg

SEQ ID NO: 1711139 - RNA, 18 nt, Salmonella enterica enterica serovar Typhi
accguugcgcccaucauc

SEQ ID NO: 1711140 - RNA, 22 nt, Salmonella enterica enterica serovar Typhi
accgugugcagugacagaggaa

SEQ ID NO: 1711141 - RNA, 16 nt, Salmonella enterica enterica serovar Typhi
accguuaggaaagcag

SEQ ID NO: 1711142 - RNA, 14 nt, Salmonella enterica enterica serovar Typhi
accguuauccggca

SEQ ID NO: 1711143 - RNA, 19 nt, Salmonella enterica enterica serovar Typhi
accguucacgcucacgcag

SEQ ID NO: 1711144 - RNA, 12 nt, Salmonella enterica enterica serovar Typhi
accguuuuccag

SEQ ID NO: 1711145 - RNA, 18 nt, Salmonella enterica enterica serovar Typhi
accguuuaaaaacaucau

SEQ ID NO: 1711146 - RNA, 13 nt, Salmonella enterica enterica serovar Typhi
accuauuuaauaa

SEQ ID NO: 1711147 - RNA, 13 nt, Salmonella enterica enterica serovar Typhi
accuauuuuaaau

SEQ ID NO: 1711148 - RNA, 16 nt, Salmonella enterica enterica serovar Typhi
accucaaggcucagca

SEQ ID NO: 1711149 - RNA, 20 nt, Salmonella enterica enterica serovar Typhi
accucaaaauggaaaauaau

SEQ ID NO: 1711150 - RNA, 11 nt, Salmonella enterica enterica serovar Typhi
accucaauaug

SEQ ID NO: 1711151 - RNA, 13 nt, Salmonella enterica enterica serovar Typhi
accucaucgcuac

SEQ ID NO: 1711152 - RNA, 17 nt, Salmonella enterica enterica serovar Typhi
accucaucaacgccaag

SEQ ID NO: 1711153 - RNA, 17 nt, Salmonella enterica enterica serovar Typhi
accucaucaccuacccu

SEQ ID NO: 1711154 - RNA, 20 nt, Salmonella enterica enterica serovar Typhi
accucagguaaauccgccag

SEQ ID NO: 1711155 - RNA, 18 nt, Salmonella enterica enterica serovar Typhi
accucagccaacccacgc

SEQ ID NO: 1711156 - RNA, 14 nt, Salmonella enterica enterica serovar Typhi
accucagccaccca

SEQ ID NO: 1711157 - RNA, 22 nt, Salmonella enterica enterica serovar Typhi
accuccacgcccagcgccgaga

SEQ ID NO: 1711158 - RNA, 13 nt, Salmonella enterica enterica serovar Typhi
accuccagcgccu

SEQ ID NO: 1711159 - RNA, 14 nt, Salmonella enterica enterica serovar Typhi
accuccgcccggug

SEQ ID NO: 1711160 - RNA, 18 nt, Salmonella enterica enterica serovar Typhi
accuccggcuaugccgga

SEQ ID NO: 1711161 - RNA, 22 nt, Salmonella enterica enterica serovar Typhi
accuccgcccggugcucaauaa

SEQ ID NO: 1711162 - RNA, 11 nt, Salmonella enterica enterica serovar Typhi
accuccgggug

SEQ ID NO: 1711163 - RNA, 20 nt, Salmonella enterica enterica serovar Typhi
accucgaaaagcgucuucuu

SEQ ID NO: 1711164 - RNA, 13 nt, Salmonella enterica enterica serovar Typhi
accuccugcaucg

SEQ ID NO: 1711165 - RNA, 16 nt, Salmonella enterica enterica serovar Typhi
accucgcaauauucau

SEQ ID NO: 1711166 - RNA, 20 nt, Salmonella enterica enterica serovar Typhi
accucgcaauauucaugcca

SEQ ID NO: 1711167 - RNA, 16 nt, Salmonella enterica enterica serovar Typhi
accucgccacauucaa

SEQ ID NO: 1711168 - RNA, 10 nt, Salmonella enterica enterica serovar Typhi
accugauguc

SEQ ID NO: 1711169 - RNA, 16 nt, Salmonella enterica enterica serovar Typhi
accugauucugcagcg

SEQ ID NO: 1711170 - RNA, 15 nt, Salmonella enterica enterica serovar Typhi
accugaaaucagccu

SEQ ID NO: 1711171 - RNA, 13 nt, Salmonella enterica enterica serovar Typhi
accucuuuuuccg

SEQ ID NO: 1711172 - RNA, 23 nt, Salmonella enterica enterica serovar Typhi
accucuuugcggccuuuauccag

SEQ ID NO: 1711173 - RNA, 20 nt, Salmonella enterica enterica serovar Typhi
accucuuuggcgcgaaccgu

SEQ ID NO: 1711174 - RNA, 16 nt, Salmonella enterica enterica serovar Typhi
accugaaugcaaagaa

SEQ ID NO: 1711175 - RNA, 23 nt, Salmonella enterica enterica serovar Typhi
accugaaugcaaagaagggcagg

SEQ ID NO: 1711176 - RNA, 23 nt, Salmonella enterica enterica serovar Typhi
accucgcuucccugacgcgcagc

SEQ ID NO: 1711177 - RNA, 15 nt, Salmonella enterica enterica serovar Typhi
accucuuccccgguc

SEQ ID NO: 1711178 - RNA, 18 nt, Salmonella enterica enterica serovar Typhi
accucuucguucauccgu

SEQ ID NO: 1711179 - RNA, 17 nt, Salmonella enterica enterica serovar Typhi
accuucaacccagcagc

SEQ ID NO: 1711180 - RNA, 19 nt, Salmonella enterica enterica serovar Typhi
accuucaagaaucaauaua

SEQ ID NO: 1711181 - RNA, 21 nt, Salmonella enterica enterica serovar Typhi
accuuacuuguaggccuggua

SEQ ID NO: 1711182 - RNA, 23 nt, Salmonella enterica enterica serovar Typhi
accuuacgcacaugaucuucguu

SEQ ID NO: 1711183 - RNA, 18 nt, Salmonella enterica enterica serovar Typhi
accuuaagcgcgaaauuu

SEQ ID NO: 1711184 - RNA, 20 nt, Salmonella enterica enterica serovar Typhi
accuuaaaaggcgcucgccu

SEQ ID NO: 1711185 - RNA, 12 nt, Salmonella enterica enterica serovar Typhi
accuguuuguuu

SEQ ID NO: 1711186 - RNA, 22 nt, Salmonella enterica enterica serovar Typhi
accugucguacgccuaaaugaa

SEQ ID NO: 1711187 - RNA, 16 nt, Salmonella enterica enterica serovar Typhi
accugucuuugcgccg

SEQ ID NO: 1711188 - RNA, 14 nt, Salmonella enterica enterica serovar Typhi
accuguauuuucgu

SEQ ID NO: 1711189 - RNA, 16 nt, Salmonella enterica enterica serovar Typhi
accuguaucaaaccaa

SEQ ID NO: 1711190 - RNA, 19 nt, Salmonella enterica enterica serovar Typhi
accuguaucugcugacacc

SEQ ID NO: 1711191 - RNA, 20 nt, Salmonella enterica enterica serovar Typhi
accuggguagcuucugucug

SEQ ID NO: 1711192 - RNA, 21 nt, Salmonella enterica enterica serovar Typhi
accuggguagcuucugucugc

SEQ ID NO: 1711193 - RNA, 19 nt, Salmonella enterica enterica serovar Typhi
accugcuguaccucuugcu

SEQ ID NO: 1711194 - RNA, 18 nt, Salmonella enterica enterica serovar Typhi
accuggaaguuuugcugg

SEQ ID NO: 1711195 - RNA, 18 nt, Salmonella enterica enterica serovar Typhi
accuggaaccaggcgcga

SEQ ID NO: 1711196 - RNA, 20 nt, Salmonella enterica enterica serovar Typhi
accugcuccagauuacuaug

SEQ ID NO: 1711197 - RNA, 18 nt, Salmonella enterica enterica serovar Typhi
accuggcccugcaucagc

SEQ ID NO: 1711198 - RNA, 19 nt, Salmonella enterica enterica serovar Typhi
accuggaugcugccugccu

SEQ ID NO: 1711199 - RNA, 23 nt, Salmonella enterica enterica serovar Typhi
accuggauuccuccaauucaggu

SEQ ID NO: 1711200 - RNA, 11 nt, Salmonella enterica enterica serovar Typhi
accuggcuggc

SEQ ID NO: 1711201 - RNA, 17 nt, Salmonella enterica enterica serovar Typhi
accugggaaucgugcaa

SEQ ID NO: 1711202 - RNA, 24 nt, Salmonella enterica enterica serovar Typhi
accugcagguuuaaaaccggccag

SEQ ID NO: 1711203 - RNA, 20 nt, Salmonella enterica enterica serovar Typhi
accugccacaggccaacaua

SEQ ID NO: 1711204 - RNA, 21 nt, Salmonella enterica enterica serovar Typhi
accugcgcugacggcggcaga

SEQ ID NO: 1711205 - RNA, 13 nt, Salmonella enterica enterica serovar Typhi
accugccgaugaa

SEQ ID NO: 1711206 - RNA, 18 nt, Salmonella enterica enterica serovar Typhi
accugccgaccucacugg

SEQ ID NO: 1711207 - RNA, 19 nt, Salmonella enterica enterica serovar Typhi
accugccguuuuccagccg

SEQ ID NO: 1711208 - RNA, 19 nt, Salmonella enterica enterica serovar Typhi
accuucgcuuuuaaaacuu

SEQ ID NO: 1711209 - RNA, 22 nt, Salmonella enterica enterica serovar Typhi
accuucccgcgauaaaaacagc

SEQ ID NO: 1711210 - RNA, 18 nt, Salmonella enterica enterica serovar Typhi
accuucacgcagugcgcg

SEQ ID NO: 1711211 - RNA, 17 nt, Salmonella enterica enterica serovar Typhi
accuucacauuggcaaa

SEQ ID NO: 1711212 - RNA, 18 nt, Salmonella enterica enterica serovar Typhi
accuucacgccgccaaag

SEQ ID NO: 1711213 - RNA, 16 nt, Salmonella enterica enterica serovar Typhi
accuugcgccucuggu

SEQ ID NO: 1711214 - RNA, 14 nt, Salmonella enterica enterica serovar Typhi
accuuguucuucca

SEQ ID NO: 1711215 - RNA, 15 nt, Salmonella enterica enterica serovar Typhi
accuuguucuuccau

SEQ ID NO: 1711216 - RNA, 22 nt, Salmonella enterica enterica serovar Typhi
accuucugugaaaguuucagga

SEQ ID NO: 1711217 - RNA, 19 nt, Salmonella enterica enterica serovar Typhi
accuucuugcucaaaaagc

SEQ ID NO: 1711218 - RNA, 18 nt, Salmonella enterica enterica serovar Typhi
accuugauucccuuuugc

SEQ ID NO: 1711219 - RNA, 14 nt, Salmonella enterica enterica serovar Typhi
accuugcccuggaa

SEQ ID NO: 1711220 - RNA, 22 nt, Salmonella enterica enterica serovar Typhi
accuugcccuggaauuuuucca

SEQ ID NO: 1711221 - RNA, 15 nt, Salmonella enterica enterica serovar Typhi
accuucuuuuggaaa

SEQ ID NO: 1711222 - RNA, 21 nt, Salmonella enterica enterica serovar Typhi
accuuuggaggagagcgucau

SEQ ID NO: 1711223 - RNA, 21 nt, Salmonella enterica enterica serovar Typhi
accuuuucauuggucaguaag

SEQ ID NO: 1711224 - RNA, 15 nt, Salmonella enterica enterica serovar Typhi
accuuuuacuucacg

SEQ ID NO: 1711225 - RNA, 12 nt, Salmonella enterica enterica serovar Typhi
accuuuccaguc

SEQ ID NO: 1711226 - RNA, 21 nt, Salmonella enterica enterica serovar Typhi
acgaaaaaugaauaccaaguc

SEQ ID NO: 1711227 - RNA, 11 nt, Salmonella enterica enterica serovar Typhi
acgaaaaauaa

SEQ ID NO: 1711228 - RNA, 13 nt, Salmonella enterica enterica serovar Typhi
acgaaaaaaaaga

SEQ ID NO: 1711229 - RNA, 14 nt, Salmonella enterica enterica serovar Typhi
acgaaaauuauuuu

SEQ ID NO: 1711230 - RNA, 16 nt, Salmonella enterica enterica serovar Typhi
acgaaacagauuaaaa

SEQ ID NO: 1711231 - RNA, 18 nt, Salmonella enterica enterica serovar Typhi
acgaacaacaucagacag

SEQ ID NO: 1711232 - RNA, 20 nt, Salmonella enterica enterica serovar Typhi
acgaaaucgucauugaccgg

SEQ ID NO: 1711233 - RNA, 23 nt, Salmonella enterica enterica serovar Typhi
acgaccaugguucccgccacuga

SEQ ID NO: 1711234 - RNA, 17 nt, Salmonella enterica enterica serovar Typhi
acgaccaugguucccgc

SEQ ID NO: 1711235 - RNA, 20 nt, Salmonella enterica enterica serovar Typhi
acgaccgccgacaaucguca

SEQ ID NO: 1711236 - RNA, 24 nt, Salmonella enterica enterica serovar Typhi
acgaccagaaucaucaugucguca

SEQ ID NO: 1711237 - RNA, 23 nt, Salmonella enterica enterica serovar Typhi
acgacauaaccggcaaccaaagu

SEQ ID NO: 1711238 - RNA, 13 nt, Salmonella enterica enterica serovar Typhi
acgaccaaacaag

SEQ ID NO: 1711239 - RNA, 16 nt, Salmonella enterica enterica serovar Typhi
acgacgccagccagcc

SEQ ID NO: 1711240 - RNA, 14 nt, Salmonella enterica enterica serovar Typhi
acgacgccagcccu

SEQ ID NO: 1711241 - RNA, 21 nt, Salmonella enterica enterica serovar Typhi
acgacuccaauaauggagaug

SEQ ID NO: 1711242 - RNA, 16 nt, Salmonella enterica enterica serovar Typhi
acgagagacugauaau

SEQ ID NO: 1711243 - RNA, 18 nt, Salmonella enterica enterica serovar Typhi
acgagaacccacuuugcu

SEQ ID NO: 1711244 - RNA, 19 nt, Salmonella enterica enterica serovar Typhi
acgacugcaaaaagguagu

SEQ ID NO: 1711245 - RNA, 22 nt, Salmonella enterica enterica serovar Typhi
acgaagaucgcguacagcgcca

SEQ ID NO: 1711246 - RNA, 19 nt, Salmonella enterica enterica serovar Typhi
acgaagaucgcguacagcg

SEQ ID NO: 1711247 - RNA, 22 nt, Salmonella enterica enterica serovar Typhi
acgaaguccuucacaaacuucu

SEQ ID NO: 1711248 - RNA, 18 nt, Salmonella enterica enterica serovar Typhi
acgacaacuucuaauuuu

SEQ ID NO: 1711249 - RNA, 15 nt, Salmonella enterica enterica serovar Typhi
acgacaaaaauacca

SEQ ID NO: 1711250 - RNA, 18 nt, Salmonella enterica enterica serovar Typhi
acgaauuuaaauagcaau

SEQ ID NO: 1711251 - RNA, 21 nt, Salmonella enterica enterica serovar Typhi
acgacacccgauacacgccga

SEQ ID NO: 1711252 - RNA, 20 nt, Salmonella enterica enterica serovar Typhi
acgaaucuggucguaagaau

SEQ ID NO: 1711253 - RNA, 22 nt, Salmonella enterica enterica serovar Typhi
acgaaugccgauagucuccgcc

SEQ ID NO: 1711254 - RNA, 18 nt, Salmonella enterica enterica serovar Typhi
acgaaucucgcugccgga

SEQ ID NO: 1711255 - RNA, 19 nt, Salmonella enterica enterica serovar Typhi
acgaaugucgcgucagguu

SEQ ID NO: 1711256 - RNA, 17 nt, Salmonella enterica enterica serovar Typhi
acgaauaccugaaagag

SEQ ID NO: 1711257 - RNA, 12 nt, Salmonella enterica enterica serovar Typhi
acgaaguuuaau

SEQ ID NO: 1711258 - RNA, 13 nt, Salmonella enterica enterica serovar Typhi
acgaauagcgcgc

SEQ ID NO: 1711259 - RNA, 15 nt, Salmonella enterica enterica serovar Typhi
acgauugaucucauc

SEQ ID NO: 1711260 - RNA, 19 nt, Salmonella enterica enterica serovar Typhi
acgauuggccgucucuuuc

SEQ ID NO: 1711261 - RNA, 13 nt, Salmonella enterica enterica serovar Typhi
acgcaacaacagu

SEQ ID NO: 1711262 - RNA, 14 nt, Salmonella enterica enterica serovar Typhi
acgcaacaccaucc

SEQ ID NO: 1711263 - RNA, 17 nt, Salmonella enterica enterica serovar Typhi
acgcaacaggccgcauc

SEQ ID NO: 1711264 - RNA, 20 nt, Salmonella enterica enterica serovar Typhi
acgcaaaggcguugugcugc

SEQ ID NO: 1711265 - RNA, 20 nt, Salmonella enterica enterica serovar Typhi
acgcaacgcuucugagaauu

SEQ ID NO: 1711266 - RNA, 19 nt, Salmonella enterica enterica serovar Typhi
acgauuuugguagcgcuga

SEQ ID NO: 1711267 - RNA, 21 nt, Salmonella enterica enterica serovar Typhi
acgcaaagacaccccagccua

SEQ ID NO: 1711268 - RNA, 19 nt, Salmonella enterica enterica serovar Typhi
acgaucuggcaaaccaugu

SEQ ID NO: 1711269 - RNA, 17 nt, Salmonella enterica enterica serovar Typhi
acgauggcaaauaauac

SEQ ID NO: 1711270 - RNA, 20 nt, Salmonella enterica enterica serovar Typhi
acgaugcauaugcacagcgc

SEQ ID NO: 1711271 - RNA, 16 nt, Salmonella enterica enterica serovar Typhi
acgaugauguagccgc

SEQ ID NO: 1711272 - RNA, 19 nt, Salmonella enterica enterica serovar Typhi
acgaggauuagacuucuuc

SEQ ID NO: 1711273 - RNA, 19 nt, Salmonella enterica enterica serovar Typhi
acgagcacuguagcggcug

SEQ ID NO: 1711274 - RNA, 20 nt, Salmonella enterica enterica serovar Typhi
acgagcgcgucagcgccucc

SEQ ID NO: 1711275 - RNA, 16 nt, Salmonella enterica enterica serovar Typhi
acgagcggucaggcca

SEQ ID NO: 1711276 - RNA, 18 nt, Salmonella enterica enterica serovar Typhi
acgagcgaaaaacugucg

SEQ ID NO: 1711277 - RNA, 19 nt, Salmonella enterica enterica serovar Typhi
acgagucggaucaugaaaa

SEQ ID NO: 1711278 - RNA, 21 nt, Salmonella enterica enterica serovar Typhi
acgaguccccucaaacaggcu

SEQ ID NO: 1711279 - RNA, 12 nt, Salmonella enterica enterica serovar Typhi
acgauaaaaaaa

SEQ ID NO: 1711280 - RNA, 15 nt, Salmonella enterica enterica serovar Typhi
acgauaaauaagagu

SEQ ID NO: 1711281 - RNA, 19 nt, Salmonella enterica enterica serovar Typhi
acgauaaauuuucagacac

SEQ ID NO: 1711282 - RNA, 20 nt, Salmonella enterica enterica serovar Typhi
acgauaaauuuucagacacu

SEQ ID NO: 1711283 - RNA, 14 nt, Salmonella enterica enterica serovar Typhi
acgauaaauuucac

SEQ ID NO: 1711284 - RNA, 23 nt, Salmonella enterica enterica serovar Typhi
acgaguugaauaacguguuaugc

SEQ ID NO: 1711285 - RNA, 18 nt, Salmonella enterica enterica serovar Typhi
acgaguugcggcaacgug

SEQ ID NO: 1711286 - RNA, 12 nt, Salmonella enterica enterica serovar Typhi
acgauaaaaugc

SEQ ID NO: 1711287 - RNA, 15 nt, Salmonella enterica enterica serovar Typhi
acgaucgauaaagcg

SEQ ID NO: 1711288 - RNA, 14 nt, Salmonella enterica enterica serovar Typhi
acgaucauuucacu

SEQ ID NO: 1711289 - RNA, 16 nt, Salmonella enterica enterica serovar Typhi
acgaucaacagaccga

SEQ ID NO: 1711290 - RNA, 20 nt, Salmonella enterica enterica serovar Typhi
acgauaguuugccagagaga

SEQ ID NO: 1711291 - RNA, 13 nt, Salmonella enterica enterica serovar Typhi
acgauauaaaaac

SEQ ID NO: 1711292 - RNA, 23 nt, Salmonella enterica enterica serovar Typhi
acgauaucgccuggugugaacau

SEQ ID NO: 1711293 - RNA, 16 nt, Salmonella enterica enterica serovar Typhi
acgauagacagcacca

SEQ ID NO: 1711294 - RNA, 21 nt, Salmonella enterica enterica serovar Typhi
acgauaggcauacacaucuuc

SEQ ID NO: 1711295 - RNA, 20 nt, Salmonella enterica enterica serovar Typhi
acgauaauguugguaaauuu

SEQ ID NO: 1711296 - RNA, 18 nt, Salmonella enterica enterica serovar Typhi
acgauacgucauaucauc

SEQ ID NO: 1711297 - RNA, 14 nt, Salmonella enterica enterica serovar Typhi
accaacaucauuau

SEQ ID NO: 1711298 - RNA, 16 nt, Salmonella enterica enterica serovar Typhi
accaaagucaaacuga

SEQ ID NO: 1711299 - RNA, 22 nt, Salmonella enterica enterica serovar Typhi
accaaaguccaacuguuaucau

SEQ ID NO: 1711300 - RNA, 14 nt, Salmonella enterica enterica serovar Typhi
accaaagccaggcc

SEQ ID NO: 1711301 - RNA, 15 nt, Salmonella enterica enterica serovar Typhi
acauuuuuuucuugc

SEQ ID NO: 1711302 - RNA, 12 nt, Salmonella enterica enterica serovar Typhi
acauuuauauua

SEQ ID NO: 1711303 - RNA, 17 nt, Salmonella enterica enterica serovar Typhi
acauuuacgccagccag

SEQ ID NO: 1711304 - RNA, 20 nt, Salmonella enterica enterica serovar Typhi
acaugucggcgaaaauccuu

SEQ ID NO: 1711305 - RNA, 20 nt, Salmonella enterica enterica serovar Typhi
acauggcggucgccauaugu

SEQ ID NO: 1711306 - RNA, 14 nt, Salmonella enterica enterica serovar Typhi
accaauaguaucca

SEQ ID NO: 1711307 - RNA, 22 nt, Salmonella enterica enterica serovar Typhi
accacaaacgccgucacaaagc

SEQ ID NO: 1711308 - RNA, 17 nt, Salmonella enterica enterica serovar Typhi
accacaugaccagcgcc

SEQ ID NO: 1711309 - RNA, 14 nt, Salmonella enterica enterica serovar Typhi
accacauuuucucg

SEQ ID NO: 1711310 - RNA, 17 nt, Salmonella enterica enterica serovar Typhi
accaauuccaccaccuc

SEQ ID NO: 1711311 - RNA, 21 nt, Salmonella enterica enterica serovar Typhi
accaacuuuuccuaauuuuua

SEQ ID NO: 1711312 - RNA, 16 nt, Salmonella enterica enterica serovar Typhi
accaagucucaggagu

SEQ ID NO: 1711313 - RNA, 13 nt, Salmonella enterica enterica serovar Typhi
accaaccaacagg

SEQ ID NO: 1711314 - RNA, 17 nt, Salmonella enterica enterica serovar Typhi
accaacguuuuuccuug

SEQ ID NO: 1711315 - RNA, 18 nt, Salmonella enterica enterica serovar Typhi
accaacgaccaucaagca

SEQ ID NO: 1711316 - RNA, 20 nt, Salmonella enterica enterica serovar Typhi
accaaccaggcaaaccagca

SEQ ID NO: 1711317 - RNA, 17 nt, Salmonella enterica enterica serovar Typhi
accaaccgccagucacc

SEQ ID NO: 1711318 - RNA, 15 nt, Salmonella enterica enterica serovar Typhi
accaacccagccugc

SEQ ID NO: 1711319 - RNA, 16 nt, Salmonella enterica enterica serovar Typhi
accagcauaauauuca

SEQ ID NO: 1711320 - RNA, 21 nt, Salmonella enterica enterica serovar Typhi
accagcaggugguacaucaaa

SEQ ID NO: 1711321 - RNA, 14 nt, Salmonella enterica enterica serovar Typhi
accagccugccguc

SEQ ID NO: 1711322 - RNA, 20 nt, Salmonella enterica enterica serovar Typhi
accagaucaacaugguguuu

SEQ ID NO: 1711323 - RNA, 16 nt, Salmonella enterica enterica serovar Typhi
accagaauaaugggga

SEQ ID NO: 1711324 - RNA, 17 nt, Salmonella enterica enterica serovar Typhi
accagaauacacuucuc

SEQ ID NO: 1711325 - RNA, 23 nt, Salmonella enterica enterica serovar Typhi
accagacugaugaugaagaacag

SEQ ID NO: 1711326 - RNA, 15 nt, Salmonella enterica enterica serovar Typhi
accagacuaaaacgu

SEQ ID NO: 1711327 - RNA, 22 nt, Salmonella enterica enterica serovar Typhi
accagacgcuggcacuggcagc

SEQ ID NO: 1711328 - RNA, 16 nt, Salmonella enterica enterica serovar Typhi
accagaccaacccagc

SEQ ID NO: 1711329 - RNA, 14 nt, Salmonella enterica enterica serovar Typhi
accagaccggcauc

SEQ ID NO: 1711330 - RNA, 21 nt, Salmonella enterica enterica serovar Typhi
accagaccggcaucucaucuu

SEQ ID NO: 1711331 - RNA, 18 nt, Salmonella enterica enterica serovar Typhi
accagaaucgccagcauc

SEQ ID NO: 1711332 - RNA, 17 nt, Salmonella enterica enterica serovar Typhi
accagaaucaccgacag

SEQ ID NO: 1711333 - RNA, 17 nt, Salmonella enterica enterica serovar Typhi
accagaaucauuaauaa

SEQ ID NO: 1711334 - RNA, 22 nt, Salmonella enterica enterica serovar Typhi
accagaaucccacggagaaaag

SEQ ID NO: 1711335 - RNA, 19 nt, Salmonella enterica enterica serovar Typhi
accacggaaugaauguuag

SEQ ID NO: 1711336 - RNA, 16 nt, Salmonella enterica enterica serovar Typhi
accacgacgccggaga

SEQ ID NO: 1711337 - RNA, 20 nt, Salmonella enterica enterica serovar Typhi
accaccggcgcgccagcgca

SEQ ID NO: 1711338 - RNA, 13 nt, Salmonella enterica enterica serovar Typhi
accacgaaaauua

SEQ ID NO: 1711339 - RNA, 17 nt, Salmonella enterica enterica serovar Typhi
accacgggguuggcccu

SEQ ID NO: 1711340 - RNA, 19 nt, Salmonella enterica enterica serovar Typhi
accacgguguaccccgccu

SEQ ID NO: 1711341 - RNA, 21 nt, Salmonella enterica enterica serovar Typhi
accacgguguccggguucagc

SEQ ID NO: 1711342 - RNA, 23 nt, Salmonella enterica enterica serovar Typhi
accacuccccaacguaauaacca

SEQ ID NO: 1711343 - RNA, 18 nt, Salmonella enterica enterica serovar Typhi
accacguaacucggcagc

SEQ ID NO: 1711344 - RNA, 20 nt, Salmonella enterica enterica serovar Typhi
accacuccggugcccauucc

SEQ ID NO: 1711345 - RNA, 14 nt, Salmonella enterica enterica serovar Typhi
accacccugaaaag

SEQ ID NO: 1711346 - RNA, 20 nt, Salmonella enterica enterica serovar Typhi
accacccagccagacgccag

SEQ ID NO: 1711347 - RNA, 18 nt, Salmonella enterica enterica serovar Typhi
accaguugaccaaacagc

SEQ ID NO: 1711348 - RNA, 14 nt, Salmonella enterica enterica serovar Typhi
accaguucacuccu

SEQ ID NO: 1711349 - RNA, 21 nt, Salmonella enterica enterica serovar Typhi
accaguucacuccuaagagaa

SEQ ID NO: 1711350 - RNA, 22 nt, Salmonella enterica enterica serovar Typhi
accagugcggcaaccaccagca

SEQ ID NO: 1711351 - RNA, 18 nt, Salmonella enterica enterica serovar Typhi
accaguaccgucauuucc

SEQ ID NO: 1711352 - RNA, 22 nt, Salmonella enterica enterica serovar Typhi
accaguccagugcgucacuuua

SEQ ID NO: 1711353 - RNA, 20 nt, Salmonella enterica enterica serovar Typhi
accagucggcaaagaccaau

SEQ ID NO: 1711354 - RNA, 23 nt, Salmonella enterica enterica serovar Typhi
accagucggcaaagaccaauaaa

SEQ ID NO: 1711355 - RNA, 17 nt, Salmonella enterica enterica serovar Typhi
accagucgaccgcagac

SEQ ID NO: 1711356 - RNA, 20 nt, Salmonella enterica enterica serovar Typhi
accagucgaccgcagaccgg

SEQ ID NO: 1711357 - RNA, 22 nt, Salmonella enterica enterica serovar Typhi
accaucagcgggcuaugcugaa

SEQ ID NO: 1711358 - RNA, 23 nt, Salmonella enterica enterica serovar Typhi
accauauuauucugcugaaaaag

SEQ ID NO: 1711359 - RNA, 22 nt, Salmonella enterica enterica serovar Typhi
accauaauugagaucauaauga

SEQ ID NO: 1711360 - RNA, 16 nt, Salmonella enterica enterica serovar Typhi
accauacugacuuaau

SEQ ID NO: 1711361 - RNA, 18 nt, Salmonella enterica enterica serovar Typhi
accauacugacuuaauaa

SEQ ID NO: 1711362 - RNA, 23 nt, Salmonella enterica enterica serovar Typhi
accauacugcucaagaauacccu

SEQ ID NO: 1711363 - RNA, 12 nt, Salmonella enterica enterica serovar Typhi
accauagcagcc

SEQ ID NO: 1711364 - RNA, 19 nt, Salmonella enterica enterica serovar Typhi
accauaaaugaaaccucaa

SEQ ID NO: 1711365 - RNA, 13 nt, Salmonella enterica enterica serovar Typhi
accaguuuuuccg

SEQ ID NO: 1711366 - RNA, 19 nt, Salmonella enterica enterica serovar Typhi
accauaaacaaaacaacaa

SEQ ID NO: 1711367 - RNA, 19 nt, Salmonella enterica enterica serovar Typhi
accauaccggugcgcccca

SEQ ID NO: 1711368 - RNA, 12 nt, Salmonella enterica enterica serovar Typhi
accagcgcgcca

SEQ ID NO: 1711369 - RNA, 14 nt, Salmonella enterica enterica serovar Typhi
accagcgccgccag

SEQ ID NO: 1711370 - RNA, 22 nt, Salmonella enterica enterica serovar Typhi
accagcgccgccagauaaagcg

SEQ ID NO: 1711371 - RNA, 15 nt, Salmonella enterica enterica serovar Typhi
accagcgccauaauc

SEQ ID NO: 1711372 - RNA, 19 nt, Salmonella enterica enterica serovar Typhi
accagcgcaguaaacuccu

SEQ ID NO: 1711373 - RNA, 15 nt, Salmonella enterica enterica serovar Typhi
accagcgacggccag

SEQ ID NO: 1711374 - RNA, 15 nt, Salmonella enterica enterica serovar Typhi
accaguaaccgccac

SEQ ID NO: 1711375 - RNA, 15 nt, Salmonella enterica enterica serovar Typhi
accaguaacggcagu

SEQ ID NO: 1711376 - RNA, 16 nt, Salmonella enterica enterica serovar Typhi
accaggucgccagcgg

SEQ ID NO: 1711377 - RNA, 18 nt, Salmonella enterica enterica serovar Typhi
accagguacagcuuagcu

SEQ ID NO: 1711378 - RNA, 20 nt, Salmonella enterica enterica serovar Typhi
accccgauaaaccaggcagc

SEQ ID NO: 1711379 - RNA, 15 nt, Salmonella enterica enterica serovar Typhi
accccauggcgucuu

SEQ ID NO: 1711380 - RNA, 18 nt, Salmonella enterica enterica serovar Typhi
acccccaccucaaucacc

SEQ ID NO: 1711381 - RNA, 12 nt, Salmonella enterica enterica serovar Typhi
accccagcugcg

SEQ ID NO: 1711382 - RNA, 16 nt, Salmonella enterica enterica serovar Typhi
accccaggucagcagu

SEQ ID NO: 1711383 - RNA, 19 nt, Salmonella enterica enterica serovar Typhi
accccaaacaccaacaaag

SEQ ID NO: 1711384 - RNA, 20 nt, Salmonella enterica enterica serovar Typhi
accccacgcuuuuuuauuuu

SEQ ID NO: 1711385 - RNA, 20 nt, Salmonella enterica enterica serovar Typhi
acccagccacaugauguugu

SEQ ID NO: 1711386 - RNA, 13 nt, Salmonella enterica enterica serovar Typhi
acccagcagcaga

SEQ ID NO: 1711387 - RNA, 16 nt, Salmonella enterica enterica serovar Typhi
acccagcgaauuauga

SEQ ID NO: 1711388 - RNA, 22 nt, Salmonella enterica enterica serovar Typhi
acccagcccaauacgccagccu

SEQ ID NO: 1711389 - RNA, 16 nt, Salmonella enterica enterica serovar Typhi
acccagauuaugggua

SEQ ID NO: 1711390 - RNA, 14 nt, Salmonella enterica enterica serovar Typhi
acccagauaucagu

SEQ ID NO: 1711391 - RNA, 15 nt, Salmonella enterica enterica serovar Typhi
acccaacgcaaugcg

SEQ ID NO: 1711392 - RNA, 13 nt, Salmonella enterica enterica serovar Typhi
acccaacaccaga

SEQ ID NO: 1711393 - RNA, 16 nt, Salmonella enterica enterica serovar Typhi
acccaauugaauuuaa

SEQ ID NO: 1711394 - RNA, 16 nt, Salmonella enterica enterica serovar Typhi
acccacuuugcuuuuc

SEQ ID NO: 1711395 - RNA, 22 nt, Salmonella enterica enterica serovar Typhi
acccagaaucaguaacacaauc

SEQ ID NO: 1711396 - RNA, 13 nt, Salmonella enterica enterica serovar Typhi
acccaccagcagg

SEQ ID NO: 1711397 - RNA, 16 nt, Salmonella enterica enterica serovar Typhi
acccaccauaaaacca

SEQ ID NO: 1711398 - RNA, 13 nt, Salmonella enterica enterica serovar Typhi
acccacacauaga

SEQ ID NO: 1711399 - RNA, 12 nt, Salmonella enterica enterica serovar Typhi
acccacaagaaa

SEQ ID NO: 1711400 - RNA, 19 nt, Salmonella enterica enterica serovar Typhi
acccacaagaaaugcaggc

SEQ ID NO: 1711401 - RNA, 17 nt, Salmonella enterica enterica serovar Typhi
acccacaccacagccac

SEQ ID NO: 1711402 - RNA, 13 nt, Salmonella enterica enterica serovar Typhi
accauuccagguc

SEQ ID NO: 1711403 - RNA, 18 nt, Salmonella enterica enterica serovar Typhi
accauucccguaaaagaa

SEQ ID NO: 1711404 - RNA, 17 nt, Salmonella enterica enterica serovar Typhi
accauugcguauuucac

SEQ ID NO: 1711405 - RNA, 15 nt, Salmonella enterica enterica serovar Typhi
accauccaugaaaua

SEQ ID NO: 1711406 - RNA, 19 nt, Salmonella enterica enterica serovar Typhi
accaucauuaauauaaucc

SEQ ID NO: 1711407 - RNA, 17 nt, Salmonella enterica enterica serovar Typhi
accauuaccauuccuca

SEQ ID NO: 1711408 - RNA, 21 nt, Salmonella enterica enterica serovar Typhi
accauuacgcccccucgcccu

SEQ ID NO: 1711409 - RNA, 22 nt, Salmonella enterica enterica serovar Typhi
acagcccauaccacaacagaau

SEQ ID NO: 1711410 - RNA, 23 nt, Salmonella enterica enterica serovar Typhi
acagccgcuguuuuucaucauca

SEQ ID NO: 1711411 - RNA, 21 nt, Salmonella enterica enterica serovar Typhi
acagccuaaaaaaccggccca

SEQ ID NO: 1711412 - RNA, 23 nt, Salmonella enterica enterica serovar Typhi
acagcgaacaguguaaacgccag

SEQ ID NO: 1711413 - RNA, 17 nt, Salmonella enterica enterica serovar Typhi
acagcgacacuccgcgc

SEQ ID NO: 1711414 - RNA, 15 nt, Salmonella enterica enterica serovar Typhi
acagcgaccacgcca

SEQ ID NO: 1711415 - RNA, 15 nt, Salmonella enterica enterica serovar Typhi
acagcguguucaugc

SEQ ID NO: 1711416 - RNA, 14 nt, Salmonella enterica enterica serovar Typhi
acagcguauuaagc

SEQ ID NO: 1711417 - RNA, 15 nt, Salmonella enterica enterica serovar Typhi
acagcguauuaagcc

SEQ ID NO: 1711418 - RNA, 13 nt, Salmonella enterica enterica serovar Typhi
acagcguacaggc

SEQ ID NO: 1711419 - RNA, 15 nt, Salmonella enterica enterica serovar Typhi
acagcguacaggcgg

SEQ ID NO: 1711420 - RNA, 22 nt, Salmonella enterica enterica serovar Typhi
acagcguaguuuauucaucucc

SEQ ID NO: 1711421 - RNA, 22 nt, Salmonella enterica enterica serovar Typhi
acagcggauuacgcgccugccu

SEQ ID NO: 1711422 - RNA, 14 nt, Salmonella enterica enterica serovar Typhi
acagcggcaggcgg

SEQ ID NO: 1711423 - RNA, 17 nt, Salmonella enterica enterica serovar Typhi
acagcguacaauggcag

SEQ ID NO: 1711424 - RNA, 19 nt, Salmonella enterica enterica serovar Typhi
acagcguacaauggcaggc

SEQ ID NO: 1711425 - RNA, 13 nt, Salmonella enterica enterica serovar Typhi
acagcgcgcgcga

SEQ ID NO: 1711426 - RNA, 19 nt, Salmonella enterica enterica serovar Typhi
acagcgcgaccaggaaacc

SEQ ID NO: 1711427 - RNA, 23 nt, Salmonella enterica enterica serovar Typhi
acagcgcuuuaguacgcguucac

SEQ ID NO: 1711428 - RNA, 13 nt, Salmonella enterica enterica serovar Typhi
acagcggagagac

SEQ ID NO: 1711429 - RNA, 14 nt, Salmonella enterica enterica serovar Typhi
acagcuuuuacaac

SEQ ID NO: 1711430 - RNA, 19 nt, Salmonella enterica enterica serovar Typhi
acagcuucgguccggcgcu

SEQ ID NO: 1711431 - RNA, 16 nt, Salmonella enterica enterica serovar Typhi
acagcuuagcuguaau

SEQ ID NO: 1711432 - RNA, 17 nt, Salmonella enterica enterica serovar Typhi
acagcuuagcuguaauu

SEQ ID NO: 1711433 - RNA, 19 nt, Salmonella enterica enterica serovar Typhi
acagcuuaaucaccagcgc

SEQ ID NO: 1711434 - RNA, 15 nt, Salmonella enterica enterica serovar Typhi
acagcucaccccuau

SEQ ID NO: 1711435 - RNA, 21 nt, Salmonella enterica enterica serovar Typhi
acagcuggcgauauccgugcc

SEQ ID NO: 1711436 - RNA, 15 nt, Salmonella enterica enterica serovar Typhi
acaggaauuccaguc

SEQ ID NO: 1711437 - RNA, 16 nt, Salmonella enterica enterica serovar Typhi
acaggaauaaccacug

SEQ ID NO: 1711438 - RNA, 14 nt, Salmonella enterica enterica serovar Typhi
acaggacagauguc

SEQ ID NO: 1711439 - RNA, 17 nt, Salmonella enterica enterica serovar Typhi
acaggacaagcagugcu

SEQ ID NO: 1711440 - RNA, 21 nt, Salmonella enterica enterica serovar Typhi
acaggacgccagcgcggcaug

SEQ ID NO: 1711441 - RNA, 18 nt, Salmonella enterica enterica serovar Typhi
acaggccauuaagcuucg

SEQ ID NO: 1711442 - RNA, 19 nt, Salmonella enterica enterica serovar Typhi
acaggccaaacccugcgcc

SEQ ID NO: 1711443 - RNA, 20 nt, Salmonella enterica enterica serovar Typhi
acaggcauccgugaccugcu

SEQ ID NO: 1711444 - RNA, 13 nt, Salmonella enterica enterica serovar Typhi
acaggcauggccu

SEQ ID NO: 1711445 - RNA, 15 nt, Salmonella enterica enterica serovar Typhi
acaggccggacaggc

SEQ ID NO: 1711446 - RNA, 14 nt, Salmonella enterica enterica serovar Typhi
acaggccgccgagg

SEQ ID NO: 1711447 - RNA, 20 nt, Salmonella enterica enterica serovar Typhi
acaggccgccauaagaaugu

SEQ ID NO: 1711448 - RNA, 15 nt, Salmonella enterica enterica serovar Typhi
acaggcgcaucagaa

SEQ ID NO: 1711449 - RNA, 16 nt, Salmonella enterica enterica serovar Typhi
acaggcgcaucagaaa

SEQ ID NO: 1711450 - RNA, 17 nt, Salmonella enterica enterica serovar Typhi
acaggcgcaucagaaaa

SEQ ID NO: 1711451 - RNA, 23 nt, Salmonella enterica enterica serovar Typhi
acaggcgcaggcauuaaaaaaac

SEQ ID NO: 1711452 - RNA, 11 nt, Salmonella enterica enterica serovar Typhi
acagcacauag

SEQ ID NO: 1711453 - RNA, 13 nt, Salmonella enterica enterica serovar Typhi
acagcacauagaa

SEQ ID NO: 1711454 - RNA, 18 nt, Salmonella enterica enterica serovar Typhi
acagcaauaucagccauu

SEQ ID NO: 1711455 - RNA, 16 nt, Salmonella enterica enterica serovar Typhi
acagcaauaucagcca

SEQ ID NO: 1711456 - RNA, 16 nt, Salmonella enterica enterica serovar Typhi
acagcaaugcccaaaa

SEQ ID NO: 1711457 - RNA, 13 nt, Salmonella enterica enterica serovar Typhi
acagaggaaugaa

SEQ ID NO: 1711458 - RNA, 18 nt, Salmonella enterica enterica serovar Typhi
acagagucguuagcagaa

SEQ ID NO: 1711459 - RNA, 21 nt, Salmonella enterica enterica serovar Typhi
acagagucgcuuaucugcugc

SEQ ID NO: 1711460 - RNA, 14 nt, Salmonella enterica enterica serovar Typhi
acagccacacugcu

SEQ ID NO: 1711461 - RNA, 14 nt, Salmonella enterica enterica serovar Typhi
acagccagaagccu

SEQ ID NO: 1711462 - RNA, 15 nt, Salmonella enterica enterica serovar Typhi
acagccaaucauaaa

SEQ ID NO: 1711463 - RNA, 14 nt, Salmonella enterica enterica serovar Typhi
acagccauccgacg

SEQ ID NO: 1711464 - RNA, 22 nt, Salmonella enterica enterica serovar Typhi
acagccaggcuuucccuucaga

SEQ ID NO: 1711465 - RNA, 13 nt, Salmonella enterica enterica serovar Typhi
acagccagcagcg

SEQ ID NO: 1711466 - RNA, 18 nt, Salmonella enterica enterica serovar Typhi
acagcagaauauugcuga

SEQ ID NO: 1711467 - RNA, 20 nt, Salmonella enterica enterica serovar Typhi
acagcacuaacgaggccacc

SEQ ID NO: 1711468 - RNA, 23 nt, Salmonella enterica enterica serovar Typhi
acagcacuacggauggcccugcc

SEQ ID NO: 1711469 - RNA, 15 nt, Salmonella enterica enterica serovar Typhi
acacucgcggauaau

SEQ ID NO: 1711470 - RNA, 13 nt, Salmonella enterica enterica serovar Typhi
acacucucuccag

SEQ ID NO: 1711471 - RNA, 14 nt, Salmonella enterica enterica serovar Typhi
acacugaaacuccg

SEQ ID NO: 1711472 - RNA, 22 nt, Salmonella enterica enterica serovar Typhi
acacuggaaacagccaaucaua

SEQ ID NO: 1711473 - RNA, 16 nt, Salmonella enterica enterica serovar Typhi
acagaauuaacgcaga

SEQ ID NO: 1711474 - RNA, 20 nt, Salmonella enterica enterica serovar Typhi
acagacaucggagauuucau

SEQ ID NO: 1711475 - RNA, 13 nt, Salmonella enterica enterica serovar Typhi
acagacaauacca

SEQ ID NO: 1711476 - RNA, 16 nt, Salmonella enterica enterica serovar Typhi
acagagaagcugugcc

SEQ ID NO: 1711477 - RNA, 22 nt, Salmonella enterica enterica serovar Typhi
acagacccaguacaaacaaaua

SEQ ID NO: 1711478 - RNA, 14 nt, Salmonella enterica enterica serovar Typhi
acacuucagccaga

SEQ ID NO: 1711479 - RNA, 14 nt, Salmonella enterica enterica serovar Typhi
acacuuucaucagc

SEQ ID NO: 1711480 - RNA, 15 nt, Salmonella enterica enterica serovar Typhi
acauauucaauaaua

SEQ ID NO: 1711481 - RNA, 23 nt, Salmonella enterica enterica serovar Typhi
acauauucaauaauauuaucaua

SEQ ID NO: 1711482 - RNA, 16 nt, Salmonella enterica enterica serovar Typhi
acauauuccagaagcg

SEQ ID NO: 1711483 - RNA, 21 nt, Salmonella enterica enterica serovar Typhi
acauaauuuccggccaguagc

SEQ ID NO: 1711484 - RNA, 22 nt, Salmonella enterica enterica serovar Typhi
acauauuuuuaugcacgcuaua

SEQ ID NO: 1711485 - RNA, 22 nt, Salmonella enterica enterica serovar Typhi
acauauuuuucacacauaagca

SEQ ID NO: 1711486 - RNA, 21 nt, Salmonella enterica enterica serovar Typhi
acauauuugcgugucaucaaa

SEQ ID NO: 1711487 - RNA, 22 nt, Salmonella enterica enterica serovar Typhi
acauauuugcgugucaucaaaa

SEQ ID NO: 1711488 - RNA, 13 nt, Salmonella enterica enterica serovar Typhi
acauauuuuuguu

SEQ ID NO: 1711489 - RNA, 13 nt, Salmonella enterica enterica serovar Typhi
acauccacauagg

SEQ ID NO: 1711490 - RNA, 16 nt, Salmonella enterica enterica serovar Typhi
acaucgcaaaauuccg

SEQ ID NO: 1711491 - RNA, 17 nt, Salmonella enterica enterica serovar Typhi
acaucagcggcacauag

SEQ ID NO: 1711492 - RNA, 13 nt, Salmonella enterica enterica serovar Typhi
acaucauuaucca

SEQ ID NO: 1711493 - RNA, 20 nt, Salmonella enterica enterica serovar Typhi
acaugaccugaauauggcca

SEQ ID NO: 1711494 - RNA, 16 nt, Salmonella enterica enterica serovar Typhi
acaugaccgcacagca

SEQ ID NO: 1711495 - RNA, 15 nt, Salmonella enterica enterica serovar Typhi
acaucuuccaugccu

SEQ ID NO: 1711496 - RNA, 20 nt, Salmonella enterica enterica serovar Typhi
acaugacgguucaucgcaga

SEQ ID NO: 1711497 - RNA, 12 nt, Salmonella enterica enterica serovar Typhi
acaucuuccagg

SEQ ID NO: 1711498 - RNA, 22 nt, Salmonella enterica enterica serovar Typhi
acaucgccguuccauuccagaa

SEQ ID NO: 1711499 - RNA, 16 nt, Salmonella enterica enterica serovar Typhi
acaucgcucccggcac

SEQ ID NO: 1711500 - RNA, 22 nt, Salmonella enterica enterica serovar Typhi
acaucgcucgcgccacgcagau

SEQ ID NO: 1711501 - RNA, 16 nt, Salmonella enterica enterica serovar Typhi
acaucgccaccaccag

SEQ ID NO: 1711502 - RNA, 17 nt, Salmonella enterica enterica serovar Typhi
acaucgccggagccgcc

SEQ ID NO: 1711503 - RNA, 11 nt, Salmonella enterica enterica serovar Typhi
acaucuacuuc

SEQ ID NO: 1711504 - RNA, 17 nt, Salmonella enterica enterica serovar Typhi
acauaacagcagcagac

SEQ ID NO: 1711505 - RNA, 14 nt, Salmonella enterica enterica serovar Typhi
acauaauggagaac

SEQ ID NO: 1711506 - RNA, 18 nt, Salmonella enterica enterica serovar Typhi
acaguugcgacugauaac

SEQ ID NO: 1711507 - RNA, 19 nt, Salmonella enterica enterica serovar Typhi
acaguucauuucaggcaaa

SEQ ID NO: 1711508 - RNA, 18 nt, Salmonella enterica enterica serovar Typhi
acaguucccggcaacagu

SEQ ID NO: 1711509 - RNA, 18 nt, Salmonella enterica enterica serovar Typhi
acagugugccgucaucca

SEQ ID NO: 1711510 - RNA, 23 nt, Salmonella enterica enterica serovar Typhi
acaguguugauugaaacucgcca

SEQ ID NO: 1711511 - RNA, 14 nt, Salmonella enterica enterica serovar Typhi
acaguuaccacaca

SEQ ID NO: 1711512 - RNA, 13 nt, Salmonella enterica enterica serovar Typhi
acaguucaaacgg

SEQ ID NO: 1711513 - RNA, 20 nt, Salmonella enterica enterica serovar Typhi
acaguucaaacggcccggcg

SEQ ID NO: 1711514 - RNA, 18 nt, Salmonella enterica enterica serovar Typhi
acaguggaaaguaccaaa

SEQ ID NO: 1711515 - RNA, 21 nt, Salmonella enterica enterica serovar Typhi
acagugauuacaaaaugugca

SEQ ID NO: 1711516 - RNA, 14 nt, Salmonella enterica enterica serovar Typhi
acagugaguacgca

SEQ ID NO: 1711517 - RNA, 21 nt, Salmonella enterica enterica serovar Typhi
acagugacccgccgccagcac

SEQ ID NO: 1711518 - RNA, 22 nt, Salmonella enterica enterica serovar Typhi
acagucaaacacgaccagcgac

SEQ ID NO: 1711519 - RNA, 16 nt, Salmonella enterica enterica serovar Typhi
acagguucgaaucccg

SEQ ID NO: 1711520 - RNA, 17 nt, Salmonella enterica enterica serovar Typhi
acaguaaaaaaacgccu

SEQ ID NO: 1711521 - RNA, 16 nt, Salmonella enterica enterica serovar Typhi
acaguaaccccauaca

SEQ ID NO: 1711522 - RNA, 18 nt, Salmonella enterica enterica serovar Typhi
acagguugcguaacgcca

SEQ ID NO: 1711523 - RNA, 22 nt, Salmonella enterica enterica serovar Typhi
acagguuaacgaagguaaacgc

SEQ ID NO: 1711524 - RNA, 13 nt, Salmonella enterica enterica serovar Typhi
acagguuaacucc

SEQ ID NO: 1711525 - RNA, 15 nt, Salmonella enterica enterica serovar Typhi
acaggucggccaacc

SEQ ID NO: 1711526 - RNA, 19 nt, Salmonella enterica enterica serovar Typhi
acaggugaaauaggggaga

SEQ ID NO: 1711527 - RNA, 17 nt, Salmonella enterica enterica serovar Typhi
acaggugaccaggcuuc

SEQ ID NO: 1711528 - RNA, 16 nt, Salmonella enterica enterica serovar Typhi
acaguagagggggacc

SEQ ID NO: 1711529 - RNA, 21 nt, Salmonella enterica enterica serovar Typhi
acaguagagggggaccucauc

SEQ ID NO: 1711530 - RNA, 20 nt, Salmonella enterica enterica serovar Typhi
acaguagcaggggcuggaga

SEQ ID NO: 1711531 - RNA, 19 nt, Salmonella enterica enterica serovar Typhi
acaguauuuguucagacac

SEQ ID NO: 1711532 - RNA, 21 nt, Salmonella enterica enterica serovar Typhi
acaguauuuguucagacacau

SEQ ID NO: 1711533 - RNA, 12 nt, Salmonella enterica enterica serovar Typhi
acaggcggauga

SEQ ID NO: 1711534 - RNA, 16 nt, Salmonella enterica enterica serovar Typhi
acaggcggaugaaaca

SEQ ID NO: 1711535 - RNA, 21 nt, Salmonella enterica enterica serovar Typhi
acaggcggaaaucaacaaucc

SEQ ID NO: 1711536 - RNA, 17 nt, Salmonella enterica enterica serovar Typhi
acaggcggcuguugguu

SEQ ID NO: 1711537 - RNA, 18 nt, Salmonella enterica enterica serovar Typhi
acaggcggcuguugguuu

SEQ ID NO: 1711538 - RNA, 16 nt, Salmonella enterica enterica serovar Typhi
acaggcugucugccau

SEQ ID NO: 1711539 - RNA, 16 nt, Salmonella enterica enterica serovar Typhi
acaggcuuuucaggcu

SEQ ID NO: 1711540 - RNA, 15 nt, Salmonella enterica enterica serovar Typhi
acagggcggccuccu

SEQ ID NO: 1711541 - RNA, 18 nt, Salmonella enterica enterica serovar Typhi
acagggcggcgcgcugcc

SEQ ID NO: 1711542 - RNA, 21 nt, Salmonella enterica enterica serovar Typhi
acaggggccacaggcggcaug

SEQ ID NO: 1711543 - RNA, 14 nt, Salmonella enterica enterica serovar Typhi
acagguaaaacaaa

SEQ ID NO: 1711544 - RNA, 17 nt, Salmonella enterica enterica serovar Typhi
acaggggggaacagcaa

SEQ ID NO: 1711545 - RNA, 22 nt, Salmonella enterica enterica serovar Typhi
acagguaaaacaaaaaaacggc

SEQ ID NO: 1711546 - RNA, 16 nt, Salmonella enterica enterica serovar Typhi
agaagacagaagcuga

SEQ ID NO: 1711547 - RNA, 17 nt, Salmonella enterica enterica serovar Typhi
agaagaaucgccccauu

SEQ ID NO: 1711548 - RNA, 13 nt, Salmonella enterica enterica serovar Typhi
agaagcaaauuca

SEQ ID NO: 1711549 - RNA, 11 nt, Salmonella enterica enterica serovar Typhi
agaagcaaauu

SEQ ID NO: 1711550 - RNA, 16 nt, Salmonella enterica enterica serovar Typhi
agaagaauaagccgga

SEQ ID NO: 1711551 - RNA, 20 nt, Salmonella enterica enterica serovar Typhi
agaagaaaccgcagaaaaag

SEQ ID NO: 1711552 - RNA, 14 nt, Salmonella enterica enterica serovar Typhi
agaacuuaaauuaa

SEQ ID NO: 1711553 - RNA, 14 nt, Salmonella enterica enterica serovar Typhi
agaauacgaauauu

SEQ ID NO: 1711554 - RNA, 23 nt, Salmonella enterica enterica serovar Typhi
agaauacccuuuacacguuccau

SEQ ID NO: 1711555 - RNA, 18 nt, Salmonella enterica enterica serovar Typhi
agaaguauggccucuuca

SEQ ID NO: 1711556 - RNA, 20 nt, Salmonella enterica enterica serovar Typhi
agaagguuauucgccuuuca

SEQ ID NO: 1711557 - RNA, 19 nt, Salmonella enterica enterica serovar Typhi
agaagcucaugugcagcau

SEQ ID NO: 1711558 - RNA, 20 nt, Salmonella enterica enterica serovar Typhi
agaagcugggcgucaacgug

SEQ ID NO: 1711559 - RNA, 16 nt, Salmonella enterica enterica serovar Typhi
agaaggugaguuucgc

SEQ ID NO: 1711560 - RNA, 23 nt, Salmonella enterica enterica serovar Typhi
agaaggucagguuaugcgcgcca

SEQ ID NO: 1711561 - RNA, 19 nt, Salmonella enterica enterica serovar Typhi
agaaucuguauaaaauauu

SEQ ID NO: 1711562 - RNA, 14 nt, Salmonella enterica enterica serovar Typhi
agaaucucugacag

SEQ ID NO: 1711563 - RNA, 15 nt, Salmonella enterica enterica serovar Typhi
agaaugcuccauugc

SEQ ID NO: 1711564 - RNA, 14 nt, Salmonella enterica enterica serovar Typhi
agaaugcuggucac

SEQ ID NO: 1711565 - RNA, 16 nt, Salmonella enterica enterica serovar Typhi
agaaugaaaaaaaaau

SEQ ID NO: 1711566 - RNA, 18 nt, Salmonella enterica enterica serovar Typhi
agaaugaaaaaaaaauua

SEQ ID NO: 1711567 - RNA, 21 nt, Salmonella enterica enterica serovar Typhi
agaauucccuauguaaagaau

SEQ ID NO: 1711568 - RNA, 13 nt, Salmonella enterica enterica serovar Typhi
agaauucgcaaug

SEQ ID NO: 1711569 - RNA, 22 nt, Salmonella enterica enterica serovar Typhi
agaauggucgguauuaucaaua

SEQ ID NO: 1711570 - RNA, 16 nt, Salmonella enterica enterica serovar Typhi
agaauggccagcacaa

SEQ ID NO: 1711571 - RNA, 22 nt, Salmonella enterica enterica serovar Typhi
agaauggccagcacaauaacga

SEQ ID NO: 1711572 - RNA, 14 nt, Salmonella enterica enterica serovar Typhi
agaaucccgauaau

SEQ ID NO: 1711573 - RNA, 16 nt, Salmonella enterica enterica serovar Typhi
agaauauuuuucucag

SEQ ID NO: 1711574 - RNA, 16 nt, Salmonella enterica enterica serovar Typhi
agaauacuuccugcuc

SEQ ID NO: 1711575 - RNA, 14 nt, Salmonella enterica enterica serovar Typhi
agaauagacuggcg

SEQ ID NO: 1711576 - RNA, 18 nt, Salmonella enterica enterica serovar Typhi
agaauagccggauaaaau

SEQ ID NO: 1711577 - RNA, 14 nt, Salmonella enterica enterica serovar Typhi
agacccaggcgcgu

SEQ ID NO: 1711578 - RNA, 18 nt, Salmonella enterica enterica serovar Typhi
agacccaguacaaacaaa

SEQ ID NO: 1711579 - RNA, 15 nt, Salmonella enterica enterica serovar Typhi
agaccaucaacagcg

SEQ ID NO: 1711580 - RNA, 22 nt, Salmonella enterica enterica serovar Typhi
agaccuccgcccggugcucaau

SEQ ID NO: 1711581 - RNA, 14 nt, Salmonella enterica enterica serovar Typhi
agaccucugcaaac

SEQ ID NO: 1711582 - RNA, 22 nt, Salmonella enterica enterica serovar Typhi
agacgaccauccaccagaaccu

SEQ ID NO: 1711583 - RNA, 13 nt, Salmonella enterica enterica serovar Typhi
agacguuuaagca

SEQ ID NO: 1711584 - RNA, 20 nt, Salmonella enterica enterica serovar Typhi
agacguuuacaccgccaucc

SEQ ID NO: 1711585 - RNA, 19 nt, Salmonella enterica enterica serovar Typhi
agacguuuauaccccacca

SEQ ID NO: 1711586 - RNA, 20 nt, Salmonella enterica enterica serovar Typhi
agacguuuaugccgccaucc

SEQ ID NO: 1711587 - RNA, 19 nt, Salmonella enterica enterica serovar Typhi
agacgguuauuuuucagau

SEQ ID NO: 1711588 - RNA, 17 nt, Salmonella enterica enterica serovar Typhi
agacgugccggaagcga

SEQ ID NO: 1711589 - RNA, 19 nt, Salmonella enterica enterica serovar Typhi
agacgucaaacaguuccug

SEQ ID NO: 1711590 - RNA, 19 nt, Salmonella enterica enterica serovar Typhi
agacgcaucaggaaccaca

SEQ ID NO: 1711591 - RNA, 13 nt, Salmonella enterica enterica serovar Typhi
agacggccaccca

SEQ ID NO: 1711592 - RNA, 12 nt, Salmonella enterica enterica serovar Typhi
agacggcugggc

SEQ ID NO: 1711593 - RNA, 15 nt, Salmonella enterica enterica serovar Typhi
agacgaugaauuccu

SEQ ID NO: 1711594 - RNA, 15 nt, Salmonella enterica enterica serovar Typhi
agacgauauagcugc

SEQ ID NO: 1711595 - RNA, 21 nt, Salmonella enterica enterica serovar Typhi
agacgcaguagcgcuuugaca

SEQ ID NO: 1711596 - RNA, 17 nt, Salmonella enterica enterica serovar Typhi
agacaagcaguucugaa

SEQ ID NO: 1711597 - RNA, 22 nt, Salmonella enterica enterica serovar Typhi
agacaauaccagggcgauuccc

SEQ ID NO: 1711598 - RNA, 13 nt, Salmonella enterica enterica serovar Typhi
agaauuuauuucu

SEQ ID NO: 1711599 - RNA, 18 nt, Salmonella enterica enterica serovar Typhi
agacaaccgggcaucacc

SEQ ID NO: 1711600 - RNA, 18 nt, Salmonella enterica enterica serovar Typhi
agaauugcgccaccuuaa

SEQ ID NO: 1711601 - RNA, 18 nt, Salmonella enterica enterica serovar Typhi
agaccagaaucccacgga

SEQ ID NO: 1711602 - RNA, 15 nt, Salmonella enterica enterica serovar Typhi
agaccacgaaucagg

SEQ ID NO: 1711603 - RNA, 17 nt, Salmonella enterica enterica serovar Typhi
agaccacgaaucaggau

SEQ ID NO: 1711604 - RNA, 15 nt, Salmonella enterica enterica serovar Typhi
agacauauuuucucu

SEQ ID NO: 1711605 - RNA, 18 nt, Salmonella enterica enterica serovar Typhi
agacagagaaaaucccca

SEQ ID NO: 1711606 - RNA, 22 nt, Salmonella enterica enterica serovar Typhi
agacagagaaccugaacaauaa

SEQ ID NO: 1711607 - RNA, 20 nt, Salmonella enterica enterica serovar Typhi
agacagauaacaccagcgau

SEQ ID NO: 1711608 - RNA, 11 nt, Salmonella enterica enterica serovar Typhi
agacagaacag

SEQ ID NO: 1711609 - RNA, 21 nt, Salmonella enterica enterica serovar Typhi
agacauauacucuucgccauu

SEQ ID NO: 1711610 - RNA, 19 nt, Salmonella enterica enterica serovar Typhi
agaacagcaucaccggccc

SEQ ID NO: 1711611 - RNA, 20 nt, Salmonella enterica enterica serovar Typhi
agaaccaauaguauggagca

SEQ ID NO: 1711612 - RNA, 22 nt, Salmonella enterica enterica serovar Typhi
agaaccaacgucaucaugaaaa

SEQ ID NO: 1711613 - RNA, 16 nt, Salmonella enterica enterica serovar Typhi
agaacauuucccgaaa

SEQ ID NO: 1711614 - RNA, 15 nt, Salmonella enterica enterica serovar Typhi
agaacauaaacagcg

SEQ ID NO: 1711615 - RNA, 14 nt, Salmonella enterica enterica serovar Typhi
agaacaugacggca

SEQ ID NO: 1711616 - RNA, 20 nt, Salmonella enterica enterica serovar Typhi
agaaagucgcaauauaaaua

SEQ ID NO: 1711617 - RNA, 23 nt, Salmonella enterica enterica serovar Typhi
agaaauuuaggucaaaaaagcga

SEQ ID NO: 1711618 - RNA, 19 nt, Salmonella enterica enterica serovar Typhi
agaaccguugcgcccauca

SEQ ID NO: 1711619 - RNA, 22 nt, Salmonella enterica enterica serovar Typhi
agaaccguugcgcccaucauca

SEQ ID NO: 1711620 - RNA, 19 nt, Salmonella enterica enterica serovar Typhi
agaacgccgggccugccag

SEQ ID NO: 1711621 - RNA, 21 nt, Salmonella enterica enterica serovar Typhi
agaacggaaguugcauauaag

SEQ ID NO: 1711622 - RNA, 22 nt, Salmonella enterica enterica serovar Typhi
agaacggauauccagaaucaca

SEQ ID NO: 1711623 - RNA, 21 nt, Salmonella enterica enterica serovar Typhi
agaacgacgcauaaaaaauga

SEQ ID NO: 1711624 - RNA, 14 nt, Salmonella enterica enterica serovar Typhi
agaacgagaggagg

SEQ ID NO: 1711625 - RNA, 20 nt, Salmonella enterica enterica serovar Typhi
agaacgacgaauaagcugaa

SEQ ID NO: 1711626 - RNA, 22 nt, Salmonella enterica enterica serovar Typhi
agaacugcugcauccgcgcuuu

SEQ ID NO: 1711627 - RNA, 22 nt, Salmonella enterica enterica serovar Typhi
agaacugcaaauaccacaucag

SEQ ID NO: 1711628 - RNA, 16 nt, Salmonella enterica enterica serovar Typhi
agaacuggcgcgauga

SEQ ID NO: 1711629 - RNA, 14 nt, Salmonella enterica enterica serovar Typhi
agaacucaggcaaa

SEQ ID NO: 1711630 - RNA, 22 nt, Salmonella enterica enterica serovar Typhi
agaacgguucauccagcagcag

SEQ ID NO: 1711631 - RNA, 22 nt, Salmonella enterica enterica serovar Typhi
agaacguugacguuucagucac

SEQ ID NO: 1711632 - RNA, 16 nt, Salmonella enterica enterica serovar Typhi
agaacucacgcucaag

SEQ ID NO: 1711633 - RNA, 14 nt, Salmonella enterica enterica serovar Typhi
acuuccuguacaaa

SEQ ID NO: 1711634 - RNA, 15 nt, Salmonella enterica enterica serovar Typhi
acuuccuguaucacu

SEQ ID NO: 1711635 - RNA, 19 nt, Salmonella enterica enterica serovar Typhi
acuuccuggaugcuuaaaa

SEQ ID NO: 1711636 - RNA, 17 nt, Salmonella enterica enterica serovar Typhi
acuuccuuugccuuucu

SEQ ID NO: 1711637 - RNA, 18 nt, Salmonella enterica enterica serovar Typhi
acuuuucuuuccugcaaa

SEQ ID NO: 1711638 - RNA, 15 nt, Salmonella enterica enterica serovar Typhi
acuuuugcaaucgca

SEQ ID NO: 1711639 - RNA, 20 nt, Salmonella enterica enterica serovar Typhi
acuuuuguagagauccagaa

SEQ ID NO: 1711640 - RNA, 22 nt, Salmonella enterica enterica serovar Typhi
acuuuugccaggcggauaaaac

SEQ ID NO: 1711641 - RNA, 20 nt, Salmonella enterica enterica serovar Typhi
agaaaaagguaacuauuucu

SEQ ID NO: 1711642 - RNA, 13 nt, Salmonella enterica enterica serovar Typhi
agaaaaaguagaa

SEQ ID NO: 1711643 - RNA, 23 nt, Salmonella enterica enterica serovar Typhi
agaaaaaucagucauuugcaggu

SEQ ID NO: 1711644 - RNA, 17 nt, Salmonella enterica enterica serovar Typhi
agaaagcauuaaaucau

SEQ ID NO: 1711645 - RNA, 14 nt, Salmonella enterica enterica serovar Typhi
agaaacugcuguag

SEQ ID NO: 1711646 - RNA, 23 nt, Salmonella enterica enterica serovar Typhi
agaaagcauuaaaucaucauaau

SEQ ID NO: 1711647 - RNA, 23 nt, Salmonella enterica enterica serovar Typhi
agaaagcgaauggcgugaagcca

SEQ ID NO: 1711648 - RNA, 18 nt, Salmonella enterica enterica serovar Typhi
agaaaggggagggcaaca

SEQ ID NO: 1711649 - RNA, 20 nt, Salmonella enterica enterica serovar Typhi
agaaaccauaaacaaaacaa

SEQ ID NO: 1711650 - RNA, 19 nt, Salmonella enterica enterica serovar Typhi
agaaaccaucuugcguuau

SEQ ID NO: 1711651 - RNA, 22 nt, Salmonella enterica enterica serovar Typhi
agaaaaauuuaagccagaugua

SEQ ID NO: 1711652 - RNA, 16 nt, Salmonella enterica enterica serovar Typhi
agaaaaucagugaaca

SEQ ID NO: 1711653 - RNA, 17 nt, Salmonella enterica enterica serovar Typhi
agaaaauuauuuuaaau

SEQ ID NO: 1711654 - RNA, 17 nt, Salmonella enterica enterica serovar Typhi
agaaaauggucugccag

SEQ ID NO: 1711655 - RNA, 23 nt, Salmonella enterica enterica serovar Typhi
agaaaaugcgcugggaaucgcga

SEQ ID NO: 1711656 - RNA, 13 nt, Salmonella enterica enterica serovar Typhi
agagcgccaaaaa

SEQ ID NO: 1711657 - RNA, 21 nt, Salmonella enterica enterica serovar Typhi
agagcgcgcucugccuuuuuu

SEQ ID NO: 1711658 - RNA, 16 nt, Salmonella enterica enterica serovar Typhi
agagcgacguugucuu

SEQ ID NO: 1711659 - RNA, 17 nt, Salmonella enterica enterica serovar Typhi
agagcgaaugcgcgcca

SEQ ID NO: 1711660 - RNA, 15 nt, Salmonella enterica enterica serovar Typhi
agagccuuacaggcg

SEQ ID NO: 1711661 - RNA, 17 nt, Salmonella enterica enterica serovar Typhi
agagcuugauaaauauc

SEQ ID NO: 1711662 - RNA, 19 nt, Salmonella enterica enterica serovar Typhi
agagguauccugaaccagc

SEQ ID NO: 1711663 - RNA, 18 nt, Salmonella enterica enterica serovar Typhi
agaguauaagcgccgcug

SEQ ID NO: 1711664 - RNA, 22 nt, Salmonella enterica enterica serovar Typhi
agaguccauucggccugcggug

SEQ ID NO: 1711665 - RNA, 13 nt, Salmonella enterica enterica serovar Typhi
agaguccagccau

SEQ ID NO: 1711666 - RNA, 17 nt, Salmonella enterica enterica serovar Typhi
agaguccagcgccagcg

SEQ ID NO: 1711667 - RNA, 22 nt, Salmonella enterica enterica serovar Typhi
agagucucgaaacgaaucucau

SEQ ID NO: 1711668 - RNA, 16 nt, Salmonella enterica enterica serovar Typhi
agacuacggaaacugu

SEQ ID NO: 1711669 - RNA, 19 nt, Salmonella enterica enterica serovar Typhi
agagacuggcgacagccgc

SEQ ID NO: 1711670 - RNA, 12 nt, Salmonella enterica enterica serovar Typhi
agagacugacaa

SEQ ID NO: 1711671 - RNA, 21 nt, Salmonella enterica enterica serovar Typhi
agacucaaagaaaacaucagc

SEQ ID NO: 1711672 - RNA, 18 nt, Salmonella enterica enterica serovar Typhi
agacuauccguccucuuu

SEQ ID NO: 1711673 - RNA, 13 nt, Salmonella enterica enterica serovar Typhi
agagaguaaaacc

SEQ ID NO: 1711674 - RNA, 12 nt, Salmonella enterica enterica serovar Typhi
agagaguuccuc

SEQ ID NO: 1711675 - RNA, 12 nt, Salmonella enterica enterica serovar Typhi
agagagugagaa

SEQ ID NO: 1711676 - RNA, 18 nt, Salmonella enterica enterica serovar Typhi
agagaguuccuccuggcu

SEQ ID NO: 1711677 - RNA, 13 nt, Salmonella enterica enterica serovar Typhi
agagagccuuaca

SEQ ID NO: 1711678 - RNA, 19 nt, Salmonella enterica enterica serovar Typhi
agagagcgccaaaaagaaa

SEQ ID NO: 1711679 - RNA, 19 nt, Salmonella enterica enterica serovar Typhi
agagagcgggccguggcca

SEQ ID NO: 1711680 - RNA, 15 nt, Salmonella enterica enterica serovar Typhi
agagagaaucggguc

SEQ ID NO: 1711681 - RNA, 20 nt, Salmonella enterica enterica serovar Typhi
agagaguucguuaaucucaa

SEQ ID NO: 1711682 - RNA, 20 nt, Salmonella enterica enterica serovar Typhi
agagaucaggaguaaauaac

SEQ ID NO: 1711683 - RNA, 16 nt, Salmonella enterica enterica serovar Typhi
agagauaauuuuccca

SEQ ID NO: 1711684 - RNA, 12 nt, Salmonella enterica enterica serovar Typhi
agagauagaacg

SEQ ID NO: 1711685 - RNA, 18 nt, Salmonella enterica enterica serovar Typhi
agagauggaacaucuuuu

SEQ ID NO: 1711686 - RNA, 13 nt, Salmonella enterica enterica serovar Typhi
agagauccagaac

SEQ ID NO: 1711687 - RNA, 17 nt, Salmonella enterica enterica serovar Typhi
agagauucugcaggcca

SEQ ID NO: 1711688 - RNA, 20 nt, Salmonella enterica enterica serovar Typhi
agagcaaauacuggaaaaaa

SEQ ID NO: 1711689 - RNA, 18 nt, Salmonella enterica enterica serovar Typhi
agagcaacgccaucagca

SEQ ID NO: 1711690 - RNA, 16 nt, Salmonella enterica enterica serovar Typhi
agauacggcuccagca

SEQ ID NO: 1711691 - RNA, 22 nt, Salmonella enterica enterica serovar Typhi
agauacuggaagugauccuuca

SEQ ID NO: 1711692 - RNA, 19 nt, Salmonella enterica enterica serovar Typhi
agauacugcgcguggcaaa

SEQ ID NO: 1711693 - RNA, 20 nt, Salmonella enterica enterica serovar Typhi
agauaggcgcgaaauguccc

SEQ ID NO: 1711694 - RNA, 21 nt, Salmonella enterica enterica serovar Typhi
agauagcccgccagcaccagc

SEQ ID NO: 1711695 - RNA, 23 nt, Salmonella enterica enterica serovar Typhi
agauagcccgccagcaccagcag

SEQ ID NO: 1711696 - RNA, 15 nt, Salmonella enterica enterica serovar Typhi
agauaaaaaagcugc

SEQ ID NO: 1711697 - RNA, 18 nt, Salmonella enterica enterica serovar Typhi
agagugacgguuuucacu

SEQ ID NO: 1711698 - RNA, 18 nt, Salmonella enterica enterica serovar Typhi
agaguucguuaaucucaa

SEQ ID NO: 1711699 - RNA, 14 nt, Salmonella enterica enterica serovar Typhi
agauauggcgggga

SEQ ID NO: 1711700 - RNA, 15 nt, Salmonella enterica enterica serovar Typhi
agauauuauaaaaua

SEQ ID NO: 1711701 - RNA, 17 nt, Salmonella enterica enterica serovar Typhi
agauaucccaugaaacu

SEQ ID NO: 1711702 - RNA, 11 nt, Salmonella enterica enterica serovar Typhi
agauaguuuuu

SEQ ID NO: 1711703 - RNA, 20 nt, Salmonella enterica enterica serovar Typhi
agauauaggguggcuuucua

SEQ ID NO: 1711704 - RNA, 21 nt, Salmonella enterica enterica serovar Typhi
agauauuuuguuuuaaauuca

SEQ ID NO: 1711705 - RNA, 22 nt, Salmonella enterica enterica serovar Typhi
agauauuuuguuuuaaauucaa

SEQ ID NO: 1711706 - RNA, 18 nt, Salmonella enterica enterica serovar Typhi
agaucagacgaccaucca

SEQ ID NO: 1711707 - RNA, 17 nt, Salmonella enterica enterica serovar Typhi
agaucaggaguaaauaa

SEQ ID NO: 1711708 - RNA, 21 nt, Salmonella enterica enterica serovar Typhi
agaucaggcgucagcauggug

SEQ ID NO: 1711709 - RNA, 24 nt, Salmonella enterica enterica serovar Typhi
agaucaggaguaaauaacaaaagc

SEQ ID NO: 1711710 - RNA, 23 nt, Salmonella enterica enterica serovar Typhi
agaugcagcggcaguuccggcgu

SEQ ID NO: 1711711 - RNA, 17 nt, Salmonella enterica enterica serovar Typhi
agaugauggaugucagc

SEQ ID NO: 1711712 - RNA, 13 nt, Salmonella enterica enterica serovar Typhi
agaugcgaaucuu

SEQ ID NO: 1711713 - RNA, 17 nt, Salmonella enterica enterica serovar Typhi
agaugcccgcagaucug

SEQ ID NO: 1711714 - RNA, 21 nt, Salmonella enterica enterica serovar Typhi
agaugaccaaagcuauucaca

SEQ ID NO: 1711715 - RNA, 18 nt, Salmonella enterica enterica serovar Typhi
agaugaagacaacgucgc

SEQ ID NO: 1711716 - RNA, 22 nt, Salmonella enterica enterica serovar Typhi
agaucuuuugcgccuuccaguu

SEQ ID NO: 1711717 - RNA, 17 nt, Salmonella enterica enterica serovar Typhi
agaugaacguaacguga

SEQ ID NO: 1711718 - RNA, 14 nt, Salmonella enterica enterica serovar Typhi
agaucuuuuugcuc

SEQ ID NO: 1711719 - RNA, 11 nt, Salmonella enterica enterica serovar Typhi
agaucucuaac

SEQ ID NO: 1711720 - RNA, 23 nt, Salmonella enterica enterica serovar Typhi
agauccuucauucagaucaaaaa

SEQ ID NO: 1711721 - RNA, 16 nt, Salmonella enterica enterica serovar Typhi
agaucgaccagcgcau

SEQ ID NO: 1711722 - RNA, 19 nt, Salmonella enterica enterica serovar Typhi
agaucgacagcgcgcgcga

SEQ ID NO: 1711723 - RNA, 23 nt, Salmonella enterica enterica serovar Typhi
agaucgaaugaaaauguaucaga

SEQ ID NO: 1711724 - RNA, 17 nt, Salmonella enterica enterica serovar Typhi
agaucgcgggcaaucaa

SEQ ID NO: 1711725 - RNA, 18 nt, Salmonella enterica enterica serovar Typhi
agaucgccaccguaacua

SEQ ID NO: 1711726 - RNA, 20 nt, Salmonella enterica enterica serovar Typhi
agaucgcauaaaauuauaaa

SEQ ID NO: 1711727 - RNA, 20 nt, Salmonella enterica enterica serovar Typhi
agaucguaugcgccuguuag

SEQ ID NO: 1711728 - RNA, 19 nt, Salmonella enterica enterica serovar Typhi
agaucguuauccagcagcc

SEQ ID NO: 1711729 - RNA, 21 nt, Salmonella enterica enterica serovar Typhi
agauccauuaaaugcgccagc

SEQ ID NO: 1711730 - RNA, 21 nt, Salmonella enterica enterica serovar Typhi
agauccacugagcgcgccaug

SEQ ID NO: 1711731 - RNA, 17 nt, Salmonella enterica enterica serovar Typhi
agauccauaagaugaaa

SEQ ID NO: 1711732 - RNA, 14 nt, Salmonella enterica enterica serovar Typhi
agauccaacacggc

SEQ ID NO: 1711733 - RNA, 13 nt, Salmonella enterica enterica serovar Typhi
agauccgcaagag

SEQ ID NO: 1711734 - RNA, 14 nt, Salmonella enterica enterica serovar Typhi
agauggaaaaaaag

SEQ ID NO: 1711735 - RNA, 16 nt, Salmonella enterica enterica serovar Typhi
agauggaaaaaaagaa

SEQ ID NO: 1711736 - RNA, 16 nt, Salmonella enterica enterica serovar Typhi
agaugcugucggaaaa

SEQ ID NO: 1711737 - RNA, 20 nt, Salmonella enterica enterica serovar Typhi
agaugcugggcgugucccug

SEQ ID NO: 1711738 - RNA, 21 nt, Salmonella enterica enterica serovar Typhi
agauggcauugcccggcggca

SEQ ID NO: 1711739 - RNA, 16 nt, Salmonella enterica enterica serovar Typhi
agauggcgcuaaaacc

SEQ ID NO: 1711740 - RNA, 21 nt, Salmonella enterica enterica serovar Typhi
agauggcuaugaagcuggagc

SEQ ID NO: 1711741 - RNA, 15 nt, Salmonella enterica enterica serovar Typhi
agauggcguggccaa

SEQ ID NO: 1711742 - RNA, 20 nt, Salmonella enterica enterica serovar Typhi
agauuacucucuugccagcg

SEQ ID NO: 1711743 - RNA, 15 nt, Salmonella enterica enterica serovar Typhi
agauuaaucagcaga

SEQ ID NO: 1711744 - RNA, 17 nt, Salmonella enterica enterica serovar Typhi
agauuaagaccguauaa

SEQ ID NO: 1711745 - RNA, 20 nt, Salmonella enterica enterica serovar Typhi
agauguugauacagaaaacc

SEQ ID NO: 1711746 - RNA, 21 nt, Salmonella enterica enterica serovar Typhi
agaugguauaaaucacgcuga

SEQ ID NO: 1711747 - RNA, 22 nt, Salmonella enterica enterica serovar Typhi
agauggucuguaccaccagaau

SEQ ID NO: 1711748 - RNA, 12 nt, Salmonella enterica enterica serovar Typhi
agaugucagauc

SEQ ID NO: 1711749 - RNA, 17 nt, Salmonella enterica enterica serovar Typhi
agaugucagauccuuca

SEQ ID NO: 1711750 - RNA, 21 nt, Salmonella enterica enterica serovar Typhi
agauugagacaaauaacuuuc

SEQ ID NO: 1711751 - RNA, 14 nt, Salmonella enterica enterica serovar Typhi
agauucuaacauaa

SEQ ID NO: 1711752 - RNA, 13 nt, Salmonella enterica enterica serovar Typhi
agauuggcaucug

SEQ ID NO: 1711753 - RNA, 14 nt, Salmonella enterica enterica serovar Typhi
agauugauuuauuc

SEQ ID NO: 1711754 - RNA, 19 nt, Salmonella enterica enterica serovar Typhi
agauuaucggccagcgcca

SEQ ID NO: 1711755 - RNA, 21 nt, Salmonella enterica enterica serovar Typhi
agauuacuucaggcugccaac

SEQ ID NO: 1711756 - RNA, 18 nt, Salmonella enterica enterica serovar Typhi
agauuagccccagcgcca

SEQ ID NO: 1711757 - RNA, 17 nt, Salmonella enterica enterica serovar Typhi
acuccuuagauuaauca

SEQ ID NO: 1711758 - RNA, 19 nt, Salmonella enterica enterica serovar Typhi
acucgaggaacuguucagc

SEQ ID NO: 1711759 - RNA, 21 nt, Salmonella enterica enterica serovar Typhi
acuccugcaucgauuccccac

SEQ ID NO: 1711760 - RNA, 15 nt, Salmonella enterica enterica serovar Typhi
acucaacaucauuaa

SEQ ID NO: 1711761 - RNA, 12 nt, Salmonella enterica enterica serovar Typhi
acucaacaucau

SEQ ID NO: 1711762 - RNA, 22 nt, Salmonella enterica enterica serovar Typhi
acucaaggcuauuagccaaagc

SEQ ID NO: 1711763 - RNA, 17 nt, Salmonella enterica enterica serovar Typhi
acucaagguagccacgc

SEQ ID NO: 1711764 - RNA, 19 nt, Salmonella enterica enterica serovar Typhi
acucaaugaauugaacuaa

SEQ ID NO: 1711765 - RNA, 19 nt, Salmonella enterica enterica serovar Typhi
acuccgcgguagagcgcgg

SEQ ID NO: 1711766 - RNA, 22 nt, Salmonella enterica enterica serovar Typhi
acuccgccggcgcggaagggau

SEQ ID NO: 1711767 - RNA, 14 nt, Salmonella enterica enterica serovar Typhi
acuccgucaaagaa

SEQ ID NO: 1711768 - RNA, 18 nt, Salmonella enterica enterica serovar Typhi
acuccuaagagaaaaccc

SEQ ID NO: 1711769 - RNA, 16 nt, Salmonella enterica enterica serovar Typhi
acuccgucaaagaaaa

SEQ ID NO: 1711770 - RNA, 15 nt, Salmonella enterica enterica serovar Typhi
acuccuaagagaaaa

SEQ ID NO: 1711771 - RNA, 23 nt, Salmonella enterica enterica serovar Typhi
acucugugcguucgcgaauuuca

SEQ ID NO: 1711772 - RNA, 13 nt, Salmonella enterica enterica serovar Typhi
acucuguuauaua

SEQ ID NO: 1711773 - RNA, 14 nt, Salmonella enterica enterica serovar Typhi
acucuuaauuauaa

SEQ ID NO: 1711774 - RNA, 15 nt, Salmonella enterica enterica serovar Typhi
acucuuaauuauaaa

SEQ ID NO: 1711775 - RNA, 19 nt, Salmonella enterica enterica serovar Typhi
acucuuugccgauggcuau

SEQ ID NO: 1711776 - RNA, 21 nt, Salmonella enterica enterica serovar Typhi
acucuuuuccccgacggccuc

SEQ ID NO: 1711777 - RNA, 23 nt, Salmonella enterica enterica serovar Typhi
acucuuuuuccgcgagagaaaaa

SEQ ID NO: 1711778 - RNA, 13 nt, Salmonella enterica enterica serovar Typhi
acucugcaaacgg

SEQ ID NO: 1711779 - RNA, 12 nt, Salmonella enterica enterica serovar Typhi
acucugaaaaaa

SEQ ID NO: 1711780 - RNA, 17 nt, Salmonella enterica enterica serovar Typhi
acucucuugccagcgca

SEQ ID NO: 1711781 - RNA, 16 nt, Salmonella enterica enterica serovar Typhi
acucucuccaguuugc

SEQ ID NO: 1711782 - RNA, 16 nt, Salmonella enterica enterica serovar Typhi
acucuaggcgcugcug

SEQ ID NO: 1711783 - RNA, 14 nt, Salmonella enterica enterica serovar Typhi
acucuaugcaaaag

SEQ ID NO: 1711784 - RNA, 17 nt, Salmonella enterica enterica serovar Typhi
acucuaugcaaaagaaa

SEQ ID NO: 1711785 - RNA, 20 nt, Salmonella enterica enterica serovar Typhi
acucucggccuauaaaccac

SEQ ID NO: 1711786 - RNA, 16 nt, Salmonella enterica enterica serovar Typhi
acucggcgaucaccac

SEQ ID NO: 1711787 - RNA, 16 nt, Salmonella enterica enterica serovar Typhi
acucgcuacgcucgcc

SEQ ID NO: 1711788 - RNA, 22 nt, Salmonella enterica enterica serovar Typhi
acucgcuccuugauugcaagaa

SEQ ID NO: 1711789 - RNA, 17 nt, Salmonella enterica enterica serovar Typhi
acucgcucccuuccccc

SEQ ID NO: 1711790 - RNA, 19 nt, Salmonella enterica enterica serovar Typhi
acugaucgauccacuuccc

SEQ ID NO: 1711791 - RNA, 21 nt, Salmonella enterica enterica serovar Typhi
acugauggaguuucaucagca

SEQ ID NO: 1711792 - RNA, 14 nt, Salmonella enterica enterica serovar Typhi
acugaugccagccg

SEQ ID NO: 1711793 - RNA, 21 nt, Salmonella enterica enterica serovar Typhi
acugauggcgcuaagccagcc

SEQ ID NO: 1711794 - RNA, 21 nt, Salmonella enterica enterica serovar Typhi
acugauucaaaaggugagaaa

SEQ ID NO: 1711795 - RNA, 16 nt, Salmonella enterica enterica serovar Typhi
acugcaaauaccacau

SEQ ID NO: 1711796 - RNA, 13 nt, Salmonella enterica enterica serovar Typhi
acugcaacugcgc

SEQ ID NO: 1711797 - RNA, 13 nt, Salmonella enterica enterica serovar Typhi
acugcaaauacca

SEQ ID NO: 1711798 - RNA, 13 nt, Salmonella enterica enterica serovar Typhi
acugagacucagc

SEQ ID NO: 1711799 - RNA, 15 nt, Salmonella enterica enterica serovar Typhi
acugacugcugucau

SEQ ID NO: 1711800 - RNA, 17 nt, Salmonella enterica enterica serovar Typhi
acugacuucaucaaaua

SEQ ID NO: 1711801 - RNA, 13 nt, Salmonella enterica enterica serovar Typhi
acugaaaaucaaa

SEQ ID NO: 1711802 - RNA, 22 nt, Salmonella enterica enterica serovar Typhi
acugagcuucaccgccagagca

SEQ ID NO: 1711803 - RNA, 19 nt, Salmonella enterica enterica serovar Typhi
acugauacuggauaaccgc

SEQ ID NO: 1711804 - RNA, 18 nt, Salmonella enterica enterica serovar Typhi
acugauacagccaaauca

SEQ ID NO: 1711805 - RNA, 19 nt, Salmonella enterica enterica serovar Typhi
acugauaguccaucaccuc

SEQ ID NO: 1711806 - RNA, 23 nt, Salmonella enterica enterica serovar Typhi
acugauaguccaucaccucuucg

SEQ ID NO: 1711807 - RNA, 16 nt, Salmonella enterica enterica serovar Typhi
acugccguauccaggg

SEQ ID NO: 1711808 - RNA, 13 nt, Salmonella enterica enterica serovar Typhi
acugcgaauuucc

SEQ ID NO: 1711809 - RNA, 22 nt, Salmonella enterica enterica serovar Typhi
acugcgaauuuccugccagacc

SEQ ID NO: 1711810 - RNA, 15 nt, Salmonella enterica enterica serovar Typhi
acugccgcagccgcu

SEQ ID NO: 1711811 - RNA, 18 nt, Salmonella enterica enterica serovar Typhi
acugccgccgucaucugc

SEQ ID NO: 1711812 - RNA, 23 nt, Salmonella enterica enterica serovar Typhi
acugcgcgccgcccugcaucaug

SEQ ID NO: 1711813 - RNA, 12 nt, Salmonella enterica enterica serovar Typhi
acugcgcccgca

SEQ ID NO: 1711814 - RNA, 16 nt, Salmonella enterica enterica serovar Typhi
acugcgccauguucau

SEQ ID NO: 1711815 - RNA, 15 nt, Salmonella enterica enterica serovar Typhi
acugcgccagccugc

SEQ ID NO: 1711816 - RNA, 14 nt, Salmonella enterica enterica serovar Typhi
acugcccaaauaaa

SEQ ID NO: 1711817 - RNA, 14 nt, Salmonella enterica enterica serovar Typhi
acugcccuggaaga

SEQ ID NO: 1711818 - RNA, 16 nt, Salmonella enterica enterica serovar Typhi
acugcccuggaagaac

SEQ ID NO: 1711819 - RNA, 22 nt, Salmonella enterica enterica serovar Typhi
acugcccuggaagaacuggaug

SEQ ID NO: 1711820 - RNA, 22 nt, Salmonella enterica enterica serovar Typhi
acugcccuacgcuucucuccau

SEQ ID NO: 1711821 - RNA, 22 nt, Salmonella enterica enterica serovar Typhi
acugcacuuccugcgucaggcu

SEQ ID NO: 1711822 - RNA, 17 nt, Salmonella enterica enterica serovar Typhi
acuggcagcagugacau

SEQ ID NO: 1711823 - RNA, 22 nt, Salmonella enterica enterica serovar Typhi
acuggcagccucguccugcaau

SEQ ID NO: 1711824 - RNA, 15 nt, Salmonella enterica enterica serovar Typhi
acuggcauugugagc

SEQ ID NO: 1711825 - RNA, 16 nt, Salmonella enterica enterica serovar Typhi
acuggccccgcauuuu

SEQ ID NO: 1711826 - RNA, 20 nt, Salmonella enterica enterica serovar Typhi
acuggccguuuucccggcaa

SEQ ID NO: 1711827 - RNA, 12 nt, Salmonella enterica enterica serovar Typhi
acuggccuccca

SEQ ID NO: 1711828 - RNA, 15 nt, Salmonella enterica enterica serovar Typhi
acuggcgauuuucau

SEQ ID NO: 1711829 - RNA, 16 nt, Salmonella enterica enterica serovar Typhi
acuggcgaccggcagc

SEQ ID NO: 1711830 - RNA, 17 nt, Salmonella enterica enterica serovar Typhi
acuggcgacagccgcgu

SEQ ID NO: 1711831 - RNA, 15 nt, Salmonella enterica enterica serovar Typhi
acuggcgaccgccac

SEQ ID NO: 1711832 - RNA, 22 nt, Salmonella enterica enterica serovar Typhi
acuggcggugcggucacaggca

SEQ ID NO: 1711833 - RNA, 17 nt, Salmonella enterica enterica serovar Typhi
acuggcuuuccugauca

SEQ ID NO: 1711834 - RNA, 21 nt, Salmonella enterica enterica serovar Typhi
acuggcuuuccugaucaauca

SEQ ID NO: 1711835 - RNA, 20 nt, Salmonella enterica enterica serovar Typhi
acuggguaaggcgcuugccu

SEQ ID NO: 1711836 - RNA, 19 nt, Salmonella enterica enterica serovar Typhi
acugguuaaggaugacuaa

SEQ ID NO: 1711837 - RNA, 16 nt, Salmonella enterica enterica serovar Typhi
acugguaaaccgugcg

SEQ ID NO: 1711838 - RNA, 22 nt, Salmonella enterica enterica serovar Typhi
acugcguuugaaauaccaggcg

SEQ ID NO: 1711839 - RNA, 17 nt, Salmonella enterica enterica serovar Typhi
acugcggccugcaaaga

SEQ ID NO: 1711840 - RNA, 20 nt, Salmonella enterica enterica serovar Typhi
acugcgcggcaaugagcggc

SEQ ID NO: 1711841 - RNA, 16 nt, Salmonella enterica enterica serovar Typhi
acugcgugagugugga

SEQ ID NO: 1711842 - RNA, 16 nt, Salmonella enterica enterica serovar Typhi
acugcguaaucuuuuc

SEQ ID NO: 1711843 - RNA, 18 nt, Salmonella enterica enterica serovar Typhi
acugcugacaaucagcac

SEQ ID NO: 1711844 - RNA, 13 nt, Salmonella enterica enterica serovar Typhi
acugcugcgcgug

SEQ ID NO: 1711845 - RNA, 10 nt, Salmonella enterica enterica serovar Typhi
acugcugcuc

SEQ ID NO: 1711846 - RNA, 22 nt, Salmonella enterica enterica serovar Typhi
acugcugcugaaagaagacgaa

SEQ ID NO: 1711847 - RNA, 21 nt, Salmonella enterica enterica serovar Typhi
acugcucguaaagcaucagac

SEQ ID NO: 1711848 - RNA, 21 nt, Salmonella enterica enterica serovar Typhi
acugcucguuaaauccuccca

SEQ ID NO: 1711849 - RNA, 18 nt, Salmonella enterica enterica serovar Typhi
acugcuuagcucaucagc

SEQ ID NO: 1711850 - RNA, 22 nt, Salmonella enterica enterica serovar Typhi
acugcuggcgcgucacaacagc

SEQ ID NO: 1711851 - RNA, 17 nt, Salmonella enterica enterica serovar Typhi
acugcugguaaauccaa

SEQ ID NO: 1711852 - RNA, 23 nt, Salmonella enterica enterica serovar Typhi
acugcuguguccaggucaucacc

SEQ ID NO: 1711853 - RNA, 15 nt, Salmonella enterica enterica serovar Typhi
acuggaauucguuac

SEQ ID NO: 1711854 - RNA, 20 nt, Salmonella enterica enterica serovar Typhi
acuggaucaccugaaugcaa

SEQ ID NO: 1711855 - RNA, 21 nt, Salmonella enterica enterica serovar Typhi
acuggaucaccugaaugcaaa

SEQ ID NO: 1711856 - RNA, 14 nt, Salmonella enterica enterica serovar Typhi
acuuaauaucaaua

SEQ ID NO: 1711857 - RNA, 15 nt, Salmonella enterica enterica serovar Typhi
acuuaaaauugaauu

SEQ ID NO: 1711858 - RNA, 22 nt, Salmonella enterica enterica serovar Typhi
acuuaaacgccggauuccagaa

SEQ ID NO: 1711859 - RNA, 20 nt, Salmonella enterica enterica serovar Typhi
acuuaaacguucguccgcac

SEQ ID NO: 1711860 - RNA, 13 nt, Salmonella enterica enterica serovar Typhi
acuguuuuugcuu

SEQ ID NO: 1711861 - RNA, 14 nt, Salmonella enterica enterica serovar Typhi
acuguuuuugcuuu

SEQ ID NO: 1711862 - RNA, 17 nt, Salmonella enterica enterica serovar Typhi
acugguuuguugcgucu

SEQ ID NO: 1711863 - RNA, 18 nt, Salmonella enterica enterica serovar Typhi
acugucgaaaccagcaua

SEQ ID NO: 1711864 - RNA, 13 nt, Salmonella enterica enterica serovar Typhi
acugucgcuggau

SEQ ID NO: 1711865 - RNA, 17 nt, Salmonella enterica enterica serovar Typhi
acuguuagcgaaacugc

SEQ ID NO: 1711866 - RNA, 21 nt, Salmonella enterica enterica serovar Typhi
acuguucaucaaagaaaacca

SEQ ID NO: 1711867 - RNA, 21 nt, Salmonella enterica enterica serovar Typhi
acugucuuaucaggccuacac

SEQ ID NO: 1711868 - RNA, 19 nt, Salmonella enterica enterica serovar Typhi
acugucuuguggaacacca

SEQ ID NO: 1711869 - RNA, 16 nt, Salmonella enterica enterica serovar Typhi
acuuauacugauaaac

SEQ ID NO: 1711870 - RNA, 22 nt, Salmonella enterica enterica serovar Typhi
acuuaucggcguguuucaucuc

SEQ ID NO: 1711871 - RNA, 18 nt, Salmonella enterica enterica serovar Typhi
acuucaauauugaugcua

SEQ ID NO: 1711872 - RNA, 12 nt, Salmonella enterica enterica serovar Typhi
acuucaaucacu

SEQ ID NO: 1711873 - RNA, 18 nt, Salmonella enterica enterica serovar Typhi
acuucaauucagaaaguu

SEQ ID NO: 1711874 - RNA, 17 nt, Salmonella enterica enterica serovar Typhi
acuucaauuuuccagau

SEQ ID NO: 1711875 - RNA, 13 nt, Salmonella enterica enterica serovar Typhi
acuucacaaacaa

SEQ ID NO: 1711876 - RNA, 20 nt, Salmonella enterica enterica serovar Typhi
acuucacaaacaauuucccc

SEQ ID NO: 1711877 - RNA, 18 nt, Salmonella enterica enterica serovar Typhi
acuuccgcacgcgcgccc

SEQ ID NO: 1711878 - RNA, 17 nt, Salmonella enterica enterica serovar Typhi
acuuccccuguaacugc

SEQ ID NO: 1711879 - RNA, 17 nt, Salmonella enterica enterica serovar Typhi
acuuccguaaaaagaac

SEQ ID NO: 1711880 - RNA, 15 nt, Salmonella enterica enterica serovar Typhi
acuuccgcaucaaua

SEQ ID NO: 1711881 - RNA, 14 nt, Salmonella enterica enterica serovar Typhi
acuuccgccucgcc

SEQ ID NO: 1711882 - RNA, 20 nt, Salmonella enterica enterica serovar Typhi
acuuccgguauccguucauc

SEQ ID NO: 1711883 - RNA, 15 nt, Salmonella enterica enterica serovar Typhi
acuucaggcugccaa

SEQ ID NO: 1711884 - RNA, 21 nt, Salmonella enterica enterica serovar Typhi
acuuccauucggcgaaagaag

SEQ ID NO: 1711885 - RNA, 20 nt, Salmonella enterica enterica serovar Typhi
acuuccauucccgccgcaau

SEQ ID NO: 1711886 - RNA, 21 nt, Salmonella enterica enterica serovar Typhi
acuucaccauaaaucauuacu

SEQ ID NO: 1711887 - RNA, 12 nt, Salmonella enterica enterica serovar Typhi
acuucacgcugg

SEQ ID NO: 1711888 - RNA, 19 nt, Salmonella enterica enterica serovar Typhi
acuucagcauacaggucuu

SEQ ID NO: 1711889 - RNA, 12 nt, Salmonella enterica enterica serovar Typhi
acuucagauacc

SEQ ID NO: 1711890 - RNA, 16 nt, Salmonella enterica enterica serovar Typhi
acuucagagcugaaaa

SEQ ID NO: 1711891 - RNA, 13 nt, Salmonella enterica enterica serovar Typhi
acguaaugugaaa

SEQ ID NO: 1711892 - RNA, 12 nt, Salmonella enterica enterica serovar Typhi
acguaauaccug

SEQ ID NO: 1711893 - RNA, 14 nt, Salmonella enterica enterica serovar Typhi
acguaauauuaagc

SEQ ID NO: 1711894 - RNA, 18 nt, Salmonella enterica enterica serovar Typhi
acguaaucccgccagccu

SEQ ID NO: 1711895 - RNA, 15 nt, Salmonella enterica enterica serovar Typhi
acguacggccugcgc

SEQ ID NO: 1711896 - RNA, 23 nt, Salmonella enterica enterica serovar Typhi
acguaccguuggaauaaaucaca

SEQ ID NO: 1711897 - RNA, 15 nt, Salmonella enterica enterica serovar Typhi
acguccauccgggua

SEQ ID NO: 1711898 - RNA, 20 nt, Salmonella enterica enterica serovar Typhi
acgucccgucagggcgaggc

SEQ ID NO: 1711899 - RNA, 18 nt, Salmonella enterica enterica serovar Typhi
acguccucuucuacacga

SEQ ID NO: 1711900 - RNA, 14 nt, Salmonella enterica enterica serovar Typhi
acgucgcaaagauu

SEQ ID NO: 1711901 - RNA, 20 nt, Salmonella enterica enterica serovar Typhi
acgucgcaagacgaaaaaug

SEQ ID NO: 1711902 - RNA, 21 nt, Salmonella enterica enterica serovar Typhi
acgucgcgcgccgccugcgcc

SEQ ID NO: 1711903 - RNA, 22 nt, Salmonella enterica enterica serovar Typhi
acgugcauuauuuuagugaaaa

SEQ ID NO: 1711904 - RNA, 17 nt, Salmonella enterica enterica serovar Typhi
acguuacuugauggaaa

SEQ ID NO: 1711905 - RNA, 19 nt, Salmonella enterica enterica serovar Typhi
acguuugccggugccauuc

SEQ ID NO: 1711906 - RNA, 16 nt, Salmonella enterica enterica serovar Typhi
acguuuucagcagugc

SEQ ID NO: 1711907 - RNA, 13 nt, Salmonella enterica enterica serovar Typhi
acguuuuccugcg

SEQ ID NO: 1711908 - RNA, 19 nt, Salmonella enterica enterica serovar Typhi
acguuuuuccauucacaca

SEQ ID NO: 1711909 - RNA, 15 nt, Salmonella enterica enterica serovar Typhi
acuaaaacgugcuga

SEQ ID NO: 1711910 - RNA, 22 nt, Salmonella enterica enterica serovar Typhi
acguuuccgcuagggcaucaga

SEQ ID NO: 1711911 - RNA, 22 nt, Salmonella enterica enterica serovar Typhi
acguuucaguuuuuucaguagc

SEQ ID NO: 1711912 - RNA, 21 nt, Salmonella enterica enterica serovar Typhi
acguuaucgccgacaaacagu

SEQ ID NO: 1711913 - RNA, 21 nt, Salmonella enterica enterica serovar Typhi
acguuaucugccucaacaagu

SEQ ID NO: 1711914 - RNA, 17 nt, Salmonella enterica enterica serovar Typhi
acuaccggcaccagcaa

SEQ ID NO: 1711915 - RNA, 18 nt, Salmonella enterica enterica serovar Typhi
acuacauaucuauauuuu

SEQ ID NO: 1711916 - RNA, 18 nt, Salmonella enterica enterica serovar Typhi
acuaccagaaacaacacg

SEQ ID NO: 1711917 - RNA, 17 nt, Salmonella enterica enterica serovar Typhi
acuacgccaaugaacuc

SEQ ID NO: 1711918 - RNA, 15 nt, Salmonella enterica enterica serovar Typhi
acuaccacuuucuug

SEQ ID NO: 1711919 - RNA, 15 nt, Salmonella enterica enterica serovar Typhi
acuaauuauuuuuca

SEQ ID NO: 1711920 - RNA, 17 nt, Salmonella enterica enterica serovar Typhi
acuaauuauuuuucaaa

SEQ ID NO: 1711921 - RNA, 21 nt, Salmonella enterica enterica serovar Typhi
acuaauuauuuuucaaaugau

SEQ ID NO: 1711922 - RNA, 21 nt, Salmonella enterica enterica serovar Typhi
acuaauuguuuguagaaagug

SEQ ID NO: 1711923 - RNA, 15 nt, Salmonella enterica enterica serovar Typhi
acuaaaguuuauuua

SEQ ID NO: 1711924 - RNA, 19 nt, Salmonella enterica enterica serovar Typhi
acuaaauaaauauccuccg

SEQ ID NO: 1711925 - RNA, 16 nt, Salmonella enterica enterica serovar Typhi
acuaucaugauuucuu

SEQ ID NO: 1711926 - RNA, 22 nt, Salmonella enterica enterica serovar Typhi
acuaucaguuuuggcaaucaca

SEQ ID NO: 1711927 - RNA, 16 nt, Salmonella enterica enterica serovar Typhi
acuauccacagcgaau

SEQ ID NO: 1711928 - RNA, 13 nt, Salmonella enterica enterica serovar Typhi
acuauuaaagcac

SEQ ID NO: 1711929 - RNA, 16 nt, Salmonella enterica enterica serovar Typhi
acuauccuggccugau

SEQ ID NO: 1711930 - RNA, 20 nt, Salmonella enterica enterica serovar Typhi
acuauggucugaaagaguuc

SEQ ID NO: 1711931 - RNA, 18 nt, Salmonella enterica enterica serovar Typhi
acuauuuuccccuucugu

SEQ ID NO: 1711932 - RNA, 21 nt, Salmonella enterica enterica serovar Typhi
acuauuuuuuaugugacaauc

SEQ ID NO: 1711933 - RNA, 23 nt, Salmonella enterica enterica serovar Typhi
acuauuuuuccggcgucaaaaau

SEQ ID NO: 1711934 - RNA, 12 nt, Salmonella enterica enterica serovar Typhi
acucaaagaaaa

SEQ ID NO: 1711935 - RNA, 20 nt, Salmonella enterica enterica serovar Typhi
acggccuagcugcguuucca

SEQ ID NO: 1711936 - RNA, 17 nt, Salmonella enterica enterica serovar Typhi
acggcccauaucaauca

SEQ ID NO: 1711937 - RNA, 22 nt, Salmonella enterica enterica serovar Typhi
acggccuucgcagaucgccugg

SEQ ID NO: 1711938 - RNA, 23 nt, Salmonella enterica enterica serovar Typhi
acggccugcaaacgaaucaccuc

SEQ ID NO: 1711939 - RNA, 17 nt, Salmonella enterica enterica serovar Typhi
acggcgcuuugggaauu

SEQ ID NO: 1711940 - RNA, 14 nt, Salmonella enterica enterica serovar Typhi
acggcggaccccuc

SEQ ID NO: 1711941 - RNA, 20 nt, Salmonella enterica enterica serovar Typhi
acggcgauaaaugucaggau

SEQ ID NO: 1711942 - RNA, 23 nt, Salmonella enterica enterica serovar Typhi
acggcaacugaaaacaggccugc

SEQ ID NO: 1711943 - RNA, 16 nt, Salmonella enterica enterica serovar Typhi
acggcaacgggacggc

SEQ ID NO: 1711944 - RNA, 19 nt, Salmonella enterica enterica serovar Typhi
acggcaaaaagcauaugcg

SEQ ID NO: 1711945 - RNA, 14 nt, Salmonella enterica enterica serovar Typhi
acggcaaaguucca

SEQ ID NO: 1711946 - RNA, 20 nt, Salmonella enterica enterica serovar Typhi
acggcaaaucgcgguaaaaa

SEQ ID NO: 1711947 - RNA, 13 nt, Salmonella enterica enterica serovar Typhi
acggauccagaac

SEQ ID NO: 1711948 - RNA, 19 nt, Salmonella enterica enterica serovar Typhi
acggcaaguauacuuauug

SEQ ID NO: 1711949 - RNA, 17 nt, Salmonella enterica enterica serovar Typhi
acggcaauuuuuacaaa

SEQ ID NO: 1711950 - RNA, 22 nt, Salmonella enterica enterica serovar Typhi
acggcaauuuuuacaaauuuaa

SEQ ID NO: 1711951 - RNA, 16 nt, Salmonella enterica enterica serovar Typhi
acggcacaacggccag

SEQ ID NO: 1711952 - RNA, 18 nt, Salmonella enterica enterica serovar Typhi
acggcacaacggccagca

SEQ ID NO: 1711953 - RNA, 22 nt, Salmonella enterica enterica serovar Typhi
acggcacaacggccagcaaaau

SEQ ID NO: 1711954 - RNA, 21 nt, Salmonella enterica enterica serovar Typhi
acgcuuaaucaguugcaggaa

SEQ ID NO: 1711955 - RNA, 19 nt, Salmonella enterica enterica serovar Typhi
acgcuuaucaguccccaca

SEQ ID NO: 1711956 - RNA, 14 nt, Salmonella enterica enterica serovar Typhi
acgcuuaucccagc

SEQ ID NO: 1711957 - RNA, 16 nt, Salmonella enterica enterica serovar Typhi
acgcuuuugcgcacug

SEQ ID NO: 1711958 - RNA, 12 nt, Salmonella enterica enterica serovar Typhi
acgcuguugccg

SEQ ID NO: 1711959 - RNA, 19 nt, Salmonella enterica enterica serovar Typhi
acggaacaaaacggaaugu

SEQ ID NO: 1711960 - RNA, 14 nt, Salmonella enterica enterica serovar Typhi
acggaaaccagcau

SEQ ID NO: 1711961 - RNA, 16 nt, Salmonella enterica enterica serovar Typhi
acggaaaccagauauc

SEQ ID NO: 1711962 - RNA, 21 nt, Salmonella enterica enterica serovar Typhi
acgcuuuuuuauuuugugacc

SEQ ID NO: 1711963 - RNA, 20 nt, Salmonella enterica enterica serovar Typhi
acgcuuuuuugcuggcuggc

SEQ ID NO: 1711964 - RNA, 14 nt, Salmonella enterica enterica serovar Typhi
acggaaaaaauacu

SEQ ID NO: 1711965 - RNA, 20 nt, Salmonella enterica enterica serovar Typhi
acggaagguaauagcccucg

SEQ ID NO: 1711966 - RNA, 16 nt, Salmonella enterica enterica serovar Typhi
acggacaucagaggua

SEQ ID NO: 1711967 - RNA, 22 nt, Salmonella enterica enterica serovar Typhi
acggaaccauuccgacagugaa

SEQ ID NO: 1711968 - RNA, 14 nt, Salmonella enterica enterica serovar Typhi
acggaacccagcaa

SEQ ID NO: 1711969 - RNA, 14 nt, Salmonella enterica enterica serovar Typhi
acggaaccaaaaua

SEQ ID NO: 1711970 - RNA, 18 nt, Salmonella enterica enterica serovar Typhi
acggaaccaaaugcccag

SEQ ID NO: 1711971 - RNA, 19 nt, Salmonella enterica enterica serovar Typhi
acgcuggcacuuuccgguu

SEQ ID NO: 1711972 - RNA, 18 nt, Salmonella enterica enterica serovar Typhi
acgcuggugcgcgggaga

SEQ ID NO: 1711973 - RNA, 17 nt, Salmonella enterica enterica serovar Typhi
acgcuggcacuggcagc

SEQ ID NO: 1711974 - RNA, 15 nt, Salmonella enterica enterica serovar Typhi
acgcuggacaauagc

SEQ ID NO: 1711975 - RNA, 13 nt, Salmonella enterica enterica serovar Typhi
acgcuggcacagg

SEQ ID NO: 1711976 - RNA, 20 nt, Salmonella enterica enterica serovar Typhi
acgcugcuccggcuuaaugc

SEQ ID NO: 1711977 - RNA, 20 nt, Salmonella enterica enterica serovar Typhi
acgcugcuauuuugcgcuuu

SEQ ID NO: 1711978 - RNA, 21 nt, Salmonella enterica enterica serovar Typhi
acgcugcuauccggcaacacg

SEQ ID NO: 1711979 - RNA, 22 nt, Salmonella enterica enterica serovar Typhi
acgcugcuauccggcaacacgu

SEQ ID NO: 1711980 - RNA, 17 nt, Salmonella enterica enterica serovar Typhi
acgcaagagagcaacau

SEQ ID NO: 1711981 - RNA, 16 nt, Salmonella enterica enterica serovar Typhi
acgcaaggaaauauua

SEQ ID NO: 1711982 - RNA, 13 nt, Salmonella enterica enterica serovar Typhi
acggggcgcagaa

SEQ ID NO: 1711983 - RNA, 18 nt, Salmonella enterica enterica serovar Typhi
acgggcuuuuagccgcgc

SEQ ID NO: 1711984 - RNA, 22 nt, Salmonella enterica enterica serovar Typhi
acgggcggcgacagagaaugcg

SEQ ID NO: 1711985 - RNA, 17 nt, Salmonella enterica enterica serovar Typhi
acgggccgccgcagcag

SEQ ID NO: 1711986 - RNA, 17 nt, Salmonella enterica enterica serovar Typhi
acgggcccuggccgcaa

SEQ ID NO: 1711987 - RNA, 20 nt, Salmonella enterica enterica serovar Typhi
acggcggcauuaaagccgcc

SEQ ID NO: 1711988 - RNA, 23 nt, Salmonella enterica enterica serovar Typhi
acgguacaaaccccacccacuga

SEQ ID NO: 1711989 - RNA, 19 nt, Salmonella enterica enterica serovar Typhi
acgguacuauuaccgcauc

SEQ ID NO: 1711990 - RNA, 21 nt, Salmonella enterica enterica serovar Typhi
acgguaaguugaaaggaaagg

SEQ ID NO: 1711991 - RNA, 14 nt, Salmonella enterica enterica serovar Typhi
acgguaaguugaaa

SEQ ID NO: 1711992 - RNA, 14 nt, Salmonella enterica enterica serovar Typhi
acgguaaaccucuu

SEQ ID NO: 1711993 - RNA, 19 nt, Salmonella enterica enterica serovar Typhi
acgguaaacgugccacagu

SEQ ID NO: 1711994 - RNA, 18 nt, Salmonella enterica enterica serovar Typhi
acgguuucgaccagcagc

SEQ ID NO: 1711995 - RNA, 17 nt, Salmonella enterica enterica serovar Typhi
acgguucauccagcagc

SEQ ID NO: 1711996 - RNA, 22 nt, Salmonella enterica enterica serovar Typhi
acgguucauccagcagcagcac

SEQ ID NO: 1711997 - RNA, 22 nt, Salmonella enterica enterica serovar Typhi
acgguuaaaaacagccagcagc

SEQ ID NO: 1711998 - RNA, 13 nt, Salmonella enterica enterica serovar Typhi
acgguuaaaaagu

SEQ ID NO: 1711999 - RNA, 22 nt, Salmonella enterica enterica serovar Typhi
acguaaagcuggccuucagguu

SEQ ID NO: 1712000 - RNA, 13 nt, Salmonella enterica enterica serovar Typhi
acguaaauaccca

SEQ ID NO: 1712001 - RNA, 17 nt, Salmonella enterica enterica serovar Typhi
acguaaauacccaggcc

SEQ ID NO: 1712002 - RNA, 21 nt, Salmonella enterica enterica serovar Typhi
acguaaauuacuuaugauaua

SEQ ID NO: 1712003 - RNA, 20 nt, Salmonella enterica enterica serovar Typhi
acguaaauuacuuaugauau

SEQ ID NO: 1712004 - RNA, 16 nt, Salmonella enterica enterica serovar Typhi
acguaacgucguaaau

SEQ ID NO: 1712005 - RNA, 20 nt, Salmonella enterica enterica serovar Typhi
acguaacgguguuucaucuu

SEQ ID NO: 1712006 - RNA, 16 nt, Salmonella enterica enterica serovar Typhi
acguaacaugaccugc

SEQ ID NO: 1712007 - RNA, 15 nt, Salmonella enterica enterica serovar Typhi
acguaacuuauccac

SEQ ID NO: 1712008 - RNA, 14 nt, Salmonella enterica enterica serovar Typhi
acggucaaucauca

SEQ ID NO: 1712009 - RNA, 17 nt, Salmonella enterica enterica serovar Typhi
acgguccuggccaggcu

SEQ ID NO: 1712010 - RNA, 19 nt, Salmonella enterica enterica serovar Typhi
acgguccuggccaggcuuc

SEQ ID NO: 1712011 - RNA, 17 nt, Salmonella enterica enterica serovar Typhi
aggugccuggguuccag

SEQ ID NO: 1712012 - RNA, 20 nt, Salmonella enterica enterica serovar Typhi
aggugcggugcgacaaagau

SEQ ID NO: 1712013 - RNA, 16 nt, Salmonella enterica enterica serovar Typhi
aggugcuggugguggg

SEQ ID NO: 1712014 - RNA, 13 nt, Salmonella enterica enterica serovar Typhi
agguggaagaaac

SEQ ID NO: 1712015 - RNA, 14 nt, Salmonella enterica enterica serovar Typhi
aggugcuuaucuga

SEQ ID NO: 1712016 - RNA, 17 nt, Salmonella enterica enterica serovar Typhi
aggugauguccagacca

SEQ ID NO: 1712017 - RNA, 14 nt, Salmonella enterica enterica serovar Typhi
aggugaucuguuca

SEQ ID NO: 1712018 - RNA, 13 nt, Salmonella enterica enterica serovar Typhi
aggugagcucuuu

SEQ ID NO: 1712019 - RNA, 15 nt, Salmonella enterica enterica serovar Typhi
aggugagcucuuucu

SEQ ID NO: 1712020 - RNA, 13 nt, Salmonella enterica enterica serovar Typhi
aggugaauagcau

SEQ ID NO: 1712021 - RNA, 19 nt, Salmonella enterica enterica serovar Typhi
aggugacgccaugcaaaaa

SEQ ID NO: 1712022 - RNA, 16 nt, Salmonella enterica enterica serovar Typhi
aggugacgaagaucgc

SEQ ID NO: 1712023 - RNA, 14 nt, Salmonella enterica enterica serovar Typhi
aggucuugauggcg

SEQ ID NO: 1712024 - RNA, 18 nt, Salmonella enterica enterica serovar Typhi
aggucuugccaacaaagg

SEQ ID NO: 1712025 - RNA, 22 nt, Salmonella enterica enterica serovar Typhi
aggucuuuaucuaucaccgccu

SEQ ID NO: 1712026 - RNA, 19 nt, Salmonella enterica enterica serovar Typhi
aggugaacauuacaaugua

SEQ ID NO: 1712027 - RNA, 14 nt, Salmonella enterica enterica serovar Typhi
aggucgucuucuug

SEQ ID NO: 1712028 - RNA, 22 nt, Salmonella enterica enterica serovar Typhi
aggucguuucccccgcaacaaa

SEQ ID NO: 1712029 - RNA, 20 nt, Salmonella enterica enterica serovar Typhi
aggucgcuauccagcaguaa

SEQ ID NO: 1712030 - RNA, 23 nt, Salmonella enterica enterica serovar Typhi
aggucgcuauccagcaguaaaua

SEQ ID NO: 1712031 - RNA, 17 nt, Salmonella enterica enterica serovar Typhi
aggucauuauucaggcc

SEQ ID NO: 1712032 - RNA, 15 nt, Salmonella enterica enterica serovar Typhi
aggucaugguaaaac

SEQ ID NO: 1712033 - RNA, 18 nt, Salmonella enterica enterica serovar Typhi
aggucaucaccuccagca

SEQ ID NO: 1712034 - RNA, 22 nt, Salmonella enterica enterica serovar Typhi
aggucgaaaacggccaauccug

SEQ ID NO: 1712035 - RNA, 19 nt, Salmonella enterica enterica serovar Typhi
agguagcccggcaggcugg

SEQ ID NO: 1712036 - RNA, 17 nt, Salmonella enterica enterica serovar Typhi
agguaguaacgggcauc

SEQ ID NO: 1712037 - RNA, 17 nt, Salmonella enterica enterica serovar Typhi
agguaguccaaauaagg

SEQ ID NO: 1712038 - RNA, 21 nt, Salmonella enterica enterica serovar Typhi
agguacuuucccccagauugu

SEQ ID NO: 1712039 - RNA, 17 nt, Salmonella enterica enterica serovar Typhi
agguagcagaccgguac

SEQ ID NO: 1712040 - RNA, 16 nt, Salmonella enterica enterica serovar Typhi
agguacagcuuagcug

SEQ ID NO: 1712041 - RNA, 13 nt, Salmonella enterica enterica serovar Typhi
agguacauugcca

SEQ ID NO: 1712042 - RNA, 14 nt, Salmonella enterica enterica serovar Typhi
agguacgcguuuca

SEQ ID NO: 1712043 - RNA, 20 nt, Salmonella enterica enterica serovar Typhi
agguacgcguuucacaaccu

SEQ ID NO: 1712044 - RNA, 15 nt, Salmonella enterica enterica serovar Typhi
aggucaauaagauau

SEQ ID NO: 1712045 - RNA, 21 nt, Salmonella enterica enterica serovar Typhi
aggucaaccacgagagcaccg

SEQ ID NO: 1712046 - RNA, 23 nt, Salmonella enterica enterica serovar Typhi
agguauuucgaggggcaggaagg

SEQ ID NO: 1712047 - RNA, 16 nt, Salmonella enterica enterica serovar Typhi
aggucacaucaucgcc

SEQ ID NO: 1712048 - RNA, 14 nt, Salmonella enterica enterica serovar Typhi
agguauuuagccac

SEQ ID NO: 1712049 - RNA, 17 nt, Salmonella enterica enterica serovar Typhi
agguauaggaaaaugau

SEQ ID NO: 1712050 - RNA, 14 nt, Salmonella enterica enterica serovar Typhi
agguauccagcaga

SEQ ID NO: 1712051 - RNA, 18 nt, Salmonella enterica enterica serovar Typhi
agggugcagcaaauaauc

SEQ ID NO: 1712052 - RNA, 15 nt, Salmonella enterica enterica serovar Typhi
agggugcaaagaaac

SEQ ID NO: 1712053 - RNA, 21 nt, Salmonella enterica enterica serovar Typhi
aggguauaugagcgcaggcga

SEQ ID NO: 1712054 - RNA, 19 nt, Salmonella enterica enterica serovar Typhi
aggguuaugauuucaggca

SEQ ID NO: 1712055 - RNA, 13 nt, Salmonella enterica enterica serovar Typhi
aggguugccagag

SEQ ID NO: 1712056 - RNA, 17 nt, Salmonella enterica enterica serovar Typhi
aggguugccagaggcag

SEQ ID NO: 1712057 - RNA, 22 nt, Salmonella enterica enterica serovar Typhi
aggguuuucaauuccacaggcg

SEQ ID NO: 1712058 - RNA, 23 nt, Salmonella enterica enterica serovar Typhi
aggguuuucaauuccacaggcgc

SEQ ID NO: 1712059 - RNA, 19 nt, Salmonella enterica enterica serovar Typhi
agguaacgcgaaaaaagau

SEQ ID NO: 1712060 - RNA, 13 nt, Salmonella enterica enterica serovar Typhi
agguaacauacaa

SEQ ID NO: 1712061 - RNA, 14 nt, Salmonella enterica enterica serovar Typhi
agguaaauccgcca

SEQ ID NO: 1712062 - RNA, 20 nt, Salmonella enterica enterica serovar Typhi
agguuugcgcggcggguaaa

SEQ ID NO: 1712063 - RNA, 23 nt, Salmonella enterica enterica serovar Typhi
agguuuugucaugguaaaugccg

SEQ ID NO: 1712064 - RNA, 11 nt, Salmonella enterica enterica serovar Typhi
agguuuugcug

SEQ ID NO: 1712065 - RNA, 21 nt, Salmonella enterica enterica serovar Typhi
agguuuaauguugccguggca

SEQ ID NO: 1712066 - RNA, 16 nt, Salmonella enterica enterica serovar Typhi
aguaaaaaaaccguau

SEQ ID NO: 1712067 - RNA, 20 nt, Salmonella enterica enterica serovar Typhi
aguaaacuccucuuccgaca

SEQ ID NO: 1712068 - RNA, 17 nt, Salmonella enterica enterica serovar Typhi
aguaaagaaauuuugca

SEQ ID NO: 1712069 - RNA, 14 nt, Salmonella enterica enterica serovar Typhi
aguaaagauuuguu

SEQ ID NO: 1712070 - RNA, 20 nt, Salmonella enterica enterica serovar Typhi
agguguaaaccguuuuuccg

SEQ ID NO: 1712071 - RNA, 17 nt, Salmonella enterica enterica serovar Typhi
agguguuuacgccgcca

SEQ ID NO: 1712072 - RNA, 21 nt, Salmonella enterica enterica serovar Typhi
agguguuacgugggucgagaa

SEQ ID NO: 1712073 - RNA, 22 nt, Salmonella enterica enterica serovar Typhi
aggugugguacggcuuucacac

SEQ ID NO: 1712074 - RNA, 17 nt, Salmonella enterica enterica serovar Typhi
agguuaucgccgcccgu

SEQ ID NO: 1712075 - RNA, 24 nt, Salmonella enterica enterica serovar Typhi
agguuauuaaaaagccagcguaaa

SEQ ID NO: 1712076 - RNA, 13 nt, Salmonella enterica enterica serovar Typhi
agguuagcagcca

SEQ ID NO: 1712077 - RNA, 15 nt, Salmonella enterica enterica serovar Typhi
agguuaaauagcagg

SEQ ID NO: 1712078 - RNA, 14 nt, Salmonella enterica enterica serovar Typhi
agguuaagccucac

SEQ ID NO: 1712079 - RNA, 14 nt, Salmonella enterica enterica serovar Typhi
agguuaauaacugc

SEQ ID NO: 1712080 - RNA, 18 nt, Salmonella enterica enterica serovar Typhi
agguucaccaccacccag

SEQ ID NO: 1712081 - RNA, 19 nt, Salmonella enterica enterica serovar Typhi
agguucauauugcgccgca

SEQ ID NO: 1712082 - RNA, 15 nt, Salmonella enterica enterica serovar Typhi
agguugcgcccggcg

SEQ ID NO: 1712083 - RNA, 23 nt, Salmonella enterica enterica serovar Typhi
aguaaugcgcgaauaucuuuguc

SEQ ID NO: 1712084 - RNA, 16 nt, Salmonella enterica enterica serovar Typhi
aguaauguccagauua

SEQ ID NO: 1712085 - RNA, 13 nt, Salmonella enterica enterica serovar Typhi
aguaauuuuuccg

SEQ ID NO: 1712086 - RNA, 16 nt, Salmonella enterica enterica serovar Typhi
aguacagacuggaugg

SEQ ID NO: 1712087 - RNA, 23 nt, Salmonella enterica enterica serovar Typhi
aguacagcuuaaucaccagcgca

SEQ ID NO: 1712088 - RNA, 19 nt, Salmonella enterica enterica serovar Typhi
aguacauaguucuggcuuu

SEQ ID NO: 1712089 - RNA, 12 nt, Salmonella enterica enterica serovar Typhi
aguaccagcacu

SEQ ID NO: 1712090 - RNA, 20 nt, Salmonella enterica enterica serovar Typhi
aguaauaacaaaaaacauau

SEQ ID NO: 1712091 - RNA, 15 nt, Salmonella enterica enterica serovar Typhi
aguaauaaaauaaua

SEQ ID NO: 1712092 - RNA, 17 nt, Salmonella enterica enterica serovar Typhi
aguaacugguuaccaca

SEQ ID NO: 1712093 - RNA, 16 nt, Salmonella enterica enterica serovar Typhi
aguaagcgccagccgu

SEQ ID NO: 1712094 - RNA, 22 nt, Salmonella enterica enterica serovar Typhi
aguaacgcguccaacuggcuuu

SEQ ID NO: 1712095 - RNA, 19 nt, Salmonella enterica enterica serovar Typhi
aguaacgcacuuuuccagc

SEQ ID NO: 1712096 - RNA, 19 nt, Salmonella enterica enterica serovar Typhi
aguaaccuauuuuacaaaa

SEQ ID NO: 1712097 - RNA, 16 nt, Salmonella enterica enterica serovar Typhi
aguaacaccgcggcgc

SEQ ID NO: 1712098 - RNA, 22 nt, Salmonella enterica enterica serovar Typhi
aguaaauugacgcuugacucug

SEQ ID NO: 1712099 - RNA, 17 nt, Salmonella enterica enterica serovar Typhi
aguaaauuauuccuuga

SEQ ID NO: 1712100 - RNA, 18 nt, Salmonella enterica enterica serovar Typhi
aggcugagcguagaccgc

SEQ ID NO: 1712101 - RNA, 19 nt, Salmonella enterica enterica serovar Typhi
aggcugacgaagaacuuag

SEQ ID NO: 1712102 - RNA, 21 nt, Salmonella enterica enterica serovar Typhi
aggcugacgaagaacuuagga

SEQ ID NO: 1712103 - RNA, 21 nt, Salmonella enterica enterica serovar Typhi
aggcuccggcaccaaaccaua

SEQ ID NO: 1712104 - RNA, 21 nt, Salmonella enterica enterica serovar Typhi
aggcucccuuauacaggcgca

SEQ ID NO: 1712105 - RNA, 22 nt, Salmonella enterica enterica serovar Typhi
aggcuccaaguauugauaccuu

SEQ ID NO: 1712106 - RNA, 16 nt, Salmonella enterica enterica serovar Typhi
aggcucaggaaaacaa

SEQ ID NO: 1712107 - RNA, 22 nt, Salmonella enterica enterica serovar Typhi
aggcucaucagcgccauugcua

SEQ ID NO: 1712108 - RNA, 14 nt, Salmonella enterica enterica serovar Typhi
aggcuacccagaca

SEQ ID NO: 1712109 - RNA, 16 nt, Salmonella enterica enterica serovar Typhi
aggcuacccagacaag

SEQ ID NO: 1712110 - RNA, 21 nt, Salmonella enterica enterica serovar Typhi
aggcuacgguacugcccaccu

SEQ ID NO: 1712111 - RNA, 19 nt, Salmonella enterica enterica serovar Typhi
aggcuacccgcaauaccaa

SEQ ID NO: 1712112 - RNA, 18 nt, Salmonella enterica enterica serovar Typhi
aggcuaccgggcaaacau

SEQ ID NO: 1712113 - RNA, 15 nt, Salmonella enterica enterica serovar Typhi
aggcuaccguucaga

SEQ ID NO: 1712114 - RNA, 14 nt, Salmonella enterica enterica serovar Typhi
aggcguuacagacg

SEQ ID NO: 1712115 - RNA, 22 nt, Salmonella enterica enterica serovar Typhi
aggcguucccgaaaugggccaa

SEQ ID NO: 1712116 - RNA, 16 nt, Salmonella enterica enterica serovar Typhi
aggcgucgaacuccgc

SEQ ID NO: 1712117 - RNA, 15 nt, Salmonella enterica enterica serovar Typhi
aggcgucccauguug

SEQ ID NO: 1712118 - RNA, 21 nt, Salmonella enterica enterica serovar Typhi
aggcgugguggauauccagca

SEQ ID NO: 1712119 - RNA, 16 nt, Salmonella enterica enterica serovar Typhi
aggcggcuaccgccgu

SEQ ID NO: 1712120 - RNA, 23 nt, Salmonella enterica enterica serovar Typhi
aggcggcaugauagggcgccugu

SEQ ID NO: 1712121 - RNA, 15 nt, Salmonella enterica enterica serovar Typhi
aggcgucaaaacagg

SEQ ID NO: 1712122 - RNA, 14 nt, Salmonella enterica enterica serovar Typhi
aggcguaaccgcca

SEQ ID NO: 1712123 - RNA, 21 nt, Salmonella enterica enterica serovar Typhi
aggcggaaaacauucgcccgu

SEQ ID NO: 1712124 - RNA, 14 nt, Salmonella enterica enterica serovar Typhi
aggcgcuugcgccg

SEQ ID NO: 1712125 - RNA, 23 nt, Salmonella enterica enterica serovar Typhi
aggcggaguuauacagugccagu

SEQ ID NO: 1712126 - RNA, 13 nt, Salmonella enterica enterica serovar Typhi
aggcggcaaagau

SEQ ID NO: 1712127 - RNA, 20 nt, Salmonella enterica enterica serovar Typhi
aggcgcuauucccaggcaaa

SEQ ID NO: 1712128 - RNA, 21 nt, Salmonella enterica enterica serovar Typhi
aggcgcuaugcuuaccaucug

SEQ ID NO: 1712129 - RNA, 21 nt, Salmonella enterica enterica serovar Typhi
aggcgcguuuacuggcgacga

SEQ ID NO: 1712130 - RNA, 18 nt, Salmonella enterica enterica serovar Typhi
aggcgcguagcuggccuu

SEQ ID NO: 1712131 - RNA, 14 nt, Salmonella enterica enterica serovar Typhi
aggcgcgcagcugc

SEQ ID NO: 1712132 - RNA, 17 nt, Salmonella enterica enterica serovar Typhi
aggcgcgcagcugccac

SEQ ID NO: 1712133 - RNA, 18 nt, Salmonella enterica enterica serovar Typhi
aggcgcgaccucaucaaa

SEQ ID NO: 1712134 - RNA, 17 nt, Salmonella enterica enterica serovar Typhi
aggcgacgaugugcaua

SEQ ID NO: 1712135 - RNA, 16 nt, Salmonella enterica enterica serovar Typhi
aggcgacgccgccauc

SEQ ID NO: 1712136 - RNA, 19 nt, Salmonella enterica enterica serovar Typhi
aggcgacuggcguccgcaa

SEQ ID NO: 1712137 - RNA, 13 nt, Salmonella enterica enterica serovar Typhi
aggcgaauagcgc

SEQ ID NO: 1712138 - RNA, 13 nt, Salmonella enterica enterica serovar Typhi
aggcgaaucccca

SEQ ID NO: 1712139 - RNA, 18 nt, Salmonella enterica enterica serovar Typhi
aggcgaccaauauccgca

SEQ ID NO: 1712140 - RNA, 20 nt, Salmonella enterica enterica serovar Typhi
aggcgaaaccggccgccauc

SEQ ID NO: 1712141 - RNA, 21 nt, Salmonella enterica enterica serovar Typhi
aggcgaaacggcggaaccauu

SEQ ID NO: 1712142 - RNA, 21 nt, Salmonella enterica enterica serovar Typhi
aggcgaacauaagagauggaa

SEQ ID NO: 1712143 - RNA, 21 nt, Salmonella enterica enterica serovar Typhi
aggccuggcuggaugaggcgc

SEQ ID NO: 1712144 - RNA, 22 nt, Salmonella enterica enterica serovar Typhi
aggccugccggguuuaaugcgc

SEQ ID NO: 1712145 - RNA, 14 nt, Salmonella enterica enterica serovar Typhi
aggccugauaagcg

SEQ ID NO: 1712146 - RNA, 21 nt, Salmonella enterica enterica serovar Typhi
aggcgcgaaaaauaggauggc

SEQ ID NO: 1712147 - RNA, 22 nt, Salmonella enterica enterica serovar Typhi
aggcgccucgcgcggcgguuca

SEQ ID NO: 1712148 - RNA, 14 nt, Salmonella enterica enterica serovar Typhi
aggcgcaucagaaa

SEQ ID NO: 1712149 - RNA, 15 nt, Salmonella enterica enterica serovar Typhi
aggcgcaucagaaaa

SEQ ID NO: 1712150 - RNA, 17 nt, Salmonella enterica enterica serovar Typhi
aggcgcaucagaaaaac

SEQ ID NO: 1712151 - RNA, 14 nt, Salmonella enterica enterica serovar Typhi
aggcgcaaaccggu

SEQ ID NO: 1712152 - RNA, 13 nt, Salmonella enterica enterica serovar Typhi
aggcgcaaaacca

SEQ ID NO: 1712153 - RNA, 19 nt, Salmonella enterica enterica serovar Typhi
aggcgcagagugagcaggc

SEQ ID NO: 1712154 - RNA, 21 nt, Salmonella enterica enterica serovar Typhi
aggcgauccuguucaaacauc

SEQ ID NO: 1712155 - RNA, 15 nt, Salmonella enterica enterica serovar Typhi
aggcgauagccccag

SEQ ID NO: 1712156 - RNA, 23 nt, Salmonella enterica enterica serovar Typhi
aggcgauaccuaaucccuggcga

SEQ ID NO: 1712157 - RNA, 15 nt, Salmonella enterica enterica serovar Typhi
aggcgauagccgucc

SEQ ID NO: 1712158 - RNA, 23 nt, Salmonella enterica enterica serovar Typhi
aggccggguaggacauagccgcc

SEQ ID NO: 1712159 - RNA, 14 nt, Salmonella enterica enterica serovar Typhi
aggccgggaaaucu

SEQ ID NO: 1712160 - RNA, 22 nt, Salmonella enterica enterica serovar Typhi
aggccgggaaaucuucuacuuc

SEQ ID NO: 1712161 - RNA, 23 nt, Salmonella enterica enterica serovar Typhi
aggccguuauugucaugcuaaaa

SEQ ID NO: 1712162 - RNA, 17 nt, Salmonella enterica enterica serovar Typhi
aggccuacauccggcuc

SEQ ID NO: 1712163 - RNA, 14 nt, Salmonella enterica enterica serovar Typhi
aggccuacaagaau

SEQ ID NO: 1712164 - RNA, 19 nt, Salmonella enterica enterica serovar Typhi
aggccguugugucccugga

SEQ ID NO: 1712165 - RNA, 16 nt, Salmonella enterica enterica serovar Typhi
aggccuaacacaugca

SEQ ID NO: 1712166 - RNA, 21 nt, Salmonella enterica enterica serovar Typhi
aggccuacacucugcgcgcga

SEQ ID NO: 1712167 - RNA, 13 nt, Salmonella enterica enterica serovar Typhi
aggccucuaucuu

SEQ ID NO: 1712168 - RNA, 23 nt, Salmonella enterica enterica serovar Typhi
aggccugauaagacgcaucgcgu

SEQ ID NO: 1712169 - RNA, 13 nt, Salmonella enterica enterica serovar Typhi
aggccugauaagc

SEQ ID NO: 1712170 - RNA, 20 nt, Salmonella enterica enterica serovar Typhi
aggccugauaagcacaggcc

SEQ ID NO: 1712171 - RNA, 13 nt, Salmonella enterica enterica serovar Typhi
aggccgcggcugu

SEQ ID NO: 1712172 - RNA, 16 nt, Salmonella enterica enterica serovar Typhi
aggccggcauaaugau

SEQ ID NO: 1712173 - RNA, 23 nt, Salmonella enterica enterica serovar Typhi
aggccggauaagagaauccgaca

SEQ ID NO: 1712174 - RNA, 21 nt, Salmonella enterica enterica serovar Typhi
aggccggcgaagauccgcuca

SEQ ID NO: 1712175 - RNA, 22 nt, Salmonella enterica enterica serovar Typhi
aggccgccgaggcuaagccaga

SEQ ID NO: 1712176 - RNA, 18 nt, Salmonella enterica enterica serovar Typhi
aggccgccgcacaggcga

SEQ ID NO: 1712177 - RNA, 18 nt, Salmonella enterica enterica serovar Typhi
aggccgccaccgccucgc

SEQ ID NO: 1712178 - RNA, 18 nt, Salmonella enterica enterica serovar Typhi
agggcaccugggcaauaa

SEQ ID NO: 1712179 - RNA, 19 nt, Salmonella enterica enterica serovar Typhi
agggcaucaauaaaaucac

SEQ ID NO: 1712180 - RNA, 22 nt, Salmonella enterica enterica serovar Typhi
agggcauaaugauugcuggcag

SEQ ID NO: 1712181 - RNA, 13 nt, Salmonella enterica enterica serovar Typhi
agggcaggggaaa

SEQ ID NO: 1712182 - RNA, 18 nt, Salmonella enterica enterica serovar Typhi
agggcauuuuuuccagua

SEQ ID NO: 1712183 - RNA, 19 nt, Salmonella enterica enterica serovar Typhi
agggcgcggcgcaacuuuu

SEQ ID NO: 1712184 - RNA, 18 nt, Salmonella enterica enterica serovar Typhi
agggcgcggcgcaacuuu

SEQ ID NO: 1712185 - RNA, 21 nt, Salmonella enterica enterica serovar Typhi
agggcggcgcgcugccgcccu

SEQ ID NO: 1712186 - RNA, 17 nt, Salmonella enterica enterica serovar Typhi
agggguugaugccgacc

SEQ ID NO: 1712187 - RNA, 18 nt, Salmonella enterica enterica serovar Typhi
aggggccacaggcggcau

SEQ ID NO: 1712188 - RNA, 14 nt, Salmonella enterica enterica serovar Typhi
aggggggaaaugag

SEQ ID NO: 1712189 - RNA, 17 nt, Salmonella enterica enterica serovar Typhi
agggcgugacgcgccag

SEQ ID NO: 1712190 - RNA, 22 nt, Salmonella enterica enterica serovar Typhi
aggcuggguugauaccggagga

SEQ ID NO: 1712191 - RNA, 20 nt, Salmonella enterica enterica serovar Typhi
aggcuggcgguaacaggcac

SEQ ID NO: 1712192 - RNA, 14 nt, Salmonella enterica enterica serovar Typhi
aggcugucugccau

SEQ ID NO: 1712193 - RNA, 11 nt, Salmonella enterica enterica serovar Typhi
aggcuggaaca

SEQ ID NO: 1712194 - RNA, 14 nt, Salmonella enterica enterica serovar Typhi
aggcuggagagcaa

SEQ ID NO: 1712195 - RNA, 13 nt, Salmonella enterica enterica serovar Typhi
aggcugcggauga

SEQ ID NO: 1712196 - RNA, 15 nt, Salmonella enterica enterica serovar Typhi
aggcugccgccagaa

SEQ ID NO: 1712197 - RNA, 20 nt, Salmonella enterica enterica serovar Typhi
aggcuucaucggauagauga

SEQ ID NO: 1712198 - RNA, 15 nt, Salmonella enterica enterica serovar Typhi
aggcuuccacgcacg

SEQ ID NO: 1712199 - RNA, 21 nt, Salmonella enterica enterica serovar Typhi
aggcuguugaggaaauucuga

SEQ ID NO: 1712200 - RNA, 13 nt, Salmonella enterica enterica serovar Typhi
aggcuugcaggau

SEQ ID NO: 1712201 - RNA, 17 nt, Salmonella enterica enterica serovar Typhi
aggcuuuaugcugacaa

SEQ ID NO: 1712202 - RNA, 14 nt, Salmonella enterica enterica serovar Typhi
aggcuuugcugcug

SEQ ID NO: 1712203 - RNA, 20 nt, Salmonella enterica enterica serovar Typhi
agggauaagaaagauaaaau

SEQ ID NO: 1712204 - RNA, 23 nt, Salmonella enterica enterica serovar Typhi
agggauaacaguauuuguucaga

SEQ ID NO: 1712205 - RNA, 21 nt, Salmonella enterica enterica serovar Typhi
agggauaagaaagauaaaaua

SEQ ID NO: 1712206 - RNA, 16 nt, Salmonella enterica enterica serovar Typhi
agggaucaauguaaaa

SEQ ID NO: 1712207 - RNA, 16 nt, Salmonella enterica enterica serovar Typhi
agggaucaucuucacu

SEQ ID NO: 1712208 - RNA, 23 nt, Salmonella enterica enterica serovar Typhi
agggaguaugcggucaaaagcug

SEQ ID NO: 1712209 - RNA, 23 nt, Salmonella enterica enterica serovar Typhi
agggaggugcucucccagcugag

SEQ ID NO: 1712210 - RNA, 18 nt, Salmonella enterica enterica serovar Typhi
agggagguucgccucccu

SEQ ID NO: 1712211 - RNA, 21 nt, Salmonella enterica enterica serovar Typhi
agggcaaaguuaucccugcug

SEQ ID NO: 1712212 - RNA, 13 nt, Salmonella enterica enterica serovar Typhi
agggaugacagaa

SEQ ID NO: 1712213 - RNA, 20 nt, Salmonella enterica enterica serovar Typhi
agggacacauuucuuuugau

SEQ ID NO: 1712214 - RNA, 18 nt, Salmonella enterica enterica serovar Typhi
agggaagacuauuaccac

SEQ ID NO: 1712215 - RNA, 13 nt, Salmonella enterica enterica serovar Typhi
agggaauaugauu

SEQ ID NO: 1712216 - RNA, 23 nt, Salmonella enterica enterica serovar Typhi
agggaaaccauguugaucguaaa

SEQ ID NO: 1712217 - RNA, 14 nt, Salmonella enterica enterica serovar Typhi
agggaaaagccauu

SEQ ID NO: 1712218 - RNA, 14 nt, Salmonella enterica enterica serovar Typhi
aggcuuuugauuca

SEQ ID NO: 1712219 - RNA, 18 nt, Salmonella enterica enterica serovar Typhi
agcuauguuuaagccaga

SEQ ID NO: 1712220 - RNA, 19 nt, Salmonella enterica enterica serovar Typhi
agcuauucauuauuuuuaa

SEQ ID NO: 1712221 - RNA, 19 nt, Salmonella enterica enterica serovar Typhi
agcuauccaguuucugacg

SEQ ID NO: 1712222 - RNA, 19 nt, Salmonella enterica enterica serovar Typhi
agcucaacuauuaaagcac

SEQ ID NO: 1712223 - RNA, 18 nt, Salmonella enterica enterica serovar Typhi
agcucaagcccgcgucgu

SEQ ID NO: 1712224 - RNA, 17 nt, Salmonella enterica enterica serovar Typhi
agcucaccgagacugcc

SEQ ID NO: 1712225 - RNA, 17 nt, Salmonella enterica enterica serovar Typhi
agcucaaacguaaagca

SEQ ID NO: 1712226 - RNA, 22 nt, Salmonella enterica enterica serovar Typhi
agcuauuccuguauaauuauuu

SEQ ID NO: 1712227 - RNA, 20 nt, Salmonella enterica enterica serovar Typhi
agcguuacccagacagcaaa

SEQ ID NO: 1712228 - RNA, 23 nt, Salmonella enterica enterica serovar Typhi
agcguuacugcaacugcgcggca

SEQ ID NO: 1712229 - RNA, 20 nt, Salmonella enterica enterica serovar Typhi
agcguuaucuguaauugacg

SEQ ID NO: 1712230 - RNA, 21 nt, Salmonella enterica enterica serovar Typhi
agcguucaugcuggucagcaa

SEQ ID NO: 1712231 - RNA, 21 nt, Salmonella enterica enterica serovar Typhi
agcguucauucccgccaauaa

SEQ ID NO: 1712232 - RNA, 18 nt, Salmonella enterica enterica serovar Typhi
agcuaaguuuguaaaaua

SEQ ID NO: 1712233 - RNA, 18 nt, Salmonella enterica enterica serovar Typhi
agcuaauccccagcgcuc

SEQ ID NO: 1712234 - RNA, 17 nt, Salmonella enterica enterica serovar Typhi
agcuaaucacccacuuc

SEQ ID NO: 1712235 - RNA, 16 nt, Salmonella enterica enterica serovar Typhi
agcgucucagcaggcg

SEQ ID NO: 1712236 - RNA, 22 nt, Salmonella enterica enterica serovar Typhi
agcgucuguuucaacgcaucca

SEQ ID NO: 1712237 - RNA, 23 nt, Salmonella enterica enterica serovar Typhi
agcgugccgagcaacagaaacca

SEQ ID NO: 1712238 - RNA, 18 nt, Salmonella enterica enterica serovar Typhi
agcgugccuucaaauaua

SEQ ID NO: 1712239 - RNA, 13 nt, Salmonella enterica enterica serovar Typhi
agcguaggguaga

SEQ ID NO: 1712240 - RNA, 18 nt, Salmonella enterica enterica serovar Typhi
agcguauaauuaagcugc

SEQ ID NO: 1712241 - RNA, 14 nt, Salmonella enterica enterica serovar Typhi
agcguauccagcac

SEQ ID NO: 1712242 - RNA, 17 nt, Salmonella enterica enterica serovar Typhi
agcgucggugaagaaaa

SEQ ID NO: 1712243 - RNA, 22 nt, Salmonella enterica enterica serovar Typhi
agcgucgggccgcgcugcgccu

SEQ ID NO: 1712244 - RNA, 15 nt, Salmonella enterica enterica serovar Typhi
agcgucuauagauga

SEQ ID NO: 1712245 - RNA, 20 nt, Salmonella enterica enterica serovar Typhi
agcgggcagcauugaccacc

SEQ ID NO: 1712246 - RNA, 13 nt, Salmonella enterica enterica serovar Typhi
agcgggggccggc

SEQ ID NO: 1712247 - RNA, 15 nt, Salmonella enterica enterica serovar Typhi
agcggucuuucaaca

SEQ ID NO: 1712248 - RNA, 20 nt, Salmonella enterica enterica serovar Typhi
agcggucggagguucgaauc

SEQ ID NO: 1712249 - RNA, 22 nt, Salmonella enterica enterica serovar Typhi
agcguaaugguggcaaccugac

SEQ ID NO: 1712250 - RNA, 16 nt, Salmonella enterica enterica serovar Typhi
agcguaccggccacaa

SEQ ID NO: 1712251 - RNA, 18 nt, Salmonella enterica enterica serovar Typhi
agcguagaccgcccagga

SEQ ID NO: 1712252 - RNA, 18 nt, Salmonella enterica enterica serovar Typhi
agcguacaggcggaugaa

SEQ ID NO: 1712253 - RNA, 22 nt, Salmonella enterica enterica serovar Typhi
agcggcguugcccaguacggcg

SEQ ID NO: 1712254 - RNA, 15 nt, Salmonella enterica enterica serovar Typhi
agcggcguucaaaac

SEQ ID NO: 1712255 - RNA, 17 nt, Salmonella enterica enterica serovar Typhi
agcggcguucaaaacgc

SEQ ID NO: 1712256 - RNA, 23 nt, Salmonella enterica enterica serovar Typhi
agcggcgggauuuuaagcaucca

SEQ ID NO: 1712257 - RNA, 22 nt, Salmonella enterica enterica serovar Typhi
agcggcugacacucauccagac

SEQ ID NO: 1712258 - RNA, 22 nt, Salmonella enterica enterica serovar Typhi
agcggcguuuuuuccugcuggu

SEQ ID NO: 1712259 - RNA, 18 nt, Salmonella enterica enterica serovar Typhi
agcggcucauccagcaac

SEQ ID NO: 1712260 - RNA, 23 nt, Salmonella enterica enterica serovar Typhi
agcggaaaauauucagcacauca

SEQ ID NO: 1712261 - RNA, 20 nt, Salmonella enterica enterica serovar Typhi
agcggaaucgcuuccugggu

SEQ ID NO: 1712262 - RNA, 16 nt, Salmonella enterica enterica serovar Typhi
agcggcgcaggggcau

SEQ ID NO: 1712263 - RNA, 17 nt, Salmonella enterica enterica serovar Typhi
agcggcgccaucaccau

SEQ ID NO: 1712264 - RNA, 19 nt, Salmonella enterica enterica serovar Typhi
agcggcgcagacacugcca

SEQ ID NO: 1712265 - RNA, 16 nt, Salmonella enterica enterica serovar Typhi
agcgcggcagcagcuu

SEQ ID NO: 1712266 - RNA, 23 nt, Salmonella enterica enterica serovar Typhi
agcgcggcgcccauuccgccugc

SEQ ID NO: 1712267 - RNA, 22 nt, Salmonella enterica enterica serovar Typhi
agcgcggcggcaacugagcgaa

SEQ ID NO: 1712268 - RNA, 19 nt, Salmonella enterica enterica serovar Typhi
agcgcggcgugaucaaauu

SEQ ID NO: 1712269 - RNA, 19 nt, Salmonella enterica enterica serovar Typhi
agcgcuggagaaugggauu

SEQ ID NO: 1712270 - RNA, 20 nt, Salmonella enterica enterica serovar Typhi
agcgcuggcauuccccaucg

SEQ ID NO: 1712271 - RNA, 20 nt, Salmonella enterica enterica serovar Typhi
agcgcuggcgccgcaaacca

SEQ ID NO: 1712272 - RNA, 16 nt, Salmonella enterica enterica serovar Typhi
agcgcugaugcaggca

SEQ ID NO: 1712273 - RNA, 19 nt, Salmonella enterica enterica serovar Typhi
agcgcgccgccgcccauaa

SEQ ID NO: 1712274 - RNA, 21 nt, Salmonella enterica enterica serovar Typhi
agcgcgccggauauggcgucc

SEQ ID NO: 1712275 - RNA, 15 nt, Salmonella enterica enterica serovar Typhi
agcgcgccgcccugu

SEQ ID NO: 1712276 - RNA, 16 nt, Salmonella enterica enterica serovar Typhi
agcgcgcucugccuuu

SEQ ID NO: 1712277 - RNA, 12 nt, Salmonella enterica enterica serovar Typhi
agcgcgcgcaca

SEQ ID NO: 1712278 - RNA, 21 nt, Salmonella enterica enterica serovar Typhi
agcgcgccaauggccgccccc

SEQ ID NO: 1712279 - RNA, 18 nt, Salmonella enterica enterica serovar Typhi
agcgcgcccgccaccagc

SEQ ID NO: 1712280 - RNA, 16 nt, Salmonella enterica enterica serovar Typhi
agauuggugaugcgca

SEQ ID NO: 1712281 - RNA, 21 nt, Salmonella enterica enterica serovar Typhi
agcgcgauacgcagcaccgcc

SEQ ID NO: 1712282 - RNA, 17 nt, Salmonella enterica enterica serovar Typhi
agcucacgcgccagcac

SEQ ID NO: 1712283 - RNA, 18 nt, Salmonella enterica enterica serovar Typhi
agcucacgcgccagcacc

SEQ ID NO: 1712284 - RNA, 19 nt, Salmonella enterica enterica serovar Typhi
agcucacgcgccagcacca

SEQ ID NO: 1712285 - RNA, 15 nt, Salmonella enterica enterica serovar Typhi
agcucacgccaaaau

SEQ ID NO: 1712286 - RNA, 23 nt, Salmonella enterica enterica serovar Typhi
agcucagaaauaaaaccagggaa

SEQ ID NO: 1712287 - RNA, 18 nt, Salmonella enterica enterica serovar Typhi
agcucagaaauaaaacca

SEQ ID NO: 1712288 - RNA, 22 nt, Salmonella enterica enterica serovar Typhi
agcucaggguccccauaucccg

SEQ ID NO: 1712289 - RNA, 19 nt, Salmonella enterica enterica serovar Typhi
agcucaguccagccgccgc

SEQ ID NO: 1712290 - RNA, 22 nt, Salmonella enterica enterica serovar Typhi
agcucaguugguagagcccugg

SEQ ID NO: 1712291 - RNA, 18 nt, Salmonella enterica enterica serovar Typhi
agcucagcuggauagagc

SEQ ID NO: 1712292 - RNA, 15 nt, Salmonella enterica enterica serovar Typhi
agcucaguuuccagc

SEQ ID NO: 1712293 - RNA, 18 nt, Salmonella enterica enterica serovar Typhi
agcucaguuuccagccag

SEQ ID NO: 1712294 - RNA, 16 nt, Salmonella enterica enterica serovar Typhi
agcugcaccaggagca

SEQ ID NO: 1712295 - RNA, 18 nt, Salmonella enterica enterica serovar Typhi
agcugccguuggcgagcc

SEQ ID NO: 1712296 - RNA, 21 nt, Salmonella enterica enterica serovar Typhi
agcugcccggauaaccgcccg

SEQ ID NO: 1712297 - RNA, 22 nt, Salmonella enterica enterica serovar Typhi
agcugcauccgggguucgaauc

SEQ ID NO: 1712298 - RNA, 18 nt, Salmonella enterica enterica serovar Typhi
agcugccacaccacaugc

SEQ ID NO: 1712299 - RNA, 17 nt, Salmonella enterica enterica serovar Typhi
agcugcaguuauuuuuu

SEQ ID NO: 1712300 - RNA, 12 nt, Salmonella enterica enterica serovar Typhi
agcugugagaau

SEQ ID NO: 1712301 - RNA, 16 nt, Salmonella enterica enterica serovar Typhi
agcuguuuugucggcc

SEQ ID NO: 1712302 - RNA, 18 nt, Salmonella enterica enterica serovar Typhi
agcuuaaaaaauccugca

SEQ ID NO: 1712303 - RNA, 23 nt, Salmonella enterica enterica serovar Typhi
agcuguaccaucaccugaugucc

SEQ ID NO: 1712304 - RNA, 22 nt, Salmonella enterica enterica serovar Typhi
agcuguacuuugccggggaggg

SEQ ID NO: 1712305 - RNA, 21 nt, Salmonella enterica enterica serovar Typhi
agcugguggcgaguccugccg

SEQ ID NO: 1712306 - RNA, 21 nt, Salmonella enterica enterica serovar Typhi
agcugguugauauugugcaua

SEQ ID NO: 1712307 - RNA, 20 nt, Salmonella enterica enterica serovar Typhi
agcugcgcaagaaacaucau

SEQ ID NO: 1712308 - RNA, 14 nt, Salmonella enterica enterica serovar Typhi
agcugcgcgccgca

SEQ ID NO: 1712309 - RNA, 16 nt, Salmonella enterica enterica serovar Typhi
agcugcuuugccugga

SEQ ID NO: 1712310 - RNA, 13 nt, Salmonella enterica enterica serovar Typhi
agcuggauaagcu

SEQ ID NO: 1712311 - RNA, 14 nt, Salmonella enterica enterica serovar Typhi
agcuggagcaggaa

SEQ ID NO: 1712312 - RNA, 21 nt, Salmonella enterica enterica serovar Typhi
agcuggcuugccagcagauuu

SEQ ID NO: 1712313 - RNA, 19 nt, Salmonella enterica enterica serovar Typhi
agcugggcgucaacgugaa

SEQ ID NO: 1712314 - RNA, 14 nt, Salmonella enterica enterica serovar Typhi
agcuuaaucaccag

SEQ ID NO: 1712315 - RNA, 15 nt, Salmonella enterica enterica serovar Typhi
agcuuaaucaccagc

SEQ ID NO: 1712316 - RNA, 18 nt, Salmonella enterica enterica serovar Typhi
agcuuaaucaccagcgca

SEQ ID NO: 1712317 - RNA, 18 nt, Salmonella enterica enterica serovar Typhi
agcuuagaacucacgcuc

SEQ ID NO: 1712318 - RNA, 22 nt, Salmonella enterica enterica serovar Typhi
agcuuaucgccaaagauauagu

SEQ ID NO: 1712319 - RNA, 14 nt, Salmonella enterica enterica serovar Typhi
agcuucaugcgccg

SEQ ID NO: 1712320 - RNA, 12 nt, Salmonella enterica enterica serovar Typhi
agcuuccagcaa

SEQ ID NO: 1712321 - RNA, 23 nt, Salmonella enterica enterica serovar Typhi
agcuuaucugaccaugccagcaa

SEQ ID NO: 1712322 - RNA, 16 nt, Salmonella enterica enterica serovar Typhi
agcuugaaagcgcaaa

SEQ ID NO: 1712323 - RNA, 20 nt, Salmonella enterica enterica serovar Typhi
agcuucugucugcgugaaga

SEQ ID NO: 1712324 - RNA, 18 nt, Salmonella enterica enterica serovar Typhi
agcuuucugaauuucacg

SEQ ID NO: 1712325 - RNA, 22 nt, Salmonella enterica enterica serovar Typhi
agcuuuucaugacgcucuccuc

SEQ ID NO: 1712326 - RNA, 20 nt, Salmonella enterica enterica serovar Typhi
agcuuuucauauagucauaa

SEQ ID NO: 1712327 - RNA, 20 nt, Salmonella enterica enterica serovar Typhi
agcuuuugcugcgccagcca

SEQ ID NO: 1712328 - RNA, 14 nt, Salmonella enterica enterica serovar Typhi
agcuugaucaucag

SEQ ID NO: 1712329 - RNA, 15 nt, Salmonella enterica enterica serovar Typhi
agcuugcgcagagua

SEQ ID NO: 1712330 - RNA, 17 nt, Salmonella enterica enterica serovar Typhi
agcuugcgcugguguuu

SEQ ID NO: 1712331 - RNA, 22 nt, Salmonella enterica enterica serovar Typhi
agcuugccgccaauaggggcgg

SEQ ID NO: 1712332 - RNA, 20 nt, Salmonella enterica enterica serovar Typhi
agcuuggcggcuuccuguuu

SEQ ID NO: 1712333 - RNA, 14 nt, Salmonella enterica enterica serovar Typhi
aggaccaacaccag

SEQ ID NO: 1712334 - RNA, 17 nt, Salmonella enterica enterica serovar Typhi
aggaccaaaacaguacu

SEQ ID NO: 1712335 - RNA, 14 nt, Salmonella enterica enterica serovar Typhi
aggacacaguaaug

SEQ ID NO: 1712336 - RNA, 16 nt, Salmonella enterica enterica serovar Typhi
aggacaucaaaggcag

SEQ ID NO: 1712337 - RNA, 14 nt, Salmonella enterica enterica serovar Typhi
aggagaaaacgggu

SEQ ID NO: 1712338 - RNA, 21 nt, Salmonella enterica enterica serovar Typhi
aggacugacggaagagcucga

SEQ ID NO: 1712339 - RNA, 17 nt, Salmonella enterica enterica serovar Typhi
aggacugauacagccaa

SEQ ID NO: 1712340 - RNA, 16 nt, Salmonella enterica enterica serovar Typhi
aggacucaaucacuua

SEQ ID NO: 1712341 - RNA, 15 nt, Salmonella enterica enterica serovar Typhi
aggacucaaucacuu

SEQ ID NO: 1712342 - RNA, 18 nt, Salmonella enterica enterica serovar Typhi
aggagagccagaagaaua

SEQ ID NO: 1712343 - RNA, 19 nt, Salmonella enterica enterica serovar Typhi
aggagagucgauacgcuga

SEQ ID NO: 1712344 - RNA, 22 nt, Salmonella enterica enterica serovar Typhi
aggagcauagauaacuauguga

SEQ ID NO: 1712345 - RNA, 15 nt, Salmonella enterica enterica serovar Typhi
aggagcauagauaac

SEQ ID NO: 1712346 - RNA, 17 nt, Salmonella enterica enterica serovar Typhi
aggagaugaccugccca

SEQ ID NO: 1712347 - RNA, 14 nt, Salmonella enterica enterica serovar Typhi
aggagaugucccac

SEQ ID NO: 1712348 - RNA, 21 nt, Salmonella enterica enterica serovar Typhi
aggagaucggcgcagguccau

SEQ ID NO: 1712349 - RNA, 16 nt, Salmonella enterica enterica serovar Typhi
aggauaagaauaggug

SEQ ID NO: 1712350 - RNA, 15 nt, Salmonella enterica enterica serovar Typhi
aggauacagccgacu

SEQ ID NO: 1712351 - RNA, 19 nt, Salmonella enterica enterica serovar Typhi
aggauagcgaccagcguca

SEQ ID NO: 1712352 - RNA, 21 nt, Salmonella enterica enterica serovar Typhi
aggauagcuuuguauauguuu

SEQ ID NO: 1712353 - RNA, 15 nt, Salmonella enterica enterica serovar Typhi
aggauauaagcgcca

SEQ ID NO: 1712354 - RNA, 13 nt, Salmonella enterica enterica serovar Typhi
aggauauaaaaaa

SEQ ID NO: 1712355 - RNA, 20 nt, Salmonella enterica enterica serovar Typhi
aggaucaaaaucgcgcccca

SEQ ID NO: 1712356 - RNA, 17 nt, Salmonella enterica enterica serovar Typhi
aggauauuuauuugcau

SEQ ID NO: 1712357 - RNA, 21 nt, Salmonella enterica enterica serovar Typhi
aggauauuuauuugguuucua

SEQ ID NO: 1712358 - RNA, 17 nt, Salmonella enterica enterica serovar Typhi
aggagcucggccaucug

SEQ ID NO: 1712359 - RNA, 19 nt, Salmonella enterica enterica serovar Typhi
aggagcgcgacgacggcgc

SEQ ID NO: 1712360 - RNA, 19 nt, Salmonella enterica enterica serovar Typhi
aggagcgccguggaaaaga

SEQ ID NO: 1712361 - RNA, 16 nt, Salmonella enterica enterica serovar Typhi
aggauaaaauccugca

SEQ ID NO: 1712362 - RNA, 22 nt, Salmonella enterica enterica serovar Typhi
aggauaaaauccugcacgccgg

SEQ ID NO: 1712363 - RNA, 22 nt, Salmonella enterica enterica serovar Typhi
aggaguccaaaacgaacaggcc

SEQ ID NO: 1712364 - RNA, 11 nt, Salmonella enterica enterica serovar Typhi
aggagugaaca

SEQ ID NO: 1712365 - RNA, 14 nt, Salmonella enterica enterica serovar Typhi
aggaguaguuaaaa

SEQ ID NO: 1712366 - RNA, 13 nt, Salmonella enterica enterica serovar Typhi
aggaaauucugac

SEQ ID NO: 1712367 - RNA, 14 nt, Salmonella enterica enterica serovar Typhi
aggaacagugacaa

SEQ ID NO: 1712368 - RNA, 12 nt, Salmonella enterica enterica serovar Typhi
aggaacagugac

SEQ ID NO: 1712369 - RNA, 14 nt, Salmonella enterica enterica serovar Typhi
aggaacagauacug

SEQ ID NO: 1712370 - RNA, 21 nt, Salmonella enterica enterica serovar Typhi
aggaaccgguagccaggcgcg

SEQ ID NO: 1712371 - RNA, 18 nt, Salmonella enterica enterica serovar Typhi
aggaacugcggccagaca

SEQ ID NO: 1712372 - RNA, 17 nt, Salmonella enterica enterica serovar Typhi
aggaacuguucagccag

SEQ ID NO: 1712373 - RNA, 20 nt, Salmonella enterica enterica serovar Typhi
aggaacuguucagccagcaa

SEQ ID NO: 1712374 - RNA, 19 nt, Salmonella enterica enterica serovar Typhi
aggaacuaacuccggagcu

SEQ ID NO: 1712375 - RNA, 22 nt, Salmonella enterica enterica serovar Typhi
aggaaaagaccauccgguuuua

SEQ ID NO: 1712376 - RNA, 14 nt, Salmonella enterica enterica serovar Typhi
aggaaaagcuguag

SEQ ID NO: 1712377 - RNA, 22 nt, Salmonella enterica enterica serovar Typhi
agcuuuugcgcguuccccaaca

SEQ ID NO: 1712378 - RNA, 15 nt, Salmonella enterica enterica serovar Typhi
agcuuuuuauuacuu

SEQ ID NO: 1712379 - RNA, 15 nt, Salmonella enterica enterica serovar Typhi
aggaaaagucauuuu

SEQ ID NO: 1712380 - RNA, 12 nt, Salmonella enterica enterica serovar Typhi
aggaaaggcaga

SEQ ID NO: 1712381 - RNA, 14 nt, Salmonella enterica enterica serovar Typhi
aggaaauaacgugc

SEQ ID NO: 1712382 - RNA, 13 nt, Salmonella enterica enterica serovar Typhi
aggacaaaaaugg

SEQ ID NO: 1712383 - RNA, 15 nt, Salmonella enterica enterica serovar Typhi
aggaauuuaucaaca

SEQ ID NO: 1712384 - RNA, 21 nt, Salmonella enterica enterica serovar Typhi
aggaauuuucccauaaaagag

SEQ ID NO: 1712385 - RNA, 13 nt, Salmonella enterica enterica serovar Typhi
aggaauuuuccca

SEQ ID NO: 1712386 - RNA, 13 nt, Salmonella enterica enterica serovar Typhi
aggaauucuccac

SEQ ID NO: 1712387 - RNA, 17 nt, Salmonella enterica enterica serovar Typhi
aggaauuccaguccuuu

SEQ ID NO: 1712388 - RNA, 19 nt, Salmonella enterica enterica serovar Typhi
aggaaugaaaacgaaucga

SEQ ID NO: 1712389 - RNA, 17 nt, Salmonella enterica enterica serovar Typhi
aggaaggaaacuuauuu

SEQ ID NO: 1712390 - RNA, 22 nt, Salmonella enterica enterica serovar Typhi
aggaagacuauccagccaggga

SEQ ID NO: 1712391 - RNA, 22 nt, Salmonella enterica enterica serovar Typhi
aggaagcccucggcgaacaggc

SEQ ID NO: 1712392 - RNA, 14 nt, Salmonella enterica enterica serovar Typhi
aggaagacuucguu

SEQ ID NO: 1712393 - RNA, 22 nt, Salmonella enterica enterica serovar Typhi
aggaagucagcuuccugcacgc

SEQ ID NO: 1712394 - RNA, 20 nt, Salmonella enterica enterica serovar Typhi
aggaaggcgguaagagagug

SEQ ID NO: 1712395 - RNA, 13 nt, Salmonella enterica enterica serovar Typhi
aggaauaacaucg

SEQ ID NO: 1712396 - RNA, 14 nt, Salmonella enterica enterica serovar Typhi
aggaauaacaucgu

SEQ ID NO: 1712397 - RNA, 13 nt, Salmonella enterica enterica serovar Typhi
aggaauaacgcgc

SEQ ID NO: 1712398 - RNA, 23 nt, Salmonella enterica enterica serovar Typhi
aggccagugccaagcaacacggc

SEQ ID NO: 1712399 - RNA, 20 nt, Salmonella enterica enterica serovar Typhi
aggccauuaagcuucgugag

SEQ ID NO: 1712400 - RNA, 12 nt, Salmonella enterica enterica serovar Typhi
aggccagcagca

SEQ ID NO: 1712401 - RNA, 20 nt, Salmonella enterica enterica serovar Typhi
aggccagcuacaccugggcu

SEQ ID NO: 1712402 - RNA, 23 nt, Salmonella enterica enterica serovar Typhi
aggccacgauauagucgcccauc

SEQ ID NO: 1712403 - RNA, 15 nt, Salmonella enterica enterica serovar Typhi
aggccacugcccugg

SEQ ID NO: 1712404 - RNA, 20 nt, Salmonella enterica enterica serovar Typhi
aggccagaaggcgaacauaa

SEQ ID NO: 1712405 - RNA, 23 nt, Salmonella enterica enterica serovar Typhi
aggccgacaaaugacgucagcaa

SEQ ID NO: 1712406 - RNA, 22 nt, Salmonella enterica enterica serovar Typhi
aggcccguucacguuuuuacuc

SEQ ID NO: 1712407 - RNA, 20 nt, Salmonella enterica enterica serovar Typhi
aggcccggcaaggaaggaaa

SEQ ID NO: 1712408 - RNA, 13 nt, Salmonella enterica enterica serovar Typhi
aggcccagccgcu

SEQ ID NO: 1712409 - RNA, 19 nt, Salmonella enterica enterica serovar Typhi
aggcauaauggaacugccu

SEQ ID NO: 1712410 - RNA, 16 nt, Salmonella enterica enterica serovar Typhi
aggcauaaaaaagagg

SEQ ID NO: 1712411 - RNA, 13 nt, Salmonella enterica enterica serovar Typhi
aggcauaaaaaaa

SEQ ID NO: 1712412 - RNA, 14 nt, Salmonella enterica enterica serovar Typhi
aggcaucagauaaa

SEQ ID NO: 1712413 - RNA, 23 nt, Salmonella enterica enterica serovar Typhi
aggcauccgugaccugcugacua

SEQ ID NO: 1712414 - RNA, 22 nt, Salmonella enterica enterica serovar Typhi
aggcaucgacgccagcggguga

SEQ ID NO: 1712415 - RNA, 19 nt, Salmonella enterica enterica serovar Typhi
aggcagcaccucaauauga

SEQ ID NO: 1712416 - RNA, 23 nt, Salmonella enterica enterica serovar Typhi
aggcagccacaaugggggcauaa

SEQ ID NO: 1712417 - RNA, 15 nt, Salmonella enterica enterica serovar Typhi
aggcaggaaauccag

SEQ ID NO: 1712418 - RNA, 20 nt, Salmonella enterica enterica serovar Typhi
aggcauugauaaagcgcuca

SEQ ID NO: 1712419 - RNA, 14 nt, Salmonella enterica enterica serovar Typhi
aggcauuggacgga

SEQ ID NO: 1712420 - RNA, 15 nt, Salmonella enterica enterica serovar Typhi
aggcauggccuucaa

SEQ ID NO: 1712421 - RNA, 16 nt, Salmonella enterica enterica serovar Typhi
aggcauguuaugaaua

SEQ ID NO: 1712422 - RNA, 15 nt, Salmonella enterica enterica serovar Typhi
aggcauuaaaaaaac

SEQ ID NO: 1712423 - RNA, 16 nt, Salmonella enterica enterica serovar Typhi
aggcauuaaaaaaacg

SEQ ID NO: 1712424 - RNA, 14 nt, Salmonella enterica enterica serovar Typhi
aggcaucugaaaug

SEQ ID NO: 1712425 - RNA, 14 nt, Salmonella enterica enterica serovar Typhi
aggcaucugcgcaa

SEQ ID NO: 1712426 - RNA, 16 nt, Salmonella enterica enterica serovar Typhi
aggcaugcacuccaau

SEQ ID NO: 1712427 - RNA, 15 nt, Salmonella enterica enterica serovar Typhi
aggcauggcagcagg

SEQ ID NO: 1712428 - RNA, 13 nt, Salmonella enterica enterica serovar Typhi
aggccaaaaccac

SEQ ID NO: 1712429 - RNA, 19 nt, Salmonella enterica enterica serovar Typhi
aggcauuuaugccgccauc

SEQ ID NO: 1712430 - RNA, 20 nt, Salmonella enterica enterica serovar Typhi
aggccaaacccugcgccgca

SEQ ID NO: 1712431 - RNA, 18 nt, Salmonella enterica enterica serovar Typhi
aggccaaauagaacgcuc

SEQ ID NO: 1712432 - RNA, 21 nt, Salmonella enterica enterica serovar Typhi
aggauggccagcaccagcauu

SEQ ID NO: 1712433 - RNA, 22 nt, Salmonella enterica enterica serovar Typhi
aggaugccccaucucuuucaga

SEQ ID NO: 1712434 - RNA, 22 nt, Salmonella enterica enterica serovar Typhi
aggaucguaacaggucacgaca

SEQ ID NO: 1712435 - RNA, 14 nt, Salmonella enterica enterica serovar Typhi
aggaucguaaugau

SEQ ID NO: 1712436 - RNA, 14 nt, Salmonella enterica enterica serovar Typhi
aggaugaacucuau

SEQ ID NO: 1712437 - RNA, 13 nt, Salmonella enterica enterica serovar Typhi
aggaugagcguuu

SEQ ID NO: 1712438 - RNA, 20 nt, Salmonella enterica enterica serovar Typhi
aggcaaacgcggugaaggca

SEQ ID NO: 1712439 - RNA, 20 nt, Salmonella enterica enterica serovar Typhi
aggcaaacaccucagccacc

SEQ ID NO: 1712440 - RNA, 12 nt, Salmonella enterica enterica serovar Typhi
aggcaaaccagc

SEQ ID NO: 1712441 - RNA, 18 nt, Salmonella enterica enterica serovar Typhi
aggcaaaaauaggcuuuu

SEQ ID NO: 1712442 - RNA, 13 nt, Salmonella enterica enterica serovar Typhi
aggauugcuguga

SEQ ID NO: 1712443 - RNA, 22 nt, Salmonella enterica enterica serovar Typhi
aggcaccguuucuuugcugccg

SEQ ID NO: 1712444 - RNA, 21 nt, Salmonella enterica enterica serovar Typhi
aggcaccuguaaccuuaaaag

SEQ ID NO: 1712445 - RNA, 18 nt, Salmonella enterica enterica serovar Typhi
aggcaccugugccauacu

SEQ ID NO: 1712446 - RNA, 15 nt, Salmonella enterica enterica serovar Typhi
aggcagauucuucug

SEQ ID NO: 1712447 - RNA, 14 nt, Salmonella enterica enterica serovar Typhi
aggcagcacaauca

SEQ ID NO: 1712448 - RNA, 14 nt, Salmonella enterica enterica serovar Typhi
aggcacuguggugu

SEQ ID NO: 1712449 - RNA, 20 nt, Salmonella enterica enterica serovar Typhi
aggcacuuuccagaccaaga

SEQ ID NO: 1712450 - RNA, 23 nt, Salmonella enterica enterica serovar Typhi
aggcaauucuggcgcacauugcu

SEQ ID NO: 1712451 - RNA, 19 nt, Salmonella enterica enterica serovar Typhi
aggcaauagaccagcggcc

SEQ ID NO: 1712452 - RNA, 19 nt, Salmonella enterica enterica serovar Typhi
aggcaauaaaaaaggcaga

SEQ ID NO: 1712453 - RNA, 12 nt, Salmonella enterica enterica serovar Typhi
aggcaauauccu

SEQ ID NO: 1712454 - RNA, 14 nt, Salmonella enterica enterica serovar Typhi
aggcaauauccucc

SEQ ID NO: 1712455 - RNA, 17 nt, Salmonella enterica enterica serovar Typhi
aggcaaagcauaggcca

SEQ ID NO: 1712456 - RNA, 20 nt, Salmonella enterica enterica serovar Typhi
aggcaaagcauaggccacga

SEQ ID NO: 1712457 - RNA, 14 nt, Salmonella enterica enterica serovar Typhi
aggcaaaggaaugc

SEQ ID NO: 1712458 - RNA, 16 nt, Salmonella enterica enterica serovar Typhi
auaagccagguuuuca

SEQ ID NO: 1712459 - RNA, 12 nt, Salmonella enterica enterica serovar Typhi
auaagccagccc

SEQ ID NO: 1712460 - RNA, 17 nt, Salmonella enterica enterica serovar Typhi
auaagccacuucaacca

SEQ ID NO: 1712461 - RNA, 13 nt, Salmonella enterica enterica serovar Typhi
auaagcugaaugg

SEQ ID NO: 1712462 - RNA, 19 nt, Salmonella enterica enterica serovar Typhi
auaagcugcgacaacaagu

SEQ ID NO: 1712463 - RNA, 18 nt, Salmonella enterica enterica serovar Typhi
auaagcuuaggauaagaa

SEQ ID NO: 1712464 - RNA, 12 nt, Salmonella enterica enterica serovar Typhi
auaagcuuuaac

SEQ ID NO: 1712465 - RNA, 16 nt, Salmonella enterica enterica serovar Typhi
auaagaaguaaacaga

SEQ ID NO: 1712466 - RNA, 18 nt, Salmonella enterica enterica serovar Typhi
auaagaccaauacgaucg

SEQ ID NO: 1712467 - RNA, 19 nt, Salmonella enterica enterica serovar Typhi
auaagacgacgguuaaaaa

SEQ ID NO: 1712468 - RNA, 14 nt, Salmonella enterica enterica serovar Typhi
auaagacgcagggc

SEQ ID NO: 1712469 - RNA, 15 nt, Salmonella enterica enterica serovar Typhi
auaagagaaaauacc

SEQ ID NO: 1712470 - RNA, 15 nt, Salmonella enterica enterica serovar Typhi
auaaggcagcaaugu

SEQ ID NO: 1712471 - RNA, 23 nt, Salmonella enterica enterica serovar Typhi
auaaggcgcuugcgccaucaucc

SEQ ID NO: 1712472 - RNA, 15 nt, Salmonella enterica enterica serovar Typhi
auaagggcuugucag

SEQ ID NO: 1712473 - RNA, 20 nt, Salmonella enterica enterica serovar Typhi
auaaggucgcuauccagcag

SEQ ID NO: 1712474 - RNA, 16 nt, Salmonella enterica enterica serovar Typhi
auaagguucuggcauu

SEQ ID NO: 1712475 - RNA, 14 nt, Salmonella enterica enterica serovar Typhi
auaaguuuuuucuu

SEQ ID NO: 1712476 - RNA, 23 nt, Salmonella enterica enterica serovar Typhi
auaauaaaugccgucgcuuucau

SEQ ID NO: 1712477 - RNA, 18 nt, Salmonella enterica enterica serovar Typhi
auaagugcauguaaauaa

SEQ ID NO: 1712478 - RNA, 20 nt, Salmonella enterica enterica serovar Typhi
auaaguuagcuuuuuuaugc

SEQ ID NO: 1712479 - RNA, 15 nt, Salmonella enterica enterica serovar Typhi
auaaucguuuuaugc

SEQ ID NO: 1712480 - RNA, 20 nt, Salmonella enterica enterica serovar Typhi
auaaucgguagcacuuuaaa

SEQ ID NO: 1712481 - RNA, 21 nt, Salmonella enterica enterica serovar Typhi
auaaucgccgacuaauuauuu

SEQ ID NO: 1712482 - RNA, 14 nt, Salmonella enterica enterica serovar Typhi
auaaucgccgccgg

SEQ ID NO: 1712483 - RNA, 22 nt, Salmonella enterica enterica serovar Typhi
auaaucgguagcacuuuaaaca

SEQ ID NO: 1712484 - RNA, 13 nt, Salmonella enterica enterica serovar Typhi
auaaucagcagcg

SEQ ID NO: 1712485 - RNA, 13 nt, Salmonella enterica enterica serovar Typhi
auaaucagcgcuc

SEQ ID NO: 1712486 - RNA, 16 nt, Salmonella enterica enterica serovar Typhi
auaaucgaccguaucc

SEQ ID NO: 1712487 - RNA, 17 nt, Salmonella enterica enterica serovar Typhi
auaaucgauuccuauuu

SEQ ID NO: 1712488 - RNA, 19 nt, Salmonella enterica enterica serovar Typhi
auaaucacauuaugcuggg

SEQ ID NO: 1712489 - RNA, 14 nt, Salmonella enterica enterica serovar Typhi
auaaucaccacgua

SEQ ID NO: 1712490 - RNA, 15 nt, Salmonella enterica enterica serovar Typhi
auaauggaacugccu

SEQ ID NO: 1712491 - RNA, 16 nt, Salmonella enterica enterica serovar Typhi
auaauggagaacccag

SEQ ID NO: 1712492 - RNA, 13 nt, Salmonella enterica enterica serovar Typhi
auaaugccgccgu

SEQ ID NO: 1712493 - RNA, 18 nt, Salmonella enterica enterica serovar Typhi
auaauguugguaaauuua

SEQ ID NO: 1712494 - RNA, 13 nt, Salmonella enterica enterica serovar Typhi
auaaugugcgcga

SEQ ID NO: 1712495 - RNA, 19 nt, Salmonella enterica enterica serovar Typhi
auaauggcgcgaaaacagc

SEQ ID NO: 1712496 - RNA, 16 nt, Salmonella enterica enterica serovar Typhi
auaauuaagaccauac

SEQ ID NO: 1712497 - RNA, 20 nt, Salmonella enterica enterica serovar Typhi
auaauaauuaccacgcagcc

SEQ ID NO: 1712498 - RNA, 23 nt, Salmonella enterica enterica serovar Typhi
auaauacaccgccauauauuuac

SEQ ID NO: 1712499 - RNA, 22 nt, Salmonella enterica enterica serovar Typhi
auaauaagcggccuauauuagu

SEQ ID NO: 1712500 - RNA, 17 nt, Salmonella enterica enterica serovar Typhi
auaauagcugaaaagau

SEQ ID NO: 1712501 - RNA, 21 nt, Salmonella enterica enterica serovar Typhi
auaauagcugaaaagauaaag

SEQ ID NO: 1712502 - RNA, 11 nt, Salmonella enterica enterica serovar Typhi
auaauacuuaa

SEQ ID NO: 1712503 - RNA, 15 nt, Salmonella enterica enterica serovar Typhi
auaauagaacccaaa

SEQ ID NO: 1712504 - RNA, 16 nt, Salmonella enterica enterica serovar Typhi
auaauaugcucaacuu

SEQ ID NO: 1712505 - RNA, 20 nt, Salmonella enterica enterica serovar Typhi
auaaucaauggccuugccag

SEQ ID NO: 1712506 - RNA, 14 nt, Salmonella enterica enterica serovar Typhi
auaaucaaacccuu

SEQ ID NO: 1712507 - RNA, 12 nt, Salmonella enterica enterica serovar Typhi
auaaucaaccau

SEQ ID NO: 1712508 - RNA, 14 nt, Salmonella enterica enterica serovar Typhi
auaaucaaccauac

SEQ ID NO: 1712509 - RNA, 18 nt, Salmonella enterica enterica serovar Typhi
auaauauuaucauaaugu

SEQ ID NO: 1712510 - RNA, 21 nt, Salmonella enterica enterica serovar Typhi
auaauauuauccuuuaauuaa

SEQ ID NO: 1712511 - RNA, 16 nt, Salmonella enterica enterica serovar Typhi
auaaaguagccaaugc

SEQ ID NO: 1712512 - RNA, 20 nt, Salmonella enterica enterica serovar Typhi
auaaaggucaaacaccugaa

SEQ ID NO: 1712513 - RNA, 21 nt, Salmonella enterica enterica serovar Typhi
auaaaggucacaucaucgcca

SEQ ID NO: 1712514 - RNA, 16 nt, Salmonella enterica enterica serovar Typhi
auaaagcgaauaacau

SEQ ID NO: 1712515 - RNA, 18 nt, Salmonella enterica enterica serovar Typhi
auaaagcccuguuauuca

SEQ ID NO: 1712516 - RNA, 14 nt, Salmonella enterica enterica serovar Typhi
auaaagcauaaaua

SEQ ID NO: 1712517 - RNA, 16 nt, Salmonella enterica enterica serovar Typhi
auaaagcauaaauaca

SEQ ID NO: 1712518 - RNA, 12 nt, Salmonella enterica enterica serovar Typhi
auaaagcagggc

SEQ ID NO: 1712519 - RNA, 15 nt, Salmonella enterica enterica serovar Typhi
auaaagcuuucaucu

SEQ ID NO: 1712520 - RNA, 18 nt, Salmonella enterica enterica serovar Typhi
auaaauauucaucaaaau

SEQ ID NO: 1712521 - RNA, 21 nt, Salmonella enterica enterica serovar Typhi
auaaauaacauuucagucuaa

SEQ ID NO: 1712522 - RNA, 18 nt, Salmonella enterica enterica serovar Typhi
auaaauauuaaugaauaa

SEQ ID NO: 1712523 - RNA, 17 nt, Salmonella enterica enterica serovar Typhi
auaaaucgcagauagca

SEQ ID NO: 1712524 - RNA, 14 nt, Salmonella enterica enterica serovar Typhi
auaaacucagcaau

SEQ ID NO: 1712525 - RNA, 21 nt, Salmonella enterica enterica serovar Typhi
auaaacucuguguuaugaaug

SEQ ID NO: 1712526 - RNA, 12 nt, Salmonella enterica enterica serovar Typhi
auaaagauggca

SEQ ID NO: 1712527 - RNA, 22 nt, Salmonella enterica enterica serovar Typhi
auaaacuucaauucagaaaguu

SEQ ID NO: 1712528 - RNA, 21 nt, Salmonella enterica enterica serovar Typhi
auaaacuucaauucagaaagu

SEQ ID NO: 1712529 - RNA, 14 nt, Salmonella enterica enterica serovar Typhi
auaaaccaacagcc

SEQ ID NO: 1712530 - RNA, 15 nt, Salmonella enterica enterica serovar Typhi
auaaacacagcaaac

SEQ ID NO: 1712531 - RNA, 16 nt, Salmonella enterica enterica serovar Typhi
auaaaaagccagggaa

SEQ ID NO: 1712532 - RNA, 14 nt, Salmonella enterica enterica serovar Typhi
auaaaaaacaucau

SEQ ID NO: 1712533 - RNA, 12 nt, Salmonella enterica enterica serovar Typhi
auaaaaauaaau

SEQ ID NO: 1712534 - RNA, 18 nt, Salmonella enterica enterica serovar Typhi
auaacaccgcauggcugg

SEQ ID NO: 1712535 - RNA, 14 nt, Salmonella enterica enterica serovar Typhi
auaaauuuuuuaac

SEQ ID NO: 1712536 - RNA, 19 nt, Salmonella enterica enterica serovar Typhi
auaaauuugucagacauga

SEQ ID NO: 1712537 - RNA, 17 nt, Salmonella enterica enterica serovar Typhi
auaacagccagcgggcg

SEQ ID NO: 1712538 - RNA, 21 nt, Salmonella enterica enterica serovar Typhi
auaaccaaacgcgcauuuuau

SEQ ID NO: 1712539 - RNA, 14 nt, Salmonella enterica enterica serovar Typhi
auaaccgcccgcgg

SEQ ID NO: 1712540 - RNA, 22 nt, Salmonella enterica enterica serovar Typhi
auaaccgccgccgcgcccgcgu

SEQ ID NO: 1712541 - RNA, 14 nt, Salmonella enterica enterica serovar Typhi
auaaccaauaauug

SEQ ID NO: 1712542 - RNA, 20 nt, Salmonella enterica enterica serovar Typhi
auaacuuuccugccuucuga

SEQ ID NO: 1712543 - RNA, 20 nt, Salmonella enterica enterica serovar Typhi
auaacuuccuuugccuuucu

SEQ ID NO: 1712544 - RNA, 22 nt, Salmonella enterica enterica serovar Typhi
auaacuuuuuaagcucccgcca

SEQ ID NO: 1712545 - RNA, 15 nt, Salmonella enterica enterica serovar Typhi
auaagaacuuuauca

SEQ ID NO: 1712546 - RNA, 20 nt, Salmonella enterica enterica serovar Typhi
auaacguuaccgcagcgaau

SEQ ID NO: 1712547 - RNA, 15 nt, Salmonella enterica enterica serovar Typhi
auaacguuguggaau

SEQ ID NO: 1712548 - RNA, 18 nt, Salmonella enterica enterica serovar Typhi
auaacucaauagcggugc

SEQ ID NO: 1712549 - RNA, 22 nt, Salmonella enterica enterica serovar Typhi
auaacuauaauugcuuuuuucc

SEQ ID NO: 1712550 - RNA, 19 nt, Salmonella enterica enterica serovar Typhi
auaaccucaaugauuuccg

SEQ ID NO: 1712551 - RNA, 19 nt, Salmonella enterica enterica serovar Typhi
auaacguuacauuuuccau

SEQ ID NO: 1712552 - RNA, 22 nt, Salmonella enterica enterica serovar Typhi
auaaccggugccgaaaucauca

SEQ ID NO: 1712553 - RNA, 16 nt, Salmonella enterica enterica serovar Typhi
auaaccuauuuugcaa

SEQ ID NO: 1712554 - RNA, 13 nt, Salmonella enterica enterica serovar Typhi
agucugaaaauaa

SEQ ID NO: 1712555 - RNA, 16 nt, Salmonella enterica enterica serovar Typhi
agucugaaaauaauug

SEQ ID NO: 1712556 - RNA, 17 nt, Salmonella enterica enterica serovar Typhi
agucugaccgucagccc

SEQ ID NO: 1712557 - RNA, 16 nt, Salmonella enterica enterica serovar Typhi
agucuucauggucgga

SEQ ID NO: 1712558 - RNA, 22 nt, Salmonella enterica enterica serovar Typhi
agugacauuauucaccuggauu

SEQ ID NO: 1712559 - RNA, 22 nt, Salmonella enterica enterica serovar Typhi
agugacagaggaaugaaaacga

SEQ ID NO: 1712560 - RNA, 22 nt, Salmonella enterica enterica serovar Typhi
agugacaaacucacguucccca

SEQ ID NO: 1712561 - RNA, 19 nt, Salmonella enterica enterica serovar Typhi
agucuuuuguuuuucucuu

SEQ ID NO: 1712562 - RNA, 17 nt, Salmonella enterica enterica serovar Typhi
aguccuucuucccccug

SEQ ID NO: 1712563 - RNA, 21 nt, Salmonella enterica enterica serovar Typhi
aguccguggagaguuuugccg

SEQ ID NO: 1712564 - RNA, 20 nt, Salmonella enterica enterica serovar Typhi
aguccgucagaauaucuuuu

SEQ ID NO: 1712565 - RNA, 17 nt, Salmonella enterica enterica serovar Typhi
aguccgguauaaaacgu

SEQ ID NO: 1712566 - RNA, 17 nt, Salmonella enterica enterica serovar Typhi
aguccgguggcgaaaac

SEQ ID NO: 1712567 - RNA, 15 nt, Salmonella enterica enterica serovar Typhi
aguacccucugcacc

SEQ ID NO: 1712568 - RNA, 18 nt, Salmonella enterica enterica serovar Typhi
aguaccgaacagccaggc

SEQ ID NO: 1712569 - RNA, 19 nt, Salmonella enterica enterica serovar Typhi
aguaccgaacagccaggcu

SEQ ID NO: 1712570 - RNA, 20 nt, Salmonella enterica enterica serovar Typhi
aguaccgaacagccaggcuu

SEQ ID NO: 1712571 - RNA, 21 nt, Salmonella enterica enterica serovar Typhi
aguaccgaacagccaggcuuu

SEQ ID NO: 1712572 - RNA, 14 nt, Salmonella enterica enterica serovar Typhi
aguccggcgaaaaa

SEQ ID NO: 1712573 - RNA, 18 nt, Salmonella enterica enterica serovar Typhi
aguaccgguuagcucaac

SEQ ID NO: 1712574 - RNA, 21 nt, Salmonella enterica enterica serovar Typhi
aguccgcuuuucguccccuau

SEQ ID NO: 1712575 - RNA, 22 nt, Salmonella enterica enterica serovar Typhi
aguccgcuuuucguccccuaua

SEQ ID NO: 1712576 - RNA, 21 nt, Salmonella enterica enterica serovar Typhi
agucgccaugaguucaauaug

SEQ ID NO: 1712577 - RNA, 19 nt, Salmonella enterica enterica serovar Typhi
agucgcauccaguggugaa

SEQ ID NO: 1712578 - RNA, 14 nt, Salmonella enterica enterica serovar Typhi
agucgccaggcaag

SEQ ID NO: 1712579 - RNA, 18 nt, Salmonella enterica enterica serovar Typhi
agucguuaucugacauau

SEQ ID NO: 1712580 - RNA, 16 nt, Salmonella enterica enterica serovar Typhi
agucucuacuacauau

SEQ ID NO: 1712581 - RNA, 14 nt, Salmonella enterica enterica serovar Typhi
aguggaucagcaga

SEQ ID NO: 1712582 - RNA, 14 nt, Salmonella enterica enterica serovar Typhi
agugcugaaaaucg

SEQ ID NO: 1712583 - RNA, 20 nt, Salmonella enterica enterica serovar Typhi
agugcugaaaaucgucucuc

SEQ ID NO: 1712584 - RNA, 14 nt, Salmonella enterica enterica serovar Typhi
agugcugaacaaua

SEQ ID NO: 1712585 - RNA, 14 nt, Salmonella enterica enterica serovar Typhi
aguggaaucagcca

SEQ ID NO: 1712586 - RNA, 14 nt, Salmonella enterica enterica serovar Typhi
agugcguuaacccg

SEQ ID NO: 1712587 - RNA, 21 nt, Salmonella enterica enterica serovar Typhi
agugcgcauacuaccgcugcg

SEQ ID NO: 1712588 - RNA, 19 nt, Salmonella enterica enterica serovar Typhi
agugcgaugggcuucagau

SEQ ID NO: 1712589 - RNA, 20 nt, Salmonella enterica enterica serovar Typhi
agugccggugacaugaaaau

SEQ ID NO: 1712590 - RNA, 11 nt, Salmonella enterica enterica serovar Typhi
agugccugccg

SEQ ID NO: 1712591 - RNA, 18 nt, Salmonella enterica enterica serovar Typhi
agugcaguauugcaccag

SEQ ID NO: 1712592 - RNA, 18 nt, Salmonella enterica enterica serovar Typhi
agugcauguacaacuuca

SEQ ID NO: 1712593 - RNA, 22 nt, Salmonella enterica enterica serovar Typhi
agugcauguacaacuucaugag

SEQ ID NO: 1712594 - RNA, 21 nt, Salmonella enterica enterica serovar Typhi
agugcagcggaugcucuuuac

SEQ ID NO: 1712595 - RNA, 19 nt, Salmonella enterica enterica serovar Typhi
agugacguuaucugucagc

SEQ ID NO: 1712596 - RNA, 16 nt, Salmonella enterica enterica serovar Typhi
agugacugacacccau

SEQ ID NO: 1712597 - RNA, 17 nt, Salmonella enterica enterica serovar Typhi
agugucgccauaaauca

SEQ ID NO: 1712598 - RNA, 23 nt, Salmonella enterica enterica serovar Typhi
aguguccuuacggacgugggggu

SEQ ID NO: 1712599 - RNA, 12 nt, Salmonella enterica enterica serovar Typhi
agugguggguga

SEQ ID NO: 1712600 - RNA, 22 nt, Salmonella enterica enterica serovar Typhi
agugguucguccaucaguucuu

SEQ ID NO: 1712601 - RNA, 17 nt, Salmonella enterica enterica serovar Typhi
agugguuccaggcgcgc

SEQ ID NO: 1712602 - RNA, 15 nt, Salmonella enterica enterica serovar Typhi
agugguuccauucca

SEQ ID NO: 1712603 - RNA, 14 nt, Salmonella enterica enterica serovar Typhi
aguggugggugaug

SEQ ID NO: 1712604 - RNA, 16 nt, Salmonella enterica enterica serovar Typhi
aguucccacagcuuca

SEQ ID NO: 1712605 - RNA, 11 nt, Salmonella enterica enterica serovar Typhi
aguuccuccug

SEQ ID NO: 1712606 - RNA, 15 nt, Salmonella enterica enterica serovar Typhi
aguuccaaucucuuu

SEQ ID NO: 1712607 - RNA, 14 nt, Salmonella enterica enterica serovar Typhi
aguuauaaauuuau

SEQ ID NO: 1712608 - RNA, 18 nt, Salmonella enterica enterica serovar Typhi
aguucaaauucuucccgg

SEQ ID NO: 1712609 - RNA, 19 nt, Salmonella enterica enterica serovar Typhi
aguucaaauucuucccggc

SEQ ID NO: 1712610 - RNA, 17 nt, Salmonella enterica enterica serovar Typhi
aguucaaguuuagaaaa

SEQ ID NO: 1712611 - RNA, 16 nt, Salmonella enterica enterica serovar Typhi
aguguguaccagcagc

SEQ ID NO: 1712612 - RNA, 17 nt, Salmonella enterica enterica serovar Typhi
aguguguaccagcagcg

SEQ ID NO: 1712613 - RNA, 14 nt, Salmonella enterica enterica serovar Typhi
aguguggcaccugc

SEQ ID NO: 1712614 - RNA, 20 nt, Salmonella enterica enterica serovar Typhi
aguguggaugucauaauugc

SEQ ID NO: 1712615 - RNA, 19 nt, Salmonella enterica enterica serovar Typhi
agugugauaagccccuuua

SEQ ID NO: 1712616 - RNA, 22 nt, Salmonella enterica enterica serovar Typhi
agugugcaaacgauaaaagcuc

SEQ ID NO: 1712617 - RNA, 19 nt, Salmonella enterica enterica serovar Typhi
aguguuaacuuccucuuuc

SEQ ID NO: 1712618 - RNA, 21 nt, Salmonella enterica enterica serovar Typhi
aguguuauauucccgaaaggu

SEQ ID NO: 1712619 - RNA, 16 nt, Salmonella enterica enterica serovar Typhi
aguuacggacaugcga

SEQ ID NO: 1712620 - RNA, 18 nt, Salmonella enterica enterica serovar Typhi
aguuuaaacacucuccac

SEQ ID NO: 1712621 - RNA, 18 nt, Salmonella enterica enterica serovar Typhi
aguuuaaccguuccaacg

SEQ ID NO: 1712622 - RNA, 15 nt, Salmonella enterica enterica serovar Typhi
aguuuaauucuuuga

SEQ ID NO: 1712623 - RNA, 15 nt, Salmonella enterica enterica serovar Typhi
aguuggcagggcuga

SEQ ID NO: 1712624 - RNA, 18 nt, Salmonella enterica enterica serovar Typhi
aguuguuccgcgcugaug

SEQ ID NO: 1712625 - RNA, 17 nt, Salmonella enterica enterica serovar Typhi
aguuguucacgggaacg

SEQ ID NO: 1712626 - RNA, 14 nt, Salmonella enterica enterica serovar Typhi
aguugcuggagcag

SEQ ID NO: 1712627 - RNA, 16 nt, Salmonella enterica enterica serovar Typhi
aguugcuggauucucu

SEQ ID NO: 1712628 - RNA, 22 nt, Salmonella enterica enterica serovar Typhi
aguugcuuaccuuguucuucca

SEQ ID NO: 1712629 - RNA, 20 nt, Salmonella enterica enterica serovar Typhi
aguugcuucguuaccgguga

SEQ ID NO: 1712630 - RNA, 21 nt, Salmonella enterica enterica serovar Typhi
aguugcagauuacugagcagu

SEQ ID NO: 1712631 - RNA, 18 nt, Salmonella enterica enterica serovar Typhi
aguugauucgcuaauaau

SEQ ID NO: 1712632 - RNA, 16 nt, Salmonella enterica enterica serovar Typhi
aguugaacgguaaaca

SEQ ID NO: 1712633 - RNA, 14 nt, Salmonella enterica enterica serovar Typhi
aguucuucauuuau

SEQ ID NO: 1712634 - RNA, 14 nt, Salmonella enterica enterica serovar Typhi
aguuuuuuucugcc

SEQ ID NO: 1712635 - RNA, 18 nt, Salmonella enterica enterica serovar Typhi
aguuuuuugaccauucca

SEQ ID NO: 1712636 - RNA, 22 nt, Salmonella enterica enterica serovar Typhi
aguuuuuucuuacuaauaaaua

SEQ ID NO: 1712637 - RNA, 16 nt, Salmonella enterica enterica serovar Typhi
aguuuugcuucaugca

SEQ ID NO: 1712638 - RNA, 19 nt, Salmonella enterica enterica serovar Typhi
aguuuugcuucaugcacaa

SEQ ID NO: 1712639 - RNA, 10 nt, Salmonella enterica enterica serovar Typhi
aguuuuaacg

SEQ ID NO: 1712640 - RNA, 16 nt, Salmonella enterica enterica serovar Typhi
aguuucgacuuucauu

SEQ ID NO: 1712641 - RNA, 14 nt, Salmonella enterica enterica serovar Typhi
aguuuccgguaaau

SEQ ID NO: 1712642 - RNA, 22 nt, Salmonella enterica enterica serovar Typhi
aguuuacgagugcguucuucca

SEQ ID NO: 1712643 - RNA, 23 nt, Salmonella enterica enterica serovar Typhi
aguuugccccauuguucuuucau

SEQ ID NO: 1712644 - RNA, 13 nt, Salmonella enterica enterica serovar Typhi
aguuugucaucca

SEQ ID NO: 1712645 - RNA, 15 nt, Salmonella enterica enterica serovar Typhi
aguuugcaauccaga

SEQ ID NO: 1712646 - RNA, 14 nt, Salmonella enterica enterica serovar Typhi
aguuucuuaccuac

SEQ ID NO: 1712647 - RNA, 13 nt, Salmonella enterica enterica serovar Typhi
aucacgcaucacu

SEQ ID NO: 1712648 - RNA, 13 nt, Salmonella enterica enterica serovar Typhi
aucacgcccagcg

SEQ ID NO: 1712649 - RNA, 18 nt, Salmonella enterica enterica serovar Typhi
aucacgccguccagcacc

SEQ ID NO: 1712650 - RNA, 22 nt, Salmonella enterica enterica serovar Typhi
aucacgcuaagucaacucaugc

SEQ ID NO: 1712651 - RNA, 15 nt, Salmonella enterica enterica serovar Typhi
aucacgguacgcauc

SEQ ID NO: 1712652 - RNA, 15 nt, Salmonella enterica enterica serovar Typhi
aucaccugcaucacg

SEQ ID NO: 1712653 - RNA, 23 nt, Salmonella enterica enterica serovar Typhi
aucaccugcuggcggcguaagcg

SEQ ID NO: 1712654 - RNA, 18 nt, Salmonella enterica enterica serovar Typhi
aucaccuucuuuggcuua

SEQ ID NO: 1712655 - RNA, 13 nt, Salmonella enterica enterica serovar Typhi
aucacugcaccuc

SEQ ID NO: 1712656 - RNA, 13 nt, Salmonella enterica enterica serovar Typhi
aucacugauauaa

SEQ ID NO: 1712657 - RNA, 13 nt, Salmonella enterica enterica serovar Typhi
aucacuaauuugc

SEQ ID NO: 1712658 - RNA, 14 nt, Salmonella enterica enterica serovar Typhi
aucacuaauuugcg

SEQ ID NO: 1712659 - RNA, 22 nt, Salmonella enterica enterica serovar Typhi
aucacuaacugaccauauauga

SEQ ID NO: 1712660 - RNA, 15 nt, Salmonella enterica enterica serovar Typhi
aucacuaagaccagc

SEQ ID NO: 1712661 - RNA, 17 nt, Salmonella enterica enterica serovar Typhi
aucacguuccuuuacuu

SEQ ID NO: 1712662 - RNA, 21 nt, Salmonella enterica enterica serovar Typhi
aucacguuggggaauaaauau

SEQ ID NO: 1712663 - RNA, 19 nt, Salmonella enterica enterica serovar Typhi
aucacccugaauuucaaua

SEQ ID NO: 1712664 - RNA, 22 nt, Salmonella enterica enterica serovar Typhi
aucaccagcgcaucucccugcc

SEQ ID NO: 1712665 - RNA, 22 nt, Salmonella enterica enterica serovar Typhi
aucaccgcugacugaacucauc

SEQ ID NO: 1712666 - RNA, 16 nt, Salmonella enterica enterica serovar Typhi
aucaccucuuucucca

SEQ ID NO: 1712667 - RNA, 17 nt, Salmonella enterica enterica serovar Typhi
aucaccucuuucuccac

SEQ ID NO: 1712668 - RNA, 19 nt, Salmonella enterica enterica serovar Typhi
aucaccucgcuucccugac

SEQ ID NO: 1712669 - RNA, 16 nt, Salmonella enterica enterica serovar Typhi
aucaccguuuuccagg

SEQ ID NO: 1712670 - RNA, 13 nt, Salmonella enterica enterica serovar Typhi
aucaccggcauuu

SEQ ID NO: 1712671 - RNA, 16 nt, Salmonella enterica enterica serovar Typhi
aucacagggggaacau

SEQ ID NO: 1712672 - RNA, 20 nt, Salmonella enterica enterica serovar Typhi
aucaccagcccgaauccacu

SEQ ID NO: 1712673 - RNA, 13 nt, Salmonella enterica enterica serovar Typhi
aucaccaccucaa

SEQ ID NO: 1712674 - RNA, 17 nt, Salmonella enterica enterica serovar Typhi
aucacauuaugcugggu

SEQ ID NO: 1712675 - RNA, 21 nt, Salmonella enterica enterica serovar Typhi
aucacaugcgggagcaaaaua

SEQ ID NO: 1712676 - RNA, 18 nt, Salmonella enterica enterica serovar Typhi
aucacaucgcgcagcagg

SEQ ID NO: 1712677 - RNA, 17 nt, Salmonella enterica enterica serovar Typhi
aucacauccgccagcgc

SEQ ID NO: 1712678 - RNA, 12 nt, Salmonella enterica enterica serovar Typhi
aucagcaaaaua

SEQ ID NO: 1712679 - RNA, 13 nt, Salmonella enterica enterica serovar Typhi
aucagcagaucca

SEQ ID NO: 1712680 - RNA, 16 nt, Salmonella enterica enterica serovar Typhi
aucagcaggauagcga

SEQ ID NO: 1712681 - RNA, 13 nt, Salmonella enterica enterica serovar Typhi
aucagcaucccac

SEQ ID NO: 1712682 - RNA, 21 nt, Salmonella enterica enterica serovar Typhi
aucagccagccgccaaaaaua

SEQ ID NO: 1712683 - RNA, 14 nt, Salmonella enterica enterica serovar Typhi
aucagcgccaccac

SEQ ID NO: 1712684 - RNA, 14 nt, Salmonella enterica enterica serovar Typhi
aucagcgagacagc

SEQ ID NO: 1712685 - RNA, 18 nt, Salmonella enterica enterica serovar Typhi
aucagccguuacuucccc

SEQ ID NO: 1712686 - RNA, 15 nt, Salmonella enterica enterica serovar Typhi
aucagcgaaggcaac

SEQ ID NO: 1712687 - RNA, 14 nt, Salmonella enterica enterica serovar Typhi
aucagcgacucauu

SEQ ID NO: 1712688 - RNA, 12 nt, Salmonella enterica enterica serovar Typhi
aucagccaggcg

SEQ ID NO: 1712689 - RNA, 14 nt, Salmonella enterica enterica serovar Typhi
aucagcgccagccc

SEQ ID NO: 1712690 - RNA, 16 nt, Salmonella enterica enterica serovar Typhi
aucagcgcaauaaauu

SEQ ID NO: 1712691 - RNA, 15 nt, Salmonella enterica enterica serovar Typhi
aucagcgccagcccu

SEQ ID NO: 1712692 - RNA, 13 nt, Salmonella enterica enterica serovar Typhi
aucagcgccuccg

SEQ ID NO: 1712693 - RNA, 15 nt, Salmonella enterica enterica serovar Typhi
aucagcgcuaccagc

SEQ ID NO: 1712694 - RNA, 20 nt, Salmonella enterica enterica serovar Typhi
aucagcgcgcuccagaccac

SEQ ID NO: 1712695 - RNA, 18 nt, Salmonella enterica enterica serovar Typhi
aucagagacaaauacaug

SEQ ID NO: 1712696 - RNA, 20 nt, Salmonella enterica enterica serovar Typhi
aucagauacggcuccagcac

SEQ ID NO: 1712697 - RNA, 19 nt, Salmonella enterica enterica serovar Typhi
aucagauacggcuccagca

SEQ ID NO: 1712698 - RNA, 18 nt, Salmonella enterica enterica serovar Typhi
aucagauaucccugcaaa

SEQ ID NO: 1712699 - RNA, 18 nt, Salmonella enterica enterica serovar Typhi
aucagauauuccagcgac

SEQ ID NO: 1712700 - RNA, 15 nt, Salmonella enterica enterica serovar Typhi
aucagauuguugccg

SEQ ID NO: 1712701 - RNA, 23 nt, Salmonella enterica enterica serovar Typhi
aucagacguuuauaccccaccau

SEQ ID NO: 1712702 - RNA, 14 nt, Salmonella enterica enterica serovar Typhi
aucagacuaucuuc

SEQ ID NO: 1712703 - RNA, 18 nt, Salmonella enterica enterica serovar Typhi
aucagaccuguaaaaaaa

SEQ ID NO: 1712704 - RNA, 18 nt, Salmonella enterica enterica serovar Typhi
aucagaccgagacccagc

SEQ ID NO: 1712705 - RNA, 16 nt, Salmonella enterica enterica serovar Typhi
aucagacgcacaaucg

SEQ ID NO: 1712706 - RNA, 12 nt, Salmonella enterica enterica serovar Typhi
aucagacgcauc

SEQ ID NO: 1712707 - RNA, 21 nt, Salmonella enterica enterica serovar Typhi
aucacuggagcgcauuuuacu

SEQ ID NO: 1712708 - RNA, 14 nt, Salmonella enterica enterica serovar Typhi
aucacuuccgccac

SEQ ID NO: 1712709 - RNA, 10 nt, Salmonella enterica enterica serovar Typhi
aucacuucca

SEQ ID NO: 1712710 - RNA, 20 nt, Salmonella enterica enterica serovar Typhi
aucacuuccgccaccacgcc

SEQ ID NO: 1712711 - RNA, 17 nt, Salmonella enterica enterica serovar Typhi
aucacuuucacccaugc

SEQ ID NO: 1712712 - RNA, 13 nt, Salmonella enterica enterica serovar Typhi
aucacuuucaguu

SEQ ID NO: 1712713 - RNA, 15 nt, Salmonella enterica enterica serovar Typhi
aucagaagaaauauu

SEQ ID NO: 1712714 - RNA, 15 nt, Salmonella enterica enterica serovar Typhi
aucagaagaagacaa

SEQ ID NO: 1712715 - RNA, 12 nt, Salmonella enterica enterica serovar Typhi
aucagaagcuuc

SEQ ID NO: 1712716 - RNA, 15 nt, Salmonella enterica enterica serovar Typhi
aucagaauaguuuug

SEQ ID NO: 1712717 - RNA, 15 nt, Salmonella enterica enterica serovar Typhi
aucagaaaaaccucc

SEQ ID NO: 1712718 - RNA, 20 nt, Salmonella enterica enterica serovar Typhi
aucagaaaaaauuacagccg

SEQ ID NO: 1712719 - RNA, 19 nt, Salmonella enterica enterica serovar Typhi
aucagaaaaaccuccggcu

SEQ ID NO: 1712720 - RNA, 14 nt, Salmonella enterica enterica serovar Typhi
aucacuuuugauaa

SEQ ID NO: 1712721 - RNA, 16 nt, Salmonella enterica enterica serovar Typhi
aucacuuuugauaaug

SEQ ID NO: 1712722 - RNA, 17 nt, Salmonella enterica enterica serovar Typhi
aucaagcccacacauca

SEQ ID NO: 1712723 - RNA, 13 nt, Salmonella enterica enterica serovar Typhi
aucaagcccagcu

SEQ ID NO: 1712724 - RNA, 17 nt, Salmonella enterica enterica serovar Typhi
aucaagauugaguccau

SEQ ID NO: 1712725 - RNA, 17 nt, Salmonella enterica enterica serovar Typhi
aucaacgccuccaggcu

SEQ ID NO: 1712726 - RNA, 22 nt, Salmonella enterica enterica serovar Typhi
aucaacgaccaugguucccgcc

SEQ ID NO: 1712727 - RNA, 20 nt, Salmonella enterica enterica serovar Typhi
aucaacgccgcgccaucagg

SEQ ID NO: 1712728 - RNA, 14 nt, Salmonella enterica enterica serovar Typhi
aucaaaacauuaga

SEQ ID NO: 1712729 - RNA, 19 nt, Salmonella enterica enterica serovar Typhi
aucaaacaaaccaaacuga

SEQ ID NO: 1712730 - RNA, 18 nt, Salmonella enterica enterica serovar Typhi
aucaaaccaucccagguu

SEQ ID NO: 1712731 - RNA, 22 nt, Salmonella enterica enterica serovar Typhi
aucaaaccauucccgucccugc

SEQ ID NO: 1712732 - RNA, 21 nt, Salmonella enterica enterica serovar Typhi
aucaaacuuuuaaauugaaga

SEQ ID NO: 1712733 - RNA, 20 nt, Salmonella enterica enterica serovar Typhi
aucaaacugaaaaucaaaua

SEQ ID NO: 1712734 - RNA, 16 nt, Salmonella enterica enterica serovar Typhi
aucaacccguuuucau

SEQ ID NO: 1712735 - RNA, 15 nt, Salmonella enterica enterica serovar Typhi
aucaacgaaaucaga

SEQ ID NO: 1712736 - RNA, 19 nt, Salmonella enterica enterica serovar Typhi
aucaacauuauuaaaaugu

SEQ ID NO: 1712737 - RNA, 14 nt, Salmonella enterica enterica serovar Typhi
aucaaccaccuuca

SEQ ID NO: 1712738 - RNA, 16 nt, Salmonella enterica enterica serovar Typhi
aucaaccaccuucacc

SEQ ID NO: 1712739 - RNA, 20 nt, Salmonella enterica enterica serovar Typhi
aucaauuccuuuuaauuuaa

SEQ ID NO: 1712740 - RNA, 21 nt, Salmonella enterica enterica serovar Typhi
aucaaugggauagugccugcc

SEQ ID NO: 1712741 - RNA, 21 nt, Salmonella enterica enterica serovar Typhi
aucaaugcccagcgcaaucac

SEQ ID NO: 1712742 - RNA, 22 nt, Salmonella enterica enterica serovar Typhi
aucaaugcccagcgcaaucacg

SEQ ID NO: 1712743 - RNA, 14 nt, Salmonella enterica enterica serovar Typhi
aucaauagauuauu

SEQ ID NO: 1712744 - RNA, 20 nt, Salmonella enterica enterica serovar Typhi
aucacacauaucgccagcca

SEQ ID NO: 1712745 - RNA, 15 nt, Salmonella enterica enterica serovar Typhi
aucacagacagaugc

SEQ ID NO: 1712746 - RNA, 13 nt, Salmonella enterica enterica serovar Typhi
aucacacauaucg

SEQ ID NO: 1712747 - RNA, 19 nt, Salmonella enterica enterica serovar Typhi
aucacaagcuguuucuccg

SEQ ID NO: 1712748 - RNA, 23 nt, Salmonella enterica enterica serovar Typhi
aucacaauuacgcaagagagcaa

SEQ ID NO: 1712749 - RNA, 21 nt, Salmonella enterica enterica serovar Typhi
aucacaaucagccacggcaac

SEQ ID NO: 1712750 - RNA, 19 nt, Salmonella enterica enterica serovar Typhi
aucaauuugccuuuauuca

SEQ ID NO: 1712751 - RNA, 23 nt, Salmonella enterica enterica serovar Typhi
aucaauuucucuuuuauuauuuu

SEQ ID NO: 1712752 - RNA, 18 nt, Salmonella enterica enterica serovar Typhi
aucaauucuuuaauuugu

SEQ ID NO: 1712753 - RNA, 19 nt, Salmonella enterica enterica serovar Typhi
aucaauugugugcacugca

SEQ ID NO: 1712754 - RNA, 18 nt, Salmonella enterica enterica serovar Typhi
aucaauuucauauuauua

SEQ ID NO: 1712755 - RNA, 19 nt, Salmonella enterica enterica serovar Typhi
aucaauuucauauuauuau

SEQ ID NO: 1712756 - RNA, 22 nt, Salmonella enterica enterica serovar Typhi
auauucagaauuuuuaaccauc

SEQ ID NO: 1712757 - RNA, 13 nt, Salmonella enterica enterica serovar Typhi
auauucagaauuu

SEQ ID NO: 1712758 - RNA, 18 nt, Salmonella enterica enterica serovar Typhi
auaugaucugcacaacau

SEQ ID NO: 1712759 - RNA, 19 nt, Salmonella enterica enterica serovar Typhi
auaugaucugcacaacauu

SEQ ID NO: 1712760 - RNA, 23 nt, Salmonella enterica enterica serovar Typhi
auaugauauguguaucuugcuuu

SEQ ID NO: 1712761 - RNA, 18 nt, Salmonella enterica enterica serovar Typhi
auaugaguacuacugaua

SEQ ID NO: 1712762 - RNA, 13 nt, Salmonella enterica enterica serovar Typhi
auauuauuauaua

SEQ ID NO: 1712763 - RNA, 21 nt, Salmonella enterica enterica serovar Typhi
auauuauuaugucauagcaau

SEQ ID NO: 1712764 - RNA, 13 nt, Salmonella enterica enterica serovar Typhi
auauucaggagca

SEQ ID NO: 1712765 - RNA, 18 nt, Salmonella enterica enterica serovar Typhi
auauucgcagcucugugu

SEQ ID NO: 1712766 - RNA, 20 nt, Salmonella enterica enterica serovar Typhi
auauucuguuagcgcccucu

SEQ ID NO: 1712767 - RNA, 12 nt, Salmonella enterica enterica serovar Typhi
auauugcauuuu

SEQ ID NO: 1712768 - RNA, 16 nt, Salmonella enterica enterica serovar Typhi
auauuuuucacacaua

SEQ ID NO: 1712769 - RNA, 14 nt, Salmonella enterica enterica serovar Typhi
auauuuuuucagga

SEQ ID NO: 1712770 - RNA, 16 nt, Salmonella enterica enterica serovar Typhi
aucaaaaaaaaccaga

SEQ ID NO: 1712771 - RNA, 13 nt, Salmonella enterica enterica serovar Typhi
auauuuuguaguu

SEQ ID NO: 1712772 - RNA, 21 nt, Salmonella enterica enterica serovar Typhi
auauuuuguuuuaaauucaac

SEQ ID NO: 1712773 - RNA, 10 nt, Salmonella enterica enterica serovar Typhi
auauuuuuaa

SEQ ID NO: 1712774 - RNA, 23 nt, Salmonella enterica enterica serovar Typhi
auauuguguuuuuuaauauauuc

SEQ ID NO: 1712775 - RNA, 15 nt, Salmonella enterica enterica serovar Typhi
auauuguugaaauua

SEQ ID NO: 1712776 - RNA, 11 nt, Salmonella enterica enterica serovar Typhi
auauuguugaa

SEQ ID NO: 1712777 - RNA, 19 nt, Salmonella enterica enterica serovar Typhi
auauugcgacaacuagaau

SEQ ID NO: 1712778 - RNA, 14 nt, Salmonella enterica enterica serovar Typhi
auauugcauuuuau

SEQ ID NO: 1712779 - RNA, 20 nt, Salmonella enterica enterica serovar Typhi
auauugcauuuuaucuuuug

SEQ ID NO: 1712780 - RNA, 14 nt, Salmonella enterica enterica serovar Typhi
auauugccauaaau

SEQ ID NO: 1712781 - RNA, 20 nt, Salmonella enterica enterica serovar Typhi
auauugccauaaauacaauu

SEQ ID NO: 1712782 - RNA, 21 nt, Salmonella enterica enterica serovar Typhi
auauugccgaccgccagcaga

SEQ ID NO: 1712783 - RNA, 11 nt, Salmonella enterica enterica serovar Typhi
auauuuuaugg

SEQ ID NO: 1712784 - RNA, 21 nt, Salmonella enterica enterica serovar Typhi
auauuuuauggaggauauaaa

SEQ ID NO: 1712785 - RNA, 20 nt, Salmonella enterica enterica serovar Typhi
auauuugugaccaacaucau

SEQ ID NO: 1712786 - RNA, 11 nt, Salmonella enterica enterica serovar Typhi
auacugcaacg

SEQ ID NO: 1712787 - RNA, 21 nt, Salmonella enterica enterica serovar Typhi
auacugaagauaaacagcagc

SEQ ID NO: 1712788 - RNA, 17 nt, Salmonella enterica enterica serovar Typhi
auacugaccaacaacag

SEQ ID NO: 1712789 - RNA, 18 nt, Salmonella enterica enterica serovar Typhi
auacugaccaacaacaga

SEQ ID NO: 1712790 - RNA, 21 nt, Salmonella enterica enterica serovar Typhi
auacugaccaacaacagauau

SEQ ID NO: 1712791 - RNA, 17 nt, Salmonella enterica enterica serovar Typhi
auacuguacgcccagcc

SEQ ID NO: 1712792 - RNA, 22 nt, Salmonella enterica enterica serovar Typhi
auacugggcgcaugaggccugu

SEQ ID NO: 1712793 - RNA, 20 nt, Salmonella enterica enterica serovar Typhi
auacuggucgcgucaauauu

SEQ ID NO: 1712794 - RNA, 22 nt, Salmonella enterica enterica serovar Typhi
auacuggccgguuuuaaaaaua

SEQ ID NO: 1712795 - RNA, 18 nt, Salmonella enterica enterica serovar Typhi
auacugugggauuuuugg

SEQ ID NO: 1712796 - RNA, 22 nt, Salmonella enterica enterica serovar Typhi
auacgucgugacccacacauag

SEQ ID NO: 1712797 - RNA, 18 nt, Salmonella enterica enterica serovar Typhi
auacguguacggcgaauu

SEQ ID NO: 1712798 - RNA, 14 nt, Salmonella enterica enterica serovar Typhi
auacguuccagcag

SEQ ID NO: 1712799 - RNA, 22 nt, Salmonella enterica enterica serovar Typhi
auacuauccaacagaaggcuuc

SEQ ID NO: 1712800 - RNA, 13 nt, Salmonella enterica enterica serovar Typhi
auacuccagcaga

SEQ ID NO: 1712801 - RNA, 16 nt, Salmonella enterica enterica serovar Typhi
auacucaauauccugc

SEQ ID NO: 1712802 - RNA, 12 nt, Salmonella enterica enterica serovar Typhi
auacucaucaua

SEQ ID NO: 1712803 - RNA, 20 nt, Salmonella enterica enterica serovar Typhi
auacuccugcaacagaagag

SEQ ID NO: 1712804 - RNA, 22 nt, Salmonella enterica enterica serovar Typhi
auacucuuggagagcaucaucu

SEQ ID NO: 1712805 - RNA, 11 nt, Salmonella enterica enterica serovar Typhi
auacucuuucc

SEQ ID NO: 1712806 - RNA, 19 nt, Salmonella enterica enterica serovar Typhi
auacucuuugaacagccag

SEQ ID NO: 1712807 - RNA, 14 nt, Salmonella enterica enterica serovar Typhi
auacuccagcagac

SEQ ID NO: 1712808 - RNA, 21 nt, Salmonella enterica enterica serovar Typhi
auaccuuuaaccucuuuuuca

SEQ ID NO: 1712809 - RNA, 22 nt, Salmonella enterica enterica serovar Typhi
auaccuucuucacuaaaaacag

SEQ ID NO: 1712810 - RNA, 22 nt, Salmonella enterica enterica serovar Typhi
auaccuucgugaugugguugug

SEQ ID NO: 1712811 - RNA, 12 nt, Salmonella enterica enterica serovar Typhi
auacgcaccagc

SEQ ID NO: 1712812 - RNA, 17 nt, Salmonella enterica enterica serovar Typhi
auacgauguaaaaaugc

SEQ ID NO: 1712813 - RNA, 18 nt, Salmonella enterica enterica serovar Typhi
auacgccgccagcaauac

SEQ ID NO: 1712814 - RNA, 23 nt, Salmonella enterica enterica serovar Typhi
auacgccagccgucaugauguuu

SEQ ID NO: 1712815 - RNA, 18 nt, Salmonella enterica enterica serovar Typhi
auacguccccauccgagc

SEQ ID NO: 1712816 - RNA, 19 nt, Salmonella enterica enterica serovar Typhi
auacgucauaucauccagc

SEQ ID NO: 1712817 - RNA, 20 nt, Salmonella enterica enterica serovar Typhi
auacgucauaucauccagcc

SEQ ID NO: 1712818 - RNA, 17 nt, Salmonella enterica enterica serovar Typhi
auacgguaaaucauuug

SEQ ID NO: 1712819 - RNA, 15 nt, Salmonella enterica enterica serovar Typhi
auacgguaauaacuc

SEQ ID NO: 1712820 - RNA, 13 nt, Salmonella enterica enterica serovar Typhi
auacggcugucag

SEQ ID NO: 1712821 - RNA, 16 nt, Salmonella enterica enterica serovar Typhi
auacggcuuccacugc

SEQ ID NO: 1712822 - RNA, 13 nt, Salmonella enterica enterica serovar Typhi
auacggggacaga

SEQ ID NO: 1712823 - RNA, 13 nt, Salmonella enterica enterica serovar Typhi
auaccguaaauuu

SEQ ID NO: 1712824 - RNA, 20 nt, Salmonella enterica enterica serovar Typhi
auaccguccagacuccuuuu

SEQ ID NO: 1712825 - RNA, 15 nt, Salmonella enterica enterica serovar Typhi
auaccggcaucacgc

SEQ ID NO: 1712826 - RNA, 22 nt, Salmonella enterica enterica serovar Typhi
auaauuaagaccauacuuugca

SEQ ID NO: 1712827 - RNA, 20 nt, Salmonella enterica enterica serovar Typhi
auagcaauuaauaaacaaug

SEQ ID NO: 1712828 - RNA, 19 nt, Salmonella enterica enterica serovar Typhi
auagcaaucauccugauuu

SEQ ID NO: 1712829 - RNA, 15 nt, Salmonella enterica enterica serovar Typhi
auagaguaauacauc

SEQ ID NO: 1712830 - RNA, 20 nt, Salmonella enterica enterica serovar Typhi
auagaucgccaccguaacua

SEQ ID NO: 1712831 - RNA, 17 nt, Salmonella enterica enterica serovar Typhi
auagacuucacuuuccc

SEQ ID NO: 1712832 - RNA, 12 nt, Salmonella enterica enterica serovar Typhi
auacuuuuacuc

SEQ ID NO: 1712833 - RNA, 14 nt, Salmonella enterica enterica serovar Typhi
auagagaaaucaac

SEQ ID NO: 1712834 - RNA, 17 nt, Salmonella enterica enterica serovar Typhi
auagagacugccgccgu

SEQ ID NO: 1712835 - RNA, 14 nt, Salmonella enterica enterica serovar Typhi
auagccacaggcug

SEQ ID NO: 1712836 - RNA, 17 nt, Salmonella enterica enterica serovar Typhi
auagccagcccccugcc

SEQ ID NO: 1712837 - RNA, 13 nt, Salmonella enterica enterica serovar Typhi
auagccauuuaau

SEQ ID NO: 1712838 - RNA, 12 nt, Salmonella enterica enterica serovar Typhi
auagcccggcuu

SEQ ID NO: 1712839 - RNA, 15 nt, Salmonella enterica enterica serovar Typhi
auagcgcuuuccugc

SEQ ID NO: 1712840 - RNA, 16 nt, Salmonella enterica enterica serovar Typhi
auagcgcugaugcguu

SEQ ID NO: 1712841 - RNA, 23 nt, Salmonella enterica enterica serovar Typhi
auagcgcuaugcgcuccaggaug

SEQ ID NO: 1712842 - RNA, 22 nt, Salmonella enterica enterica serovar Typhi
auagcgcuggcgccgcaaacca

SEQ ID NO: 1712843 - RNA, 18 nt, Salmonella enterica enterica serovar Typhi
auagcgcgucguugccuu

SEQ ID NO: 1712844 - RNA, 15 nt, Salmonella enterica enterica serovar Typhi
auagcccguuaugcc

SEQ ID NO: 1712845 - RNA, 16 nt, Salmonella enterica enterica serovar Typhi
auagcccuauucguga

SEQ ID NO: 1712846 - RNA, 14 nt, Salmonella enterica enterica serovar Typhi
auagcggguaaaca

SEQ ID NO: 1712847 - RNA, 17 nt, Salmonella enterica enterica serovar Typhi
auagcggccagauggca

SEQ ID NO: 1712848 - RNA, 22 nt, Salmonella enterica enterica serovar Typhi
auagcgguacccggucccuggc

SEQ ID NO: 1712849 - RNA, 19 nt, Salmonella enterica enterica serovar Typhi
auagcuggcugucuuccgu

SEQ ID NO: 1712850 - RNA, 20 nt, Salmonella enterica enterica serovar Typhi
auagcuggcuuuauauaaaa

SEQ ID NO: 1712851 - RNA, 20 nt, Salmonella enterica enterica serovar Typhi
auagcuaaugcgguugcgau

SEQ ID NO: 1712852 - RNA, 15 nt, Salmonella enterica enterica serovar Typhi
auagcuaaugcaaua

SEQ ID NO: 1712853 - RNA, 20 nt, Salmonella enterica enterica serovar Typhi
auaucgacauaaguaaauaa

SEQ ID NO: 1712854 - RNA, 22 nt, Salmonella enterica enterica serovar Typhi
auaucgacauaaguaaauaaca

SEQ ID NO: 1712855 - RNA, 13 nt, Salmonella enterica enterica serovar Typhi
auaucgccauaca

SEQ ID NO: 1712856 - RNA, 18 nt, Salmonella enterica enterica serovar Typhi
auaucgacggucaggcug

SEQ ID NO: 1712857 - RNA, 13 nt, Salmonella enterica enterica serovar Typhi
auaucgauaaaga

SEQ ID NO: 1712858 - RNA, 14 nt, Salmonella enterica enterica serovar Typhi
auaucaauucaaca

SEQ ID NO: 1712859 - RNA, 13 nt, Salmonella enterica enterica serovar Typhi
auaucaaucaccu

SEQ ID NO: 1712860 - RNA, 12 nt, Salmonella enterica enterica serovar Typhi
auaucaacgacc

SEQ ID NO: 1712861 - RNA, 20 nt, Salmonella enterica enterica serovar Typhi
auaucaaacacaaauuucga

SEQ ID NO: 1712862 - RNA, 14 nt, Salmonella enterica enterica serovar Typhi
auaucagucugcaa

SEQ ID NO: 1712863 - RNA, 17 nt, Salmonella enterica enterica serovar Typhi
auauauuuacugaauaa

SEQ ID NO: 1712864 - RNA, 12 nt, Salmonella enterica enterica serovar Typhi
auauauuuuccg

SEQ ID NO: 1712865 - RNA, 15 nt, Salmonella enterica enterica serovar Typhi
auauacuucaccaua

SEQ ID NO: 1712866 - RNA, 22 nt, Salmonella enterica enterica serovar Typhi
auauacuucaccauaaaucauu

SEQ ID NO: 1712867 - RNA, 13 nt, Salmonella enterica enterica serovar Typhi
auauacuucauca

SEQ ID NO: 1712868 - RNA, 21 nt, Salmonella enterica enterica serovar Typhi
auaguacccucugcaccagaa

SEQ ID NO: 1712869 - RNA, 15 nt, Salmonella enterica enterica serovar Typhi
auaguaaauagaaaa

SEQ ID NO: 1712870 - RNA, 18 nt, Salmonella enterica enterica serovar Typhi
auaguaaauagaaaauaa

SEQ ID NO: 1712871 - RNA, 23 nt, Salmonella enterica enterica serovar Typhi
auaguaaauagaaaauaauucuu

SEQ ID NO: 1712872 - RNA, 12 nt, Salmonella enterica enterica serovar Typhi
auagguugaaag

SEQ ID NO: 1712873 - RNA, 22 nt, Salmonella enterica enterica serovar Typhi
auagguugaauaaccauacuga

SEQ ID NO: 1712874 - RNA, 12 nt, Salmonella enterica enterica serovar Typhi
auaggcgccgcc

SEQ ID NO: 1712875 - RNA, 23 nt, Salmonella enterica enterica serovar Typhi
auaggccucgaccaguuuuuccg

SEQ ID NO: 1712876 - RNA, 13 nt, Salmonella enterica enterica serovar Typhi
auaggccaggcua

SEQ ID NO: 1712877 - RNA, 22 nt, Salmonella enterica enterica serovar Typhi
auaggccagcuacaccugggcu

SEQ ID NO: 1712878 - RNA, 12 nt, Salmonella enterica enterica serovar Typhi
auaggccaggcu

SEQ ID NO: 1712879 - RNA, 15 nt, Salmonella enterica enterica serovar Typhi
auaggcaauauccuc

SEQ ID NO: 1712880 - RNA, 20 nt, Salmonella enterica enterica serovar Typhi
auagugucgccauaaaucag

SEQ ID NO: 1712881 - RNA, 21 nt, Salmonella enterica enterica serovar Typhi
auagugcucauucguuuugcu

SEQ ID NO: 1712882 - RNA, 21 nt, Salmonella enterica enterica serovar Typhi
auagugcgugacaaucuccuc

SEQ ID NO: 1712883 - RNA, 14 nt, Salmonella enterica enterica serovar Typhi
auagugauaccagu

SEQ ID NO: 1712884 - RNA, 12 nt, Salmonella enterica enterica serovar Typhi
auaguuugcaua

SEQ ID NO: 1712885 - RNA, 17 nt, Salmonella enterica enterica serovar Typhi
auauaaaaaacauauaa

SEQ ID NO: 1712886 - RNA, 15 nt, Salmonella enterica enterica serovar Typhi
auaguuuuuccccau

SEQ ID NO: 1712887 - RNA, 16 nt, Salmonella enterica enterica serovar Typhi
auauaauuuauagcca

SEQ ID NO: 1712888 - RNA, 19 nt, Salmonella enterica enterica serovar Typhi
auauaaaaaacauauaauu

SEQ ID NO: 1712889 - RNA, 12 nt, Salmonella enterica enterica serovar Typhi
auauaaaaauag

SEQ ID NO: 1712890 - RNA, 22 nt, Salmonella enterica enterica serovar Typhi
auuaucgauuugguaaauaacu

SEQ ID NO: 1712891 - RNA, 17 nt, Salmonella enterica enterica serovar Typhi
auuauccuuuaauuaau

SEQ ID NO: 1712892 - RNA, 23 nt, Salmonella enterica enterica serovar Typhi
auuauccuuuaauuaauccauuu

SEQ ID NO: 1712893 - RNA, 18 nt, Salmonella enterica enterica serovar Typhi
auuauccgccgcaaauuc

SEQ ID NO: 1712894 - RNA, 18 nt, Salmonella enterica enterica serovar Typhi
auuaucaggaugaauaug

SEQ ID NO: 1712895 - RNA, 14 nt, Salmonella enterica enterica serovar Typhi
auuauauuuuaugg

SEQ ID NO: 1712896 - RNA, 20 nt, Salmonella enterica enterica serovar Typhi
auuaucaauuucauauuauu

SEQ ID NO: 1712897 - RNA, 11 nt, Salmonella enterica enterica serovar Typhi
auuaucaccau

SEQ ID NO: 1712898 - RNA, 23 nt, Salmonella enterica enterica serovar Typhi
auuaucugccagccgauuuuucg

SEQ ID NO: 1712899 - RNA, 17 nt, Salmonella enterica enterica serovar Typhi
auuaucguuuacguuau

SEQ ID NO: 1712900 - RNA, 16 nt, Salmonella enterica enterica serovar Typhi
auuaucuuuauugaaa

SEQ ID NO: 1712901 - RNA, 14 nt, Salmonella enterica enterica serovar Typhi
auuauugcacauaa

SEQ ID NO: 1712902 - RNA, 21 nt, Salmonella enterica enterica serovar Typhi
auuauuggcuuuguaaauauu

SEQ ID NO: 1712903 - RNA, 22 nt, Salmonella enterica enterica serovar Typhi
auuauugcguugcuuuauaaaa

SEQ ID NO: 1712904 - RNA, 14 nt, Salmonella enterica enterica serovar Typhi
auuauuguuaaaaa

SEQ ID NO: 1712905 - RNA, 20 nt, Salmonella enterica enterica serovar Typhi
auuauuggugaaaaaucauu

SEQ ID NO: 1712906 - RNA, 21 nt, Salmonella enterica enterica serovar Typhi
auuauuccuugaucaggaaau

SEQ ID NO: 1712907 - RNA, 20 nt, Salmonella enterica enterica serovar Typhi
auuauucggcgacuggaaca

SEQ ID NO: 1712908 - RNA, 22 nt, Salmonella enterica enterica serovar Typhi
auuauucaccuggauuccucca

SEQ ID NO: 1712909 - RNA, 16 nt, Salmonella enterica enterica serovar Typhi
auuauucaggccuccu

SEQ ID NO: 1712910 - RNA, 13 nt, Salmonella enterica enterica serovar Typhi
auuauuacaauaa

SEQ ID NO: 1712911 - RNA, 21 nt, Salmonella enterica enterica serovar Typhi
auuaugcugcucgaagaugag

SEQ ID NO: 1712912 - RNA, 19 nt, Salmonella enterica enterica serovar Typhi
auuaugccgcacuccccag

SEQ ID NO: 1712913 - RNA, 15 nt, Salmonella enterica enterica serovar Typhi
auucaaaauccgcca

SEQ ID NO: 1712914 - RNA, 18 nt, Salmonella enterica enterica serovar Typhi
auuauuuuuaaauaacuu

SEQ ID NO: 1712915 - RNA, 17 nt, Salmonella enterica enterica serovar Typhi
auuauuuuucaaaugau

SEQ ID NO: 1712916 - RNA, 14 nt, Salmonella enterica enterica serovar Typhi
auuauuuucacgcu

SEQ ID NO: 1712917 - RNA, 17 nt, Salmonella enterica enterica serovar Typhi
auuauuuucuaaaaucu

SEQ ID NO: 1712918 - RNA, 14 nt, Salmonella enterica enterica serovar Typhi
auuauuuuuaaaua

SEQ ID NO: 1712919 - RNA, 17 nt, Salmonella enterica enterica serovar Typhi
auuauuuuuaaauaacu

SEQ ID NO: 1712920 - RNA, 11 nt, Salmonella enterica enterica serovar Typhi
auucaauauug

SEQ ID NO: 1712921 - RNA, 11 nt, Salmonella enterica enterica serovar Typhi
auucaaucacu

SEQ ID NO: 1712922 - RNA, 23 nt, Salmonella enterica enterica serovar Typhi
auucaagcaacuguagaaugcua

SEQ ID NO: 1712923 - RNA, 19 nt, Salmonella enterica enterica serovar Typhi
auucaacacauuccauuuu

SEQ ID NO: 1712924 - RNA, 20 nt, Salmonella enterica enterica serovar Typhi
auucaaauguuguuugaaaa

SEQ ID NO: 1712925 - RNA, 22 nt, Salmonella enterica enterica serovar Typhi
auucaaccagccgaucagcgcc

SEQ ID NO: 1712926 - RNA, 23 nt, Salmonella enterica enterica serovar Typhi
auucaaccagccgaucagcgcca

SEQ ID NO: 1712927 - RNA, 22 nt, Salmonella enterica enterica serovar Typhi
auucaacagggguuccggcaau

SEQ ID NO: 1712928 - RNA, 19 nt, Salmonella enterica enterica serovar Typhi
auucaacgccaucuuccuc

SEQ ID NO: 1712929 - RNA, 19 nt, Salmonella enterica enterica serovar Typhi
auucaccuggauuccucca

SEQ ID NO: 1712930 - RNA, 22 nt, Salmonella enterica enterica serovar Typhi
auucacaccuuuauauuuuucc

SEQ ID NO: 1712931 - RNA, 21 nt, Salmonella enterica enterica serovar Typhi
auucacauuauucacgcuaug

SEQ ID NO: 1712932 - RNA, 21 nt, Salmonella enterica enterica serovar Typhi
auucacaccaaugucauauuu

SEQ ID NO: 1712933 - RNA, 19 nt, Salmonella enterica enterica serovar Typhi
auucaauucuggaaucaau

SEQ ID NO: 1712934 - RNA, 19 nt, Salmonella enterica enterica serovar Typhi
auucacuuuccgaaucagg

SEQ ID NO: 1712935 - RNA, 17 nt, Salmonella enterica enterica serovar Typhi
auucagauccgaggcgu

SEQ ID NO: 1712936 - RNA, 16 nt, Salmonella enterica enterica serovar Typhi
auucacguagcggcgc

SEQ ID NO: 1712937 - RNA, 17 nt, Salmonella enterica enterica serovar Typhi
auucacgcgauuguuau

SEQ ID NO: 1712938 - RNA, 22 nt, Salmonella enterica enterica serovar Typhi
auucacgcgauuguuauccccc

SEQ ID NO: 1712939 - RNA, 16 nt, Salmonella enterica enterica serovar Typhi
auuacaaacaggcuuu

SEQ ID NO: 1712940 - RNA, 14 nt, Salmonella enterica enterica serovar Typhi
auuacaacaugucc

SEQ ID NO: 1712941 - RNA, 18 nt, Salmonella enterica enterica serovar Typhi
auuacaacauguccuaca

SEQ ID NO: 1712942 - RNA, 18 nt, Salmonella enterica enterica serovar Typhi
auuacaaguaauaaaaua

SEQ ID NO: 1712943 - RNA, 23 nt, Salmonella enterica enterica serovar Typhi
auuacagacagucuggauauaaa

SEQ ID NO: 1712944 - RNA, 18 nt, Salmonella enterica enterica serovar Typhi
auuacagccgcgaugcua

SEQ ID NO: 1712945 - RNA, 19 nt, Salmonella enterica enterica serovar Typhi
auuacagcguguucaugcg

SEQ ID NO: 1712946 - RNA, 20 nt, Salmonella enterica enterica serovar Typhi
auuacagguguuaaucauuu

SEQ ID NO: 1712947 - RNA, 22 nt, Salmonella enterica enterica serovar Typhi
auuaauucccgcagccagcaau

SEQ ID NO: 1712948 - RNA, 19 nt, Salmonella enterica enterica serovar Typhi
auuaauucuuuuaacauaa

SEQ ID NO: 1712949 - RNA, 21 nt, Salmonella enterica enterica serovar Typhi
auuaauucuuuuaacauaagu

SEQ ID NO: 1712950 - RNA, 15 nt, Salmonella enterica enterica serovar Typhi
auuaauugcuuugca

SEQ ID NO: 1712951 - RNA, 15 nt, Salmonella enterica enterica serovar Typhi
auuaauuuucacgcu

SEQ ID NO: 1712952 - RNA, 18 nt, Salmonella enterica enterica serovar Typhi
auuaauuuauccaacagg

SEQ ID NO: 1712953 - RNA, 14 nt, Salmonella enterica enterica serovar Typhi
auuacgcaugguca

SEQ ID NO: 1712954 - RNA, 15 nt, Salmonella enterica enterica serovar Typhi
auuacggguaaugau

SEQ ID NO: 1712955 - RNA, 17 nt, Salmonella enterica enterica serovar Typhi
auuacguuuucccugag

SEQ ID NO: 1712956 - RNA, 21 nt, Salmonella enterica enterica serovar Typhi
auuacguuggggauaaccaga

SEQ ID NO: 1712957 - RNA, 16 nt, Salmonella enterica enterica serovar Typhi
auuaccggcugccgau

SEQ ID NO: 1712958 - RNA, 22 nt, Salmonella enterica enterica serovar Typhi
auuaccgggauuuccauauuaa

SEQ ID NO: 1712959 - RNA, 18 nt, Salmonella enterica enterica serovar Typhi
auuacgacccacaaugag

SEQ ID NO: 1712960 - RNA, 14 nt, Salmonella enterica enterica serovar Typhi
auuaccgcuauuca

SEQ ID NO: 1712961 - RNA, 18 nt, Salmonella enterica enterica serovar Typhi
auuaccccgugguggggu

SEQ ID NO: 1712962 - RNA, 22 nt, Salmonella enterica enterica serovar Typhi
auuagccgccauccggcaucuc

SEQ ID NO: 1712963 - RNA, 19 nt, Salmonella enterica enterica serovar Typhi
auuagcauccagcacgagc

SEQ ID NO: 1712964 - RNA, 18 nt, Salmonella enterica enterica serovar Typhi
auuagaggcguaaguaaa

SEQ ID NO: 1712965 - RNA, 20 nt, Salmonella enterica enterica serovar Typhi
auuagaggucagaauaacuc

SEQ ID NO: 1712966 - RNA, 15 nt, Salmonella enterica enterica serovar Typhi
auuacuuuccagcaa

SEQ ID NO: 1712967 - RNA, 20 nt, Salmonella enterica enterica serovar Typhi
auuagaaacccauauuccug

SEQ ID NO: 1712968 - RNA, 13 nt, Salmonella enterica enterica serovar Typhi
auuacugauaaag

SEQ ID NO: 1712969 - RNA, 12 nt, Salmonella enterica enterica serovar Typhi
auuacugauaaa

SEQ ID NO: 1712970 - RNA, 20 nt, Salmonella enterica enterica serovar Typhi
auuacugcgugcuggcggcc

SEQ ID NO: 1712971 - RNA, 15 nt, Salmonella enterica enterica serovar Typhi
auuacuuaugauaua

SEQ ID NO: 1712972 - RNA, 14 nt, Salmonella enterica enterica serovar Typhi
auuacuuauauuua

SEQ ID NO: 1712973 - RNA, 16 nt, Salmonella enterica enterica serovar Typhi
auuauauagucuuaau

SEQ ID NO: 1712974 - RNA, 18 nt, Salmonella enterica enterica serovar Typhi
auuauauagacuccguca

SEQ ID NO: 1712975 - RNA, 13 nt, Salmonella enterica enterica serovar Typhi
auuauauuuaaaa

SEQ ID NO: 1712976 - RNA, 17 nt, Salmonella enterica enterica serovar Typhi
auuauauuuaaaauucc

SEQ ID NO: 1712977 - RNA, 22 nt, Salmonella enterica enterica serovar Typhi
auuauacuugcugcuauguaaa

SEQ ID NO: 1712978 - RNA, 19 nt, Salmonella enterica enterica serovar Typhi
auuaggcguaaaauugccg

SEQ ID NO: 1712979 - RNA, 13 nt, Salmonella enterica enterica serovar Typhi
auuaguaauauca

SEQ ID NO: 1712980 - RNA, 15 nt, Salmonella enterica enterica serovar Typhi
auuagggugcaguga

SEQ ID NO: 1712981 - RNA, 20 nt, Salmonella enterica enterica serovar Typhi
auuaguucaaguuuagaaaa

SEQ ID NO: 1712982 - RNA, 15 nt, Salmonella enterica enterica serovar Typhi
auuauaaagcauaaa

SEQ ID NO: 1712983 - RNA, 17 nt, Salmonella enterica enterica serovar Typhi
auguucauaccggauau

SEQ ID NO: 1712984 - RNA, 19 nt, Salmonella enterica enterica serovar Typhi
auguucaugaaccacgcca

SEQ ID NO: 1712985 - RNA, 17 nt, Salmonella enterica enterica serovar Typhi
auguugcguaaauaaau

SEQ ID NO: 1712986 - RNA, 15 nt, Salmonella enterica enterica serovar Typhi
auguuguuccagagu

SEQ ID NO: 1712987 - RNA, 17 nt, Salmonella enterica enterica serovar Typhi
auguuguuccagagugc

SEQ ID NO: 1712988 - RNA, 22 nt, Salmonella enterica enterica serovar Typhi
auguuggauuauacauucgcuc

SEQ ID NO: 1712989 - RNA, 15 nt, Salmonella enterica enterica serovar Typhi
auguuugccacgcca

SEQ ID NO: 1712990 - RNA, 16 nt, Salmonella enterica enterica serovar Typhi
auguuuugucguucac

SEQ ID NO: 1712991 - RNA, 20 nt, Salmonella enterica enterica serovar Typhi
auguuuguaggcuuccagaa

SEQ ID NO: 1712992 - RNA, 20 nt, Salmonella enterica enterica serovar Typhi
auguuucgacaguuucuucu

SEQ ID NO: 1712993 - RNA, 16 nt, Salmonella enterica enterica serovar Typhi
auuaaacuuucaugaa

SEQ ID NO: 1712994 - RNA, 11 nt, Salmonella enterica enterica serovar Typhi
auuaaagccac

SEQ ID NO: 1712995 - RNA, 13 nt, Salmonella enterica enterica serovar Typhi
auuaaagccccuu

SEQ ID NO: 1712996 - RNA, 20 nt, Salmonella enterica enterica serovar Typhi
auuaaauccugaaacccaua

SEQ ID NO: 1712997 - RNA, 21 nt, Salmonella enterica enterica serovar Typhi
auuaaaucagauaacaaugac

SEQ ID NO: 1712998 - RNA, 19 nt, Salmonella enterica enterica serovar Typhi
auuaaaacgagucagcguu

SEQ ID NO: 1712999 - RNA, 22 nt, Salmonella enterica enterica serovar Typhi
auuaaaaauaccccaggggcau

SEQ ID NO: 1713000 - RNA, 15 nt, Salmonella enterica enterica serovar Typhi
auuaaaaaggccgac

SEQ ID NO: 1713001 - RNA, 12 nt, Salmonella enterica enterica serovar Typhi
auuaaaaauacc

SEQ ID NO: 1713002 - RNA, 19 nt, Salmonella enterica enterica serovar Typhi
auguuuuuaucagcuugcc

SEQ ID NO: 1713003 - RNA, 17 nt, Salmonella enterica enterica serovar Typhi
auuaagggacgguaaau

SEQ ID NO: 1713004 - RNA, 16 nt, Salmonella enterica enterica serovar Typhi
auuaauacaucacuuu

SEQ ID NO: 1713005 - RNA, 12 nt, Salmonella enterica enterica serovar Typhi
auuaauaaaauc

SEQ ID NO: 1713006 - RNA, 18 nt, Salmonella enterica enterica serovar Typhi
auuaaguuuuuuuaaaaa

SEQ ID NO: 1713007 - RNA, 19 nt, Salmonella enterica enterica serovar Typhi
auuaauaugcgcaaucacc

SEQ ID NO: 1713008 - RNA, 14 nt, Salmonella enterica enterica serovar Typhi
auuaauaucagccc

SEQ ID NO: 1713009 - RNA, 21 nt, Salmonella enterica enterica serovar Typhi
auuaauccccggcgaaagaaa

SEQ ID NO: 1713010 - RNA, 20 nt, Salmonella enterica enterica serovar Typhi
auuaaugaauaaaugaauua

SEQ ID NO: 1713011 - RNA, 14 nt, Salmonella enterica enterica serovar Typhi
auuaauccugcgcu

SEQ ID NO: 1713012 - RNA, 17 nt, Salmonella enterica enterica serovar Typhi
auuaaugcuccaauaaa

SEQ ID NO: 1713013 - RNA, 12 nt, Salmonella enterica enterica serovar Typhi
auuaacaaauaa

SEQ ID NO: 1713014 - RNA, 16 nt, Salmonella enterica enterica serovar Typhi
auuaaaugcuugcuuu

SEQ ID NO: 1713015 - RNA, 18 nt, Salmonella enterica enterica serovar Typhi
auuaaaugcgccagcggc

SEQ ID NO: 1713016 - RNA, 13 nt, Salmonella enterica enterica serovar Typhi
auuaacaaaucau

SEQ ID NO: 1713017 - RNA, 13 nt, Salmonella enterica enterica serovar Typhi
auuaacaaauaaa

SEQ ID NO: 1713018 - RNA, 23 nt, Salmonella enterica enterica serovar Typhi
auuaacagcgcgaccaggaaacc

SEQ ID NO: 1713019 - RNA, 23 nt, Salmonella enterica enterica serovar Typhi
auuaacaggcgccggggcagcaa

SEQ ID NO: 1713020 - RNA, 11 nt, Salmonella enterica enterica serovar Typhi
auuaacaucag

SEQ ID NO: 1713021 - RNA, 23 nt, Salmonella enterica enterica serovar Typhi
auuaacuugacuuugcucuccuu

SEQ ID NO: 1713022 - RNA, 13 nt, Salmonella enterica enterica serovar Typhi
auuaacucuuccg

SEQ ID NO: 1713023 - RNA, 21 nt, Salmonella enterica enterica serovar Typhi
auuaacgccgcgaggaucugc

SEQ ID NO: 1713024 - RNA, 23 nt, Salmonella enterica enterica serovar Typhi
auuaacgcagaauauuuuucuca

SEQ ID NO: 1713025 - RNA, 16 nt, Salmonella enterica enterica serovar Typhi
auggucugaaagaguu

SEQ ID NO: 1713026 - RNA, 16 nt, Salmonella enterica enterica serovar Typhi
auggucuguaccacca

SEQ ID NO: 1713027 - RNA, 14 nt, Salmonella enterica enterica serovar Typhi
augguuaaauucau

SEQ ID NO: 1713028 - RNA, 20 nt, Salmonella enterica enterica serovar Typhi
auggucgaaaauaucggccu

SEQ ID NO: 1713029 - RNA, 18 nt, Salmonella enterica enterica serovar Typhi
auggucgcgccaaaagag

SEQ ID NO: 1713030 - RNA, 19 nt, Salmonella enterica enterica serovar Typhi
auggucguauuuuggcgcu

SEQ ID NO: 1713031 - RNA, 21 nt, Salmonella enterica enterica serovar Typhi
augguacaccaggaguuaaac

SEQ ID NO: 1713032 - RNA, 20 nt, Salmonella enterica enterica serovar Typhi
augguacacauaugggaaga

SEQ ID NO: 1713033 - RNA, 20 nt, Salmonella enterica enterica serovar Typhi
augguacucaacaucauuaa

SEQ ID NO: 1713034 - RNA, 15 nt, Salmonella enterica enterica serovar Typhi
augggcuucuucacu

SEQ ID NO: 1713035 - RNA, 22 nt, Salmonella enterica enterica serovar Typhi
auggggaaauaaauauguuauu

SEQ ID NO: 1713036 - RNA, 17 nt, Salmonella enterica enterica serovar Typhi
auggggaucgucugcaa

SEQ ID NO: 1713037 - RNA, 16 nt, Salmonella enterica enterica serovar Typhi
auggggcaagcucagc

SEQ ID NO: 1713038 - RNA, 24 nt, Salmonella enterica enterica serovar Typhi
augguaacugcggcuauauaaaau

SEQ ID NO: 1713039 - RNA, 17 nt, Salmonella enterica enterica serovar Typhi
augggccuacgccugga

SEQ ID NO: 1713040 - RNA, 22 nt, Salmonella enterica enterica serovar Typhi
augggcaggagaugaccugccc

SEQ ID NO: 1713041 - RNA, 20 nt, Salmonella enterica enterica serovar Typhi
augggauagugccugccguc

SEQ ID NO: 1713042 - RNA, 18 nt, Salmonella enterica enterica serovar Typhi
augggauuugaugcccaa

SEQ ID NO: 1713043 - RNA, 15 nt, Salmonella enterica enterica serovar Typhi
augggaaaucacagc

SEQ ID NO: 1713044 - RNA, 18 nt, Salmonella enterica enterica serovar Typhi
auggcugauggcgaaaau

SEQ ID NO: 1713045 - RNA, 17 nt, Salmonella enterica enterica serovar Typhi
auggcugagaaucaccu

SEQ ID NO: 1713046 - RNA, 16 nt, Salmonella enterica enterica serovar Typhi
augggauaacgcagaa

SEQ ID NO: 1713047 - RNA, 19 nt, Salmonella enterica enterica serovar Typhi
augggauaacgcagaagac

SEQ ID NO: 1713048 - RNA, 18 nt, Salmonella enterica enterica serovar Typhi
auggcgggccugugccug

SEQ ID NO: 1713049 - RNA, 18 nt, Salmonella enterica enterica serovar Typhi
auggccagaaugacaugg

SEQ ID NO: 1713050 - RNA, 20 nt, Salmonella enterica enterica serovar Typhi
auggccagcaccagcauuag

SEQ ID NO: 1713051 - RNA, 19 nt, Salmonella enterica enterica serovar Typhi
auggcccaguguacugcca

SEQ ID NO: 1713052 - RNA, 12 nt, Salmonella enterica enterica serovar Typhi
auggccagcccc

SEQ ID NO: 1713053 - RNA, 14 nt, Salmonella enterica enterica serovar Typhi
auggccauagacuu

SEQ ID NO: 1713054 - RNA, 17 nt, Salmonella enterica enterica serovar Typhi
auggcgcuaagccagcc

SEQ ID NO: 1713055 - RNA, 15 nt, Salmonella enterica enterica serovar Typhi
auggcgcugcgcgca

SEQ ID NO: 1713056 - RNA, 20 nt, Salmonella enterica enterica serovar Typhi
auggcgcgccacuucuuuga

SEQ ID NO: 1713057 - RNA, 18 nt, Salmonella enterica enterica serovar Typhi
auggcgcgaaaacagcug

SEQ ID NO: 1713058 - RNA, 16 nt, Salmonella enterica enterica serovar Typhi
auggcagaauaaaaca

SEQ ID NO: 1713059 - RNA, 22 nt, Salmonella enterica enterica serovar Typhi
auggcauaacgcuguagcguuu

SEQ ID NO: 1713060 - RNA, 19 nt, Salmonella enterica enterica serovar Typhi
auggcaguauaaauaccuu

SEQ ID NO: 1713061 - RNA, 22 nt, Salmonella enterica enterica serovar Typhi
auggcauaugacgguauugcuu

SEQ ID NO: 1713062 - RNA, 20 nt, Salmonella enterica enterica serovar Typhi
augcgcagaaacugaucgaa

SEQ ID NO: 1713063 - RNA, 15 nt, Salmonella enterica enterica serovar Typhi
augcgaaaaguaaag

SEQ ID NO: 1713064 - RNA, 19 nt, Salmonella enterica enterica serovar Typhi
augcgaucgggcaauccau

SEQ ID NO: 1713065 - RNA, 18 nt, Salmonella enterica enterica serovar Typhi
augcgaugccgcacgccu

SEQ ID NO: 1713066 - RNA, 20 nt, Salmonella enterica enterica serovar Typhi
auguaucgcgcggauuccgc

SEQ ID NO: 1713067 - RNA, 16 nt, Salmonella enterica enterica serovar Typhi
augucccaguaauauc

SEQ ID NO: 1713068 - RNA, 18 nt, Salmonella enterica enterica serovar Typhi
auguccaucagauucaac

SEQ ID NO: 1713069 - RNA, 17 nt, Salmonella enterica enterica serovar Typhi
auguccgauagcauuau

SEQ ID NO: 1713070 - RNA, 17 nt, Salmonella enterica enterica serovar Typhi
auguccauaaauagauc

SEQ ID NO: 1713071 - RNA, 19 nt, Salmonella enterica enterica serovar Typhi
auguccaggcgacaugaca

SEQ ID NO: 1713072 - RNA, 17 nt, Salmonella enterica enterica serovar Typhi
augucaugacuuaacgu

SEQ ID NO: 1713073 - RNA, 14 nt, Salmonella enterica enterica serovar Typhi
auguaguaaauagg

SEQ ID NO: 1713074 - RNA, 21 nt, Salmonella enterica enterica serovar Typhi
auguaguaaauaggagaugca

SEQ ID NO: 1713075 - RNA, 19 nt, Salmonella enterica enterica serovar Typhi
auguaaaacgguaugaaac

SEQ ID NO: 1713076 - RNA, 19 nt, Salmonella enterica enterica serovar Typhi
auguaaaaaaauaaaaaag

SEQ ID NO: 1713077 - RNA, 19 nt, Salmonella enterica enterica serovar Typhi
augucgauaauacagccug

SEQ ID NO: 1713078 - RNA, 19 nt, Salmonella enterica enterica serovar Typhi
auguccuuuacugcgccag

SEQ ID NO: 1713079 - RNA, 23 nt, Salmonella enterica enterica serovar Typhi
auguccuuuacugcgccagccug

SEQ ID NO: 1713080 - RNA, 20 nt, Salmonella enterica enterica serovar Typhi
auguccugccgcaaacgccu

SEQ ID NO: 1713081 - RNA, 23 nt, Salmonella enterica enterica serovar Typhi
augucuuuucgguauuuaucaaa

SEQ ID NO: 1713082 - RNA, 16 nt, Salmonella enterica enterica serovar Typhi
augugaucuauauauu

SEQ ID NO: 1713083 - RNA, 19 nt, Salmonella enterica enterica serovar Typhi
augugaugccgucaguuau

SEQ ID NO: 1713084 - RNA, 15 nt, Salmonella enterica enterica serovar Typhi
augugacaaucacuc

SEQ ID NO: 1713085 - RNA, 20 nt, Salmonella enterica enterica serovar Typhi
augugguaaccgaacugggu

SEQ ID NO: 1713086 - RNA, 21 nt, Salmonella enterica enterica serovar Typhi
auguuaaaguuuuucauaucc

SEQ ID NO: 1713087 - RNA, 17 nt, Salmonella enterica enterica serovar Typhi
auguguuucagcagccc

SEQ ID NO: 1713088 - RNA, 17 nt, Salmonella enterica enterica serovar Typhi
auguuaacuacuuuaca

SEQ ID NO: 1713089 - RNA, 18 nt, Salmonella enterica enterica serovar Typhi
auguuaauaccagcgcca

SEQ ID NO: 1713090 - RNA, 22 nt, Salmonella enterica enterica serovar Typhi
auguuaauaccagcgccaauca

SEQ ID NO: 1713091 - RNA, 17 nt, Salmonella enterica enterica serovar Typhi
auguggcggcccguggu

SEQ ID NO: 1713092 - RNA, 22 nt, Salmonella enterica enterica serovar Typhi
auguggacgccauaaaccagaa

SEQ ID NO: 1713093 - RNA, 21 nt, Salmonella enterica enterica serovar Typhi
augugcaaucacacuacacga

SEQ ID NO: 1713094 - RNA, 13 nt, Salmonella enterica enterica serovar Typhi
aucucauaaaccg

SEQ ID NO: 1713095 - RNA, 18 nt, Salmonella enterica enterica serovar Typhi
aucucagauaauagcugc

SEQ ID NO: 1713096 - RNA, 22 nt, Salmonella enterica enterica serovar Typhi
aucucacgcauggcguugcugc

SEQ ID NO: 1713097 - RNA, 11 nt, Salmonella enterica enterica serovar Typhi
aucuccagcau

SEQ ID NO: 1713098 - RNA, 17 nt, Salmonella enterica enterica serovar Typhi
aucuccagaccgcugcg

SEQ ID NO: 1713099 - RNA, 19 nt, Salmonella enterica enterica serovar Typhi
aucuccagaccgcugcgga

SEQ ID NO: 1713100 - RNA, 14 nt, Salmonella enterica enterica serovar Typhi
aucucauugauggu

SEQ ID NO: 1713101 - RNA, 19 nt, Salmonella enterica enterica serovar Typhi
aucucaucagacuguaugu

SEQ ID NO: 1713102 - RNA, 18 nt, Salmonella enterica enterica serovar Typhi
aucucauaaacgccugga

SEQ ID NO: 1713103 - RNA, 17 nt, Salmonella enterica enterica serovar Typhi
aucucauaccaggugcc

SEQ ID NO: 1713104 - RNA, 21 nt, Salmonella enterica enterica serovar Typhi
aucuccagcgcauugccuuuc

SEQ ID NO: 1713105 - RNA, 16 nt, Salmonella enterica enterica serovar Typhi
aucuccggcagcgaau

SEQ ID NO: 1713106 - RNA, 17 nt, Salmonella enterica enterica serovar Typhi
aucuccuguaaugaggc

SEQ ID NO: 1713107 - RNA, 19 nt, Salmonella enterica enterica serovar Typhi
aucuccugacauagcucac

SEQ ID NO: 1713108 - RNA, 18 nt, Salmonella enterica enterica serovar Typhi
aucuccuguaaugaggca

SEQ ID NO: 1713109 - RNA, 17 nt, Salmonella enterica enterica serovar Typhi
aucuccuccggcuucag

SEQ ID NO: 1713110 - RNA, 22 nt, Salmonella enterica enterica serovar Typhi
aucuccuccucauucagcggcu

SEQ ID NO: 1713111 - RNA, 12 nt, Salmonella enterica enterica serovar Typhi
aucuccugacau

SEQ ID NO: 1713112 - RNA, 14 nt, Salmonella enterica enterica serovar Typhi
aucucaaggucugu

SEQ ID NO: 1713113 - RNA, 19 nt, Salmonella enterica enterica serovar Typhi
aucucaaggucugucagga

SEQ ID NO: 1713114 - RNA, 20 nt, Salmonella enterica enterica serovar Typhi
aucuauuuagcguauaguac

SEQ ID NO: 1713115 - RNA, 16 nt, Salmonella enterica enterica serovar Typhi
aucuauauauucuucu

SEQ ID NO: 1713116 - RNA, 20 nt, Salmonella enterica enterica serovar Typhi
aucuaccuucacgcagugcg

SEQ ID NO: 1713117 - RNA, 21 nt, Salmonella enterica enterica serovar Typhi
aucuagcggaaccuguccuga

SEQ ID NO: 1713118 - RNA, 21 nt, Salmonella enterica enterica serovar Typhi
aucucgucaaacucuuccggg

SEQ ID NO: 1713119 - RNA, 18 nt, Salmonella enterica enterica serovar Typhi
aucucuacuuuccugaag

SEQ ID NO: 1713120 - RNA, 12 nt, Salmonella enterica enterica serovar Typhi
aucucgccuggc

SEQ ID NO: 1713121 - RNA, 19 nt, Salmonella enterica enterica serovar Typhi
aucucucuggcgcauucca

SEQ ID NO: 1713122 - RNA, 16 nt, Salmonella enterica enterica serovar Typhi
aucucugucgaccauc

SEQ ID NO: 1713123 - RNA, 19 nt, Salmonella enterica enterica serovar Typhi
aucucugucgaccaucgca

SEQ ID NO: 1713124 - RNA, 17 nt, Salmonella enterica enterica serovar Typhi
aucucuuuuaauuuucu

SEQ ID NO: 1713125 - RNA, 15 nt, Salmonella enterica enterica serovar Typhi
aucucuuucagaaua

SEQ ID NO: 1713126 - RNA, 16 nt, Salmonella enterica enterica serovar Typhi
aucugacgcggcgccg

SEQ ID NO: 1713127 - RNA, 13 nt, Salmonella enterica enterica serovar Typhi
aucugauaaaaug

SEQ ID NO: 1713128 - RNA, 16 nt, Salmonella enterica enterica serovar Typhi
aucugaguaucgcuuu

SEQ ID NO: 1713129 - RNA, 19 nt, Salmonella enterica enterica serovar Typhi
aucugagcugguuucuccg

SEQ ID NO: 1713130 - RNA, 21 nt, Salmonella enterica enterica serovar Typhi
aucugcacaacauuccgcuuc

SEQ ID NO: 1713131 - RNA, 17 nt, Salmonella enterica enterica serovar Typhi
aucugauucaauuaaug

SEQ ID NO: 1713132 - RNA, 18 nt, Salmonella enterica enterica serovar Typhi
aucugccgggagcagauu

SEQ ID NO: 1713133 - RNA, 17 nt, Salmonella enterica enterica serovar Typhi
aucugcccuuucuuaug

SEQ ID NO: 1713134 - RNA, 24 nt, Salmonella enterica enterica serovar Typhi
aucugccucaacaaguccuucuuc

SEQ ID NO: 1713135 - RNA, 21 nt, Salmonella enterica enterica serovar Typhi
aucugcgcaacauucugcuuc

SEQ ID NO: 1713136 - RNA, 19 nt, Salmonella enterica enterica serovar Typhi
aucugcgccggcugcgcug

SEQ ID NO: 1713137 - RNA, 17 nt, Salmonella enterica enterica serovar Typhi
aucugcggucuccugaa

SEQ ID NO: 1713138 - RNA, 16 nt, Salmonella enterica enterica serovar Typhi
aucugcaugcgcugga

SEQ ID NO: 1713139 - RNA, 16 nt, Salmonella enterica enterica serovar Typhi
aucugccauuucugcu

SEQ ID NO: 1713140 - RNA, 16 nt, Salmonella enterica enterica serovar Typhi
aucgggcaauccauua

SEQ ID NO: 1713141 - RNA, 22 nt, Salmonella enterica enterica serovar Typhi
aucgggacaaucaccaucccau

SEQ ID NO: 1713142 - RNA, 14 nt, Salmonella enterica enterica serovar Typhi
aucggccugcucuu

SEQ ID NO: 1713143 - RNA, 14 nt, Salmonella enterica enterica serovar Typhi
aucggccugaaugc

SEQ ID NO: 1713144 - RNA, 18 nt, Salmonella enterica enterica serovar Typhi
aucggccaggauggcccg

SEQ ID NO: 1713145 - RNA, 18 nt, Salmonella enterica enterica serovar Typhi
aucgggcuguugaauauc

SEQ ID NO: 1713146 - RNA, 15 nt, Salmonella enterica enterica serovar Typhi
aucgggcuuccagcg

SEQ ID NO: 1713147 - RNA, 19 nt, Salmonella enterica enterica serovar Typhi
aucggguauguuuuagcag

SEQ ID NO: 1713148 - RNA, 20 nt, Salmonella enterica enterica serovar Typhi
aucggucugcuucagccacu

SEQ ID NO: 1713149 - RNA, 18 nt, Salmonella enterica enterica serovar Typhi
aucgguauaacuggucau

SEQ ID NO: 1713150 - RNA, 17 nt, Salmonella enterica enterica serovar Typhi
aucggguuuuccugaau

SEQ ID NO: 1713151 - RNA, 23 nt, Salmonella enterica enterica serovar Typhi
aucgguaggccggauaaggcauu

SEQ ID NO: 1713152 - RNA, 21 nt, Salmonella enterica enterica serovar Typhi
aucgguaauugcgccguucac

SEQ ID NO: 1713153 - RNA, 20 nt, Salmonella enterica enterica serovar Typhi
aucggcaaacauagccucaa

SEQ ID NO: 1713154 - RNA, 11 nt, Salmonella enterica enterica serovar Typhi
aucggcaaaca

SEQ ID NO: 1713155 - RNA, 15 nt, Salmonella enterica enterica serovar Typhi
aucggcaagcaucug

SEQ ID NO: 1713156 - RNA, 13 nt, Salmonella enterica enterica serovar Typhi
aucggccagcagg

SEQ ID NO: 1713157 - RNA, 20 nt, Salmonella enterica enterica serovar Typhi
aucggccagauaguggcuga

SEQ ID NO: 1713158 - RNA, 13 nt, Salmonella enterica enterica serovar Typhi
aucggauccaucg

SEQ ID NO: 1713159 - RNA, 15 nt, Salmonella enterica enterica serovar Typhi
aucggauagaugaag

SEQ ID NO: 1713160 - RNA, 17 nt, Salmonella enterica enterica serovar Typhi
aucggauuuacagggga

SEQ ID NO: 1713161 - RNA, 16 nt, Salmonella enterica enterica serovar Typhi
aucgcguacaggaugu

SEQ ID NO: 1713162 - RNA, 15 nt, Salmonella enterica enterica serovar Typhi
aucgcggggcaacag

SEQ ID NO: 1713163 - RNA, 20 nt, Salmonella enterica enterica serovar Typhi
aucgcguuuuccagcauccu

SEQ ID NO: 1713164 - RNA, 18 nt, Salmonella enterica enterica serovar Typhi
aucgcguuuuccagcauc

SEQ ID NO: 1713165 - RNA, 15 nt, Salmonella enterica enterica serovar Typhi
aucgcuaauuuuuaa

SEQ ID NO: 1713166 - RNA, 17 nt, Salmonella enterica enterica serovar Typhi
aucgcuaaacauauacc

SEQ ID NO: 1713167 - RNA, 17 nt, Salmonella enterica enterica serovar Typhi
aucuaaaauuauuuuua

SEQ ID NO: 1713168 - RNA, 14 nt, Salmonella enterica enterica serovar Typhi
aucguugccgccgu

SEQ ID NO: 1713169 - RNA, 22 nt, Salmonella enterica enterica serovar Typhi
aucguucgcccuucaucuucca

SEQ ID NO: 1713170 - RNA, 19 nt, Salmonella enterica enterica serovar Typhi
aucguuauccagcagccac

SEQ ID NO: 1713171 - RNA, 13 nt, Salmonella enterica enterica serovar Typhi
aucguuauauaua

SEQ ID NO: 1713172 - RNA, 23 nt, Salmonella enterica enterica serovar Typhi
aucuacaaucgucuucagcaauu

SEQ ID NO: 1713173 - RNA, 16 nt, Salmonella enterica enterica serovar Typhi
aucguccggcgaaaac

SEQ ID NO: 1713174 - RNA, 16 nt, Salmonella enterica enterica serovar Typhi
aucgucgccagaccca

SEQ ID NO: 1713175 - RNA, 13 nt, Salmonella enterica enterica serovar Typhi
aucguccagccau

SEQ ID NO: 1713176 - RNA, 22 nt, Salmonella enterica enterica serovar Typhi
aucgucaucggucaguuugccc

SEQ ID NO: 1713177 - RNA, 15 nt, Salmonella enterica enterica serovar Typhi
aucguguugcagccc

SEQ ID NO: 1713178 - RNA, 19 nt, Salmonella enterica enterica serovar Typhi
aucguguuauuuucaaaaa

SEQ ID NO: 1713179 - RNA, 23 nt, Salmonella enterica enterica serovar Typhi
aucgugcgcguaugauuuucuua

SEQ ID NO: 1713180 - RNA, 16 nt, Salmonella enterica enterica serovar Typhi
aucgugguuggcauau

SEQ ID NO: 1713181 - RNA, 20 nt, Salmonella enterica enterica serovar Typhi
aucgugcggcgaagcaucuu

SEQ ID NO: 1713182 - RNA, 23 nt, Salmonella enterica enterica serovar Typhi
aucgugccguccggcaucacaaa

SEQ ID NO: 1713183 - RNA, 23 nt, Salmonella enterica enterica serovar Typhi
aucgugcaagcccaacuauuuua

SEQ ID NO: 1713184 - RNA, 15 nt, Salmonella enterica enterica serovar Typhi
aucgagaucagacuu

SEQ ID NO: 1713185 - RNA, 13 nt, Salmonella enterica enterica serovar Typhi
aucgagauaagau

SEQ ID NO: 1713186 - RNA, 15 nt, Salmonella enterica enterica serovar Typhi
auccuuuuucaugca

SEQ ID NO: 1713187 - RNA, 18 nt, Salmonella enterica enterica serovar Typhi
auccuuuuucugcgccag

SEQ ID NO: 1713188 - RNA, 13 nt, Salmonella enterica enterica serovar Typhi
aucgaaaaccggu

SEQ ID NO: 1713189 - RNA, 23 nt, Salmonella enterica enterica serovar Typhi
aucagcguuucgccguaaaacaa

SEQ ID NO: 1713190 - RNA, 22 nt, Salmonella enterica enterica serovar Typhi
aucagcuauuagcguuuuuacc

SEQ ID NO: 1713191 - RNA, 22 nt, Salmonella enterica enterica serovar Typhi
aucagcuuugcggccagcauau

SEQ ID NO: 1713192 - RNA, 21 nt, Salmonella enterica enterica serovar Typhi
aucaggaaaaagggaauaaua

SEQ ID NO: 1713193 - RNA, 21 nt, Salmonella enterica enterica serovar Typhi
aucgcaacgccggugccugcc

SEQ ID NO: 1713194 - RNA, 14 nt, Salmonella enterica enterica serovar Typhi
aucgauaagccagc

SEQ ID NO: 1713195 - RNA, 16 nt, Salmonella enterica enterica serovar Typhi
aucgauacuaaaacuu

SEQ ID NO: 1713196 - RNA, 20 nt, Salmonella enterica enterica serovar Typhi
aucgauauaucgcgucauca

SEQ ID NO: 1713197 - RNA, 18 nt, Salmonella enterica enterica serovar Typhi
aucgagcggcaguagcag

SEQ ID NO: 1713198 - RNA, 17 nt, Salmonella enterica enterica serovar Typhi
aucgaggccauauuuaa

SEQ ID NO: 1713199 - RNA, 16 nt, Salmonella enterica enterica serovar Typhi
aucgagucaggcgcca

SEQ ID NO: 1713200 - RNA, 21 nt, Salmonella enterica enterica serovar Typhi
aucgagugucaauaagccaga

SEQ ID NO: 1713201 - RNA, 13 nt, Salmonella enterica enterica serovar Typhi
aucgcgagaaaau

SEQ ID NO: 1713202 - RNA, 19 nt, Salmonella enterica enterica serovar Typhi
aucgcgagcacuuuuuccu

SEQ ID NO: 1713203 - RNA, 23 nt, Salmonella enterica enterica serovar Typhi
aucgcgagcacuuuuuccuccug

SEQ ID NO: 1713204 - RNA, 17 nt, Salmonella enterica enterica serovar Typhi
aucgcgcagcaaaucag

SEQ ID NO: 1713205 - RNA, 19 nt, Salmonella enterica enterica serovar Typhi
aucgcgauacugccgccca

SEQ ID NO: 1713206 - RNA, 22 nt, Salmonella enterica enterica serovar Typhi
aucgccucccugccuaaagaaa

SEQ ID NO: 1713207 - RNA, 23 nt, Salmonella enterica enterica serovar Typhi
aucgccucccugccuaaagaaaa

SEQ ID NO: 1713208 - RNA, 13 nt, Salmonella enterica enterica serovar Typhi
aucgccucaacca

SEQ ID NO: 1713209 - RNA, 22 nt, Salmonella enterica enterica serovar Typhi
aucgccguuaucgaggcgcugg

SEQ ID NO: 1713210 - RNA, 19 nt, Salmonella enterica enterica serovar Typhi
aucgcgccggucgccagca

SEQ ID NO: 1713211 - RNA, 21 nt, Salmonella enterica enterica serovar Typhi
aucgcgcgcagaguguaggcc

SEQ ID NO: 1713212 - RNA, 15 nt, Salmonella enterica enterica serovar Typhi
aucgcgcugauauuu

SEQ ID NO: 1713213 - RNA, 21 nt, Salmonella enterica enterica serovar Typhi
aucgcggcgcugaguuucucc

SEQ ID NO: 1713214 - RNA, 23 nt, Salmonella enterica enterica serovar Typhi
aucgcgggcaaucaaaugcgcau

SEQ ID NO: 1713215 - RNA, 16 nt, Salmonella enterica enterica serovar Typhi
aucgcaggaugcgcug

SEQ ID NO: 1713216 - RNA, 22 nt, Salmonella enterica enterica serovar Typhi
aucgcagaaauauuuugccugc

SEQ ID NO: 1713217 - RNA, 13 nt, Salmonella enterica enterica serovar Typhi
aucgcauauugcg

SEQ ID NO: 1713218 - RNA, 22 nt, Salmonella enterica enterica serovar Typhi
aucgcccccaucgugauaaagg

SEQ ID NO: 1713219 - RNA, 15 nt, Salmonella enterica enterica serovar Typhi
aucgcccaucacaug

SEQ ID NO: 1713220 - RNA, 17 nt, Salmonella enterica enterica serovar Typhi
aucgcccggccuccggu

SEQ ID NO: 1713221 - RNA, 22 nt, Salmonella enterica enterica serovar Typhi
aucgccgguagcuucagcggcg

SEQ ID NO: 1713222 - RNA, 17 nt, Salmonella enterica enterica serovar Typhi
aucuugaguuuggccug

SEQ ID NO: 1713223 - RNA, 17 nt, Salmonella enterica enterica serovar Typhi
aucuuuaccaaugugca

SEQ ID NO: 1713224 - RNA, 17 nt, Salmonella enterica enterica serovar Typhi
aucuggccaauuuuuca

SEQ ID NO: 1713225 - RNA, 21 nt, Salmonella enterica enterica serovar Typhi
aucuggcgcuuuuccagcacg

SEQ ID NO: 1713226 - RNA, 20 nt, Salmonella enterica enterica serovar Typhi
aucugcgugaugcaucagaa

SEQ ID NO: 1713227 - RNA, 18 nt, Salmonella enterica enterica serovar Typhi
aucuggcugcguaaaauc

SEQ ID NO: 1713228 - RNA, 19 nt, Salmonella enterica enterica serovar Typhi
aucugggcugagaaaaauu

SEQ ID NO: 1713229 - RNA, 11 nt, Salmonella enterica enterica serovar Typhi
aucuucuuccg

SEQ ID NO: 1713230 - RNA, 17 nt, Salmonella enterica enterica serovar Typhi
aucuggucaaguauuuc

SEQ ID NO: 1713231 - RNA, 14 nt, Salmonella enterica enterica serovar Typhi
augaaagaaaucac

SEQ ID NO: 1713232 - RNA, 12 nt, Salmonella enterica enterica serovar Typhi
augaaagagaaa

SEQ ID NO: 1713233 - RNA, 13 nt, Salmonella enterica enterica serovar Typhi
augaaaccccaaa

SEQ ID NO: 1713234 - RNA, 13 nt, Salmonella enterica enterica serovar Typhi
aucuuuccuuuuu

SEQ ID NO: 1713235 - RNA, 16 nt, Salmonella enterica enterica serovar Typhi
aucuuuuacgaaacaa

SEQ ID NO: 1713236 - RNA, 18 nt, Salmonella enterica enterica serovar Typhi
aucuuuugcgccuuccag

SEQ ID NO: 1713237 - RNA, 15 nt, Salmonella enterica enterica serovar Typhi
augaagauauucacu

SEQ ID NO: 1713238 - RNA, 19 nt, Salmonella enterica enterica serovar Typhi
augaaggagagcauuuuuu

SEQ ID NO: 1713239 - RNA, 23 nt, Salmonella enterica enterica serovar Typhi
augaaggauacggaauggauaac

SEQ ID NO: 1713240 - RNA, 20 nt, Salmonella enterica enterica serovar Typhi
augaacuuacacuuaccuga

SEQ ID NO: 1713241 - RNA, 20 nt, Salmonella enterica enterica serovar Typhi
augacugcgaauuuccugcc

SEQ ID NO: 1713242 - RNA, 12 nt, Salmonella enterica enterica serovar Typhi
augagaagaaaa

SEQ ID NO: 1713243 - RNA, 13 nt, Salmonella enterica enterica serovar Typhi
augacgaacagga

SEQ ID NO: 1713244 - RNA, 21 nt, Salmonella enterica enterica serovar Typhi
augaccugggcgccagagagc

SEQ ID NO: 1713245 - RNA, 18 nt, Salmonella enterica enterica serovar Typhi
augaccuggugcaucaua

SEQ ID NO: 1713246 - RNA, 17 nt, Salmonella enterica enterica serovar Typhi
augacgccgaaauaaau

SEQ ID NO: 1713247 - RNA, 14 nt, Salmonella enterica enterica serovar Typhi
augaguaaaugaac

SEQ ID NO: 1713248 - RNA, 23 nt, Salmonella enterica enterica serovar Typhi
augaguauauagcgcuccuuuaa

SEQ ID NO: 1713249 - RNA, 18 nt, Salmonella enterica enterica serovar Typhi
augagcaaacugcucauu

SEQ ID NO: 1713250 - RNA, 22 nt, Salmonella enterica enterica serovar Typhi
augagauacgucaucaugcugc

SEQ ID NO: 1713251 - RNA, 18 nt, Salmonella enterica enterica serovar Typhi
augagagacggagaaaaa

SEQ ID NO: 1713252 - RNA, 20 nt, Salmonella enterica enterica serovar Typhi
augaaguuaucgaaggucag

SEQ ID NO: 1713253 - RNA, 18 nt, Salmonella enterica enterica serovar Typhi
augaauaaaugaauuauu

SEQ ID NO: 1713254 - RNA, 21 nt, Salmonella enterica enterica serovar Typhi
augaaggguauauaaaucaaa

SEQ ID NO: 1713255 - RNA, 23 nt, Salmonella enterica enterica serovar Typhi
augaagcugcagggauaugcuga

SEQ ID NO: 1713256 - RNA, 14 nt, Salmonella enterica enterica serovar Typhi
augaaucaucagaa

SEQ ID NO: 1713257 - RNA, 20 nt, Salmonella enterica enterica serovar Typhi
augaauacgcaagccgaacu

SEQ ID NO: 1713258 - RNA, 23 nt, Salmonella enterica enterica serovar Typhi
augaauacgcuccagcuggcugg

SEQ ID NO: 1713259 - RNA, 20 nt, Salmonella enterica enterica serovar Typhi
augaauagccccucaauuau

SEQ ID NO: 1713260 - RNA, 22 nt, Salmonella enterica enterica serovar Typhi
augaauauccgccgcccagcgg

SEQ ID NO: 1713261 - RNA, 14 nt, Salmonella enterica enterica serovar Typhi
augaauaucaaacc

SEQ ID NO: 1713262 - RNA, 19 nt, Salmonella enterica enterica serovar Typhi
augaccaccgcaucggcau

SEQ ID NO: 1713263 - RNA, 16 nt, Salmonella enterica enterica serovar Typhi
augacaugaaagaaga

SEQ ID NO: 1713264 - RNA, 16 nt, Salmonella enterica enterica serovar Typhi
augacaucgcaaugcc

SEQ ID NO: 1713265 - RNA, 21 nt, Salmonella enterica enterica serovar Typhi
augaauuuaucccgugguggg

SEQ ID NO: 1713266 - RNA, 12 nt, Salmonella enterica enterica serovar Typhi
augaauuauuuu

SEQ ID NO: 1713267 - RNA, 20 nt, Salmonella enterica enterica serovar Typhi
augauguucauccauauauc

SEQ ID NO: 1713268 - RNA, 19 nt, Salmonella enterica enterica serovar Typhi
augauguucauccauauau

SEQ ID NO: 1713269 - RNA, 23 nt, Salmonella enterica enterica serovar Typhi
augauguccgccuugaggcguuu

SEQ ID NO: 1713270 - RNA, 14 nt, Salmonella enterica enterica serovar Typhi
augauuucaggcau

SEQ ID NO: 1713271 - RNA, 13 nt, Salmonella enterica enterica serovar Typhi
augauuuaaaaaa

SEQ ID NO: 1713272 - RNA, 16 nt, Salmonella enterica enterica serovar Typhi
augauuuuaacaucac

SEQ ID NO: 1713273 - RNA, 21 nt, Salmonella enterica enterica serovar Typhi
augcaaagaagggcaggggaa

SEQ ID NO: 1713274 - RNA, 14 nt, Salmonella enterica enterica serovar Typhi
augauuuuaacauc

SEQ ID NO: 1713275 - RNA, 12 nt, Salmonella enterica enterica serovar Typhi
augcaaauguca

SEQ ID NO: 1713276 - RNA, 21 nt, Salmonella enterica enterica serovar Typhi
augaugagaugcaggccaagc

SEQ ID NO: 1713277 - RNA, 17 nt, Salmonella enterica enterica serovar Typhi
augauggggucacaggu

SEQ ID NO: 1713278 - RNA, 14 nt, Salmonella enterica enterica serovar Typhi
augaugaaaaagaa

SEQ ID NO: 1713279 - RNA, 15 nt, Salmonella enterica enterica serovar Typhi
augaugaaaaagaau

SEQ ID NO: 1713280 - RNA, 21 nt, Salmonella enterica enterica serovar Typhi
augaugaccuggugcaucaua

SEQ ID NO: 1713281 - RNA, 17 nt, Salmonella enterica enterica serovar Typhi
augaugaccgaagcagg

SEQ ID NO: 1713282 - RNA, 15 nt, Salmonella enterica enterica serovar Typhi
augaguuaacgacug

SEQ ID NO: 1713283 - RNA, 13 nt, Salmonella enterica enterica serovar Typhi
augaugaaaaaga

SEQ ID NO: 1713284 - RNA, 15 nt, Salmonella enterica enterica serovar Typhi
augcauaaaaaaacg

SEQ ID NO: 1713285 - RNA, 13 nt, Salmonella enterica enterica serovar Typhi
augcagugcugcu

SEQ ID NO: 1713286 - RNA, 14 nt, Salmonella enterica enterica serovar Typhi
augccaaccaccgc

SEQ ID NO: 1713287 - RNA, 14 nt, Salmonella enterica enterica serovar Typhi
augccaagcggcau

SEQ ID NO: 1713288 - RNA, 16 nt, Salmonella enterica enterica serovar Typhi
augccacuauagauga

SEQ ID NO: 1713289 - RNA, 23 nt, Salmonella enterica enterica serovar Typhi
augccacugcccucaaguuaugu

SEQ ID NO: 1713290 - RNA, 21 nt, Salmonella enterica enterica serovar Typhi
augccacgccccuaaggcagc

SEQ ID NO: 1713291 - RNA, 14 nt, Salmonella enterica enterica serovar Typhi
augccacgaucccc

SEQ ID NO: 1713292 - RNA, 21 nt, Salmonella enterica enterica serovar Typhi
augccacacccugagcgccgc

SEQ ID NO: 1713293 - RNA, 15 nt, Salmonella enterica enterica serovar Typhi
augccagcgauuauu

SEQ ID NO: 1713294 - RNA, 19 nt, Salmonella enterica enterica serovar Typhi
augcaauuccgcuuucuuc

SEQ ID NO: 1713295 - RNA, 14 nt, Salmonella enterica enterica serovar Typhi
augcaauuccgcuu

SEQ ID NO: 1713296 - RNA, 15 nt, Salmonella enterica enterica serovar Typhi
augcacaacacgcuu

SEQ ID NO: 1713297 - RNA, 19 nt, Salmonella enterica enterica serovar Typhi
augcacaggcggcgguuca

SEQ ID NO: 1713298 - RNA, 19 nt, Salmonella enterica enterica serovar Typhi
augcacaauacgccgagca

SEQ ID NO: 1713299 - RNA, 13 nt, Salmonella enterica enterica serovar Typhi
augcacacgcagc

SEQ ID NO: 1713300 - RNA, 13 nt, Salmonella enterica enterica serovar Typhi
augcagccaggcc

SEQ ID NO: 1713301 - RNA, 20 nt, Salmonella enterica enterica serovar Typhi
augcagguaguccaaauaag

SEQ ID NO: 1713302 - RNA, 20 nt, Salmonella enterica enterica serovar Typhi
augcagcgucugcccuccug

SEQ ID NO: 1713303 - RNA, 14 nt, Salmonella enterica enterica serovar Typhi
augcaggccaagca

SEQ ID NO: 1713304 - RNA, 17 nt, Salmonella enterica enterica serovar Typhi
augcccccgcgcaggcg

SEQ ID NO: 1713305 - RNA, 15 nt, Salmonella enterica enterica serovar Typhi
augcccauaaagaaa

SEQ ID NO: 1713306 - RNA, 20 nt, Salmonella enterica enterica serovar Typhi
augcccaggcggcgggaaug

SEQ ID NO: 1713307 - RNA, 12 nt, Salmonella enterica enterica serovar Typhi
augcccaaaaua

SEQ ID NO: 1713308 - RNA, 21 nt, Salmonella enterica enterica serovar Typhi
augccauaguagaagugaagc

SEQ ID NO: 1713309 - RNA, 19 nt, Salmonella enterica enterica serovar Typhi
augccaucggccagcaggc

SEQ ID NO: 1713310 - RNA, 18 nt, Salmonella enterica enterica serovar Typhi
augccauguuucuuuuaa

SEQ ID NO: 1713311 - RNA, 16 nt, Salmonella enterica enterica serovar Typhi
augccgcacaaaauuu

SEQ ID NO: 1713312 - RNA, 16 nt, Salmonella enterica enterica serovar Typhi
augccgaguuccggau

SEQ ID NO: 1713313 - RNA, 20 nt, Salmonella enterica enterica serovar Typhi
augccgccauccgacacagc

SEQ ID NO: 1713314 - RNA, 15 nt, Salmonella enterica enterica serovar Typhi
augccgccgcaacgc

SEQ ID NO: 1713315 - RNA, 10 nt, Salmonella enterica enterica serovar Typhi
augccgccgc

SEQ ID NO: 1713316 - RNA, 12 nt, Salmonella enterica enterica serovar Typhi
augccgaccaau

SEQ ID NO: 1713317 - RNA, 14 nt, Salmonella enterica enterica serovar Typhi
augccgacccaccu

SEQ ID NO: 1713318 - RNA, 17 nt, Salmonella enterica enterica serovar Typhi
augccgacccaccugac

SEQ ID NO: 1713319 - RNA, 17 nt, Salmonella enterica enterica serovar Typhi
augcccggggugaacaa

SEQ ID NO: 1713320 - RNA, 19 nt, Salmonella enterica enterica serovar Typhi
augcccgguaagaaugcgc

SEQ ID NO: 1713321 - RNA, 21 nt, Salmonella enterica enterica serovar Typhi
augccuguguaucgcccugcc

SEQ ID NO: 1713322 - RNA, 20 nt, Salmonella enterica enterica serovar Typhi
augccugcgcauccucuuuc

SEQ ID NO: 1713323 - RNA, 21 nt, Salmonella enterica enterica serovar Typhi
augccugcgcauccucuuucc

SEQ ID NO: 1713324 - RNA, 21 nt, Salmonella enterica enterica serovar Typhi
augccguucuuuaaucagauu

SEQ ID NO: 1713325 - RNA, 18 nt, Salmonella enterica enterica serovar Typhi
augccguuggcuuuggcu

SEQ ID NO: 1713326 - RNA, 22 nt, Salmonella enterica enterica serovar Typhi
augccggauaguuacccggcaa

SEQ ID NO: 1713327 - RNA, 15 nt, Salmonella enterica enterica serovar Typhi
augccgggcaaaaaa

SEQ ID NO: 1713328 - RNA, 13 nt, Salmonella enterica enterica serovar Typhi
augccgcugcugg

SEQ ID NO: 1713329 - RNA, 21 nt, Salmonella enterica enterica serovar Typhi
augccgcuggccgaugucaau

SEQ ID NO: 1713330 - RNA, 18 nt, Salmonella enterica enterica serovar Typhi
augccgccuuuaucgaca

SEQ ID NO: 1713331 - RNA, 17 nt, Salmonella enterica enterica serovar Typhi
augccguagccaaguau

SEQ ID NO: 1713332 - RNA, 14 nt, Salmonella enterica enterica serovar Typhi
augccgugaguaau

SEQ ID NO: 1713333 - RNA, 23 nt, Salmonella enterica enterica serovar Typhi
augccggugcgagaaaaagcaau

SEQ ID NO: 1713334 - RNA, 13 nt, Salmonella enterica enterica serovar Typhi
auucagcggcugc

SEQ ID NO: 1713335 - RNA, 21 nt, Salmonella enterica enterica serovar Typhi
auucagggaacguugcgccau

SEQ ID NO: 1713336 - RNA, 16 nt, Salmonella enterica enterica serovar Typhi
auucaggguugucuca

SEQ ID NO: 1713337 - RNA, 11 nt, Salmonella enterica enterica serovar Typhi
auucagguaau

SEQ ID NO: 1713338 - RNA, 12 nt, Salmonella enterica enterica serovar Typhi
auucagguaaua

SEQ ID NO: 1713339 - RNA, 21 nt, Salmonella enterica enterica serovar Typhi
auucagguuauuugccucugg

SEQ ID NO: 1713340 - RNA, 18 nt, Salmonella enterica enterica serovar Typhi
auucagguggauuuuugc

SEQ ID NO: 1713341 - RNA, 20 nt, Salmonella enterica enterica serovar Typhi
auucagguuuugcugaucaa

SEQ ID NO: 1713342 - RNA, 14 nt, Salmonella enterica enterica serovar Typhi
auucucgcacuuua

SEQ ID NO: 1713343 - RNA, 18 nt, Salmonella enterica enterica serovar Typhi
auucugcuuaccagaccg

SEQ ID NO: 1713344 - RNA, 16 nt, Salmonella enterica enterica serovar Typhi
auucuggaaucaauuu

SEQ ID NO: 1713345 - RNA, 21 nt, Salmonella enterica enterica serovar Typhi
auucuggaaucaauuucccuu

SEQ ID NO: 1713346 - RNA, 18 nt, Salmonella enterica enterica serovar Typhi
auucugguaguaagucag

SEQ ID NO: 1713347 - RNA, 19 nt, Salmonella enterica enterica serovar Typhi
auucugggcuuacuuucca

SEQ ID NO: 1713348 - RNA, 23 nt, Salmonella enterica enterica serovar Typhi
auucuguggggcuuaacccacga

SEQ ID NO: 1713349 - RNA, 22 nt, Salmonella enterica enterica serovar Typhi
auucuguaucgcuuauuuucgu

SEQ ID NO: 1713350 - RNA, 15 nt, Salmonella enterica enterica serovar Typhi
auucugucagaaauc

SEQ ID NO: 1713351 - RNA, 17 nt, Salmonella enterica enterica serovar Typhi
auucuguguuuuuucgu

SEQ ID NO: 1713352 - RNA, 18 nt, Salmonella enterica enterica serovar Typhi
auucuguuagcgcccucu

SEQ ID NO: 1713353 - RNA, 19 nt, Salmonella enterica enterica serovar Typhi
auucuuaacccacaagaaa

SEQ ID NO: 1713354 - RNA, 18 nt, Salmonella enterica enterica serovar Typhi
auucuuaacccacaagaa

SEQ ID NO: 1713355 - RNA, 14 nt, Salmonella enterica enterica serovar Typhi
auugaccggaaaaa

SEQ ID NO: 1713356 - RNA, 18 nt, Salmonella enterica enterica serovar Typhi
auugaccguccccagcca

SEQ ID NO: 1713357 - RNA, 16 nt, Salmonella enterica enterica serovar Typhi
auugaccgcuuuuucc

SEQ ID NO: 1713358 - RNA, 14 nt, Salmonella enterica enterica serovar Typhi
auugagacaugccg

SEQ ID NO: 1713359 - RNA, 21 nt, Salmonella enterica enterica serovar Typhi
auugagacaugccgccagacc

SEQ ID NO: 1713360 - RNA, 22 nt, Salmonella enterica enterica serovar Typhi
auugagacaugccgccagacca

SEQ ID NO: 1713361 - RNA, 15 nt, Salmonella enterica enterica serovar Typhi
auugagacaaauaac

SEQ ID NO: 1713362 - RNA, 14 nt, Salmonella enterica enterica serovar Typhi
auugacuucaacgc

SEQ ID NO: 1713363 - RNA, 17 nt, Salmonella enterica enterica serovar Typhi
auugacuggauuuuuga

SEQ ID NO: 1713364 - RNA, 23 nt, Salmonella enterica enterica serovar Typhi
auugaagcgauauucgguaagcu

SEQ ID NO: 1713365 - RNA, 20 nt, Salmonella enterica enterica serovar Typhi
auugaaaagcagccagaccc

SEQ ID NO: 1713366 - RNA, 18 nt, Salmonella enterica enterica serovar Typhi
auucuuaguccucagcga

SEQ ID NO: 1713367 - RNA, 18 nt, Salmonella enterica enterica serovar Typhi
auugccgcgcccugcgga

SEQ ID NO: 1713368 - RNA, 19 nt, Salmonella enterica enterica serovar Typhi
auugccgaccauuacccac

SEQ ID NO: 1713369 - RNA, 19 nt, Salmonella enterica enterica serovar Typhi
auugccgaccgccagcaga

SEQ ID NO: 1713370 - RNA, 17 nt, Salmonella enterica enterica serovar Typhi
auugcccuuuuguuuuu

SEQ ID NO: 1713371 - RNA, 21 nt, Salmonella enterica enterica serovar Typhi
auugccguuguugucaauauc

SEQ ID NO: 1713372 - RNA, 15 nt, Salmonella enterica enterica serovar Typhi
auugccuaaauaacu

SEQ ID NO: 1713373 - RNA, 13 nt, Salmonella enterica enterica serovar Typhi
auugcccaccggc

SEQ ID NO: 1713374 - RNA, 15 nt, Salmonella enterica enterica serovar Typhi
auugcaccauuuaca

SEQ ID NO: 1713375 - RNA, 16 nt, Salmonella enterica enterica serovar Typhi
auugcagaauauguuc

SEQ ID NO: 1713376 - RNA, 19 nt, Salmonella enterica enterica serovar Typhi
auugccauguuaauaccag

SEQ ID NO: 1713377 - RNA, 18 nt, Salmonella enterica enterica serovar Typhi
auugaggcuacccagaca

SEQ ID NO: 1713378 - RNA, 20 nt, Salmonella enterica enterica serovar Typhi
auugagcgcaaaacgcugcu

SEQ ID NO: 1713379 - RNA, 18 nt, Salmonella enterica enterica serovar Typhi
auugagcuggauaagcug

SEQ ID NO: 1713380 - RNA, 13 nt, Salmonella enterica enterica serovar Typhi
auugcaagaauau

SEQ ID NO: 1713381 - RNA, 13 nt, Salmonella enterica enterica serovar Typhi
auugauuuuucug

SEQ ID NO: 1713382 - RNA, 15 nt, Salmonella enterica enterica serovar Typhi
auugauuuuucuggu

SEQ ID NO: 1713383 - RNA, 20 nt, Salmonella enterica enterica serovar Typhi
auugggcguaagaaaaguuu

SEQ ID NO: 1713384 - RNA, 19 nt, Salmonella enterica enterica serovar Typhi
auuggguaguaauauuaaa

SEQ ID NO: 1713385 - RNA, 23 nt, Salmonella enterica enterica serovar Typhi
auugggccagcagcgcaucaucc

SEQ ID NO: 1713386 - RNA, 15 nt, Salmonella enterica enterica serovar Typhi
auugggcguaagaaa

SEQ ID NO: 1713387 - RNA, 17 nt, Salmonella enterica enterica serovar Typhi
auugcgaauaaaacugc

SEQ ID NO: 1713388 - RNA, 13 nt, Salmonella enterica enterica serovar Typhi
auugcguugcuuu

SEQ ID NO: 1713389 - RNA, 14 nt, Salmonella enterica enterica serovar Typhi
auugcgagaaaaaa

SEQ ID NO: 1713390 - RNA, 16 nt, Salmonella enterica enterica serovar Typhi
auugcgauaugcuguu

SEQ ID NO: 1713391 - RNA, 21 nt, Salmonella enterica enterica serovar Typhi
auugcgaucuccuuuaaugaa

SEQ ID NO: 1713392 - RNA, 20 nt, Salmonella enterica enterica serovar Typhi
auugcugugaaguaauucuu

SEQ ID NO: 1713393 - RNA, 13 nt, Salmonella enterica enterica serovar Typhi
auugcucacccau

SEQ ID NO: 1713394 - RNA, 15 nt, Salmonella enterica enterica serovar Typhi
auuucaggcauuuua

SEQ ID NO: 1713395 - RNA, 20 nt, Salmonella enterica enterica serovar Typhi
auuucagcgcagaauuuauu

SEQ ID NO: 1713396 - RNA, 16 nt, Salmonella enterica enterica serovar Typhi
auuucagcauccuccg

SEQ ID NO: 1713397 - RNA, 15 nt, Salmonella enterica enterica serovar Typhi
auuucaacccggcau

SEQ ID NO: 1713398 - RNA, 18 nt, Salmonella enterica enterica serovar Typhi
auuuauuuugaauuuuua

SEQ ID NO: 1713399 - RNA, 19 nt, Salmonella enterica enterica serovar Typhi
auuuauuuugaauuuuuau

SEQ ID NO: 1713400 - RNA, 23 nt, Salmonella enterica enterica serovar Typhi
auuuauuuucugaacgcugcugu

SEQ ID NO: 1713401 - RNA, 17 nt, Salmonella enterica enterica serovar Typhi
auuuauugccugaaacg

SEQ ID NO: 1713402 - RNA, 12 nt, Salmonella enterica enterica serovar Typhi
auuuauucuauu

SEQ ID NO: 1713403 - RNA, 15 nt, Salmonella enterica enterica serovar Typhi
auuuauagagcagca

SEQ ID NO: 1713404 - RNA, 20 nt, Salmonella enterica enterica serovar Typhi
auuuauccauguuuguuuaa

SEQ ID NO: 1713405 - RNA, 14 nt, Salmonella enterica enterica serovar Typhi
auuuauccacgccg

SEQ ID NO: 1713406 - RNA, 18 nt, Salmonella enterica enterica serovar Typhi
auuuaucgaucuccaucu

SEQ ID NO: 1713407 - RNA, 21 nt, Salmonella enterica enterica serovar Typhi
auuuaaugaaccgggagauaa

SEQ ID NO: 1713408 - RNA, 13 nt, Salmonella enterica enterica serovar Typhi
auuuaauauuuau

SEQ ID NO: 1713409 - RNA, 17 nt, Salmonella enterica enterica serovar Typhi
auuuaauauaugaacca

SEQ ID NO: 1713410 - RNA, 13 nt, Salmonella enterica enterica serovar Typhi
auuuaauacauca

SEQ ID NO: 1713411 - RNA, 15 nt, Salmonella enterica enterica serovar Typhi
auuguggaaauaaga

SEQ ID NO: 1713412 - RNA, 13 nt, Salmonella enterica enterica serovar Typhi
auugugaaauucg

SEQ ID NO: 1713413 - RNA, 15 nt, Salmonella enterica enterica serovar Typhi
auugugauuccaguu

SEQ ID NO: 1713414 - RNA, 18 nt, Salmonella enterica enterica serovar Typhi
auugugcacagguaaacg

SEQ ID NO: 1713415 - RNA, 21 nt, Salmonella enterica enterica serovar Typhi
auugucaccuguaaccccagc

SEQ ID NO: 1713416 - RNA, 23 nt, Salmonella enterica enterica serovar Typhi
auuguccuuuaucugcccuuucu

SEQ ID NO: 1713417 - RNA, 13 nt, Salmonella enterica enterica serovar Typhi
auuguaugcaaga

SEQ ID NO: 1713418 - RNA, 14 nt, Salmonella enterica enterica serovar Typhi
auuguugcgccaug

SEQ ID NO: 1713419 - RNA, 13 nt, Salmonella enterica enterica serovar Typhi
auuguugccccgc

SEQ ID NO: 1713420 - RNA, 17 nt, Salmonella enterica enterica serovar Typhi
auuguguuuaccucaua

SEQ ID NO: 1713421 - RNA, 13 nt, Salmonella enterica enterica serovar Typhi
auuguuccagguu

SEQ ID NO: 1713422 - RNA, 17 nt, Salmonella enterica enterica serovar Typhi
auuguuuguagaaagug

SEQ ID NO: 1713423 - RNA, 15 nt, Salmonella enterica enterica serovar Typhi
auuuaaauagcaauu

SEQ ID NO: 1713424 - RNA, 20 nt, Salmonella enterica enterica serovar Typhi
auuuaaauagcaauuauauu

SEQ ID NO: 1713425 - RNA, 18 nt, Salmonella enterica enterica serovar Typhi
auuuaaagauagcugcuu

SEQ ID NO: 1713426 - RNA, 19 nt, Salmonella enterica enterica serovar Typhi
auuuaacccugguuugcug

SEQ ID NO: 1713427 - RNA, 20 nt, Salmonella enterica enterica serovar Typhi
auuuaacgaguugaauaacg

SEQ ID NO: 1713428 - RNA, 21 nt, Salmonella enterica enterica serovar Typhi
auuuucaucaagccauugcgc

SEQ ID NO: 1713429 - RNA, 21 nt, Salmonella enterica enterica serovar Typhi
auuuucagccauuuuuuauug

SEQ ID NO: 1713430 - RNA, 17 nt, Salmonella enterica enterica serovar Typhi
auuuucacuuauaaaua

SEQ ID NO: 1713431 - RNA, 22 nt, Salmonella enterica enterica serovar Typhi
auuuucacgcucgaguucuuca

SEQ ID NO: 1713432 - RNA, 22 nt, Salmonella enterica enterica serovar Typhi
auuuucagaggucaggauuuuc

SEQ ID NO: 1713433 - RNA, 18 nt, Salmonella enterica enterica serovar Typhi
auuuuauuauauuuaaaa

SEQ ID NO: 1713434 - RNA, 14 nt, Salmonella enterica enterica serovar Typhi
auuuuaaauacacc

SEQ ID NO: 1713435 - RNA, 18 nt, Salmonella enterica enterica serovar Typhi
auuuuaaauuuccucuug

SEQ ID NO: 1713436 - RNA, 20 nt, Salmonella enterica enterica serovar Typhi
auuuuaaauugguuauauua

SEQ ID NO: 1713437 - RNA, 13 nt, Salmonella enterica enterica serovar Typhi
auuuuaacaucac

SEQ ID NO: 1713438 - RNA, 21 nt, Salmonella enterica enterica serovar Typhi
auuuuaaauuuccucuuguca

SEQ ID NO: 1713439 - RNA, 15 nt, Salmonella enterica enterica serovar Typhi
auuuuacuaaugaau

SEQ ID NO: 1713440 - RNA, 22 nt, Salmonella enterica enterica serovar Typhi
auuuuacugcguaaucuuuuca

SEQ ID NO: 1713441 - RNA, 21 nt, Salmonella enterica enterica serovar Typhi
auuuuagaaauagaaauugca

SEQ ID NO: 1713442 - RNA, 18 nt, Salmonella enterica enterica serovar Typhi
auuuuguugcuccagcau

SEQ ID NO: 1713443 - RNA, 15 nt, Salmonella enterica enterica serovar Typhi
auuuugauaaaucag

SEQ ID NO: 1713444 - RNA, 16 nt, Salmonella enterica enterica serovar Typhi
auuuugauaaaaacac

SEQ ID NO: 1713445 - RNA, 23 nt, Salmonella enterica enterica serovar Typhi
auuuucaugguaucccacaugag

SEQ ID NO: 1713446 - RNA, 18 nt, Salmonella enterica enterica serovar Typhi
auuuucggcacaucaaua

SEQ ID NO: 1713447 - RNA, 19 nt, Salmonella enterica enterica serovar Typhi
auuuucucguguagccagu

SEQ ID NO: 1713448 - RNA, 13 nt, Salmonella enterica enterica serovar Typhi
auuucuccugcau

SEQ ID NO: 1713449 - RNA, 16 nt, Salmonella enterica enterica serovar Typhi
auuucuccugcgccag

SEQ ID NO: 1713450 - RNA, 20 nt, Salmonella enterica enterica serovar Typhi
auuucuccugcgccagccgg

SEQ ID NO: 1713451 - RNA, 16 nt, Salmonella enterica enterica serovar Typhi
auuucaucgccgccgc

SEQ ID NO: 1713452 - RNA, 18 nt, Salmonella enterica enterica serovar Typhi
auuucaugcgcagcauga

SEQ ID NO: 1713453 - RNA, 23 nt, Salmonella enterica enterica serovar Typhi
auuucaugcggugcaugaauauc

SEQ ID NO: 1713454 - RNA, 23 nt, Salmonella enterica enterica serovar Typhi
auuugaaggacugauacagccaa

SEQ ID NO: 1713455 - RNA, 15 nt, Salmonella enterica enterica serovar Typhi
auuucucgccgccgg

SEQ ID NO: 1713456 - RNA, 16 nt, Salmonella enterica enterica serovar Typhi
auuugucagacaugau

SEQ ID NO: 1713457 - RNA, 13 nt, Salmonella enterica enterica serovar Typhi
auuuggucggcgu

SEQ ID NO: 1713458 - RNA, 19 nt, Salmonella enterica enterica serovar Typhi
auuugucgucaugcgccag

SEQ ID NO: 1713459 - RNA, 17 nt, Salmonella enterica enterica serovar Typhi
auuugugagcuauacgg

SEQ ID NO: 1713460 - RNA, 13 nt, Salmonella enterica enterica serovar Typhi
auuuguuaucuac

SEQ ID NO: 1713461 - RNA, 15 nt, Salmonella enterica enterica serovar Typhi
auuuguugacugucu

SEQ ID NO: 1713462 - RNA, 15 nt, Salmonella enterica enterica serovar Typhi
auuugcucaguucag

SEQ ID NO: 1713463 - RNA, 16 nt, Salmonella enterica enterica serovar Typhi
auuugcgcuuuuaauu

SEQ ID NO: 1713464 - RNA, 16 nt, Salmonella enterica enterica serovar Typhi
auuugguaaauaacuu

SEQ ID NO: 1713465 - RNA, 13 nt, Salmonella enterica enterica serovar Typhi
auuugcgcaguuu

SEQ ID NO: 1713466 - RNA, 18 nt, Salmonella enterica enterica serovar Typhi
auuugcccuuccagcagc

SEQ ID NO: 1713467 - RNA, 17 nt, Salmonella enterica enterica serovar Typhi
caaaacgcauccagcgc

SEQ ID NO: 1713468 - RNA, 21 nt, Salmonella enterica enterica serovar Typhi
caaaacgccgguacuggagac

SEQ ID NO: 1713469 - RNA, 16 nt, Salmonella enterica enterica serovar Typhi
caaaacaacaaaguau

SEQ ID NO: 1713470 - RNA, 17 nt, Salmonella enterica enterica serovar Typhi
caaaacgucgugagugg

SEQ ID NO: 1713471 - RNA, 15 nt, Salmonella enterica enterica serovar Typhi
caaaacggucgguaa

SEQ ID NO: 1713472 - RNA, 17 nt, Salmonella enterica enterica serovar Typhi
caaaacgcugcuauuuu

SEQ ID NO: 1713473 - RNA, 12 nt, Salmonella enterica enterica serovar Typhi
caaaacuauuuu

SEQ ID NO: 1713474 - RNA, 21 nt, Salmonella enterica enterica serovar Typhi
caaaacuuauuuuauuuuuau

SEQ ID NO: 1713475 - RNA, 14 nt, Salmonella enterica enterica serovar Typhi
caaaagaaaaaacu

SEQ ID NO: 1713476 - RNA, 22 nt, Salmonella enterica enterica serovar Typhi
caaaagaggaaguugcucccgc

SEQ ID NO: 1713477 - RNA, 16 nt, Salmonella enterica enterica serovar Typhi
caaaagcaucaauuug

SEQ ID NO: 1713478 - RNA, 10 nt, Salmonella enterica enterica serovar Typhi
caaaaacaag

SEQ ID NO: 1713479 - RNA, 16 nt, Salmonella enterica enterica serovar Typhi
caaaaaaugugagcca

SEQ ID NO: 1713480 - RNA, 20 nt, Salmonella enterica enterica serovar Typhi
caaaaagauauuauaaaaua

SEQ ID NO: 1713481 - RNA, 11 nt, Salmonella enterica enterica serovar Typhi
caaaaagccuu

SEQ ID NO: 1713482 - RNA, 21 nt, Salmonella enterica enterica serovar Typhi
caaaaaccccgacauucccag

SEQ ID NO: 1713483 - RNA, 12 nt, Salmonella enterica enterica serovar Typhi
caaaaacgccag

SEQ ID NO: 1713484 - RNA, 13 nt, Salmonella enterica enterica serovar Typhi
caaaaacgccaga

SEQ ID NO: 1713485 - RNA, 15 nt, Salmonella enterica enterica serovar Typhi
caaaaacgcccccag

SEQ ID NO: 1713486 - RNA, 20 nt, Salmonella enterica enterica serovar Typhi
caaaaacauccacauaggcg

SEQ ID NO: 1713487 - RNA, 15 nt, Salmonella enterica enterica serovar Typhi
caaaaauagcauuaa

SEQ ID NO: 1713488 - RNA, 18 nt, Salmonella enterica enterica serovar Typhi
caaaaaguaguuccagca

SEQ ID NO: 1713489 - RNA, 20 nt, Salmonella enterica enterica serovar Typhi
caaaaaguaguuccagcaua

SEQ ID NO: 1713490 - RNA, 12 nt, Salmonella enterica enterica serovar Typhi
caaaaauaccac

SEQ ID NO: 1713491 - RNA, 14 nt, Salmonella enterica enterica serovar Typhi
caaaaauaaaaacc

SEQ ID NO: 1713492 - RNA, 18 nt, Salmonella enterica enterica serovar Typhi
caaaaaaggaaaaugacg

SEQ ID NO: 1713493 - RNA, 22 nt, Salmonella enterica enterica serovar Typhi
caaaaaaacuaauccucuucuc

SEQ ID NO: 1713494 - RNA, 13 nt, Salmonella enterica enterica serovar Typhi
auuuuuuuugccu

SEQ ID NO: 1713495 - RNA, 23 nt, Salmonella enterica enterica serovar Typhi
auuuuuuucucgauaucuucccc

SEQ ID NO: 1713496 - RNA, 12 nt, Salmonella enterica enterica serovar Typhi
auuuuuucugcu

SEQ ID NO: 1713497 - RNA, 19 nt, Salmonella enterica enterica serovar Typhi
auuuuuuauauucgcucau

SEQ ID NO: 1713498 - RNA, 16 nt, Salmonella enterica enterica serovar Typhi
auuuuuugcugggaua

SEQ ID NO: 1713499 - RNA, 23 nt, Salmonella enterica enterica serovar Typhi
auuuuucucagccagauccagug

SEQ ID NO: 1713500 - RNA, 17 nt, Salmonella enterica enterica serovar Typhi
auuuuucgaucuucucc

SEQ ID NO: 1713501 - RNA, 16 nt, Salmonella enterica enterica serovar Typhi
auuuuucgaucuucuc

SEQ ID NO: 1713502 - RNA, 19 nt, Salmonella enterica enterica serovar Typhi
auuuuucgcgucaaaacuu

SEQ ID NO: 1713503 - RNA, 18 nt, Salmonella enterica enterica serovar Typhi
auuuuucgccagguacau

SEQ ID NO: 1713504 - RNA, 20 nt, Salmonella enterica enterica serovar Typhi
auuuuuccggcgucaaaaau

SEQ ID NO: 1713505 - RNA, 15 nt, Salmonella enterica enterica serovar Typhi
auuuuucccuggccg

SEQ ID NO: 1713506 - RNA, 13 nt, Salmonella enterica enterica serovar Typhi
auuuuuaaauaac

SEQ ID NO: 1713507 - RNA, 16 nt, Salmonella enterica enterica serovar Typhi
auuuuucccaucaauc

SEQ ID NO: 1713508 - RNA, 13 nt, Salmonella enterica enterica serovar Typhi
auuuuuccagcau

SEQ ID NO: 1713509 - RNA, 12 nt, Salmonella enterica enterica serovar Typhi
auuuuucagggu

SEQ ID NO: 1713510 - RNA, 18 nt, Salmonella enterica enterica serovar Typhi
auuuuucauggcauagcc

SEQ ID NO: 1713511 - RNA, 18 nt, Salmonella enterica enterica serovar Typhi
auuuuugcccagccuucu

SEQ ID NO: 1713512 - RNA, 14 nt, Salmonella enterica enterica serovar Typhi
caaucuccuccggc

SEQ ID NO: 1713513 - RNA, 20 nt, Salmonella enterica enterica serovar Typhi
caaucucuggccaggcauug

SEQ ID NO: 1713514 - RNA, 12 nt, Salmonella enterica enterica serovar Typhi
caaucucuuuau

SEQ ID NO: 1713515 - RNA, 21 nt, Salmonella enterica enterica serovar Typhi
caaucuggugacgaugauaac

SEQ ID NO: 1713516 - RNA, 20 nt, Salmonella enterica enterica serovar Typhi
caaucugguggcguuccuua

SEQ ID NO: 1713517 - RNA, 13 nt, Salmonella enterica enterica serovar Typhi
caaucguucuugc

SEQ ID NO: 1713518 - RNA, 14 nt, Salmonella enterica enterica serovar Typhi
caaucgagaagcca

SEQ ID NO: 1713519 - RNA, 16 nt, Salmonella enterica enterica serovar Typhi
caaucgagaucagacu

SEQ ID NO: 1713520 - RNA, 17 nt, Salmonella enterica enterica serovar Typhi
caaucgcaaauugcugu

SEQ ID NO: 1713521 - RNA, 14 nt, Salmonella enterica enterica serovar Typhi
caaucgccagcccc

SEQ ID NO: 1713522 - RNA, 13 nt, Salmonella enterica enterica serovar Typhi
caauccuggcuuc

SEQ ID NO: 1713523 - RNA, 22 nt, Salmonella enterica enterica serovar Typhi
caauccugucgucaccagcagg

SEQ ID NO: 1713524 - RNA, 23 nt, Salmonella enterica enterica serovar Typhi
caauccugucgucaccagcaggu

SEQ ID NO: 1713525 - RNA, 20 nt, Salmonella enterica enterica serovar Typhi
caaucgcuuccagcgccggu

SEQ ID NO: 1713526 - RNA, 14 nt, Salmonella enterica enterica serovar Typhi
caaucgcguuuucc

SEQ ID NO: 1713527 - RNA, 18 nt, Salmonella enterica enterica serovar Typhi
caaucgcuaucugacagc

SEQ ID NO: 1713528 - RNA, 21 nt, Salmonella enterica enterica serovar Typhi
caaucgucacuucaauuugcc

SEQ ID NO: 1713529 - RNA, 15 nt, Salmonella enterica enterica serovar Typhi
caaucaaaacauuag

SEQ ID NO: 1713530 - RNA, 13 nt, Salmonella enterica enterica serovar Typhi
caauauuuuuccg

SEQ ID NO: 1713531 - RNA, 20 nt, Salmonella enterica enterica serovar Typhi
caauauuccgaaagaaagac

SEQ ID NO: 1713532 - RNA, 12 nt, Salmonella enterica enterica serovar Typhi
caauauuccugg

SEQ ID NO: 1713533 - RNA, 20 nt, Salmonella enterica enterica serovar Typhi
caauauucacgcgaauuccu

SEQ ID NO: 1713534 - RNA, 19 nt, Salmonella enterica enterica serovar Typhi
caauauugcugugcuauga

SEQ ID NO: 1713535 - RNA, 17 nt, Salmonella enterica enterica serovar Typhi
caauccacggguuacaa

SEQ ID NO: 1713536 - RNA, 23 nt, Salmonella enterica enterica serovar Typhi
caauccagguggaucggaaauca

SEQ ID NO: 1713537 - RNA, 18 nt, Salmonella enterica enterica serovar Typhi
caauccaacgaaacucag

SEQ ID NO: 1713538 - RNA, 17 nt, Salmonella enterica enterica serovar Typhi
caauccauuuuaaauac

SEQ ID NO: 1713539 - RNA, 15 nt, Salmonella enterica enterica serovar Typhi
caauccgcggcaaac

SEQ ID NO: 1713540 - RNA, 15 nt, Salmonella enterica enterica serovar Typhi
caaucccuuaaagcc

SEQ ID NO: 1713541 - RNA, 17 nt, Salmonella enterica enterica serovar Typhi
caaugaugccuugcgaa

SEQ ID NO: 1713542 - RNA, 16 nt, Salmonella enterica enterica serovar Typhi
caaugaucagacgcac

SEQ ID NO: 1713543 - RNA, 15 nt, Salmonella enterica enterica serovar Typhi
caaugauuuuuagcc

SEQ ID NO: 1713544 - RNA, 20 nt, Salmonella enterica enterica serovar Typhi
caaugcacuacgaaaagagg

SEQ ID NO: 1713545 - RNA, 14 nt, Salmonella enterica enterica serovar Typhi
caaugccaccacac

SEQ ID NO: 1713546 - RNA, 22 nt, Salmonella enterica enterica serovar Typhi
caaucugguggcguuccuuauc

SEQ ID NO: 1713547 - RNA, 17 nt, Salmonella enterica enterica serovar Typhi
caaucuguuuguuagaa

SEQ ID NO: 1713548 - RNA, 18 nt, Salmonella enterica enterica serovar Typhi
caaucuguucguugcugu

SEQ ID NO: 1713549 - RNA, 14 nt, Salmonella enterica enterica serovar Typhi
caaugaaauaauug

SEQ ID NO: 1713550 - RNA, 17 nt, Salmonella enterica enterica serovar Typhi
caaugaaccagcccaua

SEQ ID NO: 1713551 - RNA, 13 nt, Salmonella enterica enterica serovar Typhi
caaugaacaguuu

SEQ ID NO: 1713552 - RNA, 14 nt, Salmonella enterica enterica serovar Typhi
caaugcuggcaggc

SEQ ID NO: 1713553 - RNA, 21 nt, Salmonella enterica enterica serovar Typhi
caaugcgcuuuuuuugcccuu

SEQ ID NO: 1713554 - RNA, 14 nt, Salmonella enterica enterica serovar Typhi
caaugcggaaacca

SEQ ID NO: 1713555 - RNA, 14 nt, Salmonella enterica enterica serovar Typhi
caaugcgcuuuuuu

SEQ ID NO: 1713556 - RNA, 18 nt, Salmonella enterica enterica serovar Typhi
caaugcgcguaauuugcg

SEQ ID NO: 1713557 - RNA, 18 nt, Salmonella enterica enterica serovar Typhi
caaugccuaacccuuuuc

SEQ ID NO: 1713558 - RNA, 18 nt, Salmonella enterica enterica serovar Typhi
caaugccuuaugcccggc

SEQ ID NO: 1713559 - RNA, 22 nt, Salmonella enterica enterica serovar Typhi
caaugcccgguuuuuuaaugag

SEQ ID NO: 1713560 - RNA, 21 nt, Salmonella enterica enterica serovar Typhi
caaugcccccaucacuuuacc

SEQ ID NO: 1713561 - RNA, 22 nt, Salmonella enterica enterica serovar Typhi
caaugccauauuuaccuuuucc

SEQ ID NO: 1713562 - RNA, 13 nt, Salmonella enterica enterica serovar Typhi
caauggcgacgau

SEQ ID NO: 1713563 - RNA, 19 nt, Salmonella enterica enterica serovar Typhi
caauggcgacgaucagcgc

SEQ ID NO: 1713564 - RNA, 19 nt, Salmonella enterica enterica serovar Typhi
caauggcuagggaaacgcu

SEQ ID NO: 1713565 - RNA, 17 nt, Salmonella enterica enterica serovar Typhi
caaugguugccuggugu

SEQ ID NO: 1713566 - RNA, 14 nt, Salmonella enterica enterica serovar Typhi
caauguaaaacuga

SEQ ID NO: 1713567 - RNA, 18 nt, Salmonella enterica enterica serovar Typhi
caauguacguaaaaccag

SEQ ID NO: 1713568 - RNA, 22 nt, Salmonella enterica enterica serovar Typhi
caagguuauuaaaaagccagcg

SEQ ID NO: 1713569 - RNA, 16 nt, Salmonella enterica enterica serovar Typhi
caagguugaucaggaa

SEQ ID NO: 1713570 - RNA, 21 nt, Salmonella enterica enterica serovar Typhi
caagguucgacucgagcaaua

SEQ ID NO: 1713571 - RNA, 16 nt, Salmonella enterica enterica serovar Typhi
caauaaaauuauccag

SEQ ID NO: 1713572 - RNA, 17 nt, Salmonella enterica enterica serovar Typhi
caaguuuagaaaaaauu

SEQ ID NO: 1713573 - RNA, 14 nt, Salmonella enterica enterica serovar Typhi
caaguuuagaaaau

SEQ ID NO: 1713574 - RNA, 14 nt, Salmonella enterica enterica serovar Typhi
caaguuuagaaaaa

SEQ ID NO: 1713575 - RNA, 16 nt, Salmonella enterica enterica serovar Typhi
caaguuuagaaaaaau

SEQ ID NO: 1713576 - RNA, 20 nt, Salmonella enterica enterica serovar Typhi
caauaaacuaaguaaggagg

SEQ ID NO: 1713577 - RNA, 20 nt, Salmonella enterica enterica serovar Typhi
caauaaacucccgcauauau

SEQ ID NO: 1713578 - RNA, 12 nt, Salmonella enterica enterica serovar Typhi
caauaaacuggc

SEQ ID NO: 1713579 - RNA, 19 nt, Salmonella enterica enterica serovar Typhi
caauaaaucaacauacuga

SEQ ID NO: 1713580 - RNA, 23 nt, Salmonella enterica enterica serovar Typhi
caauaaauaauaucguuaagccu

SEQ ID NO: 1713581 - RNA, 19 nt, Salmonella enterica enterica serovar Typhi
caauaagggcauguuucau

SEQ ID NO: 1713582 - RNA, 23 nt, Salmonella enterica enterica serovar Typhi
caauaaguaaaaacgaaaaaccc

SEQ ID NO: 1713583 - RNA, 19 nt, Salmonella enterica enterica serovar Typhi
caauaagggucgcgcugua

SEQ ID NO: 1713584 - RNA, 17 nt, Salmonella enterica enterica serovar Typhi
caauaacagccagcggg

SEQ ID NO: 1713585 - RNA, 14 nt, Salmonella enterica enterica serovar Typhi
caauaacagccagc

SEQ ID NO: 1713586 - RNA, 15 nt, Salmonella enterica enterica serovar Typhi
caauaacaccacaac

SEQ ID NO: 1713587 - RNA, 18 nt, Salmonella enterica enterica serovar Typhi
caauaacaccacaacaca

SEQ ID NO: 1713588 - RNA, 21 nt, Salmonella enterica enterica serovar Typhi
caauaucagccauuaaccaga

SEQ ID NO: 1713589 - RNA, 16 nt, Salmonella enterica enterica serovar Typhi
caauaucguugccgcc

SEQ ID NO: 1713590 - RNA, 19 nt, Salmonella enterica enterica serovar Typhi
caauaucgcggcaaagaaa

SEQ ID NO: 1713591 - RNA, 21 nt, Salmonella enterica enterica serovar Typhi
caauaucgauagcauuuuuac

SEQ ID NO: 1713592 - RNA, 19 nt, Salmonella enterica enterica serovar Typhi
caauauccucgcauccucc

SEQ ID NO: 1713593 - RNA, 20 nt, Salmonella enterica enterica serovar Typhi
caauauuaaugcugcguuua

SEQ ID NO: 1713594 - RNA, 20 nt, Salmonella enterica enterica serovar Typhi
caauauuacaaagcaguaaa

SEQ ID NO: 1713595 - RNA, 16 nt, Salmonella enterica enterica serovar Typhi
caauaguggacacaca

SEQ ID NO: 1713596 - RNA, 19 nt, Salmonella enterica enterica serovar Typhi
caauagguugaaagaggaa

SEQ ID NO: 1713597 - RNA, 14 nt, Salmonella enterica enterica serovar Typhi
caauaguauccaua

SEQ ID NO: 1713598 - RNA, 19 nt, Salmonella enterica enterica serovar Typhi
caauagcuucaaugaucca

SEQ ID NO: 1713599 - RNA, 19 nt, Salmonella enterica enterica serovar Typhi
caauacgaucggcuggaau

SEQ ID NO: 1713600 - RNA, 22 nt, Salmonella enterica enterica serovar Typhi
caauaauuuuaccauucagcuu

SEQ ID NO: 1713601 - RNA, 21 nt, Salmonella enterica enterica serovar Typhi
caauaauauguuccacaauca

SEQ ID NO: 1713602 - RNA, 23 nt, Salmonella enterica enterica serovar Typhi
caauacucacuaucacacuggcg

SEQ ID NO: 1713603 - RNA, 16 nt, Salmonella enterica enterica serovar Typhi
caauagcgagaggcaa

SEQ ID NO: 1713604 - RNA, 14 nt, Salmonella enterica enterica serovar Typhi
caauagcgcuaaac

SEQ ID NO: 1713605 - RNA, 22 nt, Salmonella enterica enterica serovar Typhi
caauacuggaccccagauaaua

SEQ ID NO: 1713606 - RNA, 10 nt, Salmonella enterica enterica serovar Typhi
caacuucaug

SEQ ID NO: 1713607 - RNA, 15 nt, Salmonella enterica enterica serovar Typhi
caacuuccaccaccu

SEQ ID NO: 1713608 - RNA, 21 nt, Salmonella enterica enterica serovar Typhi
caacuuccaccaccuccugcu

SEQ ID NO: 1713609 - RNA, 18 nt, Salmonella enterica enterica serovar Typhi
caacuucaugaguaaaug

SEQ ID NO: 1713610 - RNA, 14 nt, Salmonella enterica enterica serovar Typhi
caagcaguaugacc

SEQ ID NO: 1713611 - RNA, 20 nt, Salmonella enterica enterica serovar Typhi
caagcaguaucguguuauuu

SEQ ID NO: 1713612 - RNA, 13 nt, Salmonella enterica enterica serovar Typhi
caagcaguucuga

SEQ ID NO: 1713613 - RNA, 15 nt, Salmonella enterica enterica serovar Typhi
caagcagcauaauga

SEQ ID NO: 1713614 - RNA, 17 nt, Salmonella enterica enterica serovar Typhi
caagcacugaaugcuga

SEQ ID NO: 1713615 - RNA, 17 nt, Salmonella enterica enterica serovar Typhi
caagccgaccuuauucc

SEQ ID NO: 1713616 - RNA, 17 nt, Salmonella enterica enterica serovar Typhi
caagccgccaacgccag

SEQ ID NO: 1713617 - RNA, 22 nt, Salmonella enterica enterica serovar Typhi
caagccaggcccgguggcgcca

SEQ ID NO: 1713618 - RNA, 18 nt, Salmonella enterica enterica serovar Typhi
caagccagguugcgcccg

SEQ ID NO: 1713619 - RNA, 22 nt, Salmonella enterica enterica serovar Typhi
caagcuaauccccagcgcucca

SEQ ID NO: 1713620 - RNA, 12 nt, Salmonella enterica enterica serovar Typhi
caaggaaagaaa

SEQ ID NO: 1713621 - RNA, 16 nt, Salmonella enterica enterica serovar Typhi
caaggaaaaccaguaa

SEQ ID NO: 1713622 - RNA, 19 nt, Salmonella enterica enterica serovar Typhi
caaggaaugacacauuucu

SEQ ID NO: 1713623 - RNA, 12 nt, Salmonella enterica enterica serovar Typhi
caaggaaggaaa

SEQ ID NO: 1713624 - RNA, 13 nt, Salmonella enterica enterica serovar Typhi
caagcgucagcau

SEQ ID NO: 1713625 - RNA, 20 nt, Salmonella enterica enterica serovar Typhi
caagcgguuugaaaauggcg

SEQ ID NO: 1713626 - RNA, 15 nt, Salmonella enterica enterica serovar Typhi
caagcgcuucguuga

SEQ ID NO: 1713627 - RNA, 13 nt, Salmonella enterica enterica serovar Typhi
caaggucggcucc

SEQ ID NO: 1713628 - RNA, 16 nt, Salmonella enterica enterica serovar Typhi
caaggcgacgcuucac

SEQ ID NO: 1713629 - RNA, 12 nt, Salmonella enterica enterica serovar Typhi
caagggcuuucu

SEQ ID NO: 1713630 - RNA, 22 nt, Salmonella enterica enterica serovar Typhi
caaagucagcgcgcgcuuucac

SEQ ID NO: 1713631 - RNA, 15 nt, Salmonella enterica enterica serovar Typhi
caaaguugcaucaag

SEQ ID NO: 1713632 - RNA, 16 nt, Salmonella enterica enterica serovar Typhi
caaaguugcaucaaga

SEQ ID NO: 1713633 - RNA, 23 nt, Salmonella enterica enterica serovar Typhi
caaagugguuccaggcgcgcacc

SEQ ID NO: 1713634 - RNA, 18 nt, Salmonella enterica enterica serovar Typhi
caaagugcgcccuuuuuu

SEQ ID NO: 1713635 - RNA, 15 nt, Salmonella enterica enterica serovar Typhi
caaagguguuauuuc

SEQ ID NO: 1713636 - RNA, 24 nt, Salmonella enterica enterica serovar Typhi
caaagguguuauuucucuugcaga

SEQ ID NO: 1713637 - RNA, 21 nt, Salmonella enterica enterica serovar Typhi
caaauagccguuaccgccgag

SEQ ID NO: 1713638 - RNA, 16 nt, Salmonella enterica enterica serovar Typhi
caaauagcggcacaga

SEQ ID NO: 1713639 - RNA, 19 nt, Salmonella enterica enterica serovar Typhi
caaauagcguguguuuucc

SEQ ID NO: 1713640 - RNA, 14 nt, Salmonella enterica enterica serovar Typhi
caaauacagaugcu

SEQ ID NO: 1713641 - RNA, 14 nt, Salmonella enterica enterica serovar Typhi
caaauacauggugc

SEQ ID NO: 1713642 - RNA, 15 nt, Salmonella enterica enterica serovar Typhi
caaaaggcuggaaca

SEQ ID NO: 1713643 - RNA, 22 nt, Salmonella enterica enterica serovar Typhi
caaaagccggucguaaugagca

SEQ ID NO: 1713644 - RNA, 20 nt, Salmonella enterica enterica serovar Typhi
caaaagcgguuaagauacau

SEQ ID NO: 1713645 - RNA, 20 nt, Salmonella enterica enterica serovar Typhi
caaaaggcgccgcuuccccc

SEQ ID NO: 1713646 - RNA, 18 nt, Salmonella enterica enterica serovar Typhi
caaaaggcuggaacagau

SEQ ID NO: 1713647 - RNA, 12 nt, Salmonella enterica enterica serovar Typhi
caaaaggcagac

SEQ ID NO: 1713648 - RNA, 21 nt, Salmonella enterica enterica serovar Typhi
caaagccaggccgccagcaac

SEQ ID NO: 1713649 - RNA, 15 nt, Salmonella enterica enterica serovar Typhi
caaagccccagucau

SEQ ID NO: 1713650 - RNA, 13 nt, Salmonella enterica enterica serovar Typhi
caaagccugcugg

SEQ ID NO: 1713651 - RNA, 20 nt, Salmonella enterica enterica serovar Typhi
caaagccgccauccggccug

SEQ ID NO: 1713652 - RNA, 19 nt, Salmonella enterica enterica serovar Typhi
caaagccgccauccggccu

SEQ ID NO: 1713653 - RNA, 16 nt, Salmonella enterica enterica serovar Typhi
caaagacaggugacca

SEQ ID NO: 1713654 - RNA, 15 nt, Salmonella enterica enterica serovar Typhi
caaagacaccccagc

SEQ ID NO: 1713655 - RNA, 14 nt, Salmonella enterica enterica serovar Typhi
caaagcaaucgcca

SEQ ID NO: 1713656 - RNA, 15 nt, Salmonella enterica enterica serovar Typhi
caaagcacugcugcu

SEQ ID NO: 1713657 - RNA, 16 nt, Salmonella enterica enterica serovar Typhi
caaagcacugcugcug

SEQ ID NO: 1713658 - RNA, 18 nt, Salmonella enterica enterica serovar Typhi
caaagcacugcugcugaa

SEQ ID NO: 1713659 - RNA, 22 nt, Salmonella enterica enterica serovar Typhi
caaagcacugcugcugaaagaa

SEQ ID NO: 1713660 - RNA, 15 nt, Salmonella enterica enterica serovar Typhi
caaaucgccaucagc

SEQ ID NO: 1713661 - RNA, 18 nt, Salmonella enterica enterica serovar Typhi
caaaucgcgguaaaaagc

SEQ ID NO: 1713662 - RNA, 16 nt, Salmonella enterica enterica serovar Typhi
caaaucgguaaauguc

SEQ ID NO: 1713663 - RNA, 14 nt, Salmonella enterica enterica serovar Typhi
caaaucguuuucua

SEQ ID NO: 1713664 - RNA, 13 nt, Salmonella enterica enterica serovar Typhi
caaaucagcagga

SEQ ID NO: 1713665 - RNA, 21 nt, Salmonella enterica enterica serovar Typhi
caaaucaggaaauaaucgagu

SEQ ID NO: 1713666 - RNA, 15 nt, Salmonella enterica enterica serovar Typhi
caaaucagacgcuuc

SEQ ID NO: 1713667 - RNA, 22 nt, Salmonella enterica enterica serovar Typhi
caaaugcgauaaccugcuguga

SEQ ID NO: 1713668 - RNA, 17 nt, Salmonella enterica enterica serovar Typhi
caaaugaucguuuuuug

SEQ ID NO: 1713669 - RNA, 15 nt, Salmonella enterica enterica serovar Typhi
caaaugaccucaaga

SEQ ID NO: 1713670 - RNA, 16 nt, Salmonella enterica enterica serovar Typhi
caaaugagaauagacu

SEQ ID NO: 1713671 - RNA, 15 nt, Salmonella enterica enterica serovar Typhi
caacacuuugcgcug

SEQ ID NO: 1713672 - RNA, 14 nt, Salmonella enterica enterica serovar Typhi
caacacgcagaccc

SEQ ID NO: 1713673 - RNA, 12 nt, Salmonella enterica enterica serovar Typhi
caacaccauccc

SEQ ID NO: 1713674 - RNA, 17 nt, Salmonella enterica enterica serovar Typhi
caacacggcgcucagga

SEQ ID NO: 1713675 - RNA, 17 nt, Salmonella enterica enterica serovar Typhi
caacacgccgaacaaca

SEQ ID NO: 1713676 - RNA, 24 nt, Salmonella enterica enterica serovar Typhi
caacacgccgaacaacacggcggc

SEQ ID NO: 1713677 - RNA, 14 nt, Salmonella enterica enterica serovar Typhi
caacacauaagcca

SEQ ID NO: 1713678 - RNA, 15 nt, Salmonella enterica enterica serovar Typhi
caaauugcuguucca

SEQ ID NO: 1713679 - RNA, 16 nt, Salmonella enterica enterica serovar Typhi
caacacacguaacaac

SEQ ID NO: 1713680 - RNA, 15 nt, Salmonella enterica enterica serovar Typhi
caacaaugccacgcc

SEQ ID NO: 1713681 - RNA, 18 nt, Salmonella enterica enterica serovar Typhi
caacaaugccacgccccu

SEQ ID NO: 1713682 - RNA, 15 nt, Salmonella enterica enterica serovar Typhi
caacaaugcuuucac

SEQ ID NO: 1713683 - RNA, 19 nt, Salmonella enterica enterica serovar Typhi
caacaaucagaagaaauau

SEQ ID NO: 1713684 - RNA, 23 nt, Salmonella enterica enterica serovar Typhi
caacaaucccuuaaagccgcccu

SEQ ID NO: 1713685 - RNA, 14 nt, Salmonella enterica enterica serovar Typhi
caacuacacucuua

SEQ ID NO: 1713686 - RNA, 22 nt, Salmonella enterica enterica serovar Typhi
caacuacucguaaucuaaaauu

SEQ ID NO: 1713687 - RNA, 16 nt, Salmonella enterica enterica serovar Typhi
caacgugccagaaaca

SEQ ID NO: 1713688 - RNA, 18 nt, Salmonella enterica enterica serovar Typhi
caacugauuaaucugccg

SEQ ID NO: 1713689 - RNA, 13 nt, Salmonella enterica enterica serovar Typhi
caacugaaaccag

SEQ ID NO: 1713690 - RNA, 11 nt, Salmonella enterica enterica serovar Typhi
caacuggaagc

SEQ ID NO: 1713691 - RNA, 22 nt, Salmonella enterica enterica serovar Typhi
caacuguucuucgguuucgaca

SEQ ID NO: 1713692 - RNA, 17 nt, Salmonella enterica enterica serovar Typhi
caacuguaccugaucca

SEQ ID NO: 1713693 - RNA, 17 nt, Salmonella enterica enterica serovar Typhi
caacuguacgccacggc

SEQ ID NO: 1713694 - RNA, 17 nt, Salmonella enterica enterica serovar Typhi
caacgccaucagccgcg

SEQ ID NO: 1713695 - RNA, 17 nt, Salmonella enterica enterica serovar Typhi
caacgcgggccauacac

SEQ ID NO: 1713696 - RNA, 19 nt, Salmonella enterica enterica serovar Typhi
caacgccaagcgcggcagc

SEQ ID NO: 1713697 - RNA, 19 nt, Salmonella enterica enterica serovar Typhi
caacgccaucagcaaaaua

SEQ ID NO: 1713698 - RNA, 12 nt, Salmonella enterica enterica serovar Typhi
caacgccacugc

SEQ ID NO: 1713699 - RNA, 17 nt, Salmonella enterica enterica serovar Typhi
caaccucggcuugcuuc

SEQ ID NO: 1713700 - RNA, 18 nt, Salmonella enterica enterica serovar Typhi
caaccucggcuugcuuca

SEQ ID NO: 1713701 - RNA, 15 nt, Salmonella enterica enterica serovar Typhi
caaccucuuuuuccg

SEQ ID NO: 1713702 - RNA, 17 nt, Salmonella enterica enterica serovar Typhi
caaccugaaagaagcgc

SEQ ID NO: 1713703 - RNA, 16 nt, Salmonella enterica enterica serovar Typhi
caaccgugagcgcgcc

SEQ ID NO: 1713704 - RNA, 19 nt, Salmonella enterica enterica serovar Typhi
caaccgugucugcugaucg

SEQ ID NO: 1713705 - RNA, 15 nt, Salmonella enterica enterica serovar Typhi
caacgcuucacaacc

SEQ ID NO: 1713706 - RNA, 13 nt, Salmonella enterica enterica serovar Typhi
caacgcucagacc

SEQ ID NO: 1713707 - RNA, 17 nt, Salmonella enterica enterica serovar Typhi
caacgcucagaccgauc

SEQ ID NO: 1713708 - RNA, 21 nt, Salmonella enterica enterica serovar Typhi
caacgcugaauaucgucagua

SEQ ID NO: 1713709 - RNA, 13 nt, Salmonella enterica enterica serovar Typhi
caacgcuccagca

SEQ ID NO: 1713710 - RNA, 15 nt, Salmonella enterica enterica serovar Typhi
caacgcuuccaccuc

SEQ ID NO: 1713711 - RNA, 19 nt, Salmonella enterica enterica serovar Typhi
caacggaagcugaccaggg

SEQ ID NO: 1713712 - RNA, 17 nt, Salmonella enterica enterica serovar Typhi
caacgucaucaugaaaa

SEQ ID NO: 1713713 - RNA, 22 nt, Salmonella enterica enterica serovar Typhi
caacguccccguuugcaguccg

SEQ ID NO: 1713714 - RNA, 20 nt, Salmonella enterica enterica serovar Typhi
caacgucgugccagugaugc

SEQ ID NO: 1713715 - RNA, 15 nt, Salmonella enterica enterica serovar Typhi
caacgucaagacgcu

SEQ ID NO: 1713716 - RNA, 12 nt, Salmonella enterica enterica serovar Typhi
caacgucauccc

SEQ ID NO: 1713717 - RNA, 19 nt, Salmonella enterica enterica serovar Typhi
caacguauaaaauggcaaa

SEQ ID NO: 1713718 - RNA, 13 nt, Salmonella enterica enterica serovar Typhi
caacggcggauga

SEQ ID NO: 1713719 - RNA, 22 nt, Salmonella enterica enterica serovar Typhi
caacguaaucaucaugcugcac

SEQ ID NO: 1713720 - RNA, 18 nt, Salmonella enterica enterica serovar Typhi
caacauuauuaaaauguc

SEQ ID NO: 1713721 - RNA, 18 nt, Salmonella enterica enterica serovar Typhi
caacauuaucaaaaguga

SEQ ID NO: 1713722 - RNA, 21 nt, Salmonella enterica enterica serovar Typhi
caacauuaucaaaagugauca

SEQ ID NO: 1713723 - RNA, 19 nt, Salmonella enterica enterica serovar Typhi
caacauugaggcuacccag

SEQ ID NO: 1713724 - RNA, 20 nt, Salmonella enterica enterica serovar Typhi
caacauugaggcuacccaga

SEQ ID NO: 1713725 - RNA, 21 nt, Salmonella enterica enterica serovar Typhi
caacauuggaaaacuccagca

SEQ ID NO: 1713726 - RNA, 15 nt, Salmonella enterica enterica serovar Typhi
caacauucugcuucc

SEQ ID NO: 1713727 - RNA, 14 nt, Salmonella enterica enterica serovar Typhi
caacauugccggca

SEQ ID NO: 1713728 - RNA, 24 nt, Salmonella enterica enterica serovar Typhi
caacagggcggccuccuggcuuac

SEQ ID NO: 1713729 - RNA, 14 nt, Salmonella enterica enterica serovar Typhi
caacagguaccccg

SEQ ID NO: 1713730 - RNA, 21 nt, Salmonella enterica enterica serovar Typhi
caacaucuuaccggugcgauu

SEQ ID NO: 1713731 - RNA, 22 nt, Salmonella enterica enterica serovar Typhi
caacaugccugauggcgcugcg

SEQ ID NO: 1713732 - RNA, 17 nt, Salmonella enterica enterica serovar Typhi
caaccaggcaaaccagc

SEQ ID NO: 1713733 - RNA, 14 nt, Salmonella enterica enterica serovar Typhi
caaccaggauucaa

SEQ ID NO: 1713734 - RNA, 13 nt, Salmonella enterica enterica serovar Typhi
caaccaggcaaac

SEQ ID NO: 1713735 - RNA, 15 nt, Salmonella enterica enterica serovar Typhi
caaccaaaguccaac

SEQ ID NO: 1713736 - RNA, 15 nt, Salmonella enterica enterica serovar Typhi
caaccaacccaaaaa

SEQ ID NO: 1713737 - RNA, 14 nt, Salmonella enterica enterica serovar Typhi
caaccaccagcagu

SEQ ID NO: 1713738 - RNA, 18 nt, Salmonella enterica enterica serovar Typhi
caaccaaugcaacgccuu

SEQ ID NO: 1713739 - RNA, 20 nt, Salmonella enterica enterica serovar Typhi
caaccacggauaagccagcc

SEQ ID NO: 1713740 - RNA, 23 nt, Salmonella enterica enterica serovar Typhi
caaccaccggauggaucaucggc

SEQ ID NO: 1713741 - RNA, 14 nt, Salmonella enterica enterica serovar Typhi
caaccgccaauaau

SEQ ID NO: 1713742 - RNA, 14 nt, Salmonella enterica enterica serovar Typhi
caaccgccacaaua

SEQ ID NO: 1713743 - RNA, 18 nt, Salmonella enterica enterica serovar Typhi
caaccgcgccaaagauaa

SEQ ID NO: 1713744 - RNA, 14 nt, Salmonella enterica enterica serovar Typhi
caaccgccugcacu

SEQ ID NO: 1713745 - RNA, 16 nt, Salmonella enterica enterica serovar Typhi
caaccgccugcguuug

SEQ ID NO: 1713746 - RNA, 16 nt, Salmonella enterica enterica serovar Typhi
caacccuuuggccacc

SEQ ID NO: 1713747 - RNA, 18 nt, Salmonella enterica enterica serovar Typhi
caacccuggcgcuuuaaa

SEQ ID NO: 1713748 - RNA, 19 nt, Salmonella enterica enterica serovar Typhi
caaccgguaucaaacccuu

SEQ ID NO: 1713749 - RNA, 14 nt, Salmonella enterica enterica serovar Typhi
caaccgggaucuuu

SEQ ID NO: 1713750 - RNA, 20 nt, Salmonella enterica enterica serovar Typhi
caaccccagacggcggcgaa

SEQ ID NO: 1713751 - RNA, 20 nt, Salmonella enterica enterica serovar Typhi
caacccgcaagcauaaaaaa

SEQ ID NO: 1713752 - RNA, 12 nt, Salmonella enterica enterica serovar Typhi
caaccccugacg

SEQ ID NO: 1713753 - RNA, 19 nt, Salmonella enterica enterica serovar Typhi
caacccguaccuccagcga

SEQ ID NO: 1713754 - RNA, 19 nt, Salmonella enterica enterica serovar Typhi
caacccuauugccacaaua

SEQ ID NO: 1713755 - RNA, 15 nt, Salmonella enterica enterica serovar Typhi
caacccacauuggcc

SEQ ID NO: 1713756 - RNA, 22 nt, Salmonella enterica enterica serovar Typhi
caacccauauucgucuucaucu

SEQ ID NO: 1713757 - RNA, 21 nt, Salmonella enterica enterica serovar Typhi
caaccaguuaauuucuuucca

SEQ ID NO: 1713758 - RNA, 18 nt, Salmonella enterica enterica serovar Typhi
caaccaucacugaaccca

SEQ ID NO: 1713759 - RNA, 20 nt, Salmonella enterica enterica serovar Typhi
caaccaugauaaccagcccc

SEQ ID NO: 1713760 - RNA, 23 nt, Salmonella enterica enterica serovar Typhi
caaccaugauaaccagccccggg

SEQ ID NO: 1713761 - RNA, 20 nt, Salmonella enterica enterica serovar Typhi
caaccaucacugaacccaaa

SEQ ID NO: 1713762 - RNA, 22 nt, Salmonella enterica enterica serovar Typhi
cagcgcugagucauccuucccc

SEQ ID NO: 1713763 - RNA, 17 nt, Salmonella enterica enterica serovar Typhi
cagcgcugaaucgcaau

SEQ ID NO: 1713764 - RNA, 15 nt, Salmonella enterica enterica serovar Typhi
cagcgcuccaccaac

SEQ ID NO: 1713765 - RNA, 18 nt, Salmonella enterica enterica serovar Typhi
cagcgcuccaccaaccag

SEQ ID NO: 1713766 - RNA, 23 nt, Salmonella enterica enterica serovar Typhi
cagcgcuccaccaaccaggcaaa

SEQ ID NO: 1713767 - RNA, 20 nt, Salmonella enterica enterica serovar Typhi
cagcgcugcauuugcugccg

SEQ ID NO: 1713768 - RNA, 15 nt, Salmonella enterica enterica serovar Typhi
cagcgcgucggccgg

SEQ ID NO: 1713769 - RNA, 17 nt, Salmonella enterica enterica serovar Typhi
cagcgcuaucaggaaga

SEQ ID NO: 1713770 - RNA, 18 nt, Salmonella enterica enterica serovar Typhi
cagcgcuaucaggcacug

SEQ ID NO: 1713771 - RNA, 19 nt, Salmonella enterica enterica serovar Typhi
cagcgcuaacggcgguacc

SEQ ID NO: 1713772 - RNA, 15 nt, Salmonella enterica enterica serovar Typhi
cagcgcuacccgcug

SEQ ID NO: 1713773 - RNA, 22 nt, Salmonella enterica enterica serovar Typhi
cagcgcuuugccgcugcugccu

SEQ ID NO: 1713774 - RNA, 18 nt, Salmonella enterica enterica serovar Typhi
cagcgcuuugccgcugcu

SEQ ID NO: 1713775 - RNA, 11 nt, Salmonella enterica enterica serovar Typhi
cagcgcuuugc

SEQ ID NO: 1713776 - RNA, 15 nt, Salmonella enterica enterica serovar Typhi
cagcgcuuucaccgc

SEQ ID NO: 1713777 - RNA, 19 nt, Salmonella enterica enterica serovar Typhi
cagcggaaaauauucagca

SEQ ID NO: 1713778 - RNA, 13 nt, Salmonella enterica enterica serovar Typhi
cagcggaaucccc

SEQ ID NO: 1713779 - RNA, 20 nt, Salmonella enterica enterica serovar Typhi
cagcggaauccccgccgcca

SEQ ID NO: 1713780 - RNA, 15 nt, Salmonella enterica enterica serovar Typhi
cagcggaucgauaac

SEQ ID NO: 1713781 - RNA, 17 nt, Salmonella enterica enterica serovar Typhi
cagcggacggcuaauau

SEQ ID NO: 1713782 - RNA, 18 nt, Salmonella enterica enterica serovar Typhi
cagcggagagacauuggu

SEQ ID NO: 1713783 - RNA, 19 nt, Salmonella enterica enterica serovar Typhi
cagcggauuacgcgccugc

SEQ ID NO: 1713784 - RNA, 16 nt, Salmonella enterica enterica serovar Typhi
cagcggcagugaugaa

SEQ ID NO: 1713785 - RNA, 15 nt, Salmonella enterica enterica serovar Typhi
cagcggcaguaaauu

SEQ ID NO: 1713786 - RNA, 16 nt, Salmonella enterica enterica serovar Typhi
cagcggcagcucugcc

SEQ ID NO: 1713787 - RNA, 19 nt, Salmonella enterica enterica serovar Typhi
cagcggcagcuucagccag

SEQ ID NO: 1713788 - RNA, 18 nt, Salmonella enterica enterica serovar Typhi
cagcggcagcucugccug

SEQ ID NO: 1713789 - RNA, 15 nt, Salmonella enterica enterica serovar Typhi
cagcgcgcaaaaacc

SEQ ID NO: 1713790 - RNA, 12 nt, Salmonella enterica enterica serovar Typhi
cagcgcgccgca

SEQ ID NO: 1713791 - RNA, 21 nt, Salmonella enterica enterica serovar Typhi
cagcgcgccaauggccgcccc

SEQ ID NO: 1713792 - RNA, 13 nt, Salmonella enterica enterica serovar Typhi
cagcgcgccgccc

SEQ ID NO: 1713793 - RNA, 14 nt, Salmonella enterica enterica serovar Typhi
cagcgcgacauaga

SEQ ID NO: 1713794 - RNA, 16 nt, Salmonella enterica enterica serovar Typhi
cagcgcgaccaggaaa

SEQ ID NO: 1713795 - RNA, 22 nt, Salmonella enterica enterica serovar Typhi
cagcgcgaccugcaucccuuuc

SEQ ID NO: 1713796 - RNA, 14 nt, Salmonella enterica enterica serovar Typhi
cagcgcgaccugca

SEQ ID NO: 1713797 - RNA, 14 nt, Salmonella enterica enterica serovar Typhi
cagcgcgaacaggc

SEQ ID NO: 1713798 - RNA, 15 nt, Salmonella enterica enterica serovar Typhi
cagcgccuguugauu

SEQ ID NO: 1713799 - RNA, 18 nt, Salmonella enterica enterica serovar Typhi
cagcgcguccagcccgcu

SEQ ID NO: 1713800 - RNA, 12 nt, Salmonella enterica enterica serovar Typhi
cagcgcguccuu

SEQ ID NO: 1713801 - RNA, 20 nt, Salmonella enterica enterica serovar Typhi
cagcgcguccaauagccccu

SEQ ID NO: 1713802 - RNA, 15 nt, Salmonella enterica enterica serovar Typhi
cagcgcggcacacag

SEQ ID NO: 1713803 - RNA, 13 nt, Salmonella enterica enterica serovar Typhi
cagcgcggcagcc

SEQ ID NO: 1713804 - RNA, 19 nt, Salmonella enterica enterica serovar Typhi
cagcgcgcgcuuucaccgc

SEQ ID NO: 1713805 - RNA, 12 nt, Salmonella enterica enterica serovar Typhi
cagcgcgcggcu

SEQ ID NO: 1713806 - RNA, 13 nt, Salmonella enterica enterica serovar Typhi
cagcgcgcguaac

SEQ ID NO: 1713807 - RNA, 12 nt, Salmonella enterica enterica serovar Typhi
cagcgcgccgcg

SEQ ID NO: 1713808 - RNA, 17 nt, Salmonella enterica enterica serovar Typhi
cagcgcgcgcgacggca

SEQ ID NO: 1713809 - RNA, 16 nt, Salmonella enterica enterica serovar Typhi
cagcgauauuucuccg

SEQ ID NO: 1713810 - RNA, 19 nt, Salmonella enterica enterica serovar Typhi
cagcgauauuucuccgccc

SEQ ID NO: 1713811 - RNA, 15 nt, Salmonella enterica enterica serovar Typhi
cagcgaucacgccgu

SEQ ID NO: 1713812 - RNA, 15 nt, Salmonella enterica enterica serovar Typhi
cagcgauauuacuuu

SEQ ID NO: 1713813 - RNA, 14 nt, Salmonella enterica enterica serovar Typhi
cagcgauagucguu

SEQ ID NO: 1713814 - RNA, 23 nt, Salmonella enterica enterica serovar Typhi
cagcgaucccaguugaucggcca

SEQ ID NO: 1713815 - RNA, 16 nt, Salmonella enterica enterica serovar Typhi
cagcgauuacgccaga

SEQ ID NO: 1713816 - RNA, 20 nt, Salmonella enterica enterica serovar Typhi
cagcgauuccgucaggaacg

SEQ ID NO: 1713817 - RNA, 22 nt, Salmonella enterica enterica serovar Typhi
cagcgcaaacgacgcugacuca

SEQ ID NO: 1713818 - RNA, 20 nt, Salmonella enterica enterica serovar Typhi
cagcgcaaaguuuucuuccg

SEQ ID NO: 1713819 - RNA, 14 nt, Salmonella enterica enterica serovar Typhi
cagcgauugcgcca

SEQ ID NO: 1713820 - RNA, 21 nt, Salmonella enterica enterica serovar Typhi
cagcgauuuuuacgccauuca

SEQ ID NO: 1713821 - RNA, 14 nt, Salmonella enterica enterica serovar Typhi
cagcgcauugccuu

SEQ ID NO: 1713822 - RNA, 21 nt, Salmonella enterica enterica serovar Typhi
cagcgcaucucccugccagug

SEQ ID NO: 1713823 - RNA, 23 nt, Salmonella enterica enterica serovar Typhi
cagcgcauugccuuucgcgcgau

SEQ ID NO: 1713824 - RNA, 21 nt, Salmonella enterica enterica serovar Typhi
cagcgccaacgccacugccau

SEQ ID NO: 1713825 - RNA, 17 nt, Salmonella enterica enterica serovar Typhi
cagcgcauuuuucuuca

SEQ ID NO: 1713826 - RNA, 19 nt, Salmonella enterica enterica serovar Typhi
cagcgccaccaaagccagg

SEQ ID NO: 1713827 - RNA, 16 nt, Salmonella enterica enterica serovar Typhi
cagcgccaccacaaac

SEQ ID NO: 1713828 - RNA, 21 nt, Salmonella enterica enterica serovar Typhi
cagcgccaccacaaacgccgu

SEQ ID NO: 1713829 - RNA, 11 nt, Salmonella enterica enterica serovar Typhi
cagcgccaccg

SEQ ID NO: 1713830 - RNA, 17 nt, Salmonella enterica enterica serovar Typhi
cagcgcagaauuuauuu

SEQ ID NO: 1713831 - RNA, 15 nt, Salmonella enterica enterica serovar Typhi
cagcgcaguuuccau

SEQ ID NO: 1713832 - RNA, 17 nt, Salmonella enterica enterica serovar Typhi
cagcgcauccaccagac

SEQ ID NO: 1713833 - RNA, 19 nt, Salmonella enterica enterica serovar Typhi
cagcgcauccaccagaccc

SEQ ID NO: 1713834 - RNA, 22 nt, Salmonella enterica enterica serovar Typhi
cagcgccauaaucgcuuuuucc

SEQ ID NO: 1713835 - RNA, 22 nt, Salmonella enterica enterica serovar Typhi
cagcgccauauaaauuucaucc

SEQ ID NO: 1713836 - RNA, 15 nt, Salmonella enterica enterica serovar Typhi
cagcgccaucaggaa

SEQ ID NO: 1713837 - RNA, 22 nt, Salmonella enterica enterica serovar Typhi
cagcgccauccacggccccggg

SEQ ID NO: 1713838 - RNA, 17 nt, Salmonella enterica enterica serovar Typhi
cagcgccaucaggcccc

SEQ ID NO: 1713839 - RNA, 23 nt, Salmonella enterica enterica serovar Typhi
cagcgccauccacggccccgggc

SEQ ID NO: 1713840 - RNA, 20 nt, Salmonella enterica enterica serovar Typhi
cagcgccauugcuaggaaca

SEQ ID NO: 1713841 - RNA, 20 nt, Salmonella enterica enterica serovar Typhi
cagcgcccacaccauaccgc

SEQ ID NO: 1713842 - RNA, 15 nt, Salmonella enterica enterica serovar Typhi
cagcgcccccagcaa

SEQ ID NO: 1713843 - RNA, 23 nt, Salmonella enterica enterica serovar Typhi
cagcgccagaauagacgccaugu

SEQ ID NO: 1713844 - RNA, 14 nt, Salmonella enterica enterica serovar Typhi
cagcgccagauagu

SEQ ID NO: 1713845 - RNA, 17 nt, Salmonella enterica enterica serovar Typhi
cagcgccagauagucac

SEQ ID NO: 1713846 - RNA, 13 nt, Salmonella enterica enterica serovar Typhi
cagcgccagcccu

SEQ ID NO: 1713847 - RNA, 15 nt, Salmonella enterica enterica serovar Typhi
cagcgccagcccugc

SEQ ID NO: 1713848 - RNA, 14 nt, Salmonella enterica enterica serovar Typhi
cagcgccagccgcg

SEQ ID NO: 1713849 - RNA, 15 nt, Salmonella enterica enterica serovar Typhi
cagcgccagcuccau

SEQ ID NO: 1713850 - RNA, 14 nt, Salmonella enterica enterica serovar Typhi
cagcgccaggccau

SEQ ID NO: 1713851 - RNA, 21 nt, Salmonella enterica enterica serovar Typhi
cagcgccagcugcgucauguc

SEQ ID NO: 1713852 - RNA, 13 nt, Salmonella enterica enterica serovar Typhi
cagcgccggcagc

SEQ ID NO: 1713853 - RNA, 20 nt, Salmonella enterica enterica serovar Typhi
cagcgccggauaauccagac

SEQ ID NO: 1713854 - RNA, 16 nt, Salmonella enterica enterica serovar Typhi
cagcgccgcgggcugg

SEQ ID NO: 1713855 - RNA, 22 nt, Salmonella enterica enterica serovar Typhi
cagcgccuccgcguagcccagc

SEQ ID NO: 1713856 - RNA, 14 nt, Salmonella enterica enterica serovar Typhi
cagcgcccgcuuca

SEQ ID NO: 1713857 - RNA, 15 nt, Salmonella enterica enterica serovar Typhi
cagcgccgcgcaagc

SEQ ID NO: 1713858 - RNA, 11 nt, Salmonella enterica enterica serovar Typhi
cagcgccgccu

SEQ ID NO: 1713859 - RNA, 17 nt, Salmonella enterica enterica serovar Typhi
cagccucaggccugccg

SEQ ID NO: 1713860 - RNA, 16 nt, Salmonella enterica enterica serovar Typhi
cagccuaccugccgcc

SEQ ID NO: 1713861 - RNA, 17 nt, Salmonella enterica enterica serovar Typhi
cagccucucuugauaac

SEQ ID NO: 1713862 - RNA, 18 nt, Salmonella enterica enterica serovar Typhi
cagccucgcguugagggu

SEQ ID NO: 1713863 - RNA, 23 nt, Salmonella enterica enterica serovar Typhi
cagccucgcgcauccgggccgcu

SEQ ID NO: 1713864 - RNA, 17 nt, Salmonella enterica enterica serovar Typhi
cagccguuacuuccccc

SEQ ID NO: 1713865 - RNA, 14 nt, Salmonella enterica enterica serovar Typhi
cagccguugugcug

SEQ ID NO: 1713866 - RNA, 13 nt, Salmonella enterica enterica serovar Typhi
cagccuguuugga

SEQ ID NO: 1713867 - RNA, 20 nt, Salmonella enterica enterica serovar Typhi
cagccuuaaucaacugcgcc

SEQ ID NO: 1713868 - RNA, 19 nt, Salmonella enterica enterica serovar Typhi
cagccuuccuggucugcca

SEQ ID NO: 1713869 - RNA, 18 nt, Salmonella enterica enterica serovar Typhi
cagccuuuucauauggaa

SEQ ID NO: 1713870 - RNA, 19 nt, Salmonella enterica enterica serovar Typhi
cagcgacacuccgcgcaug

SEQ ID NO: 1713871 - RNA, 15 nt, Salmonella enterica enterica serovar Typhi
cagcgacacuccgcg

SEQ ID NO: 1713872 - RNA, 17 nt, Salmonella enterica enterica serovar Typhi
cagcgacauccucuuca

SEQ ID NO: 1713873 - RNA, 14 nt, Salmonella enterica enterica serovar Typhi
cagcgaauaaugaa

SEQ ID NO: 1713874 - RNA, 21 nt, Salmonella enterica enterica serovar Typhi
cagcgaaagaugcguaccgcu

SEQ ID NO: 1713875 - RNA, 23 nt, Salmonella enterica enterica serovar Typhi
cagcgaauccgugcguaaaauau

SEQ ID NO: 1713876 - RNA, 22 nt, Salmonella enterica enterica serovar Typhi
cagcgaaaugacggccaccagc

SEQ ID NO: 1713877 - RNA, 21 nt, Salmonella enterica enterica serovar Typhi
cagcgaaaugacggccaccag

SEQ ID NO: 1713878 - RNA, 19 nt, Salmonella enterica enterica serovar Typhi
cagcgaacucccgggcgcu

SEQ ID NO: 1713879 - RNA, 16 nt, Salmonella enterica enterica serovar Typhi
cagcgaaccgcggcau

SEQ ID NO: 1713880 - RNA, 18 nt, Salmonella enterica enterica serovar Typhi
cagcgagcaggaauagcu

SEQ ID NO: 1713881 - RNA, 15 nt, Salmonella enterica enterica serovar Typhi
cagcgagauggcuuu

SEQ ID NO: 1713882 - RNA, 21 nt, Salmonella enterica enterica serovar Typhi
cagcgaguuacguugcggcgu

SEQ ID NO: 1713883 - RNA, 15 nt, Salmonella enterica enterica serovar Typhi
cagcgagugcgccca

SEQ ID NO: 1713884 - RNA, 15 nt, Salmonella enterica enterica serovar Typhi
cagcgacuucaggcg

SEQ ID NO: 1713885 - RNA, 15 nt, Salmonella enterica enterica serovar Typhi
cagcgagaagucggc

SEQ ID NO: 1713886 - RNA, 15 nt, Salmonella enterica enterica serovar Typhi
cagcgacgcauugag

SEQ ID NO: 1713887 - RNA, 13 nt, Salmonella enterica enterica serovar Typhi
cagcgacgccaga

SEQ ID NO: 1713888 - RNA, 14 nt, Salmonella enterica enterica serovar Typhi
cagcgaccuccgcg

SEQ ID NO: 1713889 - RNA, 13 nt, Salmonella enterica enterica serovar Typhi
cagcgaccuccgc

SEQ ID NO: 1713890 - RNA, 22 nt, Salmonella enterica enterica serovar Typhi
cagccgcuuuccgccgccgcca

SEQ ID NO: 1713891 - RNA, 16 nt, Salmonella enterica enterica serovar Typhi
cagccggauuuuaaau

SEQ ID NO: 1713892 - RNA, 20 nt, Salmonella enterica enterica serovar Typhi
cagccgcucugcuguuccuu

SEQ ID NO: 1713893 - RNA, 16 nt, Salmonella enterica enterica serovar Typhi
cagccgggcaggaaaa

SEQ ID NO: 1713894 - RNA, 18 nt, Salmonella enterica enterica serovar Typhi
cagccgggccgcaaccgc

SEQ ID NO: 1713895 - RNA, 16 nt, Salmonella enterica enterica serovar Typhi
cagccgguauccagcg

SEQ ID NO: 1713896 - RNA, 17 nt, Salmonella enterica enterica serovar Typhi
cagccgauuucauacca

SEQ ID NO: 1713897 - RNA, 11 nt, Salmonella enterica enterica serovar Typhi
cagccgccauu

SEQ ID NO: 1713898 - RNA, 19 nt, Salmonella enterica enterica serovar Typhi
cagccgccauuaauaccau

SEQ ID NO: 1713899 - RNA, 13 nt, Salmonella enterica enterica serovar Typhi
cagccgccauccg

SEQ ID NO: 1713900 - RNA, 15 nt, Salmonella enterica enterica serovar Typhi
cagccgccaucgcug

SEQ ID NO: 1713901 - RNA, 12 nt, Salmonella enterica enterica serovar Typhi
cagccgccaggc

SEQ ID NO: 1713902 - RNA, 22 nt, Salmonella enterica enterica serovar Typhi
cagccgccaguuugguuaauuc

SEQ ID NO: 1713903 - RNA, 13 nt, Salmonella enterica enterica serovar Typhi
cagccgccaaaaa

SEQ ID NO: 1713904 - RNA, 12 nt, Salmonella enterica enterica serovar Typhi
cagccgccacca

SEQ ID NO: 1713905 - RNA, 17 nt, Salmonella enterica enterica serovar Typhi
cagccgccaccacaaag

SEQ ID NO: 1713906 - RNA, 12 nt, Salmonella enterica enterica serovar Typhi
cagccgcaucuu

SEQ ID NO: 1713907 - RNA, 14 nt, Salmonella enterica enterica serovar Typhi
cagccgcauuuuuu

SEQ ID NO: 1713908 - RNA, 18 nt, Salmonella enterica enterica serovar Typhi
cagccgacuaucuucuuc

SEQ ID NO: 1713909 - RNA, 21 nt, Salmonella enterica enterica serovar Typhi
cagccgacgcauuucuccuga

SEQ ID NO: 1713910 - RNA, 13 nt, Salmonella enterica enterica serovar Typhi
cagccgacgcauu

SEQ ID NO: 1713911 - RNA, 17 nt, Salmonella enterica enterica serovar Typhi
cagccgaucaucacgaa

SEQ ID NO: 1713912 - RNA, 20 nt, Salmonella enterica enterica serovar Typhi
cagccgaucuauuucauaau

SEQ ID NO: 1713913 - RNA, 22 nt, Salmonella enterica enterica serovar Typhi
cagccgagcgguaagagccaga

SEQ ID NO: 1713914 - RNA, 23 nt, Salmonella enterica enterica serovar Typhi
cagccgagcgguaagagccagac

SEQ ID NO: 1713915 - RNA, 19 nt, Salmonella enterica enterica serovar Typhi
cagcccguucucgccgcgu

SEQ ID NO: 1713916 - RNA, 18 nt, Salmonella enterica enterica serovar Typhi
cagcccgucggcgucugc

SEQ ID NO: 1713917 - RNA, 23 nt, Salmonella enterica enterica serovar Typhi
cagcccgucggcgucugcgcgcu

SEQ ID NO: 1713918 - RNA, 13 nt, Salmonella enterica enterica serovar Typhi
cagcccugugccg

SEQ ID NO: 1713919 - RNA, 15 nt, Salmonella enterica enterica serovar Typhi
cagcccugugccgcu

SEQ ID NO: 1713920 - RNA, 23 nt, Salmonella enterica enterica serovar Typhi
cagcccuuucaggaauuuaucaa

SEQ ID NO: 1713921 - RNA, 12 nt, Salmonella enterica enterica serovar Typhi
cagcccggcgug

SEQ ID NO: 1713922 - RNA, 14 nt, Salmonella enterica enterica serovar Typhi
cagcccgccgcccu

SEQ ID NO: 1713923 - RNA, 16 nt, Salmonella enterica enterica serovar Typhi
cagcccgaucaucucc

SEQ ID NO: 1713924 - RNA, 22 nt, Salmonella enterica enterica serovar Typhi
cagcccgaucggcuggcauuuu

SEQ ID NO: 1713925 - RNA, 19 nt, Salmonella enterica enterica serovar Typhi
cagcccgaucaucuccugu

SEQ ID NO: 1713926 - RNA, 20 nt, Salmonella enterica enterica serovar Typhi
cagcccgaucaucuccugua

SEQ ID NO: 1713927 - RNA, 13 nt, Salmonella enterica enterica serovar Typhi
cagcccgccagca

SEQ ID NO: 1713928 - RNA, 17 nt, Salmonella enterica enterica serovar Typhi
cagcccgcucguuucaa

SEQ ID NO: 1713929 - RNA, 15 nt, Salmonella enterica enterica serovar Typhi
cagcaccuccagcgc

SEQ ID NO: 1713930 - RNA, 16 nt, Salmonella enterica enterica serovar Typhi
cagcaccuccagcgcc

SEQ ID NO: 1713931 - RNA, 21 nt, Salmonella enterica enterica serovar Typhi
cagcaccucgcugcugcuuuu

SEQ ID NO: 1713932 - RNA, 16 nt, Salmonella enterica enterica serovar Typhi
cagcaccugaauaaug

SEQ ID NO: 1713933 - RNA, 13 nt, Salmonella enterica enterica serovar Typhi
cagcaccuccagc

SEQ ID NO: 1713934 - RNA, 14 nt, Salmonella enterica enterica serovar Typhi
cagcaccuccagcg

SEQ ID NO: 1713935 - RNA, 12 nt, Salmonella enterica enterica serovar Typhi
cagcaccgccgc

SEQ ID NO: 1713936 - RNA, 15 nt, Salmonella enterica enterica serovar Typhi
cagcaccgccgcgau

SEQ ID NO: 1713937 - RNA, 21 nt, Salmonella enterica enterica serovar Typhi
cagcaccaguugcgucagcgu

SEQ ID NO: 1713938 - RNA, 20 nt, Salmonella enterica enterica serovar Typhi
cagcacccagcgaauuauga

SEQ ID NO: 1713939 - RNA, 17 nt, Salmonella enterica enterica serovar Typhi
cagcacuucgcugauac

SEQ ID NO: 1713940 - RNA, 15 nt, Salmonella enterica enterica serovar Typhi
cagcagaaaaccggu

SEQ ID NO: 1713941 - RNA, 17 nt, Salmonella enterica enterica serovar Typhi
cagcagaaucaggcaca

SEQ ID NO: 1713942 - RNA, 17 nt, Salmonella enterica enterica serovar Typhi
cagcagacaaccgacgc

SEQ ID NO: 1713943 - RNA, 14 nt, Salmonella enterica enterica serovar Typhi
cagcagaccggcaa

SEQ ID NO: 1713944 - RNA, 23 nt, Salmonella enterica enterica serovar Typhi
cagcagaccggcaaaaauuugcg

SEQ ID NO: 1713945 - RNA, 20 nt, Salmonella enterica enterica serovar Typhi
cagcagacugccuacgcggc

SEQ ID NO: 1713946 - RNA, 15 nt, Salmonella enterica enterica serovar Typhi
cagcagacugguaac

SEQ ID NO: 1713947 - RNA, 19 nt, Salmonella enterica enterica serovar Typhi
cagcacgcgcugcgccgca

SEQ ID NO: 1713948 - RNA, 23 nt, Salmonella enterica enterica serovar Typhi
cagcacuaacagcagcagcaaac

SEQ ID NO: 1713949 - RNA, 13 nt, Salmonella enterica enterica serovar Typhi
cagcacuaacagc

SEQ ID NO: 1713950 - RNA, 14 nt, Salmonella enterica enterica serovar Typhi
cagcacuaacagca

SEQ ID NO: 1713951 - RNA, 19 nt, Salmonella enterica enterica serovar Typhi
cagcacguagcuuauaaau

SEQ ID NO: 1713952 - RNA, 19 nt, Salmonella enterica enterica serovar Typhi
cagcacgcuuacccagcau

SEQ ID NO: 1713953 - RNA, 19 nt, Salmonella enterica enterica serovar Typhi
cagcagcccgucuuuuucc

SEQ ID NO: 1713954 - RNA, 15 nt, Salmonella enterica enterica serovar Typhi
cagcagcgacgcauu

SEQ ID NO: 1713955 - RNA, 14 nt, Salmonella enterica enterica serovar Typhi
cagcagcagcaccg

SEQ ID NO: 1713956 - RNA, 18 nt, Salmonella enterica enterica serovar Typhi
cagcagcagagccggaac

SEQ ID NO: 1713957 - RNA, 20 nt, Salmonella enterica enterica serovar Typhi
cagcagcgcuuucuucuuca

SEQ ID NO: 1713958 - RNA, 13 nt, Salmonella enterica enterica serovar Typhi
cagcagcgcggca

SEQ ID NO: 1713959 - RNA, 22 nt, Salmonella enterica enterica serovar Typhi
cagcagcgcgaucgccccgacc

SEQ ID NO: 1713960 - RNA, 16 nt, Salmonella enterica enterica serovar Typhi
cagcaggacgcgcacu

SEQ ID NO: 1713961 - RNA, 22 nt, Salmonella enterica enterica serovar Typhi
cagcagcuucagcaucaucucc

SEQ ID NO: 1713962 - RNA, 12 nt, Salmonella enterica enterica serovar Typhi
cagcaggcuuug

SEQ ID NO: 1713963 - RNA, 18 nt, Salmonella enterica enterica serovar Typhi
cagcaggcuuugcugcug

SEQ ID NO: 1713964 - RNA, 20 nt, Salmonella enterica enterica serovar Typhi
cagcaggcuuugcugcugcg

SEQ ID NO: 1713965 - RNA, 21 nt, Salmonella enterica enterica serovar Typhi
cagcagggauauacaaauauc

SEQ ID NO: 1713966 - RNA, 20 nt, Salmonella enterica enterica serovar Typhi
cagcagguuaaacagacaau

SEQ ID NO: 1713967 - RNA, 20 nt, Salmonella enterica enterica serovar Typhi
cagcaggucgcacuccucug

SEQ ID NO: 1713968 - RNA, 20 nt, Salmonella enterica enterica serovar Typhi
cagcaggucgaccaccugcu

SEQ ID NO: 1713969 - RNA, 20 nt, Salmonella enterica enterica serovar Typhi
cagcagguugagucugcucg

SEQ ID NO: 1713970 - RNA, 18 nt, Salmonella enterica enterica serovar Typhi
cagcaguuuuucaaucuu

SEQ ID NO: 1713971 - RNA, 14 nt, Salmonella enterica enterica serovar Typhi
cagcaguucuacgc

SEQ ID NO: 1713972 - RNA, 18 nt, Salmonella enterica enterica serovar Typhi
cagcaguggcucagucag

SEQ ID NO: 1713973 - RNA, 17 nt, Salmonella enterica enterica serovar Typhi
cagccagacggcgccca

SEQ ID NO: 1713974 - RNA, 15 nt, Salmonella enterica enterica serovar Typhi
cagccagacgccagc

SEQ ID NO: 1713975 - RNA, 14 nt, Salmonella enterica enterica serovar Typhi
cagccacucccgau

SEQ ID NO: 1713976 - RNA, 11 nt, Salmonella enterica enterica serovar Typhi
cagccaggcca

SEQ ID NO: 1713977 - RNA, 17 nt, Salmonella enterica enterica serovar Typhi
cagccaggcggcaaagu

SEQ ID NO: 1713978 - RNA, 20 nt, Salmonella enterica enterica serovar Typhi
cagccagcguuucuggaagu

SEQ ID NO: 1713979 - RNA, 18 nt, Salmonella enterica enterica serovar Typhi
cagccagguugccagaaa

SEQ ID NO: 1713980 - RNA, 18 nt, Salmonella enterica enterica serovar Typhi
cagccagguuuugcucug

SEQ ID NO: 1713981 - RNA, 13 nt, Salmonella enterica enterica serovar Typhi
cagccagguggca

SEQ ID NO: 1713982 - RNA, 21 nt, Salmonella enterica enterica serovar Typhi
cagccagguauuuagccacgc

SEQ ID NO: 1713983 - RNA, 23 nt, Salmonella enterica enterica serovar Typhi
cagccagucgccaggcaagguua

SEQ ID NO: 1713984 - RNA, 20 nt, Salmonella enterica enterica serovar Typhi
cagccccugaaauaacagac

SEQ ID NO: 1713985 - RNA, 16 nt, Salmonella enterica enterica serovar Typhi
cagccccacauuggaa

SEQ ID NO: 1713986 - RNA, 13 nt, Salmonella enterica enterica serovar Typhi
cagccccagcgcc

SEQ ID NO: 1713987 - RNA, 12 nt, Salmonella enterica enterica serovar Typhi
cagcccaugaag

SEQ ID NO: 1713988 - RNA, 19 nt, Salmonella enterica enterica serovar Typhi
cagcccauagcuacgaccg

SEQ ID NO: 1713989 - RNA, 20 nt, Salmonella enterica enterica serovar Typhi
cagcccaucggucgcgcgca

SEQ ID NO: 1713990 - RNA, 22 nt, Salmonella enterica enterica serovar Typhi
cagcccaucggucgcgcgcagg

SEQ ID NO: 1713991 - RNA, 19 nt, Salmonella enterica enterica serovar Typhi
cagcccaucuuucgccagc

SEQ ID NO: 1713992 - RNA, 16 nt, Salmonella enterica enterica serovar Typhi
cagcccagguuaccaa

SEQ ID NO: 1713993 - RNA, 14 nt, Salmonella enterica enterica serovar Typhi
cagccauggcccuu

SEQ ID NO: 1713994 - RNA, 23 nt, Salmonella enterica enterica serovar Typhi
cagccauggcccaaaagguagcg

SEQ ID NO: 1713995 - RNA, 17 nt, Salmonella enterica enterica serovar Typhi
cagccaugccauauggc

SEQ ID NO: 1713996 - RNA, 16 nt, Salmonella enterica enterica serovar Typhi
cagccauauuuaugca

SEQ ID NO: 1713997 - RNA, 22 nt, Salmonella enterica enterica serovar Typhi
cagccauaauggauuagguugc

SEQ ID NO: 1713998 - RNA, 18 nt, Salmonella enterica enterica serovar Typhi
cagccauaaucaguacug

SEQ ID NO: 1713999 - RNA, 14 nt, Salmonella enterica enterica serovar Typhi
cagcaucgcccggg

SEQ ID NO: 1714000 - RNA, 19 nt, Salmonella enterica enterica serovar Typhi
cagcaucgccaucaacucc

SEQ ID NO: 1714001 - RNA, 15 nt, Salmonella enterica enterica serovar Typhi
cagcaucccggcaaa

SEQ ID NO: 1714002 - RNA, 15 nt, Salmonella enterica enterica serovar Typhi
cagcaucaugucccc

SEQ ID NO: 1714003 - RNA, 23 nt, Salmonella enterica enterica serovar Typhi
cagcaucccguuaugguuaucaa

SEQ ID NO: 1714004 - RNA, 14 nt, Salmonella enterica enterica serovar Typhi
cagcaucgaccagg

SEQ ID NO: 1714005 - RNA, 18 nt, Salmonella enterica enterica serovar Typhi
cagcaucgggaaucaucg

SEQ ID NO: 1714006 - RNA, 16 nt, Salmonella enterica enterica serovar Typhi
cagcaucggcagcgcc

SEQ ID NO: 1714007 - RNA, 20 nt, Salmonella enterica enterica serovar Typhi
cagcaugaauaaccucccgc

SEQ ID NO: 1714008 - RNA, 14 nt, Salmonella enterica enterica serovar Typhi
cagcaucugcggcu

SEQ ID NO: 1714009 - RNA, 17 nt, Salmonella enterica enterica serovar Typhi
cagcaucggcagcgcca

SEQ ID NO: 1714010 - RNA, 17 nt, Salmonella enterica enterica serovar Typhi
cagcaugaucauacugc

SEQ ID NO: 1714011 - RNA, 15 nt, Salmonella enterica enterica serovar Typhi
cagcauccaugccag

SEQ ID NO: 1714012 - RNA, 13 nt, Salmonella enterica enterica serovar Typhi
cagcaucccgcug

SEQ ID NO: 1714013 - RNA, 12 nt, Salmonella enterica enterica serovar Typhi
cagcaucaucuc

SEQ ID NO: 1714014 - RNA, 18 nt, Salmonella enterica enterica serovar Typhi
cagcaucaucucccaggc

SEQ ID NO: 1714015 - RNA, 18 nt, Salmonella enterica enterica serovar Typhi
cagcaucaaccaccaaaa

SEQ ID NO: 1714016 - RNA, 23 nt, Salmonella enterica enterica serovar Typhi
cagcauaauauccugcaccgccu

SEQ ID NO: 1714017 - RNA, 19 nt, Salmonella enterica enterica serovar Typhi
cagcauaauaaagcagcgg

SEQ ID NO: 1714018 - RNA, 18 nt, Salmonella enterica enterica serovar Typhi
cagcauaauauucauaac

SEQ ID NO: 1714019 - RNA, 17 nt, Salmonella enterica enterica serovar Typhi
cagcauaccgcccaaca

SEQ ID NO: 1714020 - RNA, 23 nt, Salmonella enterica enterica serovar Typhi
cagcauaucgauagcaucgguca

SEQ ID NO: 1714021 - RNA, 16 nt, Salmonella enterica enterica serovar Typhi
cagcauauccagcgcc

SEQ ID NO: 1714022 - RNA, 18 nt, Salmonella enterica enterica serovar Typhi
cagcauauuuuccggcgu

SEQ ID NO: 1714023 - RNA, 14 nt, Salmonella enterica enterica serovar Typhi
cagcauauccagcg

SEQ ID NO: 1714024 - RNA, 17 nt, Salmonella enterica enterica serovar Typhi
cagcauugaccaccaua

SEQ ID NO: 1714025 - RNA, 21 nt, Salmonella enterica enterica serovar Typhi
cagcauuggugagagaguugc

SEQ ID NO: 1714026 - RNA, 13 nt, Salmonella enterica enterica serovar Typhi
cagcauuuccagc

SEQ ID NO: 1714027 - RNA, 13 nt, Salmonella enterica enterica serovar Typhi
cagcauuucuuca

SEQ ID NO: 1714028 - RNA, 23 nt, Salmonella enterica enterica serovar Typhi
cagcauuucaaucgcgcccgcca

SEQ ID NO: 1714029 - RNA, 14 nt, Salmonella enterica enterica serovar Typhi
cagcauuacccccg

SEQ ID NO: 1714030 - RNA, 23 nt, Salmonella enterica enterica serovar Typhi
cagcaugguguguucccgcgcca

SEQ ID NO: 1714031 - RNA, 19 nt, Salmonella enterica enterica serovar Typhi
cagccacauuguaugcaag

SEQ ID NO: 1714032 - RNA, 19 nt, Salmonella enterica enterica serovar Typhi
cagccaauuuaggcguggu

SEQ ID NO: 1714033 - RNA, 15 nt, Salmonella enterica enterica serovar Typhi
cagccacacacuguu

SEQ ID NO: 1714034 - RNA, 20 nt, Salmonella enterica enterica serovar Typhi
cagccacacacuguuuaaug

SEQ ID NO: 1714035 - RNA, 19 nt, Salmonella enterica enterica serovar Typhi
cagccacaagagcagcaac

SEQ ID NO: 1714036 - RNA, 21 nt, Salmonella enterica enterica serovar Typhi
cagccaaucauaaacgccuga

SEQ ID NO: 1714037 - RNA, 21 nt, Salmonella enterica enterica serovar Typhi
cagccaaaaauaacgcccugc

SEQ ID NO: 1714038 - RNA, 17 nt, Salmonella enterica enterica serovar Typhi
cagcauuugcuguuuua

SEQ ID NO: 1714039 - RNA, 21 nt, Salmonella enterica enterica serovar Typhi
cagccaaauaggcgaggaaaa

SEQ ID NO: 1714040 - RNA, 23 nt, Salmonella enterica enterica serovar Typhi
cagccaaagcgagguaaaaagcg

SEQ ID NO: 1714041 - RNA, 18 nt, Salmonella enterica enterica serovar Typhi
cagccaaauagcgccaga

SEQ ID NO: 1714042 - RNA, 21 nt, Salmonella enterica enterica serovar Typhi
cagcauuuuucacaguucuac

SEQ ID NO: 1714043 - RNA, 19 nt, Salmonella enterica enterica serovar Typhi
cagccaacaacaggccgcc

SEQ ID NO: 1714044 - RNA, 17 nt, Salmonella enterica enterica serovar Typhi
cagccaacaacaggccg

SEQ ID NO: 1714045 - RNA, 16 nt, Salmonella enterica enterica serovar Typhi
cagaugcguuuucugc

SEQ ID NO: 1714046 - RNA, 18 nt, Salmonella enterica enterica serovar Typhi
cagauggauaaccugccg

SEQ ID NO: 1714047 - RNA, 14 nt, Salmonella enterica enterica serovar Typhi
cagauggaaaccgg

SEQ ID NO: 1714048 - RNA, 23 nt, Salmonella enterica enterica serovar Typhi
cagaugcuuaaugcucugcugug

SEQ ID NO: 1714049 - RNA, 20 nt, Salmonella enterica enterica serovar Typhi
cagaugcuuaaugcucugcu

SEQ ID NO: 1714050 - RNA, 21 nt, Salmonella enterica enterica serovar Typhi
cagaugcugucuuagugaaag

SEQ ID NO: 1714051 - RNA, 17 nt, Salmonella enterica enterica serovar Typhi
cagaugagcgguaaguc

SEQ ID NO: 1714052 - RNA, 14 nt, Salmonella enterica enterica serovar Typhi
cagaugcaaugcag

SEQ ID NO: 1714053 - RNA, 19 nt, Salmonella enterica enterica serovar Typhi
cagaugcagguucccgccc

SEQ ID NO: 1714054 - RNA, 21 nt, Salmonella enterica enterica serovar Typhi
cagaugcagguucccgcccug

SEQ ID NO: 1714055 - RNA, 19 nt, Salmonella enterica enterica serovar Typhi
cagaugcccguaaagcucg

SEQ ID NO: 1714056 - RNA, 15 nt, Salmonella enterica enterica serovar Typhi
cagaucggcaucuuu

SEQ ID NO: 1714057 - RNA, 19 nt, Salmonella enterica enterica serovar Typhi
cagaucgguaaaagcguuu

SEQ ID NO: 1714058 - RNA, 16 nt, Salmonella enterica enterica serovar Typhi
cagaucugucgccaug

SEQ ID NO: 1714059 - RNA, 17 nt, Salmonella enterica enterica serovar Typhi
cagaucuuuuugcuccu

SEQ ID NO: 1714060 - RNA, 14 nt, Salmonella enterica enterica serovar Typhi
cagaucuucaaucg

SEQ ID NO: 1714061 - RNA, 15 nt, Salmonella enterica enterica serovar Typhi
cagaucuucagaggc

SEQ ID NO: 1714062 - RNA, 16 nt, Salmonella enterica enterica serovar Typhi
cagaucccagguaacc

SEQ ID NO: 1714063 - RNA, 15 nt, Salmonella enterica enterica serovar Typhi
cagaucgaaugaaaa

SEQ ID NO: 1714064 - RNA, 13 nt, Salmonella enterica enterica serovar Typhi
cagaucgccgccg

SEQ ID NO: 1714065 - RNA, 19 nt, Salmonella enterica enterica serovar Typhi
cagaucggcagacaguuuc

SEQ ID NO: 1714066 - RNA, 13 nt, Salmonella enterica enterica serovar Typhi
cagauucuucugc

SEQ ID NO: 1714067 - RNA, 16 nt, Salmonella enterica enterica serovar Typhi
cagauuaucagcgaga

SEQ ID NO: 1714068 - RNA, 14 nt, Salmonella enterica enterica serovar Typhi
cagauuacuaugag

SEQ ID NO: 1714069 - RNA, 22 nt, Salmonella enterica enterica serovar Typhi
cagaugguauaaaucacgcuga

SEQ ID NO: 1714070 - RNA, 22 nt, Salmonella enterica enterica serovar Typhi
cagauggcuaugaagcuggagc

SEQ ID NO: 1714071 - RNA, 13 nt, Salmonella enterica enterica serovar Typhi
cagauggcugcac

SEQ ID NO: 1714072 - RNA, 22 nt, Salmonella enterica enterica serovar Typhi
cagauggcuuuacgcuuauucg

SEQ ID NO: 1714073 - RNA, 20 nt, Salmonella enterica enterica serovar Typhi
cagauguaccagcggcagcu

SEQ ID NO: 1714074 - RNA, 19 nt, Salmonella enterica enterica serovar Typhi
cagaugucgcggauaugca

SEQ ID NO: 1714075 - RNA, 17 nt, Salmonella enterica enterica serovar Typhi
cagauguuauaaacuuc

SEQ ID NO: 1714076 - RNA, 15 nt, Salmonella enterica enterica serovar Typhi
cagauguugauacag

SEQ ID NO: 1714077 - RNA, 14 nt, Salmonella enterica enterica serovar Typhi
cagauuugaacguc

SEQ ID NO: 1714078 - RNA, 18 nt, Salmonella enterica enterica serovar Typhi
cagcaaaccgauaaucac

SEQ ID NO: 1714079 - RNA, 19 nt, Salmonella enterica enterica serovar Typhi
cagcaaaauaccggcagcg

SEQ ID NO: 1714080 - RNA, 21 nt, Salmonella enterica enterica serovar Typhi
cagcaaaauggcaauugcgcc

SEQ ID NO: 1714081 - RNA, 18 nt, Salmonella enterica enterica serovar Typhi
cagcaaaauaccggcagc

SEQ ID NO: 1714082 - RNA, 22 nt, Salmonella enterica enterica serovar Typhi
cagauuuuuaauguccagcagu

SEQ ID NO: 1714083 - RNA, 23 nt, Salmonella enterica enterica serovar Typhi
cagauuuuuaauguccagcagug

SEQ ID NO: 1714084 - RNA, 15 nt, Salmonella enterica enterica serovar Typhi
cagauuuuuaauguc

SEQ ID NO: 1714085 - RNA, 22 nt, Salmonella enterica enterica serovar Typhi
cagauuuucauuuagcgccugu

SEQ ID NO: 1714086 - RNA, 21 nt, Salmonella enterica enterica serovar Typhi
cagcacaaucccggcgccgau

SEQ ID NO: 1714087 - RNA, 21 nt, Salmonella enterica enterica serovar Typhi
cagcacaauuccggcccaggc

SEQ ID NO: 1714088 - RNA, 22 nt, Salmonella enterica enterica serovar Typhi
cagcaauuucucgcccgccaga

SEQ ID NO: 1714089 - RNA, 21 nt, Salmonella enterica enterica serovar Typhi
cagcaauuggccaucuucguu

SEQ ID NO: 1714090 - RNA, 15 nt, Salmonella enterica enterica serovar Typhi
cagcaaugcccaaaa

SEQ ID NO: 1714091 - RNA, 18 nt, Salmonella enterica enterica serovar Typhi
cagcaaugagacaacggc

SEQ ID NO: 1714092 - RNA, 15 nt, Salmonella enterica enterica serovar Typhi
cagcaaugagcaggc

SEQ ID NO: 1714093 - RNA, 13 nt, Salmonella enterica enterica serovar Typhi
cagcaaugauaac

SEQ ID NO: 1714094 - RNA, 20 nt, Salmonella enterica enterica serovar Typhi
cagcaaugauaacggcgcca

SEQ ID NO: 1714095 - RNA, 20 nt, Salmonella enterica enterica serovar Typhi
cagcaauaguggacacacaa

SEQ ID NO: 1714096 - RNA, 17 nt, Salmonella enterica enterica serovar Typhi
cagcaauaucagccauu

SEQ ID NO: 1714097 - RNA, 12 nt, Salmonella enterica enterica serovar Typhi
cagcaaucaggu

SEQ ID NO: 1714098 - RNA, 16 nt, Salmonella enterica enterica serovar Typhi
cagcacauagaagcuc

SEQ ID NO: 1714099 - RNA, 17 nt, Salmonella enterica enterica serovar Typhi
cagcacauagccuaaug

SEQ ID NO: 1714100 - RNA, 14 nt, Salmonella enterica enterica serovar Typhi
cagcacaugcaauu

SEQ ID NO: 1714101 - RNA, 17 nt, Salmonella enterica enterica serovar Typhi
cagcacaugauguuuua

SEQ ID NO: 1714102 - RNA, 15 nt, Salmonella enterica enterica serovar Typhi
cagcaccagcauuag

SEQ ID NO: 1714103 - RNA, 13 nt, Salmonella enterica enterica serovar Typhi
cagcaacccugcc

SEQ ID NO: 1714104 - RNA, 17 nt, Salmonella enterica enterica serovar Typhi
cagcaaccccugagugc

SEQ ID NO: 1714105 - RNA, 23 nt, Salmonella enterica enterica serovar Typhi
cagcaacagugggcuaugaagag

SEQ ID NO: 1714106 - RNA, 16 nt, Salmonella enterica enterica serovar Typhi
cagcaacaguugcugg

SEQ ID NO: 1714107 - RNA, 17 nt, Salmonella enterica enterica serovar Typhi
cagcaacaguugcugga

SEQ ID NO: 1714108 - RNA, 17 nt, Salmonella enterica enterica serovar Typhi
cagcaacgccuccagcg

SEQ ID NO: 1714109 - RNA, 18 nt, Salmonella enterica enterica serovar Typhi
cagcaacgagcuuuuuuc

SEQ ID NO: 1714110 - RNA, 19 nt, Salmonella enterica enterica serovar Typhi
cagcaacacuuugcgcugc

SEQ ID NO: 1714111 - RNA, 16 nt, Salmonella enterica enterica serovar Typhi
cagcaacagaaguuca

SEQ ID NO: 1714112 - RNA, 20 nt, Salmonella enterica enterica serovar Typhi
cagcaaacgccauagcaucg

SEQ ID NO: 1714113 - RNA, 22 nt, Salmonella enterica enterica serovar Typhi
cagcaaacgccauagcaucgac

SEQ ID NO: 1714114 - RNA, 11 nt, Salmonella enterica enterica serovar Typhi
cagcaaauaau

SEQ ID NO: 1714115 - RNA, 23 nt, Salmonella enterica enterica serovar Typhi
cagcaagucgcgggcgcuaaacc

SEQ ID NO: 1714116 - RNA, 18 nt, Salmonella enterica enterica serovar Typhi
cagcaacugcgcgcgggu

SEQ ID NO: 1714117 - RNA, 22 nt, Salmonella enterica enterica serovar Typhi
cagcaacugcugcgcgugcugu

SEQ ID NO: 1714118 - RNA, 22 nt, Salmonella enterica enterica serovar Typhi
cagcaacgugaacugcgccugc

SEQ ID NO: 1714119 - RNA, 19 nt, Salmonella enterica enterica serovar Typhi
cagcaacggaagcugacca

SEQ ID NO: 1714120 - RNA, 22 nt, Salmonella enterica enterica serovar Typhi
cagcaacgcgcuaaaugcauag

SEQ ID NO: 1714121 - RNA, 16 nt, Salmonella enterica enterica serovar Typhi
cagagcgauaaagaac

SEQ ID NO: 1714122 - RNA, 17 nt, Salmonella enterica enterica serovar Typhi
cagagcgcgcuggcaag

SEQ ID NO: 1714123 - RNA, 18 nt, Salmonella enterica enterica serovar Typhi
cagagcgacaaugaacca

SEQ ID NO: 1714124 - RNA, 21 nt, Salmonella enterica enterica serovar Typhi
cagagcgacauggcccauuuc

SEQ ID NO: 1714125 - RNA, 20 nt, Salmonella enterica enterica serovar Typhi
cagagcgccggcaaagccau

SEQ ID NO: 1714126 - RNA, 20 nt, Salmonella enterica enterica serovar Typhi
cagagcgcgcuggcaagcgc

SEQ ID NO: 1714127 - RNA, 22 nt, Salmonella enterica enterica serovar Typhi
cagagcgcgcuggcaagcgcca

SEQ ID NO: 1714128 - RNA, 15 nt, Salmonella enterica enterica serovar Typhi
cagagcggauaaaua

SEQ ID NO: 1714129 - RNA, 17 nt, Salmonella enterica enterica serovar Typhi
cagagcguccacgccau

SEQ ID NO: 1714130 - RNA, 22 nt, Salmonella enterica enterica serovar Typhi
cagagcggggaaacucuuuucc

SEQ ID NO: 1714131 - RNA, 12 nt, Salmonella enterica enterica serovar Typhi
cagaggaaaacg

SEQ ID NO: 1714132 - RNA, 20 nt, Salmonella enterica enterica serovar Typhi
cagagcucgucaaaaaucac

SEQ ID NO: 1714133 - RNA, 18 nt, Salmonella enterica enterica serovar Typhi
cagagcucgucaaaaauc

SEQ ID NO: 1714134 - RNA, 16 nt, Salmonella enterica enterica serovar Typhi
cagagugcucaauaag

SEQ ID NO: 1714135 - RNA, 18 nt, Salmonella enterica enterica serovar Typhi
cagaguucuuuugaggcu

SEQ ID NO: 1714136 - RNA, 17 nt, Salmonella enterica enterica serovar Typhi
cagagucugaaaacuca

SEQ ID NO: 1714137 - RNA, 12 nt, Salmonella enterica enterica serovar Typhi
cagauaaaccac

SEQ ID NO: 1714138 - RNA, 18 nt, Salmonella enterica enterica serovar Typhi
cagagucgaaagaaacgc

SEQ ID NO: 1714139 - RNA, 12 nt, Salmonella enterica enterica serovar Typhi
cagaguacauuc

SEQ ID NO: 1714140 - RNA, 16 nt, Salmonella enterica enterica serovar Typhi
cagaguaugcugcuaa

SEQ ID NO: 1714141 - RNA, 18 nt, Salmonella enterica enterica serovar Typhi
cagagguaagauguucua

SEQ ID NO: 1714142 - RNA, 23 nt, Salmonella enterica enterica serovar Typhi
cagaggugaaccauugagauaug

SEQ ID NO: 1714143 - RNA, 21 nt, Salmonella enterica enterica serovar Typhi
cagaguaacccgauacccuga

SEQ ID NO: 1714144 - RNA, 19 nt, Salmonella enterica enterica serovar Typhi
cagaggucucagguucgaa

SEQ ID NO: 1714145 - RNA, 20 nt, Salmonella enterica enterica serovar Typhi
cagauacugcgcguggcaaa

SEQ ID NO: 1714146 - RNA, 15 nt, Salmonella enterica enterica serovar Typhi
cagauacuucaguuu

SEQ ID NO: 1714147 - RNA, 15 nt, Salmonella enterica enterica serovar Typhi
cagauacauggcuau

SEQ ID NO: 1714148 - RNA, 23 nt, Salmonella enterica enterica serovar Typhi
cagauacacgccuuccuccagca

SEQ ID NO: 1714149 - RNA, 13 nt, Salmonella enterica enterica serovar Typhi
cagauagcccgcc

SEQ ID NO: 1714150 - RNA, 21 nt, Salmonella enterica enterica serovar Typhi
cagauagcccgccagcaccag

SEQ ID NO: 1714151 - RNA, 17 nt, Salmonella enterica enterica serovar Typhi
cagauagcccugagccc

SEQ ID NO: 1714152 - RNA, 13 nt, Salmonella enterica enterica serovar Typhi
cagauagcgcugc

SEQ ID NO: 1714153 - RNA, 17 nt, Salmonella enterica enterica serovar Typhi
cagauagcgcugcgcca

SEQ ID NO: 1714154 - RNA, 19 nt, Salmonella enterica enterica serovar Typhi
cagauagcgcugcgccaga

SEQ ID NO: 1714155 - RNA, 15 nt, Salmonella enterica enterica serovar Typhi
cagauagcguaaccg

SEQ ID NO: 1714156 - RNA, 15 nt, Salmonella enterica enterica serovar Typhi
cagauagcuuccaug

SEQ ID NO: 1714157 - RNA, 22 nt, Salmonella enterica enterica serovar Typhi
cagauaacgaaccaucauuaau

SEQ ID NO: 1714158 - RNA, 23 nt, Salmonella enterica enterica serovar Typhi
cagauaaguuugcagaucggccu

SEQ ID NO: 1714159 - RNA, 21 nt, Salmonella enterica enterica serovar Typhi
cagauaagcucuccuggaugc

SEQ ID NO: 1714160 - RNA, 22 nt, Salmonella enterica enterica serovar Typhi
cagauaaugaucaacgcggcga

SEQ ID NO: 1714161 - RNA, 17 nt, Salmonella enterica enterica serovar Typhi
cagaucaggucugagau

SEQ ID NO: 1714162 - RNA, 15 nt, Salmonella enterica enterica serovar Typhi
cagaucaaaaaucug

SEQ ID NO: 1714163 - RNA, 21 nt, Salmonella enterica enterica serovar Typhi
cagauauugcggaucagcaaa

SEQ ID NO: 1714164 - RNA, 13 nt, Salmonella enterica enterica serovar Typhi
cagauaucgcgua

SEQ ID NO: 1714165 - RNA, 19 nt, Salmonella enterica enterica serovar Typhi
cagauaguggcugaggccg

SEQ ID NO: 1714166 - RNA, 18 nt, Salmonella enterica enterica serovar Typhi
cagauagcgaucgccgcu

SEQ ID NO: 1714167 - RNA, 12 nt, Salmonella enterica enterica serovar Typhi
cagauagucauc

SEQ ID NO: 1714168 - RNA, 19 nt, Salmonella enterica enterica serovar Typhi
cagacgaccguaauagcaa

SEQ ID NO: 1714169 - RNA, 14 nt, Salmonella enterica enterica serovar Typhi
cagacgaugaauuc

SEQ ID NO: 1714170 - RNA, 14 nt, Salmonella enterica enterica serovar Typhi
cagaccucugcaaa

SEQ ID NO: 1714171 - RNA, 18 nt, Salmonella enterica enterica serovar Typhi
cagaccucugcaaacacc

SEQ ID NO: 1714172 - RNA, 23 nt, Salmonella enterica enterica serovar Typhi
cagaccugaauauucggcuccag

SEQ ID NO: 1714173 - RNA, 15 nt, Salmonella enterica enterica serovar Typhi
cagaccuguaaaaaa

SEQ ID NO: 1714174 - RNA, 21 nt, Salmonella enterica enterica serovar Typhi
cagacgcguauggcgguuggg

SEQ ID NO: 1714175 - RNA, 19 nt, Salmonella enterica enterica serovar Typhi
cagacgcuccgcaguaauc

SEQ ID NO: 1714176 - RNA, 16 nt, Salmonella enterica enterica serovar Typhi
cagacgcugcuucacg

SEQ ID NO: 1714177 - RNA, 20 nt, Salmonella enterica enterica serovar Typhi
cagacgcaucaggaaccaca

SEQ ID NO: 1714178 - RNA, 14 nt, Salmonella enterica enterica serovar Typhi
cagacgcgcagcac

SEQ ID NO: 1714179 - RNA, 16 nt, Salmonella enterica enterica serovar Typhi
cagacgcgcagcaccg

SEQ ID NO: 1714180 - RNA, 14 nt, Salmonella enterica enterica serovar Typhi
cagacucagccagg

SEQ ID NO: 1714181 - RNA, 15 nt, Salmonella enterica enterica serovar Typhi
cagacucagccaggu

SEQ ID NO: 1714182 - RNA, 17 nt, Salmonella enterica enterica serovar Typhi
cagacucgcucccuucc

SEQ ID NO: 1714183 - RNA, 20 nt, Salmonella enterica enterica serovar Typhi
cagacucgcucccuuccccc

SEQ ID NO: 1714184 - RNA, 12 nt, Salmonella enterica enterica serovar Typhi
cagacuaucuuc

SEQ ID NO: 1714185 - RNA, 21 nt, Salmonella enterica enterica serovar Typhi
cagacuaaccguucaucuauc

SEQ ID NO: 1714186 - RNA, 18 nt, Salmonella enterica enterica serovar Typhi
cagacggcaagcaaccgu

SEQ ID NO: 1714187 - RNA, 13 nt, Salmonella enterica enterica serovar Typhi
cagacggcugggc

SEQ ID NO: 1714188 - RNA, 16 nt, Salmonella enterica enterica serovar Typhi
cagacggcgaaucaau

SEQ ID NO: 1714189 - RNA, 18 nt, Salmonella enterica enterica serovar Typhi
cagacggcuccagcgcca

SEQ ID NO: 1714190 - RNA, 21 nt, Salmonella enterica enterica serovar Typhi
cagagcaacgagaacccacuu

SEQ ID NO: 1714191 - RNA, 19 nt, Salmonella enterica enterica serovar Typhi
cagagccaaacacuucccc

SEQ ID NO: 1714192 - RNA, 21 nt, Salmonella enterica enterica serovar Typhi
cagagcaucuaccgcauacug

SEQ ID NO: 1714193 - RNA, 18 nt, Salmonella enterica enterica serovar Typhi
cagagcaucaauggugaa

SEQ ID NO: 1714194 - RNA, 18 nt, Salmonella enterica enterica serovar Typhi
cagagagggaaaaaaauc

SEQ ID NO: 1714195 - RNA, 16 nt, Salmonella enterica enterica serovar Typhi
cagagagggaaaaaaa

SEQ ID NO: 1714196 - RNA, 17 nt, Salmonella enterica enterica serovar Typhi
cagagauaauuuuccca

SEQ ID NO: 1714197 - RNA, 15 nt, Salmonella enterica enterica serovar Typhi
cagagauaauuuucc

SEQ ID NO: 1714198 - RNA, 17 nt, Salmonella enterica enterica serovar Typhi
cagagauccacauuggu

SEQ ID NO: 1714199 - RNA, 12 nt, Salmonella enterica enterica serovar Typhi
cagacuuuccag

SEQ ID NO: 1714200 - RNA, 17 nt, Salmonella enterica enterica serovar Typhi
cagacuucauuuuccac

SEQ ID NO: 1714201 - RNA, 18 nt, Salmonella enterica enterica serovar Typhi
cagacuucaacgccgcac

SEQ ID NO: 1714202 - RNA, 20 nt, Salmonella enterica enterica serovar Typhi
cagacugguauagccuuuuu

SEQ ID NO: 1714203 - RNA, 18 nt, Salmonella enterica enterica serovar Typhi
cagacuguaaaucugccg

SEQ ID NO: 1714204 - RNA, 16 nt, Salmonella enterica enterica serovar Typhi
cagacuguaugugcuc

SEQ ID NO: 1714205 - RNA, 19 nt, Salmonella enterica enterica serovar Typhi
cagacugaauaaaggguuu

SEQ ID NO: 1714206 - RNA, 15 nt, Salmonella enterica enterica serovar Typhi
cagacugcacuuccu

SEQ ID NO: 1714207 - RNA, 15 nt, Salmonella enterica enterica serovar Typhi
cagacugcgccacgu

SEQ ID NO: 1714208 - RNA, 16 nt, Salmonella enterica enterica serovar Typhi
cagacugguauagccu

SEQ ID NO: 1714209 - RNA, 18 nt, Salmonella enterica enterica serovar Typhi
cagaccaaagucaaacug

SEQ ID NO: 1714210 - RNA, 20 nt, Salmonella enterica enterica serovar Typhi
cagacaugcagcacuuuuga

SEQ ID NO: 1714211 - RNA, 22 nt, Salmonella enterica enterica serovar Typhi
cagaccaauagagagcgacagc

SEQ ID NO: 1714212 - RNA, 20 nt, Salmonella enterica enterica serovar Typhi
cagacaugaccgcacagcag

SEQ ID NO: 1714213 - RNA, 14 nt, Salmonella enterica enterica serovar Typhi
cagacaucaucgaa

SEQ ID NO: 1714214 - RNA, 16 nt, Salmonella enterica enterica serovar Typhi
cagacauggcaauggc

SEQ ID NO: 1714215 - RNA, 20 nt, Salmonella enterica enterica serovar Typhi
cagacagucuggauauaaac

SEQ ID NO: 1714216 - RNA, 22 nt, Salmonella enterica enterica serovar Typhi
cagacaguggccaucuuccagc

SEQ ID NO: 1714217 - RNA, 13 nt, Salmonella enterica enterica serovar Typhi
cagacacugcacc

SEQ ID NO: 1714218 - RNA, 14 nt, Salmonella enterica enterica serovar Typhi
cagacacugcacca

SEQ ID NO: 1714219 - RNA, 13 nt, Salmonella enterica enterica serovar Typhi
cagacacugccac

SEQ ID NO: 1714220 - RNA, 23 nt, Salmonella enterica enterica serovar Typhi
cagacaggccugguuaacaauau

SEQ ID NO: 1714221 - RNA, 14 nt, Salmonella enterica enterica serovar Typhi
cagacaggacgcca

SEQ ID NO: 1714222 - RNA, 19 nt, Salmonella enterica enterica serovar Typhi
cagacagccauauuuaugc

SEQ ID NO: 1714223 - RNA, 22 nt, Salmonella enterica enterica serovar Typhi
cagacacuggaaacagccaauc

SEQ ID NO: 1714224 - RNA, 12 nt, Salmonella enterica enterica serovar Typhi
cagacacuggaa

SEQ ID NO: 1714225 - RNA, 19 nt, Salmonella enterica enterica serovar Typhi
cagacacuggaaacagcca

SEQ ID NO: 1714226 - RNA, 13 nt, Salmonella enterica enterica serovar Typhi
cagaccaccagcg

SEQ ID NO: 1714227 - RNA, 19 nt, Salmonella enterica enterica serovar Typhi
cagaccaccccacaguaau

SEQ ID NO: 1714228 - RNA, 23 nt, Salmonella enterica enterica serovar Typhi
cagaccaguugccccugcgucac

SEQ ID NO: 1714229 - RNA, 23 nt, Salmonella enterica enterica serovar Typhi
cagacccaguacaaacaaauaaa

SEQ ID NO: 1714230 - RNA, 14 nt, Salmonella enterica enterica serovar Typhi
cagaccgaucucau

SEQ ID NO: 1714231 - RNA, 17 nt, Salmonella enterica enterica serovar Typhi
cagaccgaucucaugca

SEQ ID NO: 1714232 - RNA, 15 nt, Salmonella enterica enterica serovar Typhi
cagaccgacaaaacu

SEQ ID NO: 1714233 - RNA, 17 nt, Salmonella enterica enterica serovar Typhi
cagaccgacaagccccc

SEQ ID NO: 1714234 - RNA, 18 nt, Salmonella enterica enterica serovar Typhi
cagacccgauagcgccgc

SEQ ID NO: 1714235 - RNA, 20 nt, Salmonella enterica enterica serovar Typhi
cagaccggcaucucaucuug

SEQ ID NO: 1714236 - RNA, 21 nt, Salmonella enterica enterica serovar Typhi
cagaccggcaucucaucuugc

SEQ ID NO: 1714237 - RNA, 14 nt, Salmonella enterica enterica serovar Typhi
cagaccggauugcc

SEQ ID NO: 1714238 - RNA, 21 nt, Salmonella enterica enterica serovar Typhi
cagaccgcugcggaacaccag

SEQ ID NO: 1714239 - RNA, 21 nt, Salmonella enterica enterica serovar Typhi
cagaauccgucagguuuuuug

SEQ ID NO: 1714240 - RNA, 14 nt, Salmonella enterica enterica serovar Typhi
cagaaucagccgac

SEQ ID NO: 1714241 - RNA, 19 nt, Salmonella enterica enterica serovar Typhi
cagaaucagcgugccggua

SEQ ID NO: 1714242 - RNA, 16 nt, Salmonella enterica enterica serovar Typhi
cagaauacacuucuca

SEQ ID NO: 1714243 - RNA, 20 nt, Salmonella enterica enterica serovar Typhi
cagaauaaacggcagggcag

SEQ ID NO: 1714244 - RNA, 18 nt, Salmonella enterica enterica serovar Typhi
cagaauaaugcuggcgga

SEQ ID NO: 1714245 - RNA, 13 nt, Salmonella enterica enterica serovar Typhi
cagaaucacccca

SEQ ID NO: 1714246 - RNA, 15 nt, Salmonella enterica enterica serovar Typhi
cagaaucaccucuuu

SEQ ID NO: 1714247 - RNA, 18 nt, Salmonella enterica enterica serovar Typhi
cagaauauccgguacacc

SEQ ID NO: 1714248 - RNA, 15 nt, Salmonella enterica enterica serovar Typhi
cagaauaucuuuuac

SEQ ID NO: 1714249 - RNA, 18 nt, Salmonella enterica enterica serovar Typhi
cagacaauaaacgguccg

SEQ ID NO: 1714250 - RNA, 18 nt, Salmonella enterica enterica serovar Typhi
cagacaaagggcacaccg

SEQ ID NO: 1714251 - RNA, 15 nt, Salmonella enterica enterica serovar Typhi
cagaauuuuuaacca

SEQ ID NO: 1714252 - RNA, 21 nt, Salmonella enterica enterica serovar Typhi
cagaauucguacguuuuucca

SEQ ID NO: 1714253 - RNA, 20 nt, Salmonella enterica enterica serovar Typhi
cagaauucguacguuuuucc

SEQ ID NO: 1714254 - RNA, 16 nt, Salmonella enterica enterica serovar Typhi
cagaauugcgccaccu

SEQ ID NO: 1714255 - RNA, 21 nt, Salmonella enterica enterica serovar Typhi
cagaauuucgcccuguauaca

SEQ ID NO: 1714256 - RNA, 19 nt, Salmonella enterica enterica serovar Typhi
cagaauuaacucaucacag

SEQ ID NO: 1714257 - RNA, 21 nt, Salmonella enterica enterica serovar Typhi
cagaauuaacucaucacagcc

SEQ ID NO: 1714258 - RNA, 14 nt, Salmonella enterica enterica serovar Typhi
cagaaugcaaaacu

SEQ ID NO: 1714259 - RNA, 15 nt, Salmonella enterica enterica serovar Typhi
cagaaugcccagcaa

SEQ ID NO: 1714260 - RNA, 20 nt, Salmonella enterica enterica serovar Typhi
cagaaggcuaacagcuggcu

SEQ ID NO: 1714261 - RNA, 19 nt, Salmonella enterica enterica serovar Typhi
cagaaggcuaacagcuggc

SEQ ID NO: 1714262 - RNA, 15 nt, Salmonella enterica enterica serovar Typhi
cagaaggcaugggga

SEQ ID NO: 1714263 - RNA, 16 nt, Salmonella enterica enterica serovar Typhi
cagaagacagaagcug

SEQ ID NO: 1714264 - RNA, 12 nt, Salmonella enterica enterica serovar Typhi
cagaagagaaug

SEQ ID NO: 1714265 - RNA, 16 nt, Salmonella enterica enterica serovar Typhi
cagaagcacuucucca

SEQ ID NO: 1714266 - RNA, 20 nt, Salmonella enterica enterica serovar Typhi
cagaacucaucuucuuuuuc

SEQ ID NO: 1714267 - RNA, 21 nt, Salmonella enterica enterica serovar Typhi
cagaacucacauauucaauaa

SEQ ID NO: 1714268 - RNA, 23 nt, Salmonella enterica enterica serovar Typhi
cagaagaaaaucaacacgucgau

SEQ ID NO: 1714269 - RNA, 17 nt, Salmonella enterica enterica serovar Typhi
cagaacugcgaaaucac

SEQ ID NO: 1714270 - RNA, 19 nt, Salmonella enterica enterica serovar Typhi
cagaacgcuuuugcgcacu

SEQ ID NO: 1714271 - RNA, 19 nt, Salmonella enterica enterica serovar Typhi
cagaaccuguucaugccag

SEQ ID NO: 1714272 - RNA, 18 nt, Salmonella enterica enterica serovar Typhi
cagaaccccaucgccuga

SEQ ID NO: 1714273 - RNA, 14 nt, Salmonella enterica enterica serovar Typhi
cagaaccacuugaa

SEQ ID NO: 1714274 - RNA, 21 nt, Salmonella enterica enterica serovar Typhi
cagaaaaucuggcgagagcau

SEQ ID NO: 1714275 - RNA, 17 nt, Salmonella enterica enterica serovar Typhi
cagaaagccauaaaacu

SEQ ID NO: 1714276 - RNA, 17 nt, Salmonella enterica enterica serovar Typhi
cagaaagcaacagcaag

SEQ ID NO: 1714277 - RNA, 14 nt, Salmonella enterica enterica serovar Typhi
cagaaauaaaauac

SEQ ID NO: 1714278 - RNA, 14 nt, Salmonella enterica enterica serovar Typhi
cagaaaggaugccc

SEQ ID NO: 1714279 - RNA, 13 nt, Salmonella enterica enterica serovar Typhi
cagaacaaaggcu

SEQ ID NO: 1714280 - RNA, 18 nt, Salmonella enterica enterica serovar Typhi
cagaacaaacuuauccca

SEQ ID NO: 1714281 - RNA, 21 nt, Salmonella enterica enterica serovar Typhi
cagaaauugaauuauaauaaa

SEQ ID NO: 1714282 - RNA, 10 nt, Salmonella enterica enterica serovar Typhi
cagaaaugac

SEQ ID NO: 1714283 - RNA, 16 nt, Salmonella enterica enterica serovar Typhi
cagaaaucgccgggcu

SEQ ID NO: 1714284 - RNA, 17 nt, Salmonella enterica enterica serovar Typhi
cagaaauauucaguacu

SEQ ID NO: 1714285 - RNA, 15 nt, Salmonella enterica enterica serovar Typhi
cagaaauaaaauacu

SEQ ID NO: 1714286 - RNA, 21 nt, Salmonella enterica enterica serovar Typhi
cacugcauaaauaucugcauu

SEQ ID NO: 1714287 - RNA, 21 nt, Salmonella enterica enterica serovar Typhi
cacugcaggcgggaagcuuca

SEQ ID NO: 1714288 - RNA, 12 nt, Salmonella enterica enterica serovar Typhi
cacugccaccgc

SEQ ID NO: 1714289 - RNA, 14 nt, Salmonella enterica enterica serovar Typhi
cacugcccuggaag

SEQ ID NO: 1714290 - RNA, 21 nt, Salmonella enterica enterica serovar Typhi
cacugcccucaaguuauguua

SEQ ID NO: 1714291 - RNA, 12 nt, Salmonella enterica enterica serovar Typhi
cacugccgccac

SEQ ID NO: 1714292 - RNA, 15 nt, Salmonella enterica enterica serovar Typhi
cacugccgccacgcc

SEQ ID NO: 1714293 - RNA, 22 nt, Salmonella enterica enterica serovar Typhi
cacugcgaacgcaucaaagcca

SEQ ID NO: 1714294 - RNA, 22 nt, Salmonella enterica enterica serovar Typhi
cacugcgagggauuuccuggca

SEQ ID NO: 1714295 - RNA, 12 nt, Salmonella enterica enterica serovar Typhi
cacugcgccgcc

SEQ ID NO: 1714296 - RNA, 15 nt, Salmonella enterica enterica serovar Typhi
cacugaugccacacc

SEQ ID NO: 1714297 - RNA, 14 nt, Salmonella enterica enterica serovar Typhi
cacugcacaucccg

SEQ ID NO: 1714298 - RNA, 21 nt, Salmonella enterica enterica serovar Typhi
caauguuuuaccggcagcucu

SEQ ID NO: 1714299 - RNA, 21 nt, Salmonella enterica enterica serovar Typhi
caauguugaaucccacgccgc

SEQ ID NO: 1714300 - RNA, 23 nt, Salmonella enterica enterica serovar Typhi
caauguugaaucccacgccgcug

SEQ ID NO: 1714301 - RNA, 19 nt, Salmonella enterica enterica serovar Typhi
caauguuaacuacuuuaca

SEQ ID NO: 1714302 - RNA, 21 nt, Salmonella enterica enterica serovar Typhi
caaugugcagcaggacgcgca

SEQ ID NO: 1714303 - RNA, 23 nt, Salmonella enterica enterica serovar Typhi
cacuuaauacucgccccguuccu

SEQ ID NO: 1714304 - RNA, 21 nt, Salmonella enterica enterica serovar Typhi
cacuguuuaaugcuuucaaua

SEQ ID NO: 1714305 - RNA, 16 nt, Salmonella enterica enterica serovar Typhi
cacuguggugugccug

SEQ ID NO: 1714306 - RNA, 17 nt, Salmonella enterica enterica serovar Typhi
cacuguggugugccugc

SEQ ID NO: 1714307 - RNA, 15 nt, Salmonella enterica enterica serovar Typhi
cacuguucagaaauc

SEQ ID NO: 1714308 - RNA, 20 nt, Salmonella enterica enterica serovar Typhi
cacuguucguccauaaaggc

SEQ ID NO: 1714309 - RNA, 20 nt, Salmonella enterica enterica serovar Typhi
cacuggaauucguuaccucg

SEQ ID NO: 1714310 - RNA, 23 nt, Salmonella enterica enterica serovar Typhi
cacugcuguguccaggucaucac

SEQ ID NO: 1714311 - RNA, 23 nt, Salmonella enterica enterica serovar Typhi
cacugcucguuaaauccucccau

SEQ ID NO: 1714312 - RNA, 19 nt, Salmonella enterica enterica serovar Typhi
cacuggccucccaguuccc

SEQ ID NO: 1714313 - RNA, 14 nt, Salmonella enterica enterica serovar Typhi
cacuggcccccugu

SEQ ID NO: 1714314 - RNA, 16 nt, Salmonella enterica enterica serovar Typhi
cacuggcccccuguuc

SEQ ID NO: 1714315 - RNA, 20 nt, Salmonella enterica enterica serovar Typhi
cacuggcguagucucccucc

SEQ ID NO: 1714316 - RNA, 17 nt, Salmonella enterica enterica serovar Typhi
cacuggaaacagccaau

SEQ ID NO: 1714317 - RNA, 22 nt, Salmonella enterica enterica serovar Typhi
cacuggcguagucucccuccug

SEQ ID NO: 1714318 - RNA, 16 nt, Salmonella enterica enterica serovar Typhi
cacuucacaaacaauu

SEQ ID NO: 1714319 - RNA, 15 nt, Salmonella enterica enterica serovar Typhi
cacuuccauccaugu

SEQ ID NO: 1714320 - RNA, 15 nt, Salmonella enterica enterica serovar Typhi
cacuuccccugccag

SEQ ID NO: 1714321 - RNA, 19 nt, Salmonella enterica enterica serovar Typhi
cacuucacacgaacuuuau

SEQ ID NO: 1714322 - RNA, 19 nt, Salmonella enterica enterica serovar Typhi
cacuucaauguuagcauua

SEQ ID NO: 1714323 - RNA, 21 nt, Salmonella enterica enterica serovar Typhi
cacuucaauguuagcauuauu

SEQ ID NO: 1714324 - RNA, 16 nt, Salmonella enterica enterica serovar Typhi
cacuuaucccugcccc

SEQ ID NO: 1714325 - RNA, 11 nt, Salmonella enterica enterica serovar Typhi
cacuuaugguc

SEQ ID NO: 1714326 - RNA, 15 nt, Salmonella enterica enterica serovar Typhi
cacuuaucccugccc

SEQ ID NO: 1714327 - RNA, 18 nt, Salmonella enterica enterica serovar Typhi
cacuuaggcagccaggca

SEQ ID NO: 1714328 - RNA, 16 nt, Salmonella enterica enterica serovar Typhi
cacuuacuuucuugcc

SEQ ID NO: 1714329 - RNA, 21 nt, Salmonella enterica enterica serovar Typhi
cacuugagaaauuauuuuaaa

SEQ ID NO: 1714330 - RNA, 22 nt, Salmonella enterica enterica serovar Typhi
cacuugagaaauuauuuuaaau

SEQ ID NO: 1714331 - RNA, 13 nt, Salmonella enterica enterica serovar Typhi
cacuucugacaga

SEQ ID NO: 1714332 - RNA, 22 nt, Salmonella enterica enterica serovar Typhi
cacuucgcgccauugaucauug

SEQ ID NO: 1714333 - RNA, 17 nt, Salmonella enterica enterica serovar Typhi
cacuuccgccaccacgc

SEQ ID NO: 1714334 - RNA, 15 nt, Salmonella enterica enterica serovar Typhi
cacuuccggugucca

SEQ ID NO: 1714335 - RNA, 22 nt, Salmonella enterica enterica serovar Typhi
cacuuccgguguccauguugcc

SEQ ID NO: 1714336 - RNA, 18 nt, Salmonella enterica enterica serovar Typhi
cacuuccgccaccacgcc

SEQ ID NO: 1714337 - RNA, 17 nt, Salmonella enterica enterica serovar Typhi
cacuuucucggcuuucc

SEQ ID NO: 1714338 - RNA, 21 nt, Salmonella enterica enterica serovar Typhi
cacuuucucggcuuuccagcu

SEQ ID NO: 1714339 - RNA, 15 nt, Salmonella enterica enterica serovar Typhi
cacuuugcgcugcgc

SEQ ID NO: 1714340 - RNA, 20 nt, Salmonella enterica enterica serovar Typhi
cacuuuucccgccagcugcg

SEQ ID NO: 1714341 - RNA, 19 nt, Salmonella enterica enterica serovar Typhi
cacuuuuggcgacaggaac

SEQ ID NO: 1714342 - RNA, 15 nt, Salmonella enterica enterica serovar Typhi
cacuuuuccagccaa

SEQ ID NO: 1714343 - RNA, 17 nt, Salmonella enterica enterica serovar Typhi
cacuuuuaccggcgucc

SEQ ID NO: 1714344 - RNA, 22 nt, Salmonella enterica enterica serovar Typhi
cagaaaaaagccaagcacaaaa

SEQ ID NO: 1714345 - RNA, 19 nt, Salmonella enterica enterica serovar Typhi
cagaaaaaaugcaccgccu

SEQ ID NO: 1714346 - RNA, 18 nt, Salmonella enterica enterica serovar Typhi
cagaaaaaccaaaaaaua

SEQ ID NO: 1714347 - RNA, 13 nt, Salmonella enterica enterica serovar Typhi
cacuuuuuccucc

SEQ ID NO: 1714348 - RNA, 15 nt, Salmonella enterica enterica serovar Typhi
cagaaaaccggcaaa

SEQ ID NO: 1714349 - RNA, 15 nt, Salmonella enterica enterica serovar Typhi
cagaaaaagccccca

SEQ ID NO: 1714350 - RNA, 19 nt, Salmonella enterica enterica serovar Typhi
cagaaaaagggaaaagcca

SEQ ID NO: 1714351 - RNA, 22 nt, Salmonella enterica enterica serovar Typhi
cacuugccgaguggaaucagcc

SEQ ID NO: 1714352 - RNA, 21 nt, Salmonella enterica enterica serovar Typhi
cacuugccgaguggaaucagc

SEQ ID NO: 1714353 - RNA, 19 nt, Salmonella enterica enterica serovar Typhi
cacuuuccagaccaagauc

SEQ ID NO: 1714354 - RNA, 17 nt, Salmonella enterica enterica serovar Typhi
cacuuucagaccacuau

SEQ ID NO: 1714355 - RNA, 17 nt, Salmonella enterica enterica serovar Typhi
cacuuuccgaaucaggc

SEQ ID NO: 1714356 - RNA, 17 nt, Salmonella enterica enterica serovar Typhi
cacuuuaaagcccagca

SEQ ID NO: 1714357 - RNA, 22 nt, Salmonella enterica enterica serovar Typhi
cacuuuacugaauaacagcacc

SEQ ID NO: 1714358 - RNA, 13 nt, Salmonella enterica enterica serovar Typhi
caggcagccacaa

SEQ ID NO: 1714359 - RNA, 20 nt, Salmonella enterica enterica serovar Typhi
caggcagccggauuuuaaau

SEQ ID NO: 1714360 - RNA, 14 nt, Salmonella enterica enterica serovar Typhi
caggcauaaaaaaa

SEQ ID NO: 1714361 - RNA, 17 nt, Salmonella enterica enterica serovar Typhi
caggcauaaaaaagagg

SEQ ID NO: 1714362 - RNA, 13 nt, Salmonella enterica enterica serovar Typhi
caggccgccaccg

SEQ ID NO: 1714363 - RNA, 15 nt, Salmonella enterica enterica serovar Typhi
caggccgccagcaac

SEQ ID NO: 1714364 - RNA, 14 nt, Salmonella enterica enterica serovar Typhi
caggccgccaccgc

SEQ ID NO: 1714365 - RNA, 17 nt, Salmonella enterica enterica serovar Typhi
caggccgccaccgccuc

SEQ ID NO: 1714366 - RNA, 15 nt, Salmonella enterica enterica serovar Typhi
caggccggauaagag

SEQ ID NO: 1714367 - RNA, 18 nt, Salmonella enterica enterica serovar Typhi
caggccggauaaggcagc

SEQ ID NO: 1714368 - RNA, 14 nt, Salmonella enterica enterica serovar Typhi
caggccgcgcugau

SEQ ID NO: 1714369 - RNA, 13 nt, Salmonella enterica enterica serovar Typhi
caggccgccgccu

SEQ ID NO: 1714370 - RNA, 18 nt, Salmonella enterica enterica serovar Typhi
caggccgccgcaaaagcc

SEQ ID NO: 1714371 - RNA, 21 nt, Salmonella enterica enterica serovar Typhi
caggccggauaaggcagcaau

SEQ ID NO: 1714372 - RNA, 17 nt, Salmonella enterica enterica serovar Typhi
caggccggauggcggcu

SEQ ID NO: 1714373 - RNA, 22 nt, Salmonella enterica enterica serovar Typhi
caggccggauggcggcuuugaa

SEQ ID NO: 1714374 - RNA, 19 nt, Salmonella enterica enterica serovar Typhi
caggcggcuuuuucaucau

SEQ ID NO: 1714375 - RNA, 13 nt, Salmonella enterica enterica serovar Typhi
caggcggucaucg

SEQ ID NO: 1714376 - RNA, 17 nt, Salmonella enterica enterica serovar Typhi
caggcgugauugagcag

SEQ ID NO: 1714377 - RNA, 23 nt, Salmonella enterica enterica serovar Typhi
caggcggguggugagcucaucca

SEQ ID NO: 1714378 - RNA, 19 nt, Salmonella enterica enterica serovar Typhi
caggcgggugcgcagcccc

SEQ ID NO: 1714379 - RNA, 22 nt, Salmonella enterica enterica serovar Typhi
caggcgggugcgcagccccagc

SEQ ID NO: 1714380 - RNA, 18 nt, Salmonella enterica enterica serovar Typhi
caggcgguauuucauaau

SEQ ID NO: 1714381 - RNA, 14 nt, Salmonella enterica enterica serovar Typhi
caggcgggugcgca

SEQ ID NO: 1714382 - RNA, 18 nt, Salmonella enterica enterica serovar Typhi
caggcuaaauggcauagc

SEQ ID NO: 1714383 - RNA, 15 nt, Salmonella enterica enterica serovar Typhi
caggcucaccagccc

SEQ ID NO: 1714384 - RNA, 14 nt, Salmonella enterica enterica serovar Typhi
caggcucagcgcca

SEQ ID NO: 1714385 - RNA, 16 nt, Salmonella enterica enterica serovar Typhi
caggcguuacgcgcca

SEQ ID NO: 1714386 - RNA, 20 nt, Salmonella enterica enterica serovar Typhi
caggcgcgaauaaugcgucc

SEQ ID NO: 1714387 - RNA, 19 nt, Salmonella enterica enterica serovar Typhi
caggcgcuauucccaggca

SEQ ID NO: 1714388 - RNA, 14 nt, Salmonella enterica enterica serovar Typhi
caggcgcaggcauu

SEQ ID NO: 1714389 - RNA, 14 nt, Salmonella enterica enterica serovar Typhi
caggcgcaucagaa

SEQ ID NO: 1714390 - RNA, 18 nt, Salmonella enterica enterica serovar Typhi
caggccuacacucugcgc

SEQ ID NO: 1714391 - RNA, 21 nt, Salmonella enterica enterica serovar Typhi
caggguaucauuaugggcagc

SEQ ID NO: 1714392 - RNA, 16 nt, Salmonella enterica enterica serovar Typhi
caggguaucuaacccg

SEQ ID NO: 1714393 - RNA, 17 nt, Salmonella enterica enterica serovar Typhi
caggguaaucaccauua

SEQ ID NO: 1714394 - RNA, 14 nt, Salmonella enterica enterica serovar Typhi
cagggguguccaga

SEQ ID NO: 1714395 - RNA, 21 nt, Salmonella enterica enterica serovar Typhi
cagggucgcggcauuaaaugc

SEQ ID NO: 1714396 - RNA, 17 nt, Salmonella enterica enterica serovar Typhi
caggguccccauauccc

SEQ ID NO: 1714397 - RNA, 23 nt, Salmonella enterica enterica serovar Typhi
caggguaucauuaugggcagcac

SEQ ID NO: 1714398 - RNA, 17 nt, Salmonella enterica enterica serovar Typhi
cagggucuuauuucucc

SEQ ID NO: 1714399 - RNA, 23 nt, Salmonella enterica enterica serovar Typhi
cagggucuuauuucuccugcgcc

SEQ ID NO: 1714400 - RNA, 21 nt, Salmonella enterica enterica serovar Typhi
caggggcuauugaaaaagccg

SEQ ID NO: 1714401 - RNA, 19 nt, Salmonella enterica enterica serovar Typhi
caggggcucuaaaaaggaa

SEQ ID NO: 1714402 - RNA, 24 nt, Salmonella enterica enterica serovar Typhi
cagggggauagcgacggggcgcag

SEQ ID NO: 1714403 - RNA, 23 nt, Salmonella enterica enterica serovar Typhi
caggggggaaaugagaaaaggaa

SEQ ID NO: 1714404 - RNA, 15 nt, Salmonella enterica enterica serovar Typhi
cagggcuuuuuucuc

SEQ ID NO: 1714405 - RNA, 18 nt, Salmonella enterica enterica serovar Typhi
caggggccacaggcggca

SEQ ID NO: 1714406 - RNA, 17 nt, Salmonella enterica enterica serovar Typhi
caggggauuagacuucc

SEQ ID NO: 1714407 - RNA, 21 nt, Salmonella enterica enterica serovar Typhi
cagggcgggauccccugcucc

SEQ ID NO: 1714408 - RNA, 14 nt, Salmonella enterica enterica serovar Typhi
cagggcggcgcgcu

SEQ ID NO: 1714409 - RNA, 22 nt, Salmonella enterica enterica serovar Typhi
cagggcggcaaaaucuuuuucg

SEQ ID NO: 1714410 - RNA, 19 nt, Salmonella enterica enterica serovar Typhi
cagggcugcuggccuucca

SEQ ID NO: 1714411 - RNA, 17 nt, Salmonella enterica enterica serovar Typhi
cagggcgugacgcgcca

SEQ ID NO: 1714412 - RNA, 20 nt, Salmonella enterica enterica serovar Typhi
cagggcaucccgucccacca

SEQ ID NO: 1714413 - RNA, 15 nt, Salmonella enterica enterica serovar Typhi
cagggcaucaugaug

SEQ ID NO: 1714414 - RNA, 20 nt, Salmonella enterica enterica serovar Typhi
cagggagacggccacccauc

SEQ ID NO: 1714415 - RNA, 19 nt, Salmonella enterica enterica serovar Typhi
caggcucaggaaaacaaau

SEQ ID NO: 1714416 - RNA, 18 nt, Salmonella enterica enterica serovar Typhi
cagggaaauggcgaacag

SEQ ID NO: 1714417 - RNA, 22 nt, Salmonella enterica enterica serovar Typhi
cagggaaauggcgaacagcccg

SEQ ID NO: 1714418 - RNA, 20 nt, Salmonella enterica enterica serovar Typhi
cagggacgauaggcgcguca

SEQ ID NO: 1714419 - RNA, 19 nt, Salmonella enterica enterica serovar Typhi
cagggacgcauccugcacu

SEQ ID NO: 1714420 - RNA, 17 nt, Salmonella enterica enterica serovar Typhi
cagggacuauaggcaau

SEQ ID NO: 1714421 - RNA, 19 nt, Salmonella enterica enterica serovar Typhi
cagggaacguugcgccaug

SEQ ID NO: 1714422 - RNA, 13 nt, Salmonella enterica enterica serovar Typhi
cagggcggaagca

SEQ ID NO: 1714423 - RNA, 23 nt, Salmonella enterica enterica serovar Typhi
cagggcgcggcgcaacuuuuucg

SEQ ID NO: 1714424 - RNA, 15 nt, Salmonella enterica enterica serovar Typhi
cagggcgaugccuca

SEQ ID NO: 1714425 - RNA, 14 nt, Salmonella enterica enterica serovar Typhi
cagggcgauuuccg

SEQ ID NO: 1714426 - RNA, 15 nt, Salmonella enterica enterica serovar Typhi
cagcuccauccacca

SEQ ID NO: 1714427 - RNA, 13 nt, Salmonella enterica enterica serovar Typhi
cagcuccaugucu

SEQ ID NO: 1714428 - RNA, 22 nt, Salmonella enterica enterica serovar Typhi
cagcuccaugucuugcuaucaa

SEQ ID NO: 1714429 - RNA, 16 nt, Salmonella enterica enterica serovar Typhi
cagcuccagcucaggg

SEQ ID NO: 1714430 - RNA, 19 nt, Salmonella enterica enterica serovar Typhi
cagcucaaccgcgcggcgu

SEQ ID NO: 1714431 - RNA, 19 nt, Salmonella enterica enterica serovar Typhi
cagcuauuuuucaccauaa

SEQ ID NO: 1714432 - RNA, 22 nt, Salmonella enterica enterica serovar Typhi
cagcucaugcaagacaucuaac

SEQ ID NO: 1714433 - RNA, 17 nt, Salmonella enterica enterica serovar Typhi
cagcucaugcgcggcgg

SEQ ID NO: 1714434 - RNA, 17 nt, Salmonella enterica enterica serovar Typhi
cagcucauuuuuacaga

SEQ ID NO: 1714435 - RNA, 21 nt, Salmonella enterica enterica serovar Typhi
cagcucauuuuuacagacacg

SEQ ID NO: 1714436 - RNA, 17 nt, Salmonella enterica enterica serovar Typhi
cagcggccauugaaguc

SEQ ID NO: 1714437 - RNA, 21 nt, Salmonella enterica enterica serovar Typhi
cagcggcgauuuauagagcag

SEQ ID NO: 1714438 - RNA, 13 nt, Salmonella enterica enterica serovar Typhi
cagcggcgcaggg

SEQ ID NO: 1714439 - RNA, 18 nt, Salmonella enterica enterica serovar Typhi
cagcggcgccaucaccau

SEQ ID NO: 1714440 - RNA, 14 nt, Salmonella enterica enterica serovar Typhi
cagcggcgcgcggu

SEQ ID NO: 1714441 - RNA, 13 nt, Salmonella enterica enterica serovar Typhi
cagcggcgcgcca

SEQ ID NO: 1714442 - RNA, 17 nt, Salmonella enterica enterica serovar Typhi
cagcuuaucugaccaug

SEQ ID NO: 1714443 - RNA, 16 nt, Salmonella enterica enterica serovar Typhi
cagcuuaucuuuuucg

SEQ ID NO: 1714444 - RNA, 16 nt, Salmonella enterica enterica serovar Typhi
cagcuuaaaucgcggc

SEQ ID NO: 1714445 - RNA, 14 nt, Salmonella enterica enterica serovar Typhi
cagcuuaccccugu

SEQ ID NO: 1714446 - RNA, 19 nt, Salmonella enterica enterica serovar Typhi
cagcuguuuaagcgccucc

SEQ ID NO: 1714447 - RNA, 20 nt, Salmonella enterica enterica serovar Typhi
cagcuguuuaagcgccucca

SEQ ID NO: 1714448 - RNA, 22 nt, Salmonella enterica enterica serovar Typhi
cagcuucaggcucaucagcgcc

SEQ ID NO: 1714449 - RNA, 16 nt, Salmonella enterica enterica serovar Typhi
cagcuucugucagccu

SEQ ID NO: 1714450 - RNA, 20 nt, Salmonella enterica enterica serovar Typhi
cagcuucagcaucaucuccc

SEQ ID NO: 1714451 - RNA, 18 nt, Salmonella enterica enterica serovar Typhi
cagcucggcaaagcccau

SEQ ID NO: 1714452 - RNA, 16 nt, Salmonella enterica enterica serovar Typhi
cagcucguacuccgcg

SEQ ID NO: 1714453 - RNA, 16 nt, Salmonella enterica enterica serovar Typhi
cagcucguuauuuccg

SEQ ID NO: 1714454 - RNA, 19 nt, Salmonella enterica enterica serovar Typhi
caggacagaugucccgccu

SEQ ID NO: 1714455 - RNA, 14 nt, Salmonella enterica enterica serovar Typhi
caggaaugcggcca

SEQ ID NO: 1714456 - RNA, 15 nt, Salmonella enterica enterica serovar Typhi
caggaauaaagguca

SEQ ID NO: 1714457 - RNA, 20 nt, Salmonella enterica enterica serovar Typhi
caggaauaacaucguaaauc

SEQ ID NO: 1714458 - RNA, 21 nt, Salmonella enterica enterica serovar Typhi
caggaauaacaucguaaauca

SEQ ID NO: 1714459 - RNA, 19 nt, Salmonella enterica enterica serovar Typhi
caggaccaaaacaguacug

SEQ ID NO: 1714460 - RNA, 19 nt, Salmonella enterica enterica serovar Typhi
caggacauggucaccauga

SEQ ID NO: 1714461 - RNA, 19 nt, Salmonella enterica enterica serovar Typhi
caggacgcacccuguucau

SEQ ID NO: 1714462 - RNA, 12 nt, Salmonella enterica enterica serovar Typhi
caggacgccagu

SEQ ID NO: 1714463 - RNA, 15 nt, Salmonella enterica enterica serovar Typhi
caggacgccagugaa

SEQ ID NO: 1714464 - RNA, 12 nt, Salmonella enterica enterica serovar Typhi
caggacgccagc

SEQ ID NO: 1714465 - RNA, 18 nt, Salmonella enterica enterica serovar Typhi
caggacgccagcgcggca

SEQ ID NO: 1714466 - RNA, 17 nt, Salmonella enterica enterica serovar Typhi
caggaacgcggcgccga

SEQ ID NO: 1714467 - RNA, 19 nt, Salmonella enterica enterica serovar Typhi
caggaacugcggccagaca

SEQ ID NO: 1714468 - RNA, 15 nt, Salmonella enterica enterica serovar Typhi
caggaaggcgugcag

SEQ ID NO: 1714469 - RNA, 13 nt, Salmonella enterica enterica serovar Typhi
caggaagggcagc

SEQ ID NO: 1714470 - RNA, 15 nt, Salmonella enterica enterica serovar Typhi
caggaagaguaucuc

SEQ ID NO: 1714471 - RNA, 20 nt, Salmonella enterica enterica serovar Typhi
caggaagaacacgccgccua

SEQ ID NO: 1714472 - RNA, 15 nt, Salmonella enterica enterica serovar Typhi
caggacgcuccauca

SEQ ID NO: 1714473 - RNA, 13 nt, Salmonella enterica enterica serovar Typhi
caggacugacugc

SEQ ID NO: 1714474 - RNA, 17 nt, Salmonella enterica enterica serovar Typhi
caggacgguggucaucu

SEQ ID NO: 1714475 - RNA, 12 nt, Salmonella enterica enterica serovar Typhi
caggagcauggu

SEQ ID NO: 1714476 - RNA, 14 nt, Salmonella enterica enterica serovar Typhi
caggagccaccggc

SEQ ID NO: 1714477 - RNA, 18 nt, Salmonella enterica enterica serovar Typhi
caggagcaaaccgaccca

SEQ ID NO: 1714478 - RNA, 15 nt, Salmonella enterica enterica serovar Typhi
caggagugaacacgu

SEQ ID NO: 1714479 - RNA, 19 nt, Salmonella enterica enterica serovar Typhi
caggauaaagaccggcaca

SEQ ID NO: 1714480 - RNA, 15 nt, Salmonella enterica enterica serovar Typhi
caggauaaaauccug

SEQ ID NO: 1714481 - RNA, 14 nt, Salmonella enterica enterica serovar Typhi
caggaggccugaau

SEQ ID NO: 1714482 - RNA, 14 nt, Salmonella enterica enterica serovar Typhi
caggaucuucaucc

SEQ ID NO: 1714483 - RNA, 17 nt, Salmonella enterica enterica serovar Typhi
caggaucuucaucccau

SEQ ID NO: 1714484 - RNA, 20 nt, Salmonella enterica enterica serovar Typhi
caggaucgggaucagcgcgc

SEQ ID NO: 1714485 - RNA, 23 nt, Salmonella enterica enterica serovar Typhi
caggaucgguaaacgccccuucg

SEQ ID NO: 1714486 - RNA, 13 nt, Salmonella enterica enterica serovar Typhi
caggaucgguaaa

SEQ ID NO: 1714487 - RNA, 15 nt, Salmonella enterica enterica serovar Typhi
caggcagaaauaacu

SEQ ID NO: 1714488 - RNA, 17 nt, Salmonella enterica enterica serovar Typhi
caggcacgugcauaaaa

SEQ ID NO: 1714489 - RNA, 17 nt, Salmonella enterica enterica serovar Typhi
caggcacuguggugugc

SEQ ID NO: 1714490 - RNA, 20 nt, Salmonella enterica enterica serovar Typhi
caggcacuguggugugccug

SEQ ID NO: 1714491 - RNA, 17 nt, Salmonella enterica enterica serovar Typhi
caggauuuacugagcgc

SEQ ID NO: 1714492 - RNA, 16 nt, Salmonella enterica enterica serovar Typhi
cagucguugcgccugu

SEQ ID NO: 1714493 - RNA, 14 nt, Salmonella enterica enterica serovar Typhi
cagucguuaucuga

SEQ ID NO: 1714494 - RNA, 13 nt, Salmonella enterica enterica serovar Typhi
cagucugcccggc

SEQ ID NO: 1714495 - RNA, 19 nt, Salmonella enterica enterica serovar Typhi
cagucugcagaccuguucu

SEQ ID NO: 1714496 - RNA, 16 nt, Salmonella enterica enterica serovar Typhi
cagucuggcggcagcc

SEQ ID NO: 1714497 - RNA, 21 nt, Salmonella enterica enterica serovar Typhi
cagucuggcggcagccgacag

SEQ ID NO: 1714498 - RNA, 22 nt, Salmonella enterica enterica serovar Typhi
cagucuggguuagcuguaucca

SEQ ID NO: 1714499 - RNA, 12 nt, Salmonella enterica enterica serovar Typhi
cagucgcgccgu

SEQ ID NO: 1714500 - RNA, 14 nt, Salmonella enterica enterica serovar Typhi
cagucgcuccacca

SEQ ID NO: 1714501 - RNA, 21 nt, Salmonella enterica enterica serovar Typhi
cagucggcaaagaccaauaaa

SEQ ID NO: 1714502 - RNA, 17 nt, Salmonella enterica enterica serovar Typhi
cagucguggcggauucu

SEQ ID NO: 1714503 - RNA, 17 nt, Salmonella enterica enterica serovar Typhi
caguccucgcccacuuc

SEQ ID NO: 1714504 - RNA, 14 nt, Salmonella enterica enterica serovar Typhi
caguccugucccug

SEQ ID NO: 1714505 - RNA, 23 nt, Salmonella enterica enterica serovar Typhi
cagucaugaaaucgauuuguuua

SEQ ID NO: 1714506 - RNA, 16 nt, Salmonella enterica enterica serovar Typhi
cagucgauguggccuu

SEQ ID NO: 1714507 - RNA, 20 nt, Salmonella enterica enterica serovar Typhi
cagucgauguggccuuccuc

SEQ ID NO: 1714508 - RNA, 18 nt, Salmonella enterica enterica serovar Typhi
cagucagcaauuaacaaa

SEQ ID NO: 1714509 - RNA, 14 nt, Salmonella enterica enterica serovar Typhi
cagucaucgccgcu

SEQ ID NO: 1714510 - RNA, 17 nt, Salmonella enterica enterica serovar Typhi
cagucaucgcgccaaac

SEQ ID NO: 1714511 - RNA, 16 nt, Salmonella enterica enterica serovar Typhi
caguguaaacgccaga

SEQ ID NO: 1714512 - RNA, 16 nt, Salmonella enterica enterica serovar Typhi
caguggacgcgucgcu

SEQ ID NO: 1714513 - RNA, 18 nt, Salmonella enterica enterica serovar Typhi
caguggagaggccaccag

SEQ ID NO: 1714514 - RNA, 14 nt, Salmonella enterica enterica serovar Typhi
caguggaaaacagc

SEQ ID NO: 1714515 - RNA, 20 nt, Salmonella enterica enterica serovar Typhi
cagugcugagcacgcccggu

SEQ ID NO: 1714516 - RNA, 21 nt, Salmonella enterica enterica serovar Typhi
cagugccaguccgguauaaaa

SEQ ID NO: 1714517 - RNA, 22 nt, Salmonella enterica enterica serovar Typhi
cagugaauauccccugacagag

SEQ ID NO: 1714518 - RNA, 14 nt, Salmonella enterica enterica serovar Typhi
cagugaacacccug

SEQ ID NO: 1714519 - RNA, 21 nt, Salmonella enterica enterica serovar Typhi
cagugaaauuugucgauaaaa

SEQ ID NO: 1714520 - RNA, 19 nt, Salmonella enterica enterica serovar Typhi
cagugaaaccggcgcgccu

SEQ ID NO: 1714521 - RNA, 15 nt, Salmonella enterica enterica serovar Typhi
cagugaaaagcugga

SEQ ID NO: 1714522 - RNA, 13 nt, Salmonella enterica enterica serovar Typhi
cagugacgccagu

SEQ ID NO: 1714523 - RNA, 16 nt, Salmonella enterica enterica serovar Typhi
cagugacgccaguucc

SEQ ID NO: 1714524 - RNA, 17 nt, Salmonella enterica enterica serovar Typhi
cagugacagaggaauga

SEQ ID NO: 1714525 - RNA, 21 nt, Salmonella enterica enterica serovar Typhi
cagugacaaacucacguuccc

SEQ ID NO: 1714526 - RNA, 14 nt, Salmonella enterica enterica serovar Typhi
cagugacccgccgc

SEQ ID NO: 1714527 - RNA, 16 nt, Salmonella enterica enterica serovar Typhi
cagugacccgccgcca

SEQ ID NO: 1714528 - RNA, 15 nt, Salmonella enterica enterica serovar Typhi
cagugaccagcauca

SEQ ID NO: 1714529 - RNA, 23 nt, Salmonella enterica enterica serovar Typhi
cagucaacgaggugaauaaaucc

SEQ ID NO: 1714530 - RNA, 20 nt, Salmonella enterica enterica serovar Typhi
caguagucgcgccauuccgc

SEQ ID NO: 1714531 - RNA, 17 nt, Salmonella enterica enterica serovar Typhi
caguacuuucuuuugau

SEQ ID NO: 1714532 - RNA, 18 nt, Salmonella enterica enterica serovar Typhi
caguagauggcgcuaaaa

SEQ ID NO: 1714533 - RNA, 15 nt, Salmonella enterica enterica serovar Typhi
caguagcagacagcc

SEQ ID NO: 1714534 - RNA, 18 nt, Salmonella enterica enterica serovar Typhi
caguagcagacagccgau

SEQ ID NO: 1714535 - RNA, 22 nt, Salmonella enterica enterica serovar Typhi
caguaguuaccguaaucaucgc

SEQ ID NO: 1714536 - RNA, 22 nt, Salmonella enterica enterica serovar Typhi
caguaguugaccugaucggcca

SEQ ID NO: 1714537 - RNA, 15 nt, Salmonella enterica enterica serovar Typhi
caguauaaauaccuu

SEQ ID NO: 1714538 - RNA, 21 nt, Salmonella enterica enterica serovar Typhi
caguaagucgccgcagcucca

SEQ ID NO: 1714539 - RNA, 21 nt, Salmonella enterica enterica serovar Typhi
caguaauauaaccaauuuaaa

SEQ ID NO: 1714540 - RNA, 13 nt, Salmonella enterica enterica serovar Typhi
caguacagccaaa

SEQ ID NO: 1714541 - RNA, 13 nt, Salmonella enterica enterica serovar Typhi
caguaagaucacc

SEQ ID NO: 1714542 - RNA, 13 nt, Salmonella enterica enterica serovar Typhi
caguaacugcaaa

SEQ ID NO: 1714543 - RNA, 17 nt, Salmonella enterica enterica serovar Typhi
caguaacucaucgccag

SEQ ID NO: 1714544 - RNA, 18 nt, Salmonella enterica enterica serovar Typhi
caguaacucaucgccagc

SEQ ID NO: 1714545 - RNA, 14 nt, Salmonella enterica enterica serovar Typhi
caguaacguucuuc

SEQ ID NO: 1714546 - RNA, 22 nt, Salmonella enterica enterica serovar Typhi
caguacgucaacaaugcuuuca

SEQ ID NO: 1714547 - RNA, 17 nt, Salmonella enterica enterica serovar Typhi
caguaccggcaggacaa

SEQ ID NO: 1714548 - RNA, 22 nt, Salmonella enterica enterica serovar Typhi
caguaccgccuucagcgcgccc

SEQ ID NO: 1714549 - RNA, 16 nt, Salmonella enterica enterica serovar Typhi
caguacagccaaaaau

SEQ ID NO: 1714550 - RNA, 23 nt, Salmonella enterica enterica serovar Typhi
caguaauaucgccucccugccua

SEQ ID NO: 1714551 - RNA, 15 nt, Salmonella enterica enterica serovar Typhi
cagguuuuuaagcug

SEQ ID NO: 1714552 - RNA, 21 nt, Salmonella enterica enterica serovar Typhi
cagguuuuuuuauaacauaaa

SEQ ID NO: 1714553 - RNA, 13 nt, Salmonella enterica enterica serovar Typhi
caguaaaaaaacg

SEQ ID NO: 1714554 - RNA, 17 nt, Salmonella enterica enterica serovar Typhi
caguaaaagcccgccca

SEQ ID NO: 1714555 - RNA, 19 nt, Salmonella enterica enterica serovar Typhi
cagguugcguccgccgcua

SEQ ID NO: 1714556 - RNA, 18 nt, Salmonella enterica enterica serovar Typhi
cagguugcguccgccgcu

SEQ ID NO: 1714557 - RNA, 19 nt, Salmonella enterica enterica serovar Typhi
cagguugcguaacgccaca

SEQ ID NO: 1714558 - RNA, 16 nt, Salmonella enterica enterica serovar Typhi
cagguugcguccgccg

SEQ ID NO: 1714559 - RNA, 21 nt, Salmonella enterica enterica serovar Typhi
cagguugccgaugacucccag

SEQ ID NO: 1714560 - RNA, 18 nt, Salmonella enterica enterica serovar Typhi
cagguugccagaaacaac

SEQ ID NO: 1714561 - RNA, 20 nt, Salmonella enterica enterica serovar Typhi
cagguaaaccggucagguag

SEQ ID NO: 1714562 - RNA, 13 nt, Salmonella enterica enterica serovar Typhi
caggguugucuca

SEQ ID NO: 1714563 - RNA, 23 nt, Salmonella enterica enterica serovar Typhi
caggguuauuuccgcuggccggu

SEQ ID NO: 1714564 - RNA, 16 nt, Salmonella enterica enterica serovar Typhi
caggguucacugccag

SEQ ID NO: 1714565 - RNA, 11 nt, Salmonella enterica enterica serovar Typhi
cagguggaucc

SEQ ID NO: 1714566 - RNA, 13 nt, Salmonella enterica enterica serovar Typhi
caggugcugccac

SEQ ID NO: 1714567 - RNA, 16 nt, Salmonella enterica enterica serovar Typhi
caggugcugccacauc

SEQ ID NO: 1714568 - RNA, 16 nt, Salmonella enterica enterica serovar Typhi
caggugcggacugggc

SEQ ID NO: 1714569 - RNA, 22 nt, Salmonella enterica enterica serovar Typhi
cauaaccggcaaccaaagucca

SEQ ID NO: 1714570 - RNA, 18 nt, Salmonella enterica enterica serovar Typhi
cauaaccgcagcgcggcc

SEQ ID NO: 1714571 - RNA, 16 nt, Salmonella enterica enterica serovar Typhi
cauaaccgcagucucc

SEQ ID NO: 1714572 - RNA, 15 nt, Salmonella enterica enterica serovar Typhi
cauaacaccaauacg

SEQ ID NO: 1714573 - RNA, 21 nt, Salmonella enterica enterica serovar Typhi
cauaacaacuauuuuuccggc

SEQ ID NO: 1714574 - RNA, 17 nt, Salmonella enterica enterica serovar Typhi
cauaaauaucugcauug

SEQ ID NO: 1714575 - RNA, 19 nt, Salmonella enterica enterica serovar Typhi
cauaaaucauuacuuauau

SEQ ID NO: 1714576 - RNA, 21 nt, Salmonella enterica enterica serovar Typhi
cauaaaucauuacuuauauuu

SEQ ID NO: 1714577 - RNA, 22 nt, Salmonella enterica enterica serovar Typhi
cauaaauauuggcggcaaagaa

SEQ ID NO: 1714578 - RNA, 15 nt, Salmonella enterica enterica serovar Typhi
cauaaaugcugauga

SEQ ID NO: 1714579 - RNA, 23 nt, Salmonella enterica enterica serovar Typhi
cauaaauuggcucagaauuuaaa

SEQ ID NO: 1714580 - RNA, 17 nt, Salmonella enterica enterica serovar Typhi
caguuuagggaucaucu

SEQ ID NO: 1714581 - RNA, 18 nt, Salmonella enterica enterica serovar Typhi
caguuuaaaucacagggg

SEQ ID NO: 1714582 - RNA, 18 nt, Salmonella enterica enterica serovar Typhi
cauaaaaaacaucaugcc

SEQ ID NO: 1714583 - RNA, 14 nt, Salmonella enterica enterica serovar Typhi
cauaaaaagccauc

SEQ ID NO: 1714584 - RNA, 15 nt, Salmonella enterica enterica serovar Typhi
cauaaaaaagaggaa

SEQ ID NO: 1714585 - RNA, 13 nt, Salmonella enterica enterica serovar Typhi
cauaaaaacguga

SEQ ID NO: 1714586 - RNA, 12 nt, Salmonella enterica enterica serovar Typhi
cauaaacauuau

SEQ ID NO: 1714587 - RNA, 22 nt, Salmonella enterica enterica serovar Typhi
cauaaagauauugucgcccugc

SEQ ID NO: 1714588 - RNA, 14 nt, Salmonella enterica enterica serovar Typhi
cagugugccgucau

SEQ ID NO: 1714589 - RNA, 17 nt, Salmonella enterica enterica serovar Typhi
caguguugauugaaacu

SEQ ID NO: 1714590 - RNA, 23 nt, Salmonella enterica enterica serovar Typhi
caguguugauugaaacucgccau

SEQ ID NO: 1714591 - RNA, 17 nt, Salmonella enterica enterica serovar Typhi
caguguuucccaacaau

SEQ ID NO: 1714592 - RNA, 22 nt, Salmonella enterica enterica serovar Typhi
caguguuucccaacaaugccac

SEQ ID NO: 1714593 - RNA, 17 nt, Salmonella enterica enterica serovar Typhi
caguugaccaaacagca

SEQ ID NO: 1714594 - RNA, 16 nt, Salmonella enterica enterica serovar Typhi
caguucuggcugcgcu

SEQ ID NO: 1714595 - RNA, 14 nt, Salmonella enterica enterica serovar Typhi
caguugcuggagca

SEQ ID NO: 1714596 - RNA, 13 nt, Salmonella enterica enterica serovar Typhi
caguugcuggauu

SEQ ID NO: 1714597 - RNA, 21 nt, Salmonella enterica enterica serovar Typhi
caguugguuguagcacagccc

SEQ ID NO: 1714598 - RNA, 21 nt, Salmonella enterica enterica serovar Typhi
caguuguaguagccacagcgg

SEQ ID NO: 1714599 - RNA, 23 nt, Salmonella enterica enterica serovar Typhi
caguugguuagagcacaucacuc

SEQ ID NO: 1714600 - RNA, 19 nt, Salmonella enterica enterica serovar Typhi
caguugucguggguucgaa

SEQ ID NO: 1714601 - RNA, 21 nt, Salmonella enterica enterica serovar Typhi
cauaaugauggggucacaggu

SEQ ID NO: 1714602 - RNA, 20 nt, Salmonella enterica enterica serovar Typhi
cauaacugagacucagcagc

SEQ ID NO: 1714603 - RNA, 15 nt, Salmonella enterica enterica serovar Typhi
cauaacggcugucca

SEQ ID NO: 1714604 - RNA, 18 nt, Salmonella enterica enterica serovar Typhi
cauaacgcacaacgucag

SEQ ID NO: 1714605 - RNA, 19 nt, Salmonella enterica enterica serovar Typhi
cauaacguuguggaaugcc

SEQ ID NO: 1714606 - RNA, 21 nt, Salmonella enterica enterica serovar Typhi
cauaacgaaauccgcgccgcc

SEQ ID NO: 1714607 - RNA, 16 nt, Salmonella enterica enterica serovar Typhi
cauaacgaaugccauu

SEQ ID NO: 1714608 - RNA, 17 nt, Salmonella enterica enterica serovar Typhi
cauaacgaccaaacaag

SEQ ID NO: 1714609 - RNA, 15 nt, Salmonella enterica enterica serovar Typhi
cauaacgccgaugcc

SEQ ID NO: 1714610 - RNA, 15 nt, Salmonella enterica enterica serovar Typhi
cauacagguuuuaau

SEQ ID NO: 1714611 - RNA, 13 nt, Salmonella enterica enterica serovar Typhi
cauacagcccgcg

SEQ ID NO: 1714612 - RNA, 14 nt, Salmonella enterica enterica serovar Typhi
cauacagcacuucc

SEQ ID NO: 1714613 - RNA, 15 nt, Salmonella enterica enterica serovar Typhi
cauacagcacuuccc

SEQ ID NO: 1714614 - RNA, 18 nt, Salmonella enterica enterica serovar Typhi
cauaccacgcagcggcau

SEQ ID NO: 1714615 - RNA, 20 nt, Salmonella enterica enterica serovar Typhi
cauacauuuuuguaauaaaa

SEQ ID NO: 1714616 - RNA, 18 nt, Salmonella enterica enterica serovar Typhi
cauacauuucgucaucgc

SEQ ID NO: 1714617 - RNA, 17 nt, Salmonella enterica enterica serovar Typhi
cauaccagccauaaaua

SEQ ID NO: 1714618 - RNA, 19 nt, Salmonella enterica enterica serovar Typhi
cauacccgcgcucuccggc

SEQ ID NO: 1714619 - RNA, 15 nt, Salmonella enterica enterica serovar Typhi
cauaccgaacagaaa

SEQ ID NO: 1714620 - RNA, 12 nt, Salmonella enterica enterica serovar Typhi
cauacgccgcca

SEQ ID NO: 1714621 - RNA, 18 nt, Salmonella enterica enterica serovar Typhi
cauacgccgccagccacu

SEQ ID NO: 1714622 - RNA, 15 nt, Salmonella enterica enterica serovar Typhi
cauacggaugaaaua

SEQ ID NO: 1714623 - RNA, 20 nt, Salmonella enterica enterica serovar Typhi
cauacgggcaugaagaaaau

SEQ ID NO: 1714624 - RNA, 18 nt, Salmonella enterica enterica serovar Typhi
cauacggaugaaauacuc

SEQ ID NO: 1714625 - RNA, 15 nt, Salmonella enterica enterica serovar Typhi
cauaccgccaaucaa

SEQ ID NO: 1714626 - RNA, 15 nt, Salmonella enterica enterica serovar Typhi
cauaccggagccugg

SEQ ID NO: 1714627 - RNA, 19 nt, Salmonella enterica enterica serovar Typhi
cauaccgucgugaaucauc

SEQ ID NO: 1714628 - RNA, 21 nt, Salmonella enterica enterica serovar Typhi
cauaccggugcgccccagcau

SEQ ID NO: 1714629 - RNA, 19 nt, Salmonella enterica enterica serovar Typhi
cauaccggugcgccccagc

SEQ ID NO: 1714630 - RNA, 19 nt, Salmonella enterica enterica serovar Typhi
cauaccgguguagcuggca

SEQ ID NO: 1714631 - RNA, 21 nt, Salmonella enterica enterica serovar Typhi
cauaccuauaaaaaugaggua

SEQ ID NO: 1714632 - RNA, 17 nt, Salmonella enterica enterica serovar Typhi
cauaccuguuccucuuu

SEQ ID NO: 1714633 - RNA, 20 nt, Salmonella enterica enterica serovar Typhi
cauaccuguuccucuuuccc

SEQ ID NO: 1714634 - RNA, 21 nt, Salmonella enterica enterica serovar Typhi
cauaccugguuacucacgcga

SEQ ID NO: 1714635 - RNA, 18 nt, Salmonella enterica enterica serovar Typhi
cauaccuguaucaaacca

SEQ ID NO: 1714636 - RNA, 19 nt, Salmonella enterica enterica serovar Typhi
cauaccuguaucaaaccaa

SEQ ID NO: 1714637 - RNA, 23 nt, Salmonella enterica enterica serovar Typhi
cauacucacauucauaaaagauc

SEQ ID NO: 1714638 - RNA, 12 nt, Salmonella enterica enterica serovar Typhi
cauacucacauu

SEQ ID NO: 1714639 - RNA, 21 nt, Salmonella enterica enterica serovar Typhi
cauacucacauucauaaaaga

SEQ ID NO: 1714640 - RNA, 16 nt, Salmonella enterica enterica serovar Typhi
cauacucacgaauaag

SEQ ID NO: 1714641 - RNA, 13 nt, Salmonella enterica enterica serovar Typhi
cauacguuuuuau

SEQ ID NO: 1714642 - RNA, 12 nt, Salmonella enterica enterica serovar Typhi
cauacuauuucc

SEQ ID NO: 1714643 - RNA, 13 nt, Salmonella enterica enterica serovar Typhi
cauacuaccgcug

SEQ ID NO: 1714644 - RNA, 19 nt, Salmonella enterica enterica serovar Typhi
cauacguuuuuauuaucug

SEQ ID NO: 1714645 - RNA, 15 nt, Salmonella enterica enterica serovar Typhi
cauacuuccucaccg

SEQ ID NO: 1714646 - RNA, 15 nt, Salmonella enterica enterica serovar Typhi
cauacuuacugcugu

SEQ ID NO: 1714647 - RNA, 16 nt, Salmonella enterica enterica serovar Typhi
cauacuuacugcuguc

SEQ ID NO: 1714648 - RNA, 19 nt, Salmonella enterica enterica serovar Typhi
cauacugauuucggaauga

SEQ ID NO: 1714649 - RNA, 16 nt, Salmonella enterica enterica serovar Typhi
cauacugccaaccauu

SEQ ID NO: 1714650 - RNA, 19 nt, Salmonella enterica enterica serovar Typhi
cauacugaccaacaacaga

SEQ ID NO: 1714651 - RNA, 21 nt, Salmonella enterica enterica serovar Typhi
cauacucuuggagagcaucau

SEQ ID NO: 1714652 - RNA, 22 nt, Salmonella enterica enterica serovar Typhi
cauacugaaauuucuuuuccag

SEQ ID NO: 1714653 - RNA, 23 nt, Salmonella enterica enterica serovar Typhi
cauacugaagauaaacagcagcg

SEQ ID NO: 1714654 - RNA, 21 nt, Salmonella enterica enterica serovar Typhi
caugcuaaaacagauaacgaa

SEQ ID NO: 1714655 - RNA, 17 nt, Salmonella enterica enterica serovar Typhi
caugcgggauggccgcc

SEQ ID NO: 1714656 - RNA, 22 nt, Salmonella enterica enterica serovar Typhi
caugcgggggaaucuuauuuuc

SEQ ID NO: 1714657 - RNA, 15 nt, Salmonella enterica enterica serovar Typhi
caugcgggagcuugg

SEQ ID NO: 1714658 - RNA, 20 nt, Salmonella enterica enterica serovar Typhi
cauggaguuccaguucaucu

SEQ ID NO: 1714659 - RNA, 17 nt, Salmonella enterica enterica serovar Typhi
caugcuugcuuugcggc

SEQ ID NO: 1714660 - RNA, 19 nt, Salmonella enterica enterica serovar Typhi
cauggaacauccucuccug

SEQ ID NO: 1714661 - RNA, 20 nt, Salmonella enterica enterica serovar Typhi
caugguaaaauccuuuuuca

SEQ ID NO: 1714662 - RNA, 16 nt, Salmonella enterica enterica serovar Typhi
caugguagucaaauuc

SEQ ID NO: 1714663 - RNA, 16 nt, Salmonella enterica enterica serovar Typhi
cauggguaaagcccau

SEQ ID NO: 1714664 - RNA, 19 nt, Salmonella enterica enterica serovar Typhi
caugggcgucuuaaugcuc

SEQ ID NO: 1714665 - RNA, 22 nt, Salmonella enterica enterica serovar Typhi
caugggacgggucuccaucaga

SEQ ID NO: 1714666 - RNA, 14 nt, Salmonella enterica enterica serovar Typhi
caugggaaauaacg

SEQ ID NO: 1714667 - RNA, 20 nt, Salmonella enterica enterica serovar Typhi
cauggcagauaaaccacgcc

SEQ ID NO: 1714668 - RNA, 22 nt, Salmonella enterica enterica serovar Typhi
cauggcaaaagacauccccgcc

SEQ ID NO: 1714669 - RNA, 23 nt, Salmonella enterica enterica serovar Typhi
cauggcaaaacuaaacccggccu

SEQ ID NO: 1714670 - RNA, 18 nt, Salmonella enterica enterica serovar Typhi
caugccuucuuugccuuu

SEQ ID NO: 1714671 - RNA, 22 nt, Salmonella enterica enterica serovar Typhi
caugcgcgucccggcagugcau

SEQ ID NO: 1714672 - RNA, 18 nt, Salmonella enterica enterica serovar Typhi
caugccguauuuaugcua

SEQ ID NO: 1714673 - RNA, 20 nt, Salmonella enterica enterica serovar Typhi
caugcccggauggcgucuga

SEQ ID NO: 1714674 - RNA, 14 nt, Salmonella enterica enterica serovar Typhi
caugcccgccagcg

SEQ ID NO: 1714675 - RNA, 17 nt, Salmonella enterica enterica serovar Typhi
caucuuuuugcucaagc

SEQ ID NO: 1714676 - RNA, 21 nt, Salmonella enterica enterica serovar Typhi
caucuuugccaaacugcugga

SEQ ID NO: 1714677 - RNA, 22 nt, Salmonella enterica enterica serovar Typhi
caucuuuuacaggccggacagg

SEQ ID NO: 1714678 - RNA, 18 nt, Salmonella enterica enterica serovar Typhi
caugcaagagucccagaa

SEQ ID NO: 1714679 - RNA, 23 nt, Salmonella enterica enterica serovar Typhi
caugcaaaaugcuucuucaaccu

SEQ ID NO: 1714680 - RNA, 12 nt, Salmonella enterica enterica serovar Typhi
caugcaaaaaag

SEQ ID NO: 1714681 - RNA, 17 nt, Salmonella enterica enterica serovar Typhi
caugcaaaaaagagggu

SEQ ID NO: 1714682 - RNA, 17 nt, Salmonella enterica enterica serovar Typhi
caugcaaaaaagcccau

SEQ ID NO: 1714683 - RNA, 21 nt, Salmonella enterica enterica serovar Typhi
caugcacgcuuuuuugcuggc

SEQ ID NO: 1714684 - RNA, 20 nt, Salmonella enterica enterica serovar Typhi
caugcaccagucccagcccc

SEQ ID NO: 1714685 - RNA, 15 nt, Salmonella enterica enterica serovar Typhi
caugcaauuugaggu

SEQ ID NO: 1714686 - RNA, 21 nt, Salmonella enterica enterica serovar Typhi
cauguugcggguuucugaaua

SEQ ID NO: 1714687 - RNA, 19 nt, Salmonella enterica enterica serovar Typhi
cauguugcguaaauaaaua

SEQ ID NO: 1714688 - RNA, 14 nt, Salmonella enterica enterica serovar Typhi
cauguugaccaggu

SEQ ID NO: 1714689 - RNA, 17 nt, Salmonella enterica enterica serovar Typhi
cauguugccaugaucca

SEQ ID NO: 1714690 - RNA, 22 nt, Salmonella enterica enterica serovar Typhi
cauguugaucguaaaaugaaaa

SEQ ID NO: 1714691 - RNA, 14 nt, Salmonella enterica enterica serovar Typhi
cauuaaaaaaacau

SEQ ID NO: 1714692 - RNA, 18 nt, Salmonella enterica enterica serovar Typhi
cauuaaaauugaacggac

SEQ ID NO: 1714693 - RNA, 13 nt, Salmonella enterica enterica serovar Typhi
cauuaaaaaaacg

SEQ ID NO: 1714694 - RNA, 14 nt, Salmonella enterica enterica serovar Typhi
caugugcagcaucc

SEQ ID NO: 1714695 - RNA, 12 nt, Salmonella enterica enterica serovar Typhi
caugucuucacu

SEQ ID NO: 1714696 - RNA, 14 nt, Salmonella enterica enterica serovar Typhi
caugguuaaccacc

SEQ ID NO: 1714697 - RNA, 13 nt, Salmonella enterica enterica serovar Typhi
caugucguuagaa

SEQ ID NO: 1714698 - RNA, 24 nt, Salmonella enterica enterica serovar Typhi
caugguguugguacacagcacaau

SEQ ID NO: 1714699 - RNA, 21 nt, Salmonella enterica enterica serovar Typhi
caugguguucagauggccaau

SEQ ID NO: 1714700 - RNA, 14 nt, Salmonella enterica enterica serovar Typhi
caugguguucagau

SEQ ID NO: 1714701 - RNA, 18 nt, Salmonella enterica enterica serovar Typhi
caugguugaaaaaagccg

SEQ ID NO: 1714702 - RNA, 21 nt, Salmonella enterica enterica serovar Typhi
cauuaccgcccuguccuccau

SEQ ID NO: 1714703 - RNA, 15 nt, Salmonella enterica enterica serovar Typhi
cauuaccgcuaacau

SEQ ID NO: 1714704 - RNA, 19 nt, Salmonella enterica enterica serovar Typhi
cauuagcauucccuuaucu

SEQ ID NO: 1714705 - RNA, 22 nt, Salmonella enterica enterica serovar Typhi
cauuagcaugggcuaaagcauc

SEQ ID NO: 1714706 - RNA, 19 nt, Salmonella enterica enterica serovar Typhi
cauuagcgcgauaaaacca

SEQ ID NO: 1714707 - RNA, 20 nt, Salmonella enterica enterica serovar Typhi
cauuagcgcgauaaaaccac

SEQ ID NO: 1714708 - RNA, 13 nt, Salmonella enterica enterica serovar Typhi
cauuacaaacagg

SEQ ID NO: 1714709 - RNA, 23 nt, Salmonella enterica enterica serovar Typhi
cauuaauggcgauaauagaaccg

SEQ ID NO: 1714710 - RNA, 22 nt, Salmonella enterica enterica serovar Typhi
cauuacaggcaucuuccagcgu

SEQ ID NO: 1714711 - RNA, 22 nt, Salmonella enterica enterica serovar Typhi
cauuaagcccauaaagcacugg

SEQ ID NO: 1714712 - RNA, 23 nt, Salmonella enterica enterica serovar Typhi
cauuaagcccauaaagcacuggu

SEQ ID NO: 1714713 - RNA, 17 nt, Salmonella enterica enterica serovar Typhi
cauuaacgggaaacugu

SEQ ID NO: 1714714 - RNA, 12 nt, Salmonella enterica enterica serovar Typhi
cauuaacgccau

SEQ ID NO: 1714715 - RNA, 14 nt, Salmonella enterica enterica serovar Typhi
cauuaacccggccc

SEQ ID NO: 1714716 - RNA, 22 nt, Salmonella enterica enterica serovar Typhi
cauuaacaucagaaaaaagcca

SEQ ID NO: 1714717 - RNA, 17 nt, Salmonella enterica enterica serovar Typhi
cauuaacaaaucauuuc

SEQ ID NO: 1714718 - RNA, 17 nt, Salmonella enterica enterica serovar Typhi
cauuaaucgccauugca

SEQ ID NO: 1714719 - RNA, 17 nt, Salmonella enterica enterica serovar Typhi
cauuaauacaggccagc

SEQ ID NO: 1714720 - RNA, 19 nt, Salmonella enterica enterica serovar Typhi
cauuaauaugcgcaaucac

SEQ ID NO: 1714721 - RNA, 23 nt, Salmonella enterica enterica serovar Typhi
cauuaauccccggcgaaagaaaa

SEQ ID NO: 1714722 - RNA, 19 nt, Salmonella enterica enterica serovar Typhi
cauuuugguuggcgacuuc

SEQ ID NO: 1714723 - RNA, 21 nt, Salmonella enterica enterica serovar Typhi
cauuuugcuggaaaaauaaga

SEQ ID NO: 1714724 - RNA, 22 nt, Salmonella enterica enterica serovar Typhi
cauuuugcgguuuuaauuucca

SEQ ID NO: 1714725 - RNA, 17 nt, Salmonella enterica enterica serovar Typhi
cauuuucuuucaucaaa

SEQ ID NO: 1714726 - RNA, 16 nt, Salmonella enterica enterica serovar Typhi
cauuuucuuugcagcu

SEQ ID NO: 1714727 - RNA, 12 nt, Salmonella enterica enterica serovar Typhi
cauuuuucucag

SEQ ID NO: 1714728 - RNA, 14 nt, Salmonella enterica enterica serovar Typhi
cauuuuuaucagcu

SEQ ID NO: 1714729 - RNA, 15 nt, Salmonella enterica enterica serovar Typhi
cauuuuccgcugucu

SEQ ID NO: 1714730 - RNA, 20 nt, Salmonella enterica enterica serovar Typhi
cauuuuccgcugucuaucca

SEQ ID NO: 1714731 - RNA, 18 nt, Salmonella enterica enterica serovar Typhi
cauuuucaccuggaugcu

SEQ ID NO: 1714732 - RNA, 16 nt, Salmonella enterica enterica serovar Typhi
cauuuucggcagcgcg

SEQ ID NO: 1714733 - RNA, 19 nt, Salmonella enterica enterica serovar Typhi
cauuuuccggcgacgcuuu

SEQ ID NO: 1714734 - RNA, 15 nt, Salmonella enterica enterica serovar Typhi
cauuuucuuauuuau

SEQ ID NO: 1714735 - RNA, 15 nt, Salmonella enterica enterica serovar Typhi
cauuuuauuuaaaaa

SEQ ID NO: 1714736 - RNA, 15 nt, Salmonella enterica enterica serovar Typhi
cauuuuauccucuuc

SEQ ID NO: 1714737 - RNA, 14 nt, Salmonella enterica enterica serovar Typhi
cauuuuauccucuu

SEQ ID NO: 1714738 - RNA, 17 nt, Salmonella enterica enterica serovar Typhi
cauuuuaccuuuaaacu

SEQ ID NO: 1714739 - RNA, 20 nt, Salmonella enterica enterica serovar Typhi
cauuuuaccuuuaaacuguu

SEQ ID NO: 1714740 - RNA, 14 nt, Salmonella enterica enterica serovar Typhi
cauuuuaaauacac

SEQ ID NO: 1714741 - RNA, 16 nt, Salmonella enterica enterica serovar Typhi
cauuugcuguuuuauu

SEQ ID NO: 1714742 - RNA, 16 nt, Salmonella enterica enterica serovar Typhi
cauuugcuuucaucaa

SEQ ID NO: 1714743 - RNA, 17 nt, Salmonella enterica enterica serovar Typhi
cauuuggcuuaaauaau

SEQ ID NO: 1714744 - RNA, 22 nt, Salmonella enterica enterica serovar Typhi
cauuugcagguuacucacugcc

SEQ ID NO: 1714745 - RNA, 16 nt, Salmonella enterica enterica serovar Typhi
cauuugcgcauauucc

SEQ ID NO: 1714746 - RNA, 13 nt, Salmonella enterica enterica serovar Typhi
cauuuguuccucg

SEQ ID NO: 1714747 - RNA, 14 nt, Salmonella enterica enterica serovar Typhi
cauuuguacaaaaa

SEQ ID NO: 1714748 - RNA, 15 nt, Salmonella enterica enterica serovar Typhi
cauuuguacaaaaaa

SEQ ID NO: 1714749 - RNA, 15 nt, Salmonella enterica enterica serovar Typhi
cauuuaccagugcua

SEQ ID NO: 1714750 - RNA, 13 nt, Salmonella enterica enterica serovar Typhi
cauuuacaauaau

SEQ ID NO: 1714751 - RNA, 21 nt, Salmonella enterica enterica serovar Typhi
cauuucuucaagcguuuccag

SEQ ID NO: 1714752 - RNA, 15 nt, Salmonella enterica enterica serovar Typhi
cauuuaagaaacaau

SEQ ID NO: 1714753 - RNA, 16 nt, Salmonella enterica enterica serovar Typhi
cauuuaagauuuaaaa

SEQ ID NO: 1714754 - RNA, 17 nt, Salmonella enterica enterica serovar Typhi
cauuucuuguugacgac

SEQ ID NO: 1714755 - RNA, 14 nt, Salmonella enterica enterica serovar Typhi
cauuucuuccagca

SEQ ID NO: 1714756 - RNA, 14 nt, Salmonella enterica enterica serovar Typhi
cauuucuucuucaa

SEQ ID NO: 1714757 - RNA, 15 nt, Salmonella enterica enterica serovar Typhi
cauuugauuuguuuu

SEQ ID NO: 1714758 - RNA, 21 nt, Salmonella enterica enterica serovar Typhi
cauuugauuuguuuuuuauau

SEQ ID NO: 1714759 - RNA, 18 nt, Salmonella enterica enterica serovar Typhi
cauugaggcuacccagac

SEQ ID NO: 1714760 - RNA, 18 nt, Salmonella enterica enterica serovar Typhi
cauugagcauucuacagu

SEQ ID NO: 1714761 - RNA, 19 nt, Salmonella enterica enterica serovar Typhi
cauucugcuuaccagaccg

SEQ ID NO: 1714762 - RNA, 22 nt, Salmonella enterica enterica serovar Typhi
cauucuguuuucgagccuugcc

SEQ ID NO: 1714763 - RNA, 12 nt, Salmonella enterica enterica serovar Typhi
cauucugucaga

SEQ ID NO: 1714764 - RNA, 20 nt, Salmonella enterica enterica serovar Typhi
cauuaggcguaauuauuaca

SEQ ID NO: 1714765 - RNA, 12 nt, Salmonella enterica enterica serovar Typhi
cauuaucaccau

SEQ ID NO: 1714766 - RNA, 17 nt, Salmonella enterica enterica serovar Typhi
cauuaucgaucugagcg

SEQ ID NO: 1714767 - RNA, 19 nt, Salmonella enterica enterica serovar Typhi
cauuaucgaugcguauuuc

SEQ ID NO: 1714768 - RNA, 14 nt, Salmonella enterica enterica serovar Typhi
cauucgucaaauuc

SEQ ID NO: 1714769 - RNA, 19 nt, Salmonella enterica enterica serovar Typhi
cauuaugaucgguuuuuuu

SEQ ID NO: 1714770 - RNA, 23 nt, Salmonella enterica enterica serovar Typhi
cauuaugaucgguuuuuuuagaa

SEQ ID NO: 1714771 - RNA, 14 nt, Salmonella enterica enterica serovar Typhi
cauuaugaugaguu

SEQ ID NO: 1714772 - RNA, 18 nt, Salmonella enterica enterica serovar Typhi
cauucucugucgccgccc

SEQ ID NO: 1714773 - RNA, 20 nt, Salmonella enterica enterica serovar Typhi
cauucucuuucugcgccgca

SEQ ID NO: 1714774 - RNA, 20 nt, Salmonella enterica enterica serovar Typhi
cauucguuuugcugauauga

SEQ ID NO: 1714775 - RNA, 17 nt, Salmonella enterica enterica serovar Typhi
cauucuaccggcugugg

SEQ ID NO: 1714776 - RNA, 18 nt, Salmonella enterica enterica serovar Typhi
cauuguugggguuaucgc

SEQ ID NO: 1714777 - RNA, 19 nt, Salmonella enterica enterica serovar Typhi
cauuguuccugcuggcaaa

SEQ ID NO: 1714778 - RNA, 22 nt, Salmonella enterica enterica serovar Typhi
cauuguuccugcuggcaaaacg

SEQ ID NO: 1714779 - RNA, 12 nt, Salmonella enterica enterica serovar Typhi
cauuggcaucug

SEQ ID NO: 1714780 - RNA, 19 nt, Salmonella enterica enterica serovar Typhi
cauugucggcgcuaucuau

SEQ ID NO: 1714781 - RNA, 14 nt, Salmonella enterica enterica serovar Typhi
cauugucgggcaga

SEQ ID NO: 1714782 - RNA, 13 nt, Salmonella enterica enterica serovar Typhi
cauugucuuuuuc

SEQ ID NO: 1714783 - RNA, 14 nt, Salmonella enterica enterica serovar Typhi
cauugucuuuuucu

SEQ ID NO: 1714784 - RNA, 20 nt, Salmonella enterica enterica serovar Typhi
cauuggaagagacacgcuga

SEQ ID NO: 1714785 - RNA, 20 nt, Salmonella enterica enterica serovar Typhi
cauuggaaaaccccaucccg

SEQ ID NO: 1714786 - RNA, 19 nt, Salmonella enterica enterica serovar Typhi
cauuggaaaaccccauccc

SEQ ID NO: 1714787 - RNA, 13 nt, Salmonella enterica enterica serovar Typhi
cauuggcaccacc

SEQ ID NO: 1714788 - RNA, 16 nt, Salmonella enterica enterica serovar Typhi
cauuggcaaaccccug

SEQ ID NO: 1714789 - RNA, 19 nt, Salmonella enterica enterica serovar Typhi
cauugaugaugaagcugca

SEQ ID NO: 1714790 - RNA, 21 nt, Salmonella enterica enterica serovar Typhi
cauugaugaugaagcugcagg

SEQ ID NO: 1714791 - RNA, 20 nt, Salmonella enterica enterica serovar Typhi
cauugaugcaggcgccuggg

SEQ ID NO: 1714792 - RNA, 21 nt, Salmonella enterica enterica serovar Typhi
cauugauauagaguccagcca

SEQ ID NO: 1714793 - RNA, 14 nt, Salmonella enterica enterica serovar Typhi
cauugcgagaaaaa

SEQ ID NO: 1714794 - RNA, 22 nt, Salmonella enterica enterica serovar Typhi
cauugcgagaaaaaacucagga

SEQ ID NO: 1714795 - RNA, 16 nt, Salmonella enterica enterica serovar Typhi
cauugcgcgccgacag

SEQ ID NO: 1714796 - RNA, 15 nt, Salmonella enterica enterica serovar Typhi
cauugcuguggaaaa

SEQ ID NO: 1714797 - RNA, 15 nt, Salmonella enterica enterica serovar Typhi
cauugcuuucuugaa

SEQ ID NO: 1714798 - RNA, 16 nt, Salmonella enterica enterica serovar Typhi
cauugcgcuauuacuc

SEQ ID NO: 1714799 - RNA, 16 nt, Salmonella enterica enterica serovar Typhi
cauaucuggacgggcc

SEQ ID NO: 1714800 - RNA, 21 nt, Salmonella enterica enterica serovar Typhi
cauaucuucgcgcguggugcu

SEQ ID NO: 1714801 - RNA, 21 nt, Salmonella enterica enterica serovar Typhi
cauaucuggauacccccuauc

SEQ ID NO: 1714802 - RNA, 12 nt, Salmonella enterica enterica serovar Typhi
cauaugggaaga

SEQ ID NO: 1714803 - RNA, 13 nt, Salmonella enterica enterica serovar Typhi
cauaugcgcggcg

SEQ ID NO: 1714804 - RNA, 14 nt, Salmonella enterica enterica serovar Typhi
cauaugcgcggcga

SEQ ID NO: 1714805 - RNA, 18 nt, Salmonella enterica enterica serovar Typhi
cauauuaucgcgcugaau

SEQ ID NO: 1714806 - RNA, 14 nt, Salmonella enterica enterica serovar Typhi
cauagaaaaagaac

SEQ ID NO: 1714807 - RNA, 23 nt, Salmonella enterica enterica serovar Typhi
cauagaaaauauaugacaacacu

SEQ ID NO: 1714808 - RNA, 23 nt, Salmonella enterica enterica serovar Typhi
cauauaaccacgaaaauuauuuu

SEQ ID NO: 1714809 - RNA, 20 nt, Salmonella enterica enterica serovar Typhi
cauauaauuaacauuuaaga

SEQ ID NO: 1714810 - RNA, 15 nt, Salmonella enterica enterica serovar Typhi
cauauaaggcccaua

SEQ ID NO: 1714811 - RNA, 22 nt, Salmonella enterica enterica serovar Typhi
cauaucaaugaacuacggcccu

SEQ ID NO: 1714812 - RNA, 12 nt, Salmonella enterica enterica serovar Typhi
cauauauuuacu

SEQ ID NO: 1714813 - RNA, 16 nt, Salmonella enterica enterica serovar Typhi
cauaucgccgccacau

SEQ ID NO: 1714814 - RNA, 19 nt, Salmonella enterica enterica serovar Typhi
cauaucgcggguaaacuca

SEQ ID NO: 1714815 - RNA, 23 nt, Salmonella enterica enterica serovar Typhi
cauauacccugcggcgaaacaga

SEQ ID NO: 1714816 - RNA, 13 nt, Salmonella enterica enterica serovar Typhi
caucaaaaucauc

SEQ ID NO: 1714817 - RNA, 14 nt, Salmonella enterica enterica serovar Typhi
caucaaacagcggc

SEQ ID NO: 1714818 - RNA, 14 nt, Salmonella enterica enterica serovar Typhi
caucaaacuuuuaa

SEQ ID NO: 1714819 - RNA, 21 nt, Salmonella enterica enterica serovar Typhi
cauauucaccagagcaucaau

SEQ ID NO: 1714820 - RNA, 15 nt, Salmonella enterica enterica serovar Typhi
cauauuuuucacaca

SEQ ID NO: 1714821 - RNA, 18 nt, Salmonella enterica enterica serovar Typhi
cauauuuuuccagcgccu

SEQ ID NO: 1714822 - RNA, 18 nt, Salmonella enterica enterica serovar Typhi
cauauuuuucacacauaa

SEQ ID NO: 1714823 - RNA, 23 nt, Salmonella enterica enterica serovar Typhi
caucaccaucguugccagcggcc

SEQ ID NO: 1714824 - RNA, 22 nt, Salmonella enterica enterica serovar Typhi
caucaaguacagcuuaaucacc

SEQ ID NO: 1714825 - RNA, 22 nt, Salmonella enterica enterica serovar Typhi
caucaagcugcuggcgagcagg

SEQ ID NO: 1714826 - RNA, 23 nt, Salmonella enterica enterica serovar Typhi
caucaacguaaauagagaaauca

SEQ ID NO: 1714827 - RNA, 17 nt, Salmonella enterica enterica serovar Typhi
caucauccugcagggua

SEQ ID NO: 1714828 - RNA, 19 nt, Salmonella enterica enterica serovar Typhi
caucaucaucggcacagcc

SEQ ID NO: 1714829 - RNA, 17 nt, Salmonella enterica enterica serovar Typhi
caucaucggcacagcca

SEQ ID NO: 1714830 - RNA, 17 nt, Salmonella enterica enterica serovar Typhi
caucaucgccgauuucu

SEQ ID NO: 1714831 - RNA, 12 nt, Salmonella enterica enterica serovar Typhi
caucaucgccaa

SEQ ID NO: 1714832 - RNA, 14 nt, Salmonella enterica enterica serovar Typhi
caucauaauaauug

SEQ ID NO: 1714833 - RNA, 14 nt, Salmonella enterica enterica serovar Typhi
caucauaauccuua

SEQ ID NO: 1714834 - RNA, 16 nt, Salmonella enterica enterica serovar Typhi
caucauaauccuuauu

SEQ ID NO: 1714835 - RNA, 18 nt, Salmonella enterica enterica serovar Typhi
cauccaccuuauccuggc

SEQ ID NO: 1714836 - RNA, 14 nt, Salmonella enterica enterica serovar Typhi
cauccacggccccg

SEQ ID NO: 1714837 - RNA, 17 nt, Salmonella enterica enterica serovar Typhi
cauccaccaggcaugca

SEQ ID NO: 1714838 - RNA, 15 nt, Salmonella enterica enterica serovar Typhi
caucaugauauaauu

SEQ ID NO: 1714839 - RNA, 15 nt, Salmonella enterica enterica serovar Typhi
caucauugauacugu

SEQ ID NO: 1714840 - RNA, 17 nt, Salmonella enterica enterica serovar Typhi
caucauugauacuguac

SEQ ID NO: 1714841 - RNA, 20 nt, Salmonella enterica enterica serovar Typhi
caucaucuuguccucaucau

SEQ ID NO: 1714842 - RNA, 20 nt, Salmonella enterica enterica serovar Typhi
caucaugaaaaacaguaccg

SEQ ID NO: 1714843 - RNA, 22 nt, Salmonella enterica enterica serovar Typhi
caucaugcaagagucccagaac

SEQ ID NO: 1714844 - RNA, 23 nt, Salmonella enterica enterica serovar Typhi
caucaugaugaucuucagcccgu

SEQ ID NO: 1714845 - RNA, 21 nt, Salmonella enterica enterica serovar Typhi
caucaugcaagagucccagaa

SEQ ID NO: 1714846 - RNA, 13 nt, Salmonella enterica enterica serovar Typhi
caucaugauauaa

SEQ ID NO: 1714847 - RNA, 14 nt, Salmonella enterica enterica serovar Typhi
caucaugauauaau

SEQ ID NO: 1714848 - RNA, 22 nt, Salmonella enterica enterica serovar Typhi
caucauucgguuaggaauagca

SEQ ID NO: 1714849 - RNA, 15 nt, Salmonella enterica enterica serovar Typhi
caucauucugcaggc

SEQ ID NO: 1714850 - RNA, 14 nt, Salmonella enterica enterica serovar Typhi
caucauucccauug

SEQ ID NO: 1714851 - RNA, 17 nt, Salmonella enterica enterica serovar Typhi
caucagguggaagaaac

SEQ ID NO: 1714852 - RNA, 11 nt, Salmonella enterica enterica serovar Typhi
caucaggcuga

SEQ ID NO: 1714853 - RNA, 21 nt, Salmonella enterica enterica serovar Typhi
caucaggcugacgaagaacuu

SEQ ID NO: 1714854 - RNA, 17 nt, Salmonella enterica enterica serovar Typhi
caucaggcuuugcgcca

SEQ ID NO: 1714855 - RNA, 15 nt, Salmonella enterica enterica serovar Typhi
caucaggccugcaaa

SEQ ID NO: 1714856 - RNA, 13 nt, Salmonella enterica enterica serovar Typhi
caucaggcgugcc

SEQ ID NO: 1714857 - RNA, 19 nt, Salmonella enterica enterica serovar Typhi
caucaggcauggcagcagg

SEQ ID NO: 1714858 - RNA, 18 nt, Salmonella enterica enterica serovar Typhi
caucagcgccagcccugc

SEQ ID NO: 1714859 - RNA, 14 nt, Salmonella enterica enterica serovar Typhi
caucaggcacaaug

SEQ ID NO: 1714860 - RNA, 14 nt, Salmonella enterica enterica serovar Typhi
caucaguuuaaccg

SEQ ID NO: 1714861 - RNA, 13 nt, Salmonella enterica enterica serovar Typhi
caucauaaaaggc

SEQ ID NO: 1714862 - RNA, 13 nt, Salmonella enterica enterica serovar Typhi
caucagucucaaa

SEQ ID NO: 1714863 - RNA, 20 nt, Salmonella enterica enterica serovar Typhi
caucagguaauacaggguuu

SEQ ID NO: 1714864 - RNA, 18 nt, Salmonella enterica enterica serovar Typhi
caucaguaacacccgcgc

SEQ ID NO: 1714865 - RNA, 15 nt, Salmonella enterica enterica serovar Typhi
caucaguacaaacgc

SEQ ID NO: 1714866 - RNA, 18 nt, Salmonella enterica enterica serovar Typhi
caucacgggaucgcagaa

SEQ ID NO: 1714867 - RNA, 20 nt, Salmonella enterica enterica serovar Typhi
caucagccguuacuuccccc

SEQ ID NO: 1714868 - RNA, 16 nt, Salmonella enterica enterica serovar Typhi
caucagcgccagcccu

SEQ ID NO: 1714869 - RNA, 22 nt, Salmonella enterica enterica serovar Typhi
caucacgcaaaugcagcggaau

SEQ ID NO: 1714870 - RNA, 21 nt, Salmonella enterica enterica serovar Typhi
caucaccgucuucaggucauu

SEQ ID NO: 1714871 - RNA, 16 nt, Salmonella enterica enterica serovar Typhi
caucaccguuuuccag

SEQ ID NO: 1714872 - RNA, 14 nt, Salmonella enterica enterica serovar Typhi
caucaccuccagca

SEQ ID NO: 1714873 - RNA, 21 nt, Salmonella enterica enterica serovar Typhi
caucaccuccagcacgcgcug

SEQ ID NO: 1714874 - RNA, 21 nt, Salmonella enterica enterica serovar Typhi
caucuauaauaccuccugucu

SEQ ID NO: 1714875 - RNA, 14 nt, Salmonella enterica enterica serovar Typhi
caucucccaggccg

SEQ ID NO: 1714876 - RNA, 18 nt, Salmonella enterica enterica serovar Typhi
caucucccaggccgccac

SEQ ID NO: 1714877 - RNA, 19 nt, Salmonella enterica enterica serovar Typhi
caucucccaggccgccacc

SEQ ID NO: 1714878 - RNA, 20 nt, Salmonella enterica enterica serovar Typhi
caucucccaggccgccaccg

SEQ ID NO: 1714879 - RNA, 17 nt, Salmonella enterica enterica serovar Typhi
caucgggucgcgcgccg

SEQ ID NO: 1714880 - RNA, 21 nt, Salmonella enterica enterica serovar Typhi
caucgggcuguuauucagcag

SEQ ID NO: 1714881 - RNA, 19 nt, Salmonella enterica enterica serovar Typhi
caucgggaacggcauacug

SEQ ID NO: 1714882 - RNA, 14 nt, Salmonella enterica enterica serovar Typhi
caucgguucucugc

SEQ ID NO: 1714883 - RNA, 18 nt, Salmonella enterica enterica serovar Typhi
caucugcaauucggcggc

SEQ ID NO: 1714884 - RNA, 19 nt, Salmonella enterica enterica serovar Typhi
caucugauaauuacgaugc

SEQ ID NO: 1714885 - RNA, 19 nt, Salmonella enterica enterica serovar Typhi
caucucuuuuaauuuucug

SEQ ID NO: 1714886 - RNA, 21 nt, Salmonella enterica enterica serovar Typhi
caucugaacucuuccagauac

SEQ ID NO: 1714887 - RNA, 23 nt, Salmonella enterica enterica serovar Typhi
caucucgauaccgguaaucaaac

SEQ ID NO: 1714888 - RNA, 21 nt, Salmonella enterica enterica serovar Typhi
caucuccgauaaauaagaagg

SEQ ID NO: 1714889 - RNA, 15 nt, Salmonella enterica enterica serovar Typhi
caucuccuguaauga

SEQ ID NO: 1714890 - RNA, 17 nt, Salmonella enterica enterica serovar Typhi
caucuucacuucacaaa

SEQ ID NO: 1714891 - RNA, 13 nt, Salmonella enterica enterica serovar Typhi
caucuucacuuca

SEQ ID NO: 1714892 - RNA, 16 nt, Salmonella enterica enterica serovar Typhi
caucuucacgcagcgu

SEQ ID NO: 1714893 - RNA, 21 nt, Salmonella enterica enterica serovar Typhi
caucuucaccgaugcccagcu

SEQ ID NO: 1714894 - RNA, 22 nt, Salmonella enterica enterica serovar Typhi
caucuuauauuuugguguaaca

SEQ ID NO: 1714895 - RNA, 12 nt, Salmonella enterica enterica serovar Typhi
caucuuauauuu

SEQ ID NO: 1714896 - RNA, 22 nt, Salmonella enterica enterica serovar Typhi
caucugguuguuucuuaacccc

SEQ ID NO: 1714897 - RNA, 17 nt, Salmonella enterica enterica serovar Typhi
caucugggcugagaaaa

SEQ ID NO: 1714898 - RNA, 15 nt, Salmonella enterica enterica serovar Typhi
caucugggggaagau

SEQ ID NO: 1714899 - RNA, 16 nt, Salmonella enterica enterica serovar Typhi
caucuggcguugccug

SEQ ID NO: 1714900 - RNA, 12 nt, Salmonella enterica enterica serovar Typhi
caucuugcguua

SEQ ID NO: 1714901 - RNA, 21 nt, Salmonella enterica enterica serovar Typhi
caucuuuaccaaugugcaaag

SEQ ID NO: 1714902 - RNA, 19 nt, Salmonella enterica enterica serovar Typhi
caucuuuaaccgccugcuc

SEQ ID NO: 1714903 - RNA, 17 nt, Salmonella enterica enterica serovar Typhi
caucuuuaaccgccugc

SEQ ID NO: 1714904 - RNA, 13 nt, Salmonella enterica enterica serovar Typhi
caucuuucuuuuc

SEQ ID NO: 1714905 - RNA, 14 nt, Salmonella enterica enterica serovar Typhi
caucuucuuuuucc

SEQ ID NO: 1714906 - RNA, 12 nt, Salmonella enterica enterica serovar Typhi
caucuuccagua

SEQ ID NO: 1714907 - RNA, 12 nt, Salmonella enterica enterica serovar Typhi
caucuucagcaa

SEQ ID NO: 1714908 - RNA, 14 nt, Salmonella enterica enterica serovar Typhi
caucuuccaugccu

SEQ ID NO: 1714909 - RNA, 20 nt, Salmonella enterica enterica serovar Typhi
caucuucggcgggaucucca

SEQ ID NO: 1714910 - RNA, 22 nt, Salmonella enterica enterica serovar Typhi
caucgcuaaguugaacgguaaa

SEQ ID NO: 1714911 - RNA, 24 nt, Salmonella enterica enterica serovar Typhi
caucggcgaguuuggugcccgcgu

SEQ ID NO: 1714912 - RNA, 16 nt, Salmonella enterica enterica serovar Typhi
caucggcgcgcuggcg

SEQ ID NO: 1714913 - RNA, 20 nt, Salmonella enterica enterica serovar Typhi
caucgcggucagcggcgcgc

SEQ ID NO: 1714914 - RNA, 15 nt, Salmonella enterica enterica serovar Typhi
caucgcuaucaugcu

SEQ ID NO: 1714915 - RNA, 20 nt, Salmonella enterica enterica serovar Typhi
caucgcgaauuucaaucgcc

SEQ ID NO: 1714916 - RNA, 22 nt, Salmonella enterica enterica serovar Typhi
caucgcgccaaacgggcaagcc

SEQ ID NO: 1714917 - RNA, 13 nt, Salmonella enterica enterica serovar Typhi
caucgcgcagcag

SEQ ID NO: 1714918 - RNA, 22 nt, Salmonella enterica enterica serovar Typhi
caucgcgcugauauuuuuacug

SEQ ID NO: 1714919 - RNA, 23 nt, Salmonella enterica enterica serovar Typhi
caucgagccaacguauaaaaugg

SEQ ID NO: 1714920 - RNA, 17 nt, Salmonella enterica enterica serovar Typhi
caucgacuucaagguuc

SEQ ID NO: 1714921 - RNA, 18 nt, Salmonella enterica enterica serovar Typhi
caucgauacccugcugau

SEQ ID NO: 1714922 - RNA, 15 nt, Salmonella enterica enterica serovar Typhi
caucgcccgcuccca

SEQ ID NO: 1714923 - RNA, 18 nt, Salmonella enterica enterica serovar Typhi
caucgccauuaaaagcca

SEQ ID NO: 1714924 - RNA, 12 nt, Salmonella enterica enterica serovar Typhi
caucgcccaggu

SEQ ID NO: 1714925 - RNA, 16 nt, Salmonella enterica enterica serovar Typhi
caucgccagcuucgcu

SEQ ID NO: 1714926 - RNA, 15 nt, Salmonella enterica enterica serovar Typhi
caucgacagacuuca

SEQ ID NO: 1714927 - RNA, 21 nt, Salmonella enterica enterica serovar Typhi
caucgaaugucgauguucugu

SEQ ID NO: 1714928 - RNA, 19 nt, Salmonella enterica enterica serovar Typhi
caucgacaaaggcaagauc

SEQ ID NO: 1714929 - RNA, 23 nt, Salmonella enterica enterica serovar Typhi
caucgaauaaagacacugcugcu

SEQ ID NO: 1714930 - RNA, 23 nt, Salmonella enterica enterica serovar Typhi
cauccuuuacaauuucgcaaaca

SEQ ID NO: 1714931 - RNA, 20 nt, Salmonella enterica enterica serovar Typhi
cauccuccggcgacugaaug

SEQ ID NO: 1714932 - RNA, 18 nt, Salmonella enterica enterica serovar Typhi
cauccucaauguuaacua

SEQ ID NO: 1714933 - RNA, 18 nt, Salmonella enterica enterica serovar Typhi
cauccugaguauaaaacu

SEQ ID NO: 1714934 - RNA, 13 nt, Salmonella enterica enterica serovar Typhi
cauccucuuuccg

SEQ ID NO: 1714935 - RNA, 23 nt, Salmonella enterica enterica serovar Typhi
cauccuguuuuuucagcgcgccg

SEQ ID NO: 1714936 - RNA, 17 nt, Salmonella enterica enterica serovar Typhi
cauccgccagcgccucu

SEQ ID NO: 1714937 - RNA, 13 nt, Salmonella enterica enterica serovar Typhi
cauccagaaggca

SEQ ID NO: 1714938 - RNA, 16 nt, Salmonella enterica enterica serovar Typhi
cauccgccagccgcca

SEQ ID NO: 1714939 - RNA, 17 nt, Salmonella enterica enterica serovar Typhi
cauccgccagccgccau

SEQ ID NO: 1714940 - RNA, 15 nt, Salmonella enterica enterica serovar Typhi
cauccgccagcgccu

SEQ ID NO: 1714941 - RNA, 16 nt, Salmonella enterica enterica serovar Typhi
cauccagacaugcaca

SEQ ID NO: 1714942 - RNA, 11 nt, Salmonella enterica enterica serovar Typhi
cauccagacca

SEQ ID NO: 1714943 - RNA, 13 nt, Salmonella enterica enterica serovar Typhi
cauccggacgcca

SEQ ID NO: 1714944 - RNA, 18 nt, Salmonella enterica enterica serovar Typhi
cauccggguuaaaccagc

SEQ ID NO: 1714945 - RNA, 15 nt, Salmonella enterica enterica serovar Typhi
cauccgguuuuaaau

SEQ ID NO: 1714946 - RNA, 23 nt, Salmonella enterica enterica serovar Typhi
ccgcccagauguugauacagaaa

SEQ ID NO: 1714947 - RNA, 17 nt, Salmonella enterica enterica serovar Typhi
ccgcccaacagggcggc

SEQ ID NO: 1714948 - RNA, 17 nt, Salmonella enterica enterica serovar Typhi
ccgccaguugcucaaca

SEQ ID NO: 1714949 - RNA, 24 nt, Salmonella enterica enterica serovar Typhi
ccgccauauauuuacugaauaaau

SEQ ID NO: 1714950 - RNA, 17 nt, Salmonella enterica enterica serovar Typhi
ccgccauccgacacagc

SEQ ID NO: 1714951 - RNA, 22 nt, Salmonella enterica enterica serovar Typhi
ccgccauccggcaaacucagcg

SEQ ID NO: 1714952 - RNA, 19 nt, Salmonella enterica enterica serovar Typhi
ccgccauccggcauuuuuu

SEQ ID NO: 1714953 - RNA, 15 nt, Salmonella enterica enterica serovar Typhi
ccgccauccggccug

SEQ ID NO: 1714954 - RNA, 20 nt, Salmonella enterica enterica serovar Typhi
ccgccgaggcuaagccagaa

SEQ ID NO: 1714955 - RNA, 11 nt, Salmonella enterica enterica serovar Typhi
ccgcccuuucg

SEQ ID NO: 1714956 - RNA, 21 nt, Salmonella enterica enterica serovar Typhi
ccgcccgcggcgaucaccacg

SEQ ID NO: 1714957 - RNA, 13 nt, Salmonella enterica enterica serovar Typhi
ccgcccgcguagc

SEQ ID NO: 1714958 - RNA, 14 nt, Salmonella enterica enterica serovar Typhi
ccgcccggcgcgcu

SEQ ID NO: 1714959 - RNA, 18 nt, Salmonella enterica enterica serovar Typhi
ccgcccuguccuccaugg

SEQ ID NO: 1714960 - RNA, 15 nt, Salmonella enterica enterica serovar Typhi
ccgccaccgccucgc

SEQ ID NO: 1714961 - RNA, 13 nt, Salmonella enterica enterica serovar Typhi
ccgccaccgccgc

SEQ ID NO: 1714962 - RNA, 12 nt, Salmonella enterica enterica serovar Typhi
ccgccacccggc

SEQ ID NO: 1714963 - RNA, 19 nt, Salmonella enterica enterica serovar Typhi
ccgccacgccgcuccacag

SEQ ID NO: 1714964 - RNA, 18 nt, Salmonella enterica enterica serovar Typhi
ccgccaccuuucugcucc

SEQ ID NO: 1714965 - RNA, 17 nt, Salmonella enterica enterica serovar Typhi
ccgccagacucagccag

SEQ ID NO: 1714966 - RNA, 20 nt, Salmonella enterica enterica serovar Typhi
ccgccagauuauccaguccc

SEQ ID NO: 1714967 - RNA, 13 nt, Salmonella enterica enterica serovar Typhi
ccgccagcacagc

SEQ ID NO: 1714968 - RNA, 18 nt, Salmonella enterica enterica serovar Typhi
ccgccagcaccaggcucg

SEQ ID NO: 1714969 - RNA, 17 nt, Salmonella enterica enterica serovar Typhi
ccgccagucacccugcc

SEQ ID NO: 1714970 - RNA, 13 nt, Salmonella enterica enterica serovar Typhi
ccgccagcagagc

SEQ ID NO: 1714971 - RNA, 12 nt, Salmonella enterica enterica serovar Typhi
ccgccagcgccu

SEQ ID NO: 1714972 - RNA, 19 nt, Salmonella enterica enterica serovar Typhi
ccgccagcgagaugaaaag

SEQ ID NO: 1714973 - RNA, 20 nt, Salmonella enterica enterica serovar Typhi
ccgccagcgacauggcgguc

SEQ ID NO: 1714974 - RNA, 16 nt, Salmonella enterica enterica serovar Typhi
ccgcacacagcagaaa

SEQ ID NO: 1714975 - RNA, 14 nt, Salmonella enterica enterica serovar Typhi
ccgcacauaaucac

SEQ ID NO: 1714976 - RNA, 17 nt, Salmonella enterica enterica serovar Typhi
ccgcaccuggguauucc

SEQ ID NO: 1714977 - RNA, 18 nt, Salmonella enterica enterica serovar Typhi
ccgcaauugguaauuaaa

SEQ ID NO: 1714978 - RNA, 23 nt, Salmonella enterica enterica serovar Typhi
ccgcacagacgucggcaccgaau

SEQ ID NO: 1714979 - RNA, 14 nt, Salmonella enterica enterica serovar Typhi
ccgcacagcagaca

SEQ ID NO: 1714980 - RNA, 18 nt, Salmonella enterica enterica serovar Typhi
ccgcaaugaccacaaauu

SEQ ID NO: 1714981 - RNA, 17 nt, Salmonella enterica enterica serovar Typhi
ccgauggacucccaggu

SEQ ID NO: 1714982 - RNA, 14 nt, Salmonella enterica enterica serovar Typhi
ccgcaauccuggcu

SEQ ID NO: 1714983 - RNA, 19 nt, Salmonella enterica enterica serovar Typhi
ccgcagauccagcacggcc

SEQ ID NO: 1714984 - RNA, 21 nt, Salmonella enterica enterica serovar Typhi
ccgcagauccagcacggccuu

SEQ ID NO: 1714985 - RNA, 22 nt, Salmonella enterica enterica serovar Typhi
ccgcaccuggguauuccacugg

SEQ ID NO: 1714986 - RNA, 23 nt, Salmonella enterica enterica serovar Typhi
ccgcacgcgaccagacacggugu

SEQ ID NO: 1714987 - RNA, 18 nt, Salmonella enterica enterica serovar Typhi
ccgcacgcgacgcgccag

SEQ ID NO: 1714988 - RNA, 23 nt, Salmonella enterica enterica serovar Typhi
ccgcacgcgacgcgccagccagc

SEQ ID NO: 1714989 - RNA, 12 nt, Salmonella enterica enterica serovar Typhi
ccgcacgcgcgc

SEQ ID NO: 1714990 - RNA, 14 nt, Salmonella enterica enterica serovar Typhi
ccgcagaaaaagcc

SEQ ID NO: 1714991 - RNA, 14 nt, Salmonella enterica enterica serovar Typhi
ccgccaccacaaag

SEQ ID NO: 1714992 - RNA, 13 nt, Salmonella enterica enterica serovar Typhi
ccgccaccacaaa

SEQ ID NO: 1714993 - RNA, 12 nt, Salmonella enterica enterica serovar Typhi
ccgccaccagca

SEQ ID NO: 1714994 - RNA, 24 nt, Salmonella enterica enterica serovar Typhi
ccgccaaacugcgcgccgcccugc

SEQ ID NO: 1714995 - RNA, 14 nt, Salmonella enterica enterica serovar Typhi
ccgccaaacgcggu

SEQ ID NO: 1714996 - RNA, 16 nt, Salmonella enterica enterica serovar Typhi
ccgcauuuuuucuuca

SEQ ID NO: 1714997 - RNA, 13 nt, Salmonella enterica enterica serovar Typhi
ccgccaacgccaa

SEQ ID NO: 1714998 - RNA, 18 nt, Salmonella enterica enterica serovar Typhi
ccgccaacgccagcagcg

SEQ ID NO: 1714999 - RNA, 21 nt, Salmonella enterica enterica serovar Typhi
ccgccaacgguaaguugaaag

SEQ ID NO: 1715000 - RNA, 13 nt, Salmonella enterica enterica serovar Typhi
ccgccaauaacca

SEQ ID NO: 1715001 - RNA, 18 nt, Salmonella enterica enterica serovar Typhi
ccgccaagcgcggacagc

SEQ ID NO: 1715002 - RNA, 19 nt, Salmonella enterica enterica serovar Typhi
ccgcauccccauagacagu

SEQ ID NO: 1715003 - RNA, 19 nt, Salmonella enterica enterica serovar Typhi
ccgcaucgauacccugcug

SEQ ID NO: 1715004 - RNA, 17 nt, Salmonella enterica enterica serovar Typhi
ccgcaucgcccgcuccc

SEQ ID NO: 1715005 - RNA, 14 nt, Salmonella enterica enterica serovar Typhi
ccgcaucgccgcgg

SEQ ID NO: 1715006 - RNA, 17 nt, Salmonella enterica enterica serovar Typhi
ccgcauugagcaacccu

SEQ ID NO: 1715007 - RNA, 15 nt, Salmonella enterica enterica serovar Typhi
ccgcaugugcggcgc

SEQ ID NO: 1715008 - RNA, 12 nt, Salmonella enterica enterica serovar Typhi
cccucgccagca

SEQ ID NO: 1715009 - RNA, 13 nt, Salmonella enterica enterica serovar Typhi
cccucgccagcaa

SEQ ID NO: 1715010 - RNA, 23 nt, Salmonella enterica enterica serovar Typhi
cccuuguuauccuaaaucugcca

SEQ ID NO: 1715011 - RNA, 13 nt, Salmonella enterica enterica serovar Typhi
cccuuucuuaugc

SEQ ID NO: 1715012 - RNA, 15 nt, Salmonella enterica enterica serovar Typhi
cccuuuccuuauuaa

SEQ ID NO: 1715013 - RNA, 19 nt, Salmonella enterica enterica serovar Typhi
cccuuucaaaaaagagaag

SEQ ID NO: 1715014 - RNA, 19 nt, Salmonella enterica enterica serovar Typhi
ccgaacugcaucccugcuu

SEQ ID NO: 1715015 - RNA, 16 nt, Salmonella enterica enterica serovar Typhi
ccgaaauccaccagcg

SEQ ID NO: 1715016 - RNA, 16 nt, Salmonella enterica enterica serovar Typhi
ccgaaagaaagacgcu

SEQ ID NO: 1715017 - RNA, 16 nt, Salmonella enterica enterica serovar Typhi
cccuuuuucaauaagc

SEQ ID NO: 1715018 - RNA, 11 nt, Salmonella enterica enterica serovar Typhi
cccuuuuucaa

SEQ ID NO: 1715019 - RNA, 18 nt, Salmonella enterica enterica serovar Typhi
cccuuuuuaaaaugaccg

SEQ ID NO: 1715020 - RNA, 17 nt, Salmonella enterica enterica serovar Typhi
ccgacauagcugaacaa

SEQ ID NO: 1715021 - RNA, 16 nt, Salmonella enterica enterica serovar Typhi
ccgacaggguuugcca

SEQ ID NO: 1715022 - RNA, 19 nt, Salmonella enterica enterica serovar Typhi
ccgaccaucgcgccgcugg

SEQ ID NO: 1715023 - RNA, 18 nt, Salmonella enterica enterica serovar Typhi
ccgaccaauugcaggcag

SEQ ID NO: 1715024 - RNA, 12 nt, Salmonella enterica enterica serovar Typhi
ccgaaucuugca

SEQ ID NO: 1715025 - RNA, 13 nt, Salmonella enterica enterica serovar Typhi
ccgacaaccccaa

SEQ ID NO: 1715026 - RNA, 18 nt, Salmonella enterica enterica serovar Typhi
ccgacaagccccccgcac

SEQ ID NO: 1715027 - RNA, 22 nt, Salmonella enterica enterica serovar Typhi
ccgacaauuuugauaagagaaa

SEQ ID NO: 1715028 - RNA, 20 nt, Salmonella enterica enterica serovar Typhi
ccgacaauauucgccgcgau

SEQ ID NO: 1715029 - RNA, 15 nt, Salmonella enterica enterica serovar Typhi
ccgacacgcucaugu

SEQ ID NO: 1715030 - RNA, 16 nt, Salmonella enterica enterica serovar Typhi
ccgacacauucaggcu

SEQ ID NO: 1715031 - RNA, 17 nt, Salmonella enterica enterica serovar Typhi
ccgacacaguaaaaaaa

SEQ ID NO: 1715032 - RNA, 22 nt, Salmonella enterica enterica serovar Typhi
ccgacccauacucuuucccggc

SEQ ID NO: 1715033 - RNA, 22 nt, Salmonella enterica enterica serovar Typhi
ccgaccccgccgucagacaggc

SEQ ID NO: 1715034 - RNA, 15 nt, Salmonella enterica enterica serovar Typhi
ccgacgcucuuccuc

SEQ ID NO: 1715035 - RNA, 15 nt, Salmonella enterica enterica serovar Typhi
ccgacgcucaaccgg

SEQ ID NO: 1715036 - RNA, 22 nt, Salmonella enterica enterica serovar Typhi
ccgaccuggcggucggcuuugu

SEQ ID NO: 1715037 - RNA, 15 nt, Salmonella enterica enterica serovar Typhi
ccgacgcgggccgca

SEQ ID NO: 1715038 - RNA, 18 nt, Salmonella enterica enterica serovar Typhi
ccgacggcauaacggccu

SEQ ID NO: 1715039 - RNA, 23 nt, Salmonella enterica enterica serovar Typhi
ccgagcaggacgcgcgcgaaaag

SEQ ID NO: 1715040 - RNA, 20 nt, Salmonella enterica enterica serovar Typhi
ccgacugucgaaaccagcau

SEQ ID NO: 1715041 - RNA, 17 nt, Salmonella enterica enterica serovar Typhi
ccgagguuuucauccac

SEQ ID NO: 1715042 - RNA, 14 nt, Salmonella enterica enterica serovar Typhi
ccgaguaacaccgc

SEQ ID NO: 1715043 - RNA, 17 nt, Salmonella enterica enterica serovar Typhi
ccgauacaggacugacu

SEQ ID NO: 1715044 - RNA, 18 nt, Salmonella enterica enterica serovar Typhi
ccgauaaucaccagcccg

SEQ ID NO: 1715045 - RNA, 15 nt, Salmonella enterica enterica serovar Typhi
ccgauaaucaccagc

SEQ ID NO: 1715046 - RNA, 16 nt, Salmonella enterica enterica serovar Typhi
ccgauagcgccgcgcu

SEQ ID NO: 1715047 - RNA, 15 nt, Salmonella enterica enterica serovar Typhi
ccgauagcgccgcgc

SEQ ID NO: 1715048 - RNA, 23 nt, Salmonella enterica enterica serovar Typhi
ccgauagcgaaacugauauuaga

SEQ ID NO: 1715049 - RNA, 21 nt, Salmonella enterica enterica serovar Typhi
ccgcuaucgaccagcaccugc

SEQ ID NO: 1715050 - RNA, 15 nt, Salmonella enterica enterica serovar Typhi
ccgcuaucauaccua

SEQ ID NO: 1715051 - RNA, 19 nt, Salmonella enterica enterica serovar Typhi
ccgcugauguuuugcgccg

SEQ ID NO: 1715052 - RNA, 23 nt, Salmonella enterica enterica serovar Typhi
ccgcugauucguuuuuacacuga

SEQ ID NO: 1715053 - RNA, 22 nt, Salmonella enterica enterica serovar Typhi
ccgcugauguuuugcgccgcgc

SEQ ID NO: 1715054 - RNA, 16 nt, Salmonella enterica enterica serovar Typhi
ccgcugcaacucccgc

SEQ ID NO: 1715055 - RNA, 18 nt, Salmonella enterica enterica serovar Typhi
ccgcugauauucaccugu

SEQ ID NO: 1715056 - RNA, 19 nt, Salmonella enterica enterica serovar Typhi
ccgcugacgaccccaggca

SEQ ID NO: 1715057 - RNA, 18 nt, Salmonella enterica enterica serovar Typhi
ccgcucccgcauggacaa

SEQ ID NO: 1715058 - RNA, 15 nt, Salmonella enterica enterica serovar Typhi
ccgcucgcccgccgc

SEQ ID NO: 1715059 - RNA, 22 nt, Salmonella enterica enterica serovar Typhi
ccgcucgcuuacgcggcgcgcu

SEQ ID NO: 1715060 - RNA, 19 nt, Salmonella enterica enterica serovar Typhi
ccgcucgcuuacgcggcgc

SEQ ID NO: 1715061 - RNA, 16 nt, Salmonella enterica enterica serovar Typhi
ccgcuucgcgcgccag

SEQ ID NO: 1715062 - RNA, 23 nt, Salmonella enterica enterica serovar Typhi
ccgcuucggacuccugacgcuga

SEQ ID NO: 1715063 - RNA, 18 nt, Salmonella enterica enterica serovar Typhi
ccgcugguugccuuccug

SEQ ID NO: 1715064 - RNA, 16 nt, Salmonella enterica enterica serovar Typhi
ccgcgauacggauagc

SEQ ID NO: 1715065 - RNA, 23 nt, Salmonella enterica enterica serovar Typhi
ccgcgauaaagaauagccugggc

SEQ ID NO: 1715066 - RNA, 23 nt, Salmonella enterica enterica serovar Typhi
ccgcgaacaaagccccgggcgcu

SEQ ID NO: 1715067 - RNA, 19 nt, Salmonella enterica enterica serovar Typhi
ccgccuuaagaauguccau

SEQ ID NO: 1715068 - RNA, 18 nt, Salmonella enterica enterica serovar Typhi
ccgccugccgcgccgccg

SEQ ID NO: 1715069 - RNA, 13 nt, Salmonella enterica enterica serovar Typhi
ccgccgcccagcg

SEQ ID NO: 1715070 - RNA, 14 nt, Salmonella enterica enterica serovar Typhi
ccgccgcccguccg

SEQ ID NO: 1715071 - RNA, 13 nt, Salmonella enterica enterica serovar Typhi
ccgccgcgaaaac

SEQ ID NO: 1715072 - RNA, 14 nt, Salmonella enterica enterica serovar Typhi
ccgccgccgggccg

SEQ ID NO: 1715073 - RNA, 16 nt, Salmonella enterica enterica serovar Typhi
ccgccugccgcgccgc

SEQ ID NO: 1715074 - RNA, 14 nt, Salmonella enterica enterica serovar Typhi
ccgccgccggccug

SEQ ID NO: 1715075 - RNA, 13 nt, Salmonella enterica enterica serovar Typhi
ccgccgccgcgcc

SEQ ID NO: 1715076 - RNA, 19 nt, Salmonella enterica enterica serovar Typhi
ccgcggagaucgcucccgc

SEQ ID NO: 1715077 - RNA, 14 nt, Salmonella enterica enterica serovar Typhi
ccgcgcucuccggc

SEQ ID NO: 1715078 - RNA, 18 nt, Salmonella enterica enterica serovar Typhi
ccgcgcuagugccgccag

SEQ ID NO: 1715079 - RNA, 13 nt, Salmonella enterica enterica serovar Typhi
ccgcgccacccca

SEQ ID NO: 1715080 - RNA, 22 nt, Salmonella enterica enterica serovar Typhi
ccgcgccaaacguggcggcaga

SEQ ID NO: 1715081 - RNA, 22 nt, Salmonella enterica enterica serovar Typhi
ccgcgcaaagcaauaccacgcc

SEQ ID NO: 1715082 - RNA, 15 nt, Salmonella enterica enterica serovar Typhi
ccgcgcauagcuggc

SEQ ID NO: 1715083 - RNA, 15 nt, Salmonella enterica enterica serovar Typhi
ccgcgcagugcagcg

SEQ ID NO: 1715084 - RNA, 13 nt, Salmonella enterica enterica serovar Typhi
ccgcgcgccgccu

SEQ ID NO: 1715085 - RNA, 15 nt, Salmonella enterica enterica serovar Typhi
ccggccuggcgcagc

SEQ ID NO: 1715086 - RNA, 13 nt, Salmonella enterica enterica serovar Typhi
ccggccuggcgca

SEQ ID NO: 1715087 - RNA, 22 nt, Salmonella enterica enterica serovar Typhi
ccggcgaaaaccgagcauccgc

SEQ ID NO: 1715088 - RNA, 17 nt, Salmonella enterica enterica serovar Typhi
ccggcgaaagcggacac

SEQ ID NO: 1715089 - RNA, 20 nt, Salmonella enterica enterica serovar Typhi
ccggcgaaaucgugcgcccc

SEQ ID NO: 1715090 - RNA, 19 nt, Salmonella enterica enterica serovar Typhi
ccggcgaacguuggcuggg

SEQ ID NO: 1715091 - RNA, 18 nt, Salmonella enterica enterica serovar Typhi
ccggcgagugccugcugg

SEQ ID NO: 1715092 - RNA, 18 nt, Salmonella enterica enterica serovar Typhi
ccggcgacgcuuucaccu

SEQ ID NO: 1715093 - RNA, 18 nt, Salmonella enterica enterica serovar Typhi
ccggcgacagcgaccacg

SEQ ID NO: 1715094 - RNA, 13 nt, Salmonella enterica enterica serovar Typhi
ccggccugcaaac

SEQ ID NO: 1715095 - RNA, 19 nt, Salmonella enterica enterica serovar Typhi
ccggccugcaaaccgccuc

SEQ ID NO: 1715096 - RNA, 20 nt, Salmonella enterica enterica serovar Typhi
ccggccuacucuugagccgg

SEQ ID NO: 1715097 - RNA, 13 nt, Salmonella enterica enterica serovar Typhi
ccggccuacagac

SEQ ID NO: 1715098 - RNA, 14 nt, Salmonella enterica enterica serovar Typhi
ccggcgcauccagu

SEQ ID NO: 1715099 - RNA, 18 nt, Salmonella enterica enterica serovar Typhi
ccggcgcagcaucugcgg

SEQ ID NO: 1715100 - RNA, 22 nt, Salmonella enterica enterica serovar Typhi
ccggcgcaaacaguacgcccgc

SEQ ID NO: 1715101 - RNA, 18 nt, Salmonella enterica enterica serovar Typhi
ccggcgccagaagcuggc

SEQ ID NO: 1715102 - RNA, 19 nt, Salmonella enterica enterica serovar Typhi
ccggcgccgaucaucccgc

SEQ ID NO: 1715103 - RNA, 15 nt, Salmonella enterica enterica serovar Typhi
ccggcgcgcguggcu

SEQ ID NO: 1715104 - RNA, 17 nt, Salmonella enterica enterica serovar Typhi
ccggcgcgccuuccagc

SEQ ID NO: 1715105 - RNA, 11 nt, Salmonella enterica enterica serovar Typhi
ccggcgcgcca

SEQ ID NO: 1715106 - RNA, 20 nt, Salmonella enterica enterica serovar Typhi
ccggcgcugcgcggcgugca

SEQ ID NO: 1715107 - RNA, 14 nt, Salmonella enterica enterica serovar Typhi
ccggcggaauagcu

SEQ ID NO: 1715108 - RNA, 18 nt, Salmonella enterica enterica serovar Typhi
ccggcgcuggcgcuggcu

SEQ ID NO: 1715109 - RNA, 19 nt, Salmonella enterica enterica serovar Typhi
ccggcgcguuuuggcagac

SEQ ID NO: 1715110 - RNA, 20 nt, Salmonella enterica enterica serovar Typhi
ccggcgcguuuuggcagaca

SEQ ID NO: 1715111 - RNA, 14 nt, Salmonella enterica enterica serovar Typhi
ccggcgcgggugau

SEQ ID NO: 1715112 - RNA, 15 nt, Salmonella enterica enterica serovar Typhi
ccggcgcguaauucc

SEQ ID NO: 1715113 - RNA, 22 nt, Salmonella enterica enterica serovar Typhi
ccggaugcguguucagguuggc

SEQ ID NO: 1715114 - RNA, 16 nt, Salmonella enterica enterica serovar Typhi
ccggaugcgccucauc

SEQ ID NO: 1715115 - RNA, 13 nt, Salmonella enterica enterica serovar Typhi
ccggauuuaccag

SEQ ID NO: 1715116 - RNA, 13 nt, Salmonella enterica enterica serovar Typhi
ccggauuuuaaau

SEQ ID NO: 1715117 - RNA, 16 nt, Salmonella enterica enterica serovar Typhi
ccggaugccccaucac

SEQ ID NO: 1715118 - RNA, 16 nt, Salmonella enterica enterica serovar Typhi
ccggaugcaccaucuc

SEQ ID NO: 1715119 - RNA, 18 nt, Salmonella enterica enterica serovar Typhi
ccggaucgcuaauuuuua

SEQ ID NO: 1715120 - RNA, 13 nt, Salmonella enterica enterica serovar Typhi
ccggaucaucuuu

SEQ ID NO: 1715121 - RNA, 12 nt, Salmonella enterica enterica serovar Typhi
ccggaucgaucc

SEQ ID NO: 1715122 - RNA, 17 nt, Salmonella enterica enterica serovar Typhi
ccggagccggucggcgc

SEQ ID NO: 1715123 - RNA, 15 nt, Salmonella enterica enterica serovar Typhi
ccggagguuuuucug

SEQ ID NO: 1715124 - RNA, 14 nt, Salmonella enterica enterica serovar Typhi
ccggacgcaccagc

SEQ ID NO: 1715125 - RNA, 17 nt, Salmonella enterica enterica serovar Typhi
ccggacgccguccaggc

SEQ ID NO: 1715126 - RNA, 13 nt, Salmonella enterica enterica serovar Typhi
ccggacgccacca

SEQ ID NO: 1715127 - RNA, 14 nt, Salmonella enterica enterica serovar Typhi
ccggacgccaccac

SEQ ID NO: 1715128 - RNA, 14 nt, Salmonella enterica enterica serovar Typhi
ccggacgcccgucc

SEQ ID NO: 1715129 - RNA, 21 nt, Salmonella enterica enterica serovar Typhi
ccggaccuaauagccagcccc

SEQ ID NO: 1715130 - RNA, 15 nt, Salmonella enterica enterica serovar Typhi
ccggccagcgccagc

SEQ ID NO: 1715131 - RNA, 21 nt, Salmonella enterica enterica serovar Typhi
ccggcaucauucugcaggcgg

SEQ ID NO: 1715132 - RNA, 23 nt, Salmonella enterica enterica serovar Typhi
ccggcaguccuugcagccagaac

SEQ ID NO: 1715133 - RNA, 17 nt, Salmonella enterica enterica serovar Typhi
ccggcaaacucagcggc

SEQ ID NO: 1715134 - RNA, 18 nt, Salmonella enterica enterica serovar Typhi
ccggcaaagaagcuuaca

SEQ ID NO: 1715135 - RNA, 20 nt, Salmonella enterica enterica serovar Typhi
ccggcaaaaagaaucgccag

SEQ ID NO: 1715136 - RNA, 20 nt, Salmonella enterica enterica serovar Typhi
ccggcaaugauaucggccgg

SEQ ID NO: 1715137 - RNA, 16 nt, Salmonella enterica enterica serovar Typhi
ccggcacauccagcug

SEQ ID NO: 1715138 - RNA, 20 nt, Salmonella enterica enterica serovar Typhi
ccggcacauauuccggcgcu

SEQ ID NO: 1715139 - RNA, 13 nt, Salmonella enterica enterica serovar Typhi
ccggcacauccag

SEQ ID NO: 1715140 - RNA, 21 nt, Salmonella enterica enterica serovar Typhi
ccggcaauuaccgccagcggc

SEQ ID NO: 1715141 - RNA, 16 nt, Salmonella enterica enterica serovar Typhi
ccggcacaaccuggcu

SEQ ID NO: 1715142 - RNA, 21 nt, Salmonella enterica enterica serovar Typhi
ccguugucuucaccuugcugc

SEQ ID NO: 1715143 - RNA, 20 nt, Salmonella enterica enterica serovar Typhi
ccguugucacaggcuuggca

SEQ ID NO: 1715144 - RNA, 17 nt, Salmonella enterica enterica serovar Typhi
ccguugaccagcugacg

SEQ ID NO: 1715145 - RNA, 18 nt, Salmonella enterica enterica serovar Typhi
ccguucugugcgccgcug

SEQ ID NO: 1715146 - RNA, 13 nt, Salmonella enterica enterica serovar Typhi
ccguucuuccugg

SEQ ID NO: 1715147 - RNA, 23 nt, Salmonella enterica enterica serovar Typhi
ccguuuuuaucuccccaauugcu

SEQ ID NO: 1715148 - RNA, 16 nt, Salmonella enterica enterica serovar Typhi
ccguuuuuaauuugcu

SEQ ID NO: 1715149 - RNA, 16 nt, Salmonella enterica enterica serovar Typhi
ccguuguugcaccacc

SEQ ID NO: 1715150 - RNA, 13 nt, Salmonella enterica enterica serovar Typhi
ccuaaagaaaaac

SEQ ID NO: 1715151 - RNA, 13 nt, Salmonella enterica enterica serovar Typhi
ccuaauaaaauaa

SEQ ID NO: 1715152 - RNA, 13 nt, Salmonella enterica enterica serovar Typhi
ccguuacaaauag

SEQ ID NO: 1715153 - RNA, 13 nt, Salmonella enterica enterica serovar Typhi
ccguuaagcugga

SEQ ID NO: 1715154 - RNA, 14 nt, Salmonella enterica enterica serovar Typhi
ccguuaagcccuga

SEQ ID NO: 1715155 - RNA, 14 nt, Salmonella enterica enterica serovar Typhi
ccguuacuuccccc

SEQ ID NO: 1715156 - RNA, 19 nt, Salmonella enterica enterica serovar Typhi
ccguguugugugccgcgcu

SEQ ID NO: 1715157 - RNA, 22 nt, Salmonella enterica enterica serovar Typhi
ccguguuuuuuacaggcauccg

SEQ ID NO: 1715158 - RNA, 15 nt, Salmonella enterica enterica serovar Typhi
ccguggcauucgcuu

SEQ ID NO: 1715159 - RNA, 23 nt, Salmonella enterica enterica serovar Typhi
ccgugcaguuuugcuucaugcac

SEQ ID NO: 1715160 - RNA, 16 nt, Salmonella enterica enterica serovar Typhi
ccgugauuuauuuucg

SEQ ID NO: 1715161 - RNA, 21 nt, Salmonella enterica enterica serovar Typhi
ccgugcaaaaucacgcggcgc

SEQ ID NO: 1715162 - RNA, 14 nt, Salmonella enterica enterica serovar Typhi
ccgugaguuuuaac

SEQ ID NO: 1715163 - RNA, 15 nt, Salmonella enterica enterica serovar Typhi
ccuaucccaauucgu

SEQ ID NO: 1715164 - RNA, 22 nt, Salmonella enterica enterica serovar Typhi
ccuaucaggaucaaaaucgcgc

SEQ ID NO: 1715165 - RNA, 22 nt, Salmonella enterica enterica serovar Typhi
ccuaucaggcguugaccgcuuc

SEQ ID NO: 1715166 - RNA, 18 nt, Salmonella enterica enterica serovar Typhi
ccuauagacaccuuauau

SEQ ID NO: 1715167 - RNA, 16 nt, Salmonella enterica enterica serovar Typhi
ccuauaagcugccucu

SEQ ID NO: 1715168 - RNA, 16 nt, Salmonella enterica enterica serovar Typhi
ccuagcgucccggcaa

SEQ ID NO: 1715169 - RNA, 21 nt, Salmonella enterica enterica serovar Typhi
ccuagcgucccggcaauacug

SEQ ID NO: 1715170 - RNA, 23 nt, Salmonella enterica enterica serovar Typhi
ccuacaaggaaagaaaaugccag

SEQ ID NO: 1715171 - RNA, 17 nt, Salmonella enterica enterica serovar Typhi
ccuacaaggcauucagg

SEQ ID NO: 1715172 - RNA, 18 nt, Salmonella enterica enterica serovar Typhi
ccuacacauugagcgaga

SEQ ID NO: 1715173 - RNA, 21 nt, Salmonella enterica enterica serovar Typhi
ccuacuguggugugccugcgu

SEQ ID NO: 1715174 - RNA, 19 nt, Salmonella enterica enterica serovar Typhi
ccuacugcccuacgcuucu

SEQ ID NO: 1715175 - RNA, 18 nt, Salmonella enterica enterica serovar Typhi
ccuacucucgcaugggga

SEQ ID NO: 1715176 - RNA, 17 nt, Salmonella enterica enterica serovar Typhi
ccucaagaauaucuuua

SEQ ID NO: 1715177 - RNA, 21 nt, Salmonella enterica enterica serovar Typhi
ccucaacgucgcucagaauag

SEQ ID NO: 1715178 - RNA, 23 nt, Salmonella enterica enterica serovar Typhi
ccucaacgcccugcucccacagc

SEQ ID NO: 1715179 - RNA, 18 nt, Salmonella enterica enterica serovar Typhi
ccucaacauugccggcau

SEQ ID NO: 1715180 - RNA, 17 nt, Salmonella enterica enterica serovar Typhi
ccucaacaucucuucgu

SEQ ID NO: 1715181 - RNA, 19 nt, Salmonella enterica enterica serovar Typhi
ccuauuuuaaauucccagc

SEQ ID NO: 1715182 - RNA, 15 nt, Salmonella enterica enterica serovar Typhi
ccuauuuuacaaaau

SEQ ID NO: 1715183 - RNA, 14 nt, Salmonella enterica enterica serovar Typhi
ccuauuuugcaaaa

SEQ ID NO: 1715184 - RNA, 22 nt, Salmonella enterica enterica serovar Typhi
ccuauuuugcaaaacugaguug

SEQ ID NO: 1715185 - RNA, 19 nt, Salmonella enterica enterica serovar Typhi
ccucaaaauggaaaauaau

SEQ ID NO: 1715186 - RNA, 16 nt, Salmonella enterica enterica serovar Typhi
ccucaaacaggcuguc

SEQ ID NO: 1715187 - RNA, 14 nt, Salmonella enterica enterica serovar Typhi
ccucaaacaggcug

SEQ ID NO: 1715188 - RNA, 18 nt, Salmonella enterica enterica serovar Typhi
ccuauuuuaaauucccag

SEQ ID NO: 1715189 - RNA, 21 nt, Salmonella enterica enterica serovar Typhi
ccuauuucaguacagccaaaa

SEQ ID NO: 1715190 - RNA, 23 nt, Salmonella enterica enterica serovar Typhi
ccuauuucaguacagccaaaaau

SEQ ID NO: 1715191 - RNA, 18 nt, Salmonella enterica enterica serovar Typhi
ccucaaguaaaaugcccu

SEQ ID NO: 1715192 - RNA, 16 nt, Salmonella enterica enterica serovar Typhi
ccucaauugccgccag

SEQ ID NO: 1715193 - RNA, 20 nt, Salmonella enterica enterica serovar Typhi
ccucaaugguuucacgcucu

SEQ ID NO: 1715194 - RNA, 19 nt, Salmonella enterica enterica serovar Typhi
ccucaaucggcgauaaacc

SEQ ID NO: 1715195 - RNA, 16 nt, Salmonella enterica enterica serovar Typhi
ccucaccguccgccag

SEQ ID NO: 1715196 - RNA, 11 nt, Salmonella enterica enterica serovar Typhi
ccucacuccag

SEQ ID NO: 1715197 - RNA, 13 nt, Salmonella enterica enterica serovar Typhi
ccucacugccgac

SEQ ID NO: 1715198 - RNA, 14 nt, Salmonella enterica enterica serovar Typhi
ccgggauucaggga

SEQ ID NO: 1715199 - RNA, 22 nt, Salmonella enterica enterica serovar Typhi
ccgggcagcaucucgauuacag

SEQ ID NO: 1715200 - RNA, 19 nt, Salmonella enterica enterica serovar Typhi
ccggggugcagaacaucaa

SEQ ID NO: 1715201 - RNA, 16 nt, Salmonella enterica enterica serovar Typhi
ccgggcgcuuaccuaa

SEQ ID NO: 1715202 - RNA, 20 nt, Salmonella enterica enterica serovar Typhi
ccggggcuggcggcgauggc

SEQ ID NO: 1715203 - RNA, 17 nt, Salmonella enterica enterica serovar Typhi
ccggggcuggcggcgau

SEQ ID NO: 1715204 - RNA, 14 nt, Salmonella enterica enterica serovar Typhi
ccggggcuggcggc

SEQ ID NO: 1715205 - RNA, 17 nt, Salmonella enterica enterica serovar Typhi
ccgggccugagcgcgca

SEQ ID NO: 1715206 - RNA, 16 nt, Salmonella enterica enterica serovar Typhi
ccgggccugagcgcgc

SEQ ID NO: 1715207 - RNA, 13 nt, Salmonella enterica enterica serovar Typhi
ccgggccgucagg

SEQ ID NO: 1715208 - RNA, 17 nt, Salmonella enterica enterica serovar Typhi
ccgggcgacacgcgcgc

SEQ ID NO: 1715209 - RNA, 22 nt, Salmonella enterica enterica serovar Typhi
ccgguaauaauuagcauccagc

SEQ ID NO: 1715210 - RNA, 17 nt, Salmonella enterica enterica serovar Typhi
ccgguaagcgcagcgcc

SEQ ID NO: 1715211 - RNA, 15 nt, Salmonella enterica enterica serovar Typhi
ccggucugcgcgccg

SEQ ID NO: 1715212 - RNA, 22 nt, Salmonella enterica enterica serovar Typhi
ccggucaucgcggaaagcaaug

SEQ ID NO: 1715213 - RNA, 17 nt, Salmonella enterica enterica serovar Typhi
ccgguagccaggcgcga

SEQ ID NO: 1715214 - RNA, 19 nt, Salmonella enterica enterica serovar Typhi
ccgguagcuucagcggcgc

SEQ ID NO: 1715215 - RNA, 15 nt, Salmonella enterica enterica serovar Typhi
ccggugggcauauga

SEQ ID NO: 1715216 - RNA, 15 nt, Salmonella enterica enterica serovar Typhi
ccgguggcguggcgc

SEQ ID NO: 1715217 - RNA, 16 nt, Salmonella enterica enterica serovar Typhi
ccgguggcgccacgcc

SEQ ID NO: 1715218 - RNA, 19 nt, Salmonella enterica enterica serovar Typhi
ccggugcgagaaaaagcaa

SEQ ID NO: 1715219 - RNA, 19 nt, Salmonella enterica enterica serovar Typhi
ccggugcggcaagcgcgcu

SEQ ID NO: 1715220 - RNA, 13 nt, Salmonella enterica enterica serovar Typhi
ccggugcgcccca

SEQ ID NO: 1715221 - RNA, 21 nt, Salmonella enterica enterica serovar Typhi
ccgguugcccauuuugcgguu

SEQ ID NO: 1715222 - RNA, 12 nt, Salmonella enterica enterica serovar Typhi
ccgguugcugau

SEQ ID NO: 1715223 - RNA, 12 nt, Salmonella enterica enterica serovar Typhi
ccgguuuauccc

SEQ ID NO: 1715224 - RNA, 16 nt, Salmonella enterica enterica serovar Typhi
ccgguuauaccgccau

SEQ ID NO: 1715225 - RNA, 22 nt, Salmonella enterica enterica serovar Typhi
ccgguucggacgguaccugaag

SEQ ID NO: 1715226 - RNA, 13 nt, Salmonella enterica enterica serovar Typhi
ccgguucacccac

SEQ ID NO: 1715227 - RNA, 15 nt, Salmonella enterica enterica serovar Typhi
ccguauccgccacca

SEQ ID NO: 1715228 - RNA, 19 nt, Salmonella enterica enterica serovar Typhi
ccguauccgccaccaugau

SEQ ID NO: 1715229 - RNA, 21 nt, Salmonella enterica enterica serovar Typhi
ccguaccgcggcgcugcagau

SEQ ID NO: 1715230 - RNA, 12 nt, Salmonella enterica enterica serovar Typhi
ccgucacaaagc

SEQ ID NO: 1715231 - RNA, 19 nt, Salmonella enterica enterica serovar Typhi
ccgucaaacaagccgccaa

SEQ ID NO: 1715232 - RNA, 21 nt, Salmonella enterica enterica serovar Typhi
ccgucaaaguugguucccagc

SEQ ID NO: 1715233 - RNA, 22 nt, Salmonella enterica enterica serovar Typhi
ccgucaaaguugguucccagca

SEQ ID NO: 1715234 - RNA, 18 nt, Salmonella enterica enterica serovar Typhi
ccguauuuuauuuuucaa

SEQ ID NO: 1715235 - RNA, 15 nt, Salmonella enterica enterica serovar Typhi
ccguccacauccagc

SEQ ID NO: 1715236 - RNA, 17 nt, Salmonella enterica enterica serovar Typhi
ccgucauccugcaacuc

SEQ ID NO: 1715237 - RNA, 23 nt, Salmonella enterica enterica serovar Typhi
ccgucaguaccagcgagauaacc

SEQ ID NO: 1715238 - RNA, 16 nt, Salmonella enterica enterica serovar Typhi
ccgucagucgccagaa

SEQ ID NO: 1715239 - RNA, 18 nt, Salmonella enterica enterica serovar Typhi
ccgucauccagcagcaga

SEQ ID NO: 1715240 - RNA, 16 nt, Salmonella enterica enterica serovar Typhi
ccgucauccagcagca

SEQ ID NO: 1715241 - RNA, 18 nt, Salmonella enterica enterica serovar Typhi
ccgucagugagcccuccu

SEQ ID NO: 1715242 - RNA, 20 nt, Salmonella enterica enterica serovar Typhi
ccgucauaaaaucaaucugc

SEQ ID NO: 1715243 - RNA, 17 nt, Salmonella enterica enterica serovar Typhi
ccguccggcaaacccuu

SEQ ID NO: 1715244 - RNA, 14 nt, Salmonella enterica enterica serovar Typhi
ccgucccuuccgcc

SEQ ID NO: 1715245 - RNA, 15 nt, Salmonella enterica enterica serovar Typhi
ccguccgccaggccc

SEQ ID NO: 1715246 - RNA, 13 nt, Salmonella enterica enterica serovar Typhi
ccguccccagcca

SEQ ID NO: 1715247 - RNA, 20 nt, Salmonella enterica enterica serovar Typhi
ccugacgccgcuguuuucac

SEQ ID NO: 1715248 - RNA, 20 nt, Salmonella enterica enterica serovar Typhi
ccugacugcgcgccugcgcu

SEQ ID NO: 1715249 - RNA, 21 nt, Salmonella enterica enterica serovar Typhi
ccugacuauugcugagcugac

SEQ ID NO: 1715250 - RNA, 17 nt, Salmonella enterica enterica serovar Typhi
ccugacggcgcugucac

SEQ ID NO: 1715251 - RNA, 13 nt, Salmonella enterica enterica serovar Typhi
ccugacggcagcc

SEQ ID NO: 1715252 - RNA, 14 nt, Salmonella enterica enterica serovar Typhi
ccugacgcugagag

SEQ ID NO: 1715253 - RNA, 20 nt, Salmonella enterica enterica serovar Typhi
ccugacgcugagagaacugc

SEQ ID NO: 1715254 - RNA, 14 nt, Salmonella enterica enterica serovar Typhi
ccugacaauacugc

SEQ ID NO: 1715255 - RNA, 22 nt, Salmonella enterica enterica serovar Typhi
ccucuuccucgauaucuucaua

SEQ ID NO: 1715256 - RNA, 13 nt, Salmonella enterica enterica serovar Typhi
ccucuuccgccag

SEQ ID NO: 1715257 - RNA, 16 nt, Salmonella enterica enterica serovar Typhi
ccugacauuuauauua

SEQ ID NO: 1715258 - RNA, 15 nt, Salmonella enterica enterica serovar Typhi
ccugagcgccgccaa

SEQ ID NO: 1715259 - RNA, 18 nt, Salmonella enterica enterica serovar Typhi
ccugagcgcgaacuacac

SEQ ID NO: 1715260 - RNA, 17 nt, Salmonella enterica enterica serovar Typhi
ccugagcgcgcagcugg

SEQ ID NO: 1715261 - RNA, 14 nt, Salmonella enterica enterica serovar Typhi
ccugagcccacagc

SEQ ID NO: 1715262 - RNA, 15 nt, Salmonella enterica enterica serovar Typhi
ccugagcccacagcg

SEQ ID NO: 1715263 - RNA, 16 nt, Salmonella enterica enterica serovar Typhi
ccugagccgaaccccu

SEQ ID NO: 1715264 - RNA, 21 nt, Salmonella enterica enterica serovar Typhi
ccugagcagacauauuuucuc

SEQ ID NO: 1715265 - RNA, 17 nt, Salmonella enterica enterica serovar Typhi
ccugacuuuuccauacu

SEQ ID NO: 1715266 - RNA, 16 nt, Salmonella enterica enterica serovar Typhi
ccugauagcaaucauc

SEQ ID NO: 1715267 - RNA, 18 nt, Salmonella enterica enterica serovar Typhi
ccugauauacaaaaccca

SEQ ID NO: 1715268 - RNA, 14 nt, Salmonella enterica enterica serovar Typhi
ccugauauccacgc

SEQ ID NO: 1715269 - RNA, 18 nt, Salmonella enterica enterica serovar Typhi
ccugauaagcgcagcgcc

SEQ ID NO: 1715270 - RNA, 18 nt, Salmonella enterica enterica serovar Typhi
ccugaggaaaaagcgcac

SEQ ID NO: 1715271 - RNA, 20 nt, Salmonella enterica enterica serovar Typhi
ccugauaaccuauuuugcaa

SEQ ID NO: 1715272 - RNA, 17 nt, Salmonella enterica enterica serovar Typhi
ccugauggcgcugcgcu

SEQ ID NO: 1715273 - RNA, 22 nt, Salmonella enterica enterica serovar Typhi
ccugauggcgcuacguuuaucu

SEQ ID NO: 1715274 - RNA, 21 nt, Salmonella enterica enterica serovar Typhi
ccugauggucgcucuggucga

SEQ ID NO: 1715275 - RNA, 17 nt, Salmonella enterica enterica serovar Typhi
ccugaugguuauuuuca

SEQ ID NO: 1715276 - RNA, 20 nt, Salmonella enterica enterica serovar Typhi
ccugaugacggcugguaagg

SEQ ID NO: 1715277 - RNA, 21 nt, Salmonella enterica enterica serovar Typhi
ccugaucgugccaugaccauu

SEQ ID NO: 1715278 - RNA, 17 nt, Salmonella enterica enterica serovar Typhi
ccugaugacgcugcgcu

SEQ ID NO: 1715279 - RNA, 19 nt, Salmonella enterica enterica serovar Typhi
ccugauccagcucuucuuc

SEQ ID NO: 1715280 - RNA, 23 nt, Salmonella enterica enterica serovar Typhi
ccugauauugcguaagcagcugc

SEQ ID NO: 1715281 - RNA, 16 nt, Salmonella enterica enterica serovar Typhi
ccugauccagcucuuc

SEQ ID NO: 1715282 - RNA, 19 nt, Salmonella enterica enterica serovar Typhi
ccugauuuaacgaguugaa

SEQ ID NO: 1715283 - RNA, 20 nt, Salmonella enterica enterica serovar Typhi
ccugcaaaccucucccccgc

SEQ ID NO: 1715284 - RNA, 16 nt, Salmonella enterica enterica serovar Typhi
ccugauugaccagcau

SEQ ID NO: 1715285 - RNA, 20 nt, Salmonella enterica enterica serovar Typhi
ccugauugauacgcgcccga

SEQ ID NO: 1715286 - RNA, 13 nt, Salmonella enterica enterica serovar Typhi
ccugauuuaucac

SEQ ID NO: 1715287 - RNA, 20 nt, Salmonella enterica enterica serovar Typhi
ccugcaaagcaaaaaucacc

SEQ ID NO: 1715288 - RNA, 17 nt, Salmonella enterica enterica serovar Typhi
ccugcaacagcaccagc

SEQ ID NO: 1715289 - RNA, 20 nt, Salmonella enterica enterica serovar Typhi
ccugcaacgcuuuagugccg

SEQ ID NO: 1715290 - RNA, 20 nt, Salmonella enterica enterica serovar Typhi
ccugcagggaauaagcgccc

SEQ ID NO: 1715291 - RNA, 16 nt, Salmonella enterica enterica serovar Typhi
ccugccacaggccaac

SEQ ID NO: 1715292 - RNA, 17 nt, Salmonella enterica enterica serovar Typhi
ccugcagggaauaagcg

SEQ ID NO: 1715293 - RNA, 16 nt, Salmonella enterica enterica serovar Typhi
ccucguccagaugggc

SEQ ID NO: 1715294 - RNA, 17 nt, Salmonella enterica enterica serovar Typhi
ccucuggccaguuucaa

SEQ ID NO: 1715295 - RNA, 23 nt, Salmonella enterica enterica serovar Typhi
ccucuucauagcguuuuuucauc

SEQ ID NO: 1715296 - RNA, 13 nt, Salmonella enterica enterica serovar Typhi
ccucuuaucaggc

SEQ ID NO: 1715297 - RNA, 23 nt, Salmonella enterica enterica serovar Typhi
ccucugccguagcguacuuucaa

SEQ ID NO: 1715298 - RNA, 13 nt, Salmonella enterica enterica serovar Typhi
ccucuaucuucuc

SEQ ID NO: 1715299 - RNA, 22 nt, Salmonella enterica enterica serovar Typhi
ccucuaccggaaaacagccgcc

SEQ ID NO: 1715300 - RNA, 23 nt, Salmonella enterica enterica serovar Typhi
ccucgcucucuuucaccagcgcc

SEQ ID NO: 1715301 - RNA, 21 nt, Salmonella enterica enterica serovar Typhi
ccucgauggcauuguccuuua

SEQ ID NO: 1715302 - RNA, 19 nt, Salmonella enterica enterica serovar Typhi
ccucgcauccuccauccag

SEQ ID NO: 1715303 - RNA, 16 nt, Salmonella enterica enterica serovar Typhi
ccucagcaggcgggcu

SEQ ID NO: 1715304 - RNA, 12 nt, Salmonella enterica enterica serovar Typhi
ccucagccaccc

SEQ ID NO: 1715305 - RNA, 19 nt, Salmonella enterica enterica serovar Typhi
ccucagauguaucgcgcuu

SEQ ID NO: 1715306 - RNA, 19 nt, Salmonella enterica enterica serovar Typhi
ccucagcaaugauuuuuag

SEQ ID NO: 1715307 - RNA, 17 nt, Salmonella enterica enterica serovar Typhi
ccucagcaaaaucacgc

SEQ ID NO: 1715308 - RNA, 22 nt, Salmonella enterica enterica serovar Typhi
ccucauacagcccgcgcagaau

SEQ ID NO: 1715309 - RNA, 16 nt, Salmonella enterica enterica serovar Typhi
ccugugaaguaaaaaa

SEQ ID NO: 1715310 - RNA, 14 nt, Salmonella enterica enterica serovar Typhi
ccugucuccucagc

SEQ ID NO: 1715311 - RNA, 17 nt, Salmonella enterica enterica serovar Typhi
ccugucugucaaaaccc

SEQ ID NO: 1715312 - RNA, 23 nt, Salmonella enterica enterica serovar Typhi
ccugucugucaaaacccagccca

SEQ ID NO: 1715313 - RNA, 14 nt, Salmonella enterica enterica serovar Typhi
ccuguaaaccgccu

SEQ ID NO: 1715314 - RNA, 21 nt, Salmonella enterica enterica serovar Typhi
ccugguuuguccaaggcauga

SEQ ID NO: 1715315 - RNA, 22 nt, Salmonella enterica enterica serovar Typhi
ccuguucuggcucggccugucg

SEQ ID NO: 1715316 - RNA, 19 nt, Salmonella enterica enterica serovar Typhi
ccuguucaagcaauaaugc

SEQ ID NO: 1715317 - RNA, 12 nt, Salmonella enterica enterica serovar Typhi
ccuguucaagug

SEQ ID NO: 1715318 - RNA, 15 nt, Salmonella enterica enterica serovar Typhi
ccuguucaugccaga

SEQ ID NO: 1715319 - RNA, 14 nt, Salmonella enterica enterica serovar Typhi
ccuguuauucaggg

SEQ ID NO: 1715320 - RNA, 18 nt, Salmonella enterica enterica serovar Typhi
ccugugcaaccagcucuu

SEQ ID NO: 1715321 - RNA, 16 nt, Salmonella enterica enterica serovar Typhi
ccuuaaucgacuucau

SEQ ID NO: 1715322 - RNA, 14 nt, Salmonella enterica enterica serovar Typhi
ccuuacaggcgcau

SEQ ID NO: 1715323 - RNA, 18 nt, Salmonella enterica enterica serovar Typhi
ccuuacaggcgcaucaga

SEQ ID NO: 1715324 - RNA, 23 nt, Salmonella enterica enterica serovar Typhi
ccuuaauccccggcccgccgcug

SEQ ID NO: 1715325 - RNA, 21 nt, Salmonella enterica enterica serovar Typhi
ccuuacaggcgcaucagaaaa

SEQ ID NO: 1715326 - RNA, 13 nt, Salmonella enterica enterica serovar Typhi
ccuuaaaaaggac

SEQ ID NO: 1715327 - RNA, 24 nt, Salmonella enterica enterica serovar Typhi
ccuguuucuuaccacgccgcgacu

SEQ ID NO: 1715328 - RNA, 18 nt, Salmonella enterica enterica serovar Typhi
ccuguuucugcgccgcuu

SEQ ID NO: 1715329 - RNA, 13 nt, Salmonella enterica enterica serovar Typhi
ccuguuuaucuga

SEQ ID NO: 1715330 - RNA, 23 nt, Salmonella enterica enterica serovar Typhi
ccuguugcgggccagcagccagg

SEQ ID NO: 1715331 - RNA, 14 nt, Salmonella enterica enterica serovar Typhi
ccuucaacccagca

SEQ ID NO: 1715332 - RNA, 23 nt, Salmonella enterica enterica serovar Typhi
ccuucaaauauauugaaaaggga

SEQ ID NO: 1715333 - RNA, 21 nt, Salmonella enterica enterica serovar Typhi
ccuucaauuugaccugaccug

SEQ ID NO: 1715334 - RNA, 22 nt, Salmonella enterica enterica serovar Typhi
ccuucaaucacgcccgcagcaa

SEQ ID NO: 1715335 - RNA, 20 nt, Salmonella enterica enterica serovar Typhi
ccuucaauaucaacgaccgu

SEQ ID NO: 1715336 - RNA, 14 nt, Salmonella enterica enterica serovar Typhi
ccuucagcgcgccc

SEQ ID NO: 1715337 - RNA, 16 nt, Salmonella enterica enterica serovar Typhi
ccuucacccccaucgc

SEQ ID NO: 1715338 - RNA, 15 nt, Salmonella enterica enterica serovar Typhi
ccuucacgccgccaa

SEQ ID NO: 1715339 - RNA, 16 nt, Salmonella enterica enterica serovar Typhi
ccuucacggucaaacg

SEQ ID NO: 1715340 - RNA, 22 nt, Salmonella enterica enterica serovar Typhi
ccuucacguuauucggaaugau

SEQ ID NO: 1715341 - RNA, 19 nt, Salmonella enterica enterica serovar Typhi
ccuucagaaaauuauuuuc

SEQ ID NO: 1715342 - RNA, 17 nt, Salmonella enterica enterica serovar Typhi
ccuuacccggccugcgu

SEQ ID NO: 1715343 - RNA, 23 nt, Salmonella enterica enterica serovar Typhi
ccuuacgcacaugaucuucguug

SEQ ID NO: 1715344 - RNA, 13 nt, Salmonella enterica enterica serovar Typhi
ccuuacggcuccu

SEQ ID NO: 1715345 - RNA, 19 nt, Salmonella enterica enterica serovar Typhi
ccuuacuaagccaguucuc

SEQ ID NO: 1715346 - RNA, 13 nt, Salmonella enterica enterica serovar Typhi
ccuuauccggccc

SEQ ID NO: 1715347 - RNA, 18 nt, Salmonella enterica enterica serovar Typhi
ccuuaucgcagucagccu

SEQ ID NO: 1715348 - RNA, 18 nt, Salmonella enterica enterica serovar Typhi
ccuuaucgaccaggcgac

SEQ ID NO: 1715349 - RNA, 15 nt, Salmonella enterica enterica serovar Typhi
ccuggaaccaggcgc

SEQ ID NO: 1715350 - RNA, 17 nt, Salmonella enterica enterica serovar Typhi
ccuggaaaaaagcgccc

SEQ ID NO: 1715351 - RNA, 18 nt, Salmonella enterica enterica serovar Typhi
ccugcuuuuucagcgagg

SEQ ID NO: 1715352 - RNA, 20 nt, Salmonella enterica enterica serovar Typhi
ccugcuuuuucaucauacug

SEQ ID NO: 1715353 - RNA, 20 nt, Salmonella enterica enterica serovar Typhi
ccugcuugucgaucaucaga

SEQ ID NO: 1715354 - RNA, 22 nt, Salmonella enterica enterica serovar Typhi
ccugcuucagacaacgccgccu

SEQ ID NO: 1715355 - RNA, 22 nt, Salmonella enterica enterica serovar Typhi
ccugcuguugcggaauacacga

SEQ ID NO: 1715356 - RNA, 13 nt, Salmonella enterica enterica serovar Typhi
ccugccagccgcu

SEQ ID NO: 1715357 - RNA, 16 nt, Salmonella enterica enterica serovar Typhi
ccugccaggccggacu

SEQ ID NO: 1715358 - RNA, 21 nt, Salmonella enterica enterica serovar Typhi
ccugccagcaacccaccugcc

SEQ ID NO: 1715359 - RNA, 21 nt, Salmonella enterica enterica serovar Typhi
ccugccauucacgcuggguga

SEQ ID NO: 1715360 - RNA, 15 nt, Salmonella enterica enterica serovar Typhi
ccugccauucccagc

SEQ ID NO: 1715361 - RNA, 18 nt, Salmonella enterica enterica serovar Typhi
ccugccaguccgcccgcc

SEQ ID NO: 1715362 - RNA, 13 nt, Salmonella enterica enterica serovar Typhi
ccugcucaucagg

SEQ ID NO: 1715363 - RNA, 13 nt, Salmonella enterica enterica serovar Typhi
ccugcuccgccag

SEQ ID NO: 1715364 - RNA, 16 nt, Salmonella enterica enterica serovar Typhi
ccugcucccagauuaa

SEQ ID NO: 1715365 - RNA, 15 nt, Salmonella enterica enterica serovar Typhi
ccugcucccacagcu

SEQ ID NO: 1715366 - RNA, 24 nt, Salmonella enterica enterica serovar Typhi
ccuggcccggcaguugcuggcgcu

SEQ ID NO: 1715367 - RNA, 15 nt, Salmonella enterica enterica serovar Typhi
ccuggaauuuuucca

SEQ ID NO: 1715368 - RNA, 22 nt, Salmonella enterica enterica serovar Typhi
ccuggaauuuuuccagcucaga

SEQ ID NO: 1715369 - RNA, 23 nt, Salmonella enterica enterica serovar Typhi
ccuggaaguugaagaaaaacccc

SEQ ID NO: 1715370 - RNA, 13 nt, Salmonella enterica enterica serovar Typhi
ccuggccuccggc

SEQ ID NO: 1715371 - RNA, 19 nt, Salmonella enterica enterica serovar Typhi
ccuggcgaauaaaauucag

SEQ ID NO: 1715372 - RNA, 22 nt, Salmonella enterica enterica serovar Typhi
ccuggcgaauaaaauucagcgc

SEQ ID NO: 1715373 - RNA, 16 nt, Salmonella enterica enterica serovar Typhi
ccuggcgagaauagaa

SEQ ID NO: 1715374 - RNA, 18 nt, Salmonella enterica enterica serovar Typhi
ccuggcgcuuuaaaccga

SEQ ID NO: 1715375 - RNA, 13 nt, Salmonella enterica enterica serovar Typhi
ccugguuaacaau

SEQ ID NO: 1715376 - RNA, 16 nt, Salmonella enterica enterica serovar Typhi
ccuggugagcuccagc

SEQ ID NO: 1715377 - RNA, 18 nt, Salmonella enterica enterica serovar Typhi
ccuggugagguuucagca

SEQ ID NO: 1715378 - RNA, 17 nt, Salmonella enterica enterica serovar Typhi
ccuggucgauagccuua

SEQ ID NO: 1715379 - RNA, 20 nt, Salmonella enterica enterica serovar Typhi
ccuggcucaauccaggugga

SEQ ID NO: 1715380 - RNA, 20 nt, Salmonella enterica enterica serovar Typhi
ccacugagcuucaccgccag

SEQ ID NO: 1715381 - RNA, 17 nt, Salmonella enterica enterica serovar Typhi
ccacucuuuuaaggccc

SEQ ID NO: 1715382 - RNA, 14 nt, Salmonella enterica enterica serovar Typhi
ccacucuuccagca

SEQ ID NO: 1715383 - RNA, 14 nt, Salmonella enterica enterica serovar Typhi
ccacucuuucagca

SEQ ID NO: 1715384 - RNA, 21 nt, Salmonella enterica enterica serovar Typhi
ccacuauaguugacgccccau

SEQ ID NO: 1715385 - RNA, 18 nt, Salmonella enterica enterica serovar Typhi
ccacuccgccaguacaua

SEQ ID NO: 1715386 - RNA, 16 nt, Salmonella enterica enterica serovar Typhi
ccacuccaucgccuga

SEQ ID NO: 1715387 - RNA, 15 nt, Salmonella enterica enterica serovar Typhi
ccacucauccagcaa

SEQ ID NO: 1715388 - RNA, 17 nt, Salmonella enterica enterica serovar Typhi
ccacgucauccuccuga

SEQ ID NO: 1715389 - RNA, 16 nt, Salmonella enterica enterica serovar Typhi
ccacuacgcagcucca

SEQ ID NO: 1715390 - RNA, 18 nt, Salmonella enterica enterica serovar Typhi
ccacuacgcagcuccagc

SEQ ID NO: 1715391 - RNA, 18 nt, Salmonella enterica enterica serovar Typhi
ccacgguuaucuggcgca

SEQ ID NO: 1715392 - RNA, 17 nt, Salmonella enterica enterica serovar Typhi
ccacgcucgcuggugcc

SEQ ID NO: 1715393 - RNA, 17 nt, Salmonella enterica enterica serovar Typhi
ccacgguucacggccaa

SEQ ID NO: 1715394 - RNA, 17 nt, Salmonella enterica enterica serovar Typhi
ccacguaacucggcagc

SEQ ID NO: 1715395 - RNA, 17 nt, Salmonella enterica enterica serovar Typhi
ccacgcgcggcaucauu

SEQ ID NO: 1715396 - RNA, 21 nt, Salmonella enterica enterica serovar Typhi
ccacgcguacgguuacaaccc

SEQ ID NO: 1715397 - RNA, 18 nt, Salmonella enterica enterica serovar Typhi
ccacuucugacagaauau

SEQ ID NO: 1715398 - RNA, 19 nt, Salmonella enterica enterica serovar Typhi
ccagaaguagcagagaaaa

SEQ ID NO: 1715399 - RNA, 17 nt, Salmonella enterica enterica serovar Typhi
ccagaaccguugcgccc

SEQ ID NO: 1715400 - RNA, 19 nt, Salmonella enterica enterica serovar Typhi
ccacuggcuuuccugauca

SEQ ID NO: 1715401 - RNA, 21 nt, Salmonella enterica enterica serovar Typhi
ccacuucaacgccgcgcuucu

SEQ ID NO: 1715402 - RNA, 22 nt, Salmonella enterica enterica serovar Typhi
ccacugauggaguuucaucagc

SEQ ID NO: 1715403 - RNA, 17 nt, Salmonella enterica enterica serovar Typhi
ccacugcccgccgccac

SEQ ID NO: 1715404 - RNA, 14 nt, Salmonella enterica enterica serovar Typhi
ccacugcccuggaa

SEQ ID NO: 1715405 - RNA, 21 nt, Salmonella enterica enterica serovar Typhi
ccacuggcagcgccugacggc

SEQ ID NO: 1715406 - RNA, 14 nt, Salmonella enterica enterica serovar Typhi
ccacuggccuccca

SEQ ID NO: 1715407 - RNA, 14 nt, Salmonella enterica enterica serovar Typhi
ccacgcccuucacg

SEQ ID NO: 1715408 - RNA, 22 nt, Salmonella enterica enterica serovar Typhi
ccacgccaaccaucggcacacu

SEQ ID NO: 1715409 - RNA, 21 nt, Salmonella enterica enterica serovar Typhi
ccacgccaauacgggagagcg

SEQ ID NO: 1715410 - RNA, 15 nt, Salmonella enterica enterica serovar Typhi
ccacgcagcgcagac

SEQ ID NO: 1715411 - RNA, 11 nt, Salmonella enterica enterica serovar Typhi
ccacgcagccg

SEQ ID NO: 1715412 - RNA, 18 nt, Salmonella enterica enterica serovar Typhi
ccacgcacgccggccccg

SEQ ID NO: 1715413 - RNA, 14 nt, Salmonella enterica enterica serovar Typhi
ccacgccguccgga

SEQ ID NO: 1715414 - RNA, 14 nt, Salmonella enterica enterica serovar Typhi
ccacgcgacgccag

SEQ ID NO: 1715415 - RNA, 16 nt, Salmonella enterica enterica serovar Typhi
ccacgcgagcugccag

SEQ ID NO: 1715416 - RNA, 20 nt, Salmonella enterica enterica serovar Typhi
ccacgcgaugcaaccccuga

SEQ ID NO: 1715417 - RNA, 15 nt, Salmonella enterica enterica serovar Typhi
ccacgcgcaccaugu

SEQ ID NO: 1715418 - RNA, 12 nt, Salmonella enterica enterica serovar Typhi
ccacgccgccau

SEQ ID NO: 1715419 - RNA, 20 nt, Salmonella enterica enterica serovar Typhi
ccacgccgcaaggacgccag

SEQ ID NO: 1715420 - RNA, 18 nt, Salmonella enterica enterica serovar Typhi
ccacgccgcuaucgacca

SEQ ID NO: 1715421 - RNA, 14 nt, Salmonella enterica enterica serovar Typhi
ccacgccgcaagga

SEQ ID NO: 1715422 - RNA, 20 nt, Salmonella enterica enterica serovar Typhi
ccacgccgagaaacaccaga

SEQ ID NO: 1715423 - RNA, 16 nt, Salmonella enterica enterica serovar Typhi
ccacgccgaguaauuu

SEQ ID NO: 1715424 - RNA, 24 nt, Salmonella enterica enterica serovar Typhi
ccaccgggcaacccggcuaaauga

SEQ ID NO: 1715425 - RNA, 17 nt, Salmonella enterica enterica serovar Typhi
ccacgacggccggaccu

SEQ ID NO: 1715426 - RNA, 17 nt, Salmonella enterica enterica serovar Typhi
ccacgaacgauauaaaa

SEQ ID NO: 1715427 - RNA, 20 nt, Salmonella enterica enterica serovar Typhi
ccacgaacgauauaaaaacc

SEQ ID NO: 1715428 - RNA, 19 nt, Salmonella enterica enterica serovar Typhi
ccaccuguuucgccaggcc

SEQ ID NO: 1715429 - RNA, 18 nt, Salmonella enterica enterica serovar Typhi
ccaccuuaaacuugccgu

SEQ ID NO: 1715430 - RNA, 18 nt, Salmonella enterica enterica serovar Typhi
ccaccuguucgccuucgu

SEQ ID NO: 1715431 - RNA, 20 nt, Salmonella enterica enterica serovar Typhi
cauuuuuuuugcaugguagu

SEQ ID NO: 1715432 - RNA, 16 nt, Salmonella enterica enterica serovar Typhi
cauuuuuuuggcuucu

SEQ ID NO: 1715433 - RNA, 22 nt, Salmonella enterica enterica serovar Typhi
cauuuuuuuguccgucauuuac

SEQ ID NO: 1715434 - RNA, 21 nt, Salmonella enterica enterica serovar Typhi
cauuuuuugacaacaaaaaga

SEQ ID NO: 1715435 - RNA, 14 nt, Salmonella enterica enterica serovar Typhi
cauuuuuucagccu

SEQ ID NO: 1715436 - RNA, 13 nt, Salmonella enterica enterica serovar Typhi
ccacccgcuauga

SEQ ID NO: 1715437 - RNA, 16 nt, Salmonella enterica enterica serovar Typhi
ccaccgccagacgccc

SEQ ID NO: 1715438 - RNA, 18 nt, Salmonella enterica enterica serovar Typhi
ccaccgcauuuucagcuu

SEQ ID NO: 1715439 - RNA, 16 nt, Salmonella enterica enterica serovar Typhi
ccaccgccaaccgccc

SEQ ID NO: 1715440 - RNA, 12 nt, Salmonella enterica enterica serovar Typhi
ccaccgccgcug

SEQ ID NO: 1715441 - RNA, 18 nt, Salmonella enterica enterica serovar Typhi
ccaccgccgccaccaaaa

SEQ ID NO: 1715442 - RNA, 17 nt, Salmonella enterica enterica serovar Typhi
ccaccgccgccaccaaa

SEQ ID NO: 1715443 - RNA, 16 nt, Salmonella enterica enterica serovar Typhi
ccaccgcgcgcuuaau

SEQ ID NO: 1715444 - RNA, 23 nt, Salmonella enterica enterica serovar Typhi
ccaccggagcggcguccgccagc

SEQ ID NO: 1715445 - RNA, 23 nt, Salmonella enterica enterica serovar Typhi
ccaccggaccuaauagccagccc

SEQ ID NO: 1715446 - RNA, 22 nt, Salmonella enterica enterica serovar Typhi
ccagcccuaaaaauagcaccag

SEQ ID NO: 1715447 - RNA, 19 nt, Salmonella enterica enterica serovar Typhi
ccagcccucaacauugccg

SEQ ID NO: 1715448 - RNA, 18 nt, Salmonella enterica enterica serovar Typhi
ccagcccugcgaucauca

SEQ ID NO: 1715449 - RNA, 21 nt, Salmonella enterica enterica serovar Typhi
ccagccgcgccaucuccuccu

SEQ ID NO: 1715450 - RNA, 19 nt, Salmonella enterica enterica serovar Typhi
ccagccgcgccaucuccuc

SEQ ID NO: 1715451 - RNA, 13 nt, Salmonella enterica enterica serovar Typhi
ccagccgccgccg

SEQ ID NO: 1715452 - RNA, 19 nt, Salmonella enterica enterica serovar Typhi
ccagccgcaucuuauauuu

SEQ ID NO: 1715453 - RNA, 12 nt, Salmonella enterica enterica serovar Typhi
ccagccgcccgc

SEQ ID NO: 1715454 - RNA, 18 nt, Salmonella enterica enterica serovar Typhi
ccagccgcuuuccgccgc

SEQ ID NO: 1715455 - RNA, 13 nt, Salmonella enterica enterica serovar Typhi
ccagccgcugccu

SEQ ID NO: 1715456 - RNA, 18 nt, Salmonella enterica enterica serovar Typhi
ccagcccaugaaggagca

SEQ ID NO: 1715457 - RNA, 18 nt, Salmonella enterica enterica serovar Typhi
ccagccauugcugacaaa

SEQ ID NO: 1715458 - RNA, 21 nt, Salmonella enterica enterica serovar Typhi
ccagccauggcccuuuugccc

SEQ ID NO: 1715459 - RNA, 14 nt, Salmonella enterica enterica serovar Typhi
ccagccaugccagc

SEQ ID NO: 1715460 - RNA, 22 nt, Salmonella enterica enterica serovar Typhi
ccagcauaugcacacgcagcug

SEQ ID NO: 1715461 - RNA, 17 nt, Salmonella enterica enterica serovar Typhi
ccagcauaccgcccaac

SEQ ID NO: 1715462 - RNA, 23 nt, Salmonella enterica enterica serovar Typhi
ccagcauagucgcuccccauaaa

SEQ ID NO: 1715463 - RNA, 15 nt, Salmonella enterica enterica serovar Typhi
ccagcauauaaauac

SEQ ID NO: 1715464 - RNA, 16 nt, Salmonella enterica enterica serovar Typhi
ccagcagguaucccaa

SEQ ID NO: 1715465 - RNA, 21 nt, Salmonella enterica enterica serovar Typhi
ccagcaggucgcacuccucug

SEQ ID NO: 1715466 - RNA, 22 nt, Salmonella enterica enterica serovar Typhi
ccagcaggugcggacugggcug

SEQ ID NO: 1715467 - RNA, 19 nt, Salmonella enterica enterica serovar Typhi
ccagccuaccugccgccau

SEQ ID NO: 1715468 - RNA, 22 nt, Salmonella enterica enterica serovar Typhi
ccagccugcuggucugaaucug

SEQ ID NO: 1715469 - RNA, 19 nt, Salmonella enterica enterica serovar Typhi
ccagccugaacaucuucca

SEQ ID NO: 1715470 - RNA, 13 nt, Salmonella enterica enterica serovar Typhi
ccagccucuccca

SEQ ID NO: 1715471 - RNA, 18 nt, Salmonella enterica enterica serovar Typhi
ccagccuuccuggucugc

SEQ ID NO: 1715472 - RNA, 15 nt, Salmonella enterica enterica serovar Typhi
ccagcgaaccgcggc

SEQ ID NO: 1715473 - RNA, 22 nt, Salmonella enterica enterica serovar Typhi
ccagcgaaaaccagcgccgcca

SEQ ID NO: 1715474 - RNA, 15 nt, Salmonella enterica enterica serovar Typhi
ccagcgacgcccagu

SEQ ID NO: 1715475 - RNA, 20 nt, Salmonella enterica enterica serovar Typhi
ccagcgaccaccgucccagu

SEQ ID NO: 1715476 - RNA, 20 nt, Salmonella enterica enterica serovar Typhi
ccagcgacuccggauagaga

SEQ ID NO: 1715477 - RNA, 15 nt, Salmonella enterica enterica serovar Typhi
ccagcgaaccuucca

SEQ ID NO: 1715478 - RNA, 21 nt, Salmonella enterica enterica serovar Typhi
ccagcgaacugauaaaagaga

SEQ ID NO: 1715479 - RNA, 16 nt, Salmonella enterica enterica serovar Typhi
ccagcgacaucccaga

SEQ ID NO: 1715480 - RNA, 22 nt, Salmonella enterica enterica serovar Typhi
ccagcgcaagcagcgccccgcc

SEQ ID NO: 1715481 - RNA, 21 nt, Salmonella enterica enterica serovar Typhi
ccagcgcauguuucgcuucaa

SEQ ID NO: 1715482 - RNA, 22 nt, Salmonella enterica enterica serovar Typhi
ccagcgcauguuucgcuucaau

SEQ ID NO: 1715483 - RNA, 21 nt, Salmonella enterica enterica serovar Typhi
ccagcgauggggcaagcucag

SEQ ID NO: 1715484 - RNA, 16 nt, Salmonella enterica enterica serovar Typhi
ccagcgaugagcgcca

SEQ ID NO: 1715485 - RNA, 22 nt, Salmonella enterica enterica serovar Typhi
ccagcgaugagcgccagcaaca

SEQ ID NO: 1715486 - RNA, 19 nt, Salmonella enterica enterica serovar Typhi
ccagcagcguuuugcgcgu

SEQ ID NO: 1715487 - RNA, 22 nt, Salmonella enterica enterica serovar Typhi
ccagcagcucgccgaccggcgc

SEQ ID NO: 1715488 - RNA, 13 nt, Salmonella enterica enterica serovar Typhi
ccagcagcagcac

SEQ ID NO: 1715489 - RNA, 15 nt, Salmonella enterica enterica serovar Typhi
ccagcagcauaaaac

SEQ ID NO: 1715490 - RNA, 22 nt, Salmonella enterica enterica serovar Typhi
ccagcagauuagcgaagaaguc

SEQ ID NO: 1715491 - RNA, 14 nt, Salmonella enterica enterica serovar Typhi
ccagcaccagcagu

SEQ ID NO: 1715492 - RNA, 12 nt, Salmonella enterica enterica serovar Typhi
ccagcaccagca

SEQ ID NO: 1715493 - RNA, 16 nt, Salmonella enterica enterica serovar Typhi
ccagcaccagcauuag

SEQ ID NO: 1715494 - RNA, 21 nt, Salmonella enterica enterica serovar Typhi
ccagcaccucaucacccaguc

SEQ ID NO: 1715495 - RNA, 23 nt, Salmonella enterica enterica serovar Typhi
ccagcacgcccauauccagcucg

SEQ ID NO: 1715496 - RNA, 22 nt, Salmonella enterica enterica serovar Typhi
ccagcaaaucgcccaucacaug

SEQ ID NO: 1715497 - RNA, 14 nt, Salmonella enterica enterica serovar Typhi
ccagcaacacagcc

SEQ ID NO: 1715498 - RNA, 19 nt, Salmonella enterica enterica serovar Typhi
ccagcaacagguaccccgc

SEQ ID NO: 1715499 - RNA, 21 nt, Salmonella enterica enterica serovar Typhi
ccagcaacagguaccccgcca

SEQ ID NO: 1715500 - RNA, 20 nt, Salmonella enterica enterica serovar Typhi
ccagcaacagugggcuauga

SEQ ID NO: 1715501 - RNA, 12 nt, Salmonella enterica enterica serovar Typhi
ccagcacagccc

SEQ ID NO: 1715502 - RNA, 17 nt, Salmonella enterica enterica serovar Typhi
ccagcacagcccaguaa

SEQ ID NO: 1715503 - RNA, 24 nt, Salmonella enterica enterica serovar Typhi
ccagcacauuacaggcaucuucca

SEQ ID NO: 1715504 - RNA, 19 nt, Salmonella enterica enterica serovar Typhi
ccagcacagguacaggccg

SEQ ID NO: 1715505 - RNA, 21 nt, Salmonella enterica enterica serovar Typhi
ccagcacagguacaggccgcc

SEQ ID NO: 1715506 - RNA, 17 nt, Salmonella enterica enterica serovar Typhi
ccagauagcgucuucag

SEQ ID NO: 1715507 - RNA, 15 nt, Salmonella enterica enterica serovar Typhi
ccagauaucccgcca

SEQ ID NO: 1715508 - RNA, 18 nt, Salmonella enterica enterica serovar Typhi
ccagauaauuaugccugu

SEQ ID NO: 1715509 - RNA, 15 nt, Salmonella enterica enterica serovar Typhi
ccagauacgccgcgc

SEQ ID NO: 1715510 - RNA, 14 nt, Salmonella enterica enterica serovar Typhi
ccagauacauggcu

SEQ ID NO: 1715511 - RNA, 19 nt, Salmonella enterica enterica serovar Typhi
ccagauagaaccacgcaaa

SEQ ID NO: 1715512 - RNA, 19 nt, Salmonella enterica enterica serovar Typhi
ccagaaucccacggagaaa

SEQ ID NO: 1715513 - RNA, 16 nt, Salmonella enterica enterica serovar Typhi
ccagauaaaucagccc

SEQ ID NO: 1715514 - RNA, 15 nt, Salmonella enterica enterica serovar Typhi
ccagaauacaccgcc

SEQ ID NO: 1715515 - RNA, 16 nt, Salmonella enterica enterica serovar Typhi
ccagaauacaccgccu

SEQ ID NO: 1715516 - RNA, 18 nt, Salmonella enterica enterica serovar Typhi
ccagaauacacuucucaa

SEQ ID NO: 1715517 - RNA, 14 nt, Salmonella enterica enterica serovar Typhi
ccagaaucaccucu

SEQ ID NO: 1715518 - RNA, 16 nt, Salmonella enterica enterica serovar Typhi
ccagaaucaccucuuu

SEQ ID NO: 1715519 - RNA, 14 nt, Salmonella enterica enterica serovar Typhi
ccagaaucagugac

SEQ ID NO: 1715520 - RNA, 19 nt, Salmonella enterica enterica serovar Typhi
ccagaauacgccgccgccc

SEQ ID NO: 1715521 - RNA, 13 nt, Salmonella enterica enterica serovar Typhi
ccagcaaaauaau

SEQ ID NO: 1715522 - RNA, 11 nt, Salmonella enterica enterica serovar Typhi
ccagcaaaauc

SEQ ID NO: 1715523 - RNA, 14 nt, Salmonella enterica enterica serovar Typhi
ccagcaaaaucacc

SEQ ID NO: 1715524 - RNA, 11 nt, Salmonella enterica enterica serovar Typhi
ccagcaaaauu

SEQ ID NO: 1715525 - RNA, 19 nt, Salmonella enterica enterica serovar Typhi
ccagauuaucggccagcgc

SEQ ID NO: 1715526 - RNA, 23 nt, Salmonella enterica enterica serovar Typhi
ccagaugcuuaaugcucugcugu

SEQ ID NO: 1715527 - RNA, 22 nt, Salmonella enterica enterica serovar Typhi
ccagaugcgaaacguccccugc

SEQ ID NO: 1715528 - RNA, 17 nt, Salmonella enterica enterica serovar Typhi
ccagauggggcuuccau

SEQ ID NO: 1715529 - RNA, 14 nt, Salmonella enterica enterica serovar Typhi
ccauaucgccgcca

SEQ ID NO: 1715530 - RNA, 14 nt, Salmonella enterica enterica serovar Typhi
ccauauuauucugc

SEQ ID NO: 1715531 - RNA, 17 nt, Salmonella enterica enterica serovar Typhi
ccauauuccagaaagga

SEQ ID NO: 1715532 - RNA, 18 nt, Salmonella enterica enterica serovar Typhi
ccauacagcccauaccac

SEQ ID NO: 1715533 - RNA, 17 nt, Salmonella enterica enterica serovar Typhi
ccauacaguggccagac

SEQ ID NO: 1715534 - RNA, 21 nt, Salmonella enterica enterica serovar Typhi
ccauacacugcauaaauaucu

SEQ ID NO: 1715535 - RNA, 17 nt, Salmonella enterica enterica serovar Typhi
ccaucaauuuugcgccu

SEQ ID NO: 1715536 - RNA, 21 nt, Salmonella enterica enterica serovar Typhi
ccaucaauccaacgaaacuca

SEQ ID NO: 1715537 - RNA, 15 nt, Salmonella enterica enterica serovar Typhi
ccaucaaucaccuua

SEQ ID NO: 1715538 - RNA, 13 nt, Salmonella enterica enterica serovar Typhi
ccaucacuuccug

SEQ ID NO: 1715539 - RNA, 21 nt, Salmonella enterica enterica serovar Typhi
ccaucagaaugcuggucacgg

SEQ ID NO: 1715540 - RNA, 22 nt, Salmonella enterica enterica serovar Typhi
ccaucacguuggggaauaaaua

SEQ ID NO: 1715541 - RNA, 16 nt, Salmonella enterica enterica serovar Typhi
ccaucaggcaauaugu

SEQ ID NO: 1715542 - RNA, 16 nt, Salmonella enterica enterica serovar Typhi
ccaucaggcaaucuuu

SEQ ID NO: 1715543 - RNA, 15 nt, Salmonella enterica enterica serovar Typhi
ccaucaggcauaaac

SEQ ID NO: 1715544 - RNA, 21 nt, Salmonella enterica enterica serovar Typhi
ccaucaggcaucugaaaugcu

SEQ ID NO: 1715545 - RNA, 21 nt, Salmonella enterica enterica serovar Typhi
ccaucagcgcgggauaacgca

SEQ ID NO: 1715546 - RNA, 14 nt, Salmonella enterica enterica serovar Typhi
ccaucaggcaauau

SEQ ID NO: 1715547 - RNA, 15 nt, Salmonella enterica enterica serovar Typhi
ccaucagauucaaca

SEQ ID NO: 1715548 - RNA, 13 nt, Salmonella enterica enterica serovar Typhi
ccaucagcaaaau

SEQ ID NO: 1715549 - RNA, 14 nt, Salmonella enterica enterica serovar Typhi
ccaucagcacauga

SEQ ID NO: 1715550 - RNA, 23 nt, Salmonella enterica enterica serovar Typhi
ccaucagccgcgcuaucaaaaug

SEQ ID NO: 1715551 - RNA, 19 nt, Salmonella enterica enterica serovar Typhi
ccaucagcccgcaaaggac

SEQ ID NO: 1715552 - RNA, 15 nt, Salmonella enterica enterica serovar Typhi
ccaucgguucucugc

SEQ ID NO: 1715553 - RNA, 14 nt, Salmonella enterica enterica serovar Typhi
ccaucguccagcca

SEQ ID NO: 1715554 - RNA, 15 nt, Salmonella enterica enterica serovar Typhi
ccaucguccagccau

SEQ ID NO: 1715555 - RNA, 16 nt, Salmonella enterica enterica serovar Typhi
ccaucuuucacccauu

SEQ ID NO: 1715556 - RNA, 23 nt, Salmonella enterica enterica serovar Typhi
ccaucgacgaaauggugugcaug

SEQ ID NO: 1715557 - RNA, 17 nt, Salmonella enterica enterica serovar Typhi
ccaucggcaaacgccgc

SEQ ID NO: 1715558 - RNA, 16 nt, Salmonella enterica enterica serovar Typhi
ccaucgacgaaauggu

SEQ ID NO: 1715559 - RNA, 20 nt, Salmonella enterica enterica serovar Typhi
ccauccggcaaacucagcgg

SEQ ID NO: 1715560 - RNA, 20 nt, Salmonella enterica enterica serovar Typhi
ccauccggcacacagaauua

SEQ ID NO: 1715561 - RNA, 15 nt, Salmonella enterica enterica serovar Typhi
ccaucccccugccgu

SEQ ID NO: 1715562 - RNA, 16 nt, Salmonella enterica enterica serovar Typhi
ccaucauuuccggcgg

SEQ ID NO: 1715563 - RNA, 23 nt, Salmonella enterica enterica serovar Typhi
ccauccgacgccuuuaccacccg

SEQ ID NO: 1715564 - RNA, 13 nt, Salmonella enterica enterica serovar Typhi
ccaucccggcgua

SEQ ID NO: 1715565 - RNA, 21 nt, Salmonella enterica enterica serovar Typhi
ccaucauguugaaauauuuga

SEQ ID NO: 1715566 - RNA, 15 nt, Salmonella enterica enterica serovar Typhi
ccaucauuaauauaa

SEQ ID NO: 1715567 - RNA, 16 nt, Salmonella enterica enterica serovar Typhi
ccaucauggcuuucag

SEQ ID NO: 1715568 - RNA, 23 nt, Salmonella enterica enterica serovar Typhi
ccaucaucaucggcacagccagu

SEQ ID NO: 1715569 - RNA, 17 nt, Salmonella enterica enterica serovar Typhi
ccaucaggcaauucugg

SEQ ID NO: 1715570 - RNA, 14 nt, Salmonella enterica enterica serovar Typhi
ccaucauagcccau

SEQ ID NO: 1715571 - RNA, 13 nt, Salmonella enterica enterica serovar Typhi
ccaucauaaagcc

SEQ ID NO: 1715572 - RNA, 14 nt, Salmonella enterica enterica serovar Typhi
ccaguuguuuauuc

SEQ ID NO: 1715573 - RNA, 14 nt, Salmonella enterica enterica serovar Typhi
ccaguuuccugacc

SEQ ID NO: 1715574 - RNA, 17 nt, Salmonella enterica enterica serovar Typhi
ccauaaagcgaauaauu

SEQ ID NO: 1715575 - RNA, 17 nt, Salmonella enterica enterica serovar Typhi
ccauaacaacuauuuuu

SEQ ID NO: 1715576 - RNA, 14 nt, Salmonella enterica enterica serovar Typhi
ccauaaaucauuac

SEQ ID NO: 1715577 - RNA, 23 nt, Salmonella enterica enterica serovar Typhi
ccauaaaucauuacuuauauuua

SEQ ID NO: 1715578 - RNA, 15 nt, Salmonella enterica enterica serovar Typhi
ccaguugcugcaucg

SEQ ID NO: 1715579 - RNA, 17 nt, Salmonella enterica enterica serovar Typhi
ccaguugcauacauaaa

SEQ ID NO: 1715580 - RNA, 12 nt, Salmonella enterica enterica serovar Typhi
ccaguugcgcca

SEQ ID NO: 1715581 - RNA, 14 nt, Salmonella enterica enterica serovar Typhi
ccaguucucuucuu

SEQ ID NO: 1715582 - RNA, 17 nt, Salmonella enterica enterica serovar Typhi
ccaguugcuuaccuugu

SEQ ID NO: 1715583 - RNA, 23 nt, Salmonella enterica enterica serovar Typhi
ccaguugccaggguucaaccuga

SEQ ID NO: 1715584 - RNA, 21 nt, Salmonella enterica enterica serovar Typhi
ccaguuguaacgccuggcgca

SEQ ID NO: 1715585 - RNA, 20 nt, Salmonella enterica enterica serovar Typhi
ccaguuggcguaccaucagc

SEQ ID NO: 1715586 - RNA, 17 nt, Salmonella enterica enterica serovar Typhi
ccaguuguuccagcagc

SEQ ID NO: 1715587 - RNA, 22 nt, Salmonella enterica enterica serovar Typhi
ccagugcccgaaagcaauacug

SEQ ID NO: 1715588 - RNA, 21 nt, Salmonella enterica enterica serovar Typhi
ccagugccaccagccggagcc

SEQ ID NO: 1715589 - RNA, 13 nt, Salmonella enterica enterica serovar Typhi
ccagugccaagca

SEQ ID NO: 1715590 - RNA, 23 nt, Salmonella enterica enterica serovar Typhi
ccaguucucaaucgccgcauggg

SEQ ID NO: 1715591 - RNA, 19 nt, Salmonella enterica enterica serovar Typhi
ccaguucgccuucuucauc

SEQ ID NO: 1715592 - RNA, 18 nt, Salmonella enterica enterica serovar Typhi
ccaguaguugaccugauc

SEQ ID NO: 1715593 - RNA, 14 nt, Salmonella enterica enterica serovar Typhi
ccaguagcugcucc

SEQ ID NO: 1715594 - RNA, 14 nt, Salmonella enterica enterica serovar Typhi
ccagucaucgccgc

SEQ ID NO: 1715595 - RNA, 13 nt, Salmonella enterica enterica serovar Typhi
ccagucaguuuau

SEQ ID NO: 1715596 - RNA, 16 nt, Salmonella enterica enterica serovar Typhi
ccagucauuaauuccc

SEQ ID NO: 1715597 - RNA, 19 nt, Salmonella enterica enterica serovar Typhi
ccagucauuaauucccgca

SEQ ID NO: 1715598 - RNA, 21 nt, Salmonella enterica enterica serovar Typhi
ccagucuuauuguccuguuuc

SEQ ID NO: 1715599 - RNA, 15 nt, Salmonella enterica enterica serovar Typhi
ccagugaaauaaaug

SEQ ID NO: 1715600 - RNA, 16 nt, Salmonella enterica enterica serovar Typhi
ccagugaauccaccac

SEQ ID NO: 1715601 - RNA, 17 nt, Salmonella enterica enterica serovar Typhi
ccagugaauccaccacg

SEQ ID NO: 1715602 - RNA, 15 nt, Salmonella enterica enterica serovar Typhi
ccagucgggcgugcc

SEQ ID NO: 1715603 - RNA, 13 nt, Salmonella enterica enterica serovar Typhi
ccagucggacagc

SEQ ID NO: 1715604 - RNA, 16 nt, Salmonella enterica enterica serovar Typhi
ccagucgcuccaccac

SEQ ID NO: 1715605 - RNA, 15 nt, Salmonella enterica enterica serovar Typhi
ccagucgacucaucu

SEQ ID NO: 1715606 - RNA, 16 nt, Salmonella enterica enterica serovar Typhi
ccaguccuuccgccgg

SEQ ID NO: 1715607 - RNA, 21 nt, Salmonella enterica enterica serovar Typhi
ccaguccuccggcugaagccc

SEQ ID NO: 1715608 - RNA, 18 nt, Salmonella enterica enterica serovar Typhi
ccagucgacucaucuuuu

SEQ ID NO: 1715609 - RNA, 17 nt, Salmonella enterica enterica serovar Typhi
ccaguccgguauaaaac

SEQ ID NO: 1715610 - RNA, 13 nt, Salmonella enterica enterica serovar Typhi
ccagucccagcac

SEQ ID NO: 1715611 - RNA, 23 nt, Salmonella enterica enterica serovar Typhi
ccagucccugaagaaaaggaaug

SEQ ID NO: 1715612 - RNA, 22 nt, Salmonella enterica enterica serovar Typhi
ccaggcuauaguggauggccca

SEQ ID NO: 1715613 - RNA, 20 nt, Salmonella enterica enterica serovar Typhi
ccaggcggguagucccagga

SEQ ID NO: 1715614 - RNA, 16 nt, Salmonella enterica enterica serovar Typhi
ccaggcggugaagacg

SEQ ID NO: 1715615 - RNA, 16 nt, Salmonella enterica enterica serovar Typhi
ccaggccgccaccgcc

SEQ ID NO: 1715616 - RNA, 12 nt, Salmonella enterica enterica serovar Typhi
ccaggccgccag

SEQ ID NO: 1715617 - RNA, 15 nt, Salmonella enterica enterica serovar Typhi
ccaggccgccaccgc

SEQ ID NO: 1715618 - RNA, 23 nt, Salmonella enterica enterica serovar Typhi
ccaggccgguuguuuacacggca

SEQ ID NO: 1715619 - RNA, 21 nt, Salmonella enterica enterica serovar Typhi
ccagggugcaaagaaacguuc

SEQ ID NO: 1715620 - RNA, 17 nt, Salmonella enterica enterica serovar Typhi
ccaggucaucaccucca

SEQ ID NO: 1715621 - RNA, 22 nt, Salmonella enterica enterica serovar Typhi
ccaggcaaagauuaccgggccc

SEQ ID NO: 1715622 - RNA, 18 nt, Salmonella enterica enterica serovar Typhi
ccaggcaaagccccaguc

SEQ ID NO: 1715623 - RNA, 14 nt, Salmonella enterica enterica serovar Typhi
ccaggcaaaccagc

SEQ ID NO: 1715624 - RNA, 15 nt, Salmonella enterica enterica serovar Typhi
ccaggcaaaaauagg

SEQ ID NO: 1715625 - RNA, 15 nt, Salmonella enterica enterica serovar Typhi
ccaggaugccaacca

SEQ ID NO: 1715626 - RNA, 17 nt, Salmonella enterica enterica serovar Typhi
ccaggaugccaaccacc

SEQ ID NO: 1715627 - RNA, 15 nt, Salmonella enterica enterica serovar Typhi
ccaggauggccagca

SEQ ID NO: 1715628 - RNA, 18 nt, Salmonella enterica enterica serovar Typhi
ccaggcauguuaugaaua

SEQ ID NO: 1715629 - RNA, 19 nt, Salmonella enterica enterica serovar Typhi
ccaggcauuuuauuaccug

SEQ ID NO: 1715630 - RNA, 12 nt, Salmonella enterica enterica serovar Typhi
ccaggccaaaac

SEQ ID NO: 1715631 - RNA, 21 nt, Salmonella enterica enterica serovar Typhi
ccaggccaaaaccacagugac

SEQ ID NO: 1715632 - RNA, 18 nt, Salmonella enterica enterica serovar Typhi
ccaggccaauuccgccau

SEQ ID NO: 1715633 - RNA, 11 nt, Salmonella enterica enterica serovar Typhi
ccaggccagcg

SEQ ID NO: 1715634 - RNA, 16 nt, Salmonella enterica enterica serovar Typhi
ccaggccagcuccgcg

SEQ ID NO: 1715635 - RNA, 18 nt, Salmonella enterica enterica serovar Typhi
ccaggcccagccgcuccg

SEQ ID NO: 1715636 - RNA, 20 nt, Salmonella enterica enterica serovar Typhi
ccagcugcgcgcuauuccag

SEQ ID NO: 1715637 - RNA, 21 nt, Salmonella enterica enterica serovar Typhi
ccagcgcgccgccaacgccaa

SEQ ID NO: 1715638 - RNA, 20 nt, Salmonella enterica enterica serovar Typhi
ccagcgcgguggcgcacagu

SEQ ID NO: 1715639 - RNA, 18 nt, Salmonella enterica enterica serovar Typhi
ccagcgcguaaauaccuu

SEQ ID NO: 1715640 - RNA, 19 nt, Salmonella enterica enterica serovar Typhi
ccagcgcgggcgaggccuc

SEQ ID NO: 1715641 - RNA, 16 nt, Salmonella enterica enterica serovar Typhi
ccagcgcgugaaccgu

SEQ ID NO: 1715642 - RNA, 14 nt, Salmonella enterica enterica serovar Typhi
ccagcgccugcgcu

SEQ ID NO: 1715643 - RNA, 21 nt, Salmonella enterica enterica serovar Typhi
ccagcgcgaauuugccccaga

SEQ ID NO: 1715644 - RNA, 16 nt, Salmonella enterica enterica serovar Typhi
ccagcgccuucuucac

SEQ ID NO: 1715645 - RNA, 20 nt, Salmonella enterica enterica serovar Typhi
ccagcgcgaccugcaucccu

SEQ ID NO: 1715646 - RNA, 17 nt, Salmonella enterica enterica serovar Typhi
ccagcgcgccauccuga

SEQ ID NO: 1715647 - RNA, 18 nt, Salmonella enterica enterica serovar Typhi
ccagcgcgccgcagcgcc

SEQ ID NO: 1715648 - RNA, 19 nt, Salmonella enterica enterica serovar Typhi
ccagcgcgccgcagcgccg

SEQ ID NO: 1715649 - RNA, 14 nt, Salmonella enterica enterica serovar Typhi
ccagcgcgccgcca

SEQ ID NO: 1715650 - RNA, 13 nt, Salmonella enterica enterica serovar Typhi
ccagcgcgccguc

SEQ ID NO: 1715651 - RNA, 18 nt, Salmonella enterica enterica serovar Typhi
ccagcgccaccaaagcca

SEQ ID NO: 1715652 - RNA, 14 nt, Salmonella enterica enterica serovar Typhi
ccagcgccgagaaa

SEQ ID NO: 1715653 - RNA, 15 nt, Salmonella enterica enterica serovar Typhi
ccagcgcccccagca

SEQ ID NO: 1715654 - RNA, 19 nt, Salmonella enterica enterica serovar Typhi
ccagcgccauaauccagaa

SEQ ID NO: 1715655 - RNA, 12 nt, Salmonella enterica enterica serovar Typhi
ccagcgccgcgc

SEQ ID NO: 1715656 - RNA, 20 nt, Salmonella enterica enterica serovar Typhi
ccagcgccgcggccuccgga

SEQ ID NO: 1715657 - RNA, 19 nt, Salmonella enterica enterica serovar Typhi
ccagcgccgggauauccuc

SEQ ID NO: 1715658 - RNA, 20 nt, Salmonella enterica enterica serovar Typhi
ccagcgccgucauaccgccc

SEQ ID NO: 1715659 - RNA, 13 nt, Salmonella enterica enterica serovar Typhi
ccagcgccgccgc

SEQ ID NO: 1715660 - RNA, 12 nt, Salmonella enterica enterica serovar Typhi
ccagcgccgccg

SEQ ID NO: 1715661 - RNA, 14 nt, Salmonella enterica enterica serovar Typhi
ccagcgccgccaga

SEQ ID NO: 1715662 - RNA, 13 nt, Salmonella enterica enterica serovar Typhi
ccagcgccgccag

SEQ ID NO: 1715663 - RNA, 15 nt, Salmonella enterica enterica serovar Typhi
ccagcuaaccuguuc

SEQ ID NO: 1715664 - RNA, 17 nt, Salmonella enterica enterica serovar Typhi
ccagcuauccaguuucu

SEQ ID NO: 1715665 - RNA, 21 nt, Salmonella enterica enterica serovar Typhi
ccagcucaacgccuuugcaau

SEQ ID NO: 1715666 - RNA, 15 nt, Salmonella enterica enterica serovar Typhi
ccagcucaaccgcgc

SEQ ID NO: 1715667 - RNA, 16 nt, Salmonella enterica enterica serovar Typhi
ccagcucaacgccuuu

SEQ ID NO: 1715668 - RNA, 13 nt, Salmonella enterica enterica serovar Typhi
ccagcuaaaaacg

SEQ ID NO: 1715669 - RNA, 18 nt, Salmonella enterica enterica serovar Typhi
ccagcgucucagcaggcg

SEQ ID NO: 1715670 - RNA, 16 nt, Salmonella enterica enterica serovar Typhi
ccagcgugacccagac

SEQ ID NO: 1715671 - RNA, 19 nt, Salmonella enterica enterica serovar Typhi
ccagcgcugucagugaaaa

SEQ ID NO: 1715672 - RNA, 16 nt, Salmonella enterica enterica serovar Typhi
ccagcgcguuuuccau

SEQ ID NO: 1715673 - RNA, 23 nt, Salmonella enterica enterica serovar Typhi
ccagcggcguuuuuuccugcugg

SEQ ID NO: 1715674 - RNA, 22 nt, Salmonella enterica enterica serovar Typhi
ccagcggcagaucguuuacgac

SEQ ID NO: 1715675 - RNA, 13 nt, Salmonella enterica enterica serovar Typhi
ccagcgggccgcu

SEQ ID NO: 1715676 - RNA, 18 nt, Salmonella enterica enterica serovar Typhi
ccagcgggcgcaguccag

SEQ ID NO: 1715677 - RNA, 15 nt, Salmonella enterica enterica serovar Typhi
ccagcgucagccaga

SEQ ID NO: 1715678 - RNA, 18 nt, Salmonella enterica enterica serovar Typhi
ccccuuucgcaaucaugc

SEQ ID NO: 1715679 - RNA, 20 nt, Salmonella enterica enterica serovar Typhi
ccccuuucgguucgccgcgc

SEQ ID NO: 1715680 - RNA, 14 nt, Salmonella enterica enterica serovar Typhi
ccccuuuuuugcug

SEQ ID NO: 1715681 - RNA, 18 nt, Salmonella enterica enterica serovar Typhi
ccccuuuuuugcuggcaa

SEQ ID NO: 1715682 - RNA, 20 nt, Salmonella enterica enterica serovar Typhi
cccgacacggcucgccuuug

SEQ ID NO: 1715683 - RNA, 19 nt, Salmonella enterica enterica serovar Typhi
cccgacuaccggcaccagc

SEQ ID NO: 1715684 - RNA, 20 nt, Salmonella enterica enterica serovar Typhi
ccccugcccgcgaucgagcg

SEQ ID NO: 1715685 - RNA, 19 nt, Salmonella enterica enterica serovar Typhi
ccccugcgcggccugcgcc

SEQ ID NO: 1715686 - RNA, 20 nt, Salmonella enterica enterica serovar Typhi
ccccucggcagcaauacgcc

SEQ ID NO: 1715687 - RNA, 17 nt, Salmonella enterica enterica serovar Typhi
ccccugacgcgcgcagu

SEQ ID NO: 1715688 - RNA, 16 nt, Salmonella enterica enterica serovar Typhi
cccgaucaucuccugu

SEQ ID NO: 1715689 - RNA, 16 nt, Salmonella enterica enterica serovar Typhi
cccgaguuuuaacacu

SEQ ID NO: 1715690 - RNA, 22 nt, Salmonella enterica enterica serovar Typhi
cccgauauaccacccgcuauga

SEQ ID NO: 1715691 - RNA, 14 nt, Salmonella enterica enterica serovar Typhi
cccgagcgacgccc

SEQ ID NO: 1715692 - RNA, 23 nt, Salmonella enterica enterica serovar Typhi
cccgagcgacgcccugcccauga

SEQ ID NO: 1715693 - RNA, 19 nt, Salmonella enterica enterica serovar Typhi
cccgcacgcgacgcgccag

SEQ ID NO: 1715694 - RNA, 21 nt, Salmonella enterica enterica serovar Typhi
cccgcaauguuuggauuucgu

SEQ ID NO: 1715695 - RNA, 18 nt, Salmonella enterica enterica serovar Typhi
cccgcacaaacgcuuuuu

SEQ ID NO: 1715696 - RNA, 13 nt, Salmonella enterica enterica serovar Typhi
cccgauucugcca

SEQ ID NO: 1715697 - RNA, 14 nt, Salmonella enterica enterica serovar Typhi
cccgauucugccag

SEQ ID NO: 1715698 - RNA, 20 nt, Salmonella enterica enterica serovar Typhi
cccgcaaacuaauggcgcag

SEQ ID NO: 1715699 - RNA, 15 nt, Salmonella enterica enterica serovar Typhi
cccgcaaaccagguc

SEQ ID NO: 1715700 - RNA, 16 nt, Salmonella enterica enterica serovar Typhi
ccccaaugauccacag

SEQ ID NO: 1715701 - RNA, 22 nt, Salmonella enterica enterica serovar Typhi
ccccaacgcgcuaucguugcgc

SEQ ID NO: 1715702 - RNA, 17 nt, Salmonella enterica enterica serovar Typhi
ccccaauugcugcuauu

SEQ ID NO: 1715703 - RNA, 12 nt, Salmonella enterica enterica serovar Typhi
ccccaccaggaa

SEQ ID NO: 1715704 - RNA, 23 nt, Salmonella enterica enterica serovar Typhi
ccccacgauacgccccugcuggc

SEQ ID NO: 1715705 - RNA, 21 nt, Salmonella enterica enterica serovar Typhi
ccccacgcugacgcgaucgcc

SEQ ID NO: 1715706 - RNA, 20 nt, Salmonella enterica enterica serovar Typhi
cccauguugagcgcuugcug

SEQ ID NO: 1715707 - RNA, 13 nt, Salmonella enterica enterica serovar Typhi
cccauuuuauccu

SEQ ID NO: 1715708 - RNA, 19 nt, Salmonella enterica enterica serovar Typhi
cccauuuuauccucuucaa

SEQ ID NO: 1715709 - RNA, 13 nt, Salmonella enterica enterica serovar Typhi
cccauuuuccgcu

SEQ ID NO: 1715710 - RNA, 14 nt, Salmonella enterica enterica serovar Typhi
cccauuaaacuggc

SEQ ID NO: 1715711 - RNA, 18 nt, Salmonella enterica enterica serovar Typhi
cccauggaugcgccgccc

SEQ ID NO: 1715712 - RNA, 21 nt, Salmonella enterica enterica serovar Typhi
cccaugcgggauggccgccga

SEQ ID NO: 1715713 - RNA, 20 nt, Salmonella enterica enterica serovar Typhi
cccaugcgggauggccgccg

SEQ ID NO: 1715714 - RNA, 18 nt, Salmonella enterica enterica serovar Typhi
cccaugauggugaacaga

SEQ ID NO: 1715715 - RNA, 24 nt, Salmonella enterica enterica serovar Typhi
ccccgccauaaugcacaauacgcc

SEQ ID NO: 1715716 - RNA, 18 nt, Salmonella enterica enterica serovar Typhi
ccccgccaucuucacgca

SEQ ID NO: 1715717 - RNA, 16 nt, Salmonella enterica enterica serovar Typhi
ccccgccaccgccgcu

SEQ ID NO: 1715718 - RNA, 20 nt, Salmonella enterica enterica serovar Typhi
ccccgccauaaugcacaaua

SEQ ID NO: 1715719 - RNA, 12 nt, Salmonella enterica enterica serovar Typhi
ccccgccgccau

SEQ ID NO: 1715720 - RNA, 13 nt, Salmonella enterica enterica serovar Typhi
ccccgccgccagu

SEQ ID NO: 1715721 - RNA, 20 nt, Salmonella enterica enterica serovar Typhi
ccccgaugucgccacgccgc

SEQ ID NO: 1715722 - RNA, 16 nt, Salmonella enterica enterica serovar Typhi
ccccgcaauugcgcgg

SEQ ID NO: 1715723 - RNA, 22 nt, Salmonella enterica enterica serovar Typhi
ccccgaugucgccacgccgccc

SEQ ID NO: 1715724 - RNA, 17 nt, Salmonella enterica enterica serovar Typhi
ccccgauaaaccaggca

SEQ ID NO: 1715725 - RNA, 19 nt, Salmonella enterica enterica serovar Typhi
ccccccgcacagcacauag

SEQ ID NO: 1715726 - RNA, 13 nt, Salmonella enterica enterica serovar Typhi
ccccccuaccgga

SEQ ID NO: 1715727 - RNA, 21 nt, Salmonella enterica enterica serovar Typhi
cccccgcacagcacauagaag

SEQ ID NO: 1715728 - RNA, 17 nt, Salmonella enterica enterica serovar Typhi
cccccauggccccaugu

SEQ ID NO: 1715729 - RNA, 11 nt, Salmonella enterica enterica serovar Typhi
cccccagcacg

SEQ ID NO: 1715730 - RNA, 12 nt, Salmonella enterica enterica serovar Typhi
ccccagccagag

SEQ ID NO: 1715731 - RNA, 14 nt, Salmonella enterica enterica serovar Typhi
ccccagcaccgaaa

SEQ ID NO: 1715732 - RNA, 22 nt, Salmonella enterica enterica serovar Typhi
ccccagacgcccuucaauauca

SEQ ID NO: 1715733 - RNA, 21 nt, Salmonella enterica enterica serovar Typhi
cccagcucaugauagggcagc

SEQ ID NO: 1715734 - RNA, 22 nt, Salmonella enterica enterica serovar Typhi
cccaggauaguacugaccagac

SEQ ID NO: 1715735 - RNA, 18 nt, Salmonella enterica enterica serovar Typhi
cccaggccaugcgccgcg

SEQ ID NO: 1715736 - RNA, 22 nt, Salmonella enterica enterica serovar Typhi
cccaggccaaaaccacagugac

SEQ ID NO: 1715737 - RNA, 20 nt, Salmonella enterica enterica serovar Typhi
cccaggcauaaaaaaagcgc

SEQ ID NO: 1715738 - RNA, 19 nt, Salmonella enterica enterica serovar Typhi
cccagcgcggcccauucaa

SEQ ID NO: 1715739 - RNA, 17 nt, Salmonella enterica enterica serovar Typhi
cccagcgcuccaccaac

SEQ ID NO: 1715740 - RNA, 22 nt, Salmonella enterica enterica serovar Typhi
cccagcgcgaauuugccccaga

SEQ ID NO: 1715741 - RNA, 14 nt, Salmonella enterica enterica serovar Typhi
cccagcgcccccag

SEQ ID NO: 1715742 - RNA, 12 nt, Salmonella enterica enterica serovar Typhi
cccagcgccccc

SEQ ID NO: 1715743 - RNA, 17 nt, Salmonella enterica enterica serovar Typhi
cccagcgaucccaguug

SEQ ID NO: 1715744 - RNA, 13 nt, Salmonella enterica enterica serovar Typhi
cccacuaacugcc

SEQ ID NO: 1715745 - RNA, 12 nt, Salmonella enterica enterica serovar Typhi
cccacuauuuuu

SEQ ID NO: 1715746 - RNA, 20 nt, Salmonella enterica enterica serovar Typhi
cccacucaaucauugucauu

SEQ ID NO: 1715747 - RNA, 13 nt, Salmonella enterica enterica serovar Typhi
cccagcaccaacg

SEQ ID NO: 1715748 - RNA, 19 nt, Salmonella enterica enterica serovar Typhi
cccacucauccagcaaaau

SEQ ID NO: 1715749 - RNA, 22 nt, Salmonella enterica enterica serovar Typhi
cccagcacuaacagcagcagca

SEQ ID NO: 1715750 - RNA, 19 nt, Salmonella enterica enterica serovar Typhi
cccagcaccgaaacagcac

SEQ ID NO: 1715751 - RNA, 21 nt, Salmonella enterica enterica serovar Typhi
cccagccuuccuggucugcca

SEQ ID NO: 1715752 - RNA, 22 nt, Salmonella enterica enterica serovar Typhi
cccagccuuccuggucugccag

SEQ ID NO: 1715753 - RNA, 14 nt, Salmonella enterica enterica serovar Typhi
cccagcccugugcc

SEQ ID NO: 1715754 - RNA, 14 nt, Salmonella enterica enterica serovar Typhi
cccagcagcagaua

SEQ ID NO: 1715755 - RNA, 13 nt, Salmonella enterica enterica serovar Typhi
cccagcagcagaa

SEQ ID NO: 1715756 - RNA, 14 nt, Salmonella enterica enterica serovar Typhi
cccagcauauuaac

SEQ ID NO: 1715757 - RNA, 21 nt, Salmonella enterica enterica serovar Typhi
cccagcauauuuuccggcguc

SEQ ID NO: 1715758 - RNA, 17 nt, Salmonella enterica enterica serovar Typhi
cccacacggccaccaua

SEQ ID NO: 1715759 - RNA, 12 nt, Salmonella enterica enterica serovar Typhi
cccacaccauac

SEQ ID NO: 1715760 - RNA, 21 nt, Salmonella enterica enterica serovar Typhi
cccaaccaguggcggggcaga

SEQ ID NO: 1715761 - RNA, 14 nt, Salmonella enterica enterica serovar Typhi
cccaacccgaccag

SEQ ID NO: 1715762 - RNA, 23 nt, Salmonella enterica enterica serovar Typhi
cccaaccgccagccauugaugca

SEQ ID NO: 1715763 - RNA, 12 nt, Salmonella enterica enterica serovar Typhi
cccaaccagugg

SEQ ID NO: 1715764 - RNA, 15 nt, Salmonella enterica enterica serovar Typhi
cccaacaugguugcu

SEQ ID NO: 1715765 - RNA, 19 nt, Salmonella enterica enterica serovar Typhi
cccaacagcgaccacgcca

SEQ ID NO: 1715766 - RNA, 20 nt, Salmonella enterica enterica serovar Typhi
cccaaaugaaaaaucggcaa

SEQ ID NO: 1715767 - RNA, 20 nt, Salmonella enterica enterica serovar Typhi
cccaaauaguccagcaucca

SEQ ID NO: 1715768 - RNA, 18 nt, Salmonella enterica enterica serovar Typhi
cccaaauaaaagccgccg

SEQ ID NO: 1715769 - RNA, 19 nt, Salmonella enterica enterica serovar Typhi
cccaaacgucguaaaaccu

SEQ ID NO: 1715770 - RNA, 21 nt, Salmonella enterica enterica serovar Typhi
cccaaacugcucguaaagcau

SEQ ID NO: 1715771 - RNA, 20 nt, Salmonella enterica enterica serovar Typhi
cccaccgcuggauauguuuu

SEQ ID NO: 1715772 - RNA, 15 nt, Salmonella enterica enterica serovar Typhi
cccaccggcccacgc

SEQ ID NO: 1715773 - RNA, 16 nt, Salmonella enterica enterica serovar Typhi
cccaccugacuguuca

SEQ ID NO: 1715774 - RNA, 15 nt, Salmonella enterica enterica serovar Typhi
cccacgcccgccauc

SEQ ID NO: 1715775 - RNA, 19 nt, Salmonella enterica enterica serovar Typhi
cccacggaugaucuucaua

SEQ ID NO: 1715776 - RNA, 15 nt, Salmonella enterica enterica serovar Typhi
cccacgcgccacguc

SEQ ID NO: 1715777 - RNA, 21 nt, Salmonella enterica enterica serovar Typhi
cccacgcggaaucgucacaga

SEQ ID NO: 1715778 - RNA, 13 nt, Salmonella enterica enterica serovar Typhi
cccaccaccgcca

SEQ ID NO: 1715779 - RNA, 12 nt, Salmonella enterica enterica serovar Typhi
cccaaaagguag

SEQ ID NO: 1715780 - RNA, 21 nt, Salmonella enterica enterica serovar Typhi
ccauuuuuuuagcuuaaaaaa

SEQ ID NO: 1715781 - RNA, 23 nt, Salmonella enterica enterica serovar Typhi
ccauuuuggacuugggcagugcu

SEQ ID NO: 1715782 - RNA, 18 nt, Salmonella enterica enterica serovar Typhi
ccauuuugguuacuauuu

SEQ ID NO: 1715783 - RNA, 16 nt, Salmonella enterica enterica serovar Typhi
ccauuuggcuuaaaua

SEQ ID NO: 1715784 - RNA, 15 nt, Salmonella enterica enterica serovar Typhi
ccauuucaugaccga

SEQ ID NO: 1715785 - RNA, 18 nt, Salmonella enterica enterica serovar Typhi
ccauuuccggcgcgccua

SEQ ID NO: 1715786 - RNA, 22 nt, Salmonella enterica enterica serovar Typhi
ccauuuauguuugcccagcuca

SEQ ID NO: 1715787 - RNA, 11 nt, Salmonella enterica enterica serovar Typhi
ccauugccgcg

SEQ ID NO: 1715788 - RNA, 20 nt, Salmonella enterica enterica serovar Typhi
ccauugccgcgacaaaaagc

SEQ ID NO: 1715789 - RNA, 22 nt, Salmonella enterica enterica serovar Typhi
ccaucuuugcaccgcuaaaaaa

SEQ ID NO: 1715790 - RNA, 17 nt, Salmonella enterica enterica serovar Typhi
ccaucuuucuuuucgcg

SEQ ID NO: 1715791 - RNA, 12 nt, Salmonella enterica enterica serovar Typhi
ccaugaaaaaaa

SEQ ID NO: 1715792 - RNA, 13 nt, Salmonella enterica enterica serovar Typhi
ccaugaaaaaaac

SEQ ID NO: 1715793 - RNA, 21 nt, Salmonella enterica enterica serovar Typhi
ccauugaugccugcccaucua

SEQ ID NO: 1715794 - RNA, 22 nt, Salmonella enterica enterica serovar Typhi
cccggcggaagcgaauggcggc

SEQ ID NO: 1715795 - RNA, 17 nt, Salmonella enterica enterica serovar Typhi
cccggcucauuaccgac

SEQ ID NO: 1715796 - RNA, 11 nt, Salmonella enterica enterica serovar Typhi
cccggcuaaac

SEQ ID NO: 1715797 - RNA, 21 nt, Salmonella enterica enterica serovar Typhi
cccggccguuaccguggcggc

SEQ ID NO: 1715798 - RNA, 12 nt, Salmonella enterica enterica serovar Typhi
cccggcccgccg

SEQ ID NO: 1715799 - RNA, 14 nt, Salmonella enterica enterica serovar Typhi
cccggcccgccgcu

SEQ ID NO: 1715800 - RNA, 21 nt, Salmonella enterica enterica serovar Typhi
cccggcgccaaucaccgccag

SEQ ID NO: 1715801 - RNA, 22 nt, Salmonella enterica enterica serovar Typhi
cccggcgcacuuccucucccac

SEQ ID NO: 1715802 - RNA, 15 nt, Salmonella enterica enterica serovar Typhi
cccggcgagugccug

SEQ ID NO: 1715803 - RNA, 16 nt, Salmonella enterica enterica serovar Typhi
cccggucauccagcgg

SEQ ID NO: 1715804 - RNA, 18 nt, Salmonella enterica enterica serovar Typhi
cccggucaacgcgccgcc

SEQ ID NO: 1715805 - RNA, 16 nt, Salmonella enterica enterica serovar Typhi
cccggucaacgcgccg

SEQ ID NO: 1715806 - RNA, 17 nt, Salmonella enterica enterica serovar Typhi
cccgguggcgcugcgcu

SEQ ID NO: 1715807 - RNA, 18 nt, Salmonella enterica enterica serovar Typhi
cccgguggcgccacgcca

SEQ ID NO: 1715808 - RNA, 21 nt, Salmonella enterica enterica serovar Typhi
cccgguggcgccacgccaccg

SEQ ID NO: 1715809 - RNA, 17 nt, Salmonella enterica enterica serovar Typhi
cccggugagcgccgcgc

SEQ ID NO: 1715810 - RNA, 24 nt, Salmonella enterica enterica serovar Typhi
cccggcuuuuuuauugccuaagau

SEQ ID NO: 1715811 - RNA, 15 nt, Salmonella enterica enterica serovar Typhi
cccggcuuccagcgg

SEQ ID NO: 1715812 - RNA, 19 nt, Salmonella enterica enterica serovar Typhi
cccgguaagcgcagcgcca

SEQ ID NO: 1715813 - RNA, 17 nt, Salmonella enterica enterica serovar Typhi
cccuccggccagcgcca

SEQ ID NO: 1715814 - RNA, 22 nt, Salmonella enterica enterica serovar Typhi
cccuccgcggauuguuuuacuu

SEQ ID NO: 1715815 - RNA, 19 nt, Salmonella enterica enterica serovar Typhi
cccuccugcuccaugcugu

SEQ ID NO: 1715816 - RNA, 12 nt, Salmonella enterica enterica serovar Typhi
cccuccagccau

SEQ ID NO: 1715817 - RNA, 15 nt, Salmonella enterica enterica serovar Typhi
cccuccaguagcagc

SEQ ID NO: 1715818 - RNA, 20 nt, Salmonella enterica enterica serovar Typhi
cccucaacgcccugcuccca

SEQ ID NO: 1715819 - RNA, 22 nt, Salmonella enterica enterica serovar Typhi
cccucaaacaggcugucugcca

SEQ ID NO: 1715820 - RNA, 14 nt, Salmonella enterica enterica serovar Typhi
cccucaacgcgccc

SEQ ID NO: 1715821 - RNA, 14 nt, Salmonella enterica enterica serovar Typhi
cccuauuguuccag

SEQ ID NO: 1715822 - RNA, 17 nt, Salmonella enterica enterica serovar Typhi
cccuacgcuucucucca

SEQ ID NO: 1715823 - RNA, 19 nt, Salmonella enterica enterica serovar Typhi
cccuacgcuucucuccaua

SEQ ID NO: 1715824 - RNA, 20 nt, Salmonella enterica enterica serovar Typhi
cccuaaaaauagcaccaggc

SEQ ID NO: 1715825 - RNA, 15 nt, Salmonella enterica enterica serovar Typhi
cccguucucgccgcg

SEQ ID NO: 1715826 - RNA, 22 nt, Salmonella enterica enterica serovar Typhi
cccguucacguuuuuacucuug

SEQ ID NO: 1715827 - RNA, 21 nt, Salmonella enterica enterica serovar Typhi
cccguugucuucaccuugcug

SEQ ID NO: 1715828 - RNA, 21 nt, Salmonella enterica enterica serovar Typhi
cccguuucagccccuugcuga

SEQ ID NO: 1715829 - RNA, 19 nt, Salmonella enterica enterica serovar Typhi
cccguuugcgagacggcga

SEQ ID NO: 1715830 - RNA, 16 nt, Salmonella enterica enterica serovar Typhi
cccguuucagccccuu

SEQ ID NO: 1715831 - RNA, 18 nt, Salmonella enterica enterica serovar Typhi
cccgucgcgcccacgcgc

SEQ ID NO: 1715832 - RNA, 21 nt, Salmonella enterica enterica serovar Typhi
cccgucgccuguuucugcgcc

SEQ ID NO: 1715833 - RNA, 22 nt, Salmonella enterica enterica serovar Typhi
cccgucugggagccgcugcuca

SEQ ID NO: 1715834 - RNA, 18 nt, Salmonella enterica enterica serovar Typhi
cccguggcgggaugcccc

SEQ ID NO: 1715835 - RNA, 15 nt, Salmonella enterica enterica serovar Typhi
cccgugguuuuacug

SEQ ID NO: 1715836 - RNA, 22 nt, Salmonella enterica enterica serovar Typhi
cccguggugggguucccgagcg

SEQ ID NO: 1715837 - RNA, 23 nt, Salmonella enterica enterica serovar Typhi
cccgguuugggcgcgaaacugcu

SEQ ID NO: 1715838 - RNA, 13 nt, Salmonella enterica enterica serovar Typhi
cccgguuuaccau

SEQ ID NO: 1715839 - RNA, 23 nt, Salmonella enterica enterica serovar Typhi
cccgguuuaugcgguucucccgg

SEQ ID NO: 1715840 - RNA, 15 nt, Salmonella enterica enterica serovar Typhi
cccguagugauagca

SEQ ID NO: 1715841 - RNA, 16 nt, Salmonella enterica enterica serovar Typhi
cccguauucaggcgau

SEQ ID NO: 1715842 - RNA, 15 nt, Salmonella enterica enterica serovar Typhi
cccgucccaccacgc

SEQ ID NO: 1715843 - RNA, 23 nt, Salmonella enterica enterica serovar Typhi
cccgcuccagaagcacuucucca

SEQ ID NO: 1715844 - RNA, 12 nt, Salmonella enterica enterica serovar Typhi
cccgcugagugg

SEQ ID NO: 1715845 - RNA, 23 nt, Salmonella enterica enterica serovar Typhi
cccgcucuucaguaaccagggag

SEQ ID NO: 1715846 - RNA, 12 nt, Salmonella enterica enterica serovar Typhi
cccgcuggcgcg

SEQ ID NO: 1715847 - RNA, 20 nt, Salmonella enterica enterica serovar Typhi
cccgcuggcuggcguugagc

SEQ ID NO: 1715848 - RNA, 20 nt, Salmonella enterica enterica serovar Typhi
cccgcugucgggagccucuu

SEQ ID NO: 1715849 - RNA, 14 nt, Salmonella enterica enterica serovar Typhi
cccgcgccagcagg

SEQ ID NO: 1715850 - RNA, 15 nt, Salmonella enterica enterica serovar Typhi
cccgcggcauggucu

SEQ ID NO: 1715851 - RNA, 16 nt, Salmonella enterica enterica serovar Typhi
cccgcgcuuuccagcc

SEQ ID NO: 1715852 - RNA, 20 nt, Salmonella enterica enterica serovar Typhi
cccgcggucauugagccgcu

SEQ ID NO: 1715853 - RNA, 14 nt, Salmonella enterica enterica serovar Typhi
cccgcguuggcggc

SEQ ID NO: 1715854 - RNA, 21 nt, Salmonella enterica enterica serovar Typhi
cccggaaauaaacgccagugg

SEQ ID NO: 1715855 - RNA, 22 nt, Salmonella enterica enterica serovar Typhi
cccggaaauggguaucuucauc

SEQ ID NO: 1715856 - RNA, 19 nt, Salmonella enterica enterica serovar Typhi
cccggaacaaaagaaagca

SEQ ID NO: 1715857 - RNA, 20 nt, Salmonella enterica enterica serovar Typhi
cccggaacaaaagaaagcaa

SEQ ID NO: 1715858 - RNA, 17 nt, Salmonella enterica enterica serovar Typhi
cccggacaucauccccg

SEQ ID NO: 1715859 - RNA, 22 nt, Salmonella enterica enterica serovar Typhi
cccggacaucauccccggcagg

SEQ ID NO: 1715860 - RNA, 21 nt, Salmonella enterica enterica serovar Typhi
cccggagagaaacaacaccgu
